United States Patent 10,982,187 (BOS TAURUS VARIETY 'HO840003150607238' AND METHODS OF USE THEREOF) - sequence listing, part 2

SEQ ID NO: 11934 - DNA, 201 bp, Bos taurus
tgggattatatgtactgcaacttatatttttaactcccagtttatcaaaattattactcaagatagccacatatgaattaaacttacaattttacatactgtggacataccaaaagcctggtattttcatataagaacttgtgacattggctactggaagcctaaggcctttattttttggttaccctcacccacttgttt

SEQ ID NO: 11935 - DNA, 201 bp, Bos taurus
aaagcagagtaattcaaaccccgcatctactgcttgccggcgccgccatgttgcctcctctcgggaagcgagcggggccacgtgaccaccaatcctcagctgcaattggtggcagctcaggttgccagggagacggggaagcttcttggagagaactgagatccacagaaaggagccaatgaactaaaatttctaggacat

SEQ ID NO: 11936 - DNA, 201 bp, Bos taurus
tttatcacagcttcttctctagtatcttcacaccacagatatagctttcttattatgttaattgtgttatattttggccataatgatagctcttctgattgtacttggttttctagcactaaagttgttgatctttccaacctctgtaagctttaccttgggtctccatataagtctccttaataatgttacacatgttaa

SEQ ID NO: 11937 - DNA, 201 bp, Bos taurus
ctctgaagatttggaatttaaacaatatcctttcaatgtaatttaaataaattcttagggggtaccagagattaaggaatggttgagatatggtctcttttgttttacttttaactgtgaaatgtaacaaatgtagagaaaagtatacaaaaaatatggttcaccgattttcacaaactaaccagtcaggttatgaagtaa

SEQ ID NO: 11938 - DNA, 201 bp, Bos taurus
ccctctccttaggcattttttgagctttatattattattattagactgtattcctcattgtgaactgcttagtggtttattagggacaagtgtggccactacctctggaagatgccagagtggtgtatgtaaaccatgatgaggttttagcagacaggggatggtatgttagctttggccttgagttcttgagggatcatg

SEQ ID NO: 11939 - DNA, 201 bp, Bos taurus
tcccaaatcctgtttcgtgtgctctcttctgtacagcagggtgtaattttgcttgtgttatatgtaagcaccttttcccagcacgctctcatctacacatgcctttccttgtgccaaacactattatgctctatcaatttactcttctcaagtctttagttatgtgattttgctaggtatgcctaatttttctgttcatct

SEQ ID NO: 11940 - DNA, 201 bp, Bos taurus
agagcctgggattcaatgtattattaatcattatttctggaatcataatggctattttgagcaagggaggaaaatggtatctgaaaatagaccccactgaagaaaacaaagacccatattccagcctcattctttttcttcttatatcagaattggtactctgtaagtgcctgtttggatcactttatctatggagtgcat

SEQ ID NO: 11941 - DNA, 201 bp, Bos taurus
gacatgtgaatgctgcaaatacagagagagaggaagcaggggctaaagtcagttcgaattccagaacgtaacttgtcccgggagtcattacagggaagggcaggtcattgaagaatcatggaagaggaacattgaagaaaaagatgagcgttattgttaaatgtagcagtgtttgaagattgagaagagaccattatgagt

SEQ ID NO: 11942 - DNA, 201 bp, Bos taurus
aatgtttctttttctcattcttcattcttttgagttccttctttgtcattttttttttcttcctacccgttatatggaatttaatctcatccttttgttttctggtgtgtctgaagcttaggcaaaaacaggttgttgttaatttcagcaacgcatctcaggggagtttgcctttgaaatgttccctttgctaggtggtcc

SEQ ID NO: 11943 - DNA, 201 bp, Bos taurus
tgtgtcaggagcaaaaggttactaggcatgttccctgcactcagaaccacaatggggtggcaaaccaagtaagcccatctcaggcccaaccactagacacatctctgctctcaaccccatccaacggacttgctcatctgctcattagggagtgagctaacaagggaacctgctacttgttctcgtagaggccttgctgca

SEQ ID NO: 11944 - DNA, 201 bp, Bos taurus
cacaacaaagatttgaggtgccggacattaaagccctcagggtgtcacagctcttgggtcatggacagactgcattatagttctcaggtctcaaacagaccgtgttgtagctcttagacagatcggtgttacagctccatgttacagctctattttatttagaaaatagcaggaaaatccatcctcgaggcgtgagggcat

SEQ ID NO: 11945 - DNA, 201 bp, Bos taurus
taaagctataagggcaataagactcttggataattttcccctagacctacagtctggtctttttaactgtatttagattttttaacttctttcagtgcaattgagtgacaccaaaacttttaattataaatagaagatttaaaaaaaaaatttgggaaaagccttatggctccttcattctttctttgctgctcgtaataa

SEQ ID NO: 11946 - DNA, 201 bp, Bos taurus
atttgtctgagaagctataatacagaaaaatagaagttggtctttatgatttagatcagcaaattctttcaagctattaaaattcttccataacctgattgaattggcattgtgcaattaaattatttattcattgaattgaagcttcagtatttacagtacgcattacactctctgagatgttctttagttttgcattat

SEQ ID NO: 11947 - DNA, 201 bp, Bos taurus
ggtacatttgttatgactgatgaaactacattggtaccataaacaaatggtttaggttttgaaacagtaagttctgatgatctactgtgtacctcatatataagtggactctttaaaatttgtgaaaaatacatgtagcaatctttgtacagagagtcctcttctgttgaattatttctgttatttaatttgggaaggttg

SEQ ID NO: 11948 - DNA, 201 bp, Bos taurus
cacatacgggggagggccatctactctactcctttgaccaattcaaatgctaatctcatccagaaatatccttagagtcccccagaaataatatttgatcgggtcacctcctggccagtcaagctgacacatcaaactaaccatcatgctgaagattcaaaagtctttggactctaaagtttacaactgtttatttagcct

SEQ ID NO: 11949 - DNA, 201 bp, Bos taurus
agataagagaagtgtaagtgtggtccttgacttctgtattcctggaagtccactcttcactgtgattatagaagtctaagaagattccatccatctgtcttctggctacagggtagatgttgcatttgccactgctaaagagtgaagacagtgggaaacaataataagtgtacaacatctagaatagaaggttaagtaaaa

SEQ ID NO: 11950 - DNA, 201 bp, Bos taurus
ttaaaaaacaaaacaaaactaagaggtatggaggagatcctggcatagagaaaatgaataccaagaatagtaaaatgtgccttcaaataaaggaaaacaagcaattccaggttaactgtaatggactgaagttctgatgacttgcaacaagagtcttaagattatcatttcttagaagagagggaaaggggttctctagtc

SEQ ID NO: 11951 - DNA, 201 bp, Bos taurus
ggatcctttctttttgctaagatgatttagaaccattgtatattcatctccctcaatttaacaaaatgcctattataaaacaaacatccactaatcatttgtttaaaaaattacaagatccatgtattgcaatccccatgaatttcaaaataatagttgtctactgcttattctgaattctcctcaaatttgtatttctta

SEQ ID NO: 11952 - DNA, 201 bp, Bos taurus
catggcccttgtgtctatactctgggagattattttcttaaccattattctcagggacacatctgaagtgagttttatgtagtatacattcctttgtgtccatacagttttcatggccacttttgttagtttatctttggagacctgaagttttgttttataacaaattgtgaaaggcattttaatccaagcctgtaactc

SEQ ID NO: 11953 - DNA, 201 bp, Bos taurus
tatggcacaataaatttttgctaatttgttttagaatgcatagcatgtcctttgtatcaacattatttatttagcaccgtttccattcctttactggacagcaaaatcggaagcatgaattttgaagatgcagaactatatccactgtgacaacagtgagaaaagggatcagtctgcacctaagtgtgccttatttctatc

SEQ ID NO: 11954 - DNA, 201 bp, Bos taurus
tgtcagtagattattgtggtaaatgttattgaatttccaaagaaagaaaggtgtcatcaagtggaaagaaacatccaaattaatagcttttatttaaggcgtaattctgtggaggtctccttattgctggtacctttctgactaggattaaaaaaatagatggggaacagttggcatcaaattaaaaaaaaaaaattagca

SEQ ID NO: 11955 - DNA, 201 bp, Bos taurus
attagtgtcataataataaaaaagaaactacataggttgaaacaacagagacattgtttttcctggaaaggaggcctcttaagcaatagctattaatttgcgtaacagacttccacatggccgttcttggtgccttcccttggaactcaaagaaaaatgtcttcatgaacaaaagatcaaatatatttcagaatattcaaa

SEQ ID NO: 11956 - DNA, 201 bp, Bos taurus
ctctcttcttctctctgtagctggggctaaaacctgcgccagtgaccactgggatttgtaacacccttttgccaggaacagaggccagacagtcattaaattggatataaacaaggcaggaattaagaatggggaatgggcaggctagacctcctatgaaagcatctggagaaaacccagacttcccagatgtaatctcag

SEQ ID NO: 11957 - DNA, 201 bp, Bos taurus
gcagcacagtgatgaataaattcaaacaaagctgaaagtaagaccctaggacttaatacagtgtaagaaaggcctgggcaaagagagacagagagattgagggaagcaagtcagagaaattcatggtagcctaggtaattgacagtagttttggggagaagagcaggtgattgtatgcctaactttcatgaggtagggata

SEQ ID NO: 11958 - DNA, 201 bp, Bos taurus
ccttatctctccttctacttgcctggcttacatctctctcatagcatgtgttgaaaagcaaagaaaacacttgctcacttaaacctctggaatgtgattcgaagcctatcttcttagccattaatacataactgcctcaggatttccgtttcttctcatctatgacttcacagagatagagtgtgggttttttgctttcat

SEQ ID NO: 11959 - DNA, 201 bp, Bos taurus
aactggggaaaaaatgccttaaaatatctggcccttgtcatatctaagatctaccttccagaatatcagtttttacaagagtgttcaaaggaaagaatttcaaccaaggccttcaaacattaaacactaacttgttctaaagtccataaagagattccagaacacctgtggtggacgctctaagaaagggagtgaatgcct

SEQ ID NO: 11960 - DNA, 201 bp, Bos taurus
agtttatttctaagacaaaatggtaacacatctctatgtatgctatgtaaagtacccatccattctagagattcctaaacttatcataagctagagtcacgtggacatttacgaatgctttaattaggaaaacttgcatatggcatcatattttcagcaatgttaatacttaacatatttttcttattttctaaaagcttg

SEQ ID NO: 11961 - DNA, 201 bp, Bos taurus
gcagggaatcctagagggaaaagaaaaccaagtcttaatgttcataaatcacaaaaataatagcaagcttaacaatgggttgtagacagaactactaaagcgaatgtagaaaacaccccaaggtaatatttgtgaatacatagacaggtgattgagtaatttttagttttgttataagaaaaatatttttatttacgaact

SEQ ID NO: 11962 - DNA, 201 bp, Bos taurus
gctatttaccaaggtgttgaaatgctaaattacgagagtgaagaggaaaaaaatatactagagagcggatatttttctatacatttctttatttctgtcatgtaattcctgagagttcaacattaacagtgccacactctactactagccaaacatttatcacattagtaatttattgaggccaacaccaattttcagaga

SEQ ID NO: 11963 - DNA, 201 bp, Bos taurus
gttaggactacaaagataagaccaccctgagtggctcgtgtgaacactgtcacagctgcttcttttcgctttgaaatcattcaaagtgatgcatgaggaatgagtctgcttttatcagcctcccactcggggtctgcttagcccactgaggaaaatacttgtgatacactgctgacagaaaacaaaacatgatccaaacag

SEQ ID NO: 11964 - DNA, 201 bp, Bos taurus
agatacaaccaataataatatgaaattctagctcccaactactgctttcaatattcttggagaaacacatttgcttttcattttaggagtggttggaactggggaactgaaacttggtttacaatttcagcactttagttcacaggagataccctgacaaacaattttttctcataaaaaaagtcatcatggtgaattctc

SEQ ID NO: 11965 - DNA, 201 bp, Bos taurus
agacacaaattaggacagtagaggaatataaagccactggcctcaacagctactgcaggcattaattaataagcaactcctattcagattagcgtaaaccatcatgctaatggcctatttactttaaaacctattctccaatacagcatcactggcatttaacaaaaaactacaaggtataccaaaagtcaataaaaagat

SEQ ID NO: 11966 - DNA, 201 bp, Bos taurus
aggtaaatagtatggttaaaggtattgactgccaacagttattgaccgtaagaatattatatccaatacatcatttaatactcattacagtcttatgaattagctcccagtggtattctcaatgtaggttgaggaatctagggtaccgaaaatgtaaataaatgcccaagattgtatgccattaacattatattaatgtta

SEQ ID NO: 11967 - DNA, 201 bp, Bos taurus
agattatttttctattatctgaattaaggaagaatttaatagcatgcctatctatttcaatttcatgaacctcatgattgattagccatggccaaatatcgcagcttgccaaacttactgattttacctcaccctgcttttcatgacagctatcatgcttattgtgtcatttgtaattaacctatggcactcggcctctgc

SEQ ID NO: 11968 - DNA, 201 bp, Bos taurus
gttttgcatttcataggcagttggcccagtgtgaaggctatgaagctgttccagaatcatctaaatgaagtatttggtaacagatggcaataaacacaccgtaatgggccttattttgttttattttattagaccaaggttatggccacagctatgaacttaatctgtctttttttatagccatgagagtggttaacattg

SEQ ID NO: 11969 - DNA, 201 bp, Bos taurus
tcccatggacagaggagcctggccgtctggtccatggggtcatgaagagttggacacaattgagcgcgtgcacacatacgcacacacatctttattgaagttgtaaactttctccatagagatcatgtgctcatctgtttcaaatggcctgatatttcctactgttcaatgaaggcagatttttaatattagaagagaaaa

SEQ ID NO: 11970 - DNA, 201 bp, Bos taurus
tcacatggcctgagttcagaaggagtgaaatccgataacggacaagaaatgaacttcctttggtccctcagcaaactgatcagccctcacaggataggagatgtttcagtggccaaggagtctatcatcagggactcagagataaatgaatacccaacaagaacataaatgggagcctttaactaagcactactcagaaaa

SEQ ID NO: 11971 - DNA, 201 bp, Bos taurus
ttttagaaaaatgtaaacatatgatatagaccctttgtctgcatcccatcctggaagcactgtccttggggcagatggcaccacagtcccaggattcttagtgggcacaaataaaatacttctcagactgggagccccaagatcagtcatccctttgctcaggagaggtgttcataaggccaagcttcacatttataacca

SEQ ID NO: 11972 - DNA, 201 bp, Bos taurus
ttacacagcaaattaaggtaacatatagatgcctaagttccaacacaaatgaatatcaaaaacattgtgcttagtggaaaagaaaattagatatattttataataacatttagaaaaatgaaatatccacccacaagacacacatattttgtaagaacacacacactgggaggaaaaaactacattaaacacaataatatg

SEQ ID NO: 11973 - DNA, 201 bp, Bos taurus
tgccaatcattagctgttcatgtaattatattttctaggttcaagttcaattctcttcaaaaataaataaagggacataaagaattttgactgcattttggggggcttctattcattatattttcccatagaaacttcacatataagacaatttatattttgtcaaaaggcagagaagatagttttgttaatgtagaagac

SEQ ID NO: 11974 - DNA, 201 bp, Bos taurus
atttttaattagatagattctctttatgctgtacatttgatgatttataaatttattggtcatgtgatatgttatctaaaccatagtgaattacagcagacgattttaaaccaatctaaattagagcacaagtgtgttagtatcaaaaatgattgacttttggattctgtctcttccataatgatacatttaattcttcag

SEQ ID NO: 11975 - DNA, 201 bp, Bos taurus
aaggatgtatagatactgactatgattaaactgaaggctaacagatatacatttttcaaaaatgtatgactgatcaccatttacctttggtatattacagacaggatatgtttcaagtattgtttaaatcaagagaaatttcccagtgcacagcagtgttacagttaatacaaatcctctagggtagaggctaagcaactg

SEQ ID NO: 11976 - DNA, 201 bp, Bos taurus
gggaaaagagcttacttttatagatactctaagaccaaccaaaagaagtcttacattaacatacactaataacagcaaaacattaatgacttagaagctacaggtctaagtcactaggggctgattaaaagaaacaggtgttaagacatttaggatgatgacagtcagctactaattaaatcattaactgaggattctgca

SEQ ID NO: 11977 - DNA, 201 bp, Bos taurus
tgagttacagcataatctaaagttatataaatatttacttagatgacaaaatacttagctgtaaaataatattacctttggagatattttaaaatttacaatatgaatgattttaatctcagatggtataaaacaaatgcaataatattttctcttgagtgcttagactgtttcagaaacaaagatacgagttaatttcta

SEQ ID NO: 11978 - DNA, 201 bp, Bos taurus
caagggcattggacacatcacacattgcacaaatcattcttgtcactaacaagcttgtgatagacacagcagtgactttaaagcccatgtttttccctccatgccaaattttcttcctttggggcactctgttgaagctccaaaaaggtatagtgttccagcagaattaaatgagtgagcaaaacaagtttgcacagtcaa

SEQ ID NO: 11979 - DNA, 201 bp, Bos taurus
acccaccaggttggcagctggatgcagattcttgggaaaccagcttctgtggttcacctcactccctgataatgacaggccgttgccttaccctcaaccctgagaaaggaaaaaaaaaatcaacactctaaaaataagaagaaagaacaagggagtgaagttcttgccagtgctagtaaccaggagacctagaaagaggcc

SEQ ID NO: 11980 - DNA, 201 bp, Bos taurus
tggtggtcaaaattgctatcacactcctcgtaaccctaacccagaagacaacagaacaatgcctccaaaattgtgaaaggaggtatatccaaagtctaggcttatataaccaagcatagtagtaactaacactctatatgacaggcaggctgggtggattattctctcttctctcatcaagcatgcctttcttaaggccac

SEQ ID NO: 11981 - DNA, 201 bp, Bos taurus
aggagcctagcgggctacagtccatggagttgcgacaagtcagacatgatggagcaactaacactaacactttccagatggtgggttgacacattggaggggaaggcggttgagccctaaactgaaccactttatgaagcttatcctatatgcccttaaactttgggtcatgtgaattacatgtaagtaggattcagactg

SEQ ID NO: 11982 - DNA, 201 bp, Bos taurus
ttttgttctcataaacggtaaaccagaatatttttcacacaaattcctcccacaatctacagatttgatccagttcaagaatgcaaaggaaaaaatgcctgttctccactaccatgagccaaatctcatcagcttcaggaataaggcagaaagaagtccatttcatctattaacttcactgaatggccctggactgtctta

SEQ ID NO: 11983 - DNA, 201 bp, Bos taurus
acatatactgccctaaacacaagcattacttatgataattttcttggtgcatgcaaaatgcaagcaaattttcattttaaaaccaaaatagctacaagagacttaacacgtcctagaacaacaagaaataagtcccaattcctagtaaaatgctgcattaggccatctctctagggaaagtcttacctttaatccattcta

SEQ ID NO: 11984 - DNA, 201 bp, Bos taurus
tttctttcttcttggtttctgtctagggagactgtacctttctgagaatttgtctatttcttccaggttgtccgttttactggcctgcagttgttcattgtagtctcttatgacccttggcatttctggggtcagttgtaacttctttttcattcttaattttactgatttgagccctctcccttttttcttgatgagtct

SEQ ID NO: 11985 - DNA, 201 bp, Bos taurus
ggacagacgggtacagggccatgtgaaagccacagggtctgacgcaaagcctaggactggggtcaggaaggaggactaagtgcacttcagctcagggaaacggcctgagtcaaggctaagaggagaaggatgtcagaaggccatcagagagggagtcagaagacttggctcatttgttgggtacacactgaacttaaaaca

SEQ ID NO: 11986 - DNA, 201 bp, Bos taurus
agcgaacagctacccactccagtattttggcatggagaattccatggactgtatggtccatgggtcacaaagagtcagacacaaccgagtgactattacttcactgcacttggtagaactatttaaagacattgttctctataacaccagatattaaaattcctcaaataaaatgtattattggtctggctaaagccatat

SEQ ID NO: 11987 - DNA, 201 bp, Bos taurus
ggagttaacacgggtaagcattttaccacataagcaagtaagttcacaaacctgagtgctctggtggccaggactggccctgctgcagcagggaaagagcgagagcctggacacagcagacaaagcccaggatacagttcagccatcagcactgggagaggccttctacctccagggctctccagcttcatgaccccattc

SEQ ID NO: 11988 - DNA, 201 bp, Bos taurus
taagtaacactactcaaagaaaaaaaagagtcgcagatatttttggattttgctgtttgaaataaaattttggttggagaggaatgagtattagctttttaattcacttaattgttgcattattttttaatgaaggtagaatgaggtcttgattggggatggaataatatgtataaatcagagggttaagtagagtgttag

SEQ ID NO: 11989 - DNA, 201 bp, Bos taurus
tttcttaggggaacttagggaatttacaggaatggcagaatattgcaattaactaccaaaaaaaaaaaaaaaaaaaccagaagcaattctgtgacactaaagttagtgaagagtggaggaaagccaaaatactgcaggctggcaacagaatgggcaggagagaataaagataagcaccaggaaatcaaacttattaataga

SEQ ID NO: 11990 - DNA, 201 bp, Bos taurus
ggccagtatgtctggcgttcttctaagaagaggaaatttggacacagagacctataaaacatataagagggtagattgtgtgaagatacagaatgaccatctacagcccaaggaaagaggccttgaacacatccttccctcacagccctcagaaggaaccaatcctgccaacaccttggtctcagaattctaaccttcaga

SEQ ID NO: 11991 - DNA, 201 bp, Bos taurus
ttctgtatctcctgacacagtgtggccagagatacaagatttcacctcactgtgttaatgctggaaaattttcatgaagaatcagaaaaatccagaatgctgaacaatcttctggaacagtaggcctgaactctttgaagaattaaatattgtgggaaaagacaggagaagtggagaactgcttctgaattgggggagcat

SEQ ID NO: 11992 - DNA, 201 bp, Bos taurus
ccatggttgcagcagaaaaacccaggtaaggaataaatgcatgagcttctagctacataggccatggacagctttacagaaatttccatgcttcacatggtgacacagcagtagaaatacgtctgcattctcaaattgtgaactagtttctggtagtcctgaaaatcctgctggacccttcttttctgagaaacagaaatg

SEQ ID NO: 11993 - DNA, 201 bp, Bos taurus
tgttttattccagaagagaaaaaagtctttttttacttctgatcaatggggaattggccatcctgtgtcgtatcaaatcttatagaacagtctgaactgccgagtaacaggaggaaatttcatttaaaaaatgtactaaaaggggagctttatatggaaacagacgtggatttaatacttcttctggatgctataataaaa

SEQ ID NO: 11994 - DNA, 201 bp, Bos taurus
ttaaatggtgaactatttcagacttgctgcatctcattttttcactaaaaatatatcttggatatcattttatataaacacatgaagctagatctgttttacccccagtggctgcatagctgtttgtagatgtaccagaattatttatccactttcctgttgatggatattttggtagttttcattcttccctactgccat

SEQ ID NO: 11995 - DNA, 201 bp, Bos taurus
ccatgttcagattaggttattagaaactttgaaatggcctctgagtattcaagtgaaaggaagagttaagcttagtgaggaaggcattttgaaactcattggctaaggtggtcctaagatggccgaggaattggaggggagaccactttcttccccacaaattcataaaaagaacatttgagcaccaagcaaattccacag

SEQ ID NO: 11996 - DNA, 201 bp, Bos taurus
gcacccacacacacagacgaaccagcttccaactcaggtaaataagtttaccctacaaaacaaatgattccaactaggaactagttcttcaatgaactgactcccatttagatactccaacaacatctcctgcctgaaagagggtatcccaatcaaattggacggtcccataaagaacaagccaaaactgagggaagaata

SEQ ID NO: 11997 - DNA, 201 bp, Bos taurus
ttatgtaagtgtaatgagaatagcaactgatcacctaggctcctttaatttacctttgctaaaagtttcataaggaatcttaaaacttttaaagtctctccaggccagcaaagtcatgttaaagatcacattttgtctcaaatgcctgcagttttgggtgaatttctttcttttcaagtactcaacatatcttcgggttct

SEQ ID NO: 11998 - DNA, 201 bp, Bos taurus
atggacagaggagcctggcaggctacagtccatggggtcgcaagagtcggacacgactgagcgacttacttcactatggtcacaataagggttaagaagtattctcaaagtggtaaagaggaatacagttgagttcaacatatagatttgtttgtttggaagaggttttagggaatttatatggttataaatttatgcatt

SEQ ID NO: 11999 - DNA, 201 bp, Bos taurus
gctagatctcgagaagagcgattaaacatttgtttgcaaaaaattagaatgcttcccacagtgaagattatttagagggcagacatacaaaatttgctaagattactttttgagcttaatgagtttaataatatatttcaatattggaatttcagttgttatattggaaaaaataaatcccatgtacataatttgtacaga

SEQ ID NO: 12000 - DNA, 201 bp, Bos taurus
aaggggggctctcactttaggggagttctctagtgcttcaaagttctggcattgtgtctcttgcctctgggttcaggcctgagcactttctgctgcatcaagatgtcacagtccacatagcatagaagataaaacccctagactaatggtgaaataactgtcaatggccaagatcacccaaagagactcacacacttatat

SEQ ID NO: 12001 - DNA, 201 bp, Bos taurus
tttgaagatttttttaattttttccctaaaattaaggtggccagaagaaacagcatatttgaacttttttgcatgcaagtaattttttaaatgcttgtcttggagagattatatggcctattggaagttccacctaattgtataatgttatggtaatacacctgtacaccagactagaggtcacaaaatcctatcacttat

SEQ ID NO: 12002 - DNA, 201 bp, Bos taurus
attttccacctcagtcagatgactgcaagaatacatgctcagagacagtcttcaaatgacaagaaagaccaccttccatacagtgtctttattcacagctatcatattccagggtcacattagaactcaataggggcccacatcactgcaaatgtagagttagtatttattattcataaagtttaggtaaaaaaatagaga

SEQ ID NO: 12003 - DNA, 201 bp, Bos taurus
aatgtaaattggtatagtcacaatggaaaacagtttggagattactaaaaaaaattgaaaatagaactgccatatgattcaattattctactccttgtcatttatatgaagaaaataaaatcaccatatggagagagatctgcaccttcatgttcattgcagcattatccataataggcaagacatgggaacaacctaagt

SEQ ID NO: 12004 - DNA, 201 bp, Bos taurus
ttaaaattgtatacatatttaagcaccttcttttctctcttttcctctttgtgtctttaaccttccatctaaaatcattttcctttgcctaaagaaatgccttcagaattaaccttaagacaagttattagacatgtattttcttactatttttgaaagcatatttattttaatttgtatgtgtgtgtataaaattctaag

SEQ ID NO: 12005 - DNA, 201 bp, Bos taurus
agacatacatgaagtcagtcttccccttaactttgatgatggctccaaacctcactcccccttctcaggtgtggtggacatcccctgacagctggtcatgtaggggtctttcttccactctctttagttaggtctttacgtgacacaagaagctttatcaactgcactcagtgcatcccaggcataccaggcatgaaatgt

SEQ ID NO: 12006 - DNA, 201 bp, Bos taurus
ttgtcttgaaaaattcaagataatactgaataaaaaaacatgagacagagaatcagtgaagaatttcacttcaacaatagtagttttgaaaatccaaaaatagagtcaatgaaagcaactgagagggttatacacaggatgaaaagtctcagttaattatttctttagatagcatttctgagataaagcatgatctgtttg

SEQ ID NO: 12007 - DNA, 201 bp, Bos taurus
ggtgatggacagggaggcctggcgtgctgcaattcatggggtcccaaagagttggacacgactgagcaactgaactgaactgaataatgtgactattagtacccttgatgttgtaccagaggcctcttaaaatgttctcagtttttaaaattatttttctgtttttttgttcagtttcagtgatttctactactctatttt

SEQ ID NO: 12008 - DNA, 201 bp, Bos taurus
gaatattaaacaatcagtcaggggcctgtgctatgtttttatagcaaactactcaaatcccataaagatgaaatgtctgatggtcatttacactcatttactgttggactgtgaagaaggctgaatgccgaagaattgatgcttttgaactgtggtgttggagtagactcttgagagtcccttggactgcaaggagatcca

SEQ ID NO: 12009 - DNA, 201 bp, Bos taurus
ctaagttactaaaatgatcctgggataagaactatactctaggaaccttgattagaataaggctatcaaaatccattttagtcagtaatttatagtcattaagttttagttactttagagagatttactaatctcatttactcagtgcccatttgtgcacatttcattattagaaggctacctttattttagattatgaat

SEQ ID NO: 12010 - DNA, 201 bp, Bos taurus
tgcttgttgaagagactatcttttctccattgtgtatttttgcctcctttgtcaaagataagatagccataggcatgtggggtaatctctggacttactattttgttccattgatttatatttctgtctttgtgtcagtataattctgtcatggtgactagctttgtagtatagtttgaagtcaggaatgttgattcctcc

SEQ ID NO: 12011 - DNA, 201 bp, Bos taurus
cgtctatggggtcacacagagtcggacacgactgaagcgactcagcagcagcagcagcagcagcagtattgtttgctaggccagagagtggctagttattctccacagttggtatttccttttaagtatgcatttgaattttccattaatgaggtgtagacaaaggcgataaaatccaattccaggccaaatccctcccag

SEQ ID NO: 12012 - DNA, 201 bp, Bos taurus
tttttaagttttccatttttagttatttgatgagaaattacagaactctgaatcacatgccttctttttccccttatttttcttaatttaaaaattatttataaaaaatgcattaatttatcacttggagagcaggacgagggctggcctgccttcacctgcctgggagaaagaaactgcctgctcactgctggcaaagca

SEQ ID NO: 12013 - DNA, 201 bp, Bos taurus
ctagttctgagaatctacttgtgaaataacaatgaataatatcagagcccagatttaaaatccctgaaattgcagtggtttctctgtggccaacaacaaagaaatatgccccttctgtgagcttgctagcacgtcaatgcacagcaggcttgtaaataattttctaagcactcactctgcagtgagtgttgagaaaggcca

SEQ ID NO: 12014 - DNA, 201 bp, Bos taurus
tgacatgacaaatagatctgacattacttgttttataagccatcttgcatgtcagaattcctgtggcgaaagcacaaaagctgaagtggacgtggggccacggaagaaaataaagtgtgcctttagcatttacaataagtgaaaagccaacatttcttgacccattgttccacacttgggaaataaggcttaaggcctctt

SEQ ID NO: 12015 - DNA, 201 bp, Bos taurus
ctcaagtggttattttcttccatttctagattcctcattatgcatgtgctttagaggctggaattctttgttgtgctaacttattcctagacaaataattactccatgattgacttgaaaaataaatgtgttgcatattgcacaggaatttaatacatttcttgtgtggtatcaaattctcaactccctccttctcactcc

SEQ ID NO: 12016 - DNA, 201 bp, Bos taurus
caaaccatgcatgacagccctatccttttgttataaactctccgttggccacattgtaactaggaattcatctctaaatttcccccttcactgcagtcagcctctgcaaagagagggccatctgccagggcagctctgcctgtgaaggtaacaggatcccctggggggcaggagatggcatcacaagtgccctctgaggtg

SEQ ID NO: 12017 - DNA, 201 bp, Bos taurus
agcaaatattatttaaaaatatcatgtaagggagtgataagcactaagaagaagaaaaaaacagcgggaggagacagaatcatgcagggccctattgtggatggggtggttaggggctacctctacagaaggggctgttcaataaataccacaagaaaagaaaacacagagatgagcatgtccagagacctgaagtgaaga

SEQ ID NO: 12018 - DNA, 201 bp, Bos taurus
agtaggtacaactgaaaaatttgagtcactcaccatcttgtatctgacagagtcctcaacagagaaatagtccctttgaagaatgcccacaaacaatgcacttaattttccaagataaaagtttatcatcatttagaaagaagccaggaaaaaaaaatggtcttaagggctttagaatgttttccaaatgcattgtggtac

SEQ ID NO: 12019 - DNA, 201 bp, Bos taurus
tcccccggccactgtcagcagcgtccagggaggctcggtccccctggtcctgggaaagctcctccgtgctgggggaagagatcacggtggctgcagcatataggcccctgctctcagacagtggtgcacaggaactaggcggccgacgggaaagagaaaggagaaaagaagatgagaaggaggggaagaaaagagcaagat

SEQ ID NO: 12020 - DNA, 201 bp, Bos taurus
acatccttgccaacactaatgtctgtcttttctatttcagccttccaaggtgtgtttgaaggtgttgctctgtatttccctaatgacaatttttcatgtgcttactggccatttacacgtctttgggtaaatatctattcaattctttgttcactttttaattgggctatttgtcttcatcactgcatgttaaggactctt

SEQ ID NO: 12021 - DNA, 201 bp, Bos taurus
cagcgtctcttatgtctaacctgcattggcaggcgggttctttaccactagcgccacctaggaagcaccagctgtaaagtcaccatggattttaaactcacagagggtaggcacccctaaactcctcaactttcaagaggcaactgtatttgcatacaatctaaactaagtcatctcaagattattttaataccttataca

SEQ ID NO: 12022 - DNA, 201 bp, Bos taurus
ggctccatccctcttcaccccaccctgacactggactcttccctaaagctccaacccaagtccatttccttatctggcctggctgggaaagtcagaaatctgttgtaatcactgttaacggcaacttcagaacatactcaattccttctggaaattaacatggtccacctagtgtctggtgcccttggcaacagctgggcc

SEQ ID NO: 12023 - DNA, 201 bp, Bos taurus
cccctcatttcaggctgttggcctagaaaccatcataatgcatcatgttagttaatcaatgtaatcctattaaagtcacacaatggcttgaactgacactctcttgagtgacttcactttcactttaaggcagtggtaaccaaaatgaaacctgtatgttcagttacaggcaaagagcaaaacctaggcttgtcatctatt

SEQ ID NO: 12024 - DNA, 201 bp, Bos taurus
catctgattactctgaaattttgaaaaacataaagcatattgtggacaaaaaatgtcacctgctaatctcagtaaacaaaagatgttgtggccatcaagcgatcagccatagcagctgcctccaacagtacaaccctgaggggattcagaatggagaaaagcaaggtgctggccctagatagtaaagatgcttgtcaaagg

SEQ ID NO: 12025 - DNA, 201 bp, Bos taurus
tcttatttactcttggggcaggatacttcatatatgtatagaggttgggctgcccactgtgatgtgactttgtagcttagctgtgagaagattttggacagtaccagctcttatggtagcttttacagtagcaactcccatgagaaaggcctagaattcttctaaacaagataggcttgatttccccaatgtcatcacgag

SEQ ID NO: 12026 - DNA, 201 bp, Bos taurus
ttgggatgttagtttcctttcccttgaatgccttgcactccgcccttttcctgtaacaagaggctagaattttccacttttattgccttggagaagaaacgaagcagatgtctgcaggaaacaaaggaatcaaatttgtagtatttaattgccaaaggcccaggtttgagcactgacaatgattgtggaaaaacaaaaaga

SEQ ID NO: 12027 - DNA, 201 bp, Bos taurus
atctaggttggtcataacttttcttagttttaaaaacaaacagatgttggtgaggggagggataaaccaggagcttgggatgaacacacatgactatacacaaaatagttagccaacaaagacctatggtacagcacagaaaaatacactgaatattctgtagtaatctttatgtgaaatgaatctgaaaaagaatggata

SEQ ID NO: 12028 - DNA, 201 bp, Bos taurus
tttgtatataggaaacagaactaattttctatccaacccctggcccaactggctcctctttaaaatgcaaatattctgaatggcttaaaccttcattgtccaggtgctccagaggccttgttcacatcttattttcagtctcaggcaaatctcttcctatcctagctcagtcaccatccttttgctgctaagtcctgagtc

SEQ ID NO: 12029 - DNA, 201 bp, Bos taurus
ttgttttcccaagccaggtacacctgttggccacagtgaatgctctctctgaactcggaacgtacagacttgatccaggggcagtcttcacctaactgttatgaataaggcccttcaggacttgaatagacattttcccaaagaaagcttataagtgaacaacaggtacatgaaaaggcaccgaatatcactaattattag

SEQ ID NO: 12030 - DNA, 201 bp, Bos taurus
aacactacatcaaaccctccttgatctatatgattttacctcacttatcactcagtctatgtccctacaagattctggccattctctttccagacttttcacattgcaggcttgtaccttcttccttttgtcctctatcattttgctcctaaaatctgaaaggagcattctcttctgtctgaagtttcagcttaagttctc

SEQ ID NO: 12031 - DNA, 201 bp, Bos taurus
ttttattggctgaggcttgctacgtggaccaatgtaattgtcaagacttccccctttcttcacaaaagtatcccagtttatatgataaatagtatggccaccctaagaataattcattattaaagcaggagaggatatagtttctcctgctttctttcacgtgggcttagcccagtatagtcaatcttccccaggccaatt

SEQ ID NO: 12032 - DNA, 201 bp, Bos taurus
gaatataacattaatatctcattttttaagaattaagtatattaagtattcagacttaatattactgatggctatagaaactagcaaatctcctaacagatggtatttagggggtagtatgtaaagaactttggcagagctgattttataggttgcattgatcaatctggaaaccagtgtccaggttgcagctatacagaa

SEQ ID NO: 12033 - DNA, 201 bp, Bos taurus
ttcagagtcccattgctaactagccaaagggagaaaaggcctttatttcctcatattgtttgggagggatgttgaaaaagctaatatgatcaaagaaatacctgcattacccaggcctctgcttatgcccggaactcacactgttccatttttcaactctgcttgtctcagcaattgagttggtctctgttgaacttcata

SEQ ID NO: 12034 - DNA, 201 bp, Bos taurus
tttgctttgaaatttttattttaaagtcaaatatttaagtggtgtttgggaatatgttggattgtagtggatagattttgaaagcaatcttagaaaagttatgcttgaaacaaattgaaatcacttgctctgggatgttgcagcaaggacaagggaatacagaacacagttgttaattttctgtacacaacattctttctg

SEQ ID NO: 12035 - DNA, 201 bp, Bos taurus
aggaaatgacaatctgagattcatatccaaatccacccaactttacaagctccgcttgtgacagtcaggccacatggcctacacaagtcgacccaggactctccactctgtcacagtgactcatttccctgagagaatttgtatcacttatacacaccgagataaactgaaaccttggccaggtgctgaaggggaaacatt

SEQ ID NO: 12036 - DNA, 201 bp, Bos taurus
tgccaatctgaaaagtgaaacccattttgaatatgctctaaggcattacatgacaaatgaggctgagatagatcaaacatgcagcgaagtggaacagaaatacaactcttggaaaccaatttggaaaatttcagtcaagttttattctgatggaaaattccaaattaaggaatagcacatgccaccttaaattttcttttt

SEQ ID NO: 12037 - DNA, 201 bp, Bos taurus
gtcaagttacttgttaggccagcaaataacctagaagggaagaggggaaatttttcttttccagtagggacatggaagtatgtgctagtgctccatcttgactgtggtcctgagggccacagttagaattaaaggaagatagagtgtaagaagacaatggcaacccactccagtactcttgcctggaaaatcccatggacg

SEQ ID NO: 12038 - DNA, 201 bp, Bos taurus
ttttatgtccttgtctctagaaagcctgcatatgtggagcaatcatgtgactgtcacaagacaaagatagcaggcaggtctagatatggtgcttgatcatcgatgaactccttgagcagctctgttatttagacacataactctgaatgtccttgcacatgagttaatggactgcttttgtctatgaggttatgctttggc

SEQ ID NO: 12039 - DNA, 201 bp, Bos taurus
tatggcattttaatcgtacgtccattaggcacttttcagcttttttcatatttgactacacttgtgacagacctcttgaaattctgtttctttcacatgctaaatactatgctttccatttttttgttcttcctctcttaacactcctgattttttctctcattttcctttggatttttattaattcagaaagtggagtct

SEQ ID NO: 12040 - DNA, 201 bp, Bos taurus
taaatttcatcactgtgctcaccgtatgcccagcacgctaaggcagagtgctaagtggaaccctttctctgtggaccaggggaggtcagaatgtaaataaagcagaagaagatgccttgggaagtgagggaccatggggattagagctgggcataaatcatagctccacagtaaagcaacacagggttttactttggcact

SEQ ID NO: 12041 - DNA, 201 bp, Bos taurus
ttaataatatgatcataagcaattgagattctaaaagtgatgtgctaccttaatttcttccaggtaaaaatgcttgtaagactatcctgtaaaaggagcatgccactatgtgtgagaagaatttacttgcaaatcaagcttagccactggtgttattaacataaaagatatcagagctctggatgtctgtttgttaaatca

SEQ ID NO: 12042 - DNA, 201 bp, Bos taurus
tgggtgggatgtgcaggggcaccctcaaatctcaatatcgctcatgaaaatgactcttatgaaaggttctgtggatggaaaatgctgtgaaggacttggtaataagaaatcacagttcccacaacttgaccagctccttcaggaatcagtcctgtcagggagatggtcatcatctctagttgtgcatcaggcaattagaaa

SEQ ID NO: 12043 - DNA, 201 bp, Bos taurus
taggtcattctgatatgatttgataagatcttttaattatcttataatttatatctattaaatcaattctgaatgtctttttagacccaaataaactacagtcctgtagagagcaatagataatatacattagacagatggtataacactataagtttcctgtggttgggagaactgtatgattcagtatataaaacattt

SEQ ID NO: 12044 - DNA, 201 bp, Bos taurus
aacacttcactgcttcaattcaaccccaagtatagcaattgtgaatttttccacaaaaatatgttctctcttctgtctccctttctcttcacaataagtcttaataactcagatactcaggaaacagatcacaagagtccaaattctcatgtattaattctctggctctaaagccaaaattacatgacatgatatcagggt

SEQ ID NO: 12045 - DNA, 201 bp, Bos taurus
taaaacaccttgatttaacttctttgttcaatctcaacaacaaaaatagaacattttaagtgtggattttttaaagcaattgaaagatgtatgcaattatgagtaattttttgctgttggctaactaatctaatcgaaaagggtttgcaattcttttttgttttaaacgaacacatttttaggggtgcacagttgttttga

SEQ ID NO: 12046 - DNA, 201 bp, Bos taurus
aagcccagaggtatcatttccagaagggagttcagtgagggtaacaaccattttgtcaacttcgctccagtatccgatctgaaaaaagacacagaaagagtgcacttggatacacggcctttctattaccaaagcactgagttattttcaaacccatgtctgaatctgaaattacacctatcctaactagacttgtcctaa

SEQ ID NO: 12047 - DNA, 201 bp, Bos taurus
tgacttgtgtgttcattgacagaaagaataaatatgaaaatgatctagccctacttctgcctaacaattagtatcagtcatacaatcatatttctgttttatggagccattagtattatactaacaacaggaagtttgttaatttctaaatgcttttgatgtctgaatccttttctcacctaatcacaactggaaataggt

SEQ ID NO: 12048 - DNA, 201 bp, Bos taurus
tctgttacaaaaaattaatgcttagataatagcacactcatcatcgcgatttcctttgtacttgtctcattcactgtaggcctaacattttatttcatttaaatatttatttatttatttggctgtacagggtcttagttgtggcatgtgaactcttagtgcagcaggtggaatatatttccctgaccaggaatggaacct

SEQ ID NO: 12049 - DNA, 201 bp, Bos taurus
gggacacattactgtgacgtgtctgcagtgagtattgctagtggaagcacattcatctctgcttgttgttcttgattagaaaggtaagcatcttcattgctttcataacccattcataatgtcagcattgttggcaggcatcagctgctgtcagcaccaagaaaaagcaggcaaaactagaaaagaaaaaaagcactagag

SEQ ID NO: 12050 - DNA, 201 bp, Bos taurus
ataagtatttgaagacacgccatccaagaatgacccactgtagagaaataatgagacgtaaaattaaccactaacctaaaaggaaaggagcctggctgaacttagcattcctgtcagtgctaagtgtgaaacgtaaaggtcagcttcggtttggttggcatttaagatgtgagcagtatgaaatggctacaaaataagtta

SEQ ID NO: 12051 - DNA, 201 bp, Bos taurus
cacagtccctaagcaagcagtaagggcttcctccctggtctttctcctgaagacacgacagaggggaattaacaggcccacagctgcccccagtcaactcgcaacactggacttcctacccctccccccacgccccagcctagggggacatctggtgcagacaccttgcccaaggccgcaggtactgtgcccacatctttg

SEQ ID NO: 12052 - DNA, 201 bp, Bos taurus
ttacatttattgtctcttataacaagacatccggagttcaggcaggttcaggatgacttagtttcagggctccgtgccatggtcaccaggctctttaaacgtttacctccatcatccttggcccatagacttcagaccttgggctcatcccagtatcacctcctgacggagctgtgtccagacataggaaaaagaagcttc

SEQ ID NO: 12053 - DNA, 201 bp, Bos taurus
tctcatacatacatattgtatacatgttcttttccattgtaggttattagaagatattgaatatagttccctgtgcttgtttaactgttttataaatagtcgggtatacctgtttatcccagtctcctaattatcttctcccctcccacactctcccctggtaaccataagtttgttttctctctgtgaatctatttctgg

SEQ ID NO: 12054 - DNA, 201 bp, Bos taurus
gggacccagctgagctttagtcctgaggggatggatcttctgtatcctcacagcaccttcaaagcagatccaaatgagatgcccctccaatggcctggccggagttggggggacccctggcatctgcccatcatctctcaataagttatgcatcatggtcaccaatgatggagactggaggggcctccaagaagttcagtg

SEQ ID NO: 12055 - DNA, 201 bp, Bos taurus
aacggtgtttacagaccagacggaaggatgatggctccacacagacaacacaatatgtgttgtgcttgagatttcaattcagagttaactgactgttcacctggggctatagagtgatttttaatctcaccaagttaactgagggatgattaaaaaacattttatgcagaattaagttagattacagaaactaaatttagg

SEQ ID NO: 12056 - DNA, 201 bp, Bos taurus
tctttcattaaatcagataagaaatttctgagtagcaggtcataaaatgagcaggaaacacgcattccgcaggaaataactttatgacaagagataaacatgacagtaaatgtttttcttgaagaatgtcagagctcttagaactgaaagtgaaaaattctggttgctcctatcacatcccatgggaaagttcccacctct

SEQ ID NO: 12057 - DNA, 201 bp, Bos taurus
ctttggcaacaacaagcttcaccctcatgggaagctgcattggagcaagaggtgtcgagtgggcacctgatgcggatgagtgtatgtgctgggatgctcatggaaaaccagccagagcttcaggagcttcagcctgcttcctctgcattcaccacagaatgagcatgtgtgtgcaagtgattcacatcagagtctaggatt

SEQ ID NO: 12058 - DNA, 201 bp, Bos taurus
ttgtcctgttatttcagataatctcctcatttaactctgtcaaaatgtggtggaaataatgcctctctttggagacagttgggccacagtcaaatctgtaccctcatttacttttaaggctttgaatctttgaattgcttgacttgatttaacatatttctacacaaactatggtgcttaattttatatatcaatttacct

SEQ ID NO: 12059 - DNA, 201 bp, Bos taurus
ggagtttccccttgagagcccagcaatttgagtgtcttagtcatagcatttggcacattgctctgtacttgtttacttctctgatacttcttgatcaagaacattgtgttatttaactttggaattcctaatgtctgggccatctgctcactgttgacagagttcaagagatacttactttgtgaattacggtttttgaac

SEQ ID NO: 12060 - DNA, 201 bp, Bos taurus
tgtccatctgaaactgctggttgctctctccaaactgttgggtggtgggggggttgggtctgtcagtctccactatggatccaggccaccacttttagggcgaagtgaagatgtgccatcctaaaggaaatcagtcctgggtgttcattggaaggactgatgttgaagctgaaactccagtattttggccacctgatgcga

SEQ ID NO: 12061 - DNA, 201 bp, Bos taurus
acaatagccaaaatatggaaacaacttaaatgtccatcaacagatgaatggataaagaagatgtggtataaatatatgtacagtggaacattacttagcgataagaagggatgaaataatgtcatatgcagcaacatctagagagtatactaagtgaagtaagtcatatagagaaagacaaatataacatgatatctcata

SEQ ID NO: 12062 - DNA, 201 bp, Bos taurus
tgctaataaaatctattcttttttactttttattttatactgaattatagctgattaataatgttgtgttagtttcagatgtacagctgttccagttacacatatacatatatctcttcttttccaaaatcttttcccatttacatattgtattacataataggatcttttttaatgaaactattgttgcatatgaaaacc

SEQ ID NO: 12063 - DNA, 201 bp, Bos taurus
ggttcctcacatcaacagcagtagccagagtggccagtttcccaactctcagttctcacagggggataccaagagggccacagattagtagtaggctgacgtacgggcaagagtcctggacttaaggagctgaatcctttctgctagatggtcggcatgccttgctttgcttcagagggaggtgctatctctatttctaag

SEQ ID NO: 12064 - DNA, 201 bp, Bos taurus
ctctgagtctgctgtctcatcaactcctccaccactggggcccaggatattcacccgtgagcgagcctggcatctgacagtatcaccttggccacacacacggagatgcactcagcctaggcgctaacctgtcacagggctcaaagagctactcagtagggggagaggccccctcagccctgctggagcccctgcgctggc

SEQ ID NO: 12065 - DNA, 201 bp, Bos taurus
gattcacatcatttattatgtaaaataaatttacacaagctaacttagagttgataataactgctctgcttatcgtcaagtcaagtgtgactgctacaggacaccctgagaccacctgaacagcaattattgtaaatgggatttctattaaaaattatctgttcaacaagaagctctagttcttataatctacacaattac

SEQ ID NO: 12066 - DNA, 201 bp, Bos taurus
ccttgtccaaggcagcttctcatctgcaagagcagagttaagtgcttgggacagaagcttctggcaagaaaagccaaaattattgcctggcctttactttgctgacactgatttagatcaaagttgcagccataatttccagcaattatctaaatagatattttcacttacgtgtcaggagtgtagaaggaatctaaggcc

SEQ ID NO: 12067 - DNA, 201 bp, Bos taurus
atctgcaaccatggtgagccgcatgcaagtcccctaatagcaagggaaggagaatgctttcttagagagaaaaaggaaggtgaaagggctttagtaaacaatccatggattgttcactgactgagtccttgccagaaaagaagaggattcattctccttttggtctcagctatcattgcaaagcatcagagctccccctct

SEQ ID NO: 12068 - DNA, 201 bp, Bos taurus
attttcagacaccattatctgtatgggtctatatattcctgatattttgatttcctttgacattttgatcacatgtataaccctgagatgaaatgaacccaaagaataccagacatatctaccaatatctgcattacatagcaaagtatacatccatagatatttgaactctacactcaagatctcagtcatttggtcatt

SEQ ID NO: 12069 - DNA, 201 bp, Bos taurus
cgactggcccccagcccggcccggttcgcccgcacggcgccgcgggcagtgcctcagcttctttctctcccctccagctctgccctccacgctacgttctcagccggccctaccctgagccatgtcgcaggtaaattgtgtttcctttcttctaaatgcagatgtttacacaggctttccttctcctgtaacccctaccct

SEQ ID NO: 12070 - DNA, 201 bp, Bos taurus
agggccagcaatggctttctcaggcaactgagaaacttgcaggaatgctaaaggcaaatcttcatagtgtccagctatccctatagggaaatccattcaagttaactttaaaaacttactctcctggggacagaaataagaactagacactatgtgatcaaagcaccatgatggtcttctactaccagagggataactgaa

SEQ ID NO: 12071 - DNA, 201 bp, Bos taurus
gtgattgtccaagatcataggcctcagaaccacagggacccacaagtcccactggacagcaaggaaagtatggggtcatacactggccaggattacagtcagatatccttatgaagcagagctcaaaaggagccatcaggaccgggcagggagaagtgactgcgacatagctgatcggctgacaaaccttcagggaattcc

SEQ ID NO: 12072 - DNA, 201 bp, Bos taurus
tgtagcgaatgacattggcgtggcagatgaagatctcatagctgtcctcctgctgcttggcgtccgcccggtggatatagttccggaaggcggcctcgatccgtgctccatcttcataatactgctgggggcagaagaaggaatcgtgcgtatggaggcagtgtgggccccgctgccaccaggagcccaagggcagagagg

SEQ ID NO: 12073 - DNA, 201 bp, Bos taurus
tgttagctatcccacctgtggcaccatgagagactatgctgtgccaaaggtggggccctgtgcacgtgccagtgcccacctgaggggccgcagcccatgccgccctccacagcgggctgtcagcctaccactctaagcttgcaaagaagcctcccatcctgggagggccgcgtgaggggagtgaagggagatgaagggacg

SEQ ID NO: 12074 - DNA, 201 bp, Bos taurus
gagatggccctacaagccatcctgagagctgcggaagcctgtggggatatgtgcagtctccttccctgggagagccctcagagaatgagctctggtggagagtggtttactctggcctctggaggcttgccttaaattgcttccccagagaacagagactgatgatgtcttgaatcagtttcctgtggaatctagtcttcc

SEQ ID NO: 12075 - DNA, 201 bp, Bos taurus
agattcacaccgaggtcccgcctcccaggtgcccttggtcctgtgtcttggctcttgctgggcaggtgctgtgccctggcctgggaaggacagcaattggtattcaacggcaaacctaaacccctctggtgacttcatccccacaggttaggcactccacagggtccctgacccgtgagaacagggtgctgtggggccaga

SEQ ID NO: 12076 - DNA, 201 bp, Bos taurus
gtttcccagtaaggtcacatcccaggttccaagtggaccagtctttgtgggaggacaccattcacccctcttccagctctggggccccaggagtccctgcgcttgtgaccgcatccctccaatctttgtgtccgtcttcacatggcttctcccctctgtgtgactgtgcctctccccttctctcttctaaagacccttgtc

SEQ ID NO: 12077 - DNA, 201 bp, Bos taurus
agtgggattgggcccagggggtggggtccccagaagagaggcaggggagcaggcagtcctcaacacctgggagtaggtgggagcagcagcccccaggggggcagggatgcaggcctggcaagggctggccagggatccagcagacacaagggatggagggtcatctgagaacccaagagaagcatcttgtccttgttcagg

SEQ ID NO: 12078 - DNA, 201 bp, Bos taurus
caagcctgtcatcaaggaaagcggttgtttgtgcgaagcggagaccagacctgaatgtaccacgagttctagtatctcgtgcctatgtggccagtctggcgaactctctcactgctgttctgctgggggcacaggttcaatccgtggtcaggtcaggaaactaggaccctatataccatgtggcatggccaaaaacgaaag

SEQ ID NO: 12079 - DNA, 201 bp, Bos taurus
cccctgacgaggcagagccgggacctccacccataacgatctggccccagggtcgtatgctaaacctgcacaagtctatccaggccacagagctgttcccgttcctcagtgtacgtgagacctgatccctggtcctcggagtagaggcagcaaaggggaactcaggcaccagcctgccagtggcctggctggtggtcaggg

SEQ ID NO: 12080 - DNA, 201 bp, Bos taurus
catctctgacctatgtcagagtacacattgaagcctgtgaggttgggataggtgcccaggggacagtttgaagtgggacaggcccctgagttgggcctcctggctgagggtccctgtgagcatgccaggaacgtgcaatgcaaggtctacagaaagcaagccagtccctcctgtgtgcttgctgcacccccaggcctagcc

SEQ ID NO: 12081 - DNA, 201 bp, Bos taurus
gcaatgagagacaaccccagtcaccttgctgggccatttgaggaacagatgaaaagtgcatataaattcccccagtgcaagtaaagtctaacctgagtggggatggggaggccattgtccctcaagctgtctctgctctcggcagaagctgactggcaggtgtgctcctgaagccccacctcccagcttggagctgcaggt

SEQ ID NO: 12082 - DNA, 201 bp, Bos taurus
cctcggcgaaatggctcactggggcatttatgtgcctgccacatagtcttcagcacctttgaaaacagccaaggtaattccaccaacaagaacataaaaggttccctagagaccattttattaccaagaggagaattctggaaagaagtctatcaagtgagtgaatgctgtcaagtgtaggttccttttcatctgaaggac

SEQ ID NO: 12083 - DNA, 201 bp, Bos taurus
cctggaccaacacttctgggagactgaccccagctgtggaactggcacgtgctgtgtgcatgtgtgtgtgtgtgtgagagagagagcatagcacaggtcagcaaggccttcccagagggttactgaggtcctttgaggatcgggttgatgggggaggggtcaaagccatgttagtaaggtatccacttactttataagaag

SEQ ID NO: 12084 - DNA, 201 bp, Bos taurus
tcctggcttcacagctgatgctgtttgttgttccctgtctctctagactgcccctgattcctgagagatgcccatggggccccagtttctgtttccacccgtgtctacctccagttgtctcctgaagttcgtggatcccgtccacattttccaatggccagtaatgggaagcagaagccaggacctcaaacccttgaggga

SEQ ID NO: 12085 - DNA, 201 bp, Bos taurus
cataggctgcagctgcggagcctgcacaccatgactagaaggaaacccaggccctgcaatgaagacccaagtgccgcaactaagacctaatgcagccagacaagtaagtattttttgaaaggccacctgtatgtcagttagttgaggaggtcagaactgtgaccaaaacaagtgtctgtgcccttgtggagacagcagtgt

SEQ ID NO: 12086 - DNA, 201 bp, Bos taurus
accatggatggtgtccttttaagagacaaagagaacaccacatgaagacagacgcagagatgggaacaggagctggaagcatcgaggaaggagcttctcccggagcctctggaggcaggatggccctgctagtatgtctggcctccagggctgtaggagaatacgtttctggtttgtttttttttttagccaccaaatcac

SEQ ID NO: 12087 - DNA, 201 bp, Bos taurus
ataaataaccactgggcctctcttcatcctcagcactggggagacaatagagattagtggaagttggagtaagtcagaggatggatatcacatttcacagggctggcctccttactccttcaacccaccacaggtgccagcacttccaatttttcaggagaagacagaaattcagatttttatgtgaattgttttgatttg

SEQ ID NO: 12088 - DNA, 201 bp, Bos taurus
tccagtgcttttggccaagagacaagttagatcaccggtatgccttatggataataaccagtgtggctaaaactctcaattctagagtctagctctggcagctggacttctcagtggccctaggatgagatttttctgtctgtgaaaccagtggagtagccaaaatttcaacagcacaaacatcctcataggaggaataac

SEQ ID NO: 12089 - DNA, 201 bp, Bos taurus
tgatgggccctttacagccatcttctcgtttactggcaggcggagagcattagaaacccccaagacagaggacctgctcttagcgtgagatctgactagcaggagaaggtaaacggccttcttgacacctgttgggagagtgggcagctccctgccgcctcctccgcgctggccgagcgggccgggtactagcccgcctcc

SEQ ID NO: 12090 - DNA, 201 bp, Bos taurus
gcaggggaaggtaccaagctcttcaggcctgagcctggagcgtgtcagagcatcacttcagccatggtctgtaggtcaaagcaatcacagaacctgcccagcttcaagggcaggcctcaccttttcatggatgtgcagatgtctataacccacggcgaaaactacatgcactcgtgtgctgaacatccctgatattcggaa

SEQ ID NO: 12091 - DNA, 201 bp, Bos taurus
tcttgagggcatggggaagggctcaagacatatttgtaagtaaaaatgatagttctaattcacacattcatatacagggctaggaattcatgtgcgtgggcatatatcatgtcctgtaatatatattttctagagaaaacatttggtaaaatgcatacccatttgcctcctggtgatggatcatgagtgatattaattttc

SEQ ID NO: 12092 - DNA, 201 bp, Bos taurus
cacccacccaacgtggttctccatattggatggccacaagctaattcaaccagaccactgtctggattattatgaataggagatgcaagcaaaagaagcaagagaggcctgttcagaggtgagaagaaagcagcatgaatataactttccctggagctgtatttacaacttagacacaagacctccaggaggtctcagagc

SEQ ID NO: 12093 - DNA, 201 bp, Bos taurus
tgtaaatctccaagaaattaacattcagtagaactcatggggatttggaccatgcttttgtcttttctgcaggacaaaatgtctcaaaagtcaaggtgatcagtgggttcctagaaaacagatgacatggcaacactttgctttcctggctctatttatggatagaaggtacacatcaggtcatcattccactttttcctc

SEQ ID NO: 12094 - DNA, 201 bp, Bos taurus
gaaggatcgtagacacacagcaggcctgtacttctctttagagagtgttgagtgtggcttagcatagtgatagtcatcgtgatgattggggtttgctttcagcacctgtaggtggggcccagaatgacagatggttccacacaatgaagaatgtcccttacgcagtttgaaattctaatgttctgcagacatttttgtagg

SEQ ID NO: 12095 - DNA, 201 bp, Bos taurus
cggctttctccagttgcagcaagcaggggctactctttagttgtgctgcataggcttctcattgtgatgacttctcttggggagtgtgggctctagggccggcaggctatgctcagtatttgccattcccaggctctagagcacaggctcaggatttgcggggcagaggctttgttgttctgcagcacgtgggaccttccc

SEQ ID NO: 12096 - DNA, 201 bp, Bos taurus
atttttaaatcccagctagaacttcaaaactactttagaactcccgaagagacgccgctgtgcttgttagctttaagaagcacacagctttattgacaaatgcatcacctccataactaagaaaaggggtgatcgacaatttcatatttccactttcagggctcgttagatcattacctccagaattgcggctgacatgcc

SEQ ID NO: 12097 - DNA, 201 bp, Bos taurus
tagaaaactgaagaaaattgcattggaatgcggtacaggcttaagagcatctcttctttaaccagccctaaaggctacaacattgggttagaaaatgtctataagaaggatattgaagcatggtaaaaaaaatacacccagatggcattttaactttaaaggtaatacaatgtgtttgacaaaaacacattcaatataatt

SEQ ID NO: 12098 - DNA, 201 bp, Bos taurus
taccctgaaaagagaccagcatctccacatctgtgctgccagcttgcagaaactgccacatggaggtctgcacctggcctctgctcatagggtctcaactagacacttgagtacttttttcttacatcaaagaagaatggaagcccaagaactaaagttatggctccagctcccagtctgtgctggcctcagactgccctg

SEQ ID NO: 12099 - DNA, 201 bp, Bos taurus
gaaaggtggagggttgttcagtgggcacagaggttcagtttgggatgatgagagatttctggaggtgaatagtggggatggccatacatcaatgggaatgcacctaatgtcacagaactgtgcacttacacatggttaagggacttccctggtggtccaggggctaagactgtgctgccagtctggggggcccaggttcga

SEQ ID NO: 12100 - DNA, 201 bp, Bos taurus
tcatgacatttgtggagtgacaactatgtgttagggaccgggcacatgggagaataattcattctttcatcaagctcatagggtcctgttactgtcattggtgtgttactagtggggaagtggagacatggagagtttaaggaagtcatcagtctaagattaaacatctggtggttagttatcagagatagactggaattc

SEQ ID NO: 12101 - DNA, 201 bp, Bos taurus
gacacaattggaaccaaagaggccctggactccagacaaagagagcagcgtttcatgtgacgtgatggttagggaatacacatgcacgcccgcatcttagcgatgaggccgtcaggaatttttatcaaggccccgtttcccaagtttccttccaacatgatgaatcaaagctcagcacctctaattaagggtgaccttcac

SEQ ID NO: 12102 - DNA, 201 bp, Bos taurus
gtgccccagaaaggggcctcagcacctctgaatgggaccttatttggaaacaaggtacctgcagaagatcaggttaaaatgaggtcacaagggcaggccttgtccaatatgactggtgtccttatgaaaagggaaatttggatgcagagacaaatagccacacaggaggaaggccacatgaagactaggtttgtgctgctg

SEQ ID NO: 12103 - DNA, 201 bp, Bos taurus
gctgatttcatgcctctggagaagcataaaccgtgttctttgtctgaatgtcagtttcacctcagcatagtttctggttctgtctgtcagcttcacagatctcatgtttcaactctccattcacttgtcacctctcttgagtggaggagggtacagagccgactcctattagagacggcagagcagactaaaaggagtgat

SEQ ID NO: 12104 - DNA, 201 bp, Bos taurus
tcactccagtctctggctccatctccacgtgatcctgctttcttctctgtgttttctcctcttcctacaaggatatttggtattggattgagggcccacccggttaattcatgttgatagcaccataagatcttagtcacatctgcaaaggatctttttttccaatgtggccacattcatgggcgccaagttgtcttatct

SEQ ID NO: 12105 - DNA, 201 bp, Bos taurus
aaacctgattcctcttccccctcatcacccagctgtgaaacaagcttctcaggccccagtatatccaataattcctctgaaactggactccagagaggtgagaagctctcagaatcatagacggccaccccagatctctataaaactctagatcctagcctgagaattctttattaataaaccattggttgttatttgcat

SEQ ID NO: 12106 - DNA, 201 bp, Bos taurus
cccccagggctctctgaggccctgaagcaacaccaaacgctgtgtattctaatgtaagaagagctgaggacgggaatgtgcagactgaaaacagcagttcatgccatgttaatctgtgagcatgggccagacggcttgtcaatgtcatcacaggaaggctgcctctagaggttcattgctctactgtcaaattacacttct

SEQ ID NO: 12107 - DNA, 201 bp, Bos taurus
agcaaccacaccattttacatttccatgaacaggagtccagtttctctacattcttgtcgacacttggtatcatcagccttttgtattttggccatcctgttgttctcattatagatttaaagattttttgatgtggacaatttttaaagtctctactgaatttattgcagtattgcttctgttttatgttttggtttttt

SEQ ID NO: 12108 - DNA, 201 bp, Bos taurus
agttgttccagcttctcctccacgctggggccactggggccgcctcgccagtagaagcccatgggaccggtcatgaagtagatggccaccacgaaacacaagggcagcacggcattctcaggctcgccctcgtacttgtgcaggatgtacacgcaggacatggagaacagaatgacccgcaccacccagaagaagcggcca

SEQ ID NO: 12109 - DNA, 201 bp, Bos taurus
ccattagctctcaaaccagattttcacaggcttgtgaaggacttctggccctctggggacaggctgatgttgcaccagctttatacctaaatggccaagccgaacctgccgcaagtaaagaaggttatggagagtcaggatgccaagagctgtgggtctgagccctgtgtagtctcctgctcctgcagaatcttggccaag

SEQ ID NO: 12110 - DNA, 201 bp, Bos taurus
ccccaggcttttgagctgctgaccttccccctgcagcatcctcttctgtaggtgccacaggcagtggcccatgcccaggccacagggtgcagtgaaacctgtacagaattgaaattctagagttttggctccctgccccaaatcggtgtgtctgtggccaaaccaagtggccttgtacctgtaaaaacgaggacagctcca

SEQ ID NO: 12111 - DNA, 201 bp, Bos taurus
gttactatccagctctgggaagaacatggaggtgatgtgaaaatgatacagaataagctccaattatagaacattcagtgaatattcaagaaacaaaatgatgtgtatagaagtctatgtttgtgttaaaaaagaaaaaaaggagggtatgattgctcatcaaggaaatgtacatcaaaaccacaatgagacaccacttca

SEQ ID NO: 12112 - DNA, 201 bp, Bos taurus
cagaggacagtggcacagctgtagggaagacaggctctggacccgggttctgttggcgaccttcctctgagcaggtgctattttctgggaatctggctccgacctggggaagggcccacttcccagtctgagagcctcgttggaaccagatctgaggatgggagatgcccatatgcttctagaaggcagggagttggtttg

SEQ ID NO: 12113 - DNA, 201 bp, Bos taurus
tggagctcctgctgtatacactgtcggcccagcctcaaccaggctaccctgctttaggattgaagtgacttcctgggggctgtgggtcgcagaccctcccctcctcaatcctcagggcctggaacctattcactgagtgatgctcagagcttccagatgacaaggccagcacgtgtcattctctgaatctctgatatgagc

SEQ ID NO: 12114 - DNA, 201 bp, Bos taurus
tgaatgggtgtgtaggtggatggatggatggatgggtagatggatggatggatggggtaggtgaggccctatggcatggggtctcgcaggccacagttggaagggtttattttggggaatgtgggagctattctgggcagtggcgacccctcagagtgtcaaagtgagtgagtgaccctgcctcagcctcaagggccacag

SEQ ID NO: 12115 - DNA, 201 bp, Bos taurus
ccccacccacaccttgattttagacttctagttttaggaattgtgagaaaataaatcttggatgtttttagcctccctgtcgtggtcccttcttatagccgccctaggaggcacatacagggcctgaggaggagcaggaaaagaaagaaacccctcccatctcctgctgccttcgctcatgctggcctttgaacgctttca

SEQ ID NO: 12116 - DNA, 201 bp, Bos taurus
tatagagaccccacttgtcctgttcacctgctgaaggaactttggatgagccccaagttcagggcggtttcaaagagtcctgctctgcacattccagtacatgatttttggtggccatatgcacatgttcatagaatggctggatcatagggttggtgtgcgttgaacattctgagaaactgctcaacctctttgccgagt

SEQ ID NO: 12117 - DNA, 201 bp, Bos taurus
aggaattcaggcctggaaggggctttatcaaataactaagccaaccctctcttcgcaaaaaggaggaaaattatgtgaagtgacttcccaaaggcttgttaacagagctatccagatgaaaattcagatggtaacacatgtaccccccccaatcccatcttctactttcacccactcagttatatgccccttttaaatctc

SEQ ID NO: 12118 - DNA, 201 bp, Bos taurus
gctggaggctgcccagaaagagcgggaggaggacaggcagggccaagtggcgccatcacagccccaccagccttggccacctccttccttagacgcacctcccctgaaacaagcagcactgagctgactgtgctgatgtgatgccccgggggcagcccctcctggccagggtcgggggaggacggggtgctggtgcccctg

SEQ ID NO: 12119 - DNA, 201 bp, Bos taurus
cctcagcaaagctcggtcttcctttcccaccgaggcctgccccgagctcgtcgcgacggaagattcttcttcttagaccgaccggaccttaacatctgaaacagcagattcgtcacaggccgtatttccgtctttccttttattgtaggaaatttaatcacaggcattgagcatcaaaggcgtatcgtctccgaagagagt

SEQ ID NO: 12120 - DNA, 201 bp, Bos taurus
taataaaccaaaaacatcaggcagaagtcctgtgagaaggtggccatgtgtccgtcctgttaaggaagagagaccacagaaccgagtggggaggggcacacgagccatagaagcatgggggccccccggactggccactcccaggccctccgccactggaagccgggcctcccagtgaccgacaccacccaggtccccacc

SEQ ID NO: 12121 - DNA, 201 bp, Bos taurus
gtgagggagtgtaccacaggcctcgagagtgggggcagctgagtctggtctccctagtttctgcaatgtggactggggccgggtatttccagatcttcccactttgccaggggagcccaaactcaagatttcaacatggaaaactctcccaaacatagcatagctgcatgcctcatccagtcttggggccaccgagttgca

SEQ ID NO: 12122 - DNA, 201 bp, Bos taurus
ctgacttcacctctctgagcctctgttttctcctccgtaagatgggaacaataacaggagctgccccacgggattgttgtcaaggtcttagcccagtatccagccatcagtaaggggcggtctggtcctctctcttccatagctcagatggttattaccataaggctgaagaggggagtggcccctctgccagtgacaggg

SEQ ID NO: 12123 - DNA, 201 bp, Bos taurus
ccctcaggaagagatgcctgagcgtgggaagtgcaggaagggaaccctaggaagtttctgtcaggcgccggcatttaataagggggtgtgaacctgtttatatgtgggccaatggctcgggcaaacaagtctggctacatacgtgaaacttttcaccaagcagataataagatattgtgcggccctggaaaacaactcagg

SEQ ID NO: 12124 - DNA, 201 bp, Bos taurus
tgtaaaacagttcaaaatgctttgttctatttattctatagtataaaggggatgggagctatttttaaaagttctgtcctcagaatgctcatgtgcctttttcagacacccacacacaacctgacttttctattttccgcaactaatcaccaagtcaagctgcactcaagccatcttcctctggtttgtttttgttgccac

SEQ ID NO: 12125 - DNA, 201 bp, Bos taurus
ccatggacagaggagcctggcaggctacagtccgtggggtcccaaagttggacactacttggcgactttcacttttgtttcttttgctagactgcaccctctatgaaagcagggccgtctctatttcgctccctcttgcatcctcagctcctagaacagtgcctggcacacggaactcggtaaataaatgttgaatgaatg

SEQ ID NO: 12126 - DNA, 201 bp, Bos taurus
atgtttggtattggtggtagtggaaatttggggggtttttttggttttgtttttcgctttggttatggacttttgaattttctgttgatgttttttaacattggattgaatttaattaatgacaggcagtaacatccaatgaacaaaagaaagggttcgcacagttgtttgttgcaaacctctgtgatctcattcaacccc

SEQ ID NO: 12127 - DNA, 201 bp, Bos taurus
tcgttgtgcctgtgagctttctctagttgcagagtttggggctactctctagttttggtgtccgggcttcttcttgccgtggcttctctccttgtggagcgcgggctctctgtgcacaggctctttagttgcagcatgcaggctcggtagttgtggcttgctggctctaaggcacgtgagcttcagtagcagcatgggggc

SEQ ID NO: 12128 - DNA, 201 bp, Bos taurus
agtgaataatgctagactggtctctcttccaggactccgactctttttcttcaaaagagcggtctccattggcttttcctgggatctgggcctggttccacgggctgctaggagccaaaactaacaggctccagacggacaaaggttcattgaggagccgaggcgtggggagcggccccgcgtgaggcacggcaggcggag

SEQ ID NO: 12129 - DNA, 201 bp, Bos taurus
tcttattttaagtgggattgctcaatttttaaattttgccatcaagttccaattaaaaataaaaacaacactgggctttggggccacacccgcacaccacgtgctggatctagtttgtctgcaacctctgtggactgtaattctcagcttcaatgcctgtcttgcccatgagctcttgggagtctggagtgggactgggcc

SEQ ID NO: 12130 - DNA, 201 bp, Bos taurus
tcaaaggacctgggaaggagggagggcccctcctcccgccacccacaggggcacagagctccctctaagctcctggctgctcatgcctttcaggatcacaagttccaaagcaggtctccaggagggccagggcaggtgcctggaccaggagagggtaggaacagagccaaggaagatgacaatcctccccacaagagaatg

SEQ ID NO: 12131 - DNA, 201 bp, Bos taurus
ttattttacctagattgtgtgtatttggggtgtctggggtcggagggaggaaggagtttgcggagaaggagcgttgccttaacggagccgaagccagccacggcctgaaatgctagaactgacattgaccatccagcaaggtcgccgggcagggcggggaagctcagaaagggccctgtcatctcatattgtcattattta

SEQ ID NO: 12132 - DNA, 201 bp, Bos taurus
ctctttcctgtacccttgcatcttcaatttgggacagcatccttactagaacccctgcttttaggcttaaaaagtgcttccagtaattttgttgggccaccaggcaggtcctattatcccactttgcaggtgaggcaactgaagccagagagggtcagggatttacttaaggcctcactgctgggaaacagaggagcagga

SEQ ID NO: 12133 - DNA, 201 bp, Bos taurus
tccactcttgaaacaatcacttgaatagagcagttgatgcccagttgaccagacttgagtcatagtggaacccctaaagctgacagcatggccagctccacggagtcccctttgacacacaaggattgattcctgacgtgaatcaggctgctgttatcatactaaaggaacttggatggattcaaggccggctaaagaaaa

SEQ ID NO: 12134 - DNA, 201 bp, Bos taurus
aagcacctgcaggatttgattcaggggagtggcatgatcagtgttggcctgaggaaggtcccacatggagactgaattttgggggacaaggaggccgtggaggcttcagctgtgtgtgccaggcatgaggttacagagatgagcacgggacagtgccagccctcatagggcttctggcctcttgaggaagatgaatctgga

SEQ ID NO: 12135 - DNA, 201 bp, Bos taurus
aacaataaaccgcccccactgtgaatgcatgtgtgtgagcatgcgtgtgtgtgtgtgtgtgtgtgtgtgtgcacatacccgctaaaggccctgagaactgtttcctgtcagttacttgcaactgacagatttctaacatagaaataagtcatctgcactcttatcatgggtgataaacaccgtggcccatccgccactgat

SEQ ID NO: 12136 - DNA, 201 bp, Bos taurus
caggcactaagccaagcactctacttactatagtgaatgtattaatacctttgtcacttggcatccattttgctggcttctgggaaatctacctgaaattccctttgggaaacacctttcctaactctccgtggtttgaatggggctgtgacctctcccaggagagggcacctgactcagtcctggccaatcaggacagtg

SEQ ID NO: 12137 - DNA, 201 bp, Bos taurus
caggtgcctaaaaataggctctcagaaaccaaagagccttgggccatttacttttttttttttttggtttctctccatattaaattgtggaagaaaaaaattaattcccaatacaggctatgtggcccaataatgtgacaaagaagcagaaatctctatgatgaatgtgtcttttgttaatcccaccggagactctacaat

SEQ ID NO: 12138 - DNA, 201 bp, Bos taurus
gaagagcttattacatttttccttcaggattgatactttagctggctaattgatgagaatgactaatcattttggaaaataatcttgtcttccacatgataacccaaataaaggaaaaaaatgtagcctgtgaaatctgcttctatgttcacagattttctcctcctaggacccactattgccagctgttgcatgggactg

SEQ ID NO: 12139 - DNA, 201 bp, Bos taurus
ttagctcacaccagcagattatggtgcaaatacccaactcttgcccccagcctgggcccccaggcacattgctatcagttacccctgatagctatggcccttcacactttacatctttaatgaaaatggatcaaatttgacactgtaggtgtacttctgctatctaggcccaagaatgattaaaaatttaacctgagttgc

SEQ ID NO: 12140 - DNA, 201 bp, Bos taurus
ggaactatgctcacgggtcatttcccttcctttttctgtagctgatttctgttcttggcatagcaggtggtgaacagggacggccctgccattctctaatgcaccactggagggcagcaaagcacctctcaggctcagcaacttctcccaggattcgggaatggggaaagtagacttgcaggcagggcccaagttcaagga

SEQ ID NO: 12141 - DNA, 201 bp, Bos taurus
tttggggacaatggaggcctttgttatctttcccttcttcgagtgggccactgtctgtatgagaatccagattacccttgttggtggcgctgatgattacctctgagaatctgttcctaccggcctctccaggcaggctgggggtgaatcgggggctgcacaaagccaagaatgttatcacggtgaaccaggacaggcccg

SEQ ID NO: 12142 - DNA, 201 bp, Bos taurus
tgcaggccaagagctttgggctcacttgtcccatggccccggatgtttgttgagtgtgaggaggtgtgtatagcttcaattcagtggtttcatgcagcctggtcgctgagcgttggagtggccaaggcagcaaaggcggcccatgtccccaggccagaccatgctaccaacgccactccgatactggcaagaaaggtgacc

SEQ ID NO: 12143 - DNA, 201 bp, Bos taurus
atagtccatggggttgctaagagtcggacacgactgagtgactttcacttccttataaaggttaccttaaaatacatagctggatttaaaatacatggccgttttgttattcccatttggtgggtgagaagttgactcactttctcaaactcacataggcaggaaatacagagctgagattggaaccttgtttgcctgcgt

SEQ ID NO: 12144 - DNA, 201 bp, Bos taurus
atgtaaggaaggtgcctgagaagtgagtgggctcaggtgacacctgcaggactcatttctctggcttcatttttgtgtcatctcatggaatgagaggagggggcacatgaaaggagatctttgttgatcaccaagtctagatatcttagacccttagagttaggactataatttaagtccatatcttaggtacaaattagg

SEQ ID NO: 12145 - DNA, 201 bp, Bos taurus
tgtggctggcgaatgactgaagagagtagaaggaagtgaggacagaaataagtcctgtgggcccttgacattgagatgagcagtttggccttgatgctgagtcaggggacagctatggaagggttttgagcagaggagggacaggatgtgccttggggttgacaatatgcctgtggctgcttgtggggagggctgtacagg

SEQ ID NO: 12146 - DNA, 201 bp, Bos taurus
cctggacttagggaggaccctaaatctgctgaagggtctccttttaagaagaagaaagggagttttaggaacactgagaagagggccatgtgaagacagcgcagaggttggagtgatgcagttgccagccaaggcgtgcctaagaccaccaggagctggaagaggccgggaaggagcctccactagagccttcagaaggag

SEQ ID NO: 12147 - DNA, 201 bp, Bos taurus
gcagtcgctccccatgcctcacctcccctgagccccagggaggccccagtctgttttctgtgtctgtggctctccttgttctggatatttcatatgagcggaaactgtccaaaaggtggcctcttgtgcctggcttctttcacttcgcgtaatgttttcaagtttcctccatatggtatcagtgcttcattccttttatga

SEQ ID NO: 12148 - DNA, 201 bp, Bos taurus
gcgcgcggacacctgttcaccgcgtccgcgagcgattcgccggttcatgcatctcctcagcggcgcccaggcgacgctggcggcctgaactcctgggcgcgctacctgtggagaccgctgttgccttcctaacggtcttggcgcttctcgggtgcggtcacgcccccggcctcacacccacctctcggtatggccccgccc

SEQ ID NO: 12149 - DNA, 201 bp, Bos taurus
agtcctttgaaggatttactactgttatcacttgtattttataaagaaactgaagcttagagaggtcaagtggcttgcttaaggtcacacagcaaggaaacgatggaaccagtggtttaatcagacatgggcaaccagaccaatataaaaatttaggcctcacagataggccagtgggtaacagatcaccttaggtgaacc

SEQ ID NO: 12150 - DNA, 201 bp, Bos taurus
atacataagagcagcagacatgacaacccacaaaagaaatacaattgcttaacgtgaaaagatgttctagtttgccagaaattgttttcttttaatggtgcctacttccagttaagacaagcaggagtggctataaatgaatgacagtgacatagcactgcctttaaaaatatatcttaaaaatagaaaaatacgttaaag

SEQ ID NO: 12151 - DNA, 201 bp, Bos taurus
caattaaactgtttacaatgatcaacatcttagccacacacaccccagaacctcattcctcattagctgggcctgtcttccttgccgttttatctagcaggtcttgacagtgtactgacccagcatcaaaatatgcctttcttggaaatgcgactctaattagaaatggctgataaaccttcattgaaatgagcattcttt

SEQ ID NO: 12152 - DNA, 201 bp, Bos taurus
ctaatgctgatatgctttgaaaagtgataatctcgcttttttaacatagcaaggctgggctcagagagagcatccagctggccacagaatctacatctcagctttaatcacagttttgttttgctatttttatttttactagaaccttctatttatggcaaaagaggttgatttttctatttattatagtgtatcaagttt

SEQ ID NO: 12153 - DNA, 201 bp, Bos taurus
ccgactctgcctatctcacttcagcatttttttttctactcaatgtcacactctcctgcagcaagtggaccttctctatctggcagtacatatggcacctggaagctctggaagggcctttgagttccatgaccatagacaataggctatattttctccagctccaagtagaaagtctcagggaagagctctgattggctt

SEQ ID NO: 12154 - DNA, 201 bp, Bos taurus
ggtgggctgccatctatggggtcgcacggagttggacatgactgaagtgacttagcagcagcagcagcagcctacccccactaatcccacttccttacacccttcttcttggattttaccttctagtcattgacacacattaggaaacacttggttaactctttctctctgtttttagatgcattgtctcatgggacattc

SEQ ID NO: 12155 - DNA, 201 bp, Bos taurus
cagaggcttctctcttccaaaaaatcaggcctccgtgccagcagagtcaaaggggaaataatgtgaaattctaaaccctttcctgaaagaaagagcaaaagagagtgaggatgacttatatcggccatctctaaaaaacggggtgtatggtgggcagagctagaggcagagggaaacaaataagaaacatacctacatgct

SEQ ID NO: 12156 - DNA, 201 bp, Bos taurus
gaagcttgcaggcatttatgagtggtgtttttaatacggtgctggaatatttgccctataaattcttaagaacagacttatagattgcctattaccagcattatggactattaataaatcagttacaggcacgtatttttttttttgaaattgcattttccctttatgttcacattctaagcacctaaaaatcagagagag

SEQ ID NO: 12157 - DNA, 201 bp, Bos taurus
tggtggcatgcatcgtctacttacattctatttctcacttcccacaatttcatgaaaagtttcagaattgattttggtaggccttaattggcaccacctgagtcactgactcatcctgaaccaatcagagaggacaagagatatggacctctgattgactgggcctcagtcatgtggccatttctgaagccagaattcaca

SEQ ID NO: 12158 - DNA, 201 bp, Bos taurus
aaagcacttttggacctatttatacatcaattttttatcacatataactctagcacatattttcttttaaaaaaagaagcataatacatcagctaagatcatccaaaaatgttttcaatacaaagtctgggtcttctgaatcatttttaaaaccagtgtccatgttttcttataagctgtggtcctgtgtgccgtgaaaag

SEQ ID NO: 12159 - DNA, 201 bp, Bos taurus
aatacatgaataagtgaaagatctcatctctgttggctcactgtccgctgtccaaatacatgcaacgttttttcaaaataaaattacaagttctggtaacactaggcccctcccataatggcaacactgggctggagctgagctgataccctggacagagcccaggtgctccaggtccccacggtggccaaaatttgctgc

SEQ ID NO: 12160 - DNA, 201 bp, Bos taurus
gcagtcacaaagctgaacacacttgtttccatggcaccagaaccccttttaaagaagagaactcatcaattatttccggcctgctcacttggtgaatttataccctcccaaacaccagcacttaccctggtggttggagagttcaacagtaattgcagaggccctaaacctaaggatttgaaagctgggtatccataatcc

SEQ ID NO: 12161 - DNA, 201 bp, Bos taurus
ttacgacagtacaccttcctgcctgaacaacccagctgtcccaaggtctccaccagtggttcacaccctagaaaatgtcccaccatttcccacggagggctgtaaaggctgaagtcctgctcagatagagcacttcaccaggaacacccgttttccaacgggttatttggtttgagtttctcatcggagccacactccatt

SEQ ID NO: 12162 - DNA, 201 bp, Bos taurus
atcaaattaacacatacttccttaagagtactagttcattaaagcaagtaatatttaagtatgactttactacctatttctcttccaaacctgttatcacatttttttttcttaaatagtatttgactttttttaaagtggtcctttatgtccttccatctagatagggcttatctttagttgtccttccaaacacgatta

SEQ ID NO: 12163 - DNA, 201 bp, Bos taurus
taaaattaaatgtttgtcaatccagcatatctaaaatgtcatctcaacatataatcttggtaaattattgaacatttttagatttttgtttttgtactgaatcttcaaaataaagcatgtattctgtagctaacaacccatcttaattgggacttgccacatttcagaaggttagtaaccacatgtggctagtggctactg

SEQ ID NO: 12164 - DNA, 201 bp, Bos taurus
gtccctgttgatttgggcaaagaggaacagggcgaaggggaagaaactgttcctctctaacaccttctggttagtggaggaagtagcacagccctgccctgtcaagctcccccagtctgattgctatcggagccctgaccttgctgagatgggcaactaccagcacacccattttatgaagatggagacttgactgcatgt

SEQ ID NO: 12165 - DNA, 201 bp, Bos taurus
cagggagagatcctggaggcttactaccaagtgaaaaaatgatataattgatgtggggaaaaaaaacacacaacaaacaatcctaacatcaaaccacactacagagtttctacatatatgtacacatggaaagtagggcttcccaggtggctcaacagtaaagaatctgcctgcatgcagaagacacgggttccatccctg

SEQ ID NO: 12166 - DNA, 201 bp, Bos taurus
ccagggctctgctttgaacagcatgccttcctccagctaacatgacctctcctctgagattcagcttagaatcctcctcccagaaaccccatctgagctgtcctgtgtcagcgtgtgaacaagggatgcatgcttcctgacagttgtctgtctccatgactttgctctaaccccagcggggatgggtgcctggtctgccct

SEQ ID NO: 12167 - DNA, 201 bp, Bos taurus
tctaggctggaaccacaaagttcctatcaggctttaactggggcactgctttcctttcctcccatgttgtgggacatataatgtgactgatacagtcttatgagtctaccagcccaccgtctgtaccctagtttacaggtggggtaggtcctggtactcaaagtgcatggatgcatgggaaaagcatcactgtaaattcaa

SEQ ID NO: 12168 - DNA, 201 bp, Bos taurus
tggcacatagtaggcctccaggcatgtttgttgaatgactgaatgactgttttgaatgtcataatatagtaataatatagtcacaaccccatgcagtgactgctttctgtctaccaggccctgtgtgaagcccttgacatgtgtaaccttgtctaatcctccaaacaacctatgaggtcaatagtgttattatgcccactt

SEQ ID NO: 12169 - DNA, 201 bp, Bos taurus
cctgccttgcaacctcagaaaccttcacttgctcttaaaatggtctctctctaaggaacacgtctctccccttctcttgccccatccaaccctgtttctgctgaaactcccacccatggatggcagttagctctatgttgccattttagtatcacggtaaaaccctttgctcaacctcagtaagaatatctttggagtcaa

SEQ ID NO: 12170 - DNA, 201 bp, Bos taurus
atcggattcttccctcctggtggcaggtccacactcatcctcctggccagtggcttttcccccaagttggggaaagcagggcagggcctctgctttttttcccattagattcatggttttccgaagtcatagactgaagaaaaagcacagggaaatggaatgaccttcagcttattcatggaggccccatgttaaccagga

SEQ ID NO: 12171 - DNA, 201 bp, Bos taurus
agatgcctaaagattttccccagcttcttcctcctctctctcatgtctttcctctgccccggtgccccctacctcaaggaaggcggtagattttcatttccctttcttggcccattcatcctgaccttgctgtccagaataaatcctcagaaagccccaagccttggggctggatgcccgaacagtgtcaggcgtgatgtc

SEQ ID NO: 12172 - DNA, 201 bp, Bos taurus
aacgccagacactcccctgccaccccgaaaaacagcaacatcttcactccctctttctccacaaggcggcagtggggaggcaggaagagcctcactctgaagtcagtatggcccagtgctaatagctgcttttaccaccagataactggagtgagtcactttgcctctcagagcctctgctttcccctctgtacaatggga

SEQ ID NO: 12173 - DNA, 201 bp, Bos taurus
gcgagctgggctatgctgctctccacaggtttgagtggttcaaggacctgggactgaagtggtacggcctccctgctgtgtccaacatgctcctggagatcggcggcctggagttcagcgcgtgtcccttcagcggctggtacatgggcacagagattggcgtccgcgactactgcgacagctcccgatacaacatcctgg

SEQ ID NO: 12174 - DNA, 201 bp, Bos taurus
ctgaggaagcagaagacccattaaccataatcagatggaaagttccgcctctgcaaaaataagcaaagtttcacagcaaaggcttggctttcctcacgttcgagtgggtggcgttcatgttggagaaacatcttaatgcagagtcctcaccagcgctgctaacaacccacccacccacccaagggtatgaaagtttgctgg

SEQ ID NO: 12175 - DNA, 201 bp, Bos taurus
tacccaagcaggaaggtaccttgtcctaacacagctctggactcccaccgttctccacctgccccttctccagtgggccagccttgcagttaacctgtagtagctaacttctgaagttagaacctagttactctactctcttaagctgaaaagatttccagttgctatagtgaatgaagctctgggggccgtgatccagcc

SEQ ID NO: 12176 - DNA, 201 bp, Bos taurus
caaaagtaaccgagccgcagagaaccatgagacatcatctgagtgggccaatgtaggcattataggagtcccagatgggaggagagagaaaagggagtagaaaggacacccgaagaaatgaaggccaaaaactctcccaaattggagggaaaacattcatctgcatagcaaagaagctcaacaaacaccatgaagaataaa

SEQ ID NO: 12177 - DNA, 201 bp, Bos taurus
tattttgggtgctgacaggccctatgagtctgtcatgagcagaggtgggagagaatccgtcagtgagactgtcaccttccaataggtcaggttcctcatgcggagtccagcaggccccaccagggctcctggtttgcagatcgccggggaagagtgagtgtcacaactgttcccagtcagagcctgtgctcagcggctctt

SEQ ID NO: 12178 - DNA, 201 bp, Bos taurus
gccattttccagttccctgggtgtcagagaaggaacgatgccattcagtgctgcagacaccaaacaggtgaatattgaaatgatgctgcacaaaaggacacccccctggcagatctgggcaggctggaagaaaggtagcatttattgacatcagaagctggggagagatttctatgactacagagattgggtgagggtctt

SEQ ID NO: 12179 - DNA, 201 bp, Bos taurus
gacacaacttaacacatcacagtccctaagcatatgcatgtgtaaatagtttttccatttcatttcaaaagactgctcttctcctgattatacttcaagaaacgtggatctcattgcagttccttcatttgcagttgtggtgtctgaggcccagagagagatagtcaccagctcaagatcacaaagcagattagaggcagg

SEQ ID NO: 12180 - DNA, 201 bp, Bos taurus
aggtgggtgcaggcgtccagcatccgtgcgcctcctgccacttggagcccccagccggaaacctggacccctcgctgctcagcctgcagatcagaaagcacgggcagtgggcccacccttcagtgttctgagtcagaaatgttgatttgttatagtaacatgagcacaggggaaagacgagaggcaagtgagcaagcgaga

SEQ ID NO: 12181 - DNA, 201 bp, Bos taurus
atgtatgtgttatttcagaaattttgcacatgccctgctttaaaccactgattatttttgtaaaatgctgttgtgtggatttggctcattccattgacgccgaactcatcagatggctatattgtcttctaggaatgtgacttgaattgattaaatggcataggcaacaacatctgttttgtgaagctagtttagtgtcat

SEQ ID NO: 12182 - DNA, 201 bp, Bos taurus
gaatcgataggaaatatcttgaacttactttacttttctctcaaaatatatgaatttcatatgaggaattatatagtatttgcaggggttattttgcctcgcagttgagaaaagacaaagacttttcagatattttgtttaaggtgataattatgacattgatgacttctataacaacttttttatggtaaaaataatagc

SEQ ID NO: 12183 - DNA, 201 bp, Bos taurus
agggatgtatcatagtttggttaaccagtcctttacaaatgggcattttgtctgtctgtagttgttaactattacaggcaatgctgtaagtgttatctgtatagtcttagaagtggcaaaagcctccttaggtcatcagtattgtcctccttgccctcttgtttcttgtaatcttaggggaaaaaaaagaattttatagct

SEQ ID NO: 12184 - DNA, 201 bp, Bos taurus
aaacattagatcagagagggatggagtcaggttacacagctgaatctcctctgagataccaaaatcactgtggtcgattcagctcagggaatgtgttagttatagaagttcacccccaggttcccagaggagagaacttgtgctcagaattctgcgagagggtccttattacatacagggcagtcaggctgatgggctagt

SEQ ID NO: 12185 - DNA, 201 bp, Bos taurus
ccttcctttttggacttttatgaaggcttcactaaatagtcatgattgattaacttactggccattggtgattgattcaacctcaattgattggccagtgagaatcactggagaaaggctggaggtcaggagggagggaatgactgggctgttctgtttctccagctcctcttgggtggcctctcttccatgtccttcgcc

SEQ ID NO: 12186 - DNA, 201 bp, Bos taurus
cacttaaggctacttttgaaagtaagcttatttttaaactggtttctcagtataacactaggctggaggcatgaatgcatgtactgtgtgtttgtataccgtatccctagttgttttgcacataataaaaggaagaagtcaggagggaagggaggaagggaccatctagtacagtggagagagttttaaaaggtgcagtca

SEQ ID NO: 12187 - DNA, 201 bp, Bos taurus
agacacgtttgggatttgaacgtaggcagtgccatctcctagctgtgactgacacatgctcagctgggttcattcgaggttggcctttcttctatcagaacggctctccctgtaagtcaccagatatgcctggggtccctatgccccgccccactttcagggtctctcgatgctattcttctgggccggcagtaaaatgac

SEQ ID NO: 12188 - DNA, 201 bp, Bos taurus
aaaggctctttgagttgtgaggccttgaggaggaagacttaggggtgttctcgagctgtgactaatggggcatgaaggtactggactactgggccaaagtagggggttcatgctagatttcgtagtgatgtctccatagctgctgtttagtttagtcttgatggatggcctactgtgtttctggacctagatctgagtctg

SEQ ID NO: 12189 - DNA, 201 bp, Bos taurus
agtgtcatcatttcctcctcaatcaggtaccatcctgcgctgttgtgagtaacccctccttcttgagaaatggtcttctcctgactcaggcaccaatatctagactttgtcttttgttggcccagagggcttagggaagtgctgaggccacaggggtttggcaaggagctgggtgagaatcctgttttaactgcctaacca

SEQ ID NO: 12190 - DNA, 201 bp, Bos taurus
cttatgctgatatccctactttgtgggtatttgcccaaaccagagaagatgtggcacctggaaacttgggtgatggctgccttgagcttcatggcccatatctcaaaggaatagtgccagacaccatccttctatgggatcatagttttattacttttaacaccagggttgatggagcaaaaacttatagatgtgtcctga

SEQ ID NO: 12191 - DNA, 201 bp, Bos taurus
ctttggactaaatttgactttttccacagtccctgaagcgtgagttctgtagtagttttccacaagtctgatctgaggaaattagatcttgggacacaaattgtgagtccaaagaatcccctcaggcttgaatcatgtaaaggcgggtcatggaaatctcccagattgctcctgtgttctcagatgccctcgggactcaag

SEQ ID NO: 12192 - DNA, 201 bp, Bos taurus
cctcacccaggctccccagctccagactccctccctgggaactttagaaggatgccttcagcctctgctgactcagcgggtcaacagggacctctgacacaccctggcctttacagaaaccttaaggaggaaggggagagtggctcggagggcaggtttaaaattagaagggagcgcaaggctgcctgtggttcttgaacc

SEQ ID NO: 12193 - DNA, 201 bp, Bos taurus
caaggagcttctgctcccctgaggttgagtctctttggttatcagcagaccacagcggcctgataactttgggcgaggaacacttagtttgaatgggaggtacccatcttcccaactttccatcgtggaagaagaaaatgccttggcaaagataaatgactccaattttaattcagacccgacatccatcttggcaaaaac

SEQ ID NO: 12194 - DNA, 201 bp, Bos taurus
aaggttttgatggagctgatttggtgtgaagctcaagcaggtctagctgggaaaattcctccagatggttaagtgcacagtgaaagttgagtgaatggatgatgtccacagttgctcacaggacaagcatgctcctttcccttagtaactccctattctccggagacctgttgaacccactacccagatattcttaactcc

SEQ ID NO: 12195 - DNA, 201 bp, Bos taurus
aatattagctttaaatattagagtgagtaataaattattcacccagaccattgctggaaaaataagtgaggaattaagtttctaccatcagaacaactatcttacaatttgcaatgtttgaaaaagggaatgatgctaaagatctctaattctggcttcttacaaatagagagatgagggttgtgtttacaaaatataacc

SEQ ID NO: 12196 - DNA, 201 bp, Bos taurus
accaactaagcaatgagggaagaaccatccaggtaggacctgctaactggtctctttttcgtttgtcatttttctgcccccactggccaactttgactttcgggtttgaacaggtgggggtagagaaagagcaatgtgtggaagttcttgcttgactgactcaattaatggttctagcttctctagactgaccggccccca

SEQ ID NO: 12197 - DNA, 201 bp, Bos taurus
atataatatactaattttatattcactcagttaattattcaacagataactgtcagcactgtggcagacagacccaagggtggcccctcatgactctgaacccctggggttcatttaatcccctcctcctgaatgttgggtgttaccctatgacttgcttccggccaatagactatgggaaagaggaaggaattctgtaga

SEQ ID NO: 12198 - DNA, 201 bp, Bos taurus
tcttaatccttgataacttcctcagtctttcaaagagagacttgctccagctcgtagtgtcaacatggtatatcttcatcccattacttatcatcttcatatgaaaaatgagtttcttgcagacaacatcattgagtgacttgcctaaaaacatgtttgaaaactacgtggactgtggctcactcccttcagtggcacata

SEQ ID NO: 12199 - DNA, 201 bp, Bos taurus
aactggggtaaaacccgagctccttgttaggcctgggagccaccgccaggtctggctcaaggagtaaaaatcctctctagggtctcaaaaagtcgtgaagcctcacacttggccagtaagagaggctggtgagagagccctgaaattctccacgtggagtgtggaaactgtcagaacactgtcatttcagttatttatcca

SEQ ID NO: 12200 - DNA, 201 bp, Bos taurus
aaggagtgcagccagggactgaaggggacatggccccacgggaatgaggaatccaggctgtgtgctcccccgggcagcccatgttctagaaaggcagggctgcacagtggttagcagcgtggccgtgaaatcagagctgcctcctccatctgtgtgaatgtgcacaagggctgttacgtcccgcaccccaggttactcgtc

SEQ ID NO: 12201 - DNA, 201 bp, Bos taurus
tggccctgtgcaggttgcgaatgcacgccctcctctcctcaccctgtgtcagggggtggacggcactcctgtccccatcttacagatgaggagcttgaggcacagaaaggaaggccagcatgtgctagaactccaaacccaacctcagggcagctgggatgaaatccgtcacatcactttccccccagggaggctcttctt

SEQ ID NO: 12202 - DNA, 201 bp, Bos taurus
actgagggactgaacagcaacaacctccgactcctaagcacacaacagaaacttccaggtcactaagaccagactgagggccaccagtgccttttataagccctgggacctcaggaaaattcccgaccctccctgagcctcagtttccccatttggaaaatgggaggagaagcttttgggggccattttgcatctggtttt

SEQ ID NO: 12203 - DNA, 201 bp, Bos taurus
atgcacacaggagcctggcaggctacaggccaagggatcgcaagagttgaacatgactcagctactaaaccaccaccaccaattattaattaattaatgataaagcctgtttgagaccccaagaactatagcccaccagggtcctctgtccatggaattctttaggcaagaataatggagtgggttgtcatttccttctcc

SEQ ID NO: 12204 - DNA, 201 bp, Bos taurus
agtggaaataactcggtccactcactgatgaatggataaacaaaactgtctatccctaagatgcgatattattcggccataaaaaggaataaagttctaatacacgctaaaatgtgcaggaaccttgaaaacaagtgaaagaagccagttgcacaaggccacatattgtatgatttctttcataggaactgtccagaataa

SEQ ID NO: 12205 - DNA, 201 bp, Bos taurus
ttcctcctctgtaatatgggcccaacaacagtccccatctcgtaagattctgatcagtattagtttgttcattcaacaggaacttaatgagcacctactacgggccagacactgtccttggcactaaggaggcagcagtgagcaggacacatacaaatcactgccctcggagcccttctattttggtaggagtgatgggcc

SEQ ID NO: 12206 - DNA, 201 bp, Bos taurus
agcaaggagggagctagtaaactgtagaactaggattcaaatgcaggcagtatagttctagggccagtgcccctaaccatgtactatcacactcttcatctgtccatcatttactctcccctcaggaaaaaaaaaaaaacaacacttggcattcctatctctgagccttcttataggctctcggcctgaatcagtcaagtc

SEQ ID NO: 12207 - DNA, 201 bp, Bos taurus
ttcctcgaccgtccaggtgcactgcaggggcaatttacctcaagtaactccacctcctgcctgctctttaggatggatttttggcctttattgtatttttctttattcatgctgccccgttttttaaaaaaaattatttatttatttacttgtctagctgggcctcggttacggcacacgggatcttccttgcatcttgca

SEQ ID NO: 12208 - DNA, 201 bp, Bos taurus
tttagtgcttttctatgggtgagaagacacaagaatctgaggtcatcgaaattcttccctagatatgcatccatctcgaccttgtaggggccatctatccaaaagcacagagcgctccctcctgtctgtctgcatcctgaatttccctcagggtgcactgaaggtggccactgcagaggctgaggacgggatccttgtaga

SEQ ID NO: 12209 - DNA, 201 bp, Bos taurus
tccctggtggtccagtggttagcgctctcactgccaggggcctgggttcgatccctagctggggaactaagattccacaagctgtgtgatgtggttaaaagaaaaaagtggaggcccactgagaaattatatttgagcaaagacctgaagtgggtaatggactgagccatgtggctgtctcgtggcagagcattctaagtg

SEQ ID NO: 12210 - DNA, 201 bp, Bos taurus
actgcaaagacactgagcagaaagaaatacaggccacccatccacccagggtcccacatggaggaggaggcttggaggaaagaaagggagtgatgattgtgggggaggccagctgcaagtctcctgcccgagagctgatgcttctgaagctgcagtcacgtgggacattcctgctcactcaggcagcaaagccaggaacct

SEQ ID NO: 12211 - DNA, 201 bp, Bos taurus
agtcatgatagtgacagtctggcctgtcagcataaaatattcactctctgaccctttataaaaaaaaatttcgccgacctctggtcaacagttgtatttgcagttgatttcctagggtcaccaaaagatgaagtaagataaggcaagtgtaacagaagcacctggcacttaataaattctcagacaatgtgatttggttta

SEQ ID NO: 12212 - DNA, 201 bp, Bos taurus
tcagtaagtgctaaccctggccttaacagaattaattttgcatttgatttcaatacttaaatgaatccagcttggaaaaagaaatacaggcaaaagaaaacgaaggctgatttctaaaaagaagggggtttgttttgttataacagtcacagattatctgccagctccaaaacgccacaaattcaccagaccctgatgctg

SEQ ID NO: 12213 - DNA, 201 bp, Bos taurus
aaaaatgataaagatgttatgagtaaccattaaattccttaaatgagcccacagtcatttgaacacaaatatcctcaatctttcttattttcttttaaatccctcatcttttaaaaaggcagtctgccatttctccactgcccaaccctaaaatgaccaactatttaatcacagtcatttaaagcaattataatagagagt

SEQ ID NO: 12214 - DNA, 201 bp, Bos taurus
cccttgtgcctctgctttgttgagcttttatgagctctgagtgaagctagtttgggaatttgtattttgaacagagacactgccgctttgtttagttcctcacagtgtggctgttgaccgggccgtgttctttatgctgaacactcatccaagttgttccggaaatcactgagccagttataacacccctgcagtttttgg

SEQ ID NO: 12215 - DNA, 201 bp, Bos taurus
agccagtaatatcttacagttggcttactggttttagatattccagtgtgcccttgcccgttaattttaacctcgttgtaacccagggaggtatccttgttggacagatgatgaagtaaaaacctatagaagtttggcaacaggactgagatgatgccgctggtgagtgccagagcctggtttcggagcctaggggtcttt

SEQ ID NO: 12216 - DNA, 201 bp, Bos taurus
cacttaaaaatgtgactgtatttgaagacagggtctttaaagaggtaattaagtaaaatgaggatgggccctcgtcgttaggacgggccctaatccaactgactggtttccttcgaataggaggaaatagggacacagacacacagagaaaactatgttagatacagggagaagtcaagtacaagccagtgagagaggcct

SEQ ID NO: 12217 - DNA, 201 bp, Bos taurus
aggatggtctttcctgctgtcacatcctaagagaaggctctctccaaaatgacaggctagacagggaaattttagtaagcattaggcagactactcactgctctaacccatgtttaggtcttactcattcaagcccagatactttacaagaagtttctgaaatcgactggctttctggggagtgaacagtgggcagtgatt

SEQ ID NO: 12218 - DNA, 201 bp, Bos taurus
agtcaggacaacatgcctacttgctctttcatgttctctgtaactttctggatcattgtgaacagcttcagagtctaaagaaaggattatttagaaaagatcctcaatgctgagagaagataatcaatgttactctagtgacaggaaatacagtctatagaactgcagagaaccacttagaggatattgatgttttggtta

SEQ ID NO: 12219 - DNA, 201 bp, Bos taurus
agtgggcagttgagaagaaaagtccagtgctctttgcttccagatgggaattgggggagatggggaagagggtctctccacctgtggccatagtggtgcaatagatgagaggcgcttccattcccacaggcatggagccatgatcagctgtttcctgtctcctggccttgactaacgcttttccaaccacaaggaacaagc

SEQ ID NO: 12220 - DNA, 201 bp, Bos taurus
gtttagatcaaacaagctaatggagttgtgtcaaaggacaccgaaggcagtttgaaaggactcacactggctgaagttgtgacagctggagcatcggggagaatagtggctgcagttgatttattcacatgaatatgtaaaaatccatgagtcctcagaaaagagacccttcccccatcccacaattgaccatcttaaaaa

SEQ ID NO: 12221 - DNA, 201 bp, Bos taurus
gcaagccagagcagggaaagtagcactgaggggacgagtctgtaagaagcaggttgtggggaggtgaggagcggagaagggtcacatcaccagcccaaagggggcctctgtgctggagaggcttccacctcctttgctcctgagacccctcagccaagtgtctgaacaacagccctttgactgagttacattttgagggac

SEQ ID NO: 12222 - DNA, 201 bp, Bos taurus
cccatcaacactcatgcctatggggtggcagagtacaagccttaaacactgtcatgcagaaggcccacaagacaagcgcccagaagctgtggggaggcccgccagtcccaggctcccacctgaaacacctcctctccctgcctcatcttgaggaggttgacaatcgcctggtcgctgtaggccctgacgacggtgttttta

SEQ ID NO: 12223 - DNA, 201 bp, Bos taurus
aaccaggtccttcctgtcacacaagcacatgggctcaccgctggggccagcgggcccgggacactgaaatctcaggtcccacgctcctgtggaaaagcccttcaaaaagggccctgggctccaccccggctgagcccgggaaataatttgccccaacggaggctctacacctgactgggtgtcccagagatcggcctcatt

SEQ ID NO: 12224 - DNA, 201 bp, Bos taurus
tgggcacctgtgttgactgaactgtgtatgcatgtcccacatccactgcacaacatggtgctgggtctacattaaggctcaaggagcggtggtagacgatgcgggatggaactctcaccagaaacagagaaagatgtactcatccattcattcagcaaacacttactacaagtctgttatgttccaaccatagtgctaaat

SEQ ID NO: 12225 - DNA, 201 bp, Bos taurus
tacacagagcttggcctagagcaagggtctatggatgttattattgttgttgttgactcactaccaagggctgtgtcagaacctgtttccatttgtaacagagtcagggagggccagggcccaaagtgacactgagggtatcaagatagactccctcacgagggggaatgggaattagggttctcccagtgacctcacaga

SEQ ID NO: 12226 - DNA, 201 bp, Bos taurus
aaattaactacacgatgaccagactgtacccaggacatacaccgccacaattccaagaactggcctcaaagaagtgtgaacaagtggaccccagaaccgaagatgaactgtacttaaccaagatgacactggtcagaccactgatgaccaatctgaagatgactgtcagagctgactgtgctgtttctgcatgtagcctcc

SEQ ID NO: 12227 - DNA, 201 bp, Bos taurus
tgaagcgagccaggtgccagggagggacagcaaggagcccacggcatgtcagtggggacagcagctgcccagctccactcaggctgccgtgtaaataaaacgggcctggagttgctgaagcttttgacttgtcagaagacatcagatgtttctgtgccatctctccatctgtaatcgtcggtgactcgtctaaacgtgttc

SEQ ID NO: 12228 - DNA, 201 bp, Bos taurus
atgctcagaggtggcagggaagcacagctgaattcaggctctgaggctgaagtccttgttgagtctgctcaggagagacccggcccttccctgtctgttccctccatgcccagccctcagcagggagctctgacccgtgggctgtctctggtccccatgacggcctgctgggggggtcacagaggcgggaaaggaggagaa

SEQ ID NO: 12229 - DNA, 201 bp, Bos taurus
gatcgcggggcggggggagacacggagaccgacaatgaacaccccaagccagttcagctgctggtgacgcctggcatcagggcacaggccttggcgagccgccgagcacagtgccttaattattccatccataaatgataagcctcgttcatttccaggccttcatgacaaatttatggccttaatgtgctcgctgcctga

SEQ ID NO: 12230 - DNA, 201 bp, Bos taurus
cggtggtgggaggagcctggcttcgagggcaacttacgtttttgtgaggaatgacgtgtgggatgtactgcaggatcagctgggcccgctttctgtccttgtcaagttcctggaagagcacgctgggtttgagatccctgaagagcaaagacacgggtttgggataaagagcatgaataccatcctccagacaaggttggc

SEQ ID NO: 12231 - DNA, 201 bp, Bos taurus
gagcgctgaatatgaaatagaaaaagtgaaacaaactagataaaagtaaaagatccttatatagtccagtttttaaacatggctgctcattggaaacatattgagctctggcagaaagaaaaaaaatagcaatgtctggccttttgtatttttcaaaaaattccaagataattctgatatgcatctggattttaaaaagtg

SEQ ID NO: 12232 - DNA, 201 bp, Bos taurus
tttgagtaacttctatcttatttctattgaagagcattgaaggaggaggatccaattttcagtccacagcaaggcttcatctctctggctagggccccctatatgttaataacctttgtcccagtctcgtgggatttgtaatctctgccttacttccctcttgtaggcctgttatgaggttttagtgaagtcctagagtta

SEQ ID NO: 12233 - DNA, 201 bp, Bos taurus
agactcccttgcagttaggggtggctgcagccatgtggccgcattctggccaatggactctaaagactcctccctggtggccctcatgctctctccttccacagtcattcactggctcctggcaacattgaaagccacgagcaggatgacagagccatgagatggaaggaggtcaggcccctgaaatgccacccactgatc

SEQ ID NO: 12234 - DNA, 201 bp, Bos taurus
tcaaggggttttctgactgcgccactacctggctgctccctcgtccctctctccgtgcgctgccctattccctgagacacagcagtgttgaaattaggcccgttaataaccttgcagtggcttctaagtgtccacgtgagaggaagagtgttaggtctctcactttaaatcaaaagttagaaataattaagctcagtgagg

SEQ ID NO: 12235 - DNA, 201 bp, Bos taurus
caccttgaaagactgaactcagtaagaaggtgacttatcttgtactcagaacaacacattctgctctgggctgatctgggacgggctgtttctcacagcgcggtctgttccttctctcgtacccattttaattggtccccaagcctctgcaaagaccaccactggtagacacagttcttcccagtaatggaaatcctttca

SEQ ID NO: 12236 - DNA, 201 bp, Bos taurus
gttcttccacaggagtgcggggtctgaaccctatgttgagctctagggggcctgaaccgggaagatgagcccccagagcagttgattttgaaggccaggggaccttcaggggtcccaggaagctgtagaaaatagaggcttcatcctttaaggatgcacacaaaatcttatgtgaaccgggacacagggcagaagtaactt

SEQ ID NO: 12237 - DNA, 201 bp, Bos taurus
cttttggcctccgagtgtctgtattccattctcttccaagtttctttgttgtgaagccacttctccaacaagatgcaatgaacagatgtaacatctacacggcgccgggcgagttcccgaggccacgggctgtttggaatcgtacctcatttagagacaaactgttccttcactctgttgggtcattgtgcttgtgaaagg

SEQ ID NO: 12238 - DNA, 201 bp, Bos taurus
gtgggccttctataattaaatgagatgaggcttggcacaggctgacacgtataggtggagagtgttctcagacgttggagtactccttcgcaggttttctctgggccgagcaccccaacaagttacctttccaagtgccactcacccttcatcatgcctctagcaggagaaaagattttcatctagaaattttataaactc

SEQ ID NO: 12239 - DNA, 201 bp, Bos taurus
ctaacatacacacagtcagtttcggcaggaagggcctgcctgctgctcagccaccgggcaaactctactttgaggccctgccccgctctccgctcatccctgccatcctttgtgtttcaagtttctgagaaaagtctcaccctctctccgtgccatctattccagctccaagtattattgtttctggccaaagtctgttgt

SEQ ID NO: 12240 - DNA, 201 bp, Bos taurus
ttagagacttagtggctcatgaggccaatgaggatgcagttcctctcatctcccgttgtcagagttgccttcatcttctgtcttctggcgcacagcaagacggccatgaaactgtcatcgtcacgtctgcacagattacaggtgacagagaagagtgttccatcccttccactagctccttcttagtaagagtgggggaag

SEQ ID NO: 12241 - DNA, 201 bp, Bos taurus
tatggatcacagcacctgccctgagaatttcctccctgcccccatggctgatgtggggatcacaggagatgacagatactcttcacaagctgcaaagcattgcacccagaacctgcccccatcctctgccctgtggcatccaggaggcagcacttctacatttcttgcttattcttccagacgtttaatttctgaacactt

SEQ ID NO: 12242 - DNA, 201 bp, Bos taurus
tgacctggagaagtgacaaagtagaggatactaggaaggcctgaccagagccttttcagcagagggatggggagacccctggctggagcaaagagacaaggcggaaataagggctggtgtttggagtagacaccagacttctctgatgagaagagaaagaaagttaactatggggaaagcggaacccacgagaggattgtt

SEQ ID NO: 12243 - DNA, 201 bp, Bos taurus
gatctctcacccttggattcacagcaggggtgggctgagggagctggggttgctgaagcccagagaaggcagggccttggcctgcgtcacccagcaagccgagggcagagggctgttgaccccaggctccaggcagggacatgttatttattgctagattggcctctgtcctcagtgagtttaatttctccactttctcac

SEQ ID NO: 12244 - DNA, 201 bp, Bos taurus
tgggttctgtctcttgtaggggaactaagatcccacaagccatgtgtctcagccaaaaccaaaacagaaccaaaaaggggattgcgaggacctgctgtgaccgggcgtggggttggggccaggggaaccaggccggccagggtggtggccctcggggaactgacctttgaggagggattgaggaaggagtcacagagatgc

SEQ ID NO: 12245 - DNA, 201 bp, Bos taurus
gatgtatcgggtcacttacattgagccactggtgaacgtttaacgttagctgggtcttggggggaaaagccccaatttgtatgtagcgtttccctattcccgtggtgtaaatactcccaccagggcacactgcagggtaccaaatagctgtccttatacacagagctgggaagagatgtgcagtacatcatcattacacac

SEQ ID NO: 12246 - DNA, 201 bp, Bos taurus
cccgttccactggccagaatcaaacagtctcacagacagagagaaaactctacaccacccaaaaggggagaggaaaaggagtgagcacgtattgacccatgtttccgtttactacctgcaggccatagacccttttggagggctgtgggtggagcagtttaagaactggattggaacctgagtctcgtatggtgatttgca

SEQ ID NO: 12247 - DNA, 201 bp, Bos taurus
ctccagaggatcttcccgacccagggatcgaacccacgtctcctattggcaggcgggttctttactgctgagcaaccagggaagcccatcatttaatttccgcctggtatttcggggtccatgctctcttcaagcctttatcacccacaagagcctctcctccaagctgcaatctgagaggatcgacttggagaaacaaaa

SEQ ID NO: 12248 - DNA, 201 bp, Bos taurus
ttcctttaaactcatgagcagtcacagtgatgctggataaagacaaacccctgtggattacatccagtcccaggtctccatctctaaggtggcaagtctcagctgcaatccaggtccacccagctctggcttcgaccgtgtttctggggtaaaatgcaagctttccagcccagtgctggggagtccctggctgcccaggac

SEQ ID NO: 12249 - DNA, 201 bp, Bos taurus
gtgcagcgggtagagacttgaatactaatgatggactgcctgggttccgatccccgggtggacacttgggagcagtgtggccttggcctgattgtgccaggtttcttggctgtgcctccgtttccctgtgccagtatctactggagtgccccgcacacctcaggaggcgtgagtgggccccggagagcctctctcaccatc

SEQ ID NO: 12250 - DNA, 201 bp, Bos taurus
tgcatgccccttttaacacctcaggaaacacagtcacagactcctgagataaagattgagatgttgacatctttggggtcgttattctgcctctcaaagcgtggttcacaaaaggtgcttttcgttatactgaggaagtcagcagatttttctttaaaaggccagatagtaaatattacagcttctcaggcagtgtggtct

SEQ ID NO: 12251 - DNA, 201 bp, Bos taurus
cccacagcgagacggacccccaaatgcatggcactgttagagttccagttcctgacttttccagccacaagagctacaccctgtcatccaggaagggccatccctctgaggctcttagcttgttcctgcatcattcacactcttaactcacctctgcccagctccagcctctcagtccagttaacatcaactgcagcttgt

SEQ ID NO: 12252 - DNA, 201 bp, Bos taurus
agaatatactacatattggaacccaataggaatccctaataacaccggcctgtgacacgttgttgctgctagagttttatctgtagcagtggttctcgactgggggaggggggtgcaattttggccccctgggaaacatttggcaatgtctagagacatttttggttgtcacagctgagcagggacgactgacatctagtg

SEQ ID NO: 12253 - DNA, 201 bp, Bos taurus
ctggagcaggggggtcagaactgggctccgcactggacctcggggctgccgggggcctgagcccctctcccctgggcccctcctgtgctgtctgtgaggattggacagagggctttactgcttcaaagcaaaagaaaattagattcaggcaattgacatcgttttgcgtatttcaagagtaaaagcaggacacgatcgggg

SEQ ID NO: 12254 - DNA, 201 bp, Bos taurus
agggatagatcccgcgtatcttacatgccctccattggcaggattctttactgctgagccaccagcaaagccctggtgtaacgtacagtatgataaatgtaattaacactgccgtatgttatatatgaaagttgttaaacagtaaatcctgagttctcatcacaaggaaaaaattttccttttattttgtatctgtgtgag

SEQ ID NO: 12255 - DNA, 201 bp, Bos taurus
gactgaaggggctccaatcctggctccaccagttactggcagtgtgaccttggcaagtcacttaacgtctctgagcctcagtttcctcatctgtaaaatgaggacgacaataccttctaggaggctcacgtgagacacccgggctcttgaaatgtggccagtgtaaatgtggaagtagcctcataggagtcctgggaagta

SEQ ID NO: 12256 - DNA, 201 bp, Bos taurus
atgtcaggttcctccgggtgcttagcagcctgagtggcctctcaggctcactgcctcctccactggaaggcacaggactgggcattccccacgtcccctcgacattagtggtcagcaaggcccccaactcccagcaccagctgcatggattatttgttgactcaaggggagaacagacaaagaagtgaaggtatccgagtg

SEQ ID NO: 12257 - DNA, 201 bp, Bos taurus
gcaccttgagagctgattccttgactgattcaaccatgtactcagtgggtgctcaataagtgacaaaggcgtgatctgttgggtggatggtagcttttgtctttttgctttattccctttgcaggtgggtagtggagtataagttccttgggggtctcaggaatgcttcagagatgacaataattatcattacttaatgac

SEQ ID NO: 12258 - DNA, 201 bp, Bos taurus
gggtgtgtgagaaccaggatcatccactgcagatggcctgggccaaccacacttacccctcaggtgtgtggacttgggaagctgctggaggcacagggcgcattggctggagcacccaggaaaatcacagggtcccagctgggtgaccatcatggccttttgcatgtggaagctgtgtgggtgtgaagttggggcatcatt

SEQ ID NO: 12259 - DNA, 201 bp, Bos taurus
ttttggccactgtctaccctctttctctcccacgtgtcctgacatgaaggagccatgatcctgtcttagaacttgttcttcctctcctgtttggacatattgtcccctctcattggccttggatcttgagccacaaggaacctccaagatagatctaatccagccccagcatcaaggcaaagtgatctgggtctcatttta

SEQ ID NO: 12260 - DNA, 201 bp, Bos taurus
gccacactgggtcttcattgcagtgctcgggcttatccttgtggcggcctcccttgttgcagagcacgggtgcagagcacgggcttcactagttgtggtacgtgggtttggttgccgagaggccacgtgggatcatccaggaccagggatcgaacctgcatcccctgcattggcaggcggattcttagccactggaccacc

SEQ ID NO: 12261 - DNA, 201 bp, Bos taurus
ggccttcagcaagtccctgttacaagtctgggcctctgtgaaataacacatttctaggagtccttccagctcggagatcaatggctttcttgcctcattctggactgtcccaggcctgactgctgggtgattctgatgactttggtttgtctcctggaccctccaggttttttaatccccctctcaatgttcacagtgcgt

SEQ ID NO: 12262 - DNA, 201 bp, Bos taurus
ctggccatccccacaacagggcatctggatgctgcttgctcccactttacagatgcagaaactgaggcccagagaggagaatgggctttctctgtggccccggagggacctgcaagccggatctctggactccaactccaggtccctcctctttgccaaacgtgatctatttgacagcaaaagagcaccgagggtgggcct

SEQ ID NO: 12263 - DNA, 201 bp, Bos taurus
gagctttgcgaatgagccgagggatgcaagccctctgtttcccagccatcttctccccttcttctacccagatccctgctcagaacagaggaggcaatggattcttttggaaaggctgtctttcggcgtctcatctccatgcagtggctgagcctagtgccctgtgtatttgcactggctgggacgctgaattcactggag

SEQ ID NO: 12264 - DNA, 201 bp, Bos taurus
gaaccaggattagacttcccagttttacagatgggaaaactgaggctcagaatagcaagccttctttgacctaattccaaagttggccagactctacagcccgtgatcctcctgagtggtctcccggtgtcatttcttccacaagagaacttccaacggccatactcccagatgcctcctgaaccgaaagacccacactgc

SEQ ID NO: 12265 - DNA, 201 bp, Bos taurus
tcccttctagcatcctctgctgtatttttatgattatctgacatggtatgtattgtaacctttttgtttctccttagtgtcccttactagaatgtaagctccatgaggccagggatcttggcctgattaggtctgtgctgcgtccccagagcctagaatggtgcctggaatataggctctgtaaatgtgtattgagtggga

SEQ ID NO: 12266 - DNA, 201 bp, Bos taurus
agggccccacctgaggtgccagacagcggggggtaagtgggaaggggtctaacttcttcactgccagcacccagactgtttatggctggcacgggcaaggcgcttaggggccaggggccggctcatttcacagattccttccgcgagaaggctgaccattcttcatgttcatcagaaagctgttcctttggagcccaggag

SEQ ID NO: 12267 - DNA, 201 bp, Bos taurus
cagagaatcctctggtcctggagaggactggagagagagagacttgtccattcagtccaaagcgctgaacgtccaatcctgaccacagctcctaactacatggtgcgagggtgccagtgaaggacaagatagctcgtctctctctctctttccaattcctgctccaccaacaaaaacgtgtttcctcaatgtttctccaga

SEQ ID NO: 12268 - DNA, 201 bp, Bos taurus
aaagccaataaagttcccaggaaaagtaatgaattcaagtcactgaaggagcaccctgataccacctcagcgagaggtgcccaggctacagcttcatgtactccttggtggacatgaactacctgaaaaaaattaagaatcgccaaggtctacacatgaaacagagacacggaaaaaactttacctatcactcaaaatggt

SEQ ID NO: 12269 - DNA, 201 bp, Bos taurus
tgggctccagttgaagcatttacaatcagcctcctatttactctctgaaatagaagtaacaacagaaacagggtaaatagccagtatttgtctcttgtcagcactttgaggtaacagtcatacaatagtcaaggtaatagtcacagcaaggacaaagaggagtaaaaccctgtttgagtaaaggattaaaggatctctgtt

SEQ ID NO: 12270 - DNA, 201 bp, Bos taurus
atggacaccaggtgagttttccccagcttcgccctcccccaacaagaggacaaaaggcccgcatgtcccctgggtgggctggacctggccacaggctgccgacgaccggttctgtctgtgtgacctaggacaacattcccagcagagaactgccaacattgccttggtacacagacctgtgacctccggtgagattccggg

SEQ ID NO: 12271 - DNA, 201 bp, Bos taurus
gcgtcaacagctcaggtggcctcgtggttagagggccggcccccacccctctgaatggagacttactgctgcagaaggggatgtgaccacacgtgtcatcatcgctcagtgactcagggtcgcctgtatgactctccagtggactgctcttgtcttcagggcagggctgggggctcgaccttttgacatttacccactctg

SEQ ID NO: 12272 - DNA, 201 bp, Bos taurus
ttgtagtaagacaaggcccagctttcgttgtagtgttcaggactgaactccttccaaaacagacctgttctgtcactctctttcatctcaggcaatagcatttctatccttggggcccttcctgactactgtctctctccccaacccacgaccaatccatcgacaatttctgctgctctaccttcagattatattcagaac

SEQ ID NO: 12273 - DNA, 201 bp, Bos taurus
atcttctccacaatttccagtttccttaaacttgaactgcccatgatgcttggagctgaaagcaaataattccaaatgataggttttaatgctaaacttgtacctggatccttattttgcagctactttaatatatgtcttttacctccctttctggggcattttattcctgttttagagatttgggggatacttaagtag

SEQ ID NO: 12274 - DNA, 201 bp, Bos taurus
cggcccggctgtgtgaccttgggcgagtcgctgtactgcgctggctctgctccgcatccaccaaaggcacacaccgtttcttgagctcctactacgtgccaggccccacactaagctattacctacacgatccttgaagcctcaacctggtgtctctgagagaagaaaacaggccagagagggggctgctgtccagggttg

SEQ ID NO: 12275 - DNA, 201 bp, Bos taurus
ccagcggagttttttcctgcacgtgtgactgagtccccgacccaggtctgctctgggctcccacagtcttctgtccagggcaggcgcctggctcagggccggggaagaggtttcagaaactttcctggcacgtctcccctctgctggcatttgtttctggttggcgccaggctgcttccaggccctatgagtcctcatgcc

SEQ ID NO: 12276 - DNA, 201 bp, Bos taurus
cttttctttaggagccagattatcacagtgtggccttgtgaatcaattttctctatgcgctgatgaaagtgtaattcatccttaatcaggcagccttgccgctgcaggccccgtgccggaatacatctagcccttctcccttcactttgggaagcagtcctccccccccacccccaccccccacccccaccaaaaggactt

SEQ ID NO: 12277 - DNA, 201 bp, Bos taurus
tctcggggtgaggagggctgacggagtgtccagggtggccagctgggccagttgccacaagttcctcttccaaggcaaaccttggggccactgttccctccggagcttcccaacaaagcttctgcgtgaaccttccagcacccccgcctcccgacaggccccaactgctgatgtccgttccctccacaaccccaggggatt

SEQ ID NO: 12278 - DNA, 201 bp, Bos taurus
cttagcgaccccatggatcgcagcacgccaggctgcacacggcgatactcttgcctaaaaaccggtccacatgctatgccaaaagtcggccctctacttttgtactcttggcgactgtgagattggctgagtgaatgctaacactctattggctgagtatttgccacaggctacctcatggggagctagccagcctgtggg

SEQ ID NO: 12279 - DNA, 201 bp, Bos taurus
ttggacatgactgagcaactgaattgaattttttctctttatgcctaagtttcagtgttttattgtatgttgtcatattggtagagttggaaaaatcttactgttttagggataaaactctattcaggtgatcattcacatcatggtgaagtgtctattctggtattttagaatctagaaagatactaactctttgatttg

SEQ ID NO: 12280 - DNA, 201 bp, Bos taurus
atgagttgtggccttaatcatttgtttaaaatagttttacacatcttttaaattgcaacttgattcttactttgagttttcttaaattgttaaatctgttggaaaatcaaggccttgttcctagacttcagttcagttcagtcgctcagttgtgtccgactctttgctaccccatgaaccacagcatgccaggcttccctg

SEQ ID NO: 12281 - DNA, 201 bp, Bos taurus
agcagcgcaagctgaaaggatttaggagtcttatcagtgatcagcccagctcaaatagggaaagccgccagctgctgctgtgcggccagcagctgtgttagatcagcagccctgtcatttgcggagtttgctgactttgagcgtaaggggaaaggactctcatctcaaagcaagggtcgttcagtgcaattcttcctgttg

SEQ ID NO: 12282 - DNA, 201 bp, Bos taurus
ttgctaggcatccggcctgctccagggcaaggaacgtctctcgcctgacctgcccaactggaggaagaagggggacgtgtcgggctctcagtgctcacagaattcctggccacctctagccagggtggtccccagtgtgaactagcgaagatccagccactgtggggggtgggggggggagtgtgaccggggacagcttct

SEQ ID NO: 12283 - DNA, 201 bp, Bos taurus
cacaaaacacctgctcaaagggaaaacagttgcaacagaatagttagaagttgaaaggaaactggctatttaaaacaattatttagatcttttttgcctttctgaagccagcttattctagataccaccatgcttagaaaccagcaagaaagcccagcaactaggcaggtgctggtagtgcattattttggatgcgatgaa

SEQ ID NO: 12284 - DNA, 201 bp, Bos taurus
gaccttcttggcatggacaaagctataggtgttgtcaaagcgcaggacgtctggggagacagatgggaaaatgggtagttgggcctgactccatgcctgcaccctgccccagccatgggggagaacaggttgtgttcccacctgttgtgtttgccaagcggggccaaactcctcccactcttcttctctcccccatgggaa

SEQ ID NO: 12285 - DNA, 201 bp, Bos taurus
gaaaggcctggtgaggggctgtgtccagggctgtgggcgcagagggcaaggaatggggtggtcccatggcaggaggagcactgggggtggggggtggagcgtctggggaactggcctgacccagctgcctcacttcccatccttcccttggcttaggcacttaactccagccacccacctgtctccactgcaggccccctg

SEQ ID NO: 12286 - DNA, 201 bp, Bos taurus
tggacaggaggcctccgctcctggctccgtgggcctgtccgaagtgtcctcacagcatggctgctggctttccccaggaggagtgatcctggagtgagcacgcaggaagaaacacttggtaagctctttcataagtgacggggatgttctgaatggaagagttttgcgggcagcgaatgcttaacgagtgagagcctcctg

SEQ ID NO: 12287 - DNA, 201 bp, Bos taurus
gccaaggagaggcaggactggcacatgtgccccaacatcttctgagctccgcccgtcctgcggacacaggcgcccgcacgccgctccacctcctgtttcgcgcactcagtttagcgctgtgtggccctcccaccccaccgttcccttctggtttaataacactttttggggctctcaccttggaaggaggaagtgctgacc

SEQ ID NO: 12288 - DNA, 201 bp, Bos taurus
ggacatatgttgtagagcatcttttcatatgcttctttgccatctttatgtcttctttggtgaggtgtctattaaaatctttggcctattttttaatcagattgtgtttggctggtattttgtttgtttgtttttgggtttggggttgtttttggttgcacagcttttggaatcttagttccctgaccagggattgaaccc

SEQ ID NO: 12289 - DNA, 201 bp, Bos taurus
cagtgagaccccaagagcaggcccaactctgacccagctctaaccccttcactcctcctggtgcccagcagcctcgggacctccaataggctcatggtctcggccttgactggacttacagccccttgtgcacacattcccaaggtggggtctccctggaagtcttggaattgtatgttgtctagtcgatagggagagggc

SEQ ID NO: 12290 - DNA, 201 bp, Bos taurus
ggtgaggtaccgcatagagacggtgttcgcccgcagctcctgggactggattggcttgtaccgggtgagaagggcaggggcggtcagcagatcggggagggaacttggggcctgaaggggcagccagggacccatacaggacttctccagagttttatgtcacccagggaggctgctagggtcaccgttacgggtcacgat

SEQ ID NO: 12291 - DNA, 201 bp, Bos taurus
ttctctcatcagaatacctgggtggacattctgctgccgtcacctgttagcttcctgccctttttaaatgagttatctaatctccttataccgtaccttatttatttgtaagtaaataatggtgttggcttcccagcccggtggtaaggaatcagcccgccagtgcaggagaggtaggttcagtccctgtgtcaggaagat

SEQ ID NO: 12292 - DNA, 201 bp, Bos taurus
gagcaaggcttcggtgtttccagtgctagtgctgttcactggggcctcacgtgtcttgaacccacgctgtgtgctgagcggggcctctgggaggcacctgcgccatctcccgcctgtcttgttcatctgagtacctttccctgccccgttcagacctgcaggaggtaccttgtcacctctgctccctcccaggcccacctc

SEQ ID NO: 12293 - DNA, 201 bp, Bos taurus
atacaagtgggagatcgtggtttatctactgtaacccaatgcacagcacccaggtagctggtttgcattcacatcttcccaagaacaatgtcaaggtctcgccatccactgctgcagccctagctcctggaacaagtgcctggcaaatagctcgttgcatcagattgtctttcatccctgggtcattcttattctcatatc

SEQ ID NO: 12294 - DNA, 201 bp, Bos taurus
tccgcagcccgcgcacagcatcatccgccttctacccgcaggtcagtccaaccccagagccctgcagcccatgcatgcctgtctgtcagctgaagccttgacctggccttcagcttggttctgaaaacacctggaattgggctgaagccgagtttgaggggcagttgaaattgaatttgatcttggagatgcagtaccttc

SEQ ID NO: 12295 - DNA, 201 bp, Bos taurus
ttctctggctccaggtcaggcaggtggcctccctgaccatctctgggctccaaactgaggaggaggaggctggttaatcctgctaagcctggaacagcagtctgagctcacacagtgcttcgggccaggggggaattgagacacaaaccctgagctccccaagcctcaccagtcacctggggaaactcacagagcactgtt

SEQ ID NO: 12296 - DNA, 201 bp, Bos taurus
gcacagctgagccactgaacaagagaggccacccccgaatgaagaaggggagccccagcaagagcctggggaggagcagtcctggcagaagggacagcgaatgcacaggccctgggctcaggcgtgtctgacaagccgcaggagcaggaaggcgggcagtgtggccggattcaaggcaggggtccggggaggggccggccc

SEQ ID NO: 12297 - DNA, 201 bp, Bos taurus
tattcttctgtcttattggcagttcagacagctccagagtgtgagttaaaccctcttcaccgtcaccagtctcggaaataccaatgcattcatttaagagtactgccagcatctttgtggccttgcagtatccaacttgccagagatggagtgaaatgcatagcttttttcagagcctgaataaaaccttggaatccttct

SEQ ID NO: 12298 - DNA, 201 bp, Bos taurus
tagaacggccttgatgagcacaggtgcctcgaatcctcacaaccaggctgcctcttaaccaagggggaaactgaggctcagagctcttgccagcattgcccgtggccactcgctcaggaagtggccgtgcgcaggggcctgggccgccctgactgggggtcgccgcctgtggccagggtggtggtggcggcggggcccttg

SEQ ID NO: 12299 - DNA, 201 bp, Bos taurus
cagccagccagtgccaaagccccggccgcagagtcaggaggagccgtggacagaggaccatagtctggaagcctgggggaaggggagtcctgcggtgacccggaggctcaggccgctcaagggaaagaaaaaaaaaaacaaaaatgccttccattcaccgccgaagcctgtctgccgaggtctccaggctgggaggaggca

SEQ ID NO: 12300 - DNA, 201 bp, Bos taurus
cggagcgcctctccgagctgctgtcttcattgccctttggtgtgaagggagggagagcctattctggggaaggagtagaggaataaaactgtcaggtggcaggtgtgtctggggccgccccggtctgggaacttaaccggtagcaactcctttctccagttctggcggcttcaagtccagggtcgcgtgtcggcaggcggg

SEQ ID NO: 12301 - DNA, 201 bp, Bos taurus
aatttagttttacaaagaactctctatactgtccttgttctttaacacactgaagcccactcaacacttcgtttcatggcctgaccacggtctgttcaccgcagctttccaaccccacctctccaatctttaaggaccacagtgtcatggaactggtgagaaggcccagttctacctctggctggagaggactaagtagcc

SEQ ID NO: 12302 - DNA, 201 bp, Bos taurus
tggaggcccagctttcgtgctgagcgcccctctggctctattcaaatcccaggcgtgtggataccatcgcagagtctggctctttctaggactgagaacaagtggtcccaggccctcgcctcccaggccccagtgcagtccccagggcacctggtgggtaggtagaggtggggggggcgggctggggaggctggctcttcc

SEQ ID NO: 12303 - DNA, 201 bp, Bos taurus
acgtgcctacagggtttttgagggcctgtgcatgtggtcccaacctgtcccatcttctgggtccctgggaaacacacgattcctttacacacccctggacaggcccctctggccacactgtcctgagggtgaagctcgctaatcctggagaccccactctgcatggcgtgggctggagggaagaacttcagcctctttctg

SEQ ID NO: 12304 - DNA, 201 bp, Bos taurus
actcagctgtgggagcctggttgacgcctttcatggggacctcgtccagcgagttttgctgtgggaaaggcttttaaacccatcttccaatggttccactgggaaatggttatatcggtcaccagagaaaataaacacgcctgtaggctgtcagcttccagactcacccactctccggactctaaaaccatgtaagtggct

SEQ ID NO: 12305 - DNA, 201 bp, Bos taurus
gccgcctgcaggaggtcctgtcgcagctgcgctgggagacgcacggcgagcaggcctcgcgcatccgccacctggaggccgcgctcgacgtggagcgccggctgtttctcaagtacatcctcgagcactttcactggcaccccgccctgcccagcgcccccgacgcccctcttccattgggagaaccgactcgcgaggccg

SEQ ID NO: 12306 - DNA, 201 bp, Bos taurus
gcactaggatccactcgcgggcactactggctgggaggaggggctgcctttcaagagctgaacctgcaaatccaaacatcagtgagcatgggcctctgagccacctgttctctctctgccagtgaagaacccaggcaggggtctgaggtgagaccaccatgacaccccgcacaggggcaggagcgcagtcagagtggccag

SEQ ID NO: 12307 - DNA, 201 bp, Bos taurus
ggggaggcggggacacgcagtgtttaaggcaggagcacactctgtccccctctgcctggcaaagtaataaagtatccgtttctacttcacccagacagacaaatagggtcatttcaagcacacaggaagacactgcagagatgagtgaaggaggctcacatccaagagcgtcctgcagtggggtcctccgggccctcacgg

SEQ ID NO: 12308 - DNA, 201 bp, Bos taurus
ctgcccgggctccccacgggggcgcccaggagcagagtggccgctgcggagtgacccgaagctggagatctaactctcgagccctcgggacgcagcctgcggactcctgagctgagggccaccccaggagcccagggagacggcagcgagggcagatccggtcctccacccacgggagaagcaaagcgcctcggcccgggg

SEQ ID NO: 12309 - DNA, 201 bp, Bos taurus
cgagggcctcaacatctcttttgggggagacacagaagcccagggtgactatcggggtttgcacactgagagcactgcctgctgggaagctcaccaaaaggggggggcgtgggtggccaacctggcagcagggcagagcccagggacgggcaggggggctgggcaagaaggcacgtgggtcagaggccagtgtcccaggaa

SEQ ID NO: 12310 - DNA, 201 bp, Bos taurus
ccccctcagcacccaggcctcctggatgtgaactggggcagatgccacaccctccccactggtgggtctggagctcctccagcagcctggatcccatccattgtcctcctgccccggcctttggcagacggggaaaatgcattaattcagagtgcttagaagagggctggaagcactgagatcttggtgggtgtcacaggt

SEQ ID NO: 12311 - DNA, 201 bp, Bos taurus
gggggtgcatcgccccggagcccacccaccgtcccactgcgcagacacttggtgttctgacagcgacaacccagacctgggctttaaagtgacatctcttcgaagggattgtggcttaaaaagaaagtacatgtgctcatcacgtgggcacatccattgtcagcaagggtgcccgcgccccaggctgggaggccatggggc

SEQ ID NO: 12312 - DNA, 201 bp, Bos taurus
gcgctagaagatcacagctttctctaatgatcattaaagtggcaaaaaaaaaaaaaatcccccaaaaggaaagccaagtcaagcaggaggccccaggcgtatcttaagttgctagtgagaccacagagatggacggggatcccctggtgacttaggaacacgggggccactggagtgggtgcagccctcaaatcatcctgg

SEQ ID NO: 12313 - DNA, 201 bp, Bos taurus
aattccaagtccatggggttgcaaagagttggacacgactgagcaactctcactagaccccactagaccaggtgtgtggcccagcgatgctgtgtgcaggatgagtgtggaaatggtcacacgcgcgcacattagcacatacacacgggaagaagggcacgttggccgtggtggggctctgggtggaggggtgcatgaacc

SEQ ID NO: 12314 - DNA, 201 bp, Bos taurus
acagggtgcttttccactcgctgggatcaaggccccctcctgacgctgtgggggaggaagccccctcgctcctggaggagcaggttcctggagttctgtatgaagatggtggggctgggggccccaggagctggacagtcggggaaggggcctccccgagaggctctgacagagtgtttggttctgggtcacggccagcct

SEQ ID NO: 12315 - DNA, 201 bp, Bos taurus
aagggcccccctgttgtaacccttcggcatgtttggaatatgtgcacttctatttagtgcatcagatcagagagccagcagtataactgcagatttatggcagccaggccttggatatcgcctactatttaaaatgacttgttaccaaaacgttcagagaaaaccatagattaagcgtattgactatgtttcttctttaag

SEQ ID NO: 12316 - DNA, 201 bp, Bos taurus
gcagagcccaaagctcacagggccctccagagcagccctctgaggctgcctctgtcccatctcctgctccccgtccttgaccagaggccccctgccagcaacacagagacactcacagccttgactgctccagcctgcagagacagagcaaactgatggccgtgtgcatcgctctaatgacacttgtaagagagtcatgat

SEQ ID NO: 12317 - DNA, 201 bp, Bos taurus
gtgctgcagagctcttcctggccctccttaggaaaggaggaaatagactgttagcaaccagtcatcacagcagcctgcatgtccttgggaacatcgacctctccacggcgcatggtacaggaggccaggataggaggtcctgcctcggctgagccagaggcactctcctggtccttgctctggagggtcgggtgagccctg

SEQ ID NO: 12318 - DNA, 201 bp, Bos taurus
ataaaatattcaggtggaaaaataaataagaacatatcttttctatcaagagacattccagatgacaaaaggtttcaggtggaagaggatattagactataatttaaatagtaattcctcatttcattttaaaggacataaaccataacatgttatatggtgatgaaatttaaccacatattgcttagagtaaaatctggc

SEQ ID NO: 12319 - DNA, 201 bp, Bos taurus
agcacatggtccatggctggcagcaggcctgtcaggcaggctgtggttctcagaggtcaagctcacggcagtaaccagaagtagggctatgccctgttgccatccacctcggccgccttggggagggcaggaggtgggcgctaaggatgctggcgtaggacacaggtcagagggcacccgcagacacacacgcattccgtc

SEQ ID NO: 12320 - DNA, 201 bp, Bos taurus
catgggccaaggccaggctggaattgggagtcatggggatgctggcctggaagcttttagaagcacagctcccttcgctgggtgtgcactggcaggacttgtgtagaccctagctcaggccttctccatcagtgtcttcaggtgtccagcctccccaggcttccggtgctgggcggagagccctgtccggagccccgtgcc

SEQ ID NO: 12321 - DNA, 201 bp, Bos taurus
acctgcggggctctggctatgggccagacgtggatgggcacaacttcatcatgaggtgagtcccagggaccccaaggctggatacgggacaagcctccaggaggaggcactggcctccttggccttgcccagctgtaggaggaattgccagctgctggggggtcctggaggaccctgattcccagaatcttccatgacaag

SEQ ID NO: 12322 - DNA, 201 bp, Bos taurus
ccgagacgctggccgtgcagagcgaacaccaggcacccttcttgtaggggacgatggtcttcccgttgacctcccagttccctctgcgaaagcaagcagcggagggctgcaaggacctggccttggccgtggcagggacaggccctgctgcctgcccgcagcccctgtcagttccttcctgccccgccagggagtcaggga

SEQ ID NO: 12323 - DNA, 201 bp, Bos taurus
gtattctgttagctggctgtttctggatggtatattattacctgacaagaccaacacatcccatggtcatggatccatttctgcaatgccgtcactggacagtaggtcccgtgggtcagatgctatactgtgcagcaatctgtgcctcaatctggcattctgccggcagaggctctagagtaagaaagttaaatccacgcc

SEQ ID NO: 12324 - DNA, 201 bp, Bos taurus
agagagggtatttcatgggcagagagggtattctgttctgtctcctgtgcccttaacacagcagatgctcagacacttgtgggagactcatgggccaacccacgcctctctagagggctggacatggataagatttgacctgtgctgttccaaaggcagcctctggttctgtttaaggaaacagttctgaagggctgtgcc

SEQ ID NO: 12325 - DNA, 201 bp, Bos taurus
ttgcaattctataccaattcatggactatagccagaggttgggctggatggtcaaggacctagaaggaacatgattggaaaactggtgacaaagaaatttggggaaagaggtatatagataggcctctctgaatgggcaaaaagtgtgaaaatatttgtgtctcacatgaattctcaccaaagaatgaactcagccaaggg

SEQ ID NO: 12326 - DNA, 201 bp, Bos taurus
gggagctggcatggcctggtgtgggtggcactgcaccttcccggtccccggtaggctgcagtgccaggctcttgggtacctggcgtggaggtgaggccatttggagcctgtctggggcgtgtgtggggcttctccttctggctcccactgtcctgctcgccagggctgtgaccgccataggcctggggacgtgggttcagc

SEQ ID NO: 12327 - DNA, 201 bp, Bos taurus
tgaggtgggcagccctgaaaagtcaggtgatgctggaagctgcccactccagcaggatgcacgatgcacaggtagctgttggtgcactcaggtggacagatgtgcacgataccggccgtagctgggtttcaagtgtccttacttcctgctccggtcattcattccttcctcatctacagcaagcacagtgctggaaaggcc

SEQ ID NO: 12328 - DNA, 201 bp, Bos taurus
actcctcaccccatcctccctcctcaggctgcggggtccccgccatccaacctgtgctaagcggcctctccaggattgtcaacggggaagaagctgtccccggctcctggccctggcaggtgtccctgcaggtgagcggggttctgtgcgtgaagggagaggcactggggggtctgctgggcaggggggcgctgcccaggt

SEQ ID NO: 12329 - DNA, 201 bp, Bos taurus
tgaaatccattggtctgagttttaaagcaggctttccaattatgtggaactgtcctactttaaagggcctcttgaactttcccttccttgcctctcagttggttcttagggttaaatgctttattattgtttcttttttagaacgcttcttctgttacttatttttggctgcaccatgtcttagtcgtggtatgcggggtc

SEQ ID NO: 12330 - DNA, 201 bp, Bos taurus
agaggttacaaaccgaacgcctgtgtctctatgtggcccctaaacatacctctagaaatacaactttcttgcttcccctcaaaaatttctaaagatctggcaacagttggccagaacaacaacaacaaaatggctcctctttggacaagtagctttccagttcactccatctactttttaaaggttttcaattcctggata

SEQ ID NO: 12331 - DNA, 201 bp, Bos taurus
catgaaccaacttgggcctggcctgggagattttgcagacgtcacaggtaatcagagacttacaggctcagtaagagagtcagcagaagggataggaaaatttcttagccaactggggttacaggggaaaaatagcctggggctaggatgagcaaagaggaaaacaggtaggcagtccagtctcctataataggagttagg

SEQ ID NO: 12332 - DNA, 201 bp, Bos taurus
gaccgcgtttctatgtgctctaggggaagggactggcaaaaataaccttagtaatgcatgttggctaagtattataaggaaaacatgagctcagggaaatgttggctgttttataagaggaaaggactatgcatcacctggatgggagctgaattcatggaataaatgacgattatgctgacacccttggagagaacgtga

SEQ ID NO: 12333 - DNA, 201 bp, Bos taurus
cagaagttttcagtggtcaattaggcatacagaaatggaataaagcaagaagccagaattctgattttcccagtagaaacatactcaggggcatcagtccgttttatattctgactcgctttagctggtaggtttaaattcctgtgactcacttactctgatgctgactagtagtgtgaaagacggacatgtaagactgag

SEQ ID NO: 12334 - DNA, 201 bp, Bos taurus
acacaaattaaccaaacataccttgctacccttttgatttgtagaagcctcccccttgatgacagtgtttttaaatttcactggtgactgaagtcttccacgctctcctgtgccccttccctggtggctcagtggtaaaaaatcctaccaatgcaacagatgcaggttcgatcctgggtcaggaagatcctctggagaagg

SEQ ID NO: 12335 - DNA, 201 bp, Bos taurus
cttgggaggtgctattgacaggccaacagagagttattgattttgcgaaaagccagatacttttgagtaaacatggaacgtgagaggcccccagagaacttgtgccctgagaggctctgggagctgtcacagcaggtgccactttggagtcactgcggagattggtcccgagggtgcagccaccatagctgcactcaggtg

SEQ ID NO: 12336 - DNA, 201 bp, Bos taurus
gagacacagcatggccggccagaggagttgtaagagatgagaacgacttgactgaacactgaattgaggaggagaggattgtgggtgtagggcttgagagaaagggcactgtgcagactgtgatatttttgtttctttttaaaattgtatctatttacttatttttaactgtgctggctctttgttgctgtgcacggattt

SEQ ID NO: 12337 - DNA, 201 bp, Bos taurus
tcatgatctttttctttataaatccatacaaacactgatatcatttcaaactgctactgaaatatagaagatgaaaaccatgaaaagacaagagtttccgctaacaaactcttgggcgctcttctcttcccaaacttcttaaaaggacttcatggcccaaatcaactggtattcttccaggaggaggaaatatttttgaac

SEQ ID NO: 12338 - DNA, 201 bp, Bos taurus
gtgtccttatccatgactccacacaaacccacatccactctgcagcaccaaaatgtttccttcacaggtagctctgctggccttcaatgttgcaagatttttttaaataactttattaagccccaaaggggctttccaaagggaaaacaggagcacaggttaaacaatgcgcggcgcgggctgcatcgcttagagtaagaa

SEQ ID NO: 12339 - DNA, 201 bp, Bos taurus
gactaaaacctcaacccagatatcccatccccagtgtccttggcccaggccagagattctatagtcctcatgctggcctgttctcaggatattcaaaggttcactcatgtgcttgagcttactgctgttgacaccactgtactcatccttgggcccatatccgcattcactttcacctcgattcctatacgaacagcaatc

SEQ ID NO: 12340 - DNA, 201 bp, Bos taurus
aatggtgggaatggtggtagagaaaaggaagagacaggagagaggaggggagggaagagacacagagatgggaagagcagctgccaatctccataatttccaggtctccagacactcaggattcccatatttctctttggataccaggaagcaaccagcttaaaaatgattctactttttagtgatgttgagatgatcagt

SEQ ID NO: 12341 - DNA, 201 bp, Bos taurus
ccaaacttcacgtgggaccatgcggccagcccttcccccacatcaccagaggctttggtgcagtgtctgttagtaacagtcctcctccttcacacatcacgtcagcatcctctggaagatgagggaggagcgtaggctaaatgtctgggatgagatgctcagaactaacatccaagttgtgttttaaatggcaatttcaga

SEQ ID NO: 12342 - DNA, 201 bp, Bos taurus
gatggcggaagattcgacttccagtggagcctgagcctcatcatgggctcattgtaatatactagcacgagctaaacaacacacccaccggcgccatgacggctcacaggccaccgtaaaagaccaaaaaatgggcgctggtccaactgcttaagggaaatctctgtccctttctccagacagttggaacaatcctcccac

SEQ ID NO: 12343 - DNA, 201 bp, Bos taurus
cctgggatctatctagggaggttccaaacatcggggttgtgtccagtctgcagcccagtattttctagtgctctctttgggagaggtcaggcctcccccatgattggatggagtctctttgaaagctgacattgaactgggacataataacagcctcgggacatcagagccctggtgcctggcctgcagtcctagacgttt

SEQ ID NO: 12344 - DNA, 201 bp, Bos taurus
actctcaacagagtttggaacaggacctagcagtaccaggaagtggaaacatctcaggaagcaatagagattgcaacaaacttgagttcccagggcacatctacagggctgtaagtccaagtattcaaggcttgagcttttttgccagaccagttctagctatgattttgatctttgtctcaggctatgcacatttgagac

SEQ ID NO: 12345 - DNA, 201 bp, Bos taurus
caattaagtccacaggctgcagctgctgaagcccacgtgtctagagctcgtgttccacaacaagagaagccagcacaataagaaggcctcgaaccccaactagagaaagcttgccacaactagagaaagcccatactcagcaacgaagaccccgtgcagccaagaataaataaatacaccttcctctgttagaagggccaa

SEQ ID NO: 12346 - DNA, 201 bp, Bos taurus
tcctggccagtctgggtcaattgttgcagacactgtggtttggcttctcggagtggctgctgcagaggtcgtgggtcagagttcactgttatagacggtccggccattgtctgtttgtgtattcaacatctcactacctatttcatgattgttcttcccagaattaaatgagctaaagtcattgcttataaagggcgagac

SEQ ID NO: 12347 - DNA, 201 bp, Bos taurus
atcctgagtgttctgcatgtgttttggcttcagtcatcgcgtgacctccatgagtaagtgttactgctgtgttgattctatagatgaagaagccggggcccctaaggagttaagtaccttgctcagaatcccagggttcgtacaccgcagagctggggtcaggaaagacattctcacgttccaggattcgctcgggcttcc

SEQ ID NO: 12348 - DNA, 201 bp, Bos taurus
ttcacgtgcttgtgtgcaacgcagctgtgtttgggctcccctggaccctcacaaaggacggcctggagaccaccttccaggtgaaccacctgggccacttttacctcgtccagctcctgcaggacgtcctgtgccgctccgcgcctgcccgggtcgtcgtggtctcctcggagtcccataggtgggtcagaatggggcatt

SEQ ID NO: 12349 - DNA, 201 bp, Bos taurus
aagaggagcgagccacctgcagttggcgtggccagcccacaaaggcctcagtgaccccgcccctgctcgctgcttggcaacactgcctccatctccaggtgtcccccagttgagagtggccaggcagcaggaaggagagaaatggtagattaggccaacctcctgccttcccgggagccctctagaaagccccgcacaagg

SEQ ID NO: 12350 - DNA, 201 bp, Bos taurus
tttgggaatgtccccactttgattgctattctgggctgctcttgcacacggtccttgcggggaacttttttctcttctacatctgtcatcacctggcccacgccctgagatacagcccttcagcccggcagcaagatgacttgtcagagtttccatcctgattttatgaccccggcagggacggaaggggtctgtgaggcc

SEQ ID NO: 12351 - DNA, 201 bp, Bos taurus
aggcccttgcgcatcattctgtctcagtaccacagtggtctcagcagcttttttgctaagctataagtcagcccccaattcctgtctgttcccagggcaaggtgcaggctggtagaggagggccacgcttcctgcccaggatggcacaggtgcctcctccctctgagggcaaggtgacgagtcgagaaggaggccagaagt

SEQ ID NO: 12352 - DNA, 201 bp, Bos taurus
ttcaagtgaacgaatgaacaaaagtgaatgaatgaagccgagccatcctcaatcaaacccaaacgctgctcacacacacagccccgaggctggccttcgcctgcacctcagttacggaaagctagaagttgatattttggagccccataagaccaggaacgctgtggcctgaatgacaaagagatgcggacacttcctctt

SEQ ID NO: 12353 - DNA, 201 bp, Bos taurus
agagacaaaatgatatggatttattcagattcagagcaaaacatactccacagacagagtatgggccatcgcagagggcaaatgtggccctgaaatttggcgtggctagtctttataggttgggtaagctcatatgctaatgagtgggagaattattccaactgtttttgggaaggggtggagatttccaggatttgggcc

SEQ ID NO: 12354 - DNA, 201 bp, Bos taurus
gcaggtttatactgcacaccccaggcggcctcggcactttacagaccacagcataaaccctcagaaccgtcccgcccccgacggggggaaagcggtgtcattattaatatagaagttgacaaacatcgttagcaccgtctagtccagccaccgcccctaggaggacctggtcacagtcccagggcatcttgggggcttgag

SEQ ID NO: 12355 - DNA, 201 bp, Bos taurus
gtggtctgtgagctcagggagccggtggagtcctctgctgacctggagtgggcccctgccctgctccgtatctctgggcgaaggcccagcctgctggaagcgtctattaaaacgtaattgatgaggtgccctgcgcctggggaagggatgtcggggaagggacagcaaaaggcctgtttgcgtgagcagggcaggaagaac

SEQ ID NO: 12356 - DNA, 201 bp, Bos taurus
tgaagacatgagacatcttgacttctatttccccgacacccgtctctctgccagacccagagggctcgcaggaggctgtactgtccacaacccggccttccgcgtcgctgccgaacatccgaagaaggtaacagcactttgggttttcagagtatatgtgagtttgggttaggccaggggaaaactcttgccatggacact

SEQ ID NO: 12357 - DNA, 201 bp, Bos taurus
ggccccagaagctgcagccatgcttagacaccccagagccacctcccagctcttctcctcaccccagcctctgtctacacggggactggcacaggagcgggttgatgggccccgagccccagcttaggtgactgctttccggtccagtgcagtgacttctgagtctctctgatggccctggtgactaggcatgaaatacag

SEQ ID NO: 12358 - DNA, 201 bp, Bos taurus
ttagttctaatcctgtctcttttgtgtcatctttccacgaatatgggggctctgaggttaatgcgcttgaaaatgagggacttgtggtgattctggccacggggacacctcccctgctggggacagctgagccaggaatggggaggtcgtcagcaagagtgctggggtttttctttagacttccttgtgagccttggaaga

SEQ ID NO: 12359 - DNA, 201 bp, Bos taurus
gcctttgctgagctgccagaatctttccttttcctctgagtttcaaaaacactggcgtgtgtcaaagaaatagcatccagtggaaagatcacgggctttggtattgcacagaaagggattcaagctatgtctcgcagcttactagctgggtaacctttggcaagaccctgagtctcatcatgcttccatttccccattagt

SEQ ID NO: 12360 - DNA, 201 bp, Bos taurus
agttagaattttattctcatcatcgttggaaaagacgcaaaggtcttaaaacgtacagcaaagtgcttggcactgatgctatgaggatccctggcccctgcgctggggctgaagcttgcgaggacggtagcccaggcaaaacgtgctgactaatgaatgacttgctttggagagggactgtcgagaagatgctggaattct

SEQ ID NO: 12361 - DNA, 201 bp, Bos taurus
catcctgtgtcctttcctgcccctccccaatctagtctccctacttcatgcagctggtgtaatccttttaaaatataactgggttcatattacttccttactttaagcccttcatttgttctaatacatgggaaacagtccagacatcttccaaagcctcccagatcctgtgtgacgtggcccccgtcctcccctcgttct

SEQ ID NO: 12362 - DNA, 201 bp, Bos taurus
tgctgaggttaccgccctcctcactgtggcctcaaggaacccaagaaacacactcattgcctctttggttgttttataaacagtgcttggaaaccacgagtcattatcactcttctggccagccagtcagactttccatgcccttgtgtgtgatgcccttaatcctctcaaagccagcatcctcattcccctaaaccagga

SEQ ID NO: 12363 - DNA, 201 bp, Bos taurus
aggcccaggagctggggtctgcagctgggggtgccgccagctcacaacagccttcagggagggggccaggagagcgaggaccccgatcatggcctcctccgtcttcctcctctcttgctggtgctccccatgggctaaaccctactgagacaaacagtaaaggattttgtcgtaaatcccactctccagggcagggggcca

SEQ ID NO: 12364 - DNA, 201 bp, Bos taurus
caagtttgcaaccagctctctcttgaagaaaaagaagaaagccctgatttgtggcgttggctgattttctggtgtaagtgttctcaccacggccaatttcagttgccagtgtgataccagttaacacagagttgggaagagatgtgtcagctcttgtgagcaggtgagaactggttccaagagcccactgggttagggcca

SEQ ID NO: 12365 - DNA, 201 bp, Bos taurus
cccagggctcccagagccacctcctgtcgcctccctcatctgtggagagaggaattcgctgcctcgccacacggacgccctttgtccgacagtgctgagccggccagttagagcccagggcttatttccaacacaactttcctcagctgcaagggctggctgaagggacctgcacatttggagactgttagccttgcatgt

SEQ ID NO: 12366 - DNA, 201 bp, Bos taurus
tctacaaacaggaaacgctggagaaggtgctgggaaaagggaactctcttgcactgttggcaggaatgtaaattgatacagttgtatggaagacagtatggcgattcctgaaaaaactaggaataaaacaaccatatgacccaacaatcccactattaggcacatactctgagaaaaccataattgaaaaagacatgtctc

SEQ ID NO: 12367 - DNA, 201 bp, Bos taurus
caacccagggatcaaacccaggtctcccgcattgcaggtagattctttaccagctgagccacaagtgaaggacatcacatacacatgcattgaaaagtccgaggttcttgggacttccccagtggcccagtggttaagactctgctgccaatgcagggggcacagtttcaatgtctggttgaggatctaagatcctgcatg

SEQ ID NO: 12368 - DNA, 201 bp, Bos taurus
gggtcctgtccactgccaagcgccttgtcgacacagcggtctccacaaagagaagccatggtgccgcgggcaggggaaaacgtcatcctggcccccatccatcttcaaggagcctaccaccgacaggaagcgtctgctcctgttcagccgcactaatgctgccagccgggctcgcctatcccagagcggcagcaccgcagg

SEQ ID NO: 12369 - DNA, 201 bp, Bos taurus
tatgggcagctatggtgacggggctggggccatgctcagtggtaagggtgtcccactgggctggttggggttctgactgtggttctggctgtcagactcccgcattcctggccatcgtttcagctgggtcctgcagccttcctggctcctgtgtgaaccagaccctctctttagaatagactccctttcagctaaaaccat

SEQ ID NO: 12370 - DNA, 201 bp, Bos taurus
atcaacagggtttgatgtcacaacagcacaaaaactgagaatggaacagtgccacagtgctgatgaaaagacccgtcagctgcttttccttcctctgctgtttttaataaatctgttttattcagatttctctttcagcctctacatctgagccatcttttgctcaggaataaattacatttgtcccatgaaatttatgag

SEQ ID NO: 12371 - DNA, 201 bp, Bos taurus
caaactgcaaaattatattttggaatatacatacacacatatatatattgtacatgtgaacacatcaatattataattactatatctgtagtatacagcagaccaggtaaaatatccattctatgtgcatgttatttaattttcatgacaatcacatgaggcaagggactgagtaggtaatccaaggtcaaagaactagta

SEQ ID NO: 12372 - DNA, 201 bp, Bos taurus
taggcccgttcacatatgggcaactgacttctgacaaaagcaccacggtaatgtagtggggagaaagctctccaacaagtggtgctggaggaactgggtatccagagggagagaaataaaccttgactcatacctcacaacatacacaaaaattaatttgaatcacagacctaaatttaaaaaactaaaactataaaattt

SEQ ID NO: 12373 - DNA, 201 bp, Bos taurus
tataagagattatagagtaatgagggattggccacaaagaggaaactctacaaattcaaggtgtagccgacgtaaggagcagctgagatgcagagttgatcggccaggacagatcaacgcatggcagaaaagccacactggtggaatttgcttgaggtcagccctctggaacgcgccagaagtctgtccactgtggtgccg

SEQ ID NO: 12374 - DNA, 201 bp, Bos taurus
ttgtccccgccttccacgcctgccctgcaggttctcggctcctcctggagcccggggaaggggtccccgtgccacaagttctacctcagcacccagccacctggcaccgtgcagggcccacctcttccttttctcttatttagctctgcttagaaacacactgcactccaaatggtgaataggattggaaattagaattac

SEQ ID NO: 12375 - DNA, 201 bp, Bos taurus
ctgattagtgaaaagtacagcgtgaaaactgagtcagagaagtgcctagaaaaacagaattgccctatgatccagaaatcctacttctgggcatctacccgtaaagaaaaacagggattcagagagatgtgtgtccatctgtgttcatagcagcattgttcccaatagtcaaaaggtggaaagaacccaaacgtccattat

SEQ ID NO: 12376 - DNA, 201 bp, Bos taurus
aaggcctcggcgtgaggcgccgggagcagggaggaggcgccggccagcctctgccacgggctgaacgtgcattccctccaggaagcccctctcggggacccgttcctgcctgtgactgctgggcctccttcacccagtccccttgctgtcacttgccccctggccagtccgcctagccccatgcctggtggtgcttcctgt

SEQ ID NO: 12377 - DNA, 201 bp, Bos taurus
gggagcgtcctctgacctacgctggagggaagtgggtcagcggagcagggggagcgcagcagtgtcggagtgctcacggccaacattcagagataaagcatctgttgtcgcacagacgcaaatgagtgagtgtcaccctcactctccagagttgggcttttttcctgaacattcctggggggcctgtgccggctgagcggg

SEQ ID NO: 12378 - DNA, 201 bp, Bos taurus
gtcctggctgtcagcggggctggaggcaggacaggaggacccaggcaggggaccggcaggcgcccaggcctggcggagcaggtgggccggccagtggtcacgtgtcctctactggtggtccttaagcgcctgcttcacagtcccctggacagattatttcaaatgcagactcctggatgccgcgtctctgggcccggcccg

SEQ ID NO: 12379 - DNA, 201 bp, Bos taurus
gcagcccagggctcactcgctggtgaagcctccagatggcctttggagcacccactgtgggccaggcccctgctgaggatgggggcaaggaggtgcggccggtttacctctacccaggaaagagctcagacccagtggacagatacgcacagcaaactaagggaggtcagggctcaggggccagcagggaggggaccacct

SEQ ID NO: 12380 - DNA, 201 bp, Bos taurus
agaagggggttgctgaaggagcaggggcatggggttcccatcctgatgttgccacatgtctccatgaccttgatcacgtgatttcacctctcaggccttgcgtttgcagcgccagtatttctgagataaatgagatgaatctgatacggcaggtgcaggcacccgggagggccaatgaacagcaggttttccagggcggag

SEQ ID NO: 12381 - DNA, 201 bp, Bos taurus
aggttaaggtcctcggtttgagcccgagtgtcagtgggcagccccagtccttgcctttgtccttctgcaagcctggggaggcctggccttggaggaagagcgtctgcagggcagcggtgatgtcgttttgcaaacagagtcagtgtggatgccagctgagagcagggggccctctgccatgctccccacacagtgggaaga

SEQ ID NO: 12382 - DNA, 201 bp, Bos taurus
gattcctcagcttaggaaagctcattcattttgtacccatgaattcccagaagagttaacccattttatggcatatctggccatcttttggcctacccccatcatttcaactagtccaagaaggcaaaaccagagaagggtggggattgagagaggagagatgggagaagcatttaccactggccaccccgtaattgggat

SEQ ID NO: 12383 - DNA, 201 bp, Bos taurus
gtgcagaggttgactcggcggagggtgcacggttcctgccaaagacgtcactcagggctgttaaagtggggcgtttacgccctgccacggcatgtgtcccgcttggccactgccttacgggacccggcagggctctgtcacccccattttacaggggaacttactgagacagattgtcatgcggccaaggccacccagtga

SEQ ID NO: 12384 - DNA, 201 bp, Bos taurus
agcggtgtctccgtttccctttcctctcgggtcttgcttgtgtcaatcagaagaaaagtggcatcagtttctagtgaacctggccagcacctttcagccctgtccacgtgaagggctgcaggtagcaacgcgacttgggcggtggcaggatgtctgtggagctggagtcatccctcgggaggggcggagctcactgccccg

SEQ ID NO: 12385 - DNA, 201 bp, Bos taurus
caatactgtatcaaattcagtagagactttaaaaatgactcacatccaaaaatctttaaaaaataaaaaagcaaagcacttactttaaaaggcatttgggaatgtccttcctgacagaagccaatttacaagagcctttttcccagttaggggtaggacatgcctgttctggccttcccagcatctgagccgctctctttt

SEQ ID NO: 12386 - DNA, 201 bp, Bos taurus
gcagaagacccatctgagtgctcggtgactcaaagcatcagttacattttgtaggataagagtgtcgtatcccacctagggcccagtgcgtcgcgccttcagtagaccactgcactgtcctattacggtgccgagtatcaggagggtggatgagatgttccatagattcagggactgtggtgccggccaagcgccgtggga

SEQ ID NO: 12387 - DNA, 201 bp, Bos taurus
ggcccaccttaaatcatggtctcatctatcagtcctcagctaatctgcagagatcctatttctaaacaagatcacattcacaagtgttgaggggttaggacttggccatatcttctgcaggaacactatttatgccactacagtgagtaatggagaaggaaatggcaacccagttcagtattcttgcctggagaatccccg

SEQ ID NO: 12388 - DNA, 201 bp, Bos taurus
acctggctcctccatccatgggattttccaagcaatagtactggagtggggtgccattgccttctccaccgttaggtctagcttattcttttttatctcattaggtgaactaggtctaggctaactggatttcttctaaggccagtagtataagtcttgcatttgagaccaggagctggcaaatttatttctgaaagggcc

SEQ ID NO: 12389 - DNA, 201 bp, Bos taurus
tttctataaaaggaaaaaagccctgccagggactcctatcaaactgcagttgaaaaacaaagttaggtctgcccggccaggaggttgcaaacttgtatttgcagcaatatttgggaagactatttggttccaggtgtttccaaagttgttcacggcccagacggtgctggtccttgctgctcttttcacgcacatgctgcc

SEQ ID NO: 12390 - DNA, 201 bp, Bos taurus
ttatacccctctttctctcaggcattgtgtgaaagctggtggagcacagttagccaaagccctctggtaacgaagggtgatgcggcattgaaagagcaacagttaaactaaacaggctcttctcctgcagtcttatcagacagtccagcaatcacaggatctgattaaaatcaaatccttggatttacccaaaggagttga

SEQ ID NO: 12391 - DNA, 201 bp, Bos taurus
agtgctgtctagggagaataaataaatgtaaaatcaggatagtcacatatgatcacagatgcagccgcaatctgaaaaagaaaacagagaaggtaccttacttcttatgcaaacagttgtaaccaagttgaaaaccgctcagacttgatcacattggcctcttatgttgattactctagtcctgttttggggtgttacagg

SEQ ID NO: 12392 - DNA, 201 bp, Bos taurus
gagcctttgcttatttctccaaaaccaaccttttaggccagagatgaaagtgtctttagaagattttagccagtacaggcaaagatattccctgacaggacgaagctgggcctgggctcagcagaatcagcttctctggacactagatctgtaaccttgagtaagttttttgtggttctcagactttgctccacttaaaaa

SEQ ID NO: 12393 - DNA, 201 bp, Bos taurus
atcttctctgccaatgacatttggggctgagatctgaaggacagatgcgggctgaccaggatggccgatgagatgcccatgcttactaggagggctgcactagaagattcttgtgttgggaaggaacagaataagttggaagaactgagaaaagactggtatacctggataatgaggaatgaaggggatctcttgtgatgt

SEQ ID NO: 12394 - DNA, 201 bp, Bos taurus
ggccagctctgatgtgtatcctccccatgccccagtgctagctgcagcctgactctggctttgttactaattgaatgtgttaatggacccacatcatatattctctgtgggcctcagtttcctcatctgttaaatgggacttgggggtatctgaagtagatgagccttagcatgccatcagcctcaaggagtgcaggtttc

SEQ ID NO: 12395 - DNA, 201 bp, Bos taurus
ctcaccaacactggggcccgatgctatcatctgaaaatggaggctagaaaatgtctctctgttgatttaatttgcatttcttcagttgctggtggaacccgtggttatttatgggccattatggttctttgtgagttgccagcacaagcgctttgtccatttgtgaaaactgggctgttaatttcgttttctgtttcatag

SEQ ID NO: 12396 - DNA, 201 bp, Bos taurus
tggaggacgggaggcaggtgaggggtgatccagcaggccaggctggcttgaatttcctctgggttccaggagatgggagggaagacgcggagcagctagggagcctgggaggcctgggccttcgagggaaagttcccggataagaagccggaagtgagtggggattggccttgaagggagcggaagcgggctggaactgtg

SEQ ID NO: 12397 - DNA, 201 bp, Bos taurus
aacgtgctcccagcatcttagctgacctcacgtggctccccaggagaatcatctgggtgctcaggaaagttcagcttcccggcccgctcagtgactcaggatagggaggggtctggtttatcgcccatctccaccccatctccccggctccagctgcatctcacgattgggcaagtttgggaaacagcccaagctttgagg

SEQ ID NO: 12398 - DNA, 201 bp, Bos taurus
ggtgaggggccagtggggctagttaattcaagatgggatcaaggacctggtccttttatttctttactctgccatcctcagcttgctggcttcgttcttagtctggattccctcatggccccaggatggctgccacagctctagacatcacaaccagacatgataaagatgaaaaagtccaacagaagaggccatgtgtgt

SEQ ID NO: 12399 - DNA, 201 bp, Bos taurus
taaaaaaaaaaaaactaacagtttagcaaaaaagcaaaatttgacaagcatgctttgttggtgaagccatgaagactcaggccatctcatacaagctggtgggagtgcaagttagcacaaccaggcatggaagccacttgtcaatatctagcaacgttgcaaatctctgtgctcttggccagtttcccctagaaacatcaa

SEQ ID NO: 12400 - DNA, 201 bp, Bos taurus
tggggggcaaggggaaaggtgaacttacatttcaggaaaccaatccatcagtggctgggacccgtgtgtcctgcagaattctagtccagacaggtttggctagacaggtttggggaagtgaattctccatgcccctcatagggattcatgaggtcttgagggccccacccaaagagcccccctttcttcttccagtttggc

SEQ ID NO: 12401 - DNA, 201 bp, Bos taurus
gcgtgtgcatccttgaggtggtgggccttgtttgcttacatctcctcctcaccaccgccaaaaaggctaggggaatcactgtctcatagaagtaatgtgccgattaaacagggtcctagctccctgaccggcatcacttaattgggatgcttcttttaattcatgcagttgctgctgtttttaccaaatgaaatcttttga

SEQ ID NO: 12402 - DNA, 201 bp, Bos taurus
atcaaggcattggggaagttcggttcctctgctaaaacagcttaggtcgagtgccttttagcaggctgatgagaacctcatcagctgacgatcaggcctcccggactggtctctcgaccttgaacgtgtggttcctgtgccctcactgtggactggactctgcaggccccttcctattttggagtctgttgtgtcagtctc

SEQ ID NO: 12403 - DNA, 201 bp, Bos taurus
caaggtttttcaaatgtccgttattaaacatttgccagtctagcactggttccagcccctcgagaagcgccaagtctagctggcaaggcagctggtgtgagcagacttgaggcaggcttctggctccttgacacccagggctcagctgagccctggaaagagacccagcctcagggcagcaacggccaccgagccggataa

SEQ ID NO: 12404 - DNA, 201 bp, Bos taurus
gggtgtgcaagagcttataatgggaggcaggcagtgtttctgtgagctctgaggggtgcggggaacatccagacagaggccaagcacagggaagcgcccccggctcctgtgtgaggaaatgaagcctgagatgaggcctggcgcacacatgcaaggtcctgaaccggctgcctgcctgtcctcagagcgcccgagcaaaag

SEQ ID NO: 12405 - DNA, 201 bp, Bos taurus
cacacagtcaccgaggctgcccagccacgcctcagcaggacgacgcagggcgagggccaggctccgagcccgaggggacaaggcctgggcagccccactgaccgtgtgggtcagcggcagagaggctggcgaacaggtgactcctgctgctggcgtccacgctggcccccgacgcggctcagggctctcgcccgatggttc

SEQ ID NO: 12406 - DNA, 201 bp, Bos taurus
gggcccccagttcagcccccgaggaacagggcctcagcccccgcggcctcccccaccagcccctttggatagggtctgagctaccaggctgcacccaggcacccttgcacggcttcactttgtggcccactccttgcaggctcctcatgtttgttttaaatcagggttatcaagacacaactcacaagcaacaccgttcgt

SEQ ID NO: 12407 - DNA, 201 bp, Bos taurus
tggaattggctcccccggctcacggtggggccagatgcttgtacgcgtgggggagtcagggcactgcccggggcaggggtctcctgcttcatttccctggaggccgggcccgcggtggcagtgacttgaccctgctccccagaggtgaaaggtccccactttgcagccggcgctaattcccagaaccatccatctcccggc

SEQ ID NO: 12408 - DNA, 201 bp, Bos taurus
tggacactgacagtggtgggaagggcttccccagtgggcactgatacaggcccggggctggtggacccggcgctcgggggctgtcggcccagcctgcagacagcgccgggattccagctgctccttcatcttccatgccagcaccctcgtccttctcgagggaggccttgcactcacttttccttctgcaagtgaacagtt

SEQ ID NO: 12409 - DNA, 201 bp, Bos taurus
ttgaccctttgacttccccttttgccaccagctggagaaaattctctgccttttaagggcgcgtgtgatttgattaggctcacccagatcatctccctttcgattcactcaaggccaacagatgagtaaccttaattacacctgccgaactccttctgccccataaaataacaaagtcagggtgtggtgtctcatcccttc

SEQ ID NO: 12410 - DNA, 201 bp, Bos taurus
cctcaaggagctaggtccttcctgtcaccttgtcttgcccaccatgacgttggctttgtcctcatgctggttacaagatggcggccgtggttccaggcattacggaagaagagagaccatctctcccatggtgctctcctggaagtcaggagattctcccagaaggcccctggctgtcactgtcttccagttcattggcca

SEQ ID NO: 12411 - DNA, 201 bp, Bos taurus
gacaagggggccggggtgtcatttcagctccttgaggacccttgccctccctggcctctgaggccttgctttaactgatcctggggccttgctctcatccggagagctccccacttcctgggggaccctcctctcgacaaggagtgtgttggcactgcctctgagcatggacatttctgtgtcctctgccatccacagcca

SEQ ID NO: 12412 - DNA, 201 bp, Bos taurus
gccctttgctgtggccccagcaactagactcaacttccagtgaggccagcgaggctgctcagcctccactggagttccctccttagactagggacgagacgaaagacccctgacgggcctggcacaggggcagtggtggcaactgagcaaaatacacacagtgaccgcattcagagatgacgccacacccaccggtggttt

SEQ ID NO: 12413 - DNA, 201 bp, Bos taurus
atttaactagccccctactgatagcgccttaatgacaaacgtcacacttcccatggactcaggtattaggcagctcctccgctgtggccagctgggactcctgggcactctcagtctggtcttcctttttcttcctcacaatctctgcagccgctttagtggggtccgcctccagcttgaggctatgttcatggctgggtg

SEQ ID NO: 12414 - DNA, 201 bp, Bos taurus
ttctagatttgaaccacacacggcattccaagggctctgccaagacaacatgtgtttaaatgcccggtaagtggttccagctgtgtgggccctgaattccagagacagggagaggtcaccttgcagttacgcacccctgcataagtgggttgagggcgccttctagtgcagggccacgagctttctgctggagtggggtgc

SEQ ID NO: 12415 - DNA, 201 bp, Bos taurus
gaggagagccctcacttccctcttactttctcccagatcccgttgggaactgcacgtggctgtagggaacagaaccaaactcaggccgtggaataaggagcgtgtttcctcctgggaccccagaggcatccagccaggcatgccggctggggcagcagccccaagctggccatagtgaccaccaccccccacccaccccac

SEQ ID NO: 12416 - DNA, 201 bp, Bos taurus
gtcccaggagaaggaaatgacaatccactctggtattcttgcctgggaaatcccatggacagaaggagcgtggcggactacagtccgtggggtcacaaaaggttggacacaacttactgtcagcaacaacaatatcactgtcacaacaattctgagcctctggccctttaatcctccctgacccaggaaccagctcagctt

SEQ ID NO: 12417 - DNA, 201 bp, Bos taurus
ctccccaggcctatgtggtgagaactctctggaggactcggcctttggacactgaagttacctagcttgtctgtgggaggtttgaagcttctgcccagacagcagtgccctcggcctgtgtggaggcacagttgtggacactcaagcacagcctcctgtcctgggactcagccccaccctagagcatctgctgtggatagc

SEQ ID NO: 12418 - DNA, 201 bp, Bos taurus
cagtgaaggaaatgcacacacacacacacacacacacacacgtgctgaccagtgaaggcctgcccagactctgagggtggccgtcttgtggtgagtgatacggcttggagtggacatggactcgggagcagacatctctgacagatgcttcagctgtggagggtggcaggaacctcctagctgcacaggccatctagacgt

SEQ ID NO: 12419 - DNA, 201 bp, Bos taurus
tgggcagaatccccagccatgcccttccacagtggctcatggcccctagccactctggtgagaagtgaagcctgggccgtgggtcacgctggggcagaggtctcagaatcgggacctgagcttcaggagcttggagacggctcagcgaggtggtgggaggctggcccaggacacaggatgcccaccttcaaggccaggcca

SEQ ID NO: 12420 - DNA, 201 bp, Bos taurus
gaccttgtgtcccaatcgccaagggctctgtgtggcatacctggcctgtccagggcccgttttctgggcctgttccagagaagcacatgctctaacctccaactgctgcatctgttcccacggggcgacagcacctctgcgtcgtccgggacagctcgagttctgagccacagcaggcccagcttcacacgtgtccctgcg

SEQ ID NO: 12421 - DNA, 201 bp, Bos taurus
ttctgctgcagctgtgctctgctggggcacatggcccacagtgccagcaaaatgaccgaggaaatgctggaaggttcctgaggatgcactgaaatggacatgtctctggccagcacagggagctggggtcaagctgacacccacgtgagaatagagccaggaatcagcacccacaggggacccgggcagcctcagaccttc

SEQ ID NO: 12422 - DNA, 201 bp, Bos taurus
gcgacctcatcttgctttcttccgaggggctggggcacctgctcgctaccgcacatctcacacatattagccagcaggagtgttaaggtcactcttttcgcggccagcatgtggggtgaagccagccatcaccgtccaaagcttctgcagcggcaacggctcctgtcatacccaacacaaaagcagcagcccagggctggt

SEQ ID NO: 12423 - DNA, 201 bp, Bos taurus
tccctgagggccatgatctcctaggccagagacaacagagctggagttcaaactcagtgcctcctcaaagctccagacatccacaccctctggtccccaggtggccgagatgtgggacacaggccagccctgcctcgctgagcaggggaccagacatcagagctgcaagccagaggccctgccttcacagctggtcactca

SEQ ID NO: 12424 - DNA, 201 bp, Bos taurus
ttttggagcaccaaccatacatgagggaggagtttgtggaggggccagggacttggcgggtagtgtccagggtgcagggtgggctcacctgcaatttgggataagggctttgtggccagaataaggagggtggatataatctgtgtggtggtgaggagccgtggggagagggtgggctcaagggggactgggaggtggatg

SEQ ID NO: 12425 - DNA, 201 bp, Bos taurus
atggccagtgcaaaggccctgaggcaggagcacgaaagtgcccagtatgagggagaatgttcgcagcctttctgacaggcctcctctcccccacctgacctggagcccagctttcggctccgccccggacacgtgctgtcactcagccgcaggccccgcccaggccccgcccctcctgcccccgcacacgtgctatcactc

SEQ ID NO: 12426 - DNA, 201 bp, Bos taurus
gggacacgcctccctcccactcccgcttctggacatcgtccttgaagcaccagtcagaggatgaggaagaaaagggggaaaagacacaaactaattgggatggaaaataaaacattctacttgataacgacatgactgtctatctgaaaaactgcaaggaatcaaccaaaaactccacgatacagtgagctcaaagaggct

SEQ ID NO: 12427 - DNA, 201 bp, Bos taurus
gtgcaggccaggtcattcaaagcagcaagacagcctcagccagaagcttgccactgtgggcacaggtacagccatgagcttgtgtgacaacctacgggctacaaggtcaggccaagtgtggagtcactaggcctttttctaaacattttgattgaaatgtaattgatttataatgtattagttgcaagtgtagagcaaact

SEQ ID NO: 12428 - DNA, 201 bp, Bos taurus
tgccgagggttcaccagtaccaaggcaggagactgccagctctaggctggcccaggtgagttaaggcaggacacggtggggaaggcccctacctgcctccggagtctgggcaaagactaaggaggcttccccaagtgtgagacagaggggaggcacagccttcgagaatgccaccagaatacagaggggcagggccctgtc

SEQ ID NO: 12429 - DNA, 201 bp, Bos taurus
ccccttcccatgagagacaccttttcatgtttctcctggcccagggtgtccgctcccggaagctgaagtgggacccccagtgttcagggcagccctgtgtgtcctgtgggctctgggccctcatgtgacttgctgggcctctggcaggtggcctcctaagtgaccagggttgcctgtatcttttaaatggccttcctcaca

SEQ ID NO: 12430 - DNA, 201 bp, Bos taurus
tggcctcattaaaggatgagctccaaagattagaaactataaggtctgcagccattgaagttgggatcctaagtgaaactgtgaaacttagcagaaccctggggccctcctggacactagaccttttttcccgtcccccctttttgttttcaggaaaaaagctttcagtctcctagattttacctaaatccccaagggcag

SEQ ID NO: 12431 - DNA, 201 bp, Bos taurus
atggacctggttacagtccatgggacctcaaagagtcagacacagctgagcgtgcacacatgcatgcatgcgcacacacacactttttagttcacagctcggcattggtagcgctatgttgtattttaaattatctgcacacacgtgtgacatgactgcctttctgtaggtatgagcttattgcaagcagtagttaacttg

SEQ ID NO: 12432 - DNA, 201 bp, Bos taurus
agttacctacactgataaaccaaggccttcatttacaagcatcaacagaaaattaaggattaccagctatttgaggaaaataaagagagcaagagagaaggaacaagataaaacatgaggaacagggagtttcctggtggcctagtggttaggattctgggctttcactgctgaggcccaggttaaatccctggtcaaggc

SEQ ID NO: 12433 - DNA, 201 bp, Bos taurus
tgttgctgtcactggcaggaccagacaaccaactattggccatggctcaagagtcagaaaaaatgtgagagagaattgactgttgagtagagcatatagtgctaagataactgtgtggagtttggccaggagtgccaaccctcagatcctgcccttgatcaggaaacatcctgcttaaggaattaatagcaacagctttcc

SEQ ID NO: 12434 - DNA, 201 bp, Bos taurus
atcctctttcataaacaataactggaacatgtcctcaggggtttgaataagatattgatggaaatgtttcatttgtctacactggaaaaaagggatttttgtttttgcttggtgataaagcatgaatcttatttttggacataatccatagtgttctaggagtcactagttatgccaatttttaaaatttatcagtgtaag

SEQ ID NO: 12435 - DNA, 201 bp, Bos taurus
gtgctgatgtgattgccagctttaattcttcaagggctgttgctgtctctcagtccaatttagtgaatctccttttgatccagttaggagttcatataacgtctgggccatcttggaatagcccagaatccaagtcctacaaaacccagtggctcccaagaactctcggacctgtcctctggttcttggttgtgggattct

SEQ ID NO: 12436 - DNA, 201 bp, Bos taurus
ccaggagttggtgatggacagggaggcctggtgtgctgcagtccgtggggttgcaaagagttggacatgcctgagcaactgaactgaacacagaagccacgtttttggcctcatgttcttcaccgtgagtgtgctttccagttcactgcatccctctcagcccttccttttccacttgacctgcttcacgcattcattcat

SEQ ID NO: 12437 - DNA, 201 bp, Bos taurus
aagaaacaaaaagagaatggtttgttatttcaaaaagtaaaaacataaaagaagccagagtatgttgaaaaagaagagaatgttttggctttttgacttgtgtaattacttcaaaatatttcaaatgattacttggattcatcttttctatatgagcttgagaaaaacatgcaaaagtactactactctctcttgctcccc

SEQ ID NO: 12438 - DNA, 201 bp, Bos taurus
agcatgtgctgagctcgttacttgcagtatgacctttagttcttcaataaccccctgaggatgtgctgttttttcctgtacagaccagaagcagaggccacgctaatcagtactatctctctagagcctgcattctcaatggggtgaagtcacccccaggggggtaaaaattggcccttgggaggacaggggtaaaaaaaa

SEQ ID NO: 12439 - DNA, 201 bp, Bos taurus
ctactggctattgccagcagggctgcgaacgtggaccccggcttcctctgcaggacctcaggcttgtcaaactccaccacctgggaggcagagagagaaggggagggaagcagggtgcagctgagctcagtcctgagggatccgaaggcctgggcgccatcctcccagcggcctgggggtgtcccctcaccttcccgttgc

SEQ ID NO: 12440 - DNA, 201 bp, Bos taurus
ccccctgctgaggcatccttttgggtgcagaggggctccttcctgctccttgttgaaccctgtggcagacacacatgagtgctgtgctcacatggccaggcctgggtgcagactcttctgagggtgcacaggccatgccggtggctgtgtggtgcgcatgcccacagacagccgccccaggccttaagtgggcagctgggg

SEQ ID NO: 12441 - DNA, 201 bp, Bos taurus
ctgaagaagctgagagaactagacttcatttctcctgttcctctcccttcccttccctggggagttgggtaaagctttctgggggcgagttctcagagctcctggagccccttgctggccctggccatctgctcgactgctgaatccctccagcccagcgcctgatcatctctgttccagaaactgggaagctccttccca

SEQ ID NO: 12442 - DNA, 201 bp, Bos taurus
gggggtggggagtgatcagtattttaactaattggcctcctaacagttacaagaaccaaaatgaaagctagagaaagtaagaaaacaagattctctagtctgaacagaggccataacgcattcttttgcttatcttcaaacaagagctaaagcagacacgtaagagtttttaatttgccagatattcttttaatgagaatt

SEQ ID NO: 12443 - DNA, 201 bp, Bos taurus
tgaaaatcctttgaattgcccataagttacagtgcatattgttttgtggcaatcaaaattccaaacatcatgctttgccaaaatcaaattttggcccctcgtatccctgtcccttctccctgttagaccattaatcaacggcattttgcccatccaaaaatgacactaatacctttggccccgtgctggagtaccttataa

SEQ ID NO: 12444 - DNA, 201 bp, Bos taurus
gatttatttatttgtgtgtctatggccgtgctgagttttcagtgctgcaccggcttttctctggttgcagtgagaggcctactcaggctgctcactagttgtggtgtgcgggcttctcgtttgttgcggagcacgggctctagggtgcatgggcctcagtggctgcagctcctggggctctagagctcaggctcagtagtt

SEQ ID NO: 12445 - DNA, 201 bp, Bos taurus
gcatggtttttgctgccagaaactgagacgccaaaggcactgcctccagagatgccctcctggcttgtccttggtgacaagtggagagcctgatcctgacaatgggaggtgaggcccctttagctccccaaggaaggagcggctgcactgctggccttgctgggaacatgccgccactggagggaaacgtgttgatttcca

SEQ ID NO: 12446 - DNA, 201 bp, Bos taurus
acacatgtgggcaaatgaaaatagtttgctgttgcagcagctgagcatagggcaggcagtggggatttaaagggtgataggccatctaagtggacccctggaattaccctataagataggcactgttgtcatcatactgatattacagatgaggaaaatgagatcacagaggtttggtagcttgtccaagtcccacagctg

SEQ ID NO: 12447 - DNA, 201 bp, Bos taurus
tgggcaggttctcctcatgagataccaaagtagtatcaaagtggactatgggcccagctctgtgaaaagagaacttctacggccaatagtttcaaagttttagagtttacccttattggaagagttgagatcatctcctcacccttgagcagctcgctgtggccaaggcgagggaatgtgatgattggctaagcctacctt

SEQ ID NO: 12448 - DNA, 201 bp, Bos taurus
tcccctctttgcatggcctcagtgacacaatcgctctaagggtctgaaggcaagggcagtgcttgctctctgggggaggcagggctggaagggggcacacgggagctactggagggccagtacaggtcctccttcttggtctggttgtgttccatttccagaaattcctcaagctgtacatttgcagtttgtgcattttcc

SEQ ID NO: 12449 - DNA, 201 bp, Bos taurus
ccctgggaatatcttgtccaagcagttaatccctgcccctcctcccacccactgccctacctccggcatcagcaaaaagcctgtctaccttccagaggtgcacacgtgctccctgagtgggcccccaccgggacccctattgggccactggaccagactggggtccgcaggttgccttaattatcagtcactccacctcct

SEQ ID NO: 12450 - DNA, 201 bp, Bos taurus
taggaaaaactcccttcaggttatatttagaaaggggtggagggggaaaggcttcctctagtaattttcattcagttgcacacgactgcctgtccccacctacccgcaggccagcgccacgggggcaggcaaccgcctctccccgagcatgggttaaaatcaagcccagcctctgcccaaccctgattatgcccacgttta

SEQ ID NO: 12451 - DNA, 201 bp, Bos taurus
agccctgttcctagcgcagcgcactgcctgtaaaatacattcttaaaacgcctgtcgtattttatctgatgctcaaaattgattttctttttggatgacatgcaatatgaaccggccgctcgatgatctctttatcagccatagactgcggggtgacactcatcctacacgagtgaacactgcgagcaggcccagatgcgg

SEQ ID NO: 12452 - DNA, 201 bp, Bos taurus
tcctgtggattttaaaatctcctgtggatttcatgagatgaaatcatatcaagaagttgtttattaagatatattataaagtataccctttggcctgatcgtactccatgagtcacactgaagagtcgagtcgcattttgccatttaactttattccggagatgtttctcaaaagtaaatttgtcttcagtggaaggccaa

SEQ ID NO: 12453 - DNA, 201 bp, Bos taurus
agtcttcaaagggcttgtagcaagttaggcctggagtggggactagggcctggccttctggtcttcctgtccagttttggcctggttctggtggagtctcggtgcccattaggagcctgatcccaccccccaggcagtctcaagcgggcccgttaaatccccctcaagagtgaaacatattgcctgtccacctacctgccc

SEQ ID NO: 12454 - DNA, 201 bp, Bos taurus
taagagaatgctctgcaactttactgcatcgtcaaaaagttcacaggagagaatgtgtgaataaagactaaaccttcttagcagtagtaaatataaagttcagtagaatagtgtgtgaaaatttcatatttaataaaacagttcatcttctgagatttatgaattattagatatttaaaacgagcatgtgaatatgggaag

SEQ ID NO: 12455 - DNA, 201 bp, Bos taurus
tcctcttctagccaggtgagaggagcactctatttaattttattgagacaggtcttttttttaaatattgattttttattttttgacagtgccatgggacgtgtggaatcttagttccctgaccagggattgaacctgcacccccagcattagaagcatggagccttagccactagactgtcagggaagtcccaagaggaa

SEQ ID NO: 12456 - DNA, 201 bp, Bos taurus
ggcctctcaccatggggtagtggccagaggcggtggccgctgggctgggggaaggacaggagagtggacaggggagatggcactctggccccggtgctgccgtgactgcctgcacttcctctctggtcctccgtttcctcgtgggtgaaggaaacctttgctaccagctccctcccaaggctgtccagggggccaaaatgg

SEQ ID NO: 12457 - DNA, 201 bp, Bos taurus
ctcagccagtcttggtaaagccattatcccctttgccagtgattggttcaggataagtcacatgaccctattctggccaataagacttgaagggaaatcttttgaggggctgtaagatgtctgggtggtagccatcttgccaccagcttgaggatcacagagcagacatgggggagaacccgggccctagaggaggaagtc

SEQ ID NO: 12458 - DNA, 201 bp, Bos taurus
aaggccacagacagagtgggctgtgggggcaccactatggttatcctgagacatagcatggcggggctggggtgtgggcaccacttagttgtaagggaaaccaaggccaaggttaaataactgatcaaagggcatagagttgggatccaaagccaggttcgcttgagtccagcgtctatgctgttcaacctgttgcctccc

SEQ ID NO: 12459 - DNA, 201 bp, Bos taurus
tggaaacagtgccagcgattaggtagggccttcctaaggattccagtgttctttagtagagactctgggtccccaattccaaagccctccaccccaccgagcgtatgacattagtaccctggccaggcacagggagggtgtccacttttctggggtgctctgtccttgtggcatttctcagaagcttagaggctggcactt

SEQ ID NO: 12460 - DNA, 201 bp, Bos taurus
agctctcctagaccttggcagtcaggttcactgcctatggagaccagacaggtaatgaaagaagtgttgaggtgataaacgggatgggagaagcaggcccggaggagtccggtttttctcgaagttaggaatttccaagagaagtgagatttcccaaatttgttaaaaatctggccaactttgttaaaaatctggccacca

SEQ ID NO: 12461 - DNA, 201 bp, Bos taurus
ttgtctctaaaatagcctattgtctgttgaccatgatttgttctttctctcacacacaccactactttgtccagttggtgaccaggctttagacctggcccctcttggacccagcactctgtcaggaagtgaacatttgttacctgtgtgagtaagtcaccccatgactctcctcttcaaagtctttctgaagagttggcc

SEQ ID NO: 12462 - DNA, 201 bp, Bos taurus
atcccactggagagagtagatttgttattttctgtgttacgttgttaattgatttgataattgcctgggagacacacacagacatacacatacacaaaacaaatgtcaggccacacacttttctctagacagtaagatgaagatgttttagttattggaacgcagatgtcacctagaagaataagaggaggtaccgggaaa

SEQ ID NO: 12463 - DNA, 201 bp, Bos taurus
tttgataagaagaaaaaatcataactaactaaaagaaaaaaaaaaaaaaaaaaacctgtcttgagaactagagaagatcagacaaagtaggaatgagttaatggaggtaattagagagaagccagccatgctgacagaaggcagcctaacacccagagccttaaaatcctgggctggcctgcttgcttgctcccctgcctg

SEQ ID NO: 12464 - DNA, 201 bp, Bos taurus
tgggcatcttttatataatgatagcaacttgtacattagatgtgcttggtctcttttggtttcttgaaaaggactgaaatgagagagaagagtagccattaatgtgaatggaaaaaacagctactttctttgatgtcactgtaaaaaccagaaagatctctgcctgtcccccaaagatctgacattcacatgcaaatttct

SEQ ID NO: 12465 - DNA, 201 bp, Bos taurus
tttaattcagtccatacagtggaatagtgtacagcagtgtataccacagaagtgtagtgtacagctatgaatacccaaaaagtgcagccagatgcataaatttggatgaatgtcacaaaaataacactgaagggggggaaagcaagcagaaaagaaaatgccgggtagaattctacttattaaacaggttagaaatatgta

SEQ ID NO: 12466 - DNA, 201 bp, Bos taurus
gggaggcacacctgcaaaacagctcaggaagtttgcctccaatgcaatctagacatttcagagaggagctgaagcagaggataggagagaaggccaatccagggaaggtcccacagggtcctgcttgattacagtccttgggttgcagtccaaaggaaccagcccctgtctgggggttcctgagaagccagagggccagct

SEQ ID NO: 12467 - DNA, 201 bp, Bos taurus
tgaggatgccatgtcttctatgtgtttgagagaacatctctgggcagaaaatgagcacaaaatggggggggaaaatgggaaatggtaaatagacttcatctattctacaattctgcttgcctttagattaaaattgaaatgagagtaagaactaaggactgtcatgttttgaatagtaagagtgtcaaacttcagaattaa

SEQ ID NO: 12468 - DNA, 201 bp, Bos taurus
tggggccaaaaagagtaggacatgactgaagcgacttagcacacaaaatgccgtttcattccctcactttcctaattagtaactgcttggatctgctcttcggaattcgagggagacctaggagactaaagtctttttctgaacacaagaaatggggaacgcagaaagagctctgtattccagagagccccacagggtcca

SEQ ID NO: 12469 - DNA, 201 bp, Bos taurus
ggttgtgcctgattaggacggcaaggtcagaaaccgcatcgccagtgttggaaacccattttccgatggcggcaaagaaaagatgtccactctgccctcaacttgcaggccaacataaggatacgtctgaagcacgcaaattatctttggcacttcccctttcttgacagcctcgagctggaggcacccaacttactgccc

SEQ ID NO: 12470 - DNA, 201 bp, Bos taurus
aacctgactcacatgtttaggaattactgatcaaaactaaccaaatgtttgttctttgtaatatcccttatataccattttagaatgtttaataaactgatatgacttcattatttctaagaaccaatgttctatgtaagtacccatagaatatgtgtgtgtatgcacatatatataaactatatattttatataaaatat

SEQ ID NO: 12471 - DNA, 201 bp, Bos taurus
taacagctccttcaactaagggcaccccctggggatcaagaggaaaagcaagaattctggaacctcttttttcctcctctgtgcatttactcccaagatggtctcaccctgtctttttttttaaattagatttttgctatttaaaaaaaaatttattgaaatatagttgattcacaatgttgtgttagtttcaggtataca

SEQ ID NO: 12472 - DNA, 201 bp, Bos taurus
gtgagagataaactttggaggggtaaaatcttgaattggagggacttttcagaagagagattagcaaagggagttatcaggcagagttggaagctactctgtggccctctatggaactatgattactcaggcaatcggtgcacaagtactctagcgaacaactgccttgatgaaatgctaagcctttcctagccaatgtga

SEQ ID NO: 12473 - DNA, 201 bp, Bos taurus
acaggctgttcctgtaatgtcaacaaatttcatgtgaaatctaaaaagaactcttttttttttccccttgtaataaataatgttgttaaacctgtatttttagagaagttgaactacacttgtattcattttcctttcaaagcagttaagtttacccccgttaaccactgtcttttaataccacagataaggtttagcagc

SEQ ID NO: 12474 - DNA, 201 bp, Bos taurus
tgaaaggcaatgctgtaactcgataggcctgtaatctgcacgctgagattaattggaaagaattagggaagggactacagggagccgccatcatccttcccggggaaattcgtagatggggcctcgtacgtctttgccacctccaccccgagagtcccattgataaatgcgcagtgcaggtgtctgattaatttagacctg

SEQ ID NO: 12475 - DNA, 201 bp, Bos taurus
agttcctttaccagggattgaacctgggccttctgcattggaagtgtggagtcttaaccactggaccaccagggaagtccctatgtgtcgcattttaaatgaaggaggccttttaaataaagacggccagatggaggggctcatgttaggcaggcttgtcggccgcacaccctggctcctgtgcgtgtgtgtgtttgagtg

SEQ ID NO: 12476 - DNA, 201 bp, Bos taurus
tctgctctgcgatgttcctcgcaaacctgatacctgtctcccatttggtggatttgagtcacggtgtttttgtttaagacttcaactgcagctccttctcaatctttgtttcatgtatgtaatatacttaaaatgcactaaatgacagtttataatatcattatctacagttaaagatattataacttcaaaaatgaaaag

SEQ ID NO: 12477 - DNA, 201 bp, Bos taurus
aggccagagtctgtgtccctgttagaggttggggtcagagggcgacaccgtggacaggcgaggtggagggacaaacgtggcccagggagccctcgtcgaacgcagggcatcttggcggctaatgactcggggtggagtcggggggtcttggctttggaatcggggcgggtgggaactccagcggcctggctgccaagcaac

SEQ ID NO: 12478 - DNA, 201 bp, Bos taurus
agaagtcggtggtagaaggaacattggagatcacttaggcaatcctcctaatttctcagatggacagctgagtcccgcaaggactaagtattttgcttgcgatagagctggtatgaaaactggggtggggtggagggcacgtggggtcctgcctcccatttctttcaacaaggaacaactctgtttttttttttttttttc

SEQ ID NO: 12479 - DNA, 201 bp, Bos taurus
gtgggcagttgtggacgggaagagcttttcataaggggagcacggggagcttgtggcaggggggcacttataactgtggcaaatgggcctcagctaggaacagcaccagctatttacatatacatctaaaatagcacctcccttccccaatttcctccttccttgattcaccatagacaacagggttttcatcttccaggc

SEQ ID NO: 12480 - DNA, 201 bp, Bos taurus
aggtttaatccctggtgggataactaagacctaagactccacaagccctgcagctttaaaaaaaaaaaggaaatcgaaacaggaaacagagtggagagccctggtggccttggaccaggctcactggacattgttgaagacagcaagaccagtttccgaaaccacccacaggtaagagggggatcctaagttctttccagg

SEQ ID NO: 12481 - DNA, 201 bp, Bos taurus
tcatgcacaattcaccacgttctctttttccttcccataatgatgttccagatggtggagcctctatcatcctgggtcccaggctgaggacaacatggagtggagacccctgctgaccctcgatggatacgcaccgtgagcaagaaataaacctttgttgttttaagccactgagatttggggtcatttgttataacagca

SEQ ID NO: 12482 - DNA, 201 bp, Bos taurus
tcatttgtgttgttctaaaaccacttgcaaaaagtcaatcaaacaccaatatgacattcctccacatacatgttgctttcctggccacaaagcagtccaccgttagagcctttgttttgctttgtttcatctattcattaacaatcatatgtggggcacctactagtgcccaggcaaagttctgagtatgtgggaaaatgg

SEQ ID NO: 12483 - DNA, 201 bp, Bos taurus
caagtgagatgatatatacaaaacgcctggcacacagcaggcactcagtagacatgagtttctccccgaccccatcttcatctcccaggcctccacaaggacagtgactaaatctgattccatcacacaagtgcccgatctgcagtgggtccccaggaaatattttccaggtgagttattcactgaatgaatatagtgatg

SEQ ID NO: 12484 - DNA, 201 bp, Bos taurus
gaagtggccagaccccagatgatgctcaagaatcccaaacagctgagaatcctgagaagggcgggtttgtacccggccagctcagtaagaagcaaggtccggatctcgtgacctgatgcagcttgggcactgcgaagctgccaggaagaggtggtgtgaaacctggtgggagggacccgaaacagctcccagtcctgtcta

SEQ ID NO: 12485 - DNA, 201 bp, Bos taurus
cccggaaactctgaggctccccactctgggaaggatggtccccagtggcacttagaaacagcagagatctgcctccttcttgccgccccaatcaggccacgtcagctttgccatctcctcgttctggctccaccaccacgaaatgacccacatttctctcgggaagttatctctcatgcctgtggtagagccagagagaga

SEQ ID NO: 12486 - DNA, 201 bp, Bos taurus
aaaccccttcctcagatgaggaaactgaggccaaatgacagggactgactcagggtcatagagaacccgtggtgaagataaatctaactctccactcagcgtccaaggccccctttcgctctgactcctctccttcttcctctgggaaaccccctccctgccttctttttgctcctgggtgacagctgctcctacccacag

SEQ ID NO: 12487 - DNA, 201 bp, Bos taurus
gtctggggatattggagcattactctaaggcctttggacagccctttcctttccaaataacaccagtgtctgagcctcacttggctccccagagccacgccgcaaggcaggtggggcagaaatgggctctccattttctaggtgagtcagctgagaaaggtaactttctggcctcaaggtcaatgaggtttacgcatccaa

SEQ ID NO: 12488 - DNA, 201 bp, Bos taurus
tctgtccccggccagtgtaaaacggctacctggtctcactgcaaggaaagcagtgcagtggaggattagtatgtgcatttctgtatcctctggaataagcagggaaggcctaatgacctctcttagactgtcatcatccagaatgctgcctagcctggacctccctccatcaggaccagactcctcatctcagcttccctg

SEQ ID NO: 12489 - DNA, 201 bp, Bos taurus
ttctggccaggaaagcccctctcaggagttccaaggctttgttcagaaccttcttgaacatggaggcagtgccagtgaggctttttccaaggtcctccacgcctgtggtcttgcacctggccctgctggtccccagggagaagtggacagatcaattgggtcctcatgtctgcctccctgccagagaagagaccactgtga

SEQ ID NO: 12490 - DNA, 201 bp, Bos taurus
gccaccccactaaacattagaaggggcccaggactagcctcctctggtcttgccccctcctcctcatcctgaaaggccaaaaagccattctggccacaaccagggaaggtagttcttcctacttgtaggttagtggggtctccattcctcaaccacaaggatcgctggggccacagtctgagccatggagccatgtttgag

SEQ ID NO: 12491 - DNA, 201 bp, Bos taurus
tgtgctttttttatttggagttgatgccgtcaccaacttttctgtttggccttctggaggagtcctaagtgtgagggtgatctgcagcacggcagtggcccccgtccttgtgttttcacggcaggtcaccgggttcattgcccagagcctgcctcaccccgtgacctcagggagtaactgttgggagtgaccgcttctgtg

SEQ ID NO: 12492 - DNA, 201 bp, Bos taurus
ccacccgcctctcgagctcctcaggtttaccagggggctgtcacatcttcccatctgatgctcctgggaagcatcacagaagcaccagaagccacacagacaggcaggggcagggcctcactgggaccttaggcatcatggctcctgccatgccatcacttgccctggagacagacccggcctgtgcatttggtcctccaa

SEQ ID NO: 12493 - DNA, 201 bp, Bos taurus
aacaacaatatgctctaaatgagccgaggggaaatggggtgtgggcagaggctgtgagagcgggggctgctcactcaggccgccctccaggtgccctagctctctctacatccttgtggtctctgtgggcatcagcttcctcatctgtaaacgggccaggctgcatgctcttctaagctccatcttgtctaagagtaagtc

SEQ ID NO: 12494 - DNA, 201 bp, Bos taurus
ggaagaactgctagtgcggatcttgaccagaaggtagcaaatacatctggcctggctgagccgagagaccttaagttctcatgcaggtgagcatacggccatggtgcccaccactggggagggctccccaggaaccctcccatacagtctgaccctgtgtggcacccatgccattttacagaaagggccaagcagagcact

SEQ ID NO: 12495 - DNA, 201 bp, Bos taurus
agatcctgccaagtgtccccaactttgctgaagacctgaggactttgcggttggcaggcacatggttcctaacaagctgtctttgggttgtggccatcccagaagcagcagccagtgcattctaatatgtcacggctggtataagtgttggaagtagagtgatgcctttaagaagttactgggtggaagccactaccattt

SEQ ID NO: 12496 - DNA, 201 bp, Bos taurus
gatctctagagtagaggaattttataatcctctagcctgtaattgatatctccagggagatacttctcccacatggaaatgtgcacctctggcctcaactctgtccacagtgctcacgggctcttcccacagattggcagggttctgggaatttctccatctggacctgtctattgtgggggcacagcagtctcagaatgg

SEQ ID NO: 12497 - DNA, 201 bp, Bos taurus
gagtttaggacaggaggaggtttctctccatttcagaagctgttttggtgtcctgtcccctttaataagatacacatgtcctagtcctggccatggcagggagggctggtaaattttaaatccacaaatctccaggagatttgcagtgaaatgaaggatggagaaggccctgcccctcagaaatgagggcagagcttagaa

SEQ ID NO: 12498 - DNA, 201 bp, Bos taurus
ccctgactgaggatcgaacctggggccccctgcactcgagtgcagaggcttagccactgcaccaccagggaagttccctttgtacttttcatacagtagtatgattgcctgggccatggtcttgcctctgagaggtgagcaccttgagggaagggactctcagcttggaatcaccaccatccatcccagagcctgactctt

SEQ ID NO: 12499 - DNA, 201 bp, Bos taurus
cctcaggctgtgaggtctaagctcttcatacatttatgaggaaagggaggccctgagagacatgggacagccccacgcacaggggcagtcagcgccctacgtggtcgcctctgcagcctgggcccgaaccctgagcccctcctaggcacccctcatccccagggttacgtggatgcagatggtctgaggtggggagcaaag

SEQ ID NO: 12500 - DNA, 201 bp, Bos taurus
ccagtgcccacctctcccaggcaggggcacagcttggtcagcgggctgactggagagcacagcactgctttccagaagctcaggcctggggacttccttgtaccccgctatgtagctttattggccttcctcttccctgcagcttgatttatacgagcaggtaagggatggacttcaccggcagcagcccctggcctcctg

SEQ ID NO: 12501 - DNA, 201 bp, Bos taurus
gcagctgagccctctgcatggggtaggcaccggcctctgaaatcacccacatgtccttttgacaaggttctgggctaggaagcagaaagttgaggctctcggctacaacacttagctccccctctttccatgcccatgggtgcttttgaggcaggatccagtgggaccaggctgcagccccaggggaacagtgaggtcaca

SEQ ID NO: 12502 - DNA, 201 bp, Bos taurus
actttcctgccccttggggagatgagatagaagaggaaattggggcggggccagaaagaccatgcaggcacctcccatatccactcataaacctgtgcccacccccaccccaacagagagggcaggcccttgaccgctaagggctgggtaggggaagacctccacccactgggtcctcagctgctctgagaacaccatgac

SEQ ID NO: 12503 - DNA, 201 bp, Bos taurus
ggctgttacttgttgaactgagtgcccccgcaaattcatatgtcgcagtcctagcacccagctcctcagaatgtggccttatttggaaaaagggtcatcagaggtgtaaagaattaagtgaagatgaggtcgtgctggagttgggggagcccctaacccaataggactggtgtcctcataaaggggcctttggatacaaag

SEQ ID NO: 12504 - DNA, 201 bp, Bos taurus
tccatgctctaaggatggagttatggagcacaggaaaccggggttcctggtaggtaggtgggagtggttatctgtgcgtggtcaggtacagtgaaaggccgctgcttaagccagtttatgctgtttctgacacaaaccaagagaccagaatgaggcaggtggagaccagactggaggtccggagaggcagggaggggaaag

SEQ ID NO: 12505 - DNA, 201 bp, Bos taurus
aggggctctgtgtggaggagagtgcgttactgtgtttctccggacttccaggagcgctccgccgatgtcccggcaccggagagagatgagaagttgaccgagttttctcgcctccacaaaagcagctttcatcccacaatagactccagattggaggggagatttcaccacacagcggccagagacaagaaactctgttga

SEQ ID NO: 12506 - DNA, 201 bp, Bos taurus
acggccaggcagattggtctgagggtcatgaagaaaggaagtaaaaatcaccagctgtagtttctttttgaggccctctaggaaaaccatgaccacagtaaacaagtgactacagttagggtcagctgtctactttccctgtgcgctacgcttatgtgaagtagaaaccaacactggagactggagaaataacagtatcat

SEQ ID NO: 12507 - DNA, 201 bp, Bos taurus
atgtaaatgaagagataagaaattcctctgtcattcatcatccaaccattctcatatgttggaaagcactggatggaaacattcaccaaagcagcaggccgttcctgtcctcaaggaacgtactctgtctcggtcaccgtgtgcacatcaacacagaagttccttcctgcggctgaaatccagtaggccaagatgaagagc

SEQ ID NO: 12508 - DNA, 201 bp, Bos taurus
ttggcttcttttagtttagttttgttttttttttcccctattataaacggcactggggtgagctttcttagagataaatcattagatgctagtttccctaaggaaagcatatggtttccttaggaaatttctcccagggagaggactactgagtccaagagtaagaaccttttaaatgattctaattcagttctgtaaagc

SEQ ID NO: 12509 - DNA, 201 bp, Bos taurus
tctccatcttctgactcttatcttcagaagacagtggctagttggcttccctcttctgactgagcacctcttctggccatttcctgttttttttttttttccaccctcttacctcccactcccaaccctactattaatggcctggactcctgaatcctgcatttcagattttggtcctcatctgctaattagctgggaaag

SEQ ID NO: 12510 - DNA, 201 bp, Bos taurus
cagggcagagggattagggccgcggggccctggggcctccgtcccagcccacaccttctgctctccagccgcatcctcctgggccctttctgctcgtggacccagaaggggaccaccccagtcctttccgatgtgttttcctaactgactctcaggatggggaagttgtggtcaaggtgtctttccttccagaagcttctg

SEQ ID NO: 12511 - DNA, 201 bp, Bos taurus
ctcattggcaggtggattcttcaccactagcgccacctgggaagcccctaatggtggacacatgtcattatattatgtgtgatgtatacatatttaggttgcatgtattataaggttgcagatagaataggtggcagagatcagacttaaacccatgactttctgactacaaagtctacgatcttttttctgaaccaggct

SEQ ID NO: 12512 - DNA, 201 bp, Bos taurus
ctaactacatagacagactattcaataggcagaagtttcttttgcaggaagatcaacaaaaagttaaaaataacacaggtctcttggtctccagtgaatctgttgtggcctgtcacctgggtttggggaagtgacccttcctgccttgctgcactgccccatgaccttcagggggcgccctcccatacacaaatctagtct

SEQ ID NO: 12513 - DNA, 201 bp, Bos taurus
gactccttttacctagacaagttatatctatgtcctactgcagtgagaacacgtgccttagctcctatcattcagatatgagcatggccacctgaagaaaggaggaaagcagttcagacctgaagatagcatggtggtggctctggctgcatgccctgggtgggtcccaatgtttccaaggcccatgtccattagccacat

SEQ ID NO: 12514 - DNA, 201 bp, Bos taurus
ctaagcacagtgtactgggctctttcaaatttggtctccaactattgccagtgtcagctgacattcctttgtattgcgttcttcatggggatggtgtgagcgaccagaggcagggctttcatgaaccagtgcctttgccctatacctgaacccctcttgggctttctctctagtgttcagtcatatttcacaactaactca

SEQ ID NO: 12515 - DNA, 201 bp, Bos taurus
accttggtagtcccttcagcttacatgcagaggcagccctgaaatgcagaggggataaccttgaaccattggtagttggaagacagtggataaatgcctcagtctcctgttgttcagaagacaaattctagaagtaattttcatgcttcctagatgtcttggcagggtcaagaccttgttgccaaaatcagtgacctacat

SEQ ID NO: 12516 - DNA, 201 bp, Bos taurus
accattagcaccacctgggcaagcccctgacgtcttaattctcccagatttctatgagtcacttaaaatctcctggaggaagttttacatccttctaaattcattagttccacgggatgaagaacgggtatgggaatttgttatttacagttcagaagtgggacaggaattgagaagtagaatctagaattgcatatttgg

SEQ ID NO: 12517 - DNA, 201 bp, Bos taurus
attttggtgttaatctgttccttcttttcctagcacttataatttcttagcatctttagtgtgcctatatctagtaactaacatttaaatttgatgctgagagcatttagaaactaagaaaccaaatgatacagtgaatatccaagagactcccctttaagaaagtgtgagataatcgaaaatattcatactggtctctgc

SEQ ID NO: 12518 - DNA, 201 bp, Bos taurus
tatgagtatggcttatgtatttattgagtcgccatggggaaaggaggctctcttgtttgtgtgtgtgtatgtttgtgtagttatttaagatgtactcaaacactgtataggagtcctctgataaatccagttaggtattcaccatctctctagaattagaggttgtgcaaaacacatatcattaaatattcattcatttga

SEQ ID NO: 12519 - DNA, 201 bp, Bos taurus
agagttattaataatagtatctacctcttgggcttatatttagcatgaaaagggagatatgaagcccttagcattaaacttggcccatataaaaggctacgcattaaatattatcattaatattagaatattatatttggcactgttttttctggccttgttagtcatgtctctgagttttcctggatttaaagcagtata

SEQ ID NO: 12520 - DNA, 201 bp, Bos taurus
ctgaagaaaataactattggttttcttatttagaaagtgctacactgttccgatgtgttcgaaaatgacaaagtacctgggcccttcatcttcttccttcactgaagctaaaagggagagaataaataacagctgggagaaaagatcaatgaaggcctcgcctgcaataacagatagaaagtacctggcaaagggaaacca

SEQ ID NO: 12521 - DNA, 201 bp, Bos taurus
gaacaaggaaaggccttatctgctcccttttcatactgcattaatgcctcctattggttatttcagtcagttatatttagccaatcagagtagcagttccttgtacctaggcaaatggacagaggccaaggattggagagcaacataaattggaccaaattatcttgttccctcaatggccttagaagaaatgctcaaaga

SEQ ID NO: 12522 - DNA, 201 bp, Bos taurus
taatatatctctggtcactaatatgttaataatacataagaaggcaagaaaagagaaatgagaaacaagaaacagtggaaataaacagaaaaaaaataaagtggccaatcgaagcagtaacatatcaataacttcaatgtaaatggtataaatatatcaaataaaaagcagaaattcacagtggttgaaaaagtgactcat

SEQ ID NO: 12523 - DNA, 201 bp, Bos taurus
ttgggattgtaaagagttggacatggatgtgcgactgagcacacacacattaaatcacattctttgtaattgtttgatatagagactggccctcgtttattccacctattcacacatgttgaaaatctggtgcatgaaatgtactatataaagatctgggtagcaggagaggaggacggtaggcatgagttaagaggccct

SEQ ID NO: 12524 - DNA, 201 bp, Bos taurus
actgtggctccactggccaatatgatcaatttattttatcagtaaataaagataaaatatttatcatgacctgtaactagagttaagtgaaatgaataacgggcctctcactttttgtggggccatagctagtacattgtaaataaactgatttaagtattatttatgtcccatctacctaaaaggaatatcttcagacac

SEQ ID NO: 12525 - DNA, 201 bp, Bos taurus
tgcagaactggtttgagatttataatttagatatacatgtagtaaaatgcattattccatttaattcatttcaatccaaatgtcaaaatatgacagtgttaaaaaaaaaacttgaccatctagcaaatttaaatttatttcttcttaattcttttcagttcagtcatcagcagtatcaaaatttatcatttaaatgaatga

SEQ ID NO: 12526 - DNA, 201 bp, Bos taurus
agaggaagcaagattcttaacaattcaattaatgattggctcagaagtactcatcctttacaacaatgatagtttcttcaggtattgagtatgtttgacaattagtcaaggggccatgacttagtgtcagctcttgactaataataatatttctacttattgtgaatatatttagtcagtggacaactatgagaagagtaa

SEQ ID NO: 12527 - DNA, 201 bp, Bos taurus
tgtttttgctgactgtatagagcttctccaccttaaactgcaaagaatataatcaatctaattttggtattgaccatctagtgatgtccatgtatagcatcgtcacttgtgttgatggaagttgatgtttgctatgattagtgcattcttttgataaaactctgttaacccttgtcctactttatcttgtactccaagacc

SEQ ID NO: 12528 - DNA, 201 bp, Bos taurus
cacagagtgtctcaccagctgacagttccagagtgaagattccagcatacaggcccacgagatgcacaccaggcagtggcctccacaggctagcctgtgacggctgcggcaggcagggacaccccagcagccagttcccaaatagcgtagtggctttgcctctggccataagcacattcataacagaggccctctttttgt

SEQ ID NO: 12529 - DNA, 201 bp, Bos taurus
gaatatatctccctacttagacactaattacactggcagaacctatctaatataactagtttggaagtctggagtctgttggaggcttgcaacttccagggaaaaccttggctggtaaattgcactgattttggtcaattttatctcatagccaagtagcagctgcccattctcctccctcagccacatggtaggcaggca

SEQ ID NO: 12530 - DNA, 201 bp, Bos taurus
gagatcccacatgctgcaactaagacctggcacagacaaatacataaataaatacatttttaaaaggttacttatattcttagttttgccaaggtgttatcccagaacacttgttataattttactggaaattgctagaagctgtaacaaaggcggccatcttaaaattaagttcttagaagtttttgcaatagttttgac

SEQ ID NO: 12531 - DNA, 201 bp, Bos taurus
agttggggaactaagattcctcatgccagactgtatggtcaaaaaaaaaaagaaggaaagaaacgaagaaggaccaaagtgctaacttcacaatgtagacgagccaagtttcttggcaaaactacactgaataaaataaacacactaccttatatgactgttatttatttttatggtttttatcccaagtagactatcagc

SEQ ID NO: 12532 - DNA, 201 bp, Bos taurus
ttagttgaacagtttcaagaaatctgaataaatccagagaatacagaggataatgaagataataaggagagtgactagaacagaggataataaaaaaaaccgacaaaaggctgaaatcataggcagtggtatcttcctgtgggcatcttacaaatacattaaggatattagacttttacccaaaggagtttggagaaatta

SEQ ID NO: 12533 - DNA, 201 bp, Bos taurus
agaatacctaatggtacactgaaaccaatgggctcttacaaggcataatataaaaaagccagaactgttaacaaagaacacaaagtcatggaatttgggcgacatttttttttaaggtgaactttcactgctgtggagttaagtcacttaaattcttttcatagattttactatcttctccactcacacagcagtcaaccc

SEQ ID NO: 12534 - DNA, 201 bp, Bos taurus
cgcagaggatgttggactccagctactgtggtgggccacagatccatgcttgggctccctgccttagaagtttggagttgaattccaggaagtgggagctgcaggctcactccatgtggcctatgccctgttttgggtacaagatggtggagtagaaggatgtgtactcaccttctcctgtgagaactccaaaactgcaac

SEQ ID NO: 12535 - DNA, 201 bp, Bos taurus
acatatcagcaaactaaatgacacattcaccagagacctgccagttctgaggccgatcatcaaagatgaaaagtcaagatgtggcccagttcctggtaatcctagccccttactgaaatagttagaataatcctcccactcattagctaatgaaattacccagcccataaaaaccaatcacactatattttggggccactc

SEQ ID NO: 12536 - DNA, 201 bp, Bos taurus
tttgactcataataatgttatattattttaaattgatacataataaaccaaaagtaagtaatctatctatccaaaatatgtttcccatttagttggccttatgcttttctcaagtaaagacaaagatttgactcaaacttcaaaagatttgaagtttgactcaaacttcaaaaactggggctaaatataaactaggataaa

SEQ ID NO: 12537 - DNA, 201 bp, Bos taurus
ggggcaattattttaaaatataatgctcacctttccaataactttccatgtggttccctaaaattaagacacatttcatgttgactcatcaaagggccccatgacccctcctttgagacaatcctatctcaaaaagtacagttttaactcgccaacccagaacgaagagggaaaatgtcaggcctcctacatattcagaac

SEQ ID NO: 12538 - DNA, 201 bp, Bos taurus
ttcctgaaccagggactgaatccaggtctcctgcattgcaggcagatttttactgtctgagccaccaaggaaacccataggccataattaaatccaccctactcccagaaaaatttcttgttggaaatacatccttctttgactaattcatatacaaaatggccatgaaaatgtggcccataaaaggatttgatctaatct

SEQ ID NO: 12539 - DNA, 201 bp, Bos taurus
ggttcttattttgaactagctctacagccctgcccactggaggccatgagatttgttttatctacaccactgggatgctgtaaggtttatggagataatggatgtgagactgcttggtataatgcaattcagatacaaggagttgttctgcatatatatattaatttcatatttatacctcccttcaaaatgattttatat

SEQ ID NO: 12540 - DNA, 201 bp, Bos taurus
aatgatgtcagctctgagaaagtaaggccttccgttcagtgttaaggcacgactattaatgtggacagtatgggtcattgagcaagtatatatctgcaggttccagtaacttggtttctattgttaatacctcttcccgtaatttgtctcttgctccagtaattaataataagagcaaatgtcattcaattaatatttgga

SEQ ID NO: 12541 - DNA, 201 bp, Bos taurus
agacctgacagtttcttttgactactttctcatgtgtccttaaaatttagctgggtctgttaactggaacagagacagtttctgatgcagcctgggattccttacaacatgatcaactgataccaagggctgagcaagggaagagagagagagaagtaaggtgtggtgcctcttatgacctagctgtgaataccatacagt

SEQ ID NO: 12542 - DNA, 201 bp, Bos taurus
gactttagaagaatcaattgcagtagtgagctagttctactgaatgttgaagaaaggaggggacagctggaaagcagggataatttcaaagagatccaaggaacatctgagatcatggatgctgaaaaccaaaagtaaaaacagtgcacctcagactgggacttgaacccacagtctttttacctggtctcagaacttaat

SEQ ID NO: 12543 - DNA, 201 bp, Bos taurus
gcaattaaggtgttggtcaggctgcattctgactagaggcttgactgaaaacaggatcctgttttttgtttgtttgtttgaaatctcccttaagttttcagcaggattaatttctttgtgatgtgggaaatggcacttaacttctttagggcaagcaagaggctctctctgacttctctgacccaatcttagccactttga

SEQ ID NO: 12544 - DNA, 201 bp, Bos taurus
tgaataaaagccagattcagattttttttttaatttttattttatttttaaactttacaatattgtattagttttgccaaatatcgaaatgaatccttcttattcatggcacagggagagcagatccttggctcacccccttcactttccatctctagccccaccccacttctctgctaatcttcttcacgtctatacaca

SEQ ID NO: 12545 - DNA, 201 bp, Bos taurus
attgaggacttaagttttgtgataatcactgcatgttagtactttcaagaagaaaacagtctccgtttcctcataaatttgctgacagtgaaagcaagtgcgaggccatgaggacgagggtgacacagctgtgggaccccacaaagatcctctggtgtgatttcctgccatcagctgttcagagtcagtggaggtctacac

SEQ ID NO: 12546 - DNA, 201 bp, Bos taurus
cctgtgctaagtgctaggacaaagtgacagaaaggcatggccatggccctcatagagtttacaggttagtagaggaagcactcattagaaactaaggtacgggggatttggtttcgttttggccagtgtgaggaaagcagttaattgtgaggttcaaattcaaatagttaaattatttttctgattgtggaaaaatgcgtg

SEQ ID NO: 12547 - DNA, 201 bp, Bos taurus
ttgcccactgacccctgacccgaaagggactttttcaaccaactgtggcaggcttgtggggacctgaaggaaatatatgaacaggatacagagtaagacaggaatttgatggtgattttcaagaaactgggtttggggcctcctttgggcaggattgctgtcataccctggtcagtagtaatggcaagaggagtctcagac

SEQ ID NO: 12548 - DNA, 201 bp, Bos taurus
caaagggtcagtatatgtttaagctcaagaaacactttgccaaatgccctccagtattaactgatactcccatcagcaaattattagagtgctcatcttattctaccctggtcagcatgagcagtagtagtattatttaaggtcctgtcacttttaatgaaaaagtcaggatgtcatcatatagttcaaaaatggaaaatg

SEQ ID NO: 12549 - DNA, 201 bp, Bos taurus
agtagctcctttacactataagagatttagggtttacttcattcattcaaacctctgaaaagtcctgtaaaatgaagatatattttgtttgctgtaatctgtgcttcttaaacttcaatcatagaacccatcctaccttgtaacacttttttacatccttcagaatatacctcatgaaagagaacattagcctatatccaa

SEQ ID NO: 12550 - DNA, 201 bp, Bos taurus
tgtcatgctatgtgagagaatttggctgagtctctagtttctgtccactttctgctcatttatttttttgtccttttgtttttatttttccccttatggtatatctttaaatgtttttggagctattgtgatgtgccaaaacctttgaaacacacggataaatagactactcgtttttaaaaggttaattaccaaaaatca

SEQ ID NO: 12551 - DNA, 201 bp, Bos taurus
cagtgctacacaatccacagtgcatttgaatccaaggatgaaaaaccgctgatggggaggaaccgtggatatggagggccgaacagaaattttgtgtgcgctttcccttgcaaagagggttgacacccctagcccttgactgttcaagggcccgctatgcagctatggccccaggacagggaggatcccttgaacaaaatg

SEQ ID NO: 12552 - DNA, 201 bp, Bos taurus
tctagctcaccttcttctcattggaatggatgacacagactaatgaagacgtatccgtgatataagtcacaagccattatgaatcccactacccagccacttggccaagatgccttctggctcaacctcaggcatgagaagtcccacccagcaagtagaggtgcctgggaatgaaacaggctcacgggaatggacagctgg

SEQ ID NO: 12553 - DNA, 201 bp, Bos taurus
gatgagttgagccttaggcatttgcattgctcatttgtttcctgagtgattaggataaagaccagtctatattaaataagcccaccactgaaacaatgtgccaaggatacacagaggcccccgaaccctatgggggctggagactaatctgtccaccaggcttgcagcctgagccctgcccagaaaccaaagactctggga

SEQ ID NO: 12554 - DNA, 201 bp, Bos taurus
ttcagaggacaccatggtatggaatgaacatgatcatcagtaacattttagagtcagtcctctgaaaattctcaccaggcccttccttctttacgcaacatattcagcaatatttattcaacagttaacagatatctattgagtgcctactatgagccagacactgtttgaaggatcagaagctcattgaagaacaagaga

SEQ ID NO: 12555 - DNA, 201 bp, Bos taurus
agtgcagtcaaaataaaaaaagaaagaagaggaatgttgcctgagtgattgctcctctctctaccccagacgcacatgtatggcctcttgaatccttggggaggaggaaggggatctctgtatccaagtttatacccagttctcacacctgtgtgggcccaggcaccctcaacacatcatgtcaagcctgcactaagtctg

SEQ ID NO: 12556 - DNA, 201 bp, Bos taurus
tcaaggactctgcctgtagatcccacattctgtcccctcacagtctcttcccctacctgctcagaactgcagggctgctgcagatggcctgtgacctcctggactaagctaaagattccaccaggatgcccgcggcccccagcctcagctgcagacctgggcttctaccgagccccagggccctgcccaccttctctcggt

SEQ ID NO: 12557 - DNA, 201 bp, Bos taurus
actccactgggaaaaaaaaactttccatgtgagggagtgcacaaactcatctctctcttttccctcctcacagcaaagcagaaggccatctctcacccgcggtctcattatgctggcatcagctcaggagaggtgtgtacgtgtgtcagtcaggagaggccgaggcatgctgctgcaacaagtgcccccactctcccataa

SEQ ID NO: 12558 - DNA, 201 bp, Bos taurus
taaaaaaattaagctgaggtgttttgggttttttttacattacaattaactaccagaaaaaaacctacactccttaaaggaaaatcacagaatacaatgtgccatccataatttccaatataccaaaaattactagtcatgtgaagaataagtaacatgtgacccataatcaagagaaaaatacgtctaaggaaacagacc

SEQ ID NO: 12559 - DNA, 201 bp, Bos taurus
gaagcgcagagccagcagcctaggggggaacacggggaggggctgcccatgagcctcagcgtctcctgcctggatgctcagagttaaatccggaagcaaggggggctggggccctgctgcagaggcttcagggctccaggagagaagagggggagcctgctggggggcgcccaagaaggggacttctgcctccagtccact

SEQ ID NO: 12560 - DNA, 201 bp, Bos taurus
cttcggagcaggtggggtgagtgcaggccaccgccaggctgcatctgggctcaggcctttgctgcctgatgctgactcactgcagccccgtggccccgtcaccttggagaccctgctgcggggctcccgcctccctgccctcgcctctgttctcagctctggctttggcatctcgttggggcctcagcaggaggcctggag

SEQ ID NO: 12561 - DNA, 201 bp, Bos taurus
tcccaatgcaaggcgtctgcgtttgatccctggtcagggaactagagcccacatgccacaaccaagacccagctcagctaaataagtaaatattattttaaaagcataagataaatacgaatgtgctcataatccaatggaaaagggtggaccttcctaaacttctctgtgtagtcactcctctcaacccctggcagtggc

SEQ ID NO: 12562 - DNA, 201 bp, Bos taurus
aagaaagggagagacgaagacaaaagtggggaggctgctgagggctcaaggcagtcagaagaaaagcagggactgggaggccagctctaccaggggcgctacaggctgtgcttgcttcgaacctccgagggctttgttttcagaggacagaagggttcaggctgctgctgctccagaaagctgtctgttggttggcctgag

SEQ ID NO: 12563 - DNA, 201 bp, Bos taurus
cacccaggggaaggcgtgacccccgccgggttccgcgcaccaccaagtccaacagtgaaagaggctcgcgatagcgaagactggcgtggacaggtaggcccgggggcaggtgttcaggtagaaggcgcacacctgaggcagcagggctggggaagacgggatccccaggggaggcgggacggaggcccagggatccggcta

SEQ ID NO: 12564 - DNA, 201 bp, Bos taurus
ctgatcaggaaaaaaaagagcaaagataaaaattaccaatatcagactgagacagatgcatcaacatagcttctaaagatattcaaaagataataatgatcatgtacaacttcatacctacagattcaatgacttaggtgaatggacaagttgcttcaaagaaacaaattaccaaaactcgcccaagaagaaataaatatt

SEQ ID NO: 12565 - DNA, 201 bp, Bos taurus
ccagtggttgggagggggagctgggcctctgaccccacagccctaactcctcaggaagccgaaggcttagggcaaaggtggagataggcagccacccccaataggctctccacctttccctgggccaggaggagaaagattccaaacctaccctcagccctgtcaggtggaagccatggagagcctcaccctcagaccagc

SEQ ID NO: 12566 - DNA, 201 bp, Bos taurus
ggggtccaagcctcccagagatgggcctaggaagggagggctgctgatgttgtgaagtcgggagtcggaagcctggatcccatcccagccatggtgaccctgggttgtctcaggctgaactgggccatagtggagttcactggctgtccatccttccctgaccaggctgtgactctggttttggcaacgcgacggccaaga

SEQ ID NO: 12567 - DNA, 201 bp, Bos taurus
cagcttgtggtgtttgaaaagttcttcataccttagaccagaaatgaccccatggaggtggtggcagtgggtgccaggagaaaaagggtacctagtgtggtggtcagtgctgaaaactgtttccccagcttgttgtccttatgtgtgtttgtctcatctcttgtgacatttgttttcttccctgtccctggggaaatcttc

SEQ ID NO: 12568 - DNA, 201 bp, Bos taurus
gggggtgggggaggtggccagaccttcccctggtctgatgtgggggatgagcagggcagacatcaggtgacttttggtattactggcaggtggcagaaacccctgaggactggccggcactgatctggcagcagcagagagagctggcacagctgcggcacagccaagaagagctgctgcagcgcctgtgcgcccagcttg

SEQ ID NO: 12569 - DNA, 201 bp, Bos taurus
tgctggagtcaggttactgtcaacaaggttcaagtctagagaggtttggtaacttacacaaagtcacacagccctttagctgagtgtcagagtcagacttcgtgcagacctgaaactaagttgggctggcagaaaccccttgaggtgaaggtagggagcaactgctggccttggggaaatgtcttgactgaactctggtga

SEQ ID NO: 12570 - DNA, 201 bp, Bos taurus
aacacctccagaaattcctgcacttcccgtgggactagtctatagaaaggagtttggttccaacacggtctgttaacataagtcttcactgagtttaacacgtatttctttgatctggaaggcaaacgtttggaaaagagatggtcaaggatagcaatgatgtactccctcagagctgtgaagtaaagggaccacggccac

SEQ ID NO: 12571 - DNA, 201 bp, Bos taurus
aatcctccactcccccacctctcaaggcccaagaagattcagaaggttcttgagtcagactgcctagactggaatcaggaattccttgccagctgagagatgttggcccaggactttctaaaccttggattccctttctgttaaatgggcgtaatagttcgcgtgtcatcttgtgtatcaggtgcccaatgaaggtgacac

SEQ ID NO: 12572 - DNA, 201 bp, Bos taurus
gagggagaagagaaaaatcttcccatccataccccgtgagaagtcagaatggctactgcacacagtagaactgggccaaacaagtcaggttgttgataagaattctctccaagtagaagacaagaaaacagtaccacttcctctttgttacctgggtagacttccccatcaaaagggcagggccctttctgactgggcgta

SEQ ID NO: 12573 - DNA, 201 bp, Bos taurus
ctcagctcactgttcctggcctgtccttatctcagccttgccagtggtcttgcctgtcctgtgaggtggtgtcaggcaagatcactgggcctggtgtggtaggcgtgcacttacaaagagcttctcacaggagttaagagataacaggaacttaagactccctcaacgggaagtaggctgtctagaaatgttatgggttgc

SEQ ID NO: 12574 - DNA, 201 bp, Bos taurus
ggcgtgattggctgttgacaggttggccccggttacggaagctggtgaggacagagcgggaggtcgacttccaggaagttggtagtggaaaccggaatagcggtggaaaagaggttatctcaggcccaatggccactgtggtagcaagcggcggcgatggaaaagagcaaggagtcgagacttccgtcacctattaccgac

SEQ ID NO: 12575 - DNA, 201 bp, Bos taurus
atacaacccagagaccctgacaactatccaaacacaggacatttcacagcctggtacttttccagcggtttctgcgtctagtcagctgcccagcaatgacgcactactacagcaggctacacagtttcaaacaagagaaactcagtctagagaggtgttacagtcagatggtacagtggttaacttgtcacacctgactga

SEQ ID NO: 12576 - DNA, 201 bp, Bos taurus
taatacaatattgtaaagtttaaaaataaaatttaagaaaaaaatgcacagaagcttataatcacatttattagaaaaatattaccacttagaagttcctatctttaaaggttgaagatctgctccaggcaccatctgctctgttttcgtcaaactccctcaacaaggcaggaatcccagttctctggatgcgcacaggtc

SEQ ID NO: 12577 - DNA, 201 bp, Bos taurus
ctttataaagctatagaactggaaccgtgtaagagctgtatcttaaggattcatttccccaagttcatccaacaacatttccaggtgcttgctgaacaggacctcgtagctctgtctcctagtgggatctttcccactcgttatgagtcatcaggtagaacatctctagttgttttgccatttgggctgctgcatggaagc

SEQ ID NO: 12578 - DNA, 201 bp, Bos taurus
taatttctatccatcttcaagtctcagattaatcagcacttgctctgggaatccttcctccatccccagtagacaaggtcagactgctctgtgtattgcaattcttctcacacgcataattgcgtgttctacgtccctctacccagctgggctgtaaatgccaagatggcaaggagcctggcacaaagtcagctcccaaga

SEQ ID NO: 12579 - DNA, 201 bp, Bos taurus
aagaccctcgcacgcaggggtgaggacttaggccgggagggctctgggtgggccctgtgcacgtccgttggcctggtggcctcgcactgtatttggcctccgtggctgatgttctgggacctttaagcacacacaagtgcccccagaccctcacgatatagtgagagcttgaaagtggcaccttacgttggccttcctcat

SEQ ID NO: 12580 - DNA, 201 bp, Bos taurus
gatcatagatgctggtattagattggcagggtttgggtcctatctctgctacttactactatgtgactttgggctagttacttactctttctcggggccttagtttccttatatgcagggtggacacagtactaagacctacatcatagcattattgaggaatcaaattaatgtgtgtaaagcattttacttgaaagagta

SEQ ID NO: 12581 - DNA, 201 bp, Bos taurus
atccaggcctaaatgacaagagtcagacacgactgagcaactgatctgatctgatctgaaatgacaaggtgttgttggatcaagatctaggggaaaactatacaaggctggtgaaaaggccctgtggcaggaagaataatgtgagaaagaaatatgcttctatcttgcttaagccactgttcttttaaatatctttttatc

SEQ ID NO: 12582 - DNA, 201 bp, Bos taurus
gaagtgggtgaaatgctagggcttctgaaattacatcagtggtgaaaattggcatgaagtattgcttctgtccttaggtaaatatttgtggaaacccagacctgacccttaggtacaccattctattttgaaatagagtagacaataatttcccaaagaaagctgtaaaaaaatactgattagattgtccatttgaatgat

SEQ ID NO: 12583 - DNA, 201 bp, Bos taurus
aaaagtagatcaatagctggcttacagcccttagattataaactgataatgcagagtactgaaataaaaatatggagcctgggtgcgtgatggaacaagaggggaaagccatctctttaaaaaaacaaaacaaaactgtacagaaacccttcagagtgcattgagtaacgtctgcggtggggcatcctctgcatcctctga

SEQ ID NO: 12584 - DNA, 201 bp, Bos taurus
tggtgtttatccttctttgtttctggagatttcaagacagaactgtagccaaaactgagttgcttttttctgtcccttttcttcttggaaggaggggaagaggctattttcttcccctgggaagttctatgtggagtcctagctctcctaagaagatccacagaagcaacaagtgtaaaagatacctgggtaccaatattc

SEQ ID NO: 12585 - DNA, 201 bp, Bos taurus
ctttgctgcccatgaagcatttgcaaatcctcccagtctctattcacagactctgctggctcttcctttgtccagtgtctttcatctttccagggccaatctccaccctctgattcatcatcacaaggggactttccatttgttgtttgctatattctcatgcagccttatctttgatggtttccatttcagcactagtta

SEQ ID NO: 12586 - DNA, 201 bp, Bos taurus
tccaggacagaaaaggagctcctgaaccaaacccgtattcttgcccttgcaaacttgacattcttgcaacaaagtctaggcaccgactagtggggtatttcagactgttttcttattactaaatggaaaggtattaacacaatgcagaaattttttaaaaatgcagagggtgaggggcggggggagagaaaagaaaagaca

SEQ ID NO: 12587 - DNA, 201 bp, Bos taurus
gccttcactagtcatgtctcctttgtttcttccagcctgtgccagtccctcagtcctcccttgtctttcatgactttgaccctttggtaaagtactggccagttacttcacagaatgtccctctattactgggagtctgatgctttctcatgatcagaatggggctctatgttttgcctaaggtaccccatggctgacacc

SEQ ID NO: 12588 - DNA, 201 bp, Bos taurus
catcttaggcttttttattagttattcctggtaacaaccctgtgagatcacaaggtgggtcagatattcccttcctcaagaggcctctgaaatttcattcgatgctactacatttcaggactcagtcctcaagtcaggagtttggtccagaccactgatcaggatcatctcaagtcctaggactcagaagctctatcaggc

SEQ ID NO: 12589 - DNA, 201 bp, Bos taurus
tagaggttttaattacttcaagttcccaaagcagggcctctgtgataaatgatggagacgaggaaatgaagtcacatcttcaaaggccaaatcagcctccggttttttccaacttgcacagaattgcaacagcttctctcgttaattgttgtgcaagattttgcatcttgcataaaactagctgcaaatgtcacatcggcc

SEQ ID NO: 12590 - DNA, 201 bp, Bos taurus
aatgggggaggggttcctgatgaaaatgttagaacttttctccacaagaggacttctcaaatggcagaggaaggtgctcagcagagagagtgcgagtgctaggtccctccctttaactctcttactgaagaggatgtgctctgttgaaatctaactaaattcttaaaaccaccaccaccaagaaaaaaaaagaaccaccca

SEQ ID NO: 12591 - DNA, 201 bp, Bos taurus
tcccacccttatcacttggacatcacagcaaagcaaatccactgaagcaagtacccagaatcatgaggtgcctggcacacttacagaacttaaaacagttctaaatttttcttagaatgttctgttctttcagactactgtaagtgaattatcatgtgctttttaaaccctcagaaaaacttttctggatgacaataggca

SEQ ID NO: 12592 - DNA, 201 bp, Bos taurus
cccgcggactctcgccttccggcggtaagtcaccgcagcaccggaagccgtcgtcaagacaacgctcttctgcccaccccgacccttcgtcccgcccaccgtcttgtacgtctgtggccagcggggcttccattggtccatttgtccttcactctgggagaagttcggagcgctaggctctggaactctgatttgaatttg

SEQ ID NO: 12593 - DNA, 201 bp, Bos taurus
taatatgaagtttgccattgaccctggaccaccctcctttcttctttacctcacactcaagcttcttgactcttctcactgtttccacttctgatctctcatttgctcttcctcaacagtgggatggctttttaccggcctttctccactgaaactgcttctgccagaatcaccagtttttaaattttcttctttggtatc

SEQ ID NO: 12594 - DNA, 201 bp, Bos taurus
ttgagatagcaggtgtcagaatcaagtgactaagaaagaattatgtatgccagtgttctactagagttttaagagttttagtgctactttggagtgaagcatggatgcacaagatttcagttagggttttagtgatgaaataaggaaggaagagaataaatcttaatggattgaaagtatctgctgaaatgaatctcctcc

SEQ ID NO: 12595 - DNA, 201 bp, Bos taurus
atattgtattatctcacttatatatggaatctttttttttttttttttgagtcctactcagagtagaaagttgattaccaaagactaagggtgggaaaaaaggggagacattaatcaaaggtgcaaaaattcagctatgacatgaattagttctggagactgaatgtacagcatggtgactgtagttaacaataatatact

SEQ ID NO: 12596 - DNA, 201 bp, Bos taurus
catggggaaggcagctcttccaactccattgccaggaaagcgctatatattttcctacaagtgttccctagtaatattgaatgctatttaaaagaaatcaaagttccaaatgtttatgaaaatgaagatttttcctttcactcctttcaaccaaattctttgcctaaaagtttacaagaaattactggattctaaatcatt

SEQ ID NO: 12597 - DNA, 201 bp, Bos taurus
ttgtggaatttactcagcgttcaaatgttcttttgatgaatctgtgggggagaaagtggtctccctggcctatgcctccgccatcttgggactgccccccgctcccccgcccacttctgttttctaacaaaggaaatagacaagttctatcatggaagatagaagataatattattgtatgtatcttacagatgagggaaa

SEQ ID NO: 12598 - DNA, 201 bp, Bos taurus
ctggcgcgagcgggctctgcggctctgccatcctcagtgctgcttggagaggacctacgcatgcgcagtgagattgcggcgctttagacacggggaaggacgtgtgggggccaagggggtgtgagggccaagggggtaggggggccacaggaatggggggcggggtggaattctgagctcttccttgaaatttctcgtggc

SEQ ID NO: 12599 - DNA, 201 bp, Bos taurus
ggaagttgatcaattctgcaagtactaaatatgcggtgagtaaatgaggctgactttcttttgcaaaaaagagcttttgtcacttctctgtcttttggctaagatcaagtgtagcatcagttatagtttagtagctgatatgccctcatcatgccaaatgccaggctgtatgaagtacaagctggaatcaggattgccagg

SEQ ID NO: 12600 - DNA, 201 bp, Bos taurus
acttgtaccatttattcagaagttgacttggctaatcaaggcaggggcctatgacaggaaaaatctgcactaggacaaaacacctgaagttagggatcctgtaaagcctctgtgacattgtggccttgagccagtcacttagcttctttgcaccttgacttcatctgtaaagtgaacattaaatacatatataggataagg

SEQ ID NO: 12601 - DNA, 201 bp, Bos taurus
gcacctggcctcctgctgtgaatttattgggcagatcccagtcttatcccaggactcttatcccagccttatcggtaaaggcagcccagctctgtggtggacggtggccgaggtcacgcccggtaactgatgagccatccagggccctacacctgacccaggttctgacccagggcttaatcatcaattagtctaaactag

SEQ ID NO: 12602 - DNA, 201 bp, Bos taurus
ctgcgccgagagccgccctccgcggtgtgggggtgcaggagggccgggtcgggcctctctgaggcttttacctatccgtaaggggagggcggccactgccgaggtgcgagctgggtggaagccaggctggggtcggcgcgccccccagccccgccgtgggctgggatccttccgcgagttcccacgtggcttcggaaccct

SEQ ID NO: 12603 - DNA, 201 bp, Bos taurus
ggaagaatgtgaagagaaagtctatattagctgagggatcatttaaatagtccactagataagtgtgactactaaaaagcatagaacttcacaagttctgttaggccatcgtcacctaacttaaatttaagcccttcttgaagttctcagagcttctcttggtttggggtgctgctgattgatcatttccattaacaagct

SEQ ID NO: 12604 - DNA, 201 bp, Bos taurus
ggaggagcccccatttcctcttagctccaaggcacaggtggaaccttagtgactacttaccaataagggtggtgaactggtcccaggcttatttccagctgatcggaaggccattagaaatgaggctcaggtcagggctcggggtggggataacctgcacagatgctagacctttgagcagaattttaaacccgtcaagtg

SEQ ID NO: 12605 - DNA, 201 bp, Bos taurus
ttccacttattccacaggaagcttttcagaacggaaaactgaattctctacacctttgtgaagctcctggagcttttatagctagtctcaatcactatttgaaatcccatcgattcccctgtgattggaattgggtagctaatactctgaatccttaccatgaggcaaatgacaatcttacgatgattatggatgaccgac

SEQ ID NO: 12606 - DNA, 201 bp, Bos taurus
gttactaatgagctaaccttaaggtatggaaaatgtcctgagtgactcaatcaataataatcacaagggtccttacatgttcaagaggaaggccgaaatatcaggctcagtgtcagaatgctgccttgtatgaaagattataccagccgtttctggctttgaagctaaaaaggccgaagaattcaagcagcctctaggaaa

SEQ ID NO: 12607 - DNA, 201 bp, Bos taurus
ccctctcttgggccccttctgtggcaccgctaaaccttcactgtggctggggtcgggcacggaatgtgacaactggcccccgggcaaggtctgggagtggaaagaaggcttccttccccaggaaagctggtgcactcttatcagaaagaacagcagaggccaggtagcaaacctgctccatgaggggaggagaaggaagag

SEQ ID NO: 12608 - DNA, 201 bp, Bos taurus
gtggagattatggttttcaaaattatttttaaagacattctccaggtagatcaataaagatatcatagatgaggctaagggccctgctgtcccttcccctcattctaatgctggtgtctctggggatgaacgtcccagcactgctcccatgtatatatgtacgcgtgtctagggaggcagaatcccacttgcactcaattc

SEQ ID NO: 12609 - DNA, 201 bp, Bos taurus
ttatgatgaaagtaactggcattagttaaatttttaattgtatcgggttatttctgtgtgagcatataatgaataggagcatgacgagcaaaaaggaaaaatttatcaggaaataaaaattagttccatttctcacaaagtaaatataagcatctctgggtattcaggactttatagagttttggtgttttagagctgggg

SEQ ID NO: 12610 - DNA, 201 bp, Bos taurus
tctgtagctgtggccactatacttcccttgcggggcacagtgggagatttattccccctccttttatggggtgtttcttatcaggccttgcacttgtaagcggtgaaaactgcaatgtgtattacctagaaaactcttaccttctgatagcaatcaccacaaaggccaggcagacagttacaacagaaaaatctcctggtg

SEQ ID NO: 12611 - DNA, 201 bp, Bos taurus
ttctcctctgccttatcctggattggaatctcccaccttggggtaaagattaggaacatgtgcagaatgatgccaaggcttgtgtgtgctcctaaggacgtgtggggccatgggatgtttccgactagcggacaccaggcaagcttggctgctttggagatggggctctccaaggccacggggtggggagagagatgttgt

SEQ ID NO: 12612 - DNA, 201 bp, Bos taurus
cacagggaggctcggatcatgacgggcagtggcagagggctacttggtaaagcccattcctcattatctgatgcgtgcctccagagccaccagtggcccccggctccttccttgcccacgggttgttggaaagatggaccaaggagacatgtgtcctgagctcggtctagccaccagatccatagagaagccctcacttcc

SEQ ID NO: 12613 - DNA, 201 bp, Bos taurus
cggaagcagagccccatctgagcggccccgtcctcaacggccagtatgccatgagtcagaagttgcaccagatcacctcccagctcagccatgctttccccgagctacatccgcggcccaaccccgaggagaagacccccgcgcctcttgacgagaaggcccacgtgcccatgagtggccagcccatgggcagtcagatgg

SEQ ID NO: 12614 - DNA, 201 bp, Bos taurus
gcccttctggccgacagtctcggtccatgcctggggaccatggggacaatttcctcggtcccaccacccctccctccacaaggaagactgcttgtccctgccccctccttccctgggcctccttggcggacatactcatttgcttgacccttgtggagatttgtttggactggtctatgggattgctagaacctggaggtt

SEQ ID NO: 12615 - DNA, 201 bp, Bos taurus
taaccctcagtttgtgggtgatcctcacgttgtaggctctacttctggattcttaattctgcatgcctgctttctaacttttagagctctggtcctacatcccttcatgtcataggcctggggtcttggcctgtgtgtgctgtccactcctaggcaatgcagaggtgagagacaaccaggagaaaggccatcccagccagc

SEQ ID NO: 12616 - DNA, 201 bp, Bos taurus
ccaacacctggggaatgcagtgagattttcccatcccctctctggtaacttgtttgattacttccttttcttgggcccattttcaggatgtggaataaaaaaagtgagtcaggcaaacaggtgtctggatacaaagtgtgtggctgaatcaaggcctccctcgacccattccccatctcttggaatatcttctttactttt

SEQ ID NO: 12617 - DNA, 201 bp, Bos taurus
agactcaggggccagaagctgcagaatagtcagtggcaagccctaggggttgactgtggaggtgagtgtacagtgatagcagattacaccccagcacaaagagaaacattaaaatggccagcactaacgtccatggctaccaataaaatgtgtgtctattctaagctgcttttactacagattttaaatgcaccatttaat

SEQ ID NO: 12618 - DNA, 201 bp, Bos taurus
gcagcctggcctccttacagggaagacagagcataaagttcaccccagatcaaaattcaaccattgtgaccatccagaagaaagcttcctgtgggcagagccttggggccaacagagattcgcagtggattgcatacacagcgccaccagccggccagggccggatatgcagcaggtatgcagatagaaaggaagggatgg

SEQ ID NO: 12619 - DNA, 201 bp, Bos taurus
gtgggggtggggggtggtcaggccaagcgatttctgcatgtccaggggagttagagagggatgagtgggtggcagatagcagagtccctgagtgtcctgaccaggaacacccttgtggcctttgggctgctttgcttggccaagttgggggcaccctgcctggagagtcaggggcagaggggccaggcagactgctcactc

SEQ ID NO: 12620 - DNA, 201 bp, Bos taurus
tgctgtcccagaattatcttatgttttatgccagggcagtgacttcacacatcacagtagcagaggatttctacagggagaaattggctgatggaagctttgtcctgaaccacatactgctggtgtcgtgatatgatgtccagagcaagtagttcaccatttgggaccggtgaaggacaagcaagcagggagagaggtgct

SEQ ID NO: 12621 - DNA, 201 bp, Bos taurus
tgccctcacagaccctgtgaagggcactggccacccttttgtaccaggtaatcccacccagtgacctgggtctggatgaagatcagaagtccaacaatccgtcaactggcctgtgacctctgacccagcatcaaaagataagctgagccaatatactctgaggaatgggagagtaagaaaaatgttgttgggttggggcag

SEQ ID NO: 12622 - DNA, 201 bp, Bos taurus
ttctgaacgcctgaaactagcacagcattgtgaatcaactattctcccattaaaaataaaacatttttttaaatcaacaaaaacagtttcatgaattggtaatttctgttcaagctcatttaagtgggtccagaaaaatctgaatagaacattaagaatctaaaagtgaaaatcatttaggctcaagaaacctaaggccaa

SEQ ID NO: 12623 - DNA, 201 bp, Bos taurus
agatggcctagggaatgttagttgtgcacaagtaagatgggctccatttacagggaaaggaggtgtcagctccacctggttctgtgccttgacaagacaacgtctggtatgccatgtgtacatctgggcccatgtattaaaagggcatcaataaactaaggaacccaataaatagcattcagagtggaggaggagttccaa

SEQ ID NO: 12624 - DNA, 201 bp, Bos taurus
gcagagtacccaagggccacagctcctcatcgtgtctccatgaccaatgttttcagcatcttttcggggcctgagcctttaagacgattcagctgatgtcgcacgcagacccaccttgaccttacttctctcccccacctccctggaccactggtcttcagaaattttaacaaaatataaagtctatgtaaataggaaaag

SEQ ID NO: 12625 - DNA, 201 bp, Bos taurus
taacccaatccatttcaagtgaagggtagtgatttttccatatggatattcattggtttcatcaccatttgttgggagactatcctgttcccataaatcatcttggctcctttatcaagagtcaatggattgcttaagggtgggcctacaactggatactttatgctgtttcattagtctatatgggaattccaatgccag

SEQ ID NO: 12626 - DNA, 201 bp, Bos taurus
atagtggtaaattatcttgtcctggtttcttgccctgtgattgcaacatgtcccagggccttcgctccttgtagaatccatgcctaatatcattgcctcaaaagcttggaaagtctaaagttaccaaagcaaagcttacctctcagggaacctgggtggccatcagaaggtggagcagcatggctttggaaatccagaaaa

SEQ ID NO: 12627 - DNA, 201 bp, Bos taurus
agcactgttttagttatatctcataaattgcaatatgttctattttccatttttttttcacttcaaaatagtttctaatttcccttggtttaagttttaactcatttgtgtctttgaatttagggtaagattctttgagacagaatatagttggataatactttatttttaaaatccactctgacaatcctctgccttcta

SEQ ID NO: 12628 - DNA, 201 bp, Bos taurus
aacaaactagagaatttagcaaaagtgctggagaccagaaaacagacaaaaattagaacacatagaaaacaaaaatttaaaaatcattaacatttacattagcatcaaagagcaacagatatctagaaataaatctaacagaaaatgtacaagacctcaccattgaaaactacaaaatgttactgagagaaactaaagaaa

SEQ ID NO: 12629 - DNA, 201 bp, Bos taurus
tatgggattcacgcggccccagtaatcctcggtttgtgggtggacttcagggtctctgcacacctctgaggtggaggccaggaatagacgggccccaactcgctttgccagccccagcatgttcagtgtcccaacggtgttggtctttagtgtcttgaaggggttgtacatgtaactgggaggggaggcaggagaggccag

SEQ ID NO: 12630 - DNA, 201 bp, Bos taurus
agggcctccaggacggagtggagccaccttgccctgccagcctccactctttcctgctggccgggcagtgatatcccccagcagggccgagtgtgctctgcggagctttttgggttcacagtgtttctcagccttcctcaggagccctttcttgctggagatttcctcaacctgtcagacacctcactacccaggtggcct

SEQ ID NO: 12631 - DNA, 201 bp, Bos taurus
ggatgttcttcctggtcatccaatagccatgcatctggttgtaggccaacccccctccattgggggcatcttctccaccaaccccagacctggtctagtcgccctgattcacaggaacagggccaaacactcaacaactgggataagtgcaatatttttaaacatctaaattaatggggaaaatctgtatgagcaaaatct

SEQ ID NO: 12632 - DNA, 201 bp, Bos taurus
aattccttctttgatgaaactaaagagtcctgtaatctggaatcgcagtatatgaggaagggctgccaaattcagtgaaactcctaggagtgtagaaagatgctgagagaggaatctcaaagctgcagattttagaaaaacctgccaaagtttagtcctccaaactcactggcatatcctaggttggggggcgtggtggct

SEQ ID NO: 12633 - DNA, 201 bp, Bos taurus
gatcaccatggggtaggaatcttaggggcaatcttagaattctgcctaccacaggcagaattacaagttaaaaagaaaactagagtctggccaatactgactatctggcagcaactgaccagagtaccatctttgtatttttattcatttattcatttattttggctgcactgggccttcgttgctgtgcacaggcttttc

SEQ ID NO: 12634 - DNA, 201 bp, Bos taurus
cttagttgttaggatgtgggatcttcccagaccagggatcaaacccatgtctccttcattgggaagtggattctttaccactgagccaccagggaaggcccgtgactttcaaactgtgctttctccagttgtaacgatgcttgcaatctgaagatgataacaccatctgcatcttatcatcttatatttggtctgtatttg

SEQ ID NO: 12635 - DNA, 201 bp, Bos taurus
cttgccacacaatttcaatgacttcagcctgagttggctccctaaacagtaattttctaaacagtttccacttttccactgtttcctagttgactagttttagttagtcaaagagtggacaccccacagaattgatgtttgaattaaactcaccttttatctttttatttgctgttttttttaataatctttttattttat

SEQ ID NO: 12636 - DNA, 201 bp, Bos taurus
gcctggcccagagtgcctcaggcagcagaccacagcccttgtctccagacgtcggacactgctcgtggcacatggcgttgagtggagggatggccagcaccagaaccagcaacttcaaacctttcgctaaagatccagaaaagcaaaaacgatatgaagaatttttagcgaatatgaaacggggtcagaaaggtgggtgct

SEQ ID NO: 12637 - DNA, 201 bp, Bos taurus
tctcctcacttggaatattcagttccatccacagagatggtatgtccaggcctgggcgatcacaagaggacagaaaagtgggcaaacctgggacctgtccatgaagagtgattggaagaggcaggccagagaataggtcagtgctgtaagatgcagggggcaggggcccaggaacaggggtgtgatggtcagatgaggcta

SEQ ID NO: 12638 - DNA, 201 bp, Bos taurus
ttgtgattaaggccaatggaaaaccacaatgacccagtccagataggactgttaatggtccagacccttcaggaataaagctttgggccaccctaccagctaaagaaccacaaccagctgaggtgattcctgaaggcagaaggaatatcaaaagagcagtagcagaaggtaattataaataccagctatacccacttggcc

SEQ ID NO: 12639 - DNA, 201 bp, Bos taurus
aattggctggtgggcagcattctttatgttacaatccctttttggtcttaattacaaccaaagtttgggaggtcttgtgtggccaatttgtcctatggagcgtgtaggaatgctcattcttaggtcaggtgaggattttcttgatggaacactcagtgtgctattactggatcaggccctgttaacagtaactgaaggcct

SEQ ID NO: 12640 - DNA, 201 bp, Bos taurus
ctggtggctctagggaagaatgtgtttctttgacttttccagtttctagaggctgcccacattctttgtctcatggccccctccatcttcaaagccagtactgtaatatctttaaatatctctgactctgactcttctggactcatgattacattgggcccaaccagatatatgggcttcctttgtggctaagatggtaaa

SEQ ID NO: 12641 - DNA, 201 bp, Bos taurus
ctgagaaatgagacccacttccccttccccagagagccaagcctgctccttttgcccttccacatccctctttacccggccctccaccctcagggctggcccaagtggtccgcattagtgggttcctttgcctctggcttttagtgggggttcagcccccagggattctccggctcaagattggaaagagagagggcattt

SEQ ID NO: 12642 - DNA, 201 bp, Bos taurus
tcatttagcagcagttccccaaaaatccactgtgctgctagactcggcaccactggggcaccgggcagtgggcaagactcttctctcctgagacatgtcatgaacttaagaagctagagcaccaacgtgtggcactcagcccagaggccggaggacagtggagtggatggccaggagaatgaggtccatggtgggaagtct

SEQ ID NO: 12643 - DNA, 201 bp, Bos taurus
ttaaattcctccaaccttacaaaattcttaaatgcaattagtaatcagtggctggaaagaatatttcttaacttacagtatcttctgcattttggtgaagataaaaattcttaatttggtaatatggggatggattagtgtgttttcatgctatatagttgggtcaaaattaattaaggatacattataccattcagttat

SEQ ID NO: 12644 - DNA, 201 bp, Bos taurus
aaaaggaagggctcccacttagatgtggatgtaggcacaacaggtggaaggggcttcacgatcaaagcaaggtcactacgggaagactgaaaggcagcagaccgtcaggactcaggaacacccagtgggctccccttcaggcagtataaacacacatggaggaggatagcagaagcacagcaagttgatcagagcagggca

SEQ ID NO: 12645 - DNA, 201 bp, Bos taurus
tttctcctgcgacgcagacggcctcgaaatgccattggtacctggagcagatcacatcccacttgtctcctgtgtggtatttacctgttaaaccggaatccttcaccaaacctgttgtgcaactatctctttcaaatgtttgctgctctcctttcggccttgtttttggaaatccggtgggaataagggtgccagcttttt

SEQ ID NO: 12646 - DNA, 201 bp, Bos taurus
aggggtgtgacctttaccggatttacaaaagcaggatcatagccctgatggtgcgtggagatgagcctgctggctgctgtccgtgtgcgggataaagctacaccttctgccctcatatctttccactcacggccagaggcttcaataaggtttccgagcgtggggttgtggtcaggggggctgcaaagagacacttgaaat

SEQ ID NO: 12647 - DNA, 201 bp, Bos taurus
cacacatggattcctgaaccaatccctgtggctggggggagtgctgtgatttgactttacgtgcctgagtatgggaaccaatataagggaagaagaattagctttatactaatcaggcccacccgtggataaggggggtgagttcaagtttcccttaaacacagcaagctgcctgaggtaaggctgggtactgaagacaac

SEQ ID NO: 12648 - DNA, 201 bp, Bos taurus
ggatcctttcccacactgtgggtgtcggccacatcctctctaccacctcattcatgaggatctttttgctcccagcttcctggagaagggccagggtggagaggaaataatgccccccacttcccaatgccctgagcagacccctgacagccttgcccacatacaggccccacaggcacatccacacacagcctgacccac

SEQ ID NO: 12649 - DNA, 201 bp, Bos taurus
gtctctgccttcagtggaagcctgccctgtgttttatgaaaccgtttttgctgtgagccttggactcccacgtaaagcattgaatgaaaccttggattcggtcgatgctaatgaagctgaaaaagcagcctttggaaaactctgggattgcttcattgaagcagaacctgaagacaggtttaatcatctgaaatataaggt

SEQ ID NO: 12650 - DNA, 201 bp, Bos taurus
caagtagcctggaggaggacctcagatctcccacaatggccaccaatccctcctccaaggacaacgcccagtctaagtaagaaagattacattattacaaccaaagcatggccttctcccatcaccccgccaggcagcagctctgcttaaagactggaatatctcccccttccctgtcctttcctgaggggcaggagatcg

SEQ ID NO: 12651 - DNA, 201 bp, Bos taurus
cgcttcctctagccctccacacagctagctaaggctcccttttcttcttcaggcctcagatcaaataatgactgtcaggagaggccttcttgagtccccaacaagagaagccacacatagatctaggcatggtcccatgactgagttttgtggttttattttgtttatcacaaatgaaagacaactccctgagggcagagg

SEQ ID NO: 12652 - DNA, 201 bp, Bos taurus
gcatcaatctgtctgtctcccatctggacaacattgtacaggcaggctctgtctgacacagctattttggaactctggaatctattgaaggctcatccaggggaaagcttggatggtaaactgtagttaattttagctaaaagcgtgactttcttattactctatttggagattaaatatggtttaaagagatgcctaagt

SEQ ID NO: 12653 - DNA, 201 bp, Bos taurus
ttcaggctaaagcagcgcatgtcatagtctattctcagtgaccccctatgaaattgggaatatttttaagtctagtttccagatttaaaaaatggggccccgaagggttaagacatgggtccacacacagctgggaaggagtacagccgggactcagacacaagcaccgtgtctgcagaatctctgtaaacgagacagcca

SEQ ID NO: 12654 - DNA, 201 bp, Bos taurus
cataactactgaagcctgaatgccctagaacgcatgctccacaacaagagaaggcctcgctcgccacaactagagaaaagccctcaatggattatccaaagcagagctaacatgcaggaaaggagatgagacaaggtggagcgaagaaagagaaaccagtgtcccaccctcctctgcaggctgtgagcccaaggcaaggaa

SEQ ID NO: 12655 - DNA, 201 bp, Bos taurus
tttccatctgaagatacctgtgtatatgtaaaaacaaattaaatgtttatgcctttctcctgttaacctgtctcacgtccatttaatttttaggccagccacagaacttaagagtgtagagggaagtttttcctcccccctacacaagtttaatttcccttcgtagtctacttcttcaagtaaactacaggccacagtttg

SEQ ID NO: 12656 - DNA, 201 bp, Bos taurus
ggcagcagtaacggtggaggcagcaatgcaggcagcagcggcagctctgggtccagctcggtatgttctactcttttgttgaaggcagagatggggcccctggtggtccctgctgaggacactcactccagggtcttcctgaaagctgcccgccccagggtagctggcgtcaatggagttgtcatcccaggccccccagct

SEQ ID NO: 12657 - DNA, 201 bp, Bos taurus
tttttcccttttcaatttcatttacttctagtcttataccatgttccttctccttgccttggctttattttgctcttacatttttccagtttcttagattagcagccatgattgttaatttgagacatttttattttctgatataagatgtgaagttgtacatttctaagcactgctttagctgcatctatatattctgct

SEQ ID NO: 12658 - DNA, 201 bp, Bos taurus
gcccagctgggcagaaaccaggccagcatgtcctatgaattggtccgtggtccctgagatagcctgatttggaaatgcgttgtggggcagttataggcacttggagctctgtgtggggtcactggccatgaggtatggcctctgaaccatcacaggttgtctgggttctggactgagcctggatctggtgactagagaggt

SEQ ID NO: 12659 - DNA, 201 bp, Bos taurus
agttggaactactgtgctgccaggaattcctaattcatgctgttttaagagggctcttcatgaggcctggagacagcagcacttacttcaatagaaacttgattgaatactaggccaggcaagcccctgatgagccaagtttggacagcacctgcagtgcatctgccctccctatctgggccaggtgtgtgccaagctggc

SEQ ID NO: 12660 - DNA, 201 bp, Bos taurus
cagagcgtgacggtccgaacgtctctggagagaatgaactggtgttcggggtgcaggtgacctgtcaggtgcggcagccgccccgcctctcctctggcccggtgaactgactgccgtggtcctcagctcagtataatgaagctgctgtatccccctgtccttcccactcccacagggccgttcctggccagttctccgcag

SEQ ID NO: 12661 - DNA, 201 bp, Bos taurus
ggattacacgagaagcgtttctttcctgagggcaaaactgagtttctgtctaatgacttcaaagttaagggggtacagaaatggaggcctaaaacctgactaggattaagagttataaaagagagtttccccagattaagtgtgaaccccaaaatctagaccctcaaagtaagagttaacaagaagtcaactctcccataa

SEQ ID NO: 12662 - DNA, 201 bp, Bos taurus
cccacccccaccaccaagttgtgcctttccactgcctgcgtgagtcacaggctgaggggttggagaacggaaggtggggggttgggtggtagtctccaaggggtgagagtctggccctggtctcaggctcacattagggagctaggtgcctgagtccacagtgggacagaagcctctgaagataaaagatctggattatgg

SEQ ID NO: 12663 - DNA, 201 bp, Bos taurus
gagacgtgagctgagaatgacatctgaaggagataatcgggcaaagagcagaaggaaaggtattctgggcagagggccaacacaagcaagggcttagaacatgcagggcactgggggcactgcagtagaagtgaggcaggaggcgtgggcagggttcaggacccccaggctgaggagctcagactctggcccgatagtatt

SEQ ID NO: 12664 - DNA, 201 bp, Bos taurus
ttgggcagagtgacaaagggtttggttaggtaacaggccaaatcatagactttggcctttattctgagtgatttgagaggccatcaaagctttttgaggtgaggagtgaaaagatcagaattaaatttgagctgctataaagaaaatatggtatagggggccaaggctaggagattaatgtgagtgatcactactgcagtg

SEQ ID NO: 12665 - DNA, 201 bp, Bos taurus
aaaagcaaggagtataacactgtctcataaggcttgcaatgtatgtagatataataaatataataatcataatataaagaggggaggctaaaaagacatatattgtggtaagatttctaaatataacatgaagcactaaaatgtaactcaaagtatactgtgaattacatatactgtgtatatcgcaatactctccaaagt

SEQ ID NO: 12666 - DNA, 201 bp, Bos taurus
gaaattctaccaagatacatctagttaaaactctttcctcctatatcctgctcagcgtagaaaggaaccatctgattactaagttttcttcaactctggccatctgtcttaactgttgtttttgcatcatcaccatattctccttctagaactcatatcttacatttattttattttctatataattttcttaccccatga

SEQ ID NO: 12667 - DNA, 201 bp, Bos taurus
cataagggggtttatatcattaacagaatgtgttaatttaatgtattccaccatcactcagatctgagaatcttcccattcattctacaaactcattaatataacaaatgtggggaagacatttatcgtcatctctagcccatcactttcctacttgtgttatactgaacaagatgcttaactgctccatactagaatttc

SEQ ID NO: 12668 - DNA, 201 bp, Bos taurus
aggccttgtgtgccgcgattcatggggtcgcaaagagtcggacacgactgagtgactgaactgaactgaaccgaaggatgaaaggcagggacaacatagtagtctgtggcctgaagtggctaaggaggacttctaggagtagggctgtctgaacaacccctgagaatctgttaaattgaagagttggtgaagacataccag

SEQ ID NO: 12669 - DNA, 201 bp, Bos taurus
ccaataaataaataaataactaaatcttgggggaaaaagaattttcagaattaagtatattttatgtggttgtaatacatttcagttatgtatacagatgcttaaatgattccatcttttacaggttaaagagcctctgccaactggttcctcttccttaattaccctatctaaattacccaattaacccatcataattcc

SEQ ID NO: 12670 - DNA, 201 bp, Bos taurus
tcttggcccccgggccgccggggaaggccctgtgtgttgtgtttgagtggggctatcgcactcatgctctgccacgtcacacggcccagcgctctgtctttgggagactttgcagtgtcctccgttgtggtcaaaacaaactccacttgttggacaaccctagaggccccctggggaggatatcgaacccacacgaggaga

SEQ ID NO: 12671 - DNA, 201 bp, Bos taurus
cctccctcacaggccagtcacgaggatgaaatgggtgcatgtgtgtaagcatttcacctggggcacagtaagctctccataagtaggagccaagctcattcacttcaggccgtggagacgattcctttacacgacacagcgctccctcactgtttatcacagcagcagcaccttccctggagtaaaggcagccggacacac

SEQ ID NO: 12672 - DNA, 201 bp, Bos taurus
ggcagccctgccctaagcccctggcaggatacaggaactgccagcagccaggggctccctggcccagtgggttccctttggctcccaaacatgactttttgacagccttagttttgttagggttagaggtttggattctttttctttctttattgaaaaaagtaacagtcactcattaagaatttaaatgaatacacagta

SEQ ID NO: 12673 - DNA, 201 bp, Bos taurus
tctgaggctctccatgtcatcgccttgagaggacaaaaggcttatttactcactctagatgtttaaactcatgttaaaaatgtaaggatactttccagaaaaattaaaatattggattggccaaaaagttcatatgggtttttctgtaccttcttaacaaaacaccagatgaactttttggccaactcaacagaatgaaag

SEQ ID NO: 12674 - DNA, 201 bp, Bos taurus
tggctcgtcactggtccttcacactctggtacctgctgtgggagctccagccccccacctctgcccctcaaatgcactccacgggcacactctttgttagggttattcctccaaacactcacttcctcctgctcactccttgccattcgcaccttctggtggtcccaggagtccatgtctgtctgcatggccctccagtgc

SEQ ID NO: 12675 - DNA, 201 bp, Bos taurus
cgcagcacgggcctgtccggttcagtggggccacgcacggcagtgctcagcggggcacagctaccccggtaacaagcagtcataaagcacttgtcacgtggcaggtattggcctaagcctcacacagttactcatcctcacaacagcccgatgaagtataggcactgtattatccctatttggcagatgtagaaactgagg

SEQ ID NO: 12676 - DNA, 201 bp, Bos taurus
aacatgtatttaagaaaaaacgtcttggccacttcatgtgcagctggcaggatcttagttccccaaccagggactgaacctgggcccctgcagtgaaagcaccaaatcctaacattggacttgatacggaattcccagaaagcatgtaattatcacaacacattttattgacacccaaaaaaagactgagaggtcaagggc

SEQ ID NO: 12677 - DNA, 201 bp, Bos taurus
ggggaccacgctgggggcgcgtgtgggctctaggacaggctgcctgtgttggaaacccaactctgcaactcgagaggagcgcggcctcctatgggtgactgcgttttttctgaggctccgagctcctcctctcacaagtggagctcggaggactgaggaaggccacctggagggctgtgagcagtgagttccaatgtgagg

SEQ ID NO: 12678 - DNA, 201 bp, Bos taurus
aggcatcttccaatccaagtccctttagggggttatcagagggctcagggagtggacttttgctctatgaaggtggcccagtcatttcccttcctactttatcctaaggggttgtttagctgctaagtcatgccccactcttttgcatctccatggactgtggcccaccaagctcctctgtctatgggatttcccaggcaa

SEQ ID NO: 12679 - DNA, 201 bp, Bos taurus
agtaattatatggctgtcctgagagtaggcaagaggcctgcgtatgattaggacagaggaaaggggtcataagtgagctatgacccctttatcagctacagcagggaccaaaaagtacaattccagtagggcttttttcttttttggctgctcagcttgtgggatcttacttcccccaccaggatggaacctgaggccccc

SEQ ID NO: 12680 - DNA, 201 bp, Bos taurus
acaaaagggtgattgtactttgtggggtgtccttgggattaaatgaggttgaaagccttggtgttgtccctgactcctctttttctctcatcccaggtttgattaggtagtaaacactgttggcttttttttctgactgatcaacatgtgggatcttagttccccgagcagggattgaacccgcacacccccacgttggaa

SEQ ID NO: 12681 - DNA, 201 bp, Bos taurus
ccatagttcccaagaaggtgtaaatccttgtttctgaggaggtggttgttgcagagggacaggcagcatccatctcaccccctaccaactaaagacatgcttcctgccgggaagccagggcccagggcacggcattgggagccagcctcaggccgaatccctgcccagcctttggtactcatgggactcgggctgcctccc

SEQ ID NO: 12682 - DNA, 201 bp, Bos taurus
cctcagggccctgcagatggaatgcggaatccccatggcttgcagtttgtatatcaccaggggtttaaattcctgaccaccacgtggtagtcccactccttgcctcttgattgacaggcccacagtggcataggggtggcagttttcctaaagggaaatggagccattgtgaccaggaggagggagggatggctcctgggc

SEQ ID NO: 12683 - DNA, 201 bp, Bos taurus
gctgggccgcatcccagcacatctcccttccccccgcaggtgccgcctggagcctgctggcgcgcgtggccggccggcgtcttctggcagctgggggcccttggacccgggacgtgcaacgcgcaggcgcctgggagctgcgcttctcctatcgtgcgcgctgcgagccgccggccgtcggggctgcgtgcgcgcgcctct

SEQ ID NO: 12684 - DNA, 201 bp, Bos taurus
gtggggtatgataaaggcctaatgaggatctggggctgctgagctgacatgaaggatgggtggctttggaaaggaagagagggatctccaggcactggggcggccaagcaggtaaggggagatggtgtaggaggctgaaaccaagacatatgtgcaaacgtctgtcattctctttgcactcaccccaggctctgtccatca

SEQ ID NO: 12685 - DNA, 201 bp, Bos taurus
ctattacctaatagagtgtaaatgctgtggaaataattgaaatacagagtagatgctatgtgaatggttgctttttggaattttctggaattttggggggcgatattttctgtccctgattgactgaatccatggctgtaaaagccataaatgtgaagggctgactatatagacattttgcaagtgatataaatagatatt

SEQ ID NO: 12686 - DNA, 201 bp, Bos taurus
ttttctttgctgtgccacaaggcatatgggatcttagttctttgaccagggattgaacccacactccctactttggaagggcagaatcttaaacactggacggccaaggaagtcccatctctgcaactttcctggtgcatgtgatcttgaacaagacacctcatttctttgtatctctgttttcatttctgaaaaatgaga

SEQ ID NO: 12687 - DNA, 201 bp, Bos taurus
ggcagaggacgggggccaggcgggaggcggccatgggcctttgggcggcctctggccaggaggaccaagagtccagtgagcagagcaaagagaaggagcacgctgagctccatggccgaagtccgacggtcttccaacctgctgggcttctggctgagccttttatactaagcctgcgccaacacccagttatgtaacacc

SEQ ID NO: 12688 - DNA, 201 bp, Bos taurus
ggccaggactgacaaggctataatattgataaaatatctaaatacttcctggacttcatggtaaatagccactgccctgagggtctcctctactgctcccacgtggccttggccaccccagaatcccccgatctccccagaaaacagcacctaaagagttaatgctggactcagcaatgagcctccctaccttgctcctgc

SEQ ID NO: 12689 - DNA, 201 bp, Bos taurus
acaaactcacctccccttaagaggctgcgcatcattttcctcatctgaaagcggggttgtgggggcgagcaggagcacaccagtacccagggcctcagccgtctcttctgcacccccaggtgttcaaatcgcgaacgccgcccgaggccatcgcgctctgctccagcctgctggagtacaccccctcctcgaggctctcgc

SEQ ID NO: 12690 - DNA, 201 bp, Bos taurus
ggacatggccctcactcagacccacatgcacacactcctcaggggaatccggaacttctggaactggggctgtttcagaagcagagagagcacacacacacattttcccagcgtcatgtgccatgtcctgcatacatctttgcatgtgcctcatggctgcctcaacccacccggagttatgactcaggacagggggagccc

SEQ ID NO: 12691 - DNA, 201 bp, Bos taurus
gctacccccacctctcctcctgagcccctactctcatcagctgaaattcccaccgtcaccaatgtccagaaccacaggtttggccaggaagccacaggatgcacagaggatgaaaacgcacatcactcagactgaccacgtggagcacggaggcaggaagaggaagggcagcaccctggagatgggccggggacaaggatg

SEQ ID NO: 12692 - DNA, 201 bp, Bos taurus
cgccaccttcctgagcctctgtgccctccaccaggataaacaggcctaggagccatccactccagccctgcagagcagctgggagaaccctgtgaggctcaccaccttctcccattgccccagggcccctccaggggggagggtatggttttgctgacttcacattctctgcaccaaacccacagcctggcccagcgcagg

SEQ ID NO: 12693 - DNA, 201 bp, Bos taurus
tggactctgcaaccgtgctgtcttcaaggggggtcaggacaatgtccccgtgctcaaggtgggtcccccctctcactggcctcagcctggctcttgcccatcccgtgcttctctgctctgccagccctctctcccgccctacagagggatgtggccggggatgcctccgaatctgctctgctcaagtgcatcgaattgtcc

SEQ ID NO: 12694 - DNA, 201 bp, Bos taurus
cgctccatttagagtggcgtgacagtcggtggggggacctagtttcttatgacagagattaaagttcagggtctagtttggaacattagaccaggagtccggactgtgtactgggtgttagggggaagccagctgcctagcttggggcacagagactgggggtgtggttgtgcagttggtcagactgaggaccatcagttt

SEQ ID NO: 12695 - DNA, 201 bp, Bos taurus
gagtcaggcggggagcctgagatgaatctttcagtcccacaagagcctcagctgcctcccgctgcagctgccactctgaggaggcagaggtccaggtcaggcgagagggtccgggggcctgcaaaggagagatgcagactgggaatccctacttctgcccacccaccagaggctccctgtccccggttacttcattattcc

SEQ ID NO: 12696 - DNA, 201 bp, Bos taurus
ggttgggacatcccagcacagcagtaacagtgctgggcattcttgggttgttcttgattttcagtgtaatactgccatttttctagaaaacaatgttgctatgtcttgtttgcttgcttttttgagggagatagattaaaaaaaattttttttccagcctttttgagatacaagggacatcatgctcagttgttcagtcat

SEQ ID NO: 12697 - DNA, 201 bp, Bos taurus
tccaaacacagccaggtgtaaagggggcatttcctcggccccttgggcttatgagaccagaacttggatccccacactcacctggtagatgggaacttgtggcttggcatcaggtagggaggcctggggcacgggagagagtgggcatcagcagagagggaaggagagtcatttcttccaagcatccatctccaagcctga

SEQ ID NO: 12698 - DNA, 201 bp, Bos taurus
ggtcccacactggcaatggtggccaagatctgagaccttgctccagacctatagttacacaataacccaggaaaaccacatactgttacagatcagaggaggtgagttctggaggcctgagtcccccaaataagggagtgtggctcagattcctgggtcctgaggggcagggtgtttggaccagaatgctctcttactatg

SEQ ID NO: 12699 - DNA, 201 bp, Bos taurus
aacacagatgagtttgacagcaaagctaaaggcctttttgagagctgcctcattcctgaatctccattgcactgtcccagacacaggcaacctactcccaaggttggttattttgttcaaatgaagagcttttgatgtttgtagagttgactgtttgaaatcttgggttggccaagaagaaagtccacttggttttgccat

SEQ ID NO: 12700 - DNA, 201 bp, Bos taurus
acttaggcagcacttgggctgaaagtttgaattcttgatctcatcttttttatttcaccattttgtgtgctgatgtcaggagcaacaaaccaaggtcatcgtattccttgagtgagtgagtgagtgagtgagtgaagtcgcttagtcgtgtccaactctttgcaaccccatggactgtagcctaccaggctcctccctcca

SEQ ID NO: 12701 - DNA, 201 bp, Bos taurus
cttatgtctcctgcgttggaaggcgggttctttactattgagccacttgggaagtcccagcatgaagattagatggtagtaattcatcactgctaatatgtttttatttctgaggttatactttggttatgtaagagatgatcctgtgtgtaggaaatacattaaatatctataagtgttggagcataagtttggcaactc

SEQ ID NO: 12702 - DNA, 201 bp, Bos taurus
tccgaggcggggagcgtgcaggtccgatgaccgctcggccccaggaggtggctcagggactcgcagttcggggagggggcacaacgccgactcaaggatgctgtttcccattgtcttggcctcacgtcttcgaaggttctgcatctctttctctctccccgggtctctgagtcttccccccttttttctgggcttcatttt

SEQ ID NO: 12703 - DNA, 201 bp, Bos taurus
cagcccttgagcctcagagcaactggcaaaggctgcagggtgtctaggcaaatccaccctgcctgccaatttcctgcccaaggaatgggaaggagggccgtgtgccacttccgtgagtcagaaatgctcccggctctttcctcctctgctggatggatgcagaaccgtgagatggaaggatcctggatcccaggatggcca

SEQ ID NO: 12704 - DNA, 201 bp, Bos taurus
ggcgggctaaagagtgggtaccactacctgcctcaagacaggtgagagagaaagggatgaggctggtgtccaaagatcaggggtccctggctctgtgttccaggagttagtttgatgtagcaggcataggtcagaggtctcacgcaagtgagaaggcgctaagagaagtcacacagctgaggagttgagtcttctggaagg

SEQ ID NO: 12705 - DNA, 201 bp, Bos taurus
cctgtttccatttttaacagctgaggaaacaggcctggagaagataagttgacatgcccaaggcagcccctggatcagggtgacccgagaacgtagtgggtgctcacttagatctttgtggccttgatggccgcctgactttaaaacccacagagcgctttctctgccttctcaaactaggattcacagcttcgtccttca

SEQ ID NO: 12706 - DNA, 201 bp, Bos taurus
atatatgtaaagaatgtaaaaaggccttccgttctatatcaggtctttctcaacataagagaattcatactggtgaaaaaaccttatgaatgtaaggaatatggtaaggcctttaatcgtagcgagcgacttattcagcatcagagaattcatactggcgtgaagccacataaatgtacggaatgcggaaagcctttactc

SEQ ID NO: 12707 - DNA, 201 bp, Bos taurus
tgggccgccatctgtggggtcgcacagagtcagacacaactgaagcaacttagcagcagcagcagcggttcctcggggataatcatatggtctctattgcgttaaaaaggcctgagtctgcaccattcactatggtagccattggccacgtgagactgttgttcttcaaatgttgctggtgccaactgagatgtgctgtta

SEQ ID NO: 12708 - DNA, 201 bp, Bos taurus
ggcacacctgttttgctgggatgttgaatcagtctcattgagaattaagttgaaattggattctgtttttacaatagttatcttccatacactgcttcaaatttttctaacattcccttgttttagggtgggtgctggaggattttcctcaatgttcctgtccaccttcagcttctggctatgcctgtgccctgtgacaca

SEQ ID NO: 12709 - DNA, 201 bp, Bos taurus
taacttccacaatcccactgagtaagtactatataattatacgccagccattaggcttctctatccatgggattttccaggcaagagtactggagtggggcgccactgccttctccggattcagagattaacttgcccaaagttataacactagcaagtggccgtgctgattgcgaatcaaggagaggctgggggaataca

SEQ ID NO: 12710 - DNA, 201 bp, Bos taurus
gaagccacagatgcagtgttggcagtcatatgtgctgaggacagctcagctccatccagtgtctggatcaacagggggcacagaccaggccctccaaacacgttgaggaatgaatgaatgaatgagtgagtgaatgaacgaatgcctctgtggtgaacagaggaagtgctcggcctctctgagtggtctccacccatgtga

SEQ ID NO: 12711 - DNA, 201 bp, Bos taurus
gggaatagcatgtgcaaaggccctgaggttagactagtttgctgtgtttaaagtatagacagatggactccatagctagaagacagtgagcaagttgggtgtgaggtctgagaggtagacaggggccaggttcataggccatggcaagactgacaagaagccatgagagggtttaaacaggagagtgatcggattcacagc

SEQ ID NO: 12712 - DNA, 201 bp, Bos taurus
cagagggtcagagagacctctctgagaaagggatcatgtgtaggaaaccaaagaatggaaccagagatacgatgagtcagaagaaaagcattccaggctgcggaaacagcatgtgcaagggccctgaggcccacactggcatattggagaacaacagggaaagaacagggtagccggagctcaggaagcaagaggggaagg

SEQ ID NO: 12713 - DNA, 201 bp, Bos taurus
tgtcatcaccccctctgcttgtttcctccggaacacatccccgtttaccattgttaattatcctgtttacttttctgccggcctgcttccctctagaccccgagctccaggagggcaggtcccagagctgtatgggcagcaccgaccccaccgcccagcactgggcctggtgtttgggaggtaacttcttttgacacgcga

SEQ ID NO: 12714 - DNA, 201 bp, Bos taurus
agagcccgtctccagtggtgttccaataactatgacgggaccacaagggcagggcctgggcctatgttggttacagttgaggccctagcagcggacgggggacgctgtcagcgctcagggctgagtaactgccgcttattaagggttcgggcgtgccggaccccgcgcctgctacttcagtgcattgtttctggtcctttc

SEQ ID NO: 12715 - DNA, 201 bp, Bos taurus
gggaagcccagagagtcatcttcttaacccaggtggcctcctcaatgatcgtatgtatctgagtttcagcttctccaaaagtgttaacccaggtacaacatgtggtgttggccacagacactgcctcactcagctaaaagataatcaagggctgtcctgttatcaggaacaactttgaccagggtctaaggatctttgttg

SEQ ID NO: 12716 - DNA, 201 bp, Bos taurus
ggctaggagggactgggttcagagtcagcgtagctctgaccactctgggtggtcctcaatatcccgcagtactggacttggcatggaggcagtgctagcagaatagtccctgatggaaagtagggggacaggagtgaacttgaggagggggcaggagtctgggcaggtgaaggcagtggaaagaaggaaagacaggatcct

SEQ ID NO: 12717 - DNA, 201 bp, Bos taurus
agtaagggtagcactggacatggtgataacagcatgtgcaaaggccctgcggttccaatccccatccactaagaatggcccgggtagagcgctgtttctggaaggggacaaaggaaggacataccagggtgtctggatgaggggccctttcccagcttgaggacctgtggtaccttgacctttccccctttcttccatctc

SEQ ID NO: 12718 - DNA, 201 bp, Bos taurus
gaatgagagcccctcatacagaaaaaataaatacaaagtgctcagtaacaaattcgattttcttcctagaatcatgcacaggccacagatacccgcactaattttgcccttttacaaacctcatgttaaaaactccagctccaaaagcaatcatcaaaaatacagcgaccaaagaaaccccgcctccaagttctaaggggt

SEQ ID NO: 12719 - DNA, 201 bp, Bos taurus
agtgcctggagtagtgcctggcacacagtaggtggtcagttgaatatttgagagatgagatagttacttacaaagacatagcaacgtctaccttatttcattgagctaagatgcgcattttccccccatttgaacctttctgaaaatggaatgggttttacagtcagtggtgtctggagattataactgacaatgtttttt

SEQ ID NO: 12720 - DNA, 201 bp, Bos taurus
atcttcctaagcacccccccaacaaatgacttccttccctgagctcacagaggtggccccttgcctgccctgcccctcaacctgacacagagatggggccggttctccatctttggcaggtttagaaagcacggggagggtttctcacaagaactccatcctctttccttctttgatttcattccccatcttttctccagc

SEQ ID NO: 12721 - DNA, 201 bp, Bos taurus
aactcaccaggagcttaaaaccaggaggagagaaaacagggaggccctgaggcctcttctgccttcttcctgcaaggaactgaagaaacacaggcgcccatttttgaaagcacttctcctgggcctaagcctgatatggaaagcccatttcacagttgagtaaactgaggccagaagcgggctgatcactttgctgacaca

SEQ ID NO: 12722 - DNA, 201 bp, Bos taurus
catcctgatagcaccttggatatcttctcctgagcacttttcacagttttttgtggctttgttgtcaagaaagacacttgagaatcaggcctagttgtgcgtttgattctcagtgagaagggaatgagtttcgtctggaaccaaacagatcaagggtttcagattgaggcaaaccacaccagccttcactctgcacgcgca

SEQ ID NO: 12723 - DNA, 201 bp, Bos taurus
ggaagaatgttttagagagattcgtgctcgagagcaaggccacaatcccctttgccattcatagcggcaggagactaaccctcttgctgggtgggtattgtggagaggaggcccagaccccttcagctttgggctcttctggaaatctgcccattgcaaagtctacagccatttttttgttttgttttgtcttttataagg

SEQ ID NO: 12724 - DNA, 201 bp, Bos taurus
agggagctgtgtactgggctcttcacagactgcacttagatcgcttaaagagagtttcagagttttcaaagaccgtttggatatctgagttctgctttcagtgctggcttaggacacagcccgccctcagcactgggactccaggaccagtggactcaaatgctacctcttccaggaagccttccccttcctcagtgtccc

SEQ ID NO: 12725 - DNA, 201 bp, Bos taurus
ttggggaagtcccgagggtgcttgatcttttgataaaggctttggcacggagactctccagcctataaaggtgagaggatggccctggctgcagacagaactccttccatctcggaacttcttggctgtgtggctccagctaagtgatttcatgtctctgaacctggggcccctcacctgccaaggagacaatcctgactt

SEQ ID NO: 12726 - DNA, 201 bp, Bos taurus
atctccctcccaggggctccctaacagcattggctgattgatgctggctgttggcaggaggcctcagttcctcgccaggtggccctctccactaggacacgtgagtgtcctcacgtgacagtggttttcccccagagtgaatgagccaagaaggggcaggtcaatagctgccctattttttatgacctggcctcaaagtca

SEQ ID NO: 12727 - DNA, 201 bp, Bos taurus
gggagaaacagccccgtcgcacagcacagatgctccccaagggagcttccaggggtcacccctccccgtcccggaagggctagtgcactgcagactgagaaccgcgtgcctgctcatccgtgctctgcggcacggactccccaggccctcagcctcatgtgtcggccgtttcactaaaaatagcattctctaggaatgagt

SEQ ID NO: 12728 - DNA, 201 bp, Bos taurus
ggttttcagacgcgctgtcctggttccctgggattctaaggatgtgcttctgtgtggaaaccagagggcaggccattaggacttctgggtccttcacccagaaggtgcagtttaaaattttattgggaaaaaaatattttgatgcccctgagaaggtttattagcccttgttctcatcagtgggaaggcagggttcagagg

SEQ ID NO: 12729 - DNA, 201 bp, Bos taurus
ggcgccaacggtgtctgggattgggcccctgacaccagtcgtgcgaccttggacctactgtgcttatttcttggagcctgggtttatctgtacaccgtgaaggggtggcccctggctctgccctccttcctcctgagttattggggcctgagttccgcattgcctggtctctgtccagactttgtcttgattcaactgacc

SEQ ID NO: 12730 - DNA, 201 bp, Bos taurus
ctgtgacgaagcgcctagagactgtgtgtgtgtgtgtgtgtgtgtgttggagacagtgtccagtgagcactgcccacaggccattctgcaatgatgaaatagccccgaactgcacctactgagtgcagcgcccctactgagcagctgaaatgcggccagctctaccaagaaagggagtccgtaatttaagctaaagttcca

SEQ ID NO: 12731 - DNA, 201 bp, Bos taurus
gttactatggccaaaaccacatccacaatcggtatctaaactggtctctttgctgactcatcactgctaccttccgctcctaaagtgtgagctctgtgaggagaggggccctgtccctccgtgtcaccatgtccccattgtatggactgggcactgtctggcctaacaacagcaggtgcttaataaatgctggcagggact

SEQ ID NO: 12732 - DNA, 201 bp, Bos taurus
ttaatgtaatatatagtccatattcagatttcccaatcatccttcaaattctcaccttaatatgaataatattccaagtaacagttagagctgtcttaaggcttggagaaggcaatggcaacccactccagtactcttgcctggaaaatcccatggacggaggagcctggtaggctgcagtccatggggttgtgaagaatc

SEQ ID NO: 12733 - DNA, 201 bp, Bos taurus
cacccagctccccgcctcttcctggcgtgggcctctggctcacacttctcaggactctcccgtatttctgcctcagtcatcatgtgggagaaatcaggccatgattaggaaggctccctccaagttcagggagaaaagagtttctgctggggaaaggaagggaggtcatgccagcagatggccagattcccagcgttttca

SEQ ID NO: 12734 - DNA, 201 bp, Bos taurus
gacccagtaatccatcctggggagggagtctgaaggaagctaaactgctggaagaagggagattgttaatgtccataaatggcccgcggagcatctgtctggtactaggacacctggggggtggggtggtcccggctaccagagggcaagtgttgaggtctcaggaagtgctgtttaatggccccgggggaatgtgtgtgt

SEQ ID NO: 12735 - DNA, 201 bp, Bos taurus
caccgaggtctcagcagggcaccctgagaggcaccacgtggggcccctgccttcagcaagggagtgacaaggtcatgttcatgccccaccacgtggcctggtggaggtgacaggcagatccccagatactgcggtggcagtccaggctggtgaccctgctgtgatgggggcagtcctggctgctggcacttggcccaggga

SEQ ID NO: 12736 - DNA, 201 bp, Bos taurus
cactagcattattcttcactgagggtagaatgggggtcttggagatacccagtccaccacccccaccagatgctggaatgcctggccttctgggggcaacggggatagcagatactctcagaagctaggtctgaacttggatgcctgcatgacagggcaggcaagggagaatatgggttgtggctaagggccagaatcacc

SEQ ID NO: 12737 - DNA, 201 bp, Bos taurus
tacgtgtgatgaagaaaatacacaagttgatatgatggagcatcccagggccctccttaggtggcagtgtgtgtgtgtataaaggaaggcctttctgatctgagacccagggaggagaagggatcccaccatcagaaactgggggtgggtgagccaggagcaatattccagacagagggaagagcaaggacatcggcactg

SEQ ID NO: 12738 - DNA, 201 bp, Bos taurus
atccatggatcaggatccaagaccggagaggcggtgaaggaccccgagagggctgcgggcagcaagccaggcagggagaaacaaggctgtgtgggaaggagggccctggaggccccagcccccaagtgcagaaggatacgtggggagtgaaaaccaagtggtgggagctaagtgccgggattcctggatctaagggcagaa

SEQ ID NO: 12739 - DNA, 201 bp, Bos taurus
ggcccggatgaatgatggatctgccaggagggagacaggtttcaaggcatctccagggaagtaggcgcccacagggctgagaatgacgaacaggagggctcgagtagggtggccgacacctagcgagggctgtgatgggcggaaggggacatcagggacccaggaatccaggcccccaaccccttccctgacccaagccta

SEQ ID NO: 12740 - DNA, 201 bp, Bos taurus
taggatgaacattttttgaatgtcttctcatcagaaatgacagagttcagatgtacattctaccctacttttatctgatgcaactgaaagtcctgtacacgaaaggactctgaaaagtaagtggtagcgacaggcagctcagagaaggaaagccaaattcaaagtaccactgtattagcagtgaatttacaatgatttttc

SEQ ID NO: 12741 - DNA, 201 bp, Bos taurus
tttaactcctcacaccaccacctctattttcttactcacatatgtttctggttcacagactgagctaggaaacaacctccagatgatatcccagaggttccgtggttcaactatatccatcctcctctccagccctctaaccggttgcttggggctggcctggaggcatttgcactctgtttttctcttccttgactctcc

SEQ ID NO: 12742 - DNA, 201 bp, Bos taurus
ggttccttcgggcagagagccccgcagtccgtggaaaaaggtctgagagagtgatggctgcgacgcggacagcatcgcgggcctgcgagatcttcacgacactggaatacggaccggcaccggagagccacgcatgcgcactggtgagggcttgcctggatccgcgctgcctatcccccttcgcggtcttcagggcccagt

SEQ ID NO: 12743 - DNA, 201 bp, Bos taurus
caccctccatgcgcctgaaggcccgacccggcagtcccggcttctctgtgctcacctgcagcgccttctccttctacccacctgagctgaagctgcgctttctgcggaacgggctggccattggctctggtgagatagacatgggccccaacggcgacggctccttctacgcctggtcatcactcacagtcaagagtggcg

SEQ ID NO: 12744 - DNA, 201 bp, Bos taurus
aaaacctgtgcttgctaagccagccttccaggtccctttgaatgtctgccaccaacttgtccgaggacacgctctgtaataacctcggcccctcgcactctacttcggcttaccaccaccggtgtatcccagtttggtggtaagaaaccttagcttcagggccaagtcttgcctctaatatccaagaccggccctcagaaa

SEQ ID NO: 12745 - DNA, 201 bp, Bos taurus
ggcctctttgactctttggtgaccgctttgaactctctcccggcagctggtttgacaaatccttctccctaatcgtcttctccaatgggaagctgggcctcagcgtggagcactcatgggctgactgccccatctcaggacacatgtgggaggtacggcaagccagctggccctccaccctggcgaccgccaccctccccc

SEQ ID NO: 12746 - DNA, 201 bp, Bos taurus
atcgaaaggcaaagtctttcaatctttccatcactgacagccaggaaactctgattaaaaaaaaaaacaaacaacctaaaaaactaagaaagcaattaagtttcacttatgtttaacatgccaagtaacaggtatatgctatgcattggaaatgcaggctcaaagaaatttgtttttcttatcatgactatgtggcccctg

SEQ ID NO: 12747 - DNA, 201 bp, Bos taurus
tttacctactgacagtttttaagctcggccctgcttcttccccttctgctgataaagcctggagctccctcttttgctaatggtggaaattcaaaccgcacgaagctctggcccatgtagactcctcacccccacctcacctcttaaccacaacaaaaacctgtgctgggtgcttgtccttgttcttgtagagctgttccc

SEQ ID NO: 12748 - DNA, 201 bp, Bos taurus
tttgtccaacctggccactcacaagcactttactataggctccaagttggggaacaccaatactttaaagtgctgcccttgccttgaagcttctggaatcggggaaatgaatggcctcatttcatagaggagtgctattcgttgccaggtgattccttggagttagagcccttgcattcactgctcaccatggccaggcct

SEQ ID NO: 12749 - DNA, 201 bp, Bos taurus
cagccaaataaataaataaacatctttttaaaaagccgtattactgggatgtggctgacttcacctctcatgcacctgtcccatgccttcccctactccaggagcttactgaaacagtacttttctctgatgcatttgggactgatcatctgacaatgtaaacaatccaggacttcttctttcagcaagcctgagcaagag

SEQ ID NO: 12750 - DNA, 201 bp, Bos taurus
ggccatcggcttgcccaagatcacacagccagagaacacctccactcgttaaccctttgtcgtgtattcattcattcttcattcattggacacctgatgggatctgcgggccggatctctgcaggcactgggggaaaggaagcgtggccaaaacagaacaagcctctgccccctggagcgctgagacccagggagcatcaa

SEQ ID NO: 12751 - DNA, 201 bp, Bos taurus
aggttttttttttttttttcaattgtttcttttttcctgtatccactgcttttatgacgacttctctgaggtcagggactcatgcttcccattttcagtgcggatttgtctgactgcgaggatgtggccagagctgggcaagcgtgtgggctgctgagggctctcatcttgctcactgagctcccccaggcctaagactcg

SEQ ID NO: 12752 - DNA, 201 bp, Bos taurus
ccccctatactctccgtgactctggatgttggggtggggaggagctaacaccactgttgaattgaatctacccaggagagaactaggacctagcctggtactgatggctttcaaaacagtggccactgccaaggcttcgtaggggtgcatgggggtgagtttgcaggtggggagggccctggtgtgagccagcctgcgtgt

SEQ ID NO: 12753 - DNA, 201 bp, Bos taurus
gctgctgctcatgctgctgagcgcctttttcgccttctggttcccgtttaacacggtgctggtggcccgactgtggcaagccagagataagttgcggcccatcctctgggctaccttctccctgggttgtttcaacagctgcctcaaccctttcctgtatgtcttcattggcagagatttccaagagaagtttttccagtc

SEQ ID NO: 12754 - DNA, 201 bp, Bos taurus
ggcaagaggctgggtccccaacagtgttggggagagggaggcagggcctgggctgctggaactggggaggatggatgaggataccccactccacttgcttcccacttctgatgtttctgggaggcctatgttcctgcccctgaaaagggacagttatatctgtctgtccagatgcaccccaggagctgaccatcagagtgt

SEQ ID NO: 12755 - DNA, 201 bp, Bos taurus
cagacctagacttctaagtcctaggagcagagggtctggagaccccaactcctggatctaagacaggaagagaatgggggcctggactcttgggtctgagtgagcaagggtctgagggttccctggaaaaagtgactgaggtccaggattccctgagggatcagggatctgggggtgggagtcctagggtctggggttgga

SEQ ID NO: 12756 - DNA, 201 bp, Bos taurus
caggagagaagctgtggcagtttctgagggtgtgagtatgcttcactcgctggtggtgtctatgcaggagaaggaccatataaacactggccccagtcacgagtcccatgaacacagcatctgggaaagtcatgataatggtgtattttgcagcactagacatttcaggatttttcaaagaacacagcccataatcccgta

SEQ ID NO: 12757 - DNA, 201 bp, Bos taurus
gcacgagggagtatgctgggaggcatggaaccaccttaagacctcaaggtcttggatgaaacaaacaacagtaagatccagaaaactgtaaaaaagaagatatcatcctttaatagcaggtaaagaagaacagccctaataacaacatgcggaaaggtgttaggttattgggtcatcaactggtgtcagggaagttcccta

SEQ ID NO: 12758 - DNA, 201 bp, Bos taurus
tgacagtcatcccacttaaagtttgtggaacaaaggaacactacctccgtcacagtcagaagcttaggcttttttggccagaagcataaaatattctggggctaccagtaaagggacactcggcaatgctgtgggcattgggttaagatgagaacccaggattagcaatatcctctgggcccagaggaaatgtaccctcag

SEQ ID NO: 12759 - DNA, 201 bp, Bos taurus
aactgagaaagtttccacgattgtgaagattttggaaaaagtattttgtctaaacattcagcttgtttctttaaaggaaaggccccagacatttgactcacagtggaaggtttctagaggatggtgtacagagggaatgggaattgggttgaggtgagtgggatagaggaaaatatagacccatgaggaagagggaggccc

SEQ ID NO: 12760 - DNA, 201 bp, Bos taurus
cgtggagagggaggagagaaagtcctgggaggagaacatcctcaagagtgaggcccaccagctctcagtggtagggcttatttgtcatagattaattgacaaatagcacgtgggtttatttctggcctctctattctattccaattatttatgtgtctatttttgtgccagtttgatactgttttggtgactgtagctctg

SEQ ID NO: 12761 - DNA, 201 bp, Bos taurus
ggacggaggagcctagtgggctgtcctctctggggtcccacagagtcagacacaactgaggcgacttagcagcagcagcagcagcagcagcatgatgagggcagtgatggagacttttttctccagtaagcttctccttaaaagttggttttatactatctttcaatttactctcacttgtcattgcttcctccaggttgc

SEQ ID NO: 12762 - DNA, 201 bp, Bos taurus
tgctaagagagccaacaaaagcaaaaaaaaaaaaaaaaaaagagccaacaaaagccagggcgtggagtggatgctggggccatctgctagaaccaacccctcaagcccaaggctcccatcctcctgcacccacagatgtctgcgggctcagcccaggccacagttctaacagtggaaaaggcttctcctggctgaattcca

SEQ ID NO: 12763 - DNA, 201 bp, Bos taurus
caaagagtcggacatgcctaagcgacttcactttcactttcaagcatgcgtttagaagttctttactaaaaggtgaacgagggccgtacacagttacagcgtttttcatctgttgcatgtgagaaaaatcaatgcattcgtattctggtattagttgcccttcagcataaacatttcctaacacaagaaaggcaagaacat

SEQ ID NO: 12764 - DNA, 201 bp, Bos taurus
aggagagttgtgagaggaggcaggtttcggcctctggatgagccctatgaatggtgtatgcgtgtgttgcaagcacagtggtgtgacccagttcaagctcgttctgtgagagaggccagtgcttgggggagacgacttcttgaggcaaacaatgggacttcattttgaaaaccagccgaccaaaaagatggctaactaata

SEQ ID NO: 12765 - DNA, 201 bp, Bos taurus
gcctgatcgcctggcccacgaatttacaaggatggcgagcgagtaagatgcccgcctacagcaagagaccatttgccatagggtaaaatttggcaccgaagaacattgggtgttacagggctggccgaggtcacctccctctacgcggggtgagaggaagggctgacgggaaggttggtctgcagggcagaaggaccggtc

SEQ ID NO: 12766 - DNA, 201 bp, Bos taurus
cacatcctgttgaagcctggcttggagaattttgagcattactttgctagcgtgtgagaggagtggaattccacttcagtattctggcctggagaacttcatggacctcttatcaaagacagagcagaaaggaaataaatctataagttgaaaagccctgaggtactaattttagcttctcatttgcatcattggacaaag

SEQ ID NO: 12767 - DNA, 201 bp, Bos taurus
caagctaagagaaaagttatgtctttatctctgggcctatgccctctgcccttaagtttttcataattgttggaggactgcagcacttttcaaattctcactgtaactggccactcatcccagaaaaccaccagatgcaaaaacaagaccaactttgtaaattatttctctcagaggatctcatttgctcagactcagaaa

SEQ ID NO: 12768 - DNA, 201 bp, Bos taurus
ccccagggaatcaggctgacattctttgtttctagaagttcccgccctaaatcctccctttctgaggtctcaggtgtgctcagtgtgaggctgcagctccaggctcctaaatgcaggtcttcctcctgcgttatttccgaaaccctcagagcctgggcctggtagcccagttggcgggtccatgattgtctctcgtgaatt

SEQ ID NO: 12769 - DNA, 201 bp, Bos taurus
gagcagacccggctagagcgagaaccctggcggaattttctcggatggctccagtacagctgctggtgacccatgttgctttctcggctgcaacgaggtaaaaggccaaagaagatttcaaaggtaagcatagaacagatcactttagaggtaaagaaacttaaagtccatcatgaaaggcagttcaacatatcaagaaaa

SEQ ID NO: 12770 - DNA, 201 bp, Bos taurus
ataattgtaacttttgaatcatcaaccttcatctcatgatacacgctaatatatccattttctatgtgttttaactatggattgctctctacagtaattcttcttcatagaaacttcagaaaagaggattgatgagaagctttctagtatgtagtctctgatatttatttaattttgattttttattaaatacctttctac

SEQ ID NO: 12771 - DNA, 201 bp, Bos taurus
aatcaggattgcaggtttgaacgttttcaagcttcaggctcatcattttgacaggttatcttttacacagtcggcctttgtgatgacaaaagcagtttgtttttttttttttttttttactccatcatattgagagggtaacaggcaggaaggccaggggtctccaaaggaggaaacaggctgcaactgtttaatctcgcc

SEQ ID NO: 12772 - DNA, 201 bp, Bos taurus
gtcgatttggtttatacatggttcagcctgaactttatgtgaactaagacagcctgtcagactctcacaacacatcagctttaactgttggagtaaagaatgtctgtcctgcatgtaaagatggaccccctcttctcatggtgtccatgttgacactctctggaagataaggtttccttcccagaccccagggtcctgctg

SEQ ID NO: 12773 - DNA, 201 bp, Bos taurus
tccttgaggttagggtctctgactgggcctaagaattaaattgacataagacagcattatgggggaaacacccaaactttattaaaagaatgaagaccgaagagcaggtgatgctgctggcctggggaccacacttgggaaccacaagtacagatgaaaggctttaaagacctccctggggctttccctggtggtctagtg

SEQ ID NO: 12774 - DNA, 201 bp, Bos taurus
tcaaaagttcatcagcagcgtttgaacaagaaggaaacacaggtccagggaagtatatgacttgttcaagggcagagaggtggggccaagatcctaatcatggcttcctgactctttgaatgcttgccctcaaccataatgctcaactcggaccttagagtaacatggacagaagccccctgctcttaactcgtgttctct

SEQ ID NO: 12775 - DNA, 201 bp, Bos taurus
tttcagaaaaacttaaaatttaatttctgcctacatacactggcaaaggatacaacgtatttggactgattcacactacactggctttgccgtagtgctcgcctttggagagaggaacaagaggtcagtgagaggcacagacttacctttattgtgtgcttctgtccttcaaattttttgtactatattaagaaaagccct

SEQ ID NO: 12776 - DNA, 201 bp, Bos taurus
tgccgcagctaagacctagtgaacctaaataagttcattttttaagtaattaaatagaccaagtgagatgggaggccactaaaggtggcccgagatggttttgatttggacaagaggactgcctctgtgtcgagagctgacggtaggaggaggaagaaggcatcggggaggctggcccagggaggcaattatggtaagcgt

SEQ ID NO: 12777 - DNA, 201 bp, Bos taurus
atcaatgccaagctcctcagactggcacttgaggctcatcatggcaatgcccctgcccaaccttctctggcttcctttctggtggctgtgggccatgtttttgagctgcatggatggatcagttcagcattccccctctaattctggttggaacaatgccagtccctctgccgtgcatggcgtggtattcctgcattcttc

SEQ ID NO: 12778 - DNA, 201 bp, Bos taurus
ggagtgctaaggagctggccccaaagaacttggatttattacatttagaaaatgggctgtcgacataactgtcaccagggcagtaaacggctcagaagtttagacttttggaggctaaaggggcctgttcctcctttcacgtggtgacagtccttgaggtctgggcgccttccgagttagaagtggggctgacgctccgct

SEQ ID NO: 12779 - DNA, 201 bp, Bos taurus
acaggaatgagctctttctctgtggccaggattcgggacatttccttaagggctgatggaaccagatgacgccctgacaggcagccctttggttactgcccgtcttcccattggccttccagaatgttctcgcatgttgctccctccatctagcaggccagctctcctcgaggcccccctcatctgggctctgtgccccta

SEQ ID NO: 12780 - DNA, 201 bp, Bos taurus
aggagcctggcaggcgacagtccatggggtcgcaaagagtcggacacgactgagcaactcaacagcaacacatcagaggcagaaacacaggtgtgtgggaccagaacacaggccgacagttctgtatctcagcgagtacgtaggaccaagcagttttctttctgctctgtgtgggtctctctgttctgccccgggctgggc

SEQ ID NO: 12781 - DNA, 201 bp, Bos taurus
atgcttgcccggaatttccaatatactcaatggtgaagtgccttcaccccttcaggaatccttcaggctcatgcctaagacatctggagggctacctatttgaagcctgaaatctgcctgagacaggtgatgatttcctgtaagccaagttcttgtgcaagaaacatgttgcaattggcatccgcaacacgtttccggaaa

SEQ ID NO: 12782 - DNA, 201 bp, Bos taurus
gaccacgactcccgccctcccgcgcgcagaccgaatcgccgaccctatggcgcccccctgggcccggctcagcagcggtcgccacccggaccggactctcccctcagaaccggccagacctcggtccgggcttcaagtccttgtcagaagtgggcgagtcctcacagcgcaagggcccctgggcaacttagtcccaacagg

SEQ ID NO: 12783 - DNA, 201 bp, Bos taurus
ctcctggaccgggaatcgaacccctgtctcctgcactgacaggtggattctttatcactgagccaccaggagagaccaagagatatcttgttactcgtgtcggtctgacttcaaagtccttgctccggaccaccatgtcctgccatccccagaggtcttgcatgtggtgtctgctagtatatataatttattagtgatgag

SEQ ID NO: 12784 - DNA, 201 bp, Bos taurus
ctcagaaatggcactgaagagaacagatttgaactccaaaccacaatgaactgaactaactgatgaaccacgtaagaatatcattttaaaaatgagttaatacaaaatgaggaaagatcgttacattcatcctacaaaggactggattcctatgcaaaacatataaagaaatcatacaaatctgtaagaaaaaggcagcaa

SEQ ID NO: 12785 - DNA, 201 bp, Bos taurus
tctgtgagcgagtgatgaggacgttcataccgccggggcttgtggtagctcagcagctcctttaaaaaggtctgcagagccagcgcggccatcccttcccgtctcccccaccgccgttctgctacactctttcccaatttaacacgcagtgctgtccagccagcagcctggagagtttaccatgattcctccggccctaga

SEQ ID NO: 12786 - DNA, 201 bp, Bos taurus
tatccccccacaaacgcgtcctccatgtcttgctcttcatttcctaagttgttctgcctttcagacgcgtctcctcccaccaaacaatgcattgatgcctccacacatctacgtgcctgatagctgaggcacctactgtgtgcaggcactggggtgggccagggtgcaggaggagaccgagacagggggtctccacctcac

SEQ ID NO: 12787 - DNA, 201 bp, Bos taurus
agtcagtagcttccatgtgattttggtccactcaggctaaaggacttagtgatttttctaagaggtcgggtggggtggggggaattccctggccatcctgcggttaggaatcggtgcagagagaacgggttcaatccctgatcggggaactaagatcctacaaggggcgcactgcggccgaaataaaaaggacgacttcca

SEQ ID NO: 12788 - DNA, 201 bp, Bos taurus
tgactgacgtttttgccgtgtctggccctctgctgcccacggcataggcggtgtgttgctcgtcttcacagcggtcgtacaagttctcgctttagctttaattttcaaaagagggaaatgaaggcctatgacatttgagtaccttgccagatgccataaagctaacgttgagttcttttggaattcgggcctaggtttttg

SEQ ID NO: 12789 - DNA, 201 bp, Bos taurus
ttgtgtctttacccgtcattgaagtcctccataccttccaaggcccaggagtgacaatgggccgtccttcactgatcctggcccctcatcctgcaaaagcgcaagggctcactcactggtgtgtcacacactcagagcaagcatgtccttcactagcgtttctttgctttcaggttgttggtgtgaagcagacaatgagga

SEQ ID NO: 12790 - DNA, 201 bp, Bos taurus
tcccccagccctgtcgccggctctgtccccttcagactgggccctcacagcaggcacttcccataaggtctgctgcccctgcgcgtgggccgattgctcccgtgtgcaactggtctgcaaacgtgtgagtctgccggtgaggcaaggtgagcaccgactcctgttctgagcgccgtcagtgtagaaccctaggcagaggtc

SEQ ID NO: 12791 - DNA, 201 bp, Bos taurus
acgcccttttagaaaaggtgtatcccttcctgttgctagattctcagttcctactaatcccccatttctgaaccaagtatggtcccccccaatgtctgtagcctaacactcagcaacaccagcctgccacattatgcacattatggcacatggctgtgttccagctggacctagagaacttccattgaacagtactagggg

SEQ ID NO: 12792 - DNA, 201 bp, Bos taurus
actgggtatctggaagggagacactgggcacgcctagtgcaggtgagcaagagggaaagcactgcttttgtacatccagaaaaggctctcttgcctgcagagtctgtgcccaactcactgagaaacaccgatgtgtaatccggccacagtgaatggctgtgctcttgctcgctgaacatcgcctgcccaaccagtccgatt

SEQ ID NO: 12793 - DNA, 201 bp, Bos taurus
gccagaaaggctcaacatttacactggctgccttttaatgagggcattgactttatcctccatgaccatgcagaatgagggcagagtagatgcaggtgagctctgagattgaggccatggtgagggcaaatgctaggtgggggctgccaggcatggtgctagtcaccggatgaagtgagggcctcatcccaaaatggcctt

SEQ ID NO: 12794 - DNA, 201 bp, Bos taurus
ttggtggaaaactgcacctgtgcaggaggagactttacaaggcaggcaggcaacagctcagggcaccatgacctgactgaggctcagaggcctcaaagacataacttactgaccagagggtaggcgtgtccctgaacacactggagcatccctggacaccctcactggcctgacctttttagcgtcagggtatctgagtgg

SEQ ID NO: 12795 - DNA, 201 bp, Bos taurus
ggcctggggcagtacttgaaagccccaccccctcactggcaggaaaaaaagaaactaggaagagaaggagaaagagaggcctctagaaagaggtctagcatgagggaaaggagttttatgtccaggtgtaatcaatagagttaaatctgctgtggcccctactgtgtgtcagcacaagtgttaaactctgtaaatgcaact

SEQ ID NO: 12796 - DNA, 201 bp, Bos taurus
ccatgaacactggctgctctctcagtcatctttacacgggggcagccatcctctccacagagcttgctgtcttcagcatcgctggcctagctgaagccctcggcagagcgtgacttgaagaccgtgaccccctccctgcagtgctcctgtctctgtctcctcgtccctgttgcagtttccctgttctggggtcaggcagag

SEQ ID NO: 12797 - DNA, 201 bp, Bos taurus
tggccaccactggctgggcgggatgtgggggccgctgaaacagaggcacaccgcctgcccttacctggctcctcggtaacctcggactcttctttcacccgcaggcccagtgttgactgctccgtagccccagggagcatctccagcccaggttctggagtctcaggtatgggctgagggagggcctggaagtcggggggc

SEQ ID NO: 12798 - DNA, 201 bp, Bos taurus
gaagaaccccatattccccacctcaactcgagatgaggctggattctcctgtttagagaagaatcctgaattccgcattgaaactcaagaggaggcctggattactagttgcaactcagccgggtctctatgttccccattacaacttgaaagaaactccaagcttcccaccacaacttgagaagaacccgagttccccac

SEQ ID NO: 12799 - DNA, 201 bp, Bos taurus
ccggcccctgggtctctctcttcctctggttggtaaagtgatttaaaacctcctggctattctcattttgtcaaatagctcctataggattcagtttcaaggctcaatccagaaatttctggctcagcaaatagatccaaagcaagaaattgtattcattcaagctgcttgtgagtaaggaatatggtttctcgtgttttg

SEQ ID NO: 12800 - DNA, 201 bp, Bos taurus
atcagccactgcagccaccctagccagtgtaccctgaggggaatttgggatgcagaaaaacaggatactgactctcagtagtgaagatgcatatccaggaactatttcaatgagcccagacccttgtatattcctgtacatagagaagcactgaattcactaacttgagatgtctgcttttcacgattaccagtaatcttc

SEQ ID NO: 12801 - DNA, 201 bp, Bos taurus
caggagaagacacagttaactctcagttaagatttagctcttccacaaaagacactagacacatgcagatagcatagggatgataccacacaagaatattacttcaagactgagaaaggtaactttaatctaatttcataaagacaaggagagaaagttaatgaagtgagaaaacaaagaaatatgtttaaaataaaaaga

SEQ ID NO: 12802 - DNA, 201 bp, Bos taurus
ttaagggaaagatagcaaaaactttctgagtcttctgtttcttaaaaataatcagtctaaattaatcttcatgccaagcagagtattttggggtggcaaatttttctccccaacagagtcaattataaaattttcactaacaaaacaaaacagaacagctctagactaaaagctttaagaaattgttaactctaatcttat

SEQ ID NO: 12803 - DNA, 201 bp, Bos taurus
gattgggttgcttcaggccaaaacacgggggcgggggggagcagagttctgtcaatcagcagaaaattggattaaatatttgttgagcatggccctgaactacagccagtccctctcatcaggaaacttgcacaagtctctaacattcatccatcaaagggcagacagaagaagcaaaaaacttcaatcccatggccccca

SEQ ID NO: 12804 - DNA, 201 bp, Bos taurus
aactgggtttatgtataacacttatggaatggaaacttgtaagtccttacttagttgggaactttagggaaatctacccgtgaaaatgtccaagatggggctcttttgatgttccaaaactggaattttccatgtgcaattagaaaaagacagcttgatcaatatctttagaattctgacccaaagagaacaatcatttta

SEQ ID NO: 12805 - DNA, 201 bp, Bos taurus
tctcttcttaaacatcttcctgctggacaggggctgcatactttagcctttattagtggcatagaagtccctctctgaatgtcccaaggacctgtagggacgtgggccactctccactgaaatgtgttgaattccttgagctatcatgagacttcaaaatactgtagcctagaagacatgtgtgtgtgcacgtgtgctaag

SEQ ID NO: 12806 - DNA, 201 bp, Bos taurus
acagcttgagaatccatccaattgctcttcccttacctctgacagagctctcattgctgtagactctggcagtttggaaagaaggtggaccctaacccttcaccaagtaggcctgggtcccacttcaaatagaaaggcaatagccaagctgaggccagtaaggggctagtcatgtctcacacactcccacagcctgctcct

SEQ ID NO: 12807 - DNA, 201 bp, Bos taurus
tgcaattaaaagacatgtgtctcttggaagaaaagctatgacacaccaagacagagtactaaaaagcagagacatcacattatcaacaaaggtccattagccaaagctatggattttgcaataataacatatggatgtgagacctggaccataaagaaagtcgagtgctgaagaattgatgctttgaactatgctgttcgt

SEQ ID NO: 12808 - DNA, 201 bp, Bos taurus
gccacacaggtcatggacacaaatcctgtctcagccaaaacctcctctggcaatgtaagtccaagcaggctaaatgcaaacccacttcaaagcttcctctagctatgctggcctctgagggtgtacctgagcctgtaccccagttggcctctgcagacacatgtgctctagaccagctccagaaacatatattgttgagag

SEQ ID NO: 12809 - DNA, 201 bp, Bos taurus
cttaatcttatacttctatgttcatgttcagtcttaaaactcccctaaattatttgttctaaactcagcaatctttcccctgttcttgtattgctgatcctgttagtgatgtcaattgtcttgttgttcacactgcttgctgaacccagggtaggcaagacatgagctaagaggctggaagaagactccaggaactgtagg

SEQ ID NO: 12810 - DNA, 201 bp, Bos taurus
cttcccctttggtaactataagtttgttttctatgtctttgagtctatttttttttttttcaaaattagttcatttgaatcattttttaaagattcaatatataagtgatatcatatgacttagtatgataatctttagacccatccttgttgctgcaaatgcattatttcacaatttttaatggctgagtaatataccat

SEQ ID NO: 12811 - DNA, 201 bp, Bos taurus
tccatcttaacatgggttcttccagtgtgtgtatatatatccaagatttcccttttaataagtaatattggattaaggccccaccttatatcattatgatcgcatttcaattaactctatgtatctgcaataactctattctcaaataaggcctcattctgagctacctcaagttatacactcaacacataaattttggtg

SEQ ID NO: 12812 - DNA, 201 bp, Bos taurus
gtaccaaagccattcaagccttgaacaaagaacaaattcagatgaggaaggcagtaattcaaaataagatgatattagacatactcacaacagcccagggggggacttgggccataattaaagttgaatgttgagtacacatgcctgacgtgtctgaaaatgtatcttctgccttggaagatatgcaaaatcaattgaaag

SEQ ID NO: 12813 - DNA, 201 bp, Bos taurus
tccttgttagtttattggttggagtcaatccagtcctgggctctataggcctatggtagggttagtcatgacctccaagagggcctatgccaagagggccgtctagaacttctactctcattgccctctttcctgtagtgagccctgctaacccatgcctccacaggagacctcgaacattagcaggtagttttgatttag

SEQ ID NO: 12814 - DNA, 201 bp, Bos taurus
gggaggaggctgaagagagagggcaaaaggggctgccttatagatgtctcctgctacctacagatacccaggtgttacaagactttaccctgggcctccacagaagggaggactggaactcagccctaccagaaaccagaccagaacagaaccagaattcgccttctctgccaagaggaggttatcagtctccaaccctca

SEQ ID NO: 12815 - DNA, 201 bp, Bos taurus
ttgtttggcctcactgtacttcagacacacaaacttgtgttcagtaacagtgacaggctagggtctgctctaaagaaaacatcccctcactaatgactgaactaagttgtggtacaagggccttgacattttctctcagtgtgagactcttctaccaggtgtgaatgaaaatattgcctgtgtcaacttgaaaaaaaaaaa

SEQ ID NO: 12816 - DNA, 201 bp, Bos taurus
atagacggcagcccaccaggcccccccgtccctgggattctccaggcaagaacactggagtgggtagaaaaaagctattacaggtggcctttgcatcaggttcttgaatgtagtcagctttggttaagataagaggtttagagtataataaacatggtgacctacaggcaaagaaggaagaaagcaatatggtggccacaa

SEQ ID NO: 12817 - DNA, 201 bp, Bos taurus
gataaaaagccctcaaaagtgctgattagtatgtcattctattaggaagattgagcttgctaagaaaatattgtgtgattgcatttttattgttgtcggggtttttttgtgtgtgtgtgtgatatggatatagttaacagtctcctgattcgttatgtattataagtttaaattttattatatcaagggttcttgaaacct

SEQ ID NO: 12818 - DNA, 201 bp, Bos taurus
tttgattgtctgacattggttcattaatgttcatgatcttgctttctttgtcctccaagctttgcagaagcaggcatatgttttacagaaccaaacttgattcaattcactcatgcatagtcaagcccatttactgacaccaggttgtgatgaaggaaattgcagcatttattgtagggcatagtataaggagaatgggtg

SEQ ID NO: 12819 - DNA, 201 bp, Bos taurus
aggaagatactctaaagaaaggtaattatgtctttgtaggccctccttcaccaaatagtccagaccttgcatggaatctcccatattataacactaacttgtcctcatcaggaacagcaccatggccaatttatttgttctgatttatgcctacatgaactgcatgtgtcaatttaaaaaaatagtcacaatctagaagtt

SEQ ID NO: 12820 - DNA, 201 bp, Bos taurus
gttctgcacttgccaaaataccctacattttcatggtatctggcaagcaacaacaaaaaaagagtaggtctgatcaatatttatgttatagtgaaacattttgaagaaaactaataaaatcctgcaaccctgtctctgtgaggcccagggaaactaagctctgtggctcctaagacatcactcacgttgtactctgtttga

SEQ ID NO: 12821 - DNA, 201 bp, Bos taurus
aacttttcatgttgtctcctctgacactcttgtggatgagatcttattccaaccagacagtggtaaagccctgagtctccacttggcctcctccagtgtcactccagaaggaaggtaaaggggcactttgctactggtgaggtgcacgttcaggctccttacctggccttcactgatactataatcagggcatgaggaatg

SEQ ID NO: 12822 - DNA, 201 bp, Bos taurus
actgttattcctttgattcaggtgagaaactgggcgcagaggagttcagccactcacccaaagacacatagtaagcaaacagggattcaaaccgccagtctagccccaggagttgctctctttattgctagcaaatgatgtcttcttcctactacactgtcaactcagtacagagcccacccctgcagagtgaaatagata

SEQ ID NO: 12823 - DNA, 201 bp, Bos taurus
ccttgaaaaaacagactcccaagagtccctggaaaatggacacttacataaatctgtccctgttcagactttcttcttcgttcttcttctggtacagtctctttcctctctcacacactttcgactgcagaacagaatgtccatttcacactgttcaaaatctctgtctcatttttcagtgctaaaacgatacagggccct

SEQ ID NO: 12824 - DNA, 201 bp, Bos taurus
aactgtaagctgagcactattgataatgacagttggaatctcaggacataacttgaagaacccacacccacagctcagcagggatagagaatggcccaggtgatactgaaacatccttcgccctcaaagtgggaatgctacttgtaagcctgagatacacaggtggaactaaacagaaggaagtgccatctgcccaaggcc

SEQ ID NO: 12825 - DNA, 201 bp, Bos taurus
ggaattctgaggtgctggcagctgtctagggtccagccaacttctgctgcctgatgtaatttgaattaagttctttgttgatagaaacaattctgtgcaccgtgtttcttgatatgggtgtagacatttatttgatatgttcccgttttcccccaactttggctgtgtgacccctgcagttgctggatgagttgccagttt

SEQ ID NO: 12826 - DNA, 201 bp, Bos taurus
tttaacagaagtattcaagaatacattattatttcaacatctttataaatgtcaacgtgaaagaattcagacagaagctgggtgtgtgaaagtgcttggcgccttgcctgtcgtgttgtgtagttgctcagtaagtgctgaagcagaatctagacagtgtggaagaggccttggcaaatccctgaagtcacaatcttctca

SEQ ID NO: 12827 - DNA, 201 bp, Bos taurus
aagccctaggaaacgatcccccttgatgcaaacatagtgcaaatgacttaacaagtaaacaacaacaacagattactaaatgaaaactcagcagcaggcccaggaatctacattctaatgaacccctctaaatgttagtatataaggctcgacaactgcagataaagaacaacagagtgtggcttctgtcttttgggatcg

SEQ ID NO: 12828 - DNA, 201 bp, Bos taurus
ctggaggtgtgggaccctcccccacgtgctgctgctgttcagtctgctgtgtctcagtttagtagaatgttggggaaaagaacctccctcctactagggtgaggtcgcagaggcctctggagaaaacagagcagaaaattatttaaacaactgcggcatttgaaaaatcattttgagaaaggtttaaaatattttttaaaa

SEQ ID NO: 12829 - DNA, 201 bp, Bos taurus
catccactgcagatctcagcagccactagaagctggaaccaagcagagcctggctaatgagaatctccatcctctgccagtgcctgggggcccatccctttctctctggcaagcaggatacaaagagagctcaaagcagagtgaggaccaaaaggtcacccagaacattcattctgcaagctccccaccaggcctttctga

SEQ ID NO: 12830 - DNA, 201 bp, Bos taurus
ctgagccatgatacctatactgtcagaaaatgcttcaaagaagcaaacaacttctgtggtccttcaaatcatatgaggtggaatgaagaaaaagaccacttcttttatagaaagttgaaatgctgaaaacaggcaagaccagataaacagacctattagaaagataagctaaggcatctaccagaattgcatttgtaacat

SEQ ID NO: 12831 - DNA, 201 bp, Bos taurus
tgattttgtcataaagggacaggggcgagaagtatttcttcattgaaaagaaataaagctgaaaagctccagaggctttgctgagtcagggagcccagcctgttgagctgggctggagggcctcagctactatcctcagactttaaaaatgtggttataagggacacagccaccctccaggaggagtgctgttgcttggta

SEQ ID NO: 12832 - DNA, 201 bp, Bos taurus
acccgggagagaggctcacgtcccttgcaggcaagtgggtgggcctaagcaagaatccgcagacccacgttttcactctgccatcaacttgtaacacttgccctgtctggtccccccaccccaggcccccgggagcacctcccactcccaccctcaccccccagaagcaccccccaccctgccccccgcagacggccgccc

SEQ ID NO: 12833 - DNA, 201 bp, Bos taurus
agttggtcttccacagtagttaaactaaaatcttggcccctttactctgagtctcaaagccctttggacccagggctgctacctctctggcctcagctgctacagctctccctcatcacagtgctctggaacccctggctttctgttccctgagtaagccagcctgtcaacctaaggaccctctcccaagccaggaatggg

SEQ ID NO: 12834 - DNA, 201 bp, Bos taurus
tcatttcctggaccacaacatactagtcaggcagatggtccagggacttttggctctgatagggcttagtccagtaacagcacaccaagtggcccatcaacgaaatcttagcctgacctaggagcaagtgatcctagcactctggcacaaaatagtcatgaaatgcctcccagtccatggtccaatttatggccatgatgg

SEQ ID NO: 12835 - DNA, 201 bp, Bos taurus
gttggcgatggacagggaggcctggtgtgctgcagtgcatggggttgcaaagagtcggacatgactgagcaactgaactgaactgaataaagtttaagataggaacctggggaaagcaatggccattaattaacacatttttgactggatattttttttttttttcagaaatgaacacctgtggcattaataagtcttttg

SEQ ID NO: 12836 - DNA, 201 bp, Bos taurus
gaagtgacttagcagcagcagcagcctcatagagttgcagagccagataccaggaccagctcagcctcactcaggccccagacacactgaaactctgagacaagaaatgttgatacatttggtacagagtgtaggtggctaatcctccacctcacttcactcaggtctcttctcaaatgtctcctaacacatccaaaacca

SEQ ID NO: 12837 - DNA, 201 bp, Bos taurus
tcagatgggccagtgggcatccctgattttgaccagcgactatgcacttggctcacgagtctttcaagatcaaacgaatgttccctaacaactcacatcttgattatccacatcgggccctcttgagaaggcaaagctgtttcagcctcctccttcctgtcaatcctgcctctagatcctcgcctcctcctcttccacagg

SEQ ID NO: 12838 - DNA, 201 bp, Bos taurus
cgatccttactaccagttgctgaagactggaatttgagtcatggtgtgagattttattgggattcttttcttgttactcctaataattctacagtgggccgctagatctttcctggggatgaggggctggggaagaggagagagaagccacagcccacccctggcgcgttgaggcgggcggcctctcggcgcttgcttgcc

SEQ ID NO: 12839 - DNA, 201 bp, Bos taurus
tggatctgtagacagtcctatgaaatagacagaaaagggattagttcccacatcatgtaatgaccacagcaggaatggggagcccactgtaaaggaggccggtaagttcatatttctcatttctcagaggcagagctccccttcctggtctgcagtgtcagagagaaaagttggcgtcagttcttggccgactgcttccca

SEQ ID NO: 12840 - DNA, 201 bp, Bos taurus
agtcccatgaaggatgaaaaaactgccttttcaagtctcttctccatggttcaatgtcttgccaacttgctacactggccccccattctataatggtgaggtgacatcaaatattccctgtagctttgcaatgataggtagtgagtgaacatacacagctggatatctccagagtgtaagtgggatccactgtggcctgct

SEQ ID NO: 12841 - DNA, 201 bp, Bos taurus
attgttattgtttctagagattggtctgcttggcacttactccatcacactgaaagtagaacttcagaagatattcaacagctcctatcaataacttctacgtttatcattatttcatgatcagtcttctctttctgagtcacagaatcacagatatcctgtacaggcattgtgaaacagacagacaaaaggaacctagat

SEQ ID NO: 12842 - DNA, 201 bp, Bos taurus
taggacagaataactctaagggaataacttcttgtgcaaaattttccccaaatggaggagaaaccatgtttaatcatttttcctggattgttgtctttctcaagattctcacctccttcctcgtgtgcttggtaccccaagtcacatgcccagagtaaacactctcaatgactcaaagttactgcatcatgattcctaggc

SEQ ID NO: 12843 - DNA, 201 bp, Bos taurus
gtagtgaacctgtgcttttggcgctctcctgggggaggaacagaggtttatcttgaagaatctagaagtaaacaaggagtaaagagacctgaattctggacctgatgttaatcggtcaactcatttctgctttctggatctgagtttcatcatttgcacaataagagtttgcctagctctcttgatgagttctggatgttt

SEQ ID NO: 12844 - DNA, 201 bp, Bos taurus
gagaagccagcgtcccgaggccggctcgggactcgcgcgcgtccctgcgcctcagcccgcggtggcgcccatccgcgccgctccacgtgggccggcttcctgacaccgctcagcactccttttatttatcttggactccgcagtcgctctcctgtgctccctccccaccccctggccacctccccgcgcctccctcccggc

SEQ ID NO: 12845 - DNA, 201 bp, Bos taurus
gatggcgtctgagacagggaaatcactgactcccagctcaggaatgaacaggggccggattcttgacaggctttttacgacgggatcttctgctgagggactgcggggaagacagcattcaagaaatactgcatttagttggaacatgacagggggctggtggtgaaatcagcatcatcaccccagaagaagcagagaaag

SEQ ID NO: 12846 - DNA, 201 bp, Bos taurus
ctctgatttcaaaggctggcaagcttgcctctgagccagcacccacccaggcccggctgacctcaccacgacagctaacccatgacatcagagcggccccaggcagagagtctggtgaattagcactatctaaagagaaggaggatggagttacaagctcacgagtgggggagaactggagaatccttcctggcttcactc

SEQ ID NO: 12847 - DNA, 201 bp, Bos taurus
gctgagagagaagtgaggaatatttttttccgaagcagagtcacagtcagaatgctatatccccccgggagcttcctggtcttctgaagcgaggcccccgtggaatcctctcttttgcaggagccaccaccaccaccagaggcaatgctgctgccttgaggctctccaacctggaagtctctgctctcacccggcctgcac

SEQ ID NO: 12848 - DNA, 201 bp, Bos taurus
gtcagcggcctgctttgatcgccacaaaagacttcacctgcccacttgaaggaaacaagttaatatatagccctagaatggtagaacgaggcagatttgcagtaatttatcgagtgcttctggcccacactccttagccaacctgcccttttggggtaaaacttggctcttaactttcatccagaggtctctaagtgctgc

SEQ ID NO: 12849 - DNA, 201 bp, Bos taurus
ctgcaggtgaactgcttggcctcagggcacgggagcccctgggagcagtctggtgctgtaggaaccacccttctcccctcgagtctgactcccggggagcggctgacttgggctgattgtgcaagttcccgtcagctttggcagagaacagaatcattgcctctgtagcaacttgcaaatcatttctgcttgggaagactt

SEQ ID NO: 12850 - DNA, 201 bp, Bos taurus
tccagagacatcttaaatgtcataggaagaattgcagttgttaaaacagggatgcgggcagaaagaaatagttaacttttgattttccaacttaagggcctgaagcctacttaagaaacattaggaaaccacggtctttgattttgcaatggaaaataaaggacatttgaggatcaaaaggatcctgcaaaaaaaaaaaag

SEQ ID NO: 12851 - DNA, 201 bp, Bos taurus
ctctctggattcgcggagaccccagtacttttagaccaaaatctcccttttggcttcaatttgcacccaaagcgctcctagttagttagcagaccgggagcggccagggccccgtgagaaggtgctccaagcctctgtgagcgcctgccacaccccagccttgccttttggcatctggagctgagactgtcctgttcttag

SEQ ID NO: 12852 - DNA, 201 bp, Bos taurus
cgtctggggacagcctgcatctgaattctggccctcacaccctctggcattgttggatcctggagattcaaaccatagccagtgtcaccctgcaggagccgggtcctgtctaccctggccttacctgcccttcccccctcacaccctcaatgagagctggaccacaggccgatcctggagctgctgctgcagaaattcctc

SEQ ID NO: 12853 - DNA, 201 bp, Bos taurus
ggacctctgcggttggaaggacacagaggcaggaaccttaactcaggcttgaaagcaaagtaacgagtctggctgaagctgcctgggtagcagagtgatcactatggcagaggaatcaccgcactacgacaaaagctgaaagcatgcagtgccggatgcctctaggaagggtggggctgttttaaaaggacactgtgcacc

SEQ ID NO: 12854 - DNA, 201 bp, Bos taurus
agtttctcccacagaagtagatcttgtccggatggccttctgaagactcaaagagcagaggagatgactacagccacactccttactgctgctttggccatgtccagtactgtgtgatggtaaaaagcaaagactttcgaataagtggacccaaacttggtccagactaacgggtgactttgtgggcctgagctacccact

SEQ ID NO: 12855 - DNA, 201 bp, Bos taurus
ctgtcgctcctgacttggcccccctttatgccgcccctctgcttctccatccattgtggtagcaaatccctctctgcttgcccaccctcctaaaaacttacggccagctgatctttgcatctgattcctgtggcattcattacccacaatggacaactggcatcttgtgatattccgtccttctcctggagtgtatgcatg

SEQ ID NO: 12856 - DNA, 201 bp, Bos taurus
agctccatgctcatgtagagcaggggttgacacacggactaaaaaggcccagatagcaagtaatttgaggctctgtgggccttatggttctgctggtacagtacaaaaggagaaatatgtaaatgagcgaccatggctgtgttccaataaagttttatttacaaaaacaggcagtgggccagatttggcctgggggccata

SEQ ID NO: 12857 - DNA, 201 bp, Bos taurus
gcacacttgggcctgttctctgcgctcggctgaatcggctgagctaagagaggttaagaggaggcggtgctcaccccactgctgaaggccagggggctccgctggagagctggccatcctaaagacaagctgctctgtttagaatcgggctgctgccacagacctctgatgaatggcaatgcgcgcagcgctagatctcag

SEQ ID NO: 12858 - DNA, 201 bp, Bos taurus
ctttcctcacttgcgggcagggccggtggggaaggtccaggtgacatgcgtcatcccacagcccagctttagaagcctgtaagatgaatgactgtcttctcggaggtctggacttcctcagcggttttcagccctgggggcacattagaatctcccagggagtttttaaaacatcctgatgtctagggcttactccagatc

SEQ ID NO: 12859 - DNA, 201 bp, Bos taurus
ttagcgacttttaatggttccactcctaacagttaacacctagctgcagcctctaatctcccttcttccctgtggattcttgctcctgtgaaaggccctcgaactgaatctggtttgctggaaatgagtgatattaaactcctggagggtccttttcagcacattccttggtattaaacttgacgtcaactctcaaccaaa

SEQ ID NO: 12860 - DNA, 201 bp, Bos taurus
aaggctcctgcatcttctgccgtgccacctctccctcccttggggaccttctgaaggcatggcaccttggtcccttcttctaggatctgggttccagaagcgtggccaggaaggggattagcctgaacgtcgccagcctccctgtgcgtgctgcagcagctcctgcctggatgagaatgttgttgttcagtcgctcagttg

SEQ ID NO: 12861 - DNA, 201 bp, Bos taurus
ggacacacacacacatacacctctttcctggatctgtgctcgcacatcccctgcaaactccaccaccacggagagcccactggccttggaaatggcatcaagggcttagctgtttccagcatgtttggggtgaccagtgaagctgggctgcctaacaggacaggagcggtagcagggagcaggagaagcaggcccagaagc

SEQ ID NO: 12862 - DNA, 201 bp, Bos taurus
gctctgccttcagggtcaggggcagccttgtccaccctctcatccatcccacgtggccatggaggcaaccccaggaaacagagggtggtgtgggagacaacggcctttatgggttcacctgtgccctccgtccaagactctcccagtgtgggactgaagtgcagccaccctgctcctctgccatgtggctctcctccgggg

SEQ ID NO: 12863 - DNA, 201 bp, Bos taurus
ttcttttaaaggttccataccacacctctgtggggcaggccgtactgaaccaccctaaaaccccgcaggtttggtgacagatggacttcgagtgttgcttatatgatgggaaagtgcaagcatgggcctcaggtgggcctcaggccgaatcagctcagacttaacttccaccaaatggtaccctctcctttgcatgctgga

SEQ ID NO: 12864 - DNA, 201 bp, Bos taurus
cgtgctggttggttcatccactagacggaatttctccagaagcatgaactacatttttttcccccttctcttcgggaagctctagacaatgctccatgcagcacctatttcatgctaatcagaagagtttggaaagttcttgagccctctccaccccaactagatgaagacgccactgcaggtagcaccctctctcccaga

SEQ ID NO: 12865 - DNA, 201 bp, Bos taurus
tccagagtggccacaccattttacattcccaccaagaatatatgagagtattatttgctttcaccttgttgacactagctattgtcagttgttctttattaattttaacttttcaaatactttggccatctgatgtgaagaaccaactcattggaaaagaccctgattctgggaaaggtggagggcaggaggaggaggggc

SEQ ID NO: 12866 - DNA, 201 bp, Bos taurus
acttctccgactatgtatggctggcctgggtgggcaggagggaaaaggaagctgtttcctggagtcattgagacagaggcctcaggggaccaccagccagcgctccttttggtggatttgtggctcttccttgagttacactctgaaggggagtgctttttatccacagccttggtttccagtttggcctaaattctgcct

SEQ ID NO: 12867 - DNA, 201 bp, Bos taurus
caaaaacaggctccttctcttcattccagttgaagttcaaaggtcacttcttcagagcagccttcccttgaatatcctttctaatgttgtgtccccctgcgccaccagtatcacttatacttattttcttcatagcacttatcactattaaaagcatctatttattcacttaatgactgtaggctcaaagagagcgggatt

SEQ ID NO: 12868 - DNA, 201 bp, Bos taurus
tgagtttgagcaagctccaggagatacaaagggcagggaagcctagtgtgctgcagtccatggggtcgcaaagagtcggacatagctgagtgatggaacaacaacaacaatggataggcagtgagtatagaagataatgctttcactgactttccattctaaaggaggaggctagacaataaaccaaaacaagtaagatga

SEQ ID NO: 12869 - DNA, 201 bp, Bos taurus
attgtaccacatttttatccattcctctgttgatggatatttagttttcttctatgtcttggctattgtaaacaatattgcagtgaatccagtgttcattgtggttttgattagcatttccctaacaactaatgaaggtgagcatcttttcatgtgtttattggccatttgtatatcttctttggagaagtactattcagg

SEQ ID NO: 12870 - DNA, 201 bp, Bos taurus
agttctgacaccagttatctggggttaggcccagcttcacaggttaagggcaaagtcctccacaggactgctctcacttcaaataccaagtttagggcccgcactatccttcccctagctttgacaattcactagaaaaactcataaacccaggaaaatacttacaattccagttttattatagccaaatgataccaatca

SEQ ID NO: 12871 - DNA, 201 bp, Bos taurus
aagaactaagatcccacatgtgcaagaaggagggcataacttcatagtcagtcctccttatcagtaattcagcatccaaagactcaaccaactgtggatttactgaaagtaatctgtggataggaggaccatacagtgcaaacccatgctgctcagagtcaaccgtgtactaaaagattacaaaccacaaccaagtagaca

SEQ ID NO: 12872 - DNA, 201 bp, Bos taurus
agcgacttagcactagccaagcaaacaaacaaaaacaattagaatatgggcaaaatacaaaacagaaacttctccaaagaatatacacaaatggccaaatggatatgtaaagatgctcaacatcttcataaggtacatgcaaatcaaaaccacaatattacttcacactgattagcatggccatcataaaaaaaaaaggac

SEQ ID NO: 12873 - DNA, 201 bp, Bos taurus
aacagactcaaaaaatcagtaaccatgataccatccttgattcctttctttcctgaatgttgcaaaagtcccccaactggccttcctattctgcccttgctccctctgcagtgtatttcaacacagcattcaaagtgagcctactaaaatcatgtcatattggtcttctacaatgaaagttctttgtataatccacaaggc

SEQ ID NO: 12874 - DNA, 201 bp, Bos taurus
agatcatgagaaaggtgacaggatatccacatgctattaagaacaggtatgatggaagtgagctggaaaggcagttggctgaggctagagagagatgtctagggtttcgagttaggaaatagaacattaagtgatacaaagtccagagtgtagctataggaataggtatgtacagtgcagtcaaaaagctgtcattaagca

SEQ ID NO: 12875 - DNA, 201 bp, Bos taurus
acaaattaccccaatattgttgacttaaaatacaagtatgatctcagtttcagaggatcaggaatcctggagtgggtggtattgctagatcacatagtgattctatgttttaccttttgaggaactgccagactgttttaaagtggatgatccatgttgtattcccaacaacagtgtataaggattttaggttctctacaa

SEQ ID NO: 12876 - DNA, 201 bp, Bos taurus
gggtaggcatgcgagattaaagaggtattgaagatgagcattcttagttatgctgttcttttactttggattgtggccctcagatgactgctatagtggagaaggtgttgcactgggatttagtagaggagggttcaactttagattttgccgccgactagtaatactcctctgggcctgtaacttaatctctctggcttt

SEQ ID NO: 12877 - DNA, 201 bp, Bos taurus
ggttcacaggaaggcagtggctggccccaggacaacagcttgaactcagggccacttgggagatttgaggcttggagggcctggaagacagcagtctaaggcggcaccagagagctttgaagcatgtaaggcttccacaggctgggctctacagccggtcaaggccccacactgaacatctccagatgggcctgcatctca

SEQ ID NO: 12878 - DNA, 201 bp, Bos taurus
tgttccaggaagctgcaggctctgactccaaccagctcttcagttccttgtctgaagtagccatacagatgccaccaagaactccccacctgtgagcatattttgcccacattgcaaggttgtgggtccactactcaaaggtgacagattcttgtatactgtctccctgcccttctggggttttcatgggctctggaatcc

SEQ ID NO: 12879 - DNA, 201 bp, Bos taurus
agaattttgtatatctggttccaaatggttaacagttagtaatggatttaatttaatttctgggtggcatgaccgccaaggccatgtgtctggtgccttcgtatcagtgaaggttttaaggaaataaacccagttcgtggatcagtcgtcctaggccaagcctagccaagacactggtgctggggtcgaggtctctgtggc

SEQ ID NO: 12880 - DNA, 201 bp, Bos taurus
caccagagcatccccaatggaaagataaaagtcccacctatgaagaagtgacagaggaaccgaaggggagatgatggagggggagttaggatactggacacgggagggatttccttggtagcccggtgcttaagactctgcccttccactgcaggggtttgatccctggttggggaactatgatcccgcaagctgcacagt

SEQ ID NO: 12881 - DNA, 201 bp, Bos taurus
cagagctgttgttgattattcttagagaataactaagagaataacttagagaactttgagagcacctgtatattgtcaccagcaaaacaaaataaaaacactcagtgggcaatttattttacatttatagtgagaggacagcctttcctgtggatgagacttgagtagttgaggaaagacaatgctaacagagtgggggca

SEQ ID NO: 12882 - DNA, 201 bp, Bos taurus
atagggtgataactacacctaatttggataattttgatgaggagatgtgaactttgagtctgatgatattttaaagagattttactgttaagaactgatgttgtaatgtgctgagatttccagggatgtttgtatggggtaaacgtattttgcacgtgaaattatcctgaatttgagggttcagagagggtggactgtaat

SEQ ID NO: 12883 - DNA, 201 bp, Bos taurus
aatcacacgtaccaatgagcactactgtcctcacaatctgaagaatattacaagaatactcacagaactaatctggactgtaaagtgctgaacctaagactataatgtatgtgtcagataatctactgtgaccaaaacttcaaatgaacatggtactgattctgttctactgcacagagatttgccaaaggtcactagtca

SEQ ID NO: 12884 - DNA, 201 bp, Bos taurus
catctggggccttccctggtagtccaatggttaagactccacacttccattggaggaaacatgagtttgatccctactcagggaattaaagtctcaaatgttgcatggtgtggccaaaaataataaataaatgaaaattataaagtaaagtcttatatataaggacagagatctggtccaaagaattggaaaagacaatta

SEQ ID NO: 12885 - DNA, 201 bp, Bos taurus
aatctgaatctctatccaaaaatttattgaacatcgtagtatttaagattctttgattggtgttggggtacagattaataaggtcgtttctttgttctcacgagcagaggggcgatacacaattaaatcaatgaatacagtgtaagttgtattatttaaagggtgaagcattgaaaaattgatgctaagtaaatggcgatg

SEQ ID NO: 12886 - DNA, 201 bp, Bos taurus
ataaaaagaatctaaagcttccactgtgctattgctatgctgtgacttggagtttcgttcagttagttactttctaagtggtgccttcaagccctccatccggatattcatcagtttcatctactaaaatttatgttgctgtttactgaataccactttacttcctctagccatgctgtctgtctcctcagatgcctctgg

SEQ ID NO: 12887 - DNA, 201 bp, Bos taurus
atcgagcctgaccgtttacatccaggtatttgcacccacaagcctgggcttctaaaccgaacaccacatgtccatctggccactgccgtgggccaatcgcgcagcaggcagactctgcaggtgccttccattcaattctgactgccaagtcccagcgcggcagcccattgtctttctctccagggtttatgggcccaactt

SEQ ID NO: 12888 - DNA, 201 bp, Bos taurus
tttgcccgtcagctgccagttgcttgtcaccgtatccttgcacctgactcgacttgctcaagggtcggctccggccacgggcctttcctttggcccggaatgctccttccagctggcagcacctccccctcgtctcccaccctcttgggtgactgggatccgactctccttacctcggccatctccctgtcctttgtgagg

SEQ ID NO: 12889 - DNA, 201 bp, Bos taurus
agcccccttctgatctcctgccccttcacctttcaggggacttacatactcctcaggcagtgttggggccctgtctgaggaggccagtgtgggaaccagcgcctggagtttcactgtccccagcgactgtcttcgggctgggaacccacacagcttgaggcctatgtgcagtggttaaaaaagggcttataaggtttcctt

SEQ ID NO: 12890 - DNA, 201 bp, Bos taurus
ggattacttagcgcttgacacggcgtgtctctgtgtcactgttcccgggcggaattaaatcaggacaggaaaatattaattccgagttggggatggaggccgctcctttccaattactctccaccccgtcaggcttatcctggcacaaacaaggaaggaggctggattaattgctttggactctgccccactccagtccca

SEQ ID NO: 12891 - DNA, 201 bp, Bos taurus
gtgctacgggccgtggaggcaactgagcccgcggctcgccggcaggagggcagtctggcggcttctggcagcacaagcacggggtcatggtcagggtcaaagtcacgatcaggtggcagaggccggtggggtgcgagcggaatcagagggtggcctgggccgggcacacgcggtcgggggatggccaggctgggcggcgct

SEQ ID NO: 12892 - DNA, 201 bp, Bos taurus
aagccctgtctccccctgccctgggcccccaagttctgagcagctcacacagaccttgggattgctggagcctgacagcgttgcagtcggtcgtgggcacaggggacggagggagggcagaggcccctcccaacccgcactgctggaggtgcccgccaaccacagccagggagggtgggggtggggaagcttgtctccgtc

SEQ ID NO: 12893 - DNA, 201 bp, Bos taurus
gtggagatgggactccacacttccaaagcagggggtttaatccctggttggggaactagggttccacatattttgggggaatggcccaaaatagtaataataaaataaaaataaaataataaaaatagaatcaagcagaccagagttcaaatcctggttctgctatttttctggctgggcaccttttgggaagggacataa

SEQ ID NO: 12894 - DNA, 201 bp, Bos taurus
gaccatgaaagttctggggggaaaggggatggcgagtgcaaaggctccaaggccctgccgaggctagtgtgttctagggaatagggaggcctgtacccccggggtggggtaggtaagaaagagtgggataggagagccataagtcagagccgtaatgggaggccaggtcctgaaggagcttgtaggccatcctaaggcttt

SEQ ID NO: 12895 - DNA, 201 bp, Bos taurus
gatcttcccaacccagggatcaaacctgcatcttttgtgtctcctgcactggcaggcgggttctttaccactagtgctacctgggaagcgacttttaatgaaaatcttacagccaaggggtctgggatcaagggaaatctgacgaatctcaaacatacatacaggaaagggattcagagacttccctggcagtccaatggc

SEQ ID NO: 12896 - DNA, 201 bp, Bos taurus
actagcgccacctgggaagcccttgataaggctgctcctgggattaaacaatgtagtgattcctccttaaatcaaatttccttagtttatattcagggcccgctccagttggaccagaattttttcagttttctctcacaactcttctctcccactcagtgccacagtccaccatccagcctacctgctgtcccctactgt

SEQ ID NO: 12897 - DNA, 201 bp, Bos taurus
aagtaatattgaccataatcccttccctcatgtgcatttttgttgacttcctttgaatcgctagcctgtcttagagattcttcagcccacgtgtatgatatgattgtccctggttcatgctggaaatggttctagaaacagactcacagatttagagaatgagcttatggttgtcaggaggggaggaggctgggaagggac

SEQ ID NO: 12898 - DNA, 201 bp, Bos taurus
ctccagccttgccccatctagcctgtgatgtccagccctgactatccatccacatctcttagggaattgttgaaacttcccctgcctgtccacttattccatattctgactctaaaaggagttgatgggggtctgcgcgtgttttcagttgcttagatgtgtccgactctttgcgaccccatggcctgcagcccaccagac

SEQ ID NO: 12899 - DNA, 201 bp, Bos taurus
gattcccagggagcctagcagaccttctatctctgactctccacccacagccaacaataggtcctctgcaaacatttgcagaatgactcactctccactcaggccatacacactatgcgtttatcattcattcgttcactcactcatcacacaattattgagtacctactgtatgccaggcacagtgctcagatcgtgggg

SEQ ID NO: 12900 - DNA, 201 bp, Bos taurus
gcattctgaatttctccatttccttccttccttcttctcttcagggaccctatcgtcctgcgaggggacgaggtggaccacagcttagattacagaactgcgacagccagtctgtctggaaagggcattgagtacaacaccgattcagggaacttcgagtgcatgtggattcaagatggtccttcagcttttctctgtgca

SEQ ID NO: 12901 - DNA, 201 bp, Bos taurus
acttggtgactgtttgatgaatgggcaaatgacagaaacatgacctcaggcttcctggtcctctggcgggaattccttaattcagttccttccatccaaaagaggcttgggccactgtcccgggcaacatcgcgcctgccctattcgtgtggttagagcaactgaagaagcacagcactctcagttctgtggaaaagtctg

SEQ ID NO: 12902 - DNA, 201 bp, Bos taurus
agagcatcacccacccaaaggtgaggggtgctggaagtggaaacccacaccacgggattctctggcttttcctggaccctttccaagtccatcatggaggtggcaacggccttccgcctccatctgctcaatttcctcggaaaacaatcaccaacgggatccactgtgctctggaaatagcgatgctcatgaaagaagaaa

SEQ ID NO: 12903 - DNA, 201 bp, Bos taurus
ctcttgtccttttcctcttgctttctgctttgctttctattcaagacatgcagagcataaactcagtctgctcactgccttatgggtcccctcaaattgaatgacaagggccaccctcaacttaaggatcccccaggtcatgcaggttcaaataatgcttgagtgacagctgacgctgtccactgggcctggtggaaacac

SEQ ID NO: 12904 - DNA, 201 bp, Bos taurus
gggcacttgagttgcttccacgttttagctctcgtaaatgtgactgtgcctctgttacttttatagtcaaaaaataaatggaaaaatataaccgggccacttccacgtacatgaatgctcagtctgaggtagtaactggcacttccttgcctccacccgccctgaaccgaagctgaaaaccgcctcctacccagaaccagg

SEQ ID NO: 12905 - DNA, 201 bp, Bos taurus
agaggaatgagtcacagatacttgaaaaaaatttttttcttagaacgagtggagtgtaggcatatatccagaatgactgtctgcgggaataaattcatgatattatccaaattctgcctccagtgtctgggccgtagcctgggagctcaactccggctcccaggcttgggtgggggtgggggtgggggctgtaaatagcac

SEQ ID NO: 12906 - DNA, 201 bp, Bos taurus
gtatggaggaatctagagtctttgttctttccacgcccagtacatttggtcacatcaagtacatcattttgatcccagacaggatccctgtctggaggctgtggctttccccagggcacaggaggctacaaaccccctccactggtccctccctctgtgtatgtttttcagctcagttaccaggtagtcagtcccagtatc

SEQ ID NO: 12907 - DNA, 201 bp, Bos taurus
cccatggatttgaggggcctggtggtctagagtccttggggttgcaaaagagttggacacgatttagtgactaagcaacagcagcaattttacatcatttcaacatcatagcattgaatttttatgtacatgtctccttggacacacgtgtgagagtgtttgtagagattatacctagaaatggagctggggtttagagct

SEQ ID NO: 12908 - DNA, 201 bp, Bos taurus
gttgctttgtgcagaagaggtgaccccagtctcagctgctggcattgtggccggggcgctgtgccgcctcccttggactggccactcctcacaccagctcccagtctttgttctggaaagcgtgtggcacacagtgggggttacagaaactggatctagtgggccctgtcctgggggagcctccagtccatgagggagaac

SEQ ID NO: 12909 - DNA, 201 bp, Bos taurus
tctgaaaggtacttctgattccatcacttcctcgtttagaatccttcagcgtctccctgtgtttcccaggatcacgtccaaacccattcactgagacttacgtacaactcagtatgttctggcccctgcctacctctccagcctcggctttcagcatcttcacccactgaagactcctgaccccactgctctgaatgaact

SEQ ID NO: 12910 - DNA, 201 bp, Bos taurus
cctcaccaactctgacctggatgggggaggaggtgggggctccaagagatggggagggtgttagggtccccgtcctgggcactttggaccctggccgcgccactcactcaccctgagatctgggcttcagggtcgaacaggacagtgatgctctcatttaacacaggtgtgcgtgagacggcctgtggaatgcttggcccc

SEQ ID NO: 12911 - DNA, 201 bp, Bos taurus
gcgccatcttgaaggccagttgtgcgattagagaacggccttaccttacttgttgttgctgcaaattcttctgccagcatatgaagacacctaaagcccacgctgaccctcttgaaagtgacgggcctcctgggagagaggcagaggcatagttgagtgcatgcctatgagtgatctgattacactgggcaggataggtct

SEQ ID NO: 12912 - DNA, 201 bp, Bos taurus
acaatagctcaataaataaataaaggtgttgagatcttgagactgctttctcctgattctgccaggctattatcacaccttgtcccctaaccaaaggcccggtagacattctgtagtaaatctcctcatttttgcgtaaggagatcagattcttgctatgggcagagacaggtcaagctggcctctgtttgcacatggtca

SEQ ID NO: 12913 - DNA, 201 bp, Bos taurus
ctataaaatcaaaattggacggaaatactcaaaatgttctgatagctgtcaggctttcttgttcttttccctaacctctgtcctgctcctttggctcatagctctcagccattccctgtggttttctcatgagctccgagatgagggggatggtgttggctgggcctgaaccatcactctttgaataacaggctgaatctc

SEQ ID NO: 12914 - DNA, 201 bp, Bos taurus
tgaaaggggcctggtccccgaagcccccggcttcaccggtccaatgccattgtgcctttgtgtttcattttcacgctgaacttgccattccagccgcaggatgtggggcctgcccatccacgttccccaccctgtgctgttttctcgctgcctctcgtcagtctgtgtttgccattttctttctccttccaagtcacacct

SEQ ID NO: 12915 - DNA, 201 bp, Bos taurus
cagacacctcctggacattttattaatatactaaaatgaggaacatcagttcatttgcttcgaacaaaaggttctgtgcagaaaagaaatccaatcttgtctctaaattgctcctaataagcccacagttgcagccccagcgatgatcctctcaggctgtaattgtgtgaaaaatggatgcattctcatcaccaagaggaa

SEQ ID NO: 12916 - DNA, 201 bp, Bos taurus
ggacctcaaacaccttttctgccttaatttctgatgtctgtttcccagaggaactctccagaacacgtcagggtgatcttgctgtctttgccctgttctcctcctgtattaagttggccctagattcctggactggggcggattcccagttcacggtcccctggagaaggtgactttctaagtcaccaacccactatcccc

SEQ ID NO: 12917 - DNA, 201 bp, Bos taurus
agtcataaaaaagctggatctgctttgggcagagattgctgccagtggtccaccctagtatctgttctagttctctctagggcctgtgggttttagctggacacgcgatctcttgcataccctaagaccacatttctcagcaccctgttgtagacaggtatgaccatatgcctaggtctggccaatggaatgtaagcagaa

SEQ ID NO: 12918 - DNA, 201 bp, Bos taurus
gaactgttttatttccttccacgtctagcatccaacactcaccatccggtgaaatgtggtcatggggacggtgcagagttaatacaaaaaaagtgctcaggactgactgtggtgctctgtacacactcaatgttagtcttcattactatacttaatatttttctgattttcccacagggtgataaatggtgtgctgcgtgt

SEQ ID NO: 12919 - DNA, 201 bp, Bos taurus
ctagatctggttcattcttgcccaaggcaccacccaaatccttgatgcaacctcaggggaccagggtccagcttgaacccaccttctctcaagagaccatcgggccaaacctatgaagcccaccccctattcagcttgttgttgttcagtcactgagttgtgtctgactctctgtgaccccatggactgcagcactccagg

SEQ ID NO: 12920 - DNA, 201 bp, Bos taurus
agtcagaggtgtggacaagctgcagtggaggccccagctaggaggagacactaactctcaccagtttaggcatcatctctggcctcaaagagcccatagtttagcaaaacaaagagagaaaggacattgcgaacgaatgtcagagagtcaccacgggcagccagagacagagactcaatgggtagcaataggtggcctgac

SEQ ID NO: 12921 - DNA, 201 bp, Bos taurus
gaggatcaccagggtcttccagaatgtccaatcaatacaggcctctttcctgcccgggttcaaagccgtttgaaaaataagaggaaaagagtaaataagacagaggccaaaaatgtcacctttgtgaccaataaggtctagatgagggacggtttatatcttcaggaagatgacttcctgaacaaacgctgagtgctagaa

SEQ ID NO: 12922 - DNA, 201 bp, Bos taurus
ctctcttcaggctgagaaatcattgtgtcatgagtatttcttggagactctggtcacctcaaaactgcttgtttcctggcctggtggagggtgagcctcacatgggtggaattgacgtccacacacctgctgaaggacaagagagggctctggtgagtgagggatgtttgtccttaaggccacctgaggaggtgtggccac

SEQ ID NO: 12923 - DNA, 201 bp, Bos taurus
agggcagacacaaacgctgggatcccacaggccgcaattaggtcattggcaggctgtgtgggcacagtcggttcctatagaagcctaagcctttgccttcagcgtagattggccacatcaccaacatttggatggaatcccatcgtggctcacaactcaaaacattactctcaatctaccccaaattaaaaaagcccagat

SEQ ID NO: 12924 - DNA, 201 bp, Bos taurus
ggaggggtaaaggtggccactgccaaagcaagaggggctgcgatggatgccctgtgggcttgtccctcgtgtgacctgagaagggcagaggaggctggacctcgtttcttggccttggtctgcaggggacttaaaaccatatacagcaatctagccagcctgtgatggggtatgacctggctcgtcacttgggcattcttc

SEQ ID NO: 12925 - DNA, 201 bp, Bos taurus
tgccatcgcaaacagccccccggtccagcagcttagtgtaacagaggagtccgtctgactcacaaaaaccctgtgggtccagaggacttagcaggcagccgttgagcactcaggtcgttttgatcctgtggctctgccatcccaaacacagagctccctctgtcaccagggcggtgtggacgctgcttctctgctcttcgg

SEQ ID NO: 12926 - DNA, 201 bp, Bos taurus
gccatgctctctctgaaacctgaagaggagaagtccttccccacctcctcctagcttccagtgatgaccctcagaccgtggccttccttggcttgtagctacttctgcctctgtcatcacggggcatcctccctgtccatctgtcttcacaggcattttcctctacttggaaggacagcagtcacactggcttaaggccca

SEQ ID NO: 12927 - DNA, 201 bp, Bos taurus
agcagcagccaggttgagtggttgcagtacagtttggcccacagagctgaaatagtcactctctggccctttagagagaaacttgactgacccctaacaacacagtatctcaggacccatccagtttgaccactttcacaaagagagactgaggcttccaaattgaaaggctcgcattttttcactgagtaataactgcac

SEQ ID NO: 12928 - DNA, 201 bp, Bos taurus
gctggttccatgaagatttcccatgtggtgaagctccagcagaagatgtcacttgacacctgcagagaatccactcccttatctgccttttggacccgcccgcactggtctgtcttcaagataagcacaagaaacccctcgctggccttaaaaccctattaaaatgctgaggaaaaaaaacacagtttgagggcaagttct

SEQ ID NO: 12929 - DNA, 201 bp, Bos taurus
ctctgacaggcttgtggcggccccattcctgcaggaacacagccctctgggttgtcagtgtagggagttcccagggcagcataaagagacacagttcatcaaaggccatcctccccacaccctccccacggggtgggcaccagctcctgcaggggattgttgcctcagccctgttctgccacttgttttggggtgggggcg

SEQ ID NO: 12930 - DNA, 201 bp, Bos taurus
ggaagcaagtccttccccaggggagcctccatgtcaccggccccagttcatactctgactgcagctttcaagactccagaagagaagcctcagctaagccgtaccctgactctggcccagagaagcgttgagattataaatgcgtgttgtttgaagccactgaatgtgtgcttgatagcatgcctcttgtgggtggggagg

SEQ ID NO: 12931 - DNA, 201 bp, Bos taurus
tgtgatcccaagttttaaaaaaggcatacgtatttaaggaagcacagaaaaatcaacggccaaacagaaatctgttaaatgtggcttatctgtaagaccctaatcagtgaggcttcctcgtcttattttgtttgaatggtgcaatgagcatacattaaaaaagaggggcaaaatgagaaaaacaagcaaacaaaaaacgtc

SEQ ID NO: 12932 - DNA, 201 bp, Bos taurus
gggttgcaaaaagttggtcacaacttcatgactgaacaacaacaaaaacatgtgaaatcttctcagaccaggggttgaacccgtgtcccctgcactggcaggtgtattcttaaccattggatctccaaggaagtcccctaaaccagttttaaactccttaagttgttattttggaagggaaaagagagacccatgtggggc

SEQ ID NO: 12933 - DNA, 201 bp, Bos taurus
ttcactttttgagaacttctgtaaaactttaaaagttgctttggaattaaaatcaactgcagtgaaaagtttgtaaattttaatggtctgttatactagaagttttagtagaaaattggttctgaatattgttaatcaatataaataatgtatattacatttcctttctgagaccttgagttatgtatcatttgtatcctt

SEQ ID NO: 12934 - DNA, 201 bp, Bos taurus
taaatactgaaatgtactactaaggaggttgtaaagtttctgaaaacttttaagaataaaatgtttatctttgtgtaacgattaagaagaaaccttgtctgtgggaagaaaagttaagactgtgggtcacaaggttcatctcttccaactttatggagactgtacataggagaactgactattaacaaccatttgaaatag

SEQ ID NO: 12935 - DNA, 201 bp, Bos taurus
tctagattgttaatttccaccctagtgcttttcctacttgccagcaccatatgttgtttaacatcccactctttaggggaatctcgagcatgctgaagaaatccttacgggcgagttggcacggatcatctataagaattctacaagtgtaattaaaagtaggtatcttttgaaaatttatttatggtgggaaaatgaacc

SEQ ID NO: 12936 - DNA, 201 bp, Bos taurus
gacagaggagccttaatttctgggctacagtccatggggtcacaaagagatgtgacggaagcaacttggcatgcacaaaaacacttcaagcaggcgtcccgcatctctgggatctaacaactgacgatctgaggtaggactgatgtaataataatagaaatgaaacgcacgataaatgtcacatgctcgaatcatccccaa

SEQ ID NO: 12937 - DNA, 201 bp, Bos taurus
catagtgattgtttgaaagggagtttatccactccctcaggctctgggctaagtgttcagagagggcaagtccctgccaaaaggacacacagctctgggaacaggtctagaactcatacccaggtctgctgcatcacgtgtggcactggtctggaggcagcctggtggagcagagagggtttgggtctgacaactggtgac

SEQ ID NO: 12938 - DNA, 201 bp, Bos taurus
atggtgagcatagtttcataggcttgttggccattcgtttatcttctttggagaaatgttcaaattctttgctaacttttaaatcaggttactgggtttatgggggtttttgctttctcagttgtagttctttatatatcctggatgttaacctcttatcacatacatggtttgcacatattttctcccattccttaggtt

SEQ ID NO: 12939 - DNA, 201 bp, Bos taurus
tggccaggaaagagcgggggcccccagtcactgaccaggagagagaggggacccccgccccgatgcttcttccccgggtctgcccccaccccgacccctacgctggtctctggggcctcacctattggccttcaggtttttcagccgggcttccaggtcattaagcaggttgattttcttgcagcactgagagcagtaaac

SEQ ID NO: 12940 - DNA, 201 bp, Bos taurus
agagatgagtgccagacagcctttggcctcccgaagctcagaatccagtgataaagaaaactacaacccaagcatcttatcctcatttcacaaatggagatgctggccccagagaggttaagtgatttgcccaagacgatacagcccatccatctcagaagcagaactcctctcccagggccctgcacagctggagggcac

SEQ ID NO: 12941 - DNA, 201 bp, Bos taurus
aaagttactttggttaaactttatttttccatatcaaaatttgaggaggagtgtgtctgagaatttaaatgcgtacaccaagttttaaacaaaactttaaattttaaattaatacctcaggtactaaataaatattccaaggttgtggggatgagagattaaaacgcatgtgtttgagaataaatttccttttagctctca

SEQ ID NO: 12942 - DNA, 201 bp, Bos taurus
gacagagaatttgatatgaacagatcattttcctagaaaatcaatgacagtgaataagactgtggtgaccatggagctctactcttttctcctttggccaggaaaactcagcaaacatttatcatgggttaggaaagaaataacaaaaatggaaaaactacaggatttatagcaagacaggaaaaagccctaagcagtgca

SEQ ID NO: 12943 - DNA, 201 bp, Bos taurus
gggctctagatgccaagatttgcaggaaaggcagctccaagcccactgatttaactgtacagcagggtacagttctagaagcagttcaacggccaagagtgacaccctcctccttccctcttccccattccactcttcatcagaagattgactcactctcccctctcctcaagtaaacacttccctttgggccttttctgc

SEQ ID NO: 12944 - DNA, 201 bp, Bos taurus
tcttcgttccccaccccaaccccatggtgtttccagtgcaaagtttgcagacagttagtagttccaagattctaatcatttgcgggccctgaaacagggtcacccccggaagcagcaggaactgagggcagctggggcttcacctgggaagcatgttgatcagtgattttgtgacagtgtggtggcctcgtatctcctatg

SEQ ID NO: 12945 - DNA, 201 bp, Bos taurus
gaggaataggtcagacaggccagggctggtgattccgaattaaaaggataataaaaagatgtgagaggccagctgggctgtgctaccagctaaatcagacgctgagatgggtccaacacgagcacttaaagggccaaggaatgttggtctgttaactttcatttatcctactcagcgatttgctattttccatcctggaga

SEQ ID NO: 12946 - DNA, 201 bp, Bos taurus
cagggaagtccccacaagtgaggccatcttgaaggttcttctcattgtagaaaattcttggatttttgtgacttaaaaggatgcgagaaatctcaagaagtgtcgggttttgccaattgagccccctgccgacccccgcctcagtcctcggtgggggctggctgaaaagactgctgggcaggaggtccagagccctctagg

SEQ ID NO: 12947 - DNA, 201 bp, Bos taurus
agtcaggattctagcaacttccggagactgatgcttatgcagctgtgtggctggtgagggcccatgacatggaccacgcagaggcctcagcctcaatgcttatgaggctggtgtgtgctgccaacagcaggtctgagcagcatcttgtctccccactgacggccagcagtacagtcctttgggatccccgccctctggcca

SEQ ID NO: 12948 - DNA, 201 bp, Bos taurus
ctatggtctacagggcagagaacggatagcctcagataagtgtctgcaactttgaataacagagctctgaggggtgcctctcacctccttaagacaagaaccaggccctgggaaaggatctcagtgactgcacggtgatgccaggctgctgaggtcaactgtgccaggccctgggtcttggagatggcctccctactgtct

SEQ ID NO: 12949 - DNA, 201 bp, Bos taurus
tttttaatctttgttttaaaaaatatttatttggccacctggggtcttagttctggcacgtgggatgtctgtcgtggcacataggagtctagttgtgaagtgagggctcagtagttgtggcccttgagtgaaagtcgttcagttgtgtccaactctttgtgaccccatggactatacagtccctggaattttggagtgtgt

SEQ ID NO: 12950 - DNA, 201 bp, Bos taurus
agatactggagggtacagatggaatctatggggtacttgctttgtgtcgggcatcagctaagtgccttagaagctttagctcattcagtgctcccagcaggcatataaaataaggcccgtgattagctgcttctcacagaaaagcaaataccgaggcttagagagtgttgttgttgttcaatcactaagcggtgttcaact

SEQ ID NO: 12951 - DNA, 201 bp, Bos taurus
aactaagcctgcatgccacaactactgagcccacgctggagactgcatgacataacaaaggtctcacatacctcaattaagacccaaggaacccccccccaaaaaaaagaaaagtagttcctcagactgctcacccctttggccttctggtgaagcgtgtcttggaaagtcactccgctgccccagtttttgatcctcaca

SEQ ID NO: 12952 - DNA, 201 bp, Bos taurus
tgctctggctgacacttctgaggaatttcctgggcctatttccctgctgtgtaccacgtgatccctcccggtccattggacaagggtgggcacctcaccctggggcagccagtggcctcgaatgtggaccctctgcctttgagtatttgaactggagacagaggagcagcagttgacagcagtgtagacctccaaaagacc

SEQ ID NO: 12953 - DNA, 201 bp, Bos taurus
taagagtcaagaatgaggcacaggtcccaagtgggccctacgacattgggctattaatttttctgggctttaatttacttattgctaaaataaaaaggacctgaatagatgactgagaaggcccaatccaactctgaaattctaaatctatgtaagtctccacatcagacctctctagagaccgaagattttatttaattt

SEQ ID NO: 12954 - DNA, 201 bp, Bos taurus
cctctgagcagatcttattgttctcatctttcacagatgaggacacggacgcttagagtggggcagtgacttatccaaggcctcacagtggtgctgtcaagattgtaacccaggcacgtctggcggctgatctcctctccttaactatcacatcaaaggcctcccatcaccctctttcattctcacaagccaatgaatgag

SEQ ID NO: 12955 - DNA, 201 bp, Bos taurus
gagcaaaattgtttgaaattatacctaatattcattaaaaattgtttccttgcccctacccctaggtaggggtgaaatattctgtaagaggttataaattcagttttaagattcaaccttggcatgactttcagttggaaatgggtcagactggaaggtatattgtttctgtcctaaaacaggtcatcccaggagaagaga

SEQ ID NO: 12956 - DNA, 201 bp, Bos taurus
cagggccccaagatgggtccccagtgtcgtctcttctcttctttctctaggagatcgtgactgctttgagctgtggcaagaacatcgtgcctgtcattgacggcttcaagtggccagagccccaggccctgccggaggacatgcaggctgtgctcaccttcaacggcatcaagtgaggagggggcggggcgggttacacag

SEQ ID NO: 12957 - DNA, 201 bp, Bos taurus
acgggattttctaggcaaaagtactggagtagggtgccactgccttctccggatataagtgttagctattttttatttatataagatcaggccacactgaacctacattcccatattgcaataattagttgggagaagcattggctgtgcacgttacatagagcatggcctccgcagtttacacagaacacacccagcagg

SEQ ID NO: 12958 - DNA, 201 bp, Bos taurus
aggaggtgataaaaactaacacctaaatagagatgtgggctctcagtggacttcctttaacgaccctagggcacctctctgttggcctgaatagatgtaagtggatgtcgtctaggcagaaaacttcattatcgttattaattacgttccagccctggccctctgttcctctgagctctcggcctcggcaaagagcccagt

SEQ ID NO: 12959 - DNA, 201 bp, Bos taurus
gtccatgctggatcccagcacgggccccataccacggtgtactggaagatttccgctggggcagaggagcacaggacgcagcctgttatacactttcacccctctctttggcctttactccagaagggcctcagctcatctcccaccccagccatcaccaccatctcagtcaaatcatctgccctcccctactcacagtgg

SEQ ID NO: 12960 - DNA, 201 bp, Bos taurus
tccatgagagtgacatccctcaagatcatgtggcgcatggagcaccttccaattcctacttcctctaaatgtcacagtcagtcttctctttgattctaggcgctcgttgctgcccaggtcttgtggatcttacctgcagcctttgctccctaagattctctggcaagttgacctatcccatctggaaggcttccagaggaa

SEQ ID NO: 12961 - DNA, 201 bp, Bos taurus
aaatttagtttggccaagtcaagaattaaggggaagtgacttttgtttgttgtttataccctgaagaataacatctgggggaagaaagtagaattaactatatttagctttaacagatatacctaatttcactgtggctgcagtaattaatttttcaaatcagatttaaaaggaatccttcttgttctcagaagcagaaca

SEQ ID NO: 12962 - DNA, 201 bp, Bos taurus
cagctgtaagaacacactagggaacatatataggaaaatcctgggacaaaacttctttattttgcataaagctcttctgagtacaaatctaagtagttaacaagaaaatttcatcttacagaaccaaagcaagggatgatttctaagaatcattcattttccaaatgaatgacaacaggacaacttgattactatgcttaa

SEQ ID NO: 12963 - DNA, 201 bp, Bos taurus
gtacaacttcagaaaactgtttggcactgtttctaaggtgaatatatatataccctatgatcagcatttatacttctaggtacataccaagataaatgaatgtatatgtctaccaaaagacatgtagaggattgatcatggcagcttttttgtaataatcaaatctggaaagtattcaaatattctatcagcagtagaatg

SEQ ID NO: 12964 - DNA, 201 bp, Bos taurus
aatgcagtttccagtctccctacctagacttggaatcaaggtctttccaagatgatttctatgtccagggaaaaaagaggcccacccccctaaggccttaatgtattcaatcttgcttttatacatggcagcttctagagctattcttagtacttcttaagtatagtatttcattgagtaaaataaggccgacctctataa

SEQ ID NO: 12965 - DNA, 201 bp, Bos taurus
ccttagaaaatgatttcaaatgtgaaaacatctattacaaggtgtaacagcacagcatttgtcaaagggaatataaactgagatttaaatcctagttatattttcctgagatgagaaaactaacatcacccaaggaacattaactaggcatttacaaaaagaataacattaattcaagaaagaacaaagatgtgcagaggc

SEQ ID NO: 12966 - DNA, 201 bp, Bos taurus
taaagattgagttatatgtaaagtgcttaggatagtataacattaatgttcacaggaagtgtaactattgttatgtgatgtcactatagttcaggtaattaagagaactcaattttgagaaattctaaaagttgtgtgtgtgagtttcatttctcatcccctgtctcaattcttactgacatacagtgtgcgtgttagtca

SEQ ID NO: 12967 - DNA, 201 bp, Bos taurus
gtaaaggcctagaaatggaatctctctcatgggacagttgtatgtgtgactgttagaaaatgccaaagttttcctaagtgttttattttgttttaagtttaccattttaccccttggccctcagcaatgtctgagagtcccagtttttccacattttcaccatttggtattgccaaataaaattatttgaacagagaacag

SEQ ID NO: 12968 - DNA, 201 bp, Bos taurus
ttcctgtgatgtcccagcagactccccagaatctcaccctgcagcctcatcacatcaccatggtgtcaactcaacagcccatggtcccccagcaaccaatagtgccagtccctggccaacactccatgaatccaacccaacagcaccagccaaactttccagtgttcatgcagcagcccttctggccccagtccatccagc

SEQ ID NO: 12969 - DNA, 201 bp, Bos taurus
gctcacagcagacagcagttctgaccacatcgtcagcctcccagtcttgctcctcatctccagataacttcctctcccacagggcccctcacagtgctcagtcacacctgggctcttgcaggaaccaatgtctcctagtacctacctgtgggcttcaggccaggggcccatcattccagggtgaggccccaagcctctcgg

SEQ ID NO: 12970 - DNA, 201 bp, Bos taurus
ttccttcaccaccaccccccaaatgctgaggcccccagagcattgtggcatctggcttcctgcgagaattcatttgcatcgcaattaactgcgtagacctcggaaacccaggccgcctcgcctacccggctcctccttgagctgcaggccaccaaggggtttctgatttgatgtcaattagtcatgcgtgcaagcgggggc

SEQ ID NO: 12971 - DNA, 201 bp, Bos taurus
ttatccattactgagagaggggaattagcatctctgttatttgttttatgagatcacccccgtgccaagctgctgtttccaaagcaacctccacttcccagggaatggcccaggcaggccaggcgtcgggccccgcagactcgggtgctccatgcagatggcggtgcctggatggccggtgacccctgcgcacaggccttc

SEQ ID NO: 12972 - DNA, 201 bp, Bos taurus
gcagagcacgtgatgctccaggccaccgtgtgtgctgcctcccctccccgctcaccccctttcagtcccactgaaccacttatattaaccaaggtagatcgccggcctccgcccaagggctgctttccgttctcccctccccacttactccgctcatcctgcaaaactcagaagctttcttgggtttttcacaacagtttg

SEQ ID NO: 12973 - DNA, 201 bp, Bos taurus
gagtcaccgcatctcaaggtctgaggtcacagtagggacccctgtgcccccagctccgaggagcggcttcacgcggccttgtgtctcccgcccaggtacacgtcctcagtcaagtacgactcagagaggcacttcattgacgacatccagctgcccctgggcctggcagtggcctcctgcagccagaccatcacctgcatt

SEQ ID NO: 12974 - DNA, 201 bp, Bos taurus
tggatggcatcaccgactcaatgggcatgagtttgagcagactcagggataaagtaaaggacagggaagcctggcttgctgcagttcatggggttacaaacagtctgagatgaatgagcgagtaaacaacaagatgagtactcagtatcagtatgatcaggccatcttagcctggtgactggcccttcaccaagataccta

SEQ ID NO: 12975 - DNA, 201 bp, Bos taurus
tgttgttgtggggtagggtgttctgctgtgcattgtaaggtgtttagcagcatcctgacctcttcccactatccatctggcccccgggtacctcctgggggaacaaaatcaccctgattcagaaccactgatctaatttactcttccccacaggccaggaggcagctactcattttaccaatgagtcaactaaggcctaga

SEQ ID NO: 12976 - DNA, 201 bp, Bos taurus
caagggactctcaagggtcttctccaacaccagagttcaaaagcatcaattcttcggcactcagctttctttagttgagtagtgggggagttgctgaaagccaagctgggcacttggtgacaaggcccagagtgtcctggagagagaccaaccgggaaccctgctcacttagcgcaccttctagccaggccctcaggagct

SEQ ID NO: 12977 - DNA, 201 bp, Bos taurus
tacagccctatttctttattatctctattatggttcttaaccactgtactgtaatctttcatttacaagtctgtatgccatggtagatctcaaaggccaggcatctactgtaggaggcactccataatcatttcgtaataacagctaacatttattcaggaaatactacctgccaggcatagtgctaacggcccttagatg

SEQ ID NO: 12978 - DNA, 201 bp, Bos taurus
ggctggttgattggtttggctggttggattaaatgaataaaaagtcactgttctctttgctaatggctcccccatgagacatcaggccctctctcactcatcatcccatcccccacacccacctggagcggcaggttgggaatgaggcaggtcaccccgaaacccacgagcagcaggttggtgaaggcgaaggcccgcgtg

SEQ ID NO: 12979 - DNA, 201 bp, Bos taurus
gacccccaccctgcagggccaggccgtcatctcgttcctgctggggttggcttcctgatccttcccttccagcttggctgatcacaggcctctggggagagctgggtgcctggggcagctcggctggttcttccggctgccagctgtacccagagcatattggatgagagaactaaccctcccggccactctggggtgggc

SEQ ID NO: 12980 - DNA, 201 bp, Bos taurus
gcatccagctgactcaaaggctcagacctgggagcctgctccgtgtttggagccgagacaggcagtttccacttatcacaacttggcatctggaactctccggcctttgccagtgcctaataaacaccatacttcacgccttgccattgtcacccacgcgtcccctgacgcctgctgacgccgcctgccaccgcacacagt

SEQ ID NO: 12981 - DNA, 201 bp, Bos taurus
caaaatcaatctgcagcccagtcaccctgcacttctctgagaacataaacttcatgttctcagcagtgcagctggagccctatggccaacagcaggtcacggtaacctcattccaggatttctcaagtacctctcctgtgcctccctcaacctctctctaggtcagcgccttatttgacttcagttctcctaagctacgct

SEQ ID NO: 12982 - DNA, 201 bp, Bos taurus
tttatgggccaacagagtttaccagctctggagtgtgatgtggctgaaactagagaccactcttgtccagatccctagcttacaccctttcggcaataaatggcttctatcatttcagcgacaggcctctatccctgccttccattacctttcttccccatctgtcaattagtcctctgagtagtgtataccttgaccatc

SEQ ID NO: 12983 - DNA, 201 bp, Bos taurus
ttctgcacaaaggagcaggagcccttaagtaggctcacgtagaaagacaaactgggcagtcacagctacaggctcccaccctagagtgctcactagtagcggtgagacagaatcccactgaatccactactccatgtccacttcaggcagtgttgaagaaatcgcacttttaacccaggggactggttctggtacatatgg

SEQ ID NO: 12984 - DNA, 201 bp, Bos taurus
ctcagaagagggtctcatttgagtcaacttctctgattgatagcaatgaccaggccttcatgctggccaccaggatggcctcgccctcccctttcccctcgtgtaccaacatgaaggtgcacacacatccttggactcatcatgtgaacagagtggctggtctaggtcagaaaacagtcacttgaggcttgaagttgaatg

SEQ ID NO: 12985 - DNA, 201 bp, Bos taurus
ctgaccagggctcaaacccaggccctgtgcactgggagagtggagtcttaagagctgtctttaaactgcttaaatcttcactcttcctttaatttctagacctcagtggtgcaaccagtcagaagactttccaatcaggtgtaacctgatacaaatctgtatagcattcgcattctgctgaagctctgctgctaactacgg

SEQ ID NO: 12986 - DNA, 201 bp, Bos taurus
cttatatcattttattcttcacttcaacctgagattaaaaaattcctatgcttattttacagatgaacatactgagttatgcaacatccacctgctcccccacgtttcccagtcccttgcagttgggtgggacacagaggtgctggtagaatagagcccgtgcatggttctccagcttccctctccccttacgtagtgccc

SEQ ID NO: 12987 - DNA, 201 bp, Bos taurus
gagagaaaacaaaagtactatttctactttcttcagatttataatctaaagcagtggagcatctatttacaacacttgcctttaatactaagagttactagacttgatattggtatgagtaattctcagtggaaaaggtggtatcttaatcattggcccaaagctaattgaaaaaatacaaaatattttgaatataaattt

SEQ ID NO: 12988 - DNA, 201 bp, Bos taurus
cacaagtgctggtggggctcagtctcagcctctgttcttttcaggagggatgttctttgggatttttttcaatgagggccctggggtttggctccagctcgggcaaagaaaacaaggagggaaagagatttcagggactgttcctcagtgacattagttcttcagtccctatctgtaatgagggtgtaggcctgggcaaag

SEQ ID NO: 12989 - DNA, 201 bp, Bos taurus
gtgggaacaatgctcttccactcagcagccccaattctgtagcaccctcctcctcaaaacaagcatcctacaaagctgaaaacctcaaaacaatacaaataagcctcaggccatatgccaggcctgggtctcccaggaatgtttccccttggacaaggctggctatagaaccaggaatagacctgcttcccaactagcagc

SEQ ID NO: 12990 - DNA, 201 bp, Bos taurus
gctggcatggcccatctccaaggacctctgagaggcttgagacccttgagccaaacagctgttttagtggggacacaatgggcccagcctggacacagacattcagcaacaacatccactcgttcacttcacatctggttccctaagcagttcagggatggcaggcaggccccgccctcagggcattcccagaatggcagg

SEQ ID NO: 12991 - DNA, 201 bp, Bos taurus
agggaaaactataacattcagctttctggtcctgtgtgttgctacagagtaaaccccctccgggggttggcaaactgaggattgagggccaaatgtggttcacctattgtctgtggttgcctttgccctgggttgttggaacggaaaccatgtgacctgtggctcatgtttattctctggccccttaaagaaagtttgttg

SEQ ID NO: 12992 - DNA, 201 bp, Bos taurus
cccagcacccacagtcctctgaaggacacattcctcataaattgtggggaagtcatgagcatcagtcctctgcaaaacttccctaaaaggccaccaggctggcttgggaacataacagggtctcttgtctcacccctgcccgggctgcctttaggagacccaagggactgcggccgcatggggcagatccgtctaggctgc

SEQ ID NO: 12993 - DNA, 201 bp, Bos taurus
attcctgccagtcccacctcactccaggcagtcccgcctcctaggaaggatcagagggatgtcggtctggatggaaatcactttcggatactgctggcccggctgtggaccaggggagtgggcctggctcagcagcgccacccagtggctggtagcagaggcgatgggaggcagggcgctggcaggagagcagcagttgtg

SEQ ID NO: 12994 - DNA, 201 bp, Bos taurus
tgggatctcagtcttaacctctgggccaccagggacatccctgagtgattgccctgttaacatccattgtagatgatatatggaattctggcaaagtaaaccccaagggagaagattcaaggcctaggcacacatggggttgtgtatgccctgcggatacacacgcacactcacacatgcacatacgttgcaaataatcct

SEQ ID NO: 12995 - DNA, 201 bp, Bos taurus
ggacagagtggctaagtgccagtgactccaggaccagccggtcacctcctgctgctctgtgctgcccacccacaagcccctctctctagtcctgcggctctggccttcacaccttggctcaccctgttccctgtcgggagtccctttctctgccctccttgccagttccccatttgcagggcttgaggtgagcttttcctc

SEQ ID NO: 12996 - DNA, 201 bp, Bos taurus
gctgattctgcagcaggcccgcatcacgcagttgggattacaaagtatcctcacaccatacacactctctgtcttcctccagaggataagagacagtcacgtggccccagcctgccctcctccctccgtctgtctcttctcttaggggcgcaggcctgtgagggaccagccagcccctgtgaacgtccaacttggcggtca

SEQ ID NO: 12997 - DNA, 201 bp, Bos taurus
cctccttagaggctctggagggagggacttaccagcctcaggcctgagtcactgggtgcccagacccctccctaactcacccagaggagtcgtggggcccggaggcatccagaatgagctgctccgaaatctcctcctcttcctcctcggactccaggctcggctcccagacccgcagcttctggtagagcacaggccctg

SEQ ID NO: 12998 - DNA, 201 bp, Bos taurus
tcaaaacatgattcctttggtggaggcaaacgtccagggatagaaatcagaccggtagttgctaagggccagaagtaagggctgaggcaaagggcacaacgaaccttttcagtcgtcggaaatgttctttatcctcttcatggtgttgctgctgctgctgctgctgctgctgctaagtcgcttgagtcgtgtccgactctg

SEQ ID NO: 12999 - DNA, 201 bp, Bos taurus
tgtctgcattcctcactttgggaatcacatattcaaagattggtccaaacatctcattttcagtgggggcagtgaggcccagagggatgaattcactttcagaggtctagtttctcagtcagtgggaaggtcagtctggtcaggagagagaaaagagaaaataaaggaatcaaagtcttatcagtctttacatttttggag

SEQ ID NO: 13000 - DNA, 201 bp, Bos taurus
gagatttatatgtttgaaagtgtcttatcttcatacttgactgatgatttggttgagttttaaattcctgattaatttttcccaaagaatatgcctccctccctttgtgggggtgaaggagggattgtcacgtagctgccacgagcaggggtggagacccatcaatctaccagctcatcctgcagtctcaatctgcattct

SEQ ID NO: 13001 - DNA, 201 bp, Bos taurus
agtagcagagacggggcagaacgcaagctccggtcccctttctcttagttcggggcttttttccccaggggaggctgcagtcccagcctgacttgcacacgtgtgcagcagacatcacttctgcccatcaggatgtcagcttctcctctcctgcaccctcttgaagctggccatggccacgtgacttgctttggccaatga

SEQ ID NO: 13002 - DNA, 201 bp, Bos taurus
tcacgggacggccagacatgcagaagcagcgggtggtgtcgtggctgtcccagcacaacttcccacagggcatgatcttcttctccgacgggctggtgcacgacccgctacggcagaaggccatcttcctgcgcaacctgatgcaggaggtgagcgtccggtgggggaggggctttggccagggaggggtgagtccttggc

SEQ ID NO: 13003 - DNA, 201 bp, Bos taurus
cagcattgaatcctgagggaggggccaaggatccagctcccccgccttcaggtctgaacacatcccaggatacggcggctttttttcaagagaaaagtctatgagacctgagaggtggccgtaacctccaggcccaggtccttcctggccagtgggcatctctggtcagcttggctagccttgaccagcctgtttctactt

SEQ ID NO: 13004 - DNA, 201 bp, Bos taurus
atagatcactccttggctcctcctttcttcagccaagctggttcctccttcagacagctgcccctgataccctatccacctccttctctcactcaggtctcttccttggtaatgacagcttcactctgcaaggagaactcagtggtaattgacaagcccaggagcttcagtatcccccgagcccctgagaaagtcacaggg

SEQ ID NO: 13005 - DNA, 201 bp, Bos taurus
cttgtggttttgggtaaagcagctcagctccctgatgcccaggactcatctgtaaaatgggaatgatgtcaccggccccatctcagcatacctccagctctctgtttcagacctgtgggtttaattcccacctttctctcagtgtctcctggaaaaaagaaggccctctggggttcccctccccagccttcctggtcccag

SEQ ID NO: 13006 - DNA, 201 bp, Bos taurus
ccaggaatccatgttctaacccaggccttcaggtgatttttaacactgatttagagccatgggggcagggaaactggcacaggtggggctggggatgggaagcagtacctaatatcttctgggccacattaagaatttcgatcttactccccaaatcaatagacatttcagggcttcagcatcaaagttctgtgccaggtt

SEQ ID NO: 13007 - DNA, 201 bp, Bos taurus
tgtgaatgcaaggaatgcacaaaagccttcatctggtgcacagcttttctcaagcatcagagacttcatactggagagaaacttaaggaagttgggaaaacattcagcaaggaaaaattgcttagagaagagcaaagaattcaccaagaagagaaagcttatcagtgcattcagtgtggtagaactttttggggcagctca

SEQ ID NO: 13008 - DNA, 201 bp, Bos taurus
ggtgtggcccatagatttctttggggggtacatttgtctctctctattcattgtgttttgttatcagagttctactggccttgtaaaataagctggaaatgtttatgttctctggaaaagttagagatcatagggattttccatgcagttttggtggaattcacctatgaaactgtctgggcctgaagacacttgtaggaa

SEQ ID NO: 13009 - DNA, 201 bp, Bos taurus
agaaatatccccctcctcaaagtaagcttgcacaacattcaaatataaagccttgctccccagcaaggacccacaatcacagaaggccttcaaacttgcataacattcaaatataaagcctggctccctggcaaagacccacaatcacagaaggccttcaaacttgcttccaggttcctattatgttccacctcaagctaa

SEQ ID NO: 13010 - DNA, 201 bp, Bos taurus
gtggtttttgagatagcttcccaggatccatgcatacctcctaagaggaagtggctttctcttaagagatatggctctttctgaggccttaagagggaggcgtggcgtgctgcaattcacggggtcacaaagagtcagacacgactgagcaactgaactgaactgaggccttaagccccctggcttgggagggcagcagca

SEQ ID NO: 13011 - DNA, 201 bp, Bos taurus
gcccattttgatccatgaggcctatccaggtatttacagggcccatgtggtgctggataaatttctggggagagaggaggggtggtgacctctccttagacctgccaacctcccagccgggccctaccggaaccttacctgctcctcccaggagcccaccaccaccaggtgggcattctccaactggcagtacttctcagc

SEQ ID NO: 13012 - DNA, 201 bp, Bos taurus
catctttgttccctgtttctatggaggccctgccctgtgacccatgagccagggagcatcttccagtgagaagaaagtgagctggaggcataagagaaagtgacaggataggaacaccacctccccccaagcctaataaaatcttttatattttattaaaagcaaaagttctttggttgctatttaagcaagagtcgcaag

SEQ ID NO: 13013 - DNA, 201 bp, Bos taurus
tgacactgacgacgatgatgacgagaagcccccacatcagcacacagcggcctgctcccacaactgggactaccctgaggattgggagggtttacagactgcccagaggttctggactccctgggcccaggacaccttggagcctcctacccagaccatccgcttccagcagactatagagggaaggcccctcaagagaga

SEQ ID NO: 13014 - DNA, 201 bp, Bos taurus
taacggaggccccattacagacaaaccagtgtgcctagtgcggaggttttggccactggaagaataaattccctagggcaagaaaagaagaggaagctcccgcagctgtggggcttgctggcttggaaattaaatagggctgccagggctcagagatatcaggtccccgagagcccatggtaaccttaaaagtgggggacc

SEQ ID NO: 13015 - DNA, 201 bp, Bos taurus
gagtggagcagagactccaagaggaggcctcaccaactgtggaggcagcaagggtgtgtgtatgcatgcgcacgtgtgtccacgtgggcacacccgctgcgaggccaaactatgtatttatatccaaatcagatagacagcacaatgggcctcactataatttcctgcctgtatttaagagctgaggatagttcatttggt

SEQ ID NO: 13016 - DNA, 201 bp, Bos taurus
ggtcaggtctgggccaggtaggggaagccaggtggcagtcctaagtggggactggaggtgattttctggattcaaggctctggctgggattgagagctcattggggctgcgtggccacagctgcagagaagacagtccagatgtggtggggttggaggaggagtggggttggggcgcagggggctctggcttcaggggacg

SEQ ID NO: 13017 - DNA, 201 bp, Bos taurus
ggaaccatctttgtgtatgtgccagattttgttgcctctgtatatagataactctaggggaggggaccagtctggcatactctcagtgctaagcaggtttatttaaaaattccgaaagattcaacaatacttaggggtaggacctttatccttcttgatccccagcgataatcttaaaccattacagctttatccctgttc

SEQ ID NO: 13018 - DNA, 201 bp, Bos taurus
tcctatatttgaccgccaagtggcgctgggactccagctagctggtcacctcggttacctggacatcccaggcaaaggccctaggcctgttgagtattcgtgtcgcgtaaacggctccagccgggcgcgtgctaccgcttgaacacagccgaatgtgcggactctttcgcggggcccgccagagattcagctcccgccagc

SEQ ID NO: 13019 - DNA, 201 bp, Bos taurus
atccgtaaagtgggaacacttacagctacttcatagcgttgctgtgaatggatatgtgtaacccactcatcacagggcctgtcccagatgaagtatctaataaatgaaagctaattttattgcatgtcaatcattatgtaagaggagggccattatatcatcccacaccctgtggatggaaaggactctgtcttcttaaaa

SEQ ID NO: 13020 - DNA, 201 bp, Bos taurus
agttaataaaaataaaatggttgaggcactgagagatgctgacacaatgctcccaactccaggggcagcaaggccatgctttttcagcacctgcagaacagcgtggcccaagcacgtccagggggctgagacagagctgagggaacagagaaaggattcccctggtagtcgggcggagctgagtagtctttcgggttaccc

SEQ ID NO: 13021 - DNA, 201 bp, Bos taurus
ccggtcctccatcttccccactgcagctaacatgactgtcctaaccagcaaaaatgatcacttcctgctgtggatgttgcattcaatcctgactttccagcacttcacacaccggcatatgataatcaataatgcttcctgggtgatacagggaaattactgaaaagtccaggaggtcaacacttggacaaacctactaaa

SEQ ID NO: 13022 - DNA, 201 bp, Bos taurus
cttactggggtaaaaagcatggtgttatgaacatatcgatgaaaatggtctttttttccccctagtctacaagttcattacaaaagagtgagaaatctttgtcctctctccataataatttttgctggcagtctaggctgcttttactcccaaaagaaaaaggtcacaggccattgttttacagagtccaagtcacaagtc

SEQ ID NO: 13023 - DNA, 201 bp, Bos taurus
ctgggccattgctgttttggctgctgtgagcagggcatacagtacttgggtgcattttgtagttatctgggtacatctcaggtcctccgatggtccaggtggaggtgggggtggggccttacctcttccagggccctggaagagggctagtgggtgctcaatatttcaaacagactggaaatcagattcttcccaacagga

SEQ ID NO: 13024 - DNA, 201 bp, Bos taurus
ccaccgtctgtgcttcctctgacagtggcccgtccttcatgcacactgttctaacccagctcctggtgcaagatggggtggagtctcccgggacagttgggtaagtgtgcaagacacccaaggccccaccccaattatgtaaccctgaggctgtgaccctacaaaacaccggagacacccgggatattcctcaggcctgga

SEQ ID NO: 13025 - DNA, 201 bp, Bos taurus
ccgcccagccggactctcgcgccacctggtggctgggcggcgtcggcctggcgccagcctgaccccaagcatcctcggagtccggcccgagcccaccgcgcgtatgaggacgcccagctctgagctcctctgccctcggaaggaacaggtcctggctgagggctggccaaggccggagggacgccagcgaccctcccccac

SEQ ID NO: 13026 - DNA, 201 bp, Bos taurus
tgagaaacctctcccggagtagggaaggcctgacatgaccttggaggtggcggtagggtcagagcggctgggtacacaggccagtatgtcgaaactggctcgcttaagggtgcttgtgccagcccgagtgaaactcctctctggctggcactcctggccagcgttggccctgtagtgccagggtctggccgagttctgacc

SEQ ID NO: 13027 - DNA, 201 bp, Bos taurus
agcgagaagcaagactcctaggctccggacctctcttttgaaattaatacccttgagggcaggggagttggcatcttgtagtcagtgggtggccgaggaatgttccagaacagggtagtgacaaggtgagaggagggttagaagagggaatcggggtggggggcccgactggagttgggaagaacacaagtggcccgggct

SEQ ID NO: 13028 - DNA, 201 bp, Bos taurus
gtgtgcaacttggccatgttttgtgtcctaattaatgagggtgtgataaagcaaagggctttagagttcacaaagaaatactgactctagaatccattttctccccatccacacagcttggccttttcttcttgggctgaagaaacttatgtctttcatctggaaagaattctgaaagagggacctctgctttactttttt

SEQ ID NO: 13029 - DNA, 201 bp, Bos taurus
agggggcttaaaaaaaaaaaaaaaggagcaccagatcttcagcacaagccgaaaaccagatctggaggatatataactgggaccaagagggccaaacacatgaggtgacaggtgggcaccactgctgcagcagccagtcacgtgacacacaggacaagaactggccctccgatcttagctgggctcctcgtcaacagccga

SEQ ID NO: 13030 - DNA, 201 bp, Bos taurus
gatttctatggggtgggaaggaggccatcgtttctaaggaactctgaaaactacactaggagaaagtctatttttcaaatcccatgtataagtaatgagcgaatctggcctcttgtcaatatgttctttctaatcagccagctttctgtctgaaatgctccatcatcccaagttgtgcagaggaaaacaatatctcttagg

SEQ ID NO: 13031 - DNA, 201 bp, Bos taurus
agagggggccagcctcgcatgctttgaaaattcatttcgaccgcaatttattgcatccttggtttatgccagcaactgtgttcagggctggaagagatacgaggatgaataaggcccgagcctggtccccaggagaattacagcttgtgaaggagactgtggcgacacttaatactcttactaatcctccatgatatattt

SEQ ID NO: 13032 - DNA, 201 bp, Bos taurus
acagtggaactagagagagtccagagaagttggggagcaaaagggctgtactccatcacaagggagaaagaacttcaggaggaaaaggggagccttgtcaatagtgttgagttgtcctggagggagagacttgactgctctacttttccgacgtcagagtttctttttgctttagattatctacttagcaaatagaatctt

SEQ ID NO: 13033 - DNA, 201 bp, Bos taurus
gatctggttgctaatccaccttctccctggactgcagattagtaggggccttctttaacatcctccatgggtgtgtgacctggaacgctggtaagagactcgcccagagatcacaaatgggccgataccagctcctcagatgtgtgtggaccatgtagtgtttcatcagtggaggcacttcagattttaaaaatctcgatt

SEQ ID NO: 13034 - DNA, 201 bp, Bos taurus
ccgcctccctcgctttctctccatccagagagtctttagtccctcctctccccaggaggatgtggacggtcagcctgcagcttccggccaggagatctctcgagaaagcagatctaaccatgtcaaaaccacgtcacactcttagcttcaaaagttcagcaatgccaactgtgtgtaccgggcacgaggcctgtcctctcc

SEQ ID NO: 13035 - DNA, 201 bp, Bos taurus
acatggtggggtccaaggcccctcataagggagatgtgtccccatcataaaggagtccccagatcacgtggacataatcagaaatggcacctgatttgtctaaaaggcctcctaacagatccagttctagaactatgggatcccccactcagcatctcccgaacctcagtcactcacattctgctatcaaatcttttccat

SEQ ID NO: 13036 - DNA, 201 bp, Bos taurus
ctgtaaacagtgagctgcattgatttagaacatcagaccttcaaggaatagttcaagtcttggccatttccaccaataggaaacacctgggaagggcccgacttggttaatgacattctctcacacaaacttgctcttctacaagtactgaaagctactccctggagcaggctgaaaaacgggcccccaaatggagcgaca

SEQ ID NO: 13037 - DNA, 201 bp, Bos taurus
caccatcacactgggggtcaggttacaacatattaatttggagtgagaggacactttccatctatggccagcttcatccacagtgcttaaactacccccaatttttcaagtatttgcaggtataagggacaggattttttttttttttttttgaagtgtagttgatctacaatattgtgttagtttcaggtgtacagcaaa

SEQ ID NO: 13038 - DNA, 201 bp, Bos taurus
cattgtccctgatcgtcatttagccagaatacaagtctcatcatttcgcttctctgtggtttttgcattgcctttggaatcaagttcacgttccttaacacggttcacaaagttcttaggttgtaatcagataatcctgtgtcctcttctacaaacaccctgcacttctactctttttcttccctaggatgttcttgtcct

SEQ ID NO: 13039 - DNA, 201 bp, Bos taurus
gtcgatctgctcccccagctcggccacactgtccgcgtgcttcttcctcagtgtggtcgtcgtggcctcgtgctgcagagtggcctcctccaggtcccggagcagtttctggaactcagcctcccgcttcttgttcatctcgatctggactgaagtggccccgctggcttcttccagccgctcgctgatctcctccagttc

SEQ ID NO: 13040 - DNA, 201 bp, Bos taurus
gttttgcagtaaaaatgggtggcctttttcatcggctgacatccagtctcttttttcttttaatcaggatgtgagatcattttgtcaggcaaagagggaaatggaaatttgaggagagtgggaagatttgaagtagagagaagtaagagtgagcaagctgactacgtaactcctgcactgaaggctcactggggttagtga

SEQ ID NO: 13041 - DNA, 201 bp, Bos taurus
gcatttcctgtaagatctagaggcagacctgtggctgttgtaatttcacagaggtaatgtctataaacaatatttgaaatagctatagttaactgaaatatgatgtgaaaatacctgtagtttcttttggtgacaaagtcacaggtgctgctcccagtcctggtgtttgtcaccaaatggactcagttaatttcactgtgg

SEQ ID NO: 13042 - DNA, 201 bp, Bos taurus
gacacccgctcgccaggcacacagcgcaggcaggggagggtgagggtgggggcgggggcggtgaccccacagcctctgcacagatcagagtggaagggggtggtcatcgggccacactgacaaaccgaggtccgtggagcatccagagggatcctgcccaagggggccctcgaagacaaagtcaaggggagcttggggagg

SEQ ID NO: 13043 - DNA, 201 bp, Bos taurus
aaaaaggagaaaaacatatattagagattgtgatttggccttttaggtttcaaagtagaatttccccaaataggatcaatttgtgtagcgatgtgtgtaaatgaaaaattccagtccggccccggcccacgtctcagcctcaggggtcctgctggtgggtgcagtggcctctgctgcccactgagagcaaagctggggtcc

SEQ ID NO: 13044 - DNA, 201 bp, Bos taurus
cgtgtacatttttgaggccctgtgtacttgcttgctctctcctagattaacagtttctccaggacttggagaaaatttagctcttcctgcagctccagagtgcgcaccacgcaggtaggcaggcctttccagccggctgtgctccgagccaacctggcagcctcacaggcccctccgaggcagagaggagagcctgtgagc

SEQ ID NO: 13045 - DNA, 201 bp, Bos taurus
ttgtttcatgatgggacagacagttcctctttccctggattcaatgctcacgacttcgtcagacatgaagtcctcctgatgccaccctgcccccgctcccccatagctgtctgctcttgggttcactctgatgagttcgtggaagtcctgggtccttggggccagtggtgctgtagacactaatccaggggtttacaatgg

SEQ ID NO: 13046 - DNA, 201 bp, Bos taurus
atatactttctaatttcctgtcaccccagggcccttggggaaacttgcatgcagtcagagggagtcatgtggattctggaagctttgcatgtgatactcagagagcataacagagcacatggccctctccctctgcaaggagcagggggagcagctgcaggcctggcatttggctactgagacgggtggagaacactcacg

SEQ ID NO: 13047 - DNA, 201 bp, Bos taurus
cttatcaagtccttcagaacaggggccttctgcttctattttccaactttctacactgggagttgcagcctcttatcggcaggaccaggacataacatggtcacagtgagacagatgacactagacttcttttttttccccagaaaagcccaaaccctagagttttaggtgaaatcagatttttgagtattgacaactaat

SEQ ID NO: 13048 - DNA, 201 bp, Bos taurus
gaaggccgcccaagcaggagctgagttttctctcacaatctgaggaccttggggtcaggaagtaatttctctgccttcctaattcaccatggccacctccagaccatgtgctcctctcccttctgcaaaaatcctttcttatttcaagctcaggctgcgcagatgtcttactctttctcccttctcatccctgccatctgc

SEQ ID NO: 13049 - DNA, 201 bp, Bos taurus
ggccaggaatcgcagctctccctgaaacgctcgctggtggtttcagaacttggggcatgggggaaggaggaggaagccatggggagaaggtggctccaccctccccggccatctgcccttgcttcgagaacatactgtaattgctgagccctgcctgaggaggaaagggagaatcacaacatgttcacccagaagagaaaa

SEQ ID NO: 13050 - DNA, 201 bp, Bos taurus
tggggagtacaataggaaataaatttagaaactggagtaggaattctctggggaaacgaagactggtgaaggtgggaacggagacagagaaaatgtatgagccagaaggccagaccctagatcttatgaaagatgcaccttaaatccttctctgggatcatggagaatataaataattgatgcctagctttttcctaaatg

SEQ ID NO: 13051 - DNA, 201 bp, Bos taurus
agcgggcagcgggcagccggggagccccgtcaaggaagggggccgttgtagacaatggcaaacagtactaccacgtttgtgggccagagactaagatgtcggaacgtgtccagcctcgggtctgaccacgccaggtctccttggcaggagctgcccgagaagtggaacaacattaaaaagacggcggttaccgtgaggcag

SEQ ID NO: 13052 - DNA, 201 bp, Bos taurus
cttagggatggagttattggcttagccatcaggacactttgaggtgttctgtaggtatcaccctctagaaactgggccagttaacattcattcacagcagcgcatcgtttgttcttttgtttgtccgtgttcgtctgctgactgaagaagtgttgaggatttatgtgtctggtgtaattcttgggccactgaggcacatga

SEQ ID NO: 13053 - DNA, 201 bp, Bos taurus
tgataagctcaggccagtcaggactcagtgcttggaggtatgggtggacctacactggaggctggagatcccagtaaagccgaagtccccagagtaaggacggcctggttaggagcggatgcttgataagcagtcagctgtgtcagtgacagtaagcactcttctctggagtttttggtagatcaccttctgagttataga

SEQ ID NO: 13054 - DNA, 201 bp, Bos taurus
ctgggaaacccccagttgcaatagcttatgttctaccatccacaggtctcctgcaaagacactgaagtttgctggctaagaggccataaataagtgtcttagagtcagaggaagcccaggaggtctaaacgagacccgctgtgctgttccttgagcctgttgagagcggtatcaggcatgagtgtgggtcttggccgttcc

SEQ ID NO: 13055 - DNA, 201 bp, Bos taurus
catgcaacatcattccttaaacagtgagattgtagaccacgcgtagaaatcagtattatccgtacaatgagatggcccactagcacccagagacagtgccctggaggactgtggtccctctcttttcccttccactcctcgtcctgtgtcaggagtgggagatgctgcagatcctcagttattgcgggtccactcaacatg

SEQ ID NO: 13056 - DNA, 201 bp, Bos taurus
taccaccactagtaaaaaaaaaatgaagtataattcacataaagtgcatatatttcagtctcttttgacaaacgtatacagctgagtgacccttactcctcccaagatgtcgtttatttgttttattccagaggagccccactgccccttcccagtcattcatcctcagaaagaagcactcatctggctttccactcagca

SEQ ID NO: 13057 - DNA, 201 bp, Bos taurus
ttaaaagaattcgtatttagacagagggcatgttgcatatgcaggacttgaagaaagtatagagcaacgagagtaaaagcagcgctataggtctgatggaaagatggctctcagggttaccaagggatgctgattgctaagtagggttcagaggattctactgggagccaagagcccactgtaagaaggtgatacagaaag

SEQ ID NO: 13058 - DNA, 201 bp, Bos taurus
catgaagggtcagatcatacagagaagatccatacctgttcagactgaaggaagtggggagggaatataagatgctaatgctcggccatcaagagttctgttgggcagaggaggctgacagcccctgggggctagcacagtcagttctgggctctctgagtcgctgtgcactcaggccctgtaccaagtaaaccccaacaa

SEQ ID NO: 13059 - DNA, 201 bp, Bos taurus
ctcccctgtcctacactgctggaggttgctcagattcatgtccattgagttggtaatgctatctaactgtcttatcctctgtggcccgctttttttcctgctctcagtctttcccagcatcatggtcgtttctaataagtcggctctttgcatcgggtggccgaagtatttagaacttcagcttcagtatcagtccttcca

SEQ ID NO: 13060 - DNA, 201 bp, Bos taurus
ctgggccctggggccggcctccccatataaaatctgccagtcacaccggagcgggcaccagggtattctgccattttcagtgtcgcagactggcccctccgagagctgtacttccaaaccactttccgctggactggatcgcgggtttatttttaaaaccgtgcccaaaccatagaccagaaaaagaccttggccagtcat

SEQ ID NO: 13061 - DNA, 201 bp, Bos taurus
atgtatgagtcttctaatcagcaagagatgtttccagctggtgttaggggatcatggctggtatcaagccctcataaaacctggcctttctcacttcctttcagatacttgatcaagtttttatccaagctctcagaataccaagatgtcaacaagatgacacccagtaacatggccattgttttaggacccaacctgctg

SEQ ID NO: 13062 - DNA, 201 bp, Bos taurus
cagtattggggtctggggttgggtggtggggaggaagcagagctttgactcaaatgtaaaattcaagttttaaatgagactgaattttctggatgcaaatgagcctattttatcaaagaaaagctaccaaattctgatgggtttatggaaagtgggatttgatagagcatagttggaatcagttataggaaaaataaaatt

SEQ ID NO: 13063 - DNA, 201 bp, Bos taurus
gccccctcaatcacaaacgtctccttcgcagttccagatcaaagactttcttgatagttctggaagaaaagcaccagggaagactctaattgtcctgactcgcctagaggagaacttatggccagagatggggtttactttacccagacctctgatggtactgtggtggacttttcacatcctagccatgtgaaaagtgtt

SEQ ID NO: 13064 - DNA, 201 bp, Bos taurus
ttggaggttacagctctaatgaacactcctcccggtgtccacagagcctgattcagcacgcggggcgattagcagggtcaggttggaactaatgagctccgagtgccagttgtggccattggagcttagtggggctttgagacccaaaagccctcgacttcattctgactggcttggacttctattacttgaaaacccagg

SEQ ID NO: 13065 - DNA, 201 bp, Bos taurus
ggcccatccacagacatttccatgagacaaatatttgggccagaccgttcttaggttgttttttttttaagggaaggcaggagatgacaaaaggattttcactcctagatggccgtgcgcttcacatacgctctatcagcaagtgatgaagctcatcactctaagcgaataatcactcacaccaggcattcccgctccgga

SEQ ID NO: 13066 - DNA, 201 bp, Bos taurus
gatgatctaagttctgagggtttccagagtgtgagaaaggaagcaaacttgcgatcatcagtattcatgggccagcctctgccggcccacatacaacccttgctaagctttggttatttctatgtattcctgtacatcctccacttcattctgaaacccagtccaggaagctcacctttttcctacccacacaggcctaca

SEQ ID NO: 13067 - DNA, 201 bp, Bos taurus
agtgctctggcctgcctcactccacaccaggaggtctgtatcagccgcttccgttcattatcctgaatcagcgtcttgcctgctgagttgcaggattccgtgtcatctcatttgagtaaggcctgagccctctctctcacacacaccaacacggctttgcctggatttcatgtaacatctctgcttcacactttccgtcag

SEQ ID NO: 13068 - DNA, 201 bp, Bos taurus
cgacccattattggagcacatggacacacacagctttgtggagttttgaaaacagaaaggacgttgaggttcaattttagacatgggggaattgacccctgaattcctgaggaagtctgattaatgctgaaccgttagcgagtgcaaaggttggttttatttccactctgtgaaaatacctctgtcaagcatgccacctct

SEQ ID NO: 13069 - DNA, 201 bp, Bos taurus
ggcccaactctcacatctgtacatgactacatgtactgtgtattgcctacattcctatcctcataataaagtccttgagggcaaggctggtgtctgacttgctttctggccccctgcatcccttctaatcaagatgtgccacctggagtacactccccatttcagtgagccagacaggtctgggcatgtccggcctccctc

SEQ ID NO: 13070 - DNA, 201 bp, Bos taurus
catcgctcctgcccagatgggcatggggaggttgggacaacccctggccagggaggggtagggcagggcctcccttcaaacccagggttcagaggcctccgccctcctcgctctgtgaaccccggttggcaaatacaggaggagcagctgcgctctggcaggcaagtccctcctcgtgttaaatgacatccagaggatgtc

SEQ ID NO: 13071 - DNA, 201 bp, Bos taurus
tattggttcctgtagttgaaagatccagaaacagctgacttcaggcacagcttgatccaggcgacagaatgttctctctgcttgtcgttggccccactcatagcagtctctctccccttaaaaacagacaccccctggacactcattcattcctttattcacaaatatctgtctactacgtgccttgggccaggtgctggg

SEQ ID NO: 13072 - DNA, 201 bp, Bos taurus
gctcacagtcttatgcaatgggccatagtgatagataatataggacaaaatgagaaatgccagaggagcggagagaagggggcccaaaggagaggtcaccgttgagttgagctttgatgtatgcataggagtttgctggctgattatcccagaaaacattcagggtagagccgctctgtggaaaaggcccagaggcccaga

SEQ ID NO: 13073 - DNA, 201 bp, Bos taurus
cgaattagcctgatgacagggctaccttcatctaagtggtacatggtcaaagtgggttaatccagctttagcttaagctggggctggttgcagggttgtggggccaccccccatcagggagacgcccgcttcctctaattcgctgtgaaggaggagtctgttgccctttctggctcgtgtgagtttatatcatcatttcta

SEQ ID NO: 13074 - DNA, 201 bp, Bos taurus
tgcacacagccttgtgatcccagatcctgtgcaaggttaactagccttctataaacattaacacccatgggaatggcgtgccgtgattatcctggcccctaagtacttggcagtttacagaaggcactctacagactggagtgcaaatgtaatttgcgttgcaatgtttattgcagtcacagttctgtaaacaggctgcct

SEQ ID NO: 13075 - DNA, 201 bp, Bos taurus
tacacttccggttcttcctctcattccaacagtgatctgtgttcactgtgcaaagtgtgcaaaatccaggaagacagaaataattcaagatatgctacccatactcctgcctcgaagaggtaaccactgttaatatgtgggtgttttttggtccagatttatttgatacacacactctgaggttcacacatgtaaatatgt

SEQ ID NO: 13076 - DNA, 201 bp, Bos taurus
tcacttttacttggaggccgaggcctgcacagcagcattagacctcctcaggctccctgccccctccaaggtttgctcattttcaccaaaaagcaggaaccactgagggtccccttgcaggcccagggcaccaggctgagcctcccaggcatctctgctggagccagggccgcctccaggctgcatgctttgaagggaggc

SEQ ID NO: 13077 - DNA, 201 bp, Bos taurus
aagggagtcagacacgactgagcgactgaactgaactgaactgagaccaagggaagaaaaccacttttttctctaaactgtatcctttagctgcaagatatcaatgcaaaaccagaggaaaggaacagctggtttacccagataaaactttagtcaaaaggacatctcttcctgattccgaaaataaagaatcactttttt

SEQ ID NO: 13078 - DNA, 201 bp, Bos taurus
taatctccacaatcttgtaagcttggaatcagcatcttcatctcacagataaggaaatagaaccttaagagtttaaggaaactgtccggcctcacatagccggcaaggggcagagggcaggttcaaagccaaggtctctaatttatgtgtaccctgaatattcattgggaagactgatgctgaagctgaagctccaatact

SEQ ID NO: 13079 - DNA, 201 bp, Bos taurus
agcattctggcggcgggttctgctcagcggagtttccgtctggcctgacaggagacacagccgaattggacgtgaggtcgggctaactggcccgagcaggcgagcgagggagggaggggaggagggaggggaggagggaggatcctgcgctcggaatgcccggtcctggcccgccgcccgcccaccccgccccgcggccgc

SEQ ID NO: 13080 - DNA, 201 bp, Bos taurus
gtgagtgcttgtccagcccccgccttgtctgcattctgaagacctgggtaaggaatccgggagaacaaggaccaaggttggggcaccgcacaggtaacagatgtaagatattatacttagggcctgggattctgacgcccccttcctggttctgcatttagaaataacttctcaatccttgaaaagcatcagaaatatgca

SEQ ID NO: 13081 - DNA, 201 bp, Bos taurus
ctagaaaactgggtgggttcttttgttaatgtgcgtagatacggccatggagagacatcttccatgtctcctgacatgtggaaacaggagtttggccgttggattcacagataaatcatcttcaaattgtgttattctttctaatgacagacgcgcacaagaaaacctgctcactaggtagttgtcattattcccactaca

SEQ ID NO: 13082 - DNA, 201 bp, Bos taurus
gcagggggcagttttgactggggcctgtggggaggcctgccagcagtgcccgtgggtatctcctgggctccagctcctcccctgcacccggcaggagtggtctcgccagcaagcaggccagcactggcacgtttccttcaaggagaggccagggcagagattgctttcgtgacttttgctttgctgtttggtgtttccaaa

SEQ ID NO: 13083 - DNA, 201 bp, Bos taurus
tggaggctggctcctggaggtgacccacttcggcctcctgagaaaagcctcctgctctcgctcaagccctgctgtcccatttccccttcagcctcaaggcagtcctggccgggagccctccggacaacaccgtggacctgtcaggcatcccgctgacctcccgtgacctggagcgggtgaccagctacctgcagcgctgcg

SEQ ID NO: 13084 - DNA, 201 bp, Bos taurus
agcttacggcatatggatttttccaaagtacatggcctactatagaaggttttaaacaaggctgccctgagatcttattggcgttttatgaagatggcttcggcagcagggaggcctggaaagaggtgaggacactgttacgattaaaactaagggcctgaatcagggtgacagtggtagaaatgtgttaagaggggcctt

SEQ ID NO: 13085 - DNA, 201 bp, Bos taurus
agcctgcatctctcctctggaggatggaaaaaaggcgaaccccccgccgccccgacccaggaacaatcacgggaagtcacctcttctgaacagacatgcagcctgacaagcaaatagggcctttgtgcgaaaaatattttaagtatcaacgtggataaaagctcagcaatatgatgagtgaagaaataaactgcagaaaca

SEQ ID NO: 13086 - DNA, 201 bp, Bos taurus
ccatttgggtgtgctggtctataggaggtaaggtctaaaaccccggcctccaggactgcaagttcagactgaaaacatccctggccctgtacacatctgaccttgttggctctgccctgggaagccgtgcgcttagtggcaggaggaacagaagaactggcgaaggtgcccacagctggccgagaccccgcggccagagtc

SEQ ID NO: 13087 - DNA, 201 bp, Bos taurus
ctgtaagcagtcttgagatcttcctggtctccacaagacccaggatgcaggctgggcaactccgccagggacctgcgggcccacgcactcatctacacttcggcacaaagatcccaagacagccccacggttgtaccaccctgcctggatccccacgaaggccacacgtgcaaagtgacggacaagcagaggggcggaggg

SEQ ID NO: 13088 - DNA, 201 bp, Bos taurus
agtcacagaagagaagtaagggataaaatgccccatgggtggagccatggccagagtttggggagcagagcctgtggtggaagaggtgacctgaatgatccaggaaaagatacacatgacactggggatggtcacgtgccttgcaccagtgctctgccactggtgaccgaagaccagcaagagaaccgatcacttaacagc

SEQ ID NO: 13089 - DNA, 201 bp, Bos taurus
cgttgctgggacggcattccatagagaacgtgggcactgaccgggctggacaaaggacatgaccacaagggacacgtaaggggccctgctctcagggagcgtacaggctccctggggctgccagaggaggggcagcccccgtcctgctggggtaactttgggaggagtgtccgctctggggttaggccactgtgtgccgcc

SEQ ID NO: 13090 - DNA, 201 bp, Bos taurus
ggcccgaggttccactcatggggggccctaggagcctgtgcaggggtgggggtgaggggccagggaggagaggggcaggaaggaggcagacctgagggccccgccattggagcaggagatgggagagctggacaccagccaagcagagctgggacagggcagagcaggagtcaagtgtggggcccaggcatccccaggcct

SEQ ID NO: 13091 - DNA, 201 bp, Bos taurus
ctcagcccgtctcactgggagtggccgtgttcccatcaaagccaacgctgagttctccccttttcccaggagatgagcgtggaactaatgggccacagcacaggatccacaagtacttggtcaggtcccggctcttcctctaccacctgtgacccggcacaagccccggtcaagccatctgtgaaacgggcaaggcactgg

SEQ ID NO: 13092 - DNA, 201 bp, Bos taurus
ctggtgaccccggccagccccctgcaggcacaggagtgccctctagggtccctccacaggcacatcaaactggaccctgagctctcagacctctcctagcatcccagtgacgcggcccatcaccagtcccaacaaagacttggacttgggccccacccgcagggcacccaggcaccaagtcccgggcccatccaggatgca

SEQ ID NO: 13093 - DNA, 201 bp, Bos taurus
gcccaggaagcagtcctctcgtgggcccagaccaccttcctggtccccgaggtcttaactcctcaggagctgagccccactgtggtgctacaaagcatgtgggtggaggccgtgtgcagcagagggcggggcacgaggccaggctgcccccacaaggcctctgcagccatggtaggccggggcgtagatggcccccaggac

SEQ ID NO: 13094 - DNA, 201 bp, Bos taurus
gctcctgtccagaacagagacactgccctgaggcgggacgcaggcagtccggggctggctggagtcctgcactgatttgccatgtgactctggaaaggccgtgtccagcccgtttactcctgtaacgagggcaagttgaacaagttcatttctacatctgaagcttaaggccggaatcaaaggagcttttagtttttcttt

SEQ ID NO: 13095 - DNA, 201 bp, Bos taurus
tttctgcccccaggctctgatgggaaggttcagggtgggaccaggcagggctgcctcacctgcagccaaggtccagagcacgatctccatcaggcccctgaccttgccctctccagctgcggggtgggtacaggggctgccccagtccctgaggacttcacattagccctgtctggtccttcctggcttgtctggtcctgt

SEQ ID NO: 13096 - DNA, 201 bp, Bos taurus
gggccaccagggaagtctctcagcttcaattcttgatactgaagttactttttgaagtctgaagcccacctggtgccaggcagggttacaccttcccaggcggacaggcctcacccactgggctcctgaagtagacacctgtccccagggctccttggaagattcgaccccggaggctgtggcttgccggggtgggggctt

SEQ ID NO: 13097 - DNA, 201 bp, Bos taurus
cagccttgctccccatggttgctgagggggcttggccatcctttgtatcctgcacctgtgcttccgtggccctggcatgggccagtgtgcccagcattcccgcaaccatgcacctctgattcttggctcagcttttcttctgtcttgggcggtcaactgagtctggctttttccctgggccctgccaactgacaggcagag

SEQ ID NO: 13098 - DNA, 201 bp, Bos taurus
gggctgttgctcaggtagggagggtcagggctggggggcaggtgagtgaggctctcaacctgctcgcctctctggacggggcctgctctctgctctgttcggtagcagtagagtgctgtgcttcacaggacccaggggtttcatcagggcagtggctcccaagcctggtgtctgggccaccttcctcaggtctgtggtcag

SEQ ID NO: 13099 - DNA, 201 bp, Bos taurus
aatatcaccatggtgtccatttcaccctaaatcatgtatagactgtgtcccagttggcggtgtggtgtggaaaggttgtatataccaaggaaggcaggtacagccggcctcatgtacatcaccctgtttagttcctaggcaagtatggtcatccttatggctcacatatccacaaggttccatggggaacaggaacaacac

SEQ ID NO: 13100 - DNA, 201 bp, Bos taurus
tgaggaggtgctgctgtggtgccctcctcccctgatgctgcagagctgccaacagcaaggtcatcatgcagttggtgccctggttgtcacaaagcagcccaagggtgccagctccagtacccctcccacaacctctgggctcgccccaagcatagtagcctccagacccaggttggtgggagtctttgcttaggagggctt

SEQ ID NO: 13101 - DNA, 201 bp, Bos taurus
acagaccctttctccttgaccatgctaagtggaaaggagggcctcctgggaaggacaggccagcgtttatctctgtctgggccaccaccagcttcacactctccatgcctctccgcaccacccgcccttgccctcctgataaggtcccaactccctggcctgagtggtccttatcatcttgtctcatggtctccctccggc

SEQ ID NO: 13102 - DNA, 201 bp, Bos taurus
tttcacaatccaaagactgacagggcccaaggctagaagtggctctgcccagagacggcatatatacaactaacactgagcctcaggcggtcactgaaacagcaggccgcttgatagaatttctcataaacactgctgcatcttcttgctcttaacccaaaggactgaaaaccttatcaactgaaagaaatatgtaatggg

SEQ ID NO: 13103 - DNA, 201 bp, Bos taurus
cgctcagtcatgtccgactcctagcgaccccgtggactgcagcctaccaggctcctccatccatgggatttgccaggcaagagtactggagttgggtgccattgccttctccgaagttaatagttgagaggacctaaatattttttgtcactatttcttaagttattaaaaaaaccaaaaatagcttcaggccaatacaga

SEQ ID NO: 13104 - DNA, 201 bp, Bos taurus
aacctatagtataacatagagctagacttatttcatcttagtggttcttagtgtttctttgggtcatggattcctctaggaatcagattaaagttatgaagctctctagaaaatacatgtatacgcagaattttgtgatctgtttgtcttttgcttagattaggcttaaaatctttgacactaaagacaggtttatatagc

SEQ ID NO: 13105 - DNA, 201 bp, Bos taurus
tttggaaccagccttgagagggctggggaaggcaggggtgaggtttaagggaatatttgcacctgtctctggatcacagaagaggctgagggtgtgtggcgtagagaattggccctgaggcctttctcagaattccctgtacagttattcaaatactccttttgctcaagtttcctggggatgcctaggctgtggggctga

SEQ ID NO: 13106 - DNA, 201 bp, Bos taurus
gcagcccccaccagcttttccatcccagattggaatgtacactgtacgagccctgtcaggctctccgtttgtgaggaaattgctagggcctgttcccctatggtggctcagcctgtgctccggctcctgttctgccaggctctgctcaacgtccacccaaatgcctgtgctggggctatcctctgatccatgagacctcta

SEQ ID NO: 13107 - DNA, 201 bp, Bos taurus
aagcaaaaagggcattatgatgacacttttgatacacttactggaatttttttcttcagttcagtctcttgtacgttctatttccaaattcactccagacactaactcagctatcaaaactagctcagtaataatctccctcaagtttcaaaatatatcagataatcaaatcagctttattttcttccatgagctttccat

SEQ ID NO: 13108 - DNA, 201 bp, Bos taurus
ccatcccgctctctctgccctcatctccccatctctgtctctccctttctctttctgtctccctctgtgtctctgtcttttggcctccatgtctccttgcgcttttccctgcccccaacccccaagcctgctcaggctccaggacccagatggcgggacattcacgccacagtgcctataagcacagggccgtggctgctt

SEQ ID NO: 13109 - DNA, 201 bp, Bos taurus
gggcgggagggaaggcccaggcaccgaaccggcgcggaagtgtcttcgccgataatcccggcagcaggctggtctctgagcgccgctcggtggccgatcacgggactgcagaccgtatactcggggcttaggaggacacaggtctgtgcaaaaaactgggtggactcgtaaatcagggcctgcggggaggtaaccctctta

SEQ ID NO: 13110 - DNA, 201 bp, Bos taurus
ctgggagacaagagctctacagaccacagatgcctctgtgggatccatgctgccctgcgaacaggggagaagcacaactttcttatttgcaggctgctgcattatatgtttacctggccccagagagggcaagttggtccaggcactgagataccagagcacatcatggtgccctggggcgactgaaagctggagcctcag

SEQ ID NO: 13111 - DNA, 201 bp, Bos taurus
ggggccattcctgactgacctgctgggggcgggggcaaggagcactgctctgaggagtcaccaaatgagggaccttctgctcgggtgacactgcctggaggcggtcagtttgccccgtggcccacatccacctgaaaggtagcaagttctacactgggcgagaggggattttccagaaacccagggctacctactgacaag

SEQ ID NO: 13112 - DNA, 201 bp, Bos taurus
cattttctgggcactggggaatggagtggcagcttggtcagtggcctgtgtgtgcactgcactcttgcaagtgtggtggtaagtgggcctggatggaaggcgggtcagagggaaccacatctggggagaataccaggtgggacaaagcttggcacacaggaggagctgggagagggatggtggggctagaccacagacagc

SEQ ID NO: 13113 - DNA, 201 bp, Bos taurus
ggacagggtggtcctgtgcctggagccaggctgtcagcctgccaggactgcaggtttcctctcctgaagggccccttcctggccagctttgatgtgtctgcgaggttagtgaaggatgtttggcttcagggcagggtgccaggataaactccctctgcctgctgggccaaaccactgcctgctcagcgcccagctcagtgc

SEQ ID NO: 13114 - DNA, 201 bp, Bos taurus
aattccaagctgactatctgggaggctagagaggaagggaagaagagagggagagggaaggaccccttggaggaggcaggtagccactctagggcctcccttaaaatgcagggggaacagggtccacaccagagaccactaggagctgagcaaagggaagcctgagcctggaggcgcagagagaggatctgccccagcagc

SEQ ID NO: 13115 - DNA, 201 bp, Bos taurus
aaacaaataaacaaccacgatcattcctaacaagaaagataggccctgctcacaggcactgctgggcttattatgtgctaaatccatgtgggaaattgtccgtcctccaaaaggccctcttgactttacacttttttcagcaaaagaaccccaaaatccctagtgctgagctctccttactatatctgatgggacacagtg

SEQ ID NO: 13116 - DNA, 201 bp, Bos taurus
cagagagctctgagggagtgagctgaggtggctggactcttgggtgggcatgaagaagaggggtctcttgccagggcccagggtaaagagagggacatcacccagagaaagctgtgctctgcagtggcctggccagtcaccagcggggggcagggacccactctggcattcttcccccaggataagaaggcaccagatccc

SEQ ID NO: 13117 - DNA, 201 bp, Bos taurus
ccattggaattttaagtgctggattaccactccctttctttagagaggattagtgagggttggctcatccactatctagaggcatttatgattgaaaaacggaagctctgccagattaacctggaatttgattgccctaaataactacagttggagaaacctgaattgggcaaatggagggccttgagtggatgaccaggg

SEQ ID NO: 13118 - DNA, 201 bp, Bos taurus
agtattttatattttccttcttaatttactatccctcttaattgatcatctcgtcggctttctgtattaattacaactttctgtcttccccagagaatcccagagcagagccaggagggtcagggataccctccaaatctaagcccagatggccaattgcactacagaaccttccaaaaccgagattccccattctctacc

SEQ ID NO: 13119 - DNA, 201 bp, Bos taurus
tgtctcatataaggacccaaattaaatggtttttgtaatgacattgaggttctgtggtattaagactctcttgatcataagaaaaataagcctatttaaaatagctcatataaaagatttatcaaaaggaaatagctgttatagaatccaaggaaaagctgaccagggcttcagaaagggctggcactgaaacagttcagg

SEQ ID NO: 13120 - DNA, 201 bp, Bos taurus
ttcatgtaccaccagactactttgctgatgagcatgtgtttgcacatggtgcctactctgagtgaaattaattagacttgtgctgtcctagtcagtttcctttccagcaggttgtgtggctagagctccttagagtctaaaactgattctctagttctactgactgctgggttggacatttttaaacaattggaagacggg

SEQ ID NO: 13121 - DNA, 201 bp, Bos taurus
aaagggtcccagttctggagggtcctagaccccttctccagttcagagagtctacctcaggctcaaacatgcactatctgtgctctggccacagaggccacctctctgccacccacccagtcccaagccggcagccacagattaccaaagcgtgggaaccgagtgcggcctgggaggatgctttccaaacacttagcccag

SEQ ID NO: 13122 - DNA, 201 bp, Bos taurus
aatgacctgtgggacaaagagaaactaaattctatcttctttagtccactgtattttggggtctccttggtatagcaattcaaactctgctctaactgatatttcagctaatacaagcactgaaaagctggctggaagcttcaggtgtgaacttccaggggtgagtttcactccaaggcagtggctctccaggtgtggtcc

SEQ ID NO: 13123 - DNA, 201 bp, Bos taurus
cctctcagtgggaaatgctatttccctctcccacgtccacaaccctccagctcacttacctccttcgggaatttccactgcagtcacaacagcacagaatggagcagaaggttttcagggcctcaggaacaacccttcatttgggggaggaggggaggagacttgcccagcatcccacaggatgcaggtggtaaggccaag

SEQ ID NO: 13124 - DNA, 201 bp, Bos taurus
ggatctgcctcttactttactttccacctcacaaccaccactctactgttatctgaatctcctgtcatttcttgactgttgattgccagtgggtggggcctatttgaggcactgaccaatgactgagcaggaccagttgcctagtaacagggtgagtgatgatgctcaggaatggctgtgagctatggcctgcatgcaccg

SEQ ID NO: 13125 - DNA, 201 bp, Bos taurus
gagaggagcctgcggggaggcctatagcaggacggggtagcactgccttccctgggcatctctgaggctctgggaaagaggagtacaggagggcctgggagcacacgtcagcatgagaatttaagggtctgggatgaaaccagcctggagtgggaggatagctcagccaacgcccaggccaagcacctgtcaggatgggct

SEQ ID NO: 13126 - DNA, 201 bp, Bos taurus
ctaagagtggcttgcaatccaagtttactggatgtcctataatgtggagccttcaggactagaaaagctgaaatctcccacccaagagaaagcaccagcagagacagaagacttagcaggagaccaactggagcaaaagcctagcctattacactgcaatgctttaaacattttctacccacgaagaagaaaaacctgggg

SEQ ID NO: 13127 - DNA, 201 bp, Bos taurus
gtcagttatcattatcgggccatttttgttcatacctggattgccaggtataatcccaagagagctgggcatttcaaacaggtgaaggaggggaaggtgaaaacatagccagtccttggccattcctgtttgaaatctgtcccttctgtgactccttctgcccagattcctccagacgagcccacactcccaactagtacc

SEQ ID NO: 13128 - DNA, 201 bp, Bos taurus
ttcaagccatggagggccaatgattgctattaactaccagaagctacaagagagacatgagacagatgttcccaagggcctctggaagaaggagacctggcgacagcctgagctgacttcttgttctaagccatcagttctggggtaaattgttacagttatccaaggaaactaatatggcctcatttacagcaagatgaa

SEQ ID NO: 13129 - DNA, 201 bp, Bos taurus
aactccaataccgactgttcagaaaagcaagaggactccccaaggttcaggagccaccacctgtcctggagctgataaacttgtgaagtgaaagagtgacgcctccagcccctggcaatgaaggcaatgggtgcacgagtcaaattatttccctggatgccaacaccctgaggcctctgaccccctctgcctgccctaacc

SEQ ID NO: 13130 - DNA, 201 bp, Bos taurus
taaaagatgctttgttttacatccagcaaaaaggatcattaacacctcaactgttttttcaccaagcctgtggaaggctcctgctgctgttgataatcacggtaaccctcagggtagcgggggcaaaggggtgggtaattcaccagaaaatggtattcgccgatttggattacgtgcaccgctgctcctctccattcatgt

SEQ ID NO: 13131 - DNA, 201 bp, Bos taurus
atctccagaaacttgtggcgttaggccctcctggttgtggttatctctaatttgctggttttctcttatttctgatgtagatccatcctgtatccacttcctgtgttacactgaaattagagcaaaggggagagaaatgcaagagcactgggtcagctctcagaattcaaagtctttgttctgatgttttttctgtaacat

SEQ ID NO: 13132 - DNA, 201 bp, Bos taurus
caaagagaatggatttcgactgagaacgttgtgcaggacccatggattctttacattcttggtgggtaggcctattctaaaggaatgcttcaagtaaacagctgtaacacggcgattctgctggctttcttaggcatttcatgttgcatgcaattagccgggcagcaacgcaggacagagaagtggccggtaacctcagta

SEQ ID NO: 13133 - DNA, 201 bp, Bos taurus
tttccagttggtgcaagttttcaattgcaaagtctgccagcaggggtcagcaaggcccctttactaagcacagagaagcctgcttttcttcactataaccagtggtagtagtactccataaaacatattaatgaaagcagttgtcctgagactcttaagaactataattaacccaaagttctcttctctgtccaaaaggaa

SEQ ID NO: 13134 - DNA, 201 bp, Bos taurus
agaaataccttttgcaatcaaattgtgttctttattttgatctgaatggtgttaaaaattcagtttgtgcttaagacttgttctttcctgtaggtaagtcatacttcatgacaaaagaaaaattaatcaaatggctgccatactgtaccctgtcatcaacatttgtatggtcctcatctgtttcctaatctcttcctcatc

SEQ ID NO: 13135 - DNA, 201 bp, Bos taurus
tgccaccagaggcaaagaggaaaaagtccccaacctggtacctcacaggatcaagaaccccatgcaaatgggtacacagcctcaaccccaggcccagagatgggcactgtcagtagggaaacaagaatctctcttttattaaagtccaactacattaacaaggaggagcagaagctgtgacttgaggctgaggggccacag

SEQ ID NO: 13136 - DNA, 201 bp, Bos taurus
cagtcaggtgcagcctggctttggagcccctgttctcctcccctgccctctaccgcagaagcaaaggtgctgcggctgaggccagagcagagagcatgcctgcactcctcctgactcccacagaagccagggggtggtatcctctttcccaggttagcagcagtgtggcctacctaccattctggtcccctctggggccct

SEQ ID NO: 13137 - DNA, 201 bp, Bos taurus
ccctgagctccggccccacgcccaggtccagggctggtgggacgggcagggcacctttgactttgcccaggtcttctccctgagccagcagcctgtgcgcatggaggctgccaaggcccgcttccgggccgggcaggagctgctgcagcaacaacaaggtcagtgagtagacagcgtggggcccagctctcttccctccca

SEQ ID NO: 13138 - DNA, 201 bp, Bos taurus
aatcttgttaacatagcttacaagaaatttcttccagggtgcgggaaaactccgcaaatgaggcaataaaaaaaaagagggcttataagaaactaagaacactaacatttgtgctcccattatgtgtcaagtactgtgctgggtgactaggtagttccatgctatcccatctaatcagcaaacaaagtatgctaaatgctt

SEQ ID NO: 13139 - DNA, 201 bp, Bos taurus
agcttcctcagggccttcctggggacagtccgcccaccccacctctgttagtagaagggagagtcctggcatccttgtttcaacctgaggaaagcaagggctccagttcagggaggctcgtggccccagctctagtggggctgtgccccacaccaacccagcacacgcttcctttacccgggaagtctgagcaagtttctc

SEQ ID NO: 13140 - DNA, 201 bp, Bos taurus
gaactccctgcttctcaggatagccttctggccctctcactctgggtctctgcaacccagactgcagattcaaacccaaacaatagactgcctgctaagcatcaccaccctacgtatcacagacacccgatgtcagcaggcccagaacagttccttgtcagctccaccaccccaatgccactcctgaattctacagtgagt

SEQ ID NO: 13141 - DNA, 201 bp, Bos taurus
cttgactggtagtacctcatgtgacaaacactgatggtgtgcaaccactttcttgtccagatggggagactgaggcccagagtggggagttagagatggaatcttgactgtctcccaggtctcttgcctcatggtactagtgagataggatggggcccaggccaatcagggtaagatgaccctggggaccactggccagta

SEQ ID NO: 13142 - DNA, 201 bp, Bos taurus
agcttagagacacagtacttcacacccacagactgcatgtctaggaactaggctggacggcagcagaggaagggaccgcaggggtgggagaaggtgtttctgattccaagtgacccattccacaagtgatgagcacagaccccacataccttctccttgtcactcgcttctctggcaacagtagaaccctgaaaggataag

SEQ ID NO: 13143 - DNA, 201 bp, Bos taurus
gttgcctcactccggggagccagaagacgcaggcaggataggagagaaacttggagaaacagttcaacaacgacctcccgagatctggtcccgggggcaaccggctaccactttcactgcccgatctagagcccacttccgggagggcgtcctattacagaaacagcgtcgcaggacagtgacgtttaatactagctgtcg

SEQ ID NO: 13144 - DNA, 201 bp, Bos taurus
aagttacacagtctatcctctagccatgtccccggccctcttctacctgtcctagggcaggctgctaagggagccttgccccaggggcctgtcgtgcccacgtctccttggtctgattttcctgagccccttctcagagggagccctgcttgccactgcagtaggggaggacggggttcctgcaccagggagagagagctg

SEQ ID NO: 13145 - DNA, 201 bp, Bos taurus
atagatatatgcagctatcaccaagttaattttagaacatcatcattacctcaaaaagaagccctgctcttttaactatacctctcccatccctctgtcctttatcacccacagcactaaccactactttctgtctctatagatttccctattctgaactttgatttgaatgaagttatatagtagatggtattttgtgac

SEQ ID NO: 13146 - DNA, 201 bp, Bos taurus
tataaaaccctgactcccgtgaacctttccagtttaggtcccaggttctagctgaaatctccacaccctctcccagccccacagacaaggccttacctccggttgctatggtgatctgccgcagaggatgcccgtagaaagggaaatcaaaggacaagaccactctctgcaggggacgggagagggtcagcagggccaaca

SEQ ID NO: 13147 - DNA, 201 bp, Bos taurus
ggggaccgcagcctgagtgttttgggcaacagacccgggcagaatgcgagcagaggtgggggtagggagaggctgttcagtggccactgggtggagattggatttcagtctccatttgtttgaagatccctccctggtgagcaaggagaaggctggaagcagagtcaaggctacaaggggccctagaggcaatctggtcca

SEQ ID NO: 13148 - DNA, 201 bp, Bos taurus
tggggactcaaagtttctttggcccccattggcaggaatgttcccatccccttttctcctttggtctggcttcataggagaagaatgtaggtacaggactggggggccaggtacctggaggaacccagcccattgtgtgtggggggggggagtgggggttggcggggagagaggcatactctttggttttccttctccctt

SEQ ID NO: 13149 - DNA, 201 bp, Bos taurus
gggcctcccagaggttaggttgcaagttaagaataggttttctgaccagaaacttccaaattactctcctgtggccccagagaggccttgtgcctactttcgggggactccttctgaccaaccaattcatacagacacttcccgagcaaaccttgccccagactagaggccttgtggggcaggccccagtttgtgacctgg

SEQ ID NO: 13150 - DNA, 201 bp, Bos taurus
ctcccccttctgagtgcaggttctctaagcagagctccatcctctgtgcgcccagactggtgctctactagttgactgttcagagttgttatttgaggccttgacctcatttctctcctttttgcagcttcttgcacgctcggctccggaccgccaccctgcggcacgacacagacgggcaggccacgctgctgaacctcc

SEQ ID NO: 13151 - DNA, 201 bp, Bos taurus
gaatgtccaagatggctggcttacacatctcatacgcagtgggtacagctggaaggctaggatggctagtcctctctctccatgtggaggcctccccctccgggtggtctctacaacagaataactgatttctcacatgggagtgttagggtggacacacaagactggaggctgccaggtcttcctaaaagcttaattatg

SEQ ID NO: 13152 - DNA, 201 bp, Bos taurus
agccattaaactgaaattaaacccttgttggaatcacttaattcagggcatgacaaattgctttcagtggaggcagcagtgaagtcccctcagggagagacggagattagcagcttccatggctggctgggtcccctcattgtcttggcccccttgctggctctgaattctgaaattggggtcggaaccatctaaagacca

SEQ ID NO: 13153 - DNA, 201 bp, Bos taurus
cagatgaagatactgagattcagagaggttaagaaatctgtgtcggccacacatccagaaaagtgatagagctgggttttaaacccaggcctggactttcgacctttaactgtttatatcacatggagttcaaatgcagagaaacacctgaggtccagagagggactgtgagttgcccaaggctcctgctagacctgctgc

SEQ ID NO: 13154 - DNA, 201 bp, Bos taurus
agcctgaccccccccacccataccccaagtagggcctgggtctcccccttggagtgggggctccctgaaagcagagctgtttctttgtcttaaactggggcaaggccttgaggagcttccttcccagaggcctcttgacagttaactccccactgccccacaaaggctctgagggaccctcccaatgtatggggtggtgag

SEQ ID NO: 13155 - DNA, 201 bp, Bos taurus
gcattaaatgtgtaaaaacaggcatggatacatacagctgattcatgttgttggacagcagaaactaacatatattgcaagcaattatactccaactaaaaaaataaaaatagtcatggaaaggtagatactaaattcaagatgggggtggaaaagggtgtcaatggagagggatttttaggagctgaatctgtgttggta

SEQ ID NO: 13156 - DNA, 201 bp, Bos taurus
gcccatgggcttagttgccctgtggcatgtggggtcttcctggaccagggattgaacccatatccctgcattggcaagaggattcttaaccactggcccattatggaagcccagctgttgatttctggaagaccgtagtctgcaatactgtttgtggtatttgtgaacacttgaagatttccttttcttttttttggcctc

SEQ ID NO: 13157 - DNA, 201 bp, Bos taurus
gtcctcttggattttccttcatacaaggtagacagtagattctacttagagaactcacagacatctataacccagatggtgatatgagcggcaggacccaagctcccatgtctcttgccattactaactcaatttgctggggagtctcgtctctgtctcttggaggttgacccctcagtttcttctgactttttttttttt

SEQ ID NO: 13158 - DNA, 201 bp, Bos taurus
gcagtccatggggtcgcaaagagtgagacacgactcagcaactgaataacaacaacaaatgctgtaaaagtagttagcgggcctgtgcttgtccttggggcggggggggcttatttcttccttccggttcctgtgattgggggagggacatctgctattagaaggtagcccactgtggcctccctcagaacctgatcctgg

SEQ ID NO: 13159 - DNA, 201 bp, Bos taurus
tctaaggtggtgataaattatgggattttttagttggattgaagaagcatgtagtgatgatgactctttctgatggccagaaaaagccatgcccttaccttaatagtttcatgagttgtgttttgttatgagtgtcatgagttatgtttttttagaaactagtttgggcgccctggatggtaggacattttgcaagttctg

SEQ ID NO: 13160 - DNA, 201 bp, Bos taurus
gctgggcacagctgcttaccggacaggcaggctcacagatggtggtctcatagcacacaggctgggcacagccgattacgggacagacaggctcacagatggtggcctcacagctcacaggctgggcacagctgactacgggacaggcaggctcacagatggtggcttcacagctcacaggctgggcacagctgctcgcag

SEQ ID NO: 13161 - DNA, 201 bp, Bos taurus
cttcccagttctttaaaaagagtccctgtggcccttggtgatcaaatgtgaaccaggttccgtaacaagaagtggtgaacacagagcatgaaagaggagagtatggccctccttctttcacctatgtgcacgaagttctctgcactgagtctaactttaggaatactgatatccacagccaggaagtctactgcagacaga

SEQ ID NO: 13162 - DNA, 201 bp, Bos taurus
gctgggactgcagttcgatctccagggcctgcaaggtgcgccggagctccgagatctcgctcttgccgctctgcaccagctcgctgttggtggccacctcgcggttcagttcctccgtctgcagacaggacacaggacagggcagcgtgagcctggcttcccttctccaaggcgacccccatggtctccatatgctcagcc

SEQ ID NO: 13163 - DNA, 201 bp, Bos taurus
ccctcaccactaccctccatgtaagtaagccccccgcccccccgctagcgtcccctcaagtctgtgtctcgccttagatggcatccaggaagggccacagctgggactcgagctcagggtcagagccgccttaccccatcctttctttcaacaaatgccagtcctccacacaggctcccgcctgggcctcacccaagcttc

SEQ ID NO: 13164 - DNA, 201 bp, Bos taurus
tctgagcaacatggatttagggagaaaagtttcaaacccagctcagtcacccccctctcccaggggaattttgggcaggttgcttctcactctttggccttgcctgtagcagaagggaattgatatctatgttgcaagacttttttttttggtatgttctgcatcttcattgctgtgcgggctttctctagttgcaatgcg

SEQ ID NO: 13165 - DNA, 201 bp, Bos taurus
cactcgatgcatccaggccttctttgctaaccctgacctttctctcaacaggcctgcattcaactctggcccgtttctttaagagctcccaagggaaagatccttgatccaagatccttgatgacgtcactgctttctacttctcttggttcaggctggcctttccatccttggaagacttaggaacctgaatctctttcc

SEQ ID NO: 13166 - DNA, 201 bp, Bos taurus
cgttgaggaggaagtttgcggtgtgggccgctgtgggcggctgattggggatgggccgatggcccagggccatgcccacgatggccgtcatgtgagtctcggtgccgaagacatggatggggatcccagtggtcttccctgtgaggaaggaaaagcactcatcacttgagtctcctaagaagtgcccgtggccgcaggact

SEQ ID NO: 13167 - DNA, 201 bp, Bos taurus
gagttgaagtccactgttggcccttacctataggaagggcctgtgagcgagatctagggtgctcaggcctcctgctgaaccggaacgtagtggcctctgccgtgctgccagagtcctcaatgccatccactatcctgggatggaggcagtggtcatcagtcccatgggcagagagtaagggccagagcagggcagagcagg

SEQ ID NO: 13168 - DNA, 201 bp, Bos taurus
cgggcgcgcgcgtgcgttgctgactcagcggcgattcccgcgagctccggtggagggttccaggttgacccccagtggcttggaccttttgaggatcggcgccatctccgggccttccctggatcctggtaccgggaggccgtgcttcttagtctcaacccccggaggctccgagaaggaaaactagcccgagctgggcgg

SEQ ID NO: 13169 - DNA, 201 bp, Bos taurus
gcggaccgcgctgccctctggacggtacccggcctcaccgcagcgagggcgcagcgcgagctgcttcctacttcgggaaaagctgagatgcccggggcccttgcagaaagctcttgggaggtctggagctggcgaagaaggaggggttttgaatgtgtgaaggaattggtgcggccccctctcttccgggcaccgaggcac

SEQ ID NO: 13170 - DNA, 201 bp, Bos taurus
aagttatgagcttcctctacaggaagcacagactccctggtggtccacagccacaaaaaagaaaaaacctgaggaggattctgccacttagggctctcacctgaaagggctcaaggtttccaagctccaagttgttacaggttttctttggggaattccaataataatcaatccttgaggaagattaactgggggaagaga

SEQ ID NO: 13171 - DNA, 201 bp, Bos taurus
cacctttgatactccgaggccacgggttgaccgatcccgtccatgcagacggtgggtggtacacccaatcagacagagcccgacactgagaggtgacccttcaaggccaagtaggaatcccttacaggaatgacctttctccggagaacggatgccggttccggaagtgacgggcactatggagtggaccgaccttctgcc

SEQ ID NO: 13172 - DNA, 201 bp, Bos taurus
agttggtctggccaacttccgggtaaggagacttactgagccttgcatcagggagttccaatccagaagtcaaggaactagctttttttttttttttttttaaactatttgtggccacaccatgtggcatgggatattacttcaccaaacaagttcaaacccccaacctctgctttggaagcacagggtcccaaccactgg

SEQ ID NO: 13173 - DNA, 201 bp, Bos taurus
aaatcctcaatgctggtgaagttgtagtaaagttggggcatgtatagactgccaggaaacattgtaaattggtatctatccctgggagagtgatatggaactgtgtgccaaaagccatgaagatatccacacccattgactcaatagtttctgggaattatttgaataattaaagcagaagcagaattatgtatataaaca

SEQ ID NO: 13174 - DNA, 201 bp, Bos taurus
taatcctttctaagagaaatggaaagaatttaggatcccaacctcaagtgccctgcccctcaaacaactatttttaatttccagagtacaggaagctgccgttggctgctgaatgacctctaccacctgagccaccctcaacttgacactggtagtggctgtgagcttgtggggcaagatgctttaaaacggaggttctct

SEQ ID NO: 13175 - DNA, 201 bp, Bos taurus
cccagtgcttctgccttgccctgggaggccaaacatttactttctctctaggttcctgaatgtgctcaggagctctacccagcaaactttaagagaataacggccatatggaagaaatggttaccaagagccaagcttcattagaggcttcatttaatcctcaactgagacactcatttcatagatgagggaactgatgct

SEQ ID NO: 13176 - DNA, 201 bp, Bos taurus
taggttaggagaagggaatggcaacccattccagtgttcttgccaagagaatcccagacagaggagcctggcaggctacagtccatggggccgcagagtcggaaacgactaacaaacacacactacatactccctttaagtcacttacaaatacacagttttgggccctccttgtgcatgaacaatgactagttctcccca

SEQ ID NO: 13177 - DNA, 201 bp, Bos taurus
ggctgcttcctttctcttggcctgaagaaacaggctgagactctgtgagggggtggggtggggtcgtggtggtgaggtgacctgcctcgtacaatgggcgcggcagcgaggtgttaggtgggccagcgaccactaaaagtagacccacctagtaatctcacacctgctgttcagtccccagctggtgatcctctgatgctc

SEQ ID NO: 13178 - DNA, 201 bp, Bos taurus
cagctgcgtctgcacctgaggggagacccgcgggtctcctaattcaacgggacacttgcctttcccagagactcagacttgcgagccggtgacctgcggccaagccacctccttgtcccacctctcagatccaggcagtcccggctgggcagggactcaggggaagactaatgggagacccgcggtaccctttctgccacc

SEQ ID NO: 13179 - DNA, 201 bp, Bos taurus
actcagagaccacccagttcaaactctgcattgcggagacggggaaatcgaggccaccgagaggtcaagacctgcccgaggccgcgaagcgaattcagtgcgagaagtcgacatgctcgccattgggagctgggctgtctgcagagggtagggagagggagctgcctgagcagagtgggggcgccttagtcctggggctgg

SEQ ID NO: 13180 - DNA, 201 bp, Bos taurus
ccttttagtaggtgccattactctcatgagcagctccttctagttaacagacctaaagataaatctcattgcaaaggttctacaatcagttttttattcaacttagtatcttttggacagtttcaaaacatctctatcatctaacatctctctacaactattcaagttgagctacttagttagtaagcaagaaaaggttgc

SEQ ID NO: 13181 - DNA, 201 bp, Bos taurus
ataccatttctaaaaaaaatttttttgatgaaaagtattactcatagtaaaagtcggcagatccaaagtttccaatttgaatcaaatccattattaacaggaggatcatacagactgaaaatttaaatcctgtctggctttcctatctagactaggtatgagccaagtttaaagttttctttgtcagctttattgtaccac

SEQ ID NO: 13182 - DNA, 201 bp, Bos taurus
gcaagattctaaaggaaccccacaaaggctgcaggaaagagttaaattacaaacaaattgtgagcgcctctcccggaaagaatggccaaagcttgcgaaacgggggatggggggagggtggtttccagtggctgagctggagcccagtgggaagaggagtgctggtctttgctgaagatttgggaaaagcctcctctgcct

SEQ ID NO: 13183 - DNA, 201 bp, Bos taurus
ccacagaatagaaatgatgattctcttctgaggctcccaacacagagggaatcctatgtgagtcacagaagccacacctgctagagcacccactccatcctgccaagctccaaaggagaggattctcaccaactcagggcagacctcctcttggagcaaaaacttgttgagtcaaaatgctcctctatgaaaatcttcctt

SEQ ID NO: 13184 - DNA, 201 bp, Bos taurus
tgacacaaaagccaccaattgtatgattccacttatatgaactgtccagaataagcaaatcaacagagacaggttagttagtggttgttagggcctatgcgcttcccttctggctcagctggtaaagaatccacctgcaacgtggcagacctgggtttgatccatgggttgggaagatcccctggagaagggaaaggctac

SEQ ID NO: 13185 - DNA, 201 bp, Bos taurus
atttttctccaggggctgagttcccatgcaggttgggcctgagaaagccccaagccttcagctcaggcctggccagcctccaggtatcttcagatggcccgatgtgcaggtgggagggtttccttcaactctcagattaaccaaagggaagacctttccaccaggcaggcaggcagggcagagcctgaagcagaagggcag

SEQ ID NO: 13186 - DNA, 201 bp, Bos taurus
ataaagatggtgtttgtactggccttgaaaagttggtaggacttctgacttcctttgttaggaggatagcatgctgtcaaggtcatggggccagttcccatcaggctgagaacaaggactatatgcaatccttgtcagggactctgcagatctgtggctgggaaagtctggctgagagaatggagacggcttggggccaca

SEQ ID NO: 13187 - DNA, 201 bp, Bos taurus
cttctttaaattgtccttgatagactggtatctttttcagagttcattccaatgtgtgaaattgctgccagcattgagtccctactcagaaaattactgaaaatggtctctgaactgcatcttatttgaccttggagttgccaggttccagtctagctcaccaaaccaacccagagtatatagaatttacatttccatctc

SEQ ID NO: 13188 - DNA, 201 bp, Bos taurus
cactgggcttggctttaggctttgtgccccatccctcaaggaccctgcttgtctgatgcaaactctgacctgaggaatcaagtctaaatccctgtgactgcctctccctgactctgggagcctttgtaggatccttctccatcttttcttcatatcagagtccttcaaggaccagctcagataccactcctctaggaagct

SEQ ID NO: 13189 - DNA, 201 bp, Bos taurus
cagagcaggtcacccccagaccccagggcaggctgcagtgggaggagaaaagcagggggcagagggcctttgccccctcaggccacatgtatttatcctccaaatgatcccaatggcaaccctgccacagtctcatgtggggtgagccccccggccctaccagttcttcccccccactccacaaggagaactctagtctgc

SEQ ID NO: 13190 - DNA, 201 bp, Bos taurus
cttgtgcatctcgttctgttgatgacatcaccatccctctcaggagtgtcctctcctccctcgcctgctcactcgagtcacgtggatcctgcctccataatgccctgcctgtggcctcccttcggcccccttttccgccagcacccccgtgatgtcccaccatttcctctcgcttcctgtcatttctattatgatccttcc

SEQ ID NO: 13191 - DNA, 201 bp, Bos taurus
ttcacagttgagcaaattgaagcccagaaggtcagagaggacagggaggccttgtggaggtctatgaggaggtccacaggggtgtcaggaagagagggccccctctgggtcccagagcccagcgtgcctgcctgcctgcccctcctccctcggctgccaagcccatccgcgtggctgggatctgctggcccataacgggtc

SEQ ID NO: 13192 - DNA, 201 bp, Bos taurus
gagcttttacaaatctagaaaaaaggaatacttccccagtaaaataaaaaactgccaaaaataaataaaataaaaaatgacatggccaaaattaactagcgaaccagtggaaaacctaaaaagactaattaccattgatgagcaaaattaataaataaaatctgccacggacagagcaccaggtccagaaggtttctcagg

SEQ ID NO: 13193 - DNA, 201 bp, Bos taurus
tggaaatgaggaattccaggctggctatctccctctgatcaccctcagggctgcactggaaatggactcgacccaacaggaagtggggcaggtgatgcctgggggctccaagggaaggcacctgtgcccaggccaagcccaaggcatgaggcatggctgctcaggagagctggtcccagggaggactcaacaaaactggta

SEQ ID NO: 13194 - DNA, 201 bp, Bos taurus
ctccgtggtagacccagaaagaccaagatattaaggcaggactttgagaatacacagcagaacaatcactcgtgagtcagcaatgcttccaaacagccagcgagatcctggaattgcttggtatcactgccctccagacctcgccgggttccctgtgtgagctgggaaatgtttgcaggcaggacacctgtgatcgctttt

SEQ ID NO: 13195 - DNA, 201 bp, Bos taurus
aatattaataaaagaaatgcaatgaatttatcaaacacaggaaagaaatcgaggaaaaacaaaattactcagaagtgaataatatattacaaagtgtccatggaagaatagattcaagttaatatttaataagaggcagtgaatgaagacaagaaaacaactaagacaataaaaataaagcatttacaaagaatagagaga

SEQ ID NO: 13196 - DNA, 201 bp, Bos taurus
cgagaggggaaggggttggccaaagcccaggctctcctggagtcacccactcagtctggactgctgcacgcatttggctgactaggaaggtggagccccccctttgggtttgaacctgcctgggcccagcacgactgccaaggatgcaggtggaagcactggctgagtctgtgccaggaatggggggtgagaatgggctga

SEQ ID NO: 13197 - DNA, 201 bp, Bos taurus
tccgattcctggaacccagatcccatgatctggcagccatcttgagggcgagtcctataagatcacaggaggtcagagcacctcagggcccacacatgctacagcccctctttgccttaaccaccccctcagggactccctgctggtccagcagctaagtctctgtgctcccaattcagggggcccgggtttgatccttgg

SEQ ID NO: 13198 - DNA, 201 bp, Bos taurus
ttccattaaaggggttggggtgagggtgctaagaaaagctgatggatcaaaagccaatagtcacagcagatatcatagcactgacttcccccaattatcacagaaaaccattgccctacaataaatttaggaataagcctggcttgcttcgattcatggggtcgcaaagagtcggacacgatcgagcgactgaactgaact

SEQ ID NO: 13199 - DNA, 201 bp, Bos taurus
gtatttctttagttctccctaaagcattctatgcttgcatcccaagatatatgtattgggaagcttgagaagatttcagaagatttgctttcccctcatggtccagttggacactgccgtggctgtcaccccctacccccatatttaggctgtgtgttaatattagttcatccaggctctgaattccctgtgtagtggcta

SEQ ID NO: 13200 - DNA, 201 bp, Bos taurus
tgtggcttaatccccattgtgagagatagactgaagatatctgcagtttggttgggaccagtttgcagttgtattgtgtggccaatcgaacagagattataattggcttctggggtgatcaaacctatgacccaaattggcttcacttgccctggggttctaaccagcagagctaatctacccaggtgttcactttaacat

SEQ ID NO: 13201 - DNA, 201 bp, Bos taurus
acctactcttcctgaacctattaagaagaggtgggaagaatacacagaagaactctgcgaaaaagatcttcataacccagataaccacgaatgggcaattgttcatctagatccagacagcctggagtgcaaagtcaagtgggccttaggaagcatcactatgaacaaagctagtggaggtgatggcattccagttgagct

SEQ ID NO: 13202 - DNA, 201 bp, Bos taurus
atccttggaacattgttaatagtgtctctgatgggaaagttgcagttaaagactttttacctaccttggagaaacctttgagtaaagaacaacttagaaactctgcaacagatggtgagtacctcagttacctctcaggtttcctctttagagtatacctgttcacactgactaaattttttaaaaaggagtgagaagact

SEQ ID NO: 13203 - DNA, 201 bp, Bos taurus
gcagagtgcctcataacatgtaaaggagatgttttgtcttcacagtccccaccctaccctctgctaccttggttttctattttccttgaacatctgcattgcaactttgcttttctccctcccattagggtttggtgcataacacttaactaaatcatttttattttaggcatgattttaatcatttctcatttcatctct

SEQ ID NO: 13204 - DNA, 201 bp, Bos taurus
tcaggtttgacagaaaacaacaattctgtaaagcaattgtccttcaattaaaaaataaacaaattttgtaaaaagaaagaaggccctggagaaaagcctggtatagttccatgacacatgatcaaaaaaactacaaaaccgggattttaatgcatgcctaaaattttattttcatagcagttatttccttattgatatatt

SEQ ID NO: 13205 - DNA, 201 bp, Bos taurus
tttgtaattccaggactgacccaaaaacatatttgctaaaaaacaaaacaaaacccacaagtactcaaaatccatgcctgtttgcttgtcaggctctgtaggtagaaataataaacaataggctggccccaaacataagtcctaaccccaaagcaccttccatctatacagtgcctcaagctgtggaacccagcttatgtc

SEQ ID NO: 13206 - DNA, 201 bp, Bos taurus
tgggttctttctcctctgatgaccttttctattcagttagtttcatttctagagagtatgtttctgtactgttcagtgcacagtattttgagaattcatacattttattccagagttaatatatttttgaaggacaagtatagcagaacgtaatgcttaaagaatgagatgagaaaggcagatttaatttcttgagccatg

SEQ ID NO: 13207 - DNA, 201 bp, Bos taurus
ccgctacagccgcagctcctccggccccagcgaggccaccgagaagaacatcctggtgtccgacatggaaatgaacgagcagcaggagtagagccgagggcgtgggcggggccgagggcgtgggcggggccgggggagctgggcgccccaccagctgcggtccagtcggcctatggggggaggtggcgccctggggagcgc

SEQ ID NO: 13208 - DNA, 201 bp, Bos taurus
caggaggtgggatttttttgatttggagagatgtagggcctaataagtagtcaggaaagaaaacataaacagtgaccgaggcctttcatttgtccctccgaggtgtggtcctgagccggctctcacatccagcgaggacatcccccacccggtcctgtccctgatgcctccctctcagggccagctctgagggcatggtca

SEQ ID NO: 13209 - DNA, 201 bp, Bos taurus
aaacacggcctatagcccaggatccatcacttatatatggtgtccatggcaaccaggcaatggtatgggatcccttctcactggggaattccttttatggcgcatttccgaaaccagcatggccagtacacgagtctgcagtttcccagttgcttagcaaccagctcctatgctctagtcactaggaacagcagacagtta

SEQ ID NO: 13210 - DNA, 201 bp, Bos taurus
tagggtatagttaattattgatgagattttagtgccttctgttgcagttcttgtagagaaatggagttatttgcctgaatgttgttcttagaagaacattcgccacataatctgaaaattcatactgattggcttcctcctgaatccagattcagctattgagggattgtttgcttcaaagacaaacctgattttgctcca

SEQ ID NO: 13211 - DNA, 201 bp, Bos taurus
ttctctatagactttgtaatgcctagaaaaggaagaaatagctttcttcatgccagttttgacccagtttgaaaacatcttgctgaaaagttgctctgatgtgtgaagtcagtttacctaggcctgaggttggagacatactctaggtatggcaaagtttctcatttttaagtaccataaaaggtcagatgtaacttggca

SEQ ID NO: 13212 - DNA, 201 bp, Bos taurus
gcgactatctccgcgtgtggagggtgagcgggcgctcgactggcctcgagtggcagctgtggactcacagagagcaggccggggctggaggccgggtcgccgcagccaggagaagcaagtggtagcgggtggactgagcttgttgggctcagcagatgtcctggtcagtctggcccagatttccttgaagtcgggctgcag

SEQ ID NO: 13213 - DNA, 201 bp, Bos taurus
ccccagccccgggttccccgcaaggcccaccccaagccccacaggtgcacctcatgtccggattgcgctgaaggcactgctccacaaagtggtggaagtggggcgagaaggtgcggtggtaggggtgggagggcgagtcgccgttggaggtcctgggggtgctgggggccaggctctcgctcaagcccgagttggccgcgg

SEQ ID NO: 13214 - DNA, 201 bp, Bos taurus
caaaatgtttctcagctttgccagggcattctgactcaaagaagtcacaaagcagtatcatttttgcttctcccagaagcccagggcctgtaaatctgaggaggactcatgaagaaaggggagagtgtccgttctctcaaatgtgtataaaaggacaaagctcactgtatatatttcagcaataatgatggaaagaattca

SEQ ID NO: 13215 - DNA, 201 bp, Bos taurus
acgatgaggccaaatgatattcaaacagttttacagccttgaaactgagcaaaagggattcgatggatgatcttaatgactccagtcatcaactagcatcctcctagcccacaccggccctgaccagcaacaaggcgaaggactaaccatgtttcctggaaaccaagagggagacagatgccacctgcaaccaaagacttt

SEQ ID NO: 13216 - DNA, 201 bp, Bos taurus
aggttcagggtggggaaaagaaacaccacagaaatggactcatattatgtgggaggagttggtgactctcaagtacatgtccttgccatagactctcgaatcaaccatctcctaatctgaaaggtagatctctattcttctccaaaccacaaatccgataagtgattgaacttcaccccagtaccaaaagccccagagact

SEQ ID NO: 13217 - DNA, 201 bp, Bos taurus
acggggtgaaaggcctgaactcggtggcctcgccagaccacaggcctggatttccatgtgttgtactgagtctttaaatcagcaaggcaagatgaaatcacccctgcctgctctgcctaagggggccaggaagtgccatgtggtttttagagatttttatcaggcgcagaagatgaaaaaagatcctggtgcctaaagggg

SEQ ID NO: 13218 - DNA, 201 bp, Bos taurus
tgctggcccccacttctgtatctcttttccccttaagtaggggaagtgggaggactcagctggctttttgggggtgggggatgctcagcttgtagtatgtgggatatcagttccctgacccaggccatgtcagtgaaagcccagaatccaaccactagacccccagtgaacttccccagctggccttttaataacaatgtg

SEQ ID NO: 13219 - DNA, 201 bp, Bos taurus
aaacccaggtcctcccacattgcaggcggattctttaccgtctgagctaccagggaagcccttaaagagattgagtccccccagtatatatttggaaaacaagttcatcactggaatttaaattttctctattttaaaatcagacttgtacatttacctcaaaaatctcttctctggaaacctcaatgcggcaatggccag

SEQ ID NO: 13220 - DNA, 201 bp, Bos taurus
ctctgaaacttgggtgttttccatcagcaagtattttagcaataaagccgtaaggtaattgacaaaagcaaagaaaaaagaatctgacaaataaaagtgaccaacgggactaacaaaagactatcaagctcaaaattctttaaacgtgccatgtctcttacctacaaaattgtcaaacactaaaaaaattgataatgtctg

SEQ ID NO: 13221 - DNA, 201 bp, Bos taurus
tgcagcccatggggtcaaaaagactcggacgtgacttagcctctgaacaacaacatagcccctattgtgagatctgagctgaatcattaaatgtctacctggagcttgggtgggccagtgtccaggactgggccctaggggaacccagggggcgccacaacctggatgctgcccttgggctgcccatggtagcaggatgga

SEQ ID NO: 13222 - DNA, 201 bp, Bos taurus
tgtatcttactttggtcacaggtgactgttagttttgtcaattccctttggggacacttccaccaacaggaagtggagatcttactgagttaagaccccattggtacacgactatcttcagcacttacttctctacaacttacaggcaaagctgcctctttccttctgctaatcccagatccaagggagaagacaatcctt

SEQ ID NO: 13223 - DNA, 201 bp, Bos taurus
gatccactgatcccccctgccgcccccaggctggaggaagcgcaggcctgaccacatccagctttgtgtcgcctgggcctccgctcaccctgaacctcagcgggcagaagaccccacagccacgaaccctgtccaggctggatgcctccagggaaggaggcaggacaagcggggcagtcattggtgctccaaggagggccc

SEQ ID NO: 13224 - DNA, 201 bp, Bos taurus
gggagccacagagcccaagcagggccaaaccttccagggaaggcaacaaaggctaattgctgagcacccttcaagtaaacccaaaggcgctgtacagagggattctcttaactcactctccaggccccctcccaccaggtcagagaagaaacctcaccaccacccctcttccaccaccctccactcatccaccctcacaca

SEQ ID NO: 13225 - DNA, 201 bp, Bos taurus
ctgaggttccctgaaccctgccggggccttggcccaggctcctcccacccagccatacccaggacagtccaggggagattgcggtccctgggatgcaggtcccaggcctagctcggtctcacaggctctgtagaaggctgggggtctccaccatgtcatgccaggccccaggcatgcctggtgacaccagttcctggcact

SEQ ID NO: 13226 - DNA, 201 bp, Bos taurus
tgtctgtttgtggccgtgcagaacctggaggactgggaggtgaggctgatgcaggaagggtgcccaggctttggggctcctgggtttccctgcagggctcgtcaaaggaagaaagattccaggggcctaattccctcaaccccatcctgaaatgtgagcccagtggtctctggccagcttgacttggcccctggacattgc

SEQ ID NO: 13227 - DNA, 201 bp, Bos taurus
ctcccccctcctccacccaacccatgcctgggctcctcctctgggcaggagtgccacgctgcagtcacctgggagatgccccagtatggggtcctcggccaatcatgtctttggaccatgaataagaccctcttggaccctcttttctttggaccatgaataagaaccagtttgagggaccttccaggaagcacctgtgga

SEQ ID NO: 13228 - DNA, 201 bp, Bos taurus
tcccagttcccgggccccgttatcccatcatagcctctcctacgtgtggggtctacctctgccttcccctgtgagtgcccctggcttccccctacctggagctgatgtcttcagagggggccttggcagagaggtgacagatttcgcccctcttgtctgtaccaccagccagctgcacaggcgtgagaccaccctctaccc

SEQ ID NO: 13229 - DNA, 201 bp, Bos taurus
acgactgaagtggctgagcgtgcacgcatgccacacgtggaccagtctcatcagttccttctgtgttccctcccctaaaacttcctccccaaagggccagcccctgaacccccatcccatatctaaagatggcacttcaaaagaggcagaggctcccctctgggctctcattttcctaggcctccttgcacctgggcatgc

SEQ ID NO: 13230 - DNA, 201 bp, Bos taurus
tggcgccagctcggggtccccttgctgctggcttggggcccctcgtccctggcaaggtggctgccaccagcgtcatcacaatagtaaagtccaagacggacgcccggtcgtagggacacacttggccaggcgggtctgcaaggggccagtaggcgcatggcaaattcggcagccctgtccccttcttcctccctcctcttc

SEQ ID NO: 13231 - DNA, 201 bp, Bos taurus
gaaaaatcctggacaccgggcatcaaggtctcaggccaccccctacacctgtctcctctccaggtggctacatctcccatgggctccctgatgggatctgcgccctgaaggctgggccttacacacacacgtgtgcgtgtgcatgtggtatgaacacactctccttacggaatgccctcctgaccccaccagcactatgct

SEQ ID NO: 13232 - DNA, 201 bp, Bos taurus
aaaaaaatgcaaacatggcaggccatccacctttgactgtacaggaggactggagagttgtgtgatggaaggacttgggctcggtgtcatgagacaataccgcagcaggcccagatggcccagagggactgtcacagacaaccctggatcctaatatatccaatatgaaggatcattaagcaaaaggggcccatactatgg

SEQ ID NO: 13233 - DNA, 201 bp, Bos taurus
tgtaagcttcagctcctgccaaactccccactagtgtcgggtctcaccctcaatctctgtcctcagtccacctggcatgacctctgggtcttcagacacatggcccttctgtctggagggctccttgcctggtctcaccagcttgggctctctcaggttcaaacttccattccttgcagaggccttcccagatctcgtcag

SEQ ID NO: 13234 - DNA, 201 bp, Bos taurus
taggcacgaaaactctgacaagtgtgggggctgtcattactggttccccagtactggtttacctgtggtagaacttggccatcactcaagatctcccccaaaggatggttttattaatggagactcaggtcagcaccacaggctctggaccctcaaagagcaggtttgacaggcccacacatatcaggacacggcctcagt

SEQ ID NO: 13235 - DNA, 201 bp, Bos taurus
caaacgagctaagacttttgaatacatgcacaatagctttcaattttgccagcatatggggtctggaaagaacaggaaggaggggtgtgagaaggggtggtgaggacgagtcactaggtttcatctcacccagaccttagctacacctcagtggaaccacctgtcagaaatcccacagtctggaagccacaggccaaggcc

SEQ ID NO: 13236 - DNA, 201 bp, Bos taurus
caacttctgctccctgtcccagatatcccctgtctgccaccaggccacaggggtactgagcagtgggagaagtgcctcctttcaagagctggatttgctgttggctattgttgcaacaaatgctggcccaggactctttatcgccctcatgtggacacgaatagtagtacacctactgcccacaaagcgctccaacaaatg

SEQ ID NO: 13237 - DNA, 201 bp, Bos taurus
cagttcacggtggtttgttacagcagccctgggaaaccaatagtgtgggatcacatgacagcccctattttagtccctgggaggcccagcgtgggtgctggtgtctgaagccagagaaatccagggacccccggagactggcagagagcgggggtgggtcagggccttcgtgttctgttaccgttcccgtgctgactctgc

SEQ ID NO: 13238 - DNA, 201 bp, Bos taurus
ccctgtgctttataaaacgtgttcttaggtctatctgagtcccccacaggggacatagccagggtttctagggatgggaatcagaggggctcttgaagccgccctgaggcccactgtatagtcatcacaaccccaccttgagggcagcaggcctgttgtgcccaggcagctctcctcccaccatgacccctgctaacctac

SEQ ID NO: 13239 - DNA, 201 bp, Bos taurus
attttagctgctgttgccgcgggcgtcagatgttaggatggtgtgggacaggacagtgggagagtggaagggcaaagccaggaacaggagatgtgttttctactgggcaaggctcgtgtgtgtcccctgggcaggtcccagacctgtttccagtctgcatctacttctgtgatattgggccttagttttcccatctggaat

SEQ ID NO: 13240 - DNA, 201 bp, Bos taurus
cgcctgcttgaaggcctgtttcccaacccttcaccccctgacctcaacacaaatgaatgggggtccaggacagtaggcccatagccaccaagtcccacaccaggaagtcaaggtgcctccagctcagcctggctactcacacctcacagtagggcccaccgtcactctgtggccatgggaggaggcaggatctggcagaaa

SEQ ID NO: 13241 - DNA, 201 bp, Bos taurus
agccaaagtcttctgagcaagggaaagacttgcctggagatgccagctggcctccttcccccaagcctgcaaccctcctgccaccacttttcactgggccagcagagagccagcacttgggggtaagccgccaaatccagggcagtagccacccaccttgagcttggagtgtcggctgcaggaggacatcacggtgtgctt

SEQ ID NO: 13242 - DNA, 201 bp, Bos taurus
aggcaggcaggcagaggccagaaaagccccagacacagagccaggagatgagggcttgattctggctcgactgctggttggcctcagggaagccccttaactgcttcaccttgaaaatgaggattaaaaatatctgttttatctaatacaaaggctgtggccagattaggcaagtgtcaaaatgctctgtgaattctgaag

SEQ ID NO: 13243 - DNA, 201 bp, Bos taurus
cttctgaccaaggaatcatccactgggtggacgcaccctgttttgcttatccactcatctgtgggtgggcacgtgggctctccccaactttggccattgggaataagctgctatgagcatggatgcaggagtgctcccctttaagacatcctcaacacgcgtgtgcattgtgggggggaaaaaatgtgaggcctctcttgt

SEQ ID NO: 13244 - DNA, 201 bp, Bos taurus
ggctgggaaagaagaagggagaggagagaggacgggacaccagtcccgagctgtggtgcctttggagctggaaacaagcacacccgggaggccaagccaaatgccagctgctgagctcgggcagcccttgcccatccaggtgctgactcagcgtctccccgagtctgcccctggaggtgccagcagcaggggaagatgtag

SEQ ID NO: 13245 - DNA, 201 bp, Bos taurus
ggcccaacaggcactttgctatcggatccaaaagactgagcgtgtttagcctcaatgaacagacagacagaacacaaggaaagagacctggaggggctcacacagacctccaagtgcccggggccctgctctattccaacacctgcagttcactaggacacagacagcttgcaggtatggttggggttgacaaccacatga

SEQ ID NO: 13246 - DNA, 201 bp, Bos taurus
cagcctgaaaaagcctgactgaccataggctatgggaggaggcgggcagggtaggactttcaccatcctcaactgcgtgagcaggatggcaggccagtcaatgtgctcatctgctttcccagccaccggtacgtacacattggagagaaagggaaaaaagccccagagtcccatcgtgtgagatccacagtgatccgtgtt

SEQ ID NO: 13247 - DNA, 201 bp, Bos taurus
aaccctgagttcgggcggtttcccaggtgattccattgcgcagccaccgggagaagcagtgttttcaagacacccgctccccacgtaaccggtgggcttgttgaagaggactcaggccctgggggtgggttctccccaaataagtaggaccaaaatgaaaggaaacacaggagggctccatagctaaggagaattggctgc

SEQ ID NO: 13248 - DNA, 201 bp, Bos taurus
cagctatatggggtaaatattctcattcacttccaaggcctcttttttttgggggggggggctacaccatgcaaccagggatcttggttccccaacagggctcaaatcctggctcccaggcctaaccatcagactgccagggaattcccctcaaatgcctcttcccatctgagctgcctcacaataattttaacagaagat

SEQ ID NO: 13249 - DNA, 201 bp, Bos taurus
agaccctggaagggaggatcaaggtgccggcaggggaggtgtctggcgagggtcctccccgggatggcagagggctttctggctgggggctcccgtggcctctttgggtttgggagcagctctccctctctctagggagacgaaccctctgtgtctcttcaaacaatcctactggatcaggactccatccttctgacctca

SEQ ID NO: 13250 - DNA, 201 bp, Bos taurus
cagccccctggatttggcacagaagcttgtggaatgcgtgttcttttctaggctccctctttctggagcagcacccacccactcactttacctttccaccgtgggcacatcctgagagagctccatgtttagagacacacgcaggtgtttgggtgactgcacacactggctccataaccttgaagtggtattaagggaaca

SEQ ID NO: 13251 - DNA, 201 bp, Bos taurus
ctgccccaggcccactcttggcatctgtaatgaaaatggtttccgcattccgatcctcatctctggggtgtcactttgaggccatgcaccccaaggtgccacagaggcaggacccttatggcatcaatgcctcttgtatccttgatgaccctgctcccatcttcctggggctcaaaggcctgcagaacttgaacttgtggg

SEQ ID NO: 13252 - DNA, 201 bp, Bos taurus
agacacagccttgggtctttctcctgcagcatcaggtagcctgcatcgccatatattcttgcattcgttctccaaattcctttctggttctaaagttctggttccagatcactctcagctctagctgacaatcagaatcatttccagagcttcttagtagacagattactggtcctcgcttcctagagctcctgtcaggag

SEQ ID NO: 13253 - DNA, 201 bp, Bos taurus
ctactctctgagagcaacctatgctccaggaggacaaagactgcatcctccaagtgttgagaaggtcaccacaccgccccacccccaccccaggccacccttccccacgcacacaccaccagaggctctgtggttcacacctttgctgagaggggatcgaggctttcttagccaaggccgatggttggatgcatctctgtc

SEQ ID NO: 13254 - DNA, 201 bp, Bos taurus
aggatgatggctggggggcggggggggttggaggggtggacacatgcctgtatgcaagcatgcttccaggggtcctgcacccagacccccagggatagaaacaggacacagggcccctgcccccaacacacacagagaagaagcccaagagacacactcgcaggccttatttctcctctgcctgcctgtaggtgagtgcct

SEQ ID NO: 13255 - DNA, 201 bp, Bos taurus
tccagcctctgcccctgtgggggcgagcagctggggactcttgggggaagcttgctgcacagttactaggtccgacccacatggagccttcctgccgtctgtggggccaagaggaacgagggttctggacaccagagtcctccgtcgtctctcaccgcctgtctgtctggtctgcagcccttcatgtacggggactacatc

SEQ ID NO: 13256 - DNA, 201 bp, Bos taurus
ggggaatccaccacggtgaaaagccccctggctgcaacgagcaagcagctcctgctcaccaccactagaggaagcccgccccgtgccacaactaaggcccggagcagtcaaataaagaagtaaatgctgaaaagaaagacgtagtgttgaagtcttctgagcgttcatgaggtgaatgaagagtgagaaaagacagttggc

SEQ ID NO: 13257 - DNA, 201 bp, Bos taurus
agccaattgccctgagaccccaagccgtgggctcagcagcctctgtaccaaggcttgaccgcttgcttccagatgaggactaagaactgaggcccacctcactgacccatctcacgtaccctcccacccctggtggggatcccccgactccttcagaatagcgagggcatcccggcagggcccaaggtcactggctattca

SEQ ID NO: 13258 - DNA, 201 bp, Bos taurus
ggggtttcccaccagccgccaggggtgggtggtctgagggcagccatggctgggggcagagccgtctgctgcctcactgttttttctggaatttgtttccgttcacctctcctttccctctagagggggcctctcggactggaactggagaatgcatatccacttgggggctgccgggtgggctgggaacaagacccctgg

SEQ ID NO: 13259 - DNA, 201 bp, Bos taurus
ttggcttgttccctcaacaccctcctggggggctggagaaggagatgtgtggcctgaagattgtaggccccttcgcccctaaaaccctgaagtagggaagagggaagcaagtttagcgcccagcttgttcaatgagttttttgactaatgagtccaggtggtgaggggctccagggcctgaccccccctacgccctctgga

SEQ ID NO: 13260 - DNA, 201 bp, Bos taurus
gagccagagtcttaaacataagagtaatgtcatgctggtaggggccttgggcatcaagtttttggaggaggagagaggtccaggttggggctggacttgcgggaggcgctcagggaatctggcctgcacatgcggattctgactcctggtgtggctctcccaacttgggctctgatgggagaaccagcggggcagggtgtg

SEQ ID NO: 13261 - DNA, 201 bp, Bos taurus
cctacaggttgtggccgtcaggcgcctggggctgtggagcctgcctgcgagtgaacaagcagccgagactccaaaacgtgagcatcagcggaaactgcccatttgaccagggaagtctgggccttgtcttccctgcagcagagcccccaggctttgaaaggggcggtaccggtgccaggaacaccgggctgagagcggcat

SEQ ID NO: 13262 - DNA, 201 bp, Bos taurus
tccaactctcccactctggtccaggccactctcaacacctgctgtactactgcaacaactcctaattaggaccctgttttcttctccagcaaccccccagcccaccaatccaatctgcacagtggcctgagggatcttttcatagcatgacacacatcacatcactttcctgcttgaaatccttgcacggcttcccatcat

SEQ ID NO: 13263 - DNA, 201 bp, Bos taurus
taactgagcgaccaacacttcacctagttcatttgaacagtgatgaagcgtcagtcgaacactacgttagacactgatgtataaagatgaggcataaacacggctcctcaccatcagaaacttacaccttggacacaggatgctggacagaaggggcaatgggggaggtactgtgggccttctaaagaggtcacgtagata

SEQ ID NO: 13264 - DNA, 201 bp, Bos taurus
gaaagtctgcggagctgggaaggctggttccctcggaggctggggaagagcctgcacacacctctcccgagcttctaaaactctgtaaagctccaccagtccatgttataaatatgcaccactcctttcgcacgctagtttaatatctgttacttcatagtttttaggggtcacctgcctacaacttaaggttttcagagg

SEQ ID NO: 13265 - DNA, 201 bp, Bos taurus
cctctgtcacccccacacccccaggcctctactgcagcggctgggtgaagcggggacccacaggtgtcatcaccaccaccatgaccgacagcttcctcaccggccagattctgctacaggacctgaaggccgggcacctgccgtctggccccaggccgggctctgcattcatcaaggccctgctggacagccgaggtctgg

SEQ ID NO: 13266 - DNA, 201 bp, Bos taurus
caggagaagctggctgtttggacgtgagcctatccctgctccctccagctaggaggctggctggcgcgtctctactcatcgtcctcctcagctctaaatcgccaagtcgtagtaagaaacataggcagaaactggcttgctggcttcagaacgagctacctgctcggtcctgacgggtggctctgaccttgaggggtcatg

SEQ ID NO: 13267 - DNA, 201 bp, Bos taurus
cggcatatacagctctgatcctagttagcacagagtatttaagaacaactcatattatccttagaactcctgagaggctgcgatgcttccttgaccacaggtcattcccagactttttgggaaatgaagccaaaaaaaaaaaaaaaaaaaagagcaagggagagtagagacctgaaattgacagctggggcatttccttaa

SEQ ID NO: 13268 - DNA, 201 bp, Bos taurus
cctcaacctcgtgccctgtccagctcctcagcctcatgccctgcggtgcttccctgagttccagaaagaccggctgacctcacgtcttgcccgaggggccggctcacaccgtgggggtgtgtctgccctgctcagtggcaggattttaagatgtagtctcttatttctcattctgtaggggggcagggagccccacaagcc

SEQ ID NO: 13269 - DNA, 201 bp, Bos taurus
ccgcggaagggggcacccttcgtagtcccaggtcccagccagagcttgtctctgcactcttgggctcaaggatgctagcgccccctctcacttgctctcatagctcaggaggccagaaatgaaaccaaggtgtgggcaggttggctccttcttgggactctaaagtagagtctgtcccaggccagtctcctcacttttggg

SEQ ID NO: 13270 - DNA, 201 bp, Bos taurus
tctcctctacaagcatgtctcctgctccctcgcctggctttccccaaccatcccaaaggacaccaagcggaactgggacttgtgagcctgatgagatgatgcctggtttcagggcctttctgggcttccgtcttcttatctgtaacctggggatgatggtacccatctgacagctttgttgtgagctttagaaataactgg

SEQ ID NO: 13271 - DNA, 201 bp, Bos taurus
tggagggtgtggcttgctgtctttagctagagttaggtgtctttaatttgacttggcttttcaggctcttaaatcacttgaagacacttgaacgtaagcctctggggccttcttgtatcttaaaggtctacacgtgtctggcacatagtaggccctcagcaaacacttgggtgtgagcacctcccccagcccacacggttc

SEQ ID NO: 13272 - DNA, 201 bp, Bos taurus
ccctcctccagagccgtttctggtcactccctcctaccggaagagcaggtgctcaggtagctttaccgggaggggaagtgggtcaggtagatacacccctcggatgcacaaggccctccatctgggggtgggtgggcagcatgacgcaggatgctgaggctggaagatgggtaccaccacgggacagcctggcttcgggcg

SEQ ID NO: 13273 - DNA, 201 bp, Bos taurus
gtgcatctttgaacccagtggggagagaagatgctgggggcagaagcctagtgttctccccctgcagggcctggagtccgtattgagagtcctgggcccatgccgcttagaccaccctctgtatgtctaagccgagaaaggagcaggcccatcggcactgcccagcccaggaccttctcggaggctcagtccagcctccct

SEQ ID NO: 13274 - DNA, 201 bp, Bos taurus
cttggcactcagcagcgtgacctcacaggccgggacctccgggataggcactgcctggtgccacagacacggtccccccctccccgggctgcagctgctgctcctggcctccctgacccggaagttaggaggatttgctgttcctgtagaagattagtcgcaactgtgaactccaagtgccgtaggggagaggggtggggg

SEQ ID NO: 13275 - DNA, 201 bp, Bos taurus
ctgagggcccttttcttacaggctgcattattcaaccagcaaatgaagaaaggaaaatgctgattgcaacggattaaaaaaacagtcccgggcgtgctcccgggtttggctaggactgactgtggccaggtccagggacaaccgtctttgttgcagggtttctgtccctttaccccaggcagagacagctggaggatggtt

SEQ ID NO: 13276 - DNA, 201 bp, Bos taurus
gcccacaagtctttcccaggagcgcctggtaggggcccgtgggcagcagcctgtgagtgacgggagctcccatcttatcctgttgctccccgctacttcaggttgagatgctaaaccacacttggccagcagttcgtgaaaattttagcagatttttcttactaattacgcagcggtgatacagcacctcttcctcccatg

SEQ ID NO: 13277 - DNA, 201 bp, Bos taurus
catcgtgactcgtgggtcagaaatctggagaacgctcagccaggtagctcgcacttgggtctcttaggcggcagcaatcccttgtcggccagggagcgtggtcatgtgaaagcttaactaggttggacgtccgaggttcggatgcgttcatgtgcctcccacttgactgctgctggaagctcagatgggctgttgaccaga

SEQ ID NO: 13278 - DNA, 201 bp, Bos taurus
cttcctgacgtgctggacccgatgaagcctctcccggcccagcctgccccgggctttacattcctcccaaagctccacccgatgccagcacctgtctcctcggggacagtggccccagaggaatgaatgtctggcttcatccctccccaggcctgccctctgagctggggcttccgggccaggcttctgaatcagctccgc

SEQ ID NO: 13279 - DNA, 201 bp, Bos taurus
tccacccctgtcaccccctaactctgagacattgggcgtatgacttaaccactctcaacctcagtttgctcagtctgtaaaatgggccaataaaactcagcggatctaagcgagacgaaaaatgtgatcagcagacagcaccaccccagcatcttgaaacacgtttcttcttcgctctctgccttctgaccaggagcctga

SEQ ID NO: 13280 - DNA, 201 bp, Bos taurus
aaggagcccggtacagctgtgcccagcttcgccctagcaagagggcagcgatgctggctgcaaaagaatcttccagaagtgccaggggttctcccagagagagaagcctctcagcaagtaagcggactgctcatcgctttctaatccaccggtttagtctctctgaattttccatctagagtcctcttcccggccccaacc

SEQ ID NO: 13281 - DNA, 201 bp, Bos taurus
catgaccagttgctctcgccatttcgcaaatctgcaggaaagcctacctccacctgacaactctgacttcttccaggtcatctgtcctgggagtctgcccagctgtttcgattgggtcagctgcaggcattccccgcgggggacaacatctcctcgaaggtgcttgtggcaggtgaggtctgcagaggttggaagtggagc

SEQ ID NO: 13282 - DNA, 201 bp, Bos taurus
acagatgggcccctgagcttctcgttggcctggaaaaatgaaaggcggagaaaatcgtcataaaaaacggaaacagctgtggcaggactgcagcagcttggggggcgggtcctggcccgaggggctcgcagtctgtcaagactctgctcccaggaggaggggcatcaccccaaatcgctgcccacccagcgtcatcagatg

SEQ ID NO: 13283 - DNA, 201 bp, Bos taurus
gtttagattctaacatgagggccatttccttcgtaggtgggactggtcagaggttagcatgagaagactgctgagacctgcccgccaggacatccagggcacctcacttgagagccctgccttgggaagtgcttctccatctgtattagcatcatagcatctttccatctgcatttatgatgtgattcacttctgagcagc

SEQ ID NO: 13284 - DNA, 201 bp, Bos taurus
tcctcaaggcctggaggcctctccagccagcccttgtatcaactaacacttgttcagtgttcagtctttgggtaaaaatcaacatcttaaaaaatttcccgcaggccccacgatagtccattaattgtctgccatttttaatatgcacttttaggtttaaattctcggcaggttggttttctgctgttttatatagcactg

SEQ ID NO: 13285 - DNA, 201 bp, Bos taurus
tggcttgagcttccttctgtgaagacttttgggtgattggaaaatgtgagagagctttaccaccaccacaagaacatctcttcggaatgaggaggtgctcggatgagctgctgtatcattctcaacaccaggagttttaaaactgcttttgtttcttacaaataaagggctcatttccccactgtctctcctccacccatc

SEQ ID NO: 13286 - DNA, 201 bp, Bos taurus
ggctgcttcacagacatgggtgatgcgtaggccgcttgttgaagggtgctgtattaacattatccaggggcatgcagtgtggtaaccaatggtgcaaatgtgcaaggccaacctattagaggcttatttgtcgttcctgccaagtctagcatgatggtcttgattgggtggtcctcctggataggtttttctccaggtggt

SEQ ID NO: 13287 - DNA, 201 bp, Bos taurus
tgcccctggagacaaactttttgctcagaacctggcctctgggcttcttttggtttgtgtgaggcatctggaggaaagccctgagggaaacgtggtgtcctgggtgagaaaggtggttagcccgaaccccaaacacctcccactgccgcacgctcctgagcagaccagcgctcacccttaaatgccaaacatcagaacgcg

SEQ ID NO: 13288 - DNA, 201 bp, Bos taurus
aagcagtaggttgcccttaaaagtatacattcactttccaaaggcaggtctattgatttttcaaacactattttagctaatgcaggagtggcagtagacatgggttcagtccctgggtcgggaaattctctggaggagggcatggcaacccactccagtcttcttgcctgggaaatcccatggatagaggagcctggcagg

SEQ ID NO: 13289 - DNA, 201 bp, Bos taurus
aggtagtgaggtggtttgaattcaagaatgggtttttctttccactaatttttcatcactgtttcttctgaggagcaaacattctattatttatggaaaagaatgcttggatttgaaatgttgagacctgactttaagaccaattttgtgtgatgacaggttttctctctagttgttcagtatctgggaaaacgtgagcag

SEQ ID NO: 13290 - DNA, 201 bp, Bos taurus
ctcttcaactgaaatgaactttgagagagaaagaagggaaagggaaagattttctgcaaacgcaaagaatactttctcactgccctagactgatggctttagccaccggcataatcctctctgggtatgctgccttttttccaagataattagttctattgacccacagaatttaatattccagaatgatctcctaataga

SEQ ID NO: 13291 - DNA, 201 bp, Bos taurus
gcagacacatttccaagataggaatgcaaatggccaccatttaatccccaactgactcccgttctccagcaaataactgctctgtgtggtggtgttagtctctaagtcctggccaactcttttcgacctccaggactgtagccccaccaggatcctctgcccatgggatttctcaggctagaatactggagtgagttgccg

SEQ ID NO: 13292 - DNA, 201 bp, Bos taurus
ctttaccatctgagccaccaggggagcccagaggtataggtaggctgcacctgtggaagaagataaagtgaaaacagatggagctttagacttttatttttgtttcactgaatggagtagacagaaaatcaaaaccatttcctcagtgttcgctttctgatctcctctgtcaccttccaccaaaatattaggacagacagg

SEQ ID NO: 13293 - DNA, 201 bp, Bos taurus
gggagcacatatttagggagaagacggccatgcctttctcggaaccaaatctaatgtgtgggctgagaggcaatgggatggccagagcccagaggtcagtggtcatggatttgggattgtccaccagagtgggacaccagctgtgcttggagggaggccccccagcgaccatggacagccagggattcagtggggctgagg

SEQ ID NO: 13294 - DNA, 201 bp, Bos taurus
catttataatagaacagggacttcattttggattctcaaataaaacatcatccgcaccgtccctttttttaaccctcggctctcgtctggtgtatcttaacgtaactctcttgttcagcatctctgtctgtctcttggccacttgctacaagacctcagccagcatttcctgcagcgctcagtcatgccacggtaatagtt

SEQ ID NO: 13295 - DNA, 201 bp, Bos taurus
ccagactggcgagaaagcccctgggggcaagggtggtagagtccgctcaccccaggccgcgcgagacaggcttgaggctgccctcggccccagctcagagggacaggtcgtttcaggttccagcaagcccagtccggtcacaggcagcaaacagcacagtcagaaggagtgagtgactctgccgtctgtgtgagtgtgtgt

SEQ ID NO: 13296 - DNA, 201 bp, Bos taurus
ccttgtgggctacagtccatggggttgcaaagagtcagagacgacttagtgactgaacaacaatgacaacatttggaagggacaggaggagaattgtgaacttatcattgtgtaacctgctttttatgaagatgttaaataatttgaatattttaaatagagagagaaggcataagaaagaagccatgagttatctgtgga

SEQ ID NO: 13297 - DNA, 201 bp, Bos taurus
ttggcagcgggttcttatccattgcacccatccctgaactgttgtttaagccgccattccttttactccctgaccgcttttccttatttctgcgttccctcgccttcctaattactaactgctcgagtctgctccttggagctcagaatgcctaggagatcaacggctctttctgcaaacaagaagtgggggtacctgggg

SEQ ID NO: 13298 - DNA, 201 bp, Bos taurus
gctggtttcttgaagaaaaaggcccttatagattaaggatgatttgtagatcaaggctaatagacccaggataactacactgttatgcttgtctcagaactggccaaagaatgctagctcctgatgctgggtctgaggaacccctaagccctcccagacgggttgcactgtctgctggccgctctagcgctcaaggtggtg

SEQ ID NO: 13299 - DNA, 201 bp, Bos taurus
agggctctcctcctcagtcccgggcagagacgacacagccctgacgtctcgggcctgctgtcccagggcaggccccagttcccactcccagctccacctcgaacggcctcctgcacgattccaacaaacgaggcttgtttgtttcctcatgtgtgaaacaggaccatccagctgaccccccagtcaggtcgggtttttctg

SEQ ID NO: 13300 - DNA, 201 bp, Bos taurus
gttcccttttctcgacaccctgcccagcaattgttatttctggactttttaatgatggccattctgaccagtgtcaggtggtagctcactggactcgcagttgcatcaaagctcagccctctcattcccgccccacgtccccacctcctccacaagtgagcccctaacagcacacaccaagggacctggtcacacgcatct

SEQ ID NO: 13301 - DNA, 201 bp, Bos taurus
ctccacctcggtgtctccatttcttctctctaaataggaacctcgagcctgtcttacagagtgaagtcagaaaaataaatgtcctttgttaacgcctgtgttttttctcctaactctccaagagcgggtccctcaggattcccaccgccctccccgcctccgcacagtgatgtggcaacgagggtcccgtggggatgtcat

SEQ ID NO: 13302 - DNA, 201 bp, Bos taurus
ggtgggccagtggttaagactccacacttctcacactggtgcaggtgtgatctctgttcgaggaattaagatctcatatgccacatgttacagccaaaaaatacaaaacaaaaagctgccacgggcccttcgtgcaggggctgaaaggccacattcgtcatttcccaaaaggctccacggggtgctgcgtgagacggacat

SEQ ID NO: 13303 - DNA, 201 bp, Bos taurus
gagggtgcgagcgcatccaggctgggcagtgcgcaacaccgacgtgctgggagaacctggggatggagaactgtctggcctggggactcaaggggtccaccgggaaattctcatgttccgaaggaagaaaccacaggtccctccccagttttgaggttttggaagcgtgtctgcttctggactccagccacgggccccgcc

SEQ ID NO: 13304 - DNA, 201 bp, Bos taurus
cccctccagcatggccctgccgacacctcacgtttgaacttcaggcctccaggacagtgatagaatggatttctgggattttcagccatccgtttgtggtgctttgtgacactggccctagggaactagtccttcctgtggtgggcacggcttttccccttccacatcagacctcgctttccagcctcctcacatcaggtg

SEQ ID NO: 13305 - DNA, 201 bp, Bos taurus
ccagctcatggacctggcaagtgcctggttctgacccagttctctccgtgaccctgtgcaagctccctgcatctgggcggctctgttctcccacctgtaatctggggccagtaaggatctacctctaggcttgctgggaggattcacgggttcagagtcggtaaacacccctcaacgagcagaaacattcttcagaccgcc

SEQ ID NO: 13306 - DNA, 201 bp, Bos taurus
ggctctggggggcgcggtcctgcctctgcttcactcctggtcctctgagatggctgctgtctgtcagtaatggcttcatatttttcacccatgggacagccgttctgtgaatcaacaagggggcatgcctgcgatgctgctgatagaggcagccctggaggcaggttgtggttgagtgccttgccggtgacagtcggaacc

SEQ ID NO: 13307 - DNA, 201 bp, Bos taurus
tcgataatgctgctgttgtgggccacagcctcatctgtccccacatggagcaaagacacgcgcctgcatcgtcttccctcggtatccgtggtaacctccgcggatatggggggccaaccgtgtaattctcgggaagggatccatgtctaagaggacctgtgcagttgaaacccatgtcgctcagggtcagctgtacataga

SEQ ID NO: 13308 - DNA, 201 bp, Bos taurus
cagggcccaacttttggggagaggatgtcagctgtgggaggaaggggagtgcattcatgtggtcgaggtgatgaatgccactcccagctacagtctgctcgtccatagtcacagggcccctgatgtttggctggacatgtggctgccgtgaataagacatgtcccagcctctcttaactgttggcttaaaactcaacattc

SEQ ID NO: 13309 - DNA, 201 bp, Bos taurus
cttgaccgttcaagagagagaaggacgcgtccagggccggagacggggcccaggcgcgcccgccaacgagcccggactcggccgggctggccaagcaccatagcttagagcgtggggaccccggaaggagaggaacgcccttaacggtgactcaggagtttggactacgagccacaggcactccggcgccgaagacctttt

SEQ ID NO: 13310 - DNA, 201 bp, Bos taurus
tactaactgggctgtttgacactggagaaaccactaacctgtcaaaaccttagtttccttaaggtctctttctcttctctgggatcttaatcatcatgacagtgaatgaaaactaatttcatagttaagatacatagattacaaaatgcctaacagcaggtatttaacagttcattacgcataagttgtcaaggataagta

SEQ ID NO: 13311 - DNA, 201 bp, Bos taurus
ccttctggggctctgtctttagtataagaggatgcagctagccaagaactggccttctctgaagttcttgcactcttagaacttggtcccttgcctgcaccgtgtgccctccctgccaagcagactctggagcttcctatgtgtcacagaggtaaagcatccttaaatgcaggagactcgggttcaatccctgggtcgaga

SEQ ID NO: 13312 - DNA, 201 bp, Bos taurus
cctgcttaaaacctttgctggattcctaacatgctctggttagaaaccgaacggcccacggctgtcctgcagcctggccctggccccccctccagccttgcccgctgtgtatgaccacgttaggcactgctcgtcctgcatctctgccctgctttaacccagggcctttgcacatgctcttcccagtgaaggaatgcactt

SEQ ID NO: 13313 - DNA, 201 bp, Bos taurus
cagctatcatcactcgccttagggtgccttctccctccccttcctggctgcctgagaaggagaggccggggggtctcttcctttgtgtaccatactctgcgctggacatcccccattgggcatgagtcaaaaatgaggctgaggtggacagatttcagtcttaccaaaagcttgtacagttccttactcctcaccgctagg

SEQ ID NO: 13314 - DNA, 201 bp, Bos taurus
acagggaagcctggcgtgctgcagtccatggggttgcgaagagttgactacaactgtgagtgaacagcaacaacaaaattcacatgttggaacctaatgttcgatgcagagacatcactttgctgacaaaggtctatatagtcaaatctatggtttttccagtagtcatgtacggatgtgagagctggaccataaagaagg

SEQ ID NO: 13315 - DNA, 201 bp, Bos taurus
tctggccaacagccagcaaagagcaggaccttcagtcctccaaccacagagaagtgaattcctccaacaacctgcaggagctgagaggcggattcttccccgatcaggccagatgaaaatgcagtctagccaacagcttgactgtagcgctgtgagaccctgagcagaggtcccagccaagctgcccagaccccaacccca

SEQ ID NO: 13316 - DNA, 201 bp, Bos taurus
cattcaccatgttttacttcacagtccatcaaaactgcagccctgcctcatctacaaagatcctcaaagatcctgcctgatcttggccaagatccacttcctcctgaaggacctgttgcattgacacgactgccctccacggtcacacgtgtcagaaaacggccacctgagttgttcaggtcactgtccgtaagccctact

SEQ ID NO: 13317 - DNA, 201 bp, Bos taurus
cacctctggcctgaaggaacaaagaaataaaaattaccagatcccactgaaagatgggcctggggaaggacctttggcaggagccgtggccctaaatgaatatcagccttgccagaacttcagtgaggaagggagggaggagagaagaataaccaccccatagtctctcctcaattaccttgcctctcattggccaaaaca

SEQ ID NO: 13318 - DNA, 201 bp, Bos taurus
gagggaggtgtgtatgaagggggaagcgccggggcggcgtagagaagggctcctggggagaggagggcagggcctaggaatacttggggcctgggtctccgcccaggcttttagctggagcagcttcttcggcagaactcagctcttacagaccaggttccgagccgaccctaatattccgctgggccgctacgactgccc

SEQ ID NO: 13319 - DNA, 201 bp, Bos taurus
accaaggctccatggccacctcaggagcacagggtggggctctccaggaggggaagcgccctcagctctgaacacagagctacctgcagtgcatggccatccctggtgtgtgtccactcagtcctctgtgaatatggttccttaggtgtgtagcatgcgtgcaagcttagtcgctcagtcatgtccaactctttgcggccc

SEQ ID NO: 13320 - DNA, 201 bp, Bos taurus
gagatgacaaatcctagctttgggaccaaggggctaatcaaaagtgaaaacgacccagcctgccaggcggcctggcattgctatgccctgcccgcttctgctgtactcacaagtgccaatattttagaaaactgcccgttaagatatacgatttttttctgggtatctgcttagaaccctcctctgtctcactgctctgca

SEQ ID NO: 13321 - DNA, 201 bp, Bos taurus
tgaagaaaggctgtaaggagggcccctgtctgggaggttgggagaggctgaggtctgcagcctgcagaaggcgggtagagcacaactgttccgggcagaaggcactgcaggcgcacgggcccagggagtgcaggccaggggcagtgtgaagccctgtggcctagaggagagcatgccaagggtgcccgcatgacaaagcag

SEQ ID NO: 13322 - DNA, 201 bp, Bos taurus
ttccgatctggtttgggagcctgagggctgtggaatcttcgaggctgccacaggcgccatcttcagaccctagactgtggccccagacctgaggctcctccggggcgtcagactagaaggagggcgtggcttttagaacgggaagaggataatgatcccccttttcggggacggcctggcctcctgcctttggtcccggga

SEQ ID NO: 13323 - DNA, 201 bp, Bos taurus
agttcccagagtaataccctatgtcttcaatgtaataaaagcattagttaactggattcagccaggtttacatgcaaatcttgtatgattttgagcaagtcacttaaattttttgagtctcaatttcttcacctgtaaaatgggcattatgtgttaaactgcgtagatttgctctaaggatcaggtgacaatttatacaca

SEQ ID NO: 13324 - DNA, 201 bp, Bos taurus
ctacactgaaaaccatgaatccccatctctgtgtttactttccctctgtccaggattcttaaacttgtgtgttctcacaagtccgtgtcttaggtgtacccgtggccgattcatggtgctgtatggcagaaaccaacgcaacactgtaaagcgattatccgccgattaaaaataaatattaaaaaaaaaaagcctgtgtct

SEQ ID NO: 13325 - DNA, 201 bp, Bos taurus
tgactctggaatcagacagacttgagttaaagcaccaaccttctctttctagtttggtccctcagatcagttcctaaatgtctctgagcttcactttcctcatttgcaaaatgactgtgaaaataacagcttcagcatcactagacaccgaaacgtcacatttttgttcacagagtgttagttagcttccctggtagtcca

SEQ ID NO: 13326 - DNA, 201 bp, Bos taurus
gaaagatgcttctcaggtcaaagaaagcagacataagcacgcttcacttttctaaggataattgataccagtaaaataccacttaaagagagtcttcttaaaacaagggtcaaaatatccattataaatggtgaaggaaaaaggtttgaatgggggccatactttaaaaaactgaaactggaagcttgaaaacaagccttt

SEQ ID NO: 13327 - DNA, 201 bp, Bos taurus
cccaggatatatacccttcagctccctttctaactccctctcactagctgaggttccttttaatcactctcattctcaagggggacagagagccccagagtgtcacctagaagaccttaccttcctggttcccacaccgtgtgcttccatgtccctctccaggagatgatggacattgtcaaagccatctacgacatgatg

SEQ ID NO: 13328 - DNA, 201 bp, Bos taurus
cttatgggttcagagtaggggccgtgatgtgggtgtgaccgtccccctctgccccagaaaagaaggagtgcagggctgcccgctgctgggccgggggccacgtgaccctgcaggctgtgccagacagtgactgagcgggcagggggtgccagtttcagcccatccctgcaggacaggtgatctagaaagtgacttctgcct

SEQ ID NO: 13329 - DNA, 201 bp, Bos taurus
tgataataaatttggtgaagttctcttctgtttcttagattatttataatgaatggggcatacatttctttgaatgctttttttgtacctactcaaatgaactttgtttttctttttcattttactaatgtaataaattacattaattgattttcctgttaaacagactttatattcctaggataaatcctacttggttat

SEQ ID NO: 13330 - DNA, 201 bp, Bos taurus
cttaggtcccagtaatgcagtaattgtccacctgcaccctctgtggtaactatgtaggcagcttgaactctggtctggccctacccctacttgtacatccgcacagagcccacagctactaaaaccagacttgtgatagggtgtttgtctggtattgtagtgaccagagcctgccctggagagtcaccagggcctctgctt

SEQ ID NO: 13331 - DNA, 201 bp, Bos taurus
actgacaaaccaagtttgggcccaagttaaatctagctatgcacatttctcaagcctttttctaataactttagaagtgctatcgtcataaagtactggggaacagcagaaaatgtgggcctagatctgtagaagtcactggctcttttatgatattactcttggtgcttggggttttgaatttttttattttttggctgc

SEQ ID NO: 13332 - DNA, 201 bp, Bos taurus
agggttggccctaactgaagccacgtagcactcacgcacacacagaacacaaggcttttttgtctctaggttttacggtttccgccgtacgagaacctcccggggccttaacctcctctcatccctggcatttcttgttactccttcagccttattcaagggtaacagagcttcccctgccttcattcctcttagtggcac

SEQ ID NO: 13333 - DNA, 201 bp, Bos taurus
ccctggaagtggtagcaaggttccccaggtatggatgtaatttactacacagaatgtattctttcctttagttcagtagtttggatgaacacttatgagtgtatgtccaattgttttttaaagaaaaaagtgaagcttgctgctgatgaagatgaagatgatgatgacgatgacgatgatgatgatgatgaagagtaagta

SEQ ID NO: 13334 - DNA, 201 bp, Bos taurus
atatgtctctgatttctggggccacagtgtcaggaggaggcggacacaacaccctagtcactgtacagactggtagaaggttccgtctgttcagacagacggatgacaccctgcagggtggccagagtgctggcaagacttccaggcagaaggaggtgatgagaaagctgagtgcattccagaagttgggcgtggccagag

SEQ ID NO: 13335 - DNA, 201 bp, Bos taurus
cccccgcatcatggccagattcaaaccccaccctttcttccttttctgaactaaaactcctatgagtcccgaacttttcagatactagatcttctagaaaggggtcttatcaggggtgccctggcctgaagcttgttggtgctcccaatcacaagctaaaacccagagtccagctttgcagataggcatctgggcagcacc

SEQ ID NO: 13336 - DNA, 201 bp, Bos taurus
ccattaggatggtgttttgtaagaacactttgatgtccaagggccgtcgagctgttcggagggcttttttcttcttcacaaacaggaagttttcccttctcgaggcatacacacagtgagaggccagttcccctagaatgagcgacagtgagcaggaagtggttccggcctgtcaggatctgtttgttcccgtggccacgg

SEQ ID NO: 13337 - DNA, 201 bp, Bos taurus
ggaatgtcttggggcactgtggtttaaaggacagtgggtgacagggccgtgggctctgcaactgcagctgcattggcttcgtgttggctcttctactcttagaacagacacctgctgaggtggtatgttgtgcctccctgggctgggaccgggccactgagagggcagggcacacttcctgctgcccaaggctgccgggtc

SEQ ID NO: 13338 - DNA, 201 bp, Bos taurus
aggaaactgaatttaaaaggaaaagacaaacattaagaatgaagtggggggaagggtggtggctgggagaaaaggccagtgcgtacactggtgcgtggcaaggttccactctggtgacaaaggacaccaccacattcgtggcttagacagtggccccaaagactgaatatctctgggctgcagccaacttcagaaccttgg

SEQ ID NO: 13339 - DNA, 201 bp, Bos taurus
gaacctggccctaaagttacccatgttatagccaccaaagggaattcctcctgcggtgtctgccctctacccttaaagctaaacatcgtgcttactggcagaggcacaatatttaaagggcccacatccattttcacaaagtaggcaatgaagagtgattttagatttgagatgcagtaatttgataattggcataatttt

SEQ ID NO: 13340 - DNA, 201 bp, Bos taurus
agaagtaagcagaggtcagagcaagagagacgcgccaagtcccatgacattgtttgaatccctggatccagtatcctggacattacctagacacaggcccaaatttttccttacttatttaagtcagtttgagtgagtttctgttactttcaaccaaagcaatcctaatacatctgatcttggcttttagattatatctcc

SEQ ID NO: 13341 - DNA, 201 bp, Bos taurus
tgtatttaaaagccaactagaacaggaaggagctggcataaatgaagagctgaaagatggatggctgagagttacaagatcataagtaatgagaaaggcccggctgctgggcacacctcggtttttgctctgacagaagacatacaacgggagaacacatctgttaatgtccttcacgagttcgtctgaacttgaagcgga

SEQ ID NO: 13342 - DNA, 201 bp, Bos taurus
ctgaggccagggcgagcctgtgcagccacctgcaatctgaggcttccttgcccgctccttacggagtgcaggcaatgtccccagggagagggcagagagggcagagcaagtggggagaggtccggcccctcctcctcgccccagtctgtcctatctcgcgccagggtgccagcactggggacctccttgggctgtccttta

SEQ ID NO: 13343 - DNA, 201 bp, Bos taurus
gagggaggcactgactgtgatgggggttttgtgtgggaggtgttggggttgctaatctaactaggatgctgcagggaggcctcaccgaaagtatggtatttgcacagcgatctgaaggcgaggagacagcaagcctatctgtctgaaagagcatccttagcagagagaacagcgaacgccaaggccctgaggtgcaagtgt

SEQ ID NO: 13344 - DNA, 201 bp, Bos taurus
ttgcttctgtgactagatattggaaagccctgcccctctgttcttggcaggctggagcagcctttggttaatactgaggggtgggccaggacggtgccctccctcctacccataggaagggactgaggcagagatctcctcttggttcccattgcagagaagtctcctccccctgccttgttcttggagtcccaggaccca

SEQ ID NO: 13345 - DNA, 201 bp, Bos taurus
cgcccacgcggcagcgacaagcttagcccccgctccgccccctcttcctggtttttcccggcaacccgcccctcccgcgtcatgtgataggggtactctgccggcccgagctcctgattggccgagctgcagggcgcctcgcgattggcccgaggccggcgggcccccgcctctctcctcctcctcgccgcggcccacgtg

SEQ ID NO: 13346 - DNA, 201 bp, Bos taurus
acacggccctgcccccgctccacccttctcccgattcccagggagattgcacacccactcctgcgccggaatccagctgcgctccgctaggactgtctgcacagaagctgggggcggggcccagcaccaagcgcacagtctggcccccgcgggtcacccctcccctctcgtcacctcccaaggaaaagggagccgcaagcc

SEQ ID NO: 13347 - DNA, 201 bp, Bos taurus
gtgttgttgagggaaggggatttgggcagctgaggaagcaagtttccatcaagtgttagaaaagagcagggacttgatctaacatgatgccaaaacgaacgggaacagctaaagccagagtttctccttggtgcttgcttggaggaaatctaacagccccaggagtcaagagggcgtcagatggggacttgggggtgaaga

SEQ ID NO: 13348 - DNA, 201 bp, Bos taurus
tatctgttcctttctccccagtagttcctgtattctagaattgaagtgtaaagacttgattagattcattcatttttgtcaagaatacggcacagggggtgatgtgcatttcagggcaatgtgaattttagcatatgaattttcatctcaagacatttattgacttcagacatacttttgtgcccttgggaaccaaagctg

SEQ ID NO: 13349 - DNA, 201 bp, Bos taurus
aaatccaaagcttcattactatgattgctattttatttggtctatattcatgttgttaaatacaccagcaaattgcttttaacttcctcaacacaagctgctatgtatgtagtcatacattttaactggaaacacatctctttaacaaaatagactattaattttcttagaatttctctgaaactctctctaaaactaccc

SEQ ID NO: 13350 - DNA, 201 bp, Bos taurus
acaggggcctgagatgtgtgtctccctacatcgcagagttggggcagccccttggggacgtgctctctggtcccagcccttgggtctccagctctcagagcaaacctgatcaggcctgctgactagttcctgcatctgaggacccctttgatgtgtgggtccgcgtgggagggagactggagtggaaatatgtgttttcct

SEQ ID NO: 13351 - DNA, 201 bp, Bos taurus
aagaggccagaaggatgtgggtctggttttcccaggtcagagaggagcccccaaggagggagtggtggatgtacctcactcaggtaggagcagggatcctgagaacagggcagggccagatggctcacttccctgggtatggggggcagggggacactgcacagagtcacgtccagctgcacagggacaacagcctgtgca

SEQ ID NO: 13352 - DNA, 201 bp, Bos taurus
tggaaaattaagtcatggaaggacacagatcctggtggagctccctcttcatcctgaacttagatttttctctgccaactggggggtaagactactgacccgatagacttgtgagcagttagcctggtaatgaattataagggaggcagtgtgatgcttggcacagaaccgtgtcctgcataaacatatcacagatacaca

SEQ ID NO: 13353 - DNA, 201 bp, Bos taurus
cttatcatcttctccatgtacagaggtttacctctttgagaggaaaaggtcctccctctgccttatctctaggtcctttcactgatcagctggcatgtctatatgttatttttacccatgaaattatgtattgccttctccataactaacaccagtgacaatctgtaacagttcttccctggagaccgatttcattttcct

SEQ ID NO: 13354 - DNA, 201 bp, Bos taurus
ggccctgaggagtgcaaattctcgggagctagccctgaaagcttgcagggacacctctgactagagagccttgcttgctgtgctcattttaattttcttgcaatagagctgaggaggttcctgcctgcacatcacataggctggaggctttttcccttctgctaaagattatggttctcctactaggctggcccaccttgc

SEQ ID NO: 13355 - DNA, 201 bp, Bos taurus
aggtgacagagacggtgaccgtgagctctgtgactgcttcatgtggttagcttcacaaggcacggtgacttcagacttccctgtagttgtcccacccctggtctggccagggggaaatgatttgtgttagatttgttgtctcttccaccaagaaaaagatcaaaacactgaatgaaaaaaggaaacaaatctgttcaaaag

SEQ ID NO: 13356 - DNA, 201 bp, Bos taurus
cgcctggggccatcctagaaagagagcatcacagcctccagtgctccctccctccccagtgctggagaagctgtgcctaccttaggagaggaggcctcatacctgtttccccacctcttctatcactctgatcagtcctccacaccacacctgtggtagtgcccccagagctgtgatcagtccttctcccttggaaagcat

SEQ ID NO: 13357 - DNA, 201 bp, Bos taurus
tagagcagctgccaagtgtgagttcttggccctgaattcaagagtaagccatagtagagtgaaaggtttattcagggaggaaatacacaccatagacagaatatgggccatctcagaaggcaagagagttacctgggtatggggttgccagtttttataagggtgggtaatttcataatctaataagtgggaggaattgta

SEQ ID NO: 13358 - DNA, 201 bp, Bos taurus
tcagagagactgagtaactttcccaatggcacacagctcttaagcggcaagacccatgtccttcttccccacttgctgtccttctggtggcaggtctgaccgggtccttgggaacatgagtttggcacaaaacagaagcagtctttaagatgcccacagcctgtggaactggcaaacacattgagagaaaatgaaaacaaa

SEQ ID NO: 13359 - DNA, 201 bp, Bos taurus
agccccgctgtttacttcatttgcctgtgattagtgttattattctcaccacctcactagcaagaggaacagggcatgaccagggccgtatgcacggtgcctggactttgcagcctcagcccagccctgggctccatttcctcaaatcccagctgtgcagctggctcacctcacctacagtcctggatctacaacccagac

SEQ ID NO: 13360 - DNA, 201 bp, Bos taurus
ggtggtgtacggactggccaccaactccaccaaatatgagattatggccatgtctggacttcaaaacaagagtccagcacagggttcagtggcctgtgttctgagtcagaagactgaatttggcttctcctggagaacatggacaaattccttccttagtccttgagcacgttaactgctctctagcgtaaggagacggtg

SEQ ID NO: 13361 - DNA, 201 bp, Bos taurus
actggacttccaggtaagtcccccaaccctttcattttatagggactggcaacggtggcccacagagaatgtcctggcctcagggcacccagggagtcaggggtgaaggcagagcatccctggtcaggggcagccctcaggggctaagagtgagacccagggagagatgtgacatgtctgggccatcacagccacagccca

SEQ ID NO: 13362 - DNA, 201 bp, Bos taurus
gctaaaatctccatcagtttcccaattgtctccgaggaacattccaacagcactgcaccatgctcaggcttctcctggcctggcccagtctcctcggcccacttgtcttactcctgccttcttgccctgaaaactcatcccgctcctctctgctccatccacctacccagctcccccagcctccaggcccttcctccctgg

SEQ ID NO: 13363 - DNA, 201 bp, Bos taurus
gggggtctctccaaaacaccagagccatcaggacacagcctcgcctataatcctgtccccactactcccggctcgctgggcccactgctgcaatcaggacgcttcctgacttccactgccttccgtgacctccgccccagaaagagttttctttccttcctcttgggtcccgtatggcctcctactttcttttactgtttc

SEQ ID NO: 13364 - DNA, 201 bp, Bos taurus
acaatttgatctgacagctttatagttatataacataggacagaagcttaaaaacaacaaaaaaagagagagaagtcactgatgtttttcatagcaagctatatctctccaaaaccttactaaccttctctgtctctttaaacctaggagaaccagcttaagactagtaatttacacagtcttaagttaactgctattttt

SEQ ID NO: 13365 - DNA, 201 bp, Bos taurus
aatgctataaacactatggattatcttcatataaatttcaaatccaagtaaaataaatacattatttatggatacatacttatgttttaagtttgtattatatagtgttattctcattaggttttttgctatcttgataacttcagaaaatgtaactttataactgattatgtaaaaagtgaagatatttttccaatgaag

SEQ ID NO: 13366 - DNA, 201 bp, Bos taurus
acagacaaatgagctgtgctgacacaaaggcctttaaaactgtctagtcacccattgagtcaattgaatcatcaagttggatgctgcctgcatcaaatgatctgggcccagatgatgcagctgcagaactagcctctcaaaccgaagtgatggacgatgaaaagagaaaaagtaaaggcaaaattctgcacgtcaggctta

SEQ ID NO: 13367 - DNA, 201 bp, Bos taurus
gaaagcattccgaacacctagatccctcagcagtacaagtggaatctccaataggaaaaccaaagagaccacctgccttctagcctactatcttgaagaaatgtcatgcagttaccaaacttttaggcttatgttcagcattaggacaataagaattatatgagcagatggagggtgtaagtctcagacatgcattattgt

SEQ ID NO: 13368 - DNA, 201 bp, Bos taurus
tgatcatatttcatttctttcataagctacagacaaacacaaggattttttgcctctgcagtgacaagcagagaaccatggggccgtgttgagatgcagatgaaagcaggctcccttctaactgagcggctcatgtgtcttcccctgggtgcagggctcagatggatgacagaaaagcacaggccaaggaccttccaggct

SEQ ID NO: 13369 - DNA, 201 bp, Bos taurus
tggcagttagagcatgatcctcaagtgatttttttcagatggaggggaccagtgaaaggattgagaaaggtgtgctgggattatttggagaacaagcataagttatatttggaggtttcaaaactaatacaggtttgaagaaaggggaaaagagtcttgtgttacccacaaaccctctttgggttagtactatcaacagga

SEQ ID NO: 13370 - DNA, 201 bp, Bos taurus
cgtctcccaacagtgtcttcaaggaaggacagactccttcttgaataatagatcagtctcctatttctgatttttacttctcttaccatctgcctctctcgtgcttgctccaaccacactggccttcttcctcttctccccagttcaggtcttgggccaataaactttatttcctgtgcttgactgctctgctcctgacca

SEQ ID NO: 13371 - DNA, 201 bp, Bos taurus
gagatgcaaataagttaaaagctaaccttataaagtcttagtccactcttatactggaaattttcagactcctgacccttcagtgtttctggctatgcaggtacaatctgcctaaggactgaccaattattaaaggagcttgtgatatgataataatagccagaatatgttgtgattattatgccccaggcctctgttaca

SEQ ID NO: 13372 - DNA, 201 bp, Bos taurus
gaccgaacccatgactcctgcattagcagctgaattctttaccactgagccagctgggatacaagctactacacataaaatagatgaataacaaggtcccactgtatagcacggggaactatattcagtgtcctataataaaccataacagaaaagagtataaaaaagaaaaaactatatatatagttatgtgtgtgtgtg

SEQ ID NO: 13373 - DNA, 201 bp, Bos taurus
cagggtaacgtgcatgtgaattacctgcagatttgtcagaatgcagattctgactcagtgtcagatggaggctgataccctgcatttctgaccagctccaggcggtgccactgctgctggcctgtggaccatactccgagcagccaaatgagagattcaaagtgtcccgttaggaacaaaaagagagaaatattcatattg

SEQ ID NO: 13374 - DNA, 201 bp, Bos taurus
tagcacccactggggaataacccagttgcccattttatttcgttagggccgctctccccttctccctgggctctgactggttgaggtgattctagctttatctcttttttctcaccgcctccttttctggatcgtcacccccacccccccgggccccttcttttcttatacttcaaaattatggcttaccggtcaattttg

SEQ ID NO: 13375 - DNA, 201 bp, Bos taurus
ctttgatgttagtatcatttgaagctatcaagatacagaagtatatagaactcgctaagaattttgtatttccaaagaaaatcttggaacaaaaggctataggtaatttttactttgttatgtcttttaactatcatataataagctataaacaaaaaggaaaacacacacaccccccccaaaaaaaggaaaaacatcttc

SEQ ID NO: 13376 - DNA, 201 bp, Bos taurus
catcattttcctattgccagttaaaataaactatatttttacttcattaagtattttttaaaaacattatttctaatggcagtataatgatccatgttttgtattcacttacttacgattttgatggataccacctattcctaattatttatttgcacctattttgtacacttacaatctggtgaagtatttctctcccct

SEQ ID NO: 13377 - DNA, 201 bp, Bos taurus
ccttctgcatttttagttcagttttcaacttcatctctcagccattacttttgttttgtcccttccttagtgttccctgtcgttcttcctttaagagtcactagattggccgtttgtcaaaagaccaatgtgtgattccgtgtgttatgcttttcctagcacttctgttggggcagagttaaagaattctaaaaatgaggg

SEQ ID NO: 13378 - DNA, 201 bp, Bos taurus
tcaatggtgcgagatgatatgcccttctggggaaccacttcttttaggaccctgtttatgtagagtgagtaattcctaaggccagattcagagctggaatgtgatttctttttgtagattgctttttggtgtcctctgcagcgcttgttcctcttggtgacgtttctggccattgcagatgttgttcttatcagttacaag

SEQ ID NO: 13379 - DNA, 201 bp, Bos taurus
atgcacaggaaagccgcctacaacaaagaattatctggtccaaaatgtcaaaagtgccagggttgagaaactctgcactcagtgttacatctgggctttcggtttagaaagaatggttaccaccagcataatagaagcatgtgtaatgatagcacccagagagatatgataaaatttccctggagagtagggagggtcaca

SEQ ID NO: 13380 - DNA, 201 bp, Bos taurus
tctgatgggcacaagggtgggaggtttcttctgggaaagttagtgtgagatgggtccagctttagtgcagaaaacagctatatatggcataatgtcaaagaatatactttaataacactaaattagggctaaaaataacaacagtagttaaaatagctggtgttcattgtgtgcttactatggcattgtgcacaggtttca

SEQ ID NO: 13381 - DNA, 201 bp, Bos taurus
ccatggcctagggttaaagacccccgtgctagaggaaaggaaattctgttgggcgaatattaggaaacgcaggcacggggctacacatgaggacagtgacgccaaggcaagcagacaggaggccgggtggagcaaaggcaggtaggtactcagcgacggaggctctggagataaggggtggagtggggcacgggagagggt

SEQ ID NO: 13382 - DNA, 201 bp, Bos taurus
ccaaaattgaggagtggtactttcttgtaccatgtcccaaattaaagaaatggaaatataggcagagagaaccttgaaacaactccccgccctagtccctgtgaatgaataccaggccatatgggttttataaggtacagttgttagctaaagacttgtctaaacctgtaataaccctagttttattaccatggatcacta

SEQ ID NO: 13383 - DNA, 201 bp, Bos taurus
ttagttttgctgtgtcatttcagctgtggagctttttggcttgttgcagtagttttccaaatcctgctcttggagcttgatggagattttctgaggcctgatttcctgttcgcatatctgtgacatatattcattcactagatttcataatgactgtctgttgacagttctagaggtgggtctggcctgtgtatatcatct

SEQ ID NO: 13384 - DNA, 201 bp, Bos taurus
cctcatccggatgagaggggagacaagcaagaggggcagaagatgaaccgctttccctgcggaaaggctgcggcacacaagcagggccgagcccccggagcatctccatcttgcttcacacaactggtcccatgggcaccagccaccgcagccatggtatcagagtgacctctggaggaggaggccctgctggaatctgag

SEQ ID NO: 13385 - DNA, 201 bp, Bos taurus
acagaagtcagtgcaatgtagttgccacaatccttctagactgaaattaagcatgcagctccttcccgaggggatcataacagcagttctgtcagaggccctaatgctacaggcacactgaaagcctcattcattcattcaacaaacatttactggctgtccacagtgtgccagagactactggcctaggagaggcaacag

SEQ ID NO: 13386 - DNA, 201 bp, Bos taurus
tcctcataaacaggaaaaagataaaaggacaaaatttaaaaggtctttcgaagaccttctttctctaactgaaaagtcaccccgtgcctacacagagggcttcccaagtggcactagtggtaaagaccccgcctgccaatgcaggagacgtaagagacccgggttcaatccctgagttgggaagataccttggaggagagc

SEQ ID NO: 13387 - DNA, 201 bp, Bos taurus
cttgtccatggtgctcaaataccctgttaaaattatgcaaaggttttaaggaaataacatatactacctgaaagatcattacaacttttcaactaaagtgcagttttctagggaagtaaattattaacttacgggatgcatataattatgtgtatttgagataaaacgctgaagatgaatttccctgatgaggctctaggt

SEQ ID NO: 13388 - DNA, 201 bp, Bos taurus
tctgaaattataaaatattttaaaatcctgaaatatattttattaaggtaataaatagggagggactttacaaaaaattaaacagattaagtcaatgttaagggttgattaaatgaaactaaatcaaagggttaaattaaatcaaagacaaataaccaatgatatatcttcagaataactgctgggaaaattcgagactgg

SEQ ID NO: 13389 - DNA, 201 bp, Bos taurus
aactgaggttcacaaatattaaatggaaagttccagaaatagacagttcatacgttctgtgtgtgtgtttgtttatttttggctgccccgggccctcatcgctgcagcaggctttctccagctgcggagcgccgggtggctgctctctagttgtgctgcaaagggctctcactgcggtggcttctgttgcaggccgtgggc

SEQ ID NO: 13390 - DNA, 201 bp, Bos taurus
ccagcgggtgacacctttgggtgcttttttaactgcctttggagaaactgcgtgaaaagtgttcacacttctcatgcttggtgtagtgaggagaggagaacggccctgcaaacatgggcagtctgtttatatgagagtagtaaaatgtccttttcctatttgaaaaggattggaaactcacagagctcagtcacagggact

SEQ ID NO: 13391 - DNA, 201 bp, Bos taurus
ggggtcatgcccagcacttggcaggcagctctaaatggccatggtgccatcataaaatgttacatgttacattacatcgtaacatcagtttaactttttacagtgtggctaattccagagaatggatggcattttgatatatggactttaagtcttctatgatctttgtgagtgattttgcaaagattttcctctgtgtcc

SEQ ID NO: 13392 - DNA, 201 bp, Bos taurus
gtggggtagaaggaacatccttagaaagaaaggaaggaaggaagaacatcctttcgagtactatgtgatactgatttggccatttatcaatgtgaaaacacatttgtgtgcatacatgctcagttactcagtcatgtccggctctttgctacctcatggactgtagcctgccaagctccactatgcatgggattatcctgg

SEQ ID NO: 13393 - DNA, 201 bp, Bos taurus
atataccccttttccttgtaataaacacttatttcactactttcagtctctatgtggaaattcatttctacatagttgacaggccagggccttgtcactggttcctggtctctggtggtctggtggctagaattcagtgatctcactgccatggcctgacttcagtctctgacccagaactgaaatcctgctccaagccac

SEQ ID NO: 13394 - DNA, 201 bp, Bos taurus
ccacagaaatttgatgacagaagtcatctttttcctggttttgaaatgagaagtgtgaaattgacccgctccccagcaatggacccgggccaagtagggcggcgcgggagcgcctcccagcaaggtctgtcctgcacatctgcacaacagctgacttggcttctgtgggcttggtcaggatggcacctgcagggtggcctc

SEQ ID NO: 13395 - DNA, 201 bp, Bos taurus
taccgtagaacggaagtctcacatccttttcaaaaacaattactaatacaatttatagtcctgtttatggcatgcaagtaaaaaacccatggaactactcggcactgtaggaaatgaatggtttattaaactgttcactgtgctctaatcctggcttcagaatgattaactaacaaatccatcgtctgggggaaagctgac

SEQ ID NO: 13396 - DNA, 201 bp, Bos taurus
gtggcccaccagggtcctccgtccatgggactttctgggcaagagtactggagtggggtgccattgccttctccggacttgttgaatgaatcaataggccattatcagacttctcaaactcattagtctctgtgaaaaagatcattatctctgtcaacaaaaactgcttaaaataccaaaccatgagtcacagggcctctc

SEQ ID NO: 13397 - DNA, 201 bp, Bos taurus
gctttcatttcagcctgtaaaatactttctgggcattacttgaatgtaatttattaaagaaactgaaaatcagggtcctaaaatacattgctggactttccgtgacttctgtttaaaaaaaagcaaaccaaacactattaaaatgccatacctatgcaagactgttactgtatcatgaaaagcaacccagaagccactgtg

SEQ ID NO: 13398 - DNA, 201 bp, Bos taurus
actgtgctatgaccagctgagcatctttcacttctaagctactaaactgagtgggacactggaggcactgacttaacaagcttcctgaaccggggccagggtggacaggagatcagcatggactggtgggagaagctggataaactgcagcctggaactgtgggagagataggggccacattgtgaccactggaggtaagg

SEQ ID NO: 13399 - DNA, 201 bp, Bos taurus
gtctggatggggagaagctgcaaacatttgcctgcaacagcagcccttctctttttatgtgtgaaattaaacgggtgagaaaagttatggagaatgtcctgtagcaactcagctgtgctacaaaccagtccccctgtcctgacaatcagctaggaagaaacacaaaggtaaggtgattttggaatagggatttgttgttcc

SEQ ID NO: 13400 - DNA, 201 bp, Bos taurus
gattgtttaatatatacattataaaaatgcatgaaatagaatcaaaagggtaaaatgaaaataaaatatacatatttgcatacatgaggttccttttacccatctgtgactttttttcatatgtttcaatgttcccatgataagaaaggaaatgagaagaaaaatatttaaaaagaagaattttctgtttctactccttac

SEQ ID NO: 13401 - DNA, 201 bp, Bos taurus
atttgcatataagtctctcagcacggggcctgatgcatagtaagtgaaagtgaagtgaaagtcgctcagttgtgtatgactctttgctagttacagtccagtggaattctccaggccagaatactggtgtgggtagcctttcccttctccagggaatcttcccgacccaggaattgaaccagggtctcctgcattgcaggc

SEQ ID NO: 13402 - DNA, 201 bp, Bos taurus
taaaaaattatatttgatgtcataaaaacttaaactttacatagagaaaaatactctgaacaattgaaatggcaagccacactagttttaaacattgtaatgtatctttaatatataataactttcctacaaatagacataaagatgaacataataatagaaaaaatagacattaacaatgtctagataattcagaaaatt

SEQ ID NO: 13403 - DNA, 201 bp, Bos taurus
gctttagaagccaaaagcttcagaagagaaaagtgaagccaaggggggctgagtaatgtctctcatctccaaaaagagaaaagaagaaaatgctggtatgtgacattcaagttttctttaactttacaaatgtccaggttatgcactataagattctatttttataacatctttgaaaggataaattttagaaatgaaggg

SEQ ID NO: 13404 - DNA, 201 bp, Bos taurus
cactcagggccagaatctctctggagccactgaagctgcgggcagctctgcttggccttggactctgcttcagtgtctgaacttgccagggtgacagatacggccttggtggcttgctaaagttctatatgtggctggcaaagcttttgaccatttcagaggccatgtgccatttgagtgtagaatgacactgtgattttc

SEQ ID NO: 13405 - DNA, 201 bp, Bos taurus
aaggggactattcacggggcctttgcagtcagtccatatccttagcagtagaaagacaccacagctcacggcggtcactggaggtgaacaggagcgcccaaggtggccgagagcatcaggcactcagtggcgccagcagcagctcagagctctgcgttctgcacaattaagaaaacgcatctgtgcaacacgaggactgga

SEQ ID NO: 13406 - DNA, 201 bp, Bos taurus
tggccagcccttcccagcggctgctgccggcttctctgtgcccttaggcccagcctcgctgtgcaccgaggacaagccggcccccagcttctcaccatccgcaggggtgtaaagtgcttcagtgcatttcttgccttcagacttgccagcgttggtgctggtggccagaggactcgggctcctgtctgtctgtttgcacgg

SEQ ID NO: 13407 - DNA, 201 bp, Bos taurus
tttagaaattgaatattttgttagaagaaatattgacaccaatgaaaatgtaagttgccatttactaccctataccacatgcaggttaattaataggacatatggcctgaaagaagccagcaattttccatttagcttttccagatattagaactagatagcatcatcaaataatgcacatatattcaggcaatttataac

SEQ ID NO: 13408 - DNA, 201 bp, Bos taurus
caggaaagagggggtggggctaaaagctgcttcatctgggagcttcaagttaattataaaagcagaactaatctcaacctcccacctttgcctggccatacgtaagtaacaccacctctaagttctccccactaatgccataaactcatttttccagctccccagccgtgcaactttgcagcttttgccagcagcctccat

SEQ ID NO: 13409 - DNA, 201 bp, Bos taurus
tgcctggatttattctttgtgttgctcaaattgcctcttattggtctatctttatgttcacttacttctgttatctccatactaccattcagctgcttcagtgaggttattattatttttattttttggtttgaaatttcccacttggctctgcttcctgtcttatattcttgtattctatcttatatcctttgctaatac

SEQ ID NO: 13410 - DNA, 201 bp, Bos taurus
ttttgttcaatttgcaaggaacttctttaacattttggaactttgcatggtgtcctttatacctgctctgaatgtcatgaagatgtatttagaagtgtatgcaagttacagtttttgttgagttatgaatggaccaaatttgatctgcggacctatgttgtgcttcagaacttggaaacttttgaataatttcaagtgaga

SEQ ID NO: 13411 - DNA, 201 bp, Bos taurus
ggggcatatctggagcccaaaagcaaagggttatctacagagacaagactaggtacttatagagactaaagagacttggccacaaaaagctagaccagagttctttcttgcctggaagttgccagaacaaaaaaggatcagaaacagcaatgatttttgtggaataccatgaagctaattggccaggttctgtgattcccc

SEQ ID NO: 13412 - DNA, 201 bp, Bos taurus
tttcattcttttttatgcataacaaaatcattattgatactaccagtttgcccttgaacaataatttatagtttacaaagcacattcacgtcctcatcttaatctccaaaaccactgcgtgaagtaggagggcagggcaggcattaatatccctgctcacagttgaggaagctgaatcatatatgtgtgcttcattcagga

SEQ ID NO: 13413 - DNA, 201 bp, Bos taurus
aaaattaaaattgattaaaaaaaactgataaaaactaaaatccagagagtaaagttgttcttttattcaataaggggagaatcagtactcataattaaataagctccttttataaaccagagaggcctttttggaaacagaatggttttagttagcctgggaaaataagcataaattatactataaagtcatctatgctag

SEQ ID NO: 13414 - DNA, 201 bp, Bos taurus
ggggccatagtaatggatttagccggacaatgctcaaagcgctctacatgtattatctctcaatctaaaaaggtgatgtgagttaacagaaaatagatgcctattgttctctggccctggttcctgacacagagctcctaaaacacttgtaaatccctaagctgctaagagcttcttttgttctaatattccatctctgac

SEQ ID NO: 13415 - DNA, 201 bp, Bos taurus
tttacagtcagatttaggcacatagattaagtttcatttttcatctttgacttgtagatgatcttaaccttatgtgctcatttaacagcacaacactctgggtggccattcatagccatcactctgtatgcctcccaagtaatcccaggtgtcctggtgttttcagttttctgtttgggcaaattagaaagcaggtgaacc

SEQ ID NO: 13416 - DNA, 201 bp, Bos taurus
ggaaaaaaccctaacttacagatgagttctcagggccttactttatgcccgtctgatgtggagattggctgtaagacattagcatttcagaggaaaaatgcgaggttcagtgactgtgggattgaaatgtggattgaggggggatagtaagaaataatagaatattggtgggacagttggaaggaataaaatattgatgac

SEQ ID NO: 13417 - DNA, 201 bp, Bos taurus
agcaactgcagcagcacatgatgtaatccttgtaaaggtggatggcaagtgcccatgggaaatgccaatttgtagttgacactgtctataggaaatagtcggtcagtcatgaacaactctttgggaccagtgggaataaagacaataaaatgactttcaaatcatgatttttgaacttctgaagtacactttttatattac

SEQ ID NO: 13418 - DNA, 201 bp, Bos taurus
cacagagtcttagccactgaaccacaagggtcatccctgattcttctttttaacaattcctttcccctaacttcctccttgggaaaaatgtacaaaaacataaataagtaaatggagtcaaaattagaaagaacagtttgttaacttttaaaaataatctgttcatttattagtattttattcacttaatataatcattct

SEQ ID NO: 13419 - DNA, 201 bp, Bos taurus
aatttaagactaaataatttttagctaccatgttcctgtctccaaagtttagactttttttgacagtcaaatgaatttacaacatatttgaagtcaagaaagtacagatatactttccaggcagttacggatgagggaatgaaaatgatctatactcctaaggataagtggtagatttccagagtcagagactctgtacca

SEQ ID NO: 13420 - DNA, 201 bp, Bos taurus
taccatagggactggaaagcccaggccatggggctgctgccagaaagcacattctttgaccttctgtggtgggtccacagagtggaaccaggtgttcttttagcccatgccagaatgcattggctgtccgactggccacctgcctccaccccactgacagggcttttggctggccctctaccaaacagctgtgctgggagc

SEQ ID NO: 13421 - DNA, 201 bp, Bos taurus
cttttttgaataattttcattttgaaacttgaaaaggtagaagaatccagcctccttctgctcgtaggagacatagataagcatctcccacaaaggtacacgattatgttacccttctggaatcctggtagccaattcaagttgtttttgaagcacaatgctacccatgaggcctaaactaaaagaaccagacattccaga

SEQ ID NO: 13422 - DNA, 201 bp, Bos taurus
ctaataatagtgtgcttaaagtaaaagccatttcttataccttcgtattatagctaatacattgagactctaactactgcttttaaaattaaataactgcgttaataatctatgtgatccaaatgacaggaaatgattctcaccttatatgatgatattagtaagagaaaatttgtagcaatagacttttaaatcaggcca

SEQ ID NO: 13423 - DNA, 201 bp, Bos taurus
tggcagaggatgagatgtttagacagcatcactgactcaatggacatgaatttgagtggagaacagaggaacctggcctgctgtgatccacagagttgcaaagagttaggctcaacttagcaactgacaaacaacagcaacacgtgtaagcggagaaaagacaggacagtaggataaatcatggccaaattttccaaaggc

SEQ ID NO: 13424 - DNA, 201 bp, Bos taurus
ccgaaagtatgtctgaaaagccaatttatcactccagatacaatctactcaccatacaggaactaagaagttttaaggccctcagacaaaggaacaattatattttaagaataagtgaaattaatgaagtttacctttccaagtctcttcttaaataacattccattaaatttgtatttatactttataaaatattctgac

SEQ ID NO: 13425 - DNA, 201 bp, Bos taurus
gctctctctttgtttttccactgagaggccaaactggtcaacctctatgccattgtgttctctaagtgataaactggtatcaacctttatgttcatacaccatcccaggctccagagacacctcaagctcttataataacgcccttcattgagaaatctagccttctgcagttcaacatagataaacaaggccactcaagg

SEQ ID NO: 13426 - DNA, 201 bp, Bos taurus
ctgtaggaatgccttcatttcatcacaatggccttggaagtattgacccttgaagaggaggggaggagcttgaaaactgaaatgaatcaaaagcaatcaaggaactatatggccctaaagagtgtgtggatttgcaggaaaattgttttgtaaacgataattacattatttggagttaaaagaacacagctgcatttcata

SEQ ID NO: 13427 - DNA, 201 bp, Bos taurus
gcctgaggggaagcctaatctcctggaccttgaccttggagctgacactccaggcatctgcttcctgaccatgcctcaacccccagactcaagatgttctagggaggtggaggccaagccttccaagggtttctgactaaataggaattaactccctctgttccctggtgttggtttgctaattgctacctcctcccacct

SEQ ID NO: 13428 - DNA, 201 bp, Bos taurus
aggagagtgtacttcacagagaagaaacctgaatcaggtgggtgtgtaggacgaagaaagacctggcctgctgcttccaagaacagcccccattgggccttctctgctgctctgaaagaagtaaattgctcagttttggagttactctttgtgccttgcaaagtccacttaggccatcgaaacagtggttttggttttgct

SEQ ID NO: 13429 - DNA, 201 bp, Bos taurus
acctctagagacagtagccatcagcaacaccagaactaaatgtactgaaactttgtgatgggtggttctccagaaaaatacccaagtggtgtattctaagtgaaagaaagataggctggttaccataacctggaagatgagccctgatattctgtactgctccataggacagaagtggagtcaattagaacaaataattgt

SEQ ID NO: 13430 - DNA, 201 bp, Bos taurus
caccaaagaaggtgattccagtactgtctttttgaaaagagatcctaatgtagtgcctcttctgagtgtttacctttgtcatgtcttctgaatatttggtccacatgcttggtgggcacaatgccattccgttggggctagatattcttgaaagaaaataagtactggccatccaagtcctgtagaaaaacgttcttaggt

SEQ ID NO: 13431 - DNA, 201 bp, Bos taurus
agagccagactcagatatgccaggcttgttggaatttacagatggaggatataaagctgtgattagcatgctaagggctctaatgggtaaagtagacagcgtgtcagaacagatggccaatgtaagcaaagagatgcaaaatcaaacaaaaaaattaaaagaaatgcttgagatcaaaaacagtgtaatagacatgtggaa

SEQ ID NO: 13432 - DNA, 201 bp, Bos taurus
tatgtgggtatatagcaggctcactgtgtcatcatgctaaccaggaaaaagaagcccttagtctataaaaatccaaaaatagtgagttgagcaatttcttaaagctgagaagaggttacggagagaaatcagtaatctaatagtgtcctttgctggcggcaataaagacattttgctgatatattcattcaaaatttccta

SEQ ID NO: 13433 - DNA, 201 bp, Bos taurus
tttcctattcacactctggaactcaccaagatggacctttctgcagattaaatcatagccagagagtgacatgggccctgaagtggaaaaacacagcacacgatgttagtatcatgttgaagctaggtaggcctgatgatctctatgccatctacataaaaatgtcagacttttgcaaaatttaactgcacgagaaaagag

SEQ ID NO: 13434 - DNA, 201 bp, Bos taurus
cctatcacatttcctctccaggactgtgtattcagcatcactcagatttaaccatctctttgagtttgtcttcctttaaagtggctcctatgttacaaaaaactaatattaatcaaatgtttatgtttttctcctcaatctattaatctttatttctcagtattactttcagatctagccagagactgtaagagaattaga

SEQ ID NO: 13435 - DNA, 201 bp, Bos taurus
cagctgaaatacagatgaccctcccgtctctgtagagaacttgagagctacatattaaagacggcaaagcctccaccaaccaggtccttggatagctacacgaaggaaggctgccaggccatcctaggcaaacacccagtactcttagcaagaagtaaatttcttttggtttgacctgctgtaaacattgggatctatttg

SEQ ID NO: 13436 - DNA, 201 bp, Bos taurus
cactgagctacagtccatggggtctcaaggagtaggacatgactgagcaactaacactaaagcctttcaatctaggccagtcatgctcctggaagcttctgtgctccatctttttttcttaagttgtgtttttttttttttttccaatgtgggccatttttaaagtctttattgaatttgtcacaatattgtttgttttat

SEQ ID NO: 13437 - DNA, 201 bp, Bos taurus
attcaccaccctacttttccaccaggacttagaaagataaggcaactagaatcaagaagtcagtggcctcagccagggccatgaaagtgtctcaccatccgttaaaccttttctctcccaagataattccagttttcacactctgtggccaagagagatggaaaacaacccactgtgttttgtttttttttttcttcttta

SEQ ID NO: 13438 - DNA, 201 bp, Bos taurus
atgaacccaaaggaaatttgcaaaatatcaaatcactagatgtaagaatttcatgcgtgcttcaaaccaggagagaaatttattttgagaataacaacaagataaaaagaaccagaaatgctagaaaatttttctgtgctttcacttagaagacaagaataaagattgtgttcatcccttctggaatgagaaagacacact

SEQ ID NO: 13439 - DNA, 201 bp, Bos taurus
cccttctgcttttatcatctctccttccaccaagaaaaacttctcatgaaaacagatttgaaaatcacatctactgggcccagaaacagtttcacagttagatagaagaataagttcaaataatgatgccctagccttatcatttcagttgctcagtcgtgtccgaccctatgtgaccccatgaattgcagcatgccaggc

SEQ ID NO: 13440 - DNA, 201 bp, Bos taurus
ctcctggcacaccggcctctgcagaacctctagcccctgtactggctcaggaagctgcagaaacaggaacgttgcagtccaggtctcattgctgacaatccatagcctaattaattggcctccccaggcatcaatgacactatccagcaaatcctttactctcttccttcacagaggcatagccgaggggtgcagcaagag

SEQ ID NO: 13441 - DNA, 201 bp, Bos taurus
catgcctggattgtaagtccaaaaagcagttgggttttttgtttttggggggggggggtttgcatttaaccatcatactgctatccaactgaaagagatatatcctattagaagaaatggcatgccagtatcaatcatcttcacaaattcaaagattcaaagtacccagtcagctaccaaaggacaagaatttttgtcttt

SEQ ID NO: 13442 - DNA, 201 bp, Bos taurus
ttctaactttaaagacacttaagaaacatgaccaaatgtgatgtatcaaccatactcatttttctggctcaaacaaaccaattgtaataatgtatttttttaaatgtagaaaattggctacaaatatttaattatattatatcatctcaacaggacgaaatggccggatggcatcactgactcaatggacctgagtttgag

SEQ ID NO: 13443 - DNA, 201 bp, Bos taurus
ctgggggatgtgcatttaggggtcggccattgacagcatgggttcagtgtctcatctgacagtgtcacctccattgcttcttagaggtggcctgtgcgagatgtcccaagatttcccatccagtggtagaagaaacacctttgagttgtcacccacacttagtcggaatgaagatccgcttttcatggccttgacttacgg

SEQ ID NO: 13444 - DNA, 201 bp, Bos taurus
tattttccccaggaatgggctgtaggcctccattctaactgcctttgggcctagtactctgcatagggtgaggagtccacagggccagtgggacacgcccgcttggaagctgttctcccacgttttgaccacattctgggtatcaaggaaccccttaatttcctactcagacatgcctgaccctgtttcctgggcctcttt

SEQ ID NO: 13445 - DNA, 201 bp, Bos taurus
aggacatggtcactacatggagggtaccccaccctcacctctggataagcgggaaagccactgacatgagattctgttgccaaaatggctctttcacaattgtgttagggtgcctgtaacttccatcattagttacttttttttaaaaagccagtttcccccaagctggtgtttgaggaaatactaataagtgctcagtgc

SEQ ID NO: 13446 - DNA, 201 bp, Bos taurus
tttgctggtctgtgtgaatgaggccccaacaggatttctggcttagactgctctctaaagctctgcatcttgttggaaatctctcctcagaagactcaccagttccactcagagtctgatttcagcaatttgaccatctcaaaagcccttctatcttgacttccctgccaataattgaggatctactatatccctagtact

SEQ ID NO: 13447 - DNA, 201 bp, Bos taurus
ataagttcccccagagaactcataggagaggtgactctgtttcagatcttttatttaattctcattatattccactgtccagtttctcagtgtcatggccaggtttcatgagccaggcactgaaagtactttgcatgtactattttaattaattcttacaatagcctatgaggtgggcatattattatcctcactttatgg

SEQ ID NO: 13448 - DNA, 201 bp, Bos taurus
agctgggggtttgagcctgaccgggtggttattagcctgtcctgcctccatgcttgtgtttgcttttcgaccttattggcagcttcctagattcagttccttcttcagggcctgaacacttccttctcttgtttccttcataatcatgaagtgcccagttgtgttaaatgtgttttgatgctggcagacaccatttttcct

SEQ ID NO: 13449 - DNA, 201 bp, Bos taurus
aaggcattttcaacttacaatggatttattgaagtgtaatagtaaattgaggaagacacatatttttctttggtcatcactgagtcacatggactcatctatctaggtgggctggaaaattcagtctctggttgggcagccacttgatagttataatcaacattggaaggagaggtttggtggagagatagtggttctcag

SEQ ID NO: 13450 - DNA, 201 bp, Bos taurus
cattttccaaactgagggaaaggaggagaaagagagagatggaactgtaatctggggaggtgccttatctttaacaacctggtcaggtggcttagggttgtagtcctcagtgtgttgcttcatttgccctttccgtacggccatctgacagccatccaagcccgaggtccactctggagctggaggagcctcctgagctca

SEQ ID NO: 13451 - DNA, 201 bp, Bos taurus
gagtcacttccaagccctcagtttctcaagggctgtggatggaaggtctcagttctccagcggatattgaccagaggcctcccctccagctcctctcactgtaggtctctccaatacagaaaccggcttcatcaaagtgtgccagccaagaaggccaggcaaaggtcgtagccttttgtagcttaattgcaggactgtcat

SEQ ID NO: 13452 - DNA, 201 bp, Bos taurus
aggagggcagatctggccacctggggcagagaagactcctattttaaccaccagctccctggatgtgatgagttaaccacccaattcaaagcagaggacgtgtggcccagccacatgatcctggcgcacccagcacacagcataaccagtacgcagggaagatggtctggcacctgccgctgaaacctgcagagcagagca

SEQ ID NO: 13453 - DNA, 201 bp, Bos taurus
tgactgaggtgtctccatttcttgctatgataggagatttcattaaggcacctttagccagagaaaaaaatgaagctgaagaaagccctgaacatacaaagtttctcgtggctgtggcccatgagctgtgtgtcccctttgctgggaatcaaatgcctcccttgggtgatacctcctctaccccagagcctgagagagtcc

SEQ ID NO: 13454 - DNA, 201 bp, Bos taurus
ccctcaggttcctactgatgtatttctggtgagtatttcagggagaaaaaaaatggaacccaactttttaatctgcttctggagctcacccaccatttacatggcatggtgactaaacccgaactctgccaggagccagtttaacgatgcagttaaatgaggaaaatgttgcctcaagtgagtagcacctgttttgcttcc

SEQ ID NO: 13455 - DNA, 201 bp, Bos taurus
atatatgtatatacatataccacatcaaaactatacctagatcacagcttcaataagccatcattacactattttaaatctgtggtatagtggctcagacagtaaagaatctgcgtgcaatgcaggagatcccggttcaatcccttagttaggaagagcctctggagaaggggatggctacccactccaatagttttgcct

SEQ ID NO: 13456 - DNA, 201 bp, Bos taurus
gcaattaccaataatttacttcatctcctaggtgctgactccttgatgcagttttatatgcaggctgtgaggttggggtgagggagtgttaaattattaacagctattggtaaacctagaatattagaattgttctttgggactatctgtacacttagttaaaagtcgtatttctagcatgtctctctctcatcagcaatt

SEQ ID NO: 13457 - DNA, 201 bp, Bos taurus
ctaggagacggctccagagatctgctggctggactgtggtcctccccagccaggtgacctttagcaagacccaagattctttgaacgagaccttctttacgtgtgaaagagtctgaagagctgacttctaggtctaaagctccctgttttgagaacttgattgaaaagccacattaatcacttctgtgttcaggtacaccc

SEQ ID NO: 13458 - DNA, 201 bp, Bos taurus
aacctatgaagcaggaagtaagtagggaggccatctacaggttcctacaatcattcaaatgtgccgtgatggtggcttggaccagggtcatggcaacagggtggtgagaagtggccagtaagaagtaacaccaagaagatttgctgatgaatgagatgtgagtggggagaggttccgaggactgattagtccaagagacat

SEQ ID NO: 13459 - DNA, 201 bp, Bos taurus
tgggcagacagggagagagaagaagaaagagggccaagtctaattgaatgactgaccgacgagtgtatatgcctgagtaatgctagcaagaaaatgcacacatgagaaaagtattgttccgtacacctgcaaaatctatgctggacacagtggtacttctctcataaaatagtattgctttggttcgtaaagtaataatgc

SEQ ID NO: 13460 - DNA, 201 bp, Bos taurus
aagcattggttgtgcgacgtgtggtcaggaattgacacggagaaggattgggccctttctggtgaccagtgccggctgcaggcctggtagttttcagtgcatctcatcgatttgctgaacgtattctcagacataatggtttcgccagaattcagaaagttgtcttggatcagaccagcagcagaccaccaaacagtggcc

SEQ ID NO: 13461 - DNA, 201 bp, Bos taurus
ggttgctttatcacttggaaagagatggggaactcatttcacatgcactagaatagatatgtaagaccaagaacaacagagatgaaagatacacatttgcattcacagtcagctcttaatgatctgtgtggaagaaaaagaaacgtggataatttaaaacaatacacattatcttttcttcacttaagaatttagtcacaa

SEQ ID NO: 13462 - DNA, 201 bp, Bos taurus
cccaaacctcgaagtcatcctcgactcctctctctcactcaacaacaaaggcttcctcttaaagtagcagcagaatttgaccacttctggaccctcatcatgtcggcctgtatttttaaaatagtttcctctctgactcactgctttggcccatgtctccatacaatgcattgtctacacagcacccaatgtcatctatta

SEQ ID NO: 13463 - DNA, 201 bp, Bos taurus
ttctggcttatttccaacatgtttattttaatttgaacctaaaatttgtcatgtagattttgtcaggtttcttgaatataagtttcacagttcttaatgtgaaaaacaggaatcgtgctccatagtttgaaaacttaccctataaaccccagtaatgaagactggtattggtgaaggggtagatggatgcttggatcagtg

SEQ ID NO: 13464 - DNA, 201 bp, Bos taurus
acaatcttatgtgattgtccccacagtgaagacttctcagaaaatattgttcagatatgactggtattaatagataactgaaaaatgcttgcctttcacacatggttcatcctttacacatgattgaaaaaatcacatgacttgtcctttacattcagataaaaataccttttacctatggctcatgttttatagggctat

SEQ ID NO: 13465 - DNA, 201 bp, Bos taurus
tgtcactttcagttgtttagggcatatttgtgttgctacataagtatcatcatttctagtgcatctaagatttagttaaaaatctgtttacagttttggcgaattctatcttggagaattgttatgtgaattgtttgcttcaagaatctaaaatgtattttttataaactgtgcctatttcaaaatagaaaagaatatatg

SEQ ID NO: 13466 - DNA, 201 bp, Bos taurus
ttacttgaaaaccactttgattttaatgtgcaaaagataaagaagaaagaaccctcaaaaagctataggattcagatacttcttatttattaaaagagatatcatgatccttcaaataatactggactgaataagggaatatcattttcatcatttgaagcttttgtttagaaaccatgtttataagttttataaggcact

SEQ ID NO: 13467 - DNA, 201 bp, Bos taurus
gatttcttagaattggctgaacatgggacagatttttcttttccagtagtgagcttggttctgtgcatgtgcaattcatgtagtcctggcctgccttttcatcttctgcagatggtcactcatagaacttctagtatttctctcaaatataacagtcagggatggaatattcagacagtgtggccaccctgggagacatgg

SEQ ID NO: 13468 - DNA, 201 bp, Bos taurus
tctcctacttcaactcatctcctagaatgtcataggacaaatgttgactttgctatttttttgctcaaaaactcttagtagttcctcattccctccaaaacgtatgataagcaaaatttgactcaggaatgtccacagtgggattgttaataaaggcaaaaccttagaatcagcatagattatttggcctaaaggtgttgt

SEQ ID NO: 13469 - DNA, 201 bp, Bos taurus
gctgctcggctcctcagcttgggccgcttggcagaggctcggctgcccagctgtggcgagcgtcatcccttagaaacacagctgttcgaagggaagcaccaaactgaaactgggctaggcccaccgaggccgagctataatcaggactgacacttgagtcccctagaaggacaagcgctgtaatcgaattctaatctaatt

SEQ ID NO: 13470 - DNA, 201 bp, Bos taurus
gaacttctgttgtgtcctgagtctatgacatactactggttgttgaggatgtgggattcactgagccaaatagagcttcaagtccattattctcatagattaatcattccttgtatcatagcttcagatgttgaattcatcccagtagatgtttatcaaacatcttccatgtgtgaggcactgttgttgatattaaagaag

SEQ ID NO: 13471 - DNA, 201 bp, Bos taurus
acactatgttagtgtgaacataaaaaaaaaaaaaaaggtaattttcaacattttgttactgactcaaaagccgagcaaaataaagttaagagaaacagaaacttggttaaaagagacatctgatttttcaaactttatttttaacttaaggctttgacggtggggatttcagatttgaagtatagtgagtatgaggctata

SEQ ID NO: 13472 - DNA, 201 bp, Bos taurus
aagtgagaaaatatgtttaagatgactggcacttgtagtgagcattcaataaatgttgcctctaactaggtaggaagattgaggcccagggaaatcataatatgatcaaggtaactaaggtagctggttcaaggctaagcaggattagaatgaaagtgctacactcaacataccaacaaatttggaaaactcagcagtggc

SEQ ID NO: 13473 - DNA, 201 bp, Bos taurus
ttatgggttacttgcccaacactaaagaactgggttgaaaatgcaatgtgtggtttataattggtcagttcatccctacctttgaatctgcacagaagccacttgcaaataaatctagatctccatttggcacactccacaaagcattctaaacaattcagtgtgttcacatgatgagattcccattatttatgcatgaag

SEQ ID NO: 13474 - DNA, 201 bp, Bos taurus
ttagtttcccctatgaacctcgagagatcccagcctactgataaatgatgaatttacaaatttagcatagctttgtttgtttttatttgcattggttgtcgcaggtgtcatcacaactgtttcagttcaataatagcaattgcaattttgagaattatcgtaaacatctgattttgaaagcattttttttttcttttagaa

SEQ ID NO: 13475 - DNA, 201 bp, Bos taurus
ctgtacagaataccatctaataatttcaaatgagcatctctgttcttcctctttcttgtctccaatactcagaatatttttttcaggactcttgaagtcagcctttaatttggccaacctgtctttgagctccccctactgttttccacttaaattatatacctgtttattatgcataattatctttaaaatgatggattc

SEQ ID NO: 13476 - DNA, 201 bp, Bos taurus
aaatcctggcaggaaccatttcattacaattacaaaatatataaatatatgattacaattgtgagaaccgctcaaaaggagacaagggcccaataaaagtgtataaataggtacctaacatagtctgagcatttggaaaatgtttccctggggatgatgaggcctgaagatgagtaacatgttctgtggagaactaagtga

SEQ ID NO: 13477 - DNA, 201 bp, Bos taurus
caagaaaaagatcaaaattcaaaatttcaggtacagttgttactgaatgtgtatttctttagcaccactgtaaagctgaaaaattgtaagtcatatcttataagaccttgtagcagctgcccctcagggaaagcacagatttttctttcaaatatcaaggaaaatgcagagaattttatgattttaatcgatcactgcttg

SEQ ID NO: 13478 - DNA, 201 bp, Bos taurus
ggggtggagtctgggccttcagaagaaaaatgacagtctccacaggagttgcagttccttatattctttgcttgttggaaggtctcagagaatgccagaaggggagggtttggttagctggggccttgaagctgatgatgaataaaggacatgttcagggtgggtaaccatggtggttcgatcaccaggacaaattatgaa

SEQ ID NO: 13479 - DNA, 201 bp, Bos taurus
ctttgtgaagcctttccacaaatggacaggattcctctgtctttgaattcctgtggtacttgctatatagctctttcatggtgttcttctgtgaatcattcgctttactccagagtgctcatctgagcttttcctacctctccagaccctgcaccatattgtaagctctttgaaacagtggccacagtcttagctcataat

SEQ ID NO: 13480 - DNA, 201 bp, Bos taurus
ttcaaagtctggattcctaaccaccatatcagtgattctcaaacttctatgggagtaaacatcacttgagaagcttcataataatacatcaggtggccaacgtattggatttcctttaggagtgattggtgtgatctccttcctgtccaagggactctcaagagtcttctccaacaccacagttcgaaagcatcaattctt

SEQ ID NO: 13481 - DNA, 201 bp, Bos taurus
tccttggaggtgggttctttttccctgcacctctctggcattggactgggccaagcacattgctttggtcaatggaatatgaggagatttgatgtgagccactggtgagcaagaggcacagaggccttgtgagtttcatcagccctcttgtattcttgacagagtgtggtccactggagaagggaatggcaagccacttca

SEQ ID NO: 13482 - DNA, 201 bp, Bos taurus
tctaaatctatttggggcttgtttttctaataaatcattcatttatttcttaaatcaaagcccactgaaagattcaaagcacagaatactctttcccaaagagaagtaacctatatttcctcaaaattatggagctaaattgctgctcttgactttaaactccacacagctatctccttaacaaacagcaggttggaacaa

SEQ ID NO: 13483 - DNA, 201 bp, Bos taurus
gagcacttcctgcctctgaatctacccacagctccccattgctgccccttaacatgaaaggtgaaatggaaggaagactcctggtacaagcaggttaggggaagagaatgttaaacatggctttaacattgccttataagaactactcatagtttttttaatatcctctctcagaaagagatcctcccatttctgatttct

SEQ ID NO: 13484 - DNA, 201 bp, Bos taurus
gaaggggcagaagactcagagggccagacttctttgataatttgcatgtggaagagtccctttagaaccttcccacccctttgcataaatatgcacagaaaccctgtctagttataagtgtccagcctccccttattgggtgtgaagactgaagtcagcattgcagaatctggtatttcaaattggcagagatgggcaggg

SEQ ID NO: 13485 - DNA, 201 bp, Bos taurus
aggcagattctttaccacctgagccaccatttgagaagtaacaatggagaaggtccaatttttctcttagtcctgaggaatagctttcagtatgtccaagctcacagagtactgcacttcttgaaattattttgtatacatctatggctggtgaaacccctggtggctcagatggtaaagcgtctgtctacaatgcgggag

SEQ ID NO: 13486 - DNA, 201 bp, Bos taurus
agcctgatataaaatattagtaatcattctaaagcttcaagaaattaatgtacacatgtacacacaaagacaaatttatgacagaaggctattatttcactgtttaaaagaattgaggttaaaaagcatggttaatgtcagattcaggggtagaatttatagcggaaattatacctttcacagctaaatcctcccctaata

SEQ ID NO: 13487 - DNA, 201 bp, Bos taurus
gagactctgaataatgttgtcttttgtggaaagggtttagcccttttctctgtaagatgaaatagaggtggccaccttaatccagtcatggcctgagtggtgtcatggatgagttacagttttggcaaggctctgtctacctctgtatttctctcctcctaagataagtgccccagagttccagataaaatggccctcttc

SEQ ID NO: 13488 - DNA, 201 bp, Bos taurus
ctgacttttttatctttccacatccgttacttagactattgcaaaagcctcccgacatgtccactcatttcattcctgggccactttaacccacctcttcactatatgtagtgtaatttcataaacatgcaagccaaacagaaacgtgttcctctgctttaaaccacactgtccatactatgaagtccaaactccctagca

SEQ ID NO: 13489 - DNA, 201 bp, Bos taurus
agacacaattttaaaaatattcaaaaagcatttaaaattctaactacataaacaaatgctcatgctctacaccaaaacaaaattgcaaactacacatagcatcctcactggacagacaaatgactcttgaactggtaagaagtagctggaactgggtcctttagaacaacgccagcaacctttgcttggaggccaggggcg

SEQ ID NO: 13490 - DNA, 201 bp, Bos taurus
ctgagcgactttcacagacccaagtacgtggagccctgccctggacacccactgaggctataaccagtttccatgggataaggagtctgcgtggccaaggagagctcgcatccctcttctagaccactctctgggagctgaggatcctggaatttcttgcccaaacatccctaagcctgcttactgggcctgtgagggcct

SEQ ID NO: 13491 - DNA, 201 bp, Bos taurus
gcaaatgaggtcccaagacaacagtagccatgtctttattacaggcctgtcttccaaaatgggggacatattcaaattctcactgagcccctgaggcctcgctaatgactaagtctatttcttctaactaggatatgttcaggaagttcaaacatccccagataaattttccttggagctgcacatatggcaatgaaaaga

SEQ ID NO: 13492 - DNA, 201 bp, Bos taurus
ccgtctccattcccacctttagacttgcttcttttgcttgcaagttgactctttcctctcagggagggagtccatcatccataagttcatcgttctcatcgtttgcttggagaaaggccctccaaagtgttccctagcaaatccagatcatagcatctgtcacatgtgcccacacatttgttgcttcttgacaatggaaga

SEQ ID NO: 13493 - DNA, 201 bp, Bos taurus
aaaaaaaaaaaaaaagttttgacattagaaagaaaaaaacaagaacatacagttgacccttaaacatagtcattagaactgtgcaggccaccttacatgtggatttttatcaatattaaatattagactactacactatccaaaactggttcaatttgtgcatgcaaaactgcagatatcaagaaacatcagatatagacg

SEQ ID NO: 13494 - DNA, 201 bp, Bos taurus
cataaataacgcactccctatccaagtatggagctgagggttggatgcaggagtcaggttgatggagatcaaagtaactcctccgaatagaactggagaatgtggcttcagagctgatgccaggccagctcacttgatactccacctctgaactagactcactcctttcctggctgggctgactacaggctacttgccacc

SEQ ID NO: 13495 - DNA, 201 bp, Bos taurus
cctcaaactttgtttgactgatgtgaattctctctctctcctgtgtttaaatgaagtcacgtttgtataccaatggcttaaaattaggaaactcctaattttaggggagaaatacgggaatccaaaactgccatatttgtaagacattgctttgctctttaagctaacccgccattctattgggctattgattacatttct

SEQ ID NO: 13496 - DNA, 201 bp, Bos taurus
aaatagcacagaggtgctttacctcctcttcctccagggtacttctgcggtggatgctaacggaccagggtggggcggaggaccctggcatcctgtctccattctctttctgcagccgggagggcacatgtaagccagtcgtgccccttgtacacttggacttggaggctggtgccatatctctctgcttccgtgcaagtg

SEQ ID NO: 13497 - DNA, 201 bp, Bos taurus
ccaacccagcagtgttggaggcagtgaaagtattttcaggagcagtggcctttttgtttagtctcaaaaatgtctccccagcatccaccaccgtgatcctgcagtctgccgtggattcgcctatatttaagcctaattattataggcatggcttccctgatagctcagttggtaaagaatctgcctgtaatgcagaagacc

SEQ ID NO: 13498 - DNA, 201 bp, Bos taurus
ggaaaaccaggagtgtgtgatcctggaggccatgcaaaggaaagtcctcacatagttactttcttgtaagatgattgtgcaacaaaggaaaaagctttgccggacagtcctctgtactgagtggcctggatccccaatctttcaaaagcccctcctagcagcttgataacaaagtttcccagtatggaatcagcaacactc

SEQ ID NO: 13499 - DNA, 201 bp, Bos taurus
attattataatatttactcaaatatcagtagaaaactgaaagataagactttccacagtgtgagacagaatgactattttattggcctttgaggatttattgttatcttaaattgcaaatgcttatgtagtgcaggcatgctaagctgcttcagtcatgtccaactctttgtgatcccatggactacgtggcctgccaggc

SEQ ID NO: 13500 - DNA, 201 bp, Bos taurus
atccctgctgagcccagacttctagtcaaccctgctgagatatcagacatgtaagcaaagccatcctgggccctccaggccagctcaccccacagttgaatcagtcagttcagttcagttcagtcgctcaggtgtgtctgactctttgcgaccccatgaatcgcagcacgccaggcctccctgtcaatcaccatctcccag

SEQ ID NO: 13501 - DNA, 201 bp, Bos taurus
atggtccctagttaggtctctagggtcacaaagagtcagacacaacggaagtgacttagcacacatgcacacgtgagcgcagcttggcagagaaggctcacaattgtgcagttctggagagagaggtctaccagacagggagcccgtgaccctcagggcagaatgagaccccccggcagagaaagcacaagaccctgaaga

SEQ ID NO: 13502 - DNA, 201 bp, Bos taurus
cttgggaaagtcctgaagcagaactcacactgagggtttctgctaagctctcttagaaagcagtcctagtcagtatgctgccgttttaatcgggatgctcgatgcagtgatgaaataaaggaggactgaattcttaaagttcacatttaggtaaaagtttagacatcttaggtgatgagtgtgaggcatgatcttgatgaa

SEQ ID NO: 13503 - DNA, 201 bp, Bos taurus
agcaagcttttggtttgcacttaaattttttttcactgtgttataattatttttaaaatattcttaccctttttctggtctttttggtatattcttcttagggattatagtctgtgcaagaaaaaattatttttgtatgtgttgctttcagttgttaatggccattttacagtgcacattatacagcatattcttaactgt

SEQ ID NO: 13504 - DNA, 201 bp, Bos taurus
ttgcttttgagaagaaaaagtcactactattccttcaagaagagaacacaaaggatgtttgatgtcagaagctacttaaaccctgggaggattctttttttttgttctctataatctattcatccctgatcatttttgcaacacagagaacattaggttaggaaacaatcttaaggtattttcattgtctcctgtcttcag

SEQ ID NO: 13505 - DNA, 201 bp, Bos taurus
ctgctagcccccaagtctagtttgtgaacctaatgatagctaatctgggagagaagggcacaagcttttcttgatttgctggacagactttgcactaagtgggcctattaatcaagccaatggtgatctttacagtgtacattgtgctgaagttcccttgataaattctcatttaacacaatagagcgcagatctccttgg

SEQ ID NO: 13506 - DNA, 201 bp, Bos taurus
ctaaactcttcagcttggcttctaagccatcatttacagagtgcctaatgtgccctgcactgctgtgtacacggtggagctgtgatcaagatcaacaaaggctcctggcctcagagtcttaccttctgtttggagtggtgtggtgttgggaccaaataataacccagaaaacaaatagagaagataatcagagattcaagt

SEQ ID NO: 13507 - DNA, 201 bp, Bos taurus
ccacactcgctagcagtatataagagttctagttgttccacatccttaccagctcttgttattgtcattatgtaatgacaactatgaaatcatcattgcaggactatgtcatgttagtcattcttataataactgataaagaggaacccttctcttaggtttatgactatttggggagtgctgttctaatcttctatccat

SEQ ID NO: 13508 - DNA, 201 bp, Bos taurus
cttttatcactgagccacctgagaagcccccaaaatgtcctggaagctctaaaataaagtacttgtaagcctctggattgcttcaggagctccagaacacatgatatgcagggtggaattcttgtcttctcacttctgtatcctagcagaaaataaaccccctgtctggcatttgatgacagtaagagtgaaacttgagta

SEQ ID NO: 13509 - DNA, 201 bp, Bos taurus
gccaaaaggcatcagcaaactattctgttcttggtgctcactgataccatcagggtaaaggctgatgaccccagggggctgaggtctactgtgatcgaacccaactatctagttcagatggggaatcatgaaactctcaaagggcttcattcccactggccactctgctgaaaggggtcccaaggactccaagcctcagga

SEQ ID NO: 13510 - DNA, 201 bp, Bos taurus
cctgagccttggccacatctttgtaaactgtcccttcattaacctctcctcagttaccctgtttgattgtgccatctgtttcctgtggtggttctgattgatacagtatgctgtatcagccaaatgtgaagggtgtctctagacagaataaaatgagtgcattcaagaaataattcattaaatgagtgtaaatcaactttc

SEQ ID NO: 13511 - DNA, 201 bp, Bos taurus
ctataggtgttatttggaataactgttcacaaaactgagagagaaaactcattgtgggagacagtagggtatatgaatttaagattgcagacatagagtagtttttggagagaaggctccaatgtgtgactggttggccttgggaaagatggggagcttaggaagcagaagaggaaatgtacccagggtgctgggtagcac

SEQ ID NO: 13512 - DNA, 201 bp, Bos taurus
gctacatggagacaaagtgactgtcttcaggccaggaagagcattctcatcagaaaccacaccctacctgattgatgattttggactttccggccttttaggctgtgagagagaaaatgtctgttgtttaagctgcccggtctttggtattttataaggggagcctgagctggctaagtcagggagacagcggccagaaaa

SEQ ID NO: 13513 - DNA, 201 bp, Bos taurus
tacatattaaataatgcttaatgccgtaaatcgattgggtgctcaggaattactcagtaagctttagaaattagtagggcttttacccagagataaaccaattcacccaagggcagcttatctttgacaaaggagtcaaaaatatacagtggagaaaagacagcctcttcaataaacattactgggaaaactggacagcta

SEQ ID NO: 13514 - DNA, 201 bp, Bos taurus
gaattaaactcatctcagccttcctctggatataaaagttattgggtttcttttaaccatgcttttctcatctccatgttgttcatttgatattctctgagcaccttatttttgccagacattttgctaggccctcagtatatcttgggcaaactctgggagatagcgagggacaggaaggcctggcatactgtggtccat

SEQ ID NO: 13515 - DNA, 201 bp, Bos taurus
ctagtggctaatcccctagtttttggactcaaccagaaccagctaatagttctggtccattccttgttaatcacaggactctggagaataatcacttggcagtgttgcagtttcttctccacagttaaggtaagatacctacttcaaggggttttcatggggattagataacatgtgtcatgtgtagaacgtgcttctcat

SEQ ID NO: 13516 - DNA, 201 bp, Bos taurus
aggccgttcctggagaaggggttagctgtgggccccagcagctgaccctcatagcagcagggggtgagagactcctgaagggggtgtgggctgcacagaacagtgtcactgaacaaggcctgcataacagccctacacaggaggacatcaacagaatcccaaagaagcaaaggtcctctctcactcttccagtttttaaaa

SEQ ID NO: 13517 - DNA, 201 bp, Bos taurus
tttcatttggcccctatatagtgctgtttaaaattgtttgaataattgccagtacttaacgattatgagatttatataataacctgaatttttcatttctcttgcaaaattgttagtcttggccaaactgggtacacatgctcacatggcaatagcacagtgctgttcagcagcagctacgtcatgggatgagccatgtgc

SEQ ID NO: 13518 - DNA, 201 bp, Bos taurus
ccagaattcctaacttaagagaatcattactatttgacctgaatggcagattcctgagaagttccattttcaaaatttgtctttatttggcctgattcagagctagatctgtgaaagtaactgtattccaggggcatttttttaaaaaaaaatttcattggccatcattttacactaaagaggtctgaagcagcaacacca

SEQ ID NO: 13519 - DNA, 201 bp, Bos taurus
tgccttagggagcccatgcctttgtcaccatgttctaagtctcctgacagtgcctgggaccagtggcgcccagcagtgccaatagggagatgttccctgagcctggctatgggcctcctatgctcttctcttctctgcagcactcagaatgaccctcctccacagcacaggcagggacagaaagtcactctggaatcatgg

SEQ ID NO: 13520 - DNA, 201 bp, Bos taurus
acaaagaaagaagatttggccaagcctgaaaaatcacctttgctttactaaaccaaagacttagcctgagaagagaagacttgagaaatcaaagagtaaacagagattactgctgcatcacttggccaggagcttaattctcctctactaatgagtaagggaaccaaccacacctgctgagtgttggcagtagaaagaggt

SEQ ID NO: 13521 - DNA, 201 bp, Bos taurus
aactactttatcatgtgcctactatgtatgtggccttgtgcaatgtttgaggaattattcaaagaatagtgaagagaaggttctgacagtttagtgggcaagtggcccaggaaataaatgaacacattgcaacttgataagtgctatatgatgggccttgaataaagtttgaaggaagtgcaaagaaaaggacttcatgtg

SEQ ID NO: 13522 - DNA, 201 bp, Bos taurus
agcaatcagacctatcataaatagtatttatgggaaaagtccataaaaagtggagaggagaatcatcagcctgtacatgatatatcaagccacaacactgcgggttattgtggtttagttgctaagtcatgtcttttgtgaccccatgaactgtagccctccaggctcctcggtccatggactttcccaggcaagaatact

SEQ ID NO: 13523 - DNA, 201 bp, Bos taurus
agtagccacatatggattaaacattaaactctttagaaaataaaaattgcatgtcataaagctataactgaaaaatctctatagcagtcaacacgaacaggcaatggagcacagtacacaaatctgaagggaagcattatgaaccagatttgggaagcagggaatagggaatccacaatctggggaaattgtactgtgtaa

SEQ ID NO: 13524 - DNA, 201 bp, Bos taurus
taccttagtaactcaaatggcaatgacatcatttatcctatgggtggcatctgctccccatgtcattgatatgcacaatgatgtgtatgtatgtgtcaatataagaatatatatatatatatacattcttagctaccatttttgtaacaaacagcaactggagttcagggtggggaaatcagaatctgagaaatggtaatt

SEQ ID NO: 13525 - DNA, 201 bp, Bos taurus
ctttcctttccaccaacctcacctgtttattgacttttgaatgacaagcagccaggtaccatactctttcagtaacaaaaagagtttagaggaccaggcccgcttcatttttggacccaacacaatgctgttggtatgttcctgaaatatagccccaagttgggtgtaggccccaaagacttaagggtctgctttctacca

SEQ ID NO: 13526 - DNA, 201 bp, Bos taurus
attttggactgagtgatattatctagggttcatatagggtgaaaaaaaggtagagaactaaaaatgaaaccccaaggaaagcttaaaatgcaaagagaaacgatgaacttcctaagaagtaaacagaatataggaaatcagaattcaacatacttggtatatggtgtcaaataccaaagaaaaattaactgaggtaagaaa

SEQ ID NO: 13527 - DNA, 201 bp, Bos taurus
ttctgccatacaacagcacaaattatgacatgctttctgtgctaaaaaacatgtgaaatattgaaaataggatatactctctgctctcagtgaactgagagaaacacatacttatacatacatactagcaaagcaagagaagtgtatatgacaaatgcatttggagttattagcctaaagtaaaagactctggagaggatt

SEQ ID NO: 13528 - DNA, 201 bp, Bos taurus
tataatgcatactcaggtaaacttgatttactacctcaaggttcatgcctgaaagcttttaaaggagactcatatatttataaaaaatgaaaatactcaggacaaggacatctaagtgatattctcctgaacacagagccaagttacacaattagaaatatatgactctatgaccacacaattttccaggctgaaaagata

SEQ ID NO: 13529 - DNA, 201 bp, Bos taurus
tacgtaaacagaccttaagggcaaccgagaactataccatcttcccacttaaagacgttaatgggatccaataaattattttacaatgtatttccttctaaatagtaactgagatgtcattacacagtgaatctatacatctttgggaaacttttttcaaataactaaatttggtcaacctttatctgattgcagatgacc

SEQ ID NO: 13530 - DNA, 201 bp, Bos taurus
aagctgtgggctgtaggggcccaagggccaaagctgcagcaagtaggcaggggaggggtaaggactctaacttctctctgccagccttccagcccaaccccgccaggccaatgcctcctcccattcactgatctcaggtagaagccaaaggttagcctcctgtggcacagacccaaacaggaaggggtggaaaatggatct

SEQ ID NO: 13531 - DNA, 201 bp, Bos taurus
gtttgagtcttaataatgctgaatttgaacacctttttcctaagtttattatccatctctccttttgtgtgtgtgtgtgtgtgtgtgattctcatgattacatcctttgcccttgataatctaaacacacaagaacaagagaaggaagaagtaatgagagccctacctctgaggtcaggaaagaatctcctcctcaagact

SEQ ID NO: 13532 - DNA, 201 bp, Bos taurus
gagctgtatataggagtaagataattaaatcactgcttttgagatgctaagtggctgttcatgctctcacttgttccttcaacaaacatcctcagaacttatatgtgtaaaagactttctaagcagcaaatcagaccctagaaaagagaactgagttaacttaatctaaataactattgttaaaagtgatcaaactatatt

SEQ ID NO: 13533 - DNA, 201 bp, Bos taurus
agatgaattgataaatgaattcagttcattgactcctctaccattctcaaaactaaagctaaaaggatcctgtgctaatttcttcttggcctctcttagacatcagtactggtacatctggtcagtgtagactagcagcattcactctacaagactttgcagccatgcaagggtgtctggtggcctcaattgttttaatta

SEQ ID NO: 13534 - DNA, 201 bp, Bos taurus
atgtgtatctatattgggcaccatgcaactttacaaatctggaaacgtattggacactgtcacctctatttcctgttccacattgattttgatgtggtacttgctttttgtcacagcaaactccaaagtaccagtttcacaaaaatatggtattatctaaaggaatgtagcatgatcttatgttgaaaatgggatctgata

SEQ ID NO: 13535 - DNA, 201 bp, Bos taurus
agctggctataatgctaatcactctagaggcaaactttgtgtaaatctgattcccagtaaataccacccaaagtacttaagttttaaaacaatctcccgccagccccatcttcaccacaaaacagcttcaggataaagcaatttcagttttataaagcagacactgagagcagcttgaagtaacgctctgggatacagcgg

SEQ ID NO: 13536 - DNA, 201 bp, Bos taurus
aatttaatgtccttccattgcttcctaaaacagcaaagacagagctttacttcaggcaaaatgagtttttaaaacaaatctaactctaaaacaagcttctgagaaccgaatgataacattttttaaaagcatcatccatcgaaggcatttgaaagttgattcttgagggaaaggaatttttagtttataacaattatttgc

SEQ ID NO: 13537 - DNA, 201 bp, Bos taurus
gataagttgcagattttgatttgatggctctgggagggttctgaaatgttaccttcttaacaagtccccaagttaagctgatcccacggcccctttgtgagcagtaagttctaagaattagaaaccggacaagtattcagtttagttcagtcgctcagttgtcgctgactctttgagaccccatggaatgcagcaacccag

SEQ ID NO: 13538 - DNA, 201 bp, Bos taurus
agtgtttctcaatggtttgcaaaagctccagtagccagcccttacttatttttgttcctcctgcttttagaacctgctgcaagaggcatttatatggccactactgttccaagctttctgaatttcccatgcttaactccagtttcaatacctgagagagcattacttaccgcaaagggggattttctgaggcctcatccc

SEQ ID NO: 13539 - DNA, 201 bp, Bos taurus
gtgacaatggcattgagggacaactatttctggaaaacagacttttaagtagcatctttataatataccatgtaaagctggtccaagtgtcatcctcaggaaatctgttgtttacacaggcttaagaggacttttcaattatcctcttcctgcttcctctctctaagccaggaaataaatccttttaaatatttccatcac

SEQ ID NO: 13540 - DNA, 201 bp, Bos taurus
gaagaattatgaaaatgccaagtcatagaaactgaaagtttggggaaggagtgaacagaattttaaaatgccacaaatgagagtatatggaccaatataaagctattattgaagagtttactctggcttagagggtaaaacatctgcctgcaatgcaggaggcctgggttcgatccctgggttgggaagatcccctggaga

SEQ ID NO: 13541 - DNA, 201 bp, Bos taurus
caaacctcatttgtaaatcaacacgtatttaacttctttcttttggagtgtgtactccttttgtcttaattgagtattcttcacagctaaattctcctcttgatgaatttattctttgttaattttttttttcaggatttctgagggaccctggcaggtacttgtaggagatagaagcatgattaaaaggaggaagggaag

SEQ ID NO: 13542 - DNA, 201 bp, Bos taurus
ttcctggtttttgtcattttacacccattatcttgttcctttgctatcttgacatgttcccttctcacagctttgactcagaagactgagataataaatgcgtttagtctgtgtttcgaagagactagaaattctcaagaatgacttgtcctctgcaaagcttgcacagcttcactctgcccctgtttggctctacaggct

SEQ ID NO: 13543 - DNA, 201 bp, Bos taurus
accactggaccacctgggaagccccattgaaaattttaaaattgacattattgttttattttacagtggagcactgtgtactcaaagcatcacattctacagaaatgtccttttagtggtctttaaattcaaaagctgggcatctgtccagttgatatttgttatatgtttgtattgtaggttatctgtccagtctttttt

SEQ ID NO: 13544 - DNA, 201 bp, Bos taurus
gaccccattagaaaagagtttattaatctgcctacaaaagcaagtgctttaaaaaattacagccagctcattaaaataacgatggccaatttgcagtgcattgaagagttcttggtagctttgcagtgattctgtgtgtccctgcccttgaggggacatcctttttttccttctgggtatttgggcagagatgcttctgtt

SEQ ID NO: 13545 - DNA, 201 bp, Bos taurus
ctggcctgccaaaaagcagactcatggttttggattacccccaggctttacccaggttccaaagttggtatcagccctgatatatattacagagcctcataggtactttagcattcatacagggccacaggcccatagggtatgtgcttcatccaaacacttcatgtgtgattgaaagacaatacagcatggcaatggaat

SEQ ID NO: 13546 - DNA, 201 bp, Bos taurus
atttgttcttgtcatcctacttgtatgcaactacaagattgatgggtataaagggtcccatttccaacgattttagtaaatccctctctagaaccaatgacgtatgaaacaatggactacttgtgttgtgcaccaaaaaacaacaaggatgttttgtaactacagtctcatttgccaacccttctttcatttgtttatcct

SEQ ID NO: 13547 - DNA, 201 bp, Bos taurus
gaagcttggggagacgaactgacttgggccacatgtcaattattagaggcaaaatgaaaaacagaagtaaggtgttttgacttctagaccaagtcctttatactggacttgttacctcatcttgttggaaatcacatgattttcaatgatttttttaaatatttacttttagaaagaaagatattaacatttaccaacctt

SEQ ID NO: 13548 - DNA, 201 bp, Bos taurus
ttcattcctattattggcaatacgatttttttttcacatgaagctttgaaataaaagtgtacatgtctcccccatccacttcctggcctgtttctagccttccctgtggcacaggcagcagcagcactcccccaggagagggagggagggaagggcaggcggaggaggcagggtgatgaggaaagccctgccagatccaag

SEQ ID NO: 13549 - DNA, 201 bp, Bos taurus
aaatattccatcctattatggatttatttatatatatttacctggtgcctctgcatgtttgagatagtgattcataattagaaatatatttttgatcttcatcctgtttctggcacagagttcttaaaacccttggaatttcctatgtcataagagtgataaaggtatcttgctattcaatcacaaacctctttcaaccca

SEQ ID NO: 13550 - DNA, 201 bp, Bos taurus
gtgactggttatacagattggaatttgagcaatagtgagggaaggagagaagccaaagttgtacataacacataaaatattcaggccttggtgatgaactgatgtaatttgatataatcaggtttatatctatcgttttgctgtttgtctatttggcccataagttttatgttccatttctctccatttcttatcttcccc

SEQ ID NO: 13551 - DNA, 201 bp, Bos taurus
aatggccaatgtgtgtcctccaagggcttaggaatgccagagaaattgattgcaaggctctttgctggagctttcttcaggggaaaaaaaggaacatattattttctttccctataggcctctaactgctaggcataaatttcttctcagactttccagaaaacctcacccttggactaagatcaagaaaagaaaactcca

SEQ ID NO: 13552 - DNA, 201 bp, Bos taurus
acaccactctgctacctcaccatcagccagagagttgtgcagaagctgacaatagacccagaaaccctcccccttcttcacctggcctttaaaagtgttacgccaaaacccttcggggagctcagggcttatcagggcacgagccccccgtctcttcacagggcccggcagtaaaatttgtttgctccaaactctgaagtt

SEQ ID NO: 13553 - DNA, 201 bp, Bos taurus
ttactagaggggccatacagcatgagatgcaatgcaggcagccttgaggagcaaaaatggtctcctagctgacaatcagcaaggaaagggggacgacagtcgtgcaacggccacgaactgaatttggtcaataacgtgaatgaacttggaagcaaattcatgcctaggacatcccaaaggtaatacagccctaatgacagc

SEQ ID NO: 13554 - DNA, 201 bp, Bos taurus
gaagtagagctggctggatttgctcataaattatgtaggtgtgagacaaagaggctaaatcccaacttttggttctgaacagcagggtaaatgtggaattgtttctggagatgagaaatatacaaagaacaggtttgtgggaatgaaattcagatgatttgattttgtaagtgttaaagctaagtaacctcacattcatta

SEQ ID NO: 13555 - DNA, 201 bp, Bos taurus
tctccatccccacttttggtaactaaaataaatacccaagaaggcaaacaggaacatctctgtgtgagagaagtaacctggtttgtgggagagaccaaatggtatagagtctattggtgctaacatccaaccaagaagttgcctttataaacaaaccaaataaatacctgtgctttgccaaagatgacagttttttttttt

SEQ ID NO: 13556 - DNA, 201 bp, Bos taurus
gtttgccaggttagcaaatgctctcatgagaaagtggctttctcctataaggagaaacttctatgtttttttcctacaggaagaattgggcctgaaaaattcctataatcttctaaggtcttcaatgcaactaagaaggcttaaaaattactttcctgtctttttagttggtttcagttggatacttggccaaatatttta

SEQ ID NO: 13557 - DNA, 201 bp, Bos taurus
gggacagggaggcctggtgtgctgtgattcatggggtcacaaagattcggacacgactgagtgactgaactgaactgaggtgagaaaagctcttggatacaaaggtaacagcatggcagaaggccacagggtggtgagagacatagctcaccatctatcactaaggacctgggtgtctgaagggtaggaaatggggtatgt

SEQ ID NO: 13558 - DNA, 201 bp, Bos taurus
cttccaggcctcctgaatttgcttgcaatcatattacactcttgacttcctttcaggctcagtttcaggcactgaccgaggtaataaaatagtatttatcctttttcctggccctttgagaagctgttgatctagttggggagcatttgctgaattttaaggtcactctgcatcatggaggaagtgagaaagttctttaag

SEQ ID NO: 13559 - DNA, 201 bp, Bos taurus
gaggctgaagagaggtgtgtgtgtggttagtgtgtgaaggaggctgcagggactcaccctgactgattcaaaactgagtgtatcttctcgatgagaggagactgcagttgtttatgtaggagaataatgccctcagttctaagaaaggttattgtgactgcagtgtagaaaagtcgcagaagaagagtgtgggggcagggc

SEQ ID NO: 13560 - DNA, 201 bp, Bos taurus
gtttatgtaagcatctacaaagaaatttcctgaggttctcactatccattctcctcatctccacaggatatgaacttttctcaaatgtggctgacattttgtacaggattatgcaccgtggtgtattagaaagaacttgagctttgaccacatattagctaaatgactgatggaaattaccttacaacagcagaagatggc

SEQ ID NO: 13561 - DNA, 201 bp, Bos taurus
atgaatctctatgtgtagtacatagcagtgacttatagaaaccatattctgactaataattctttataaaatatctgtatttaaaatgtatgattaattaattgactcttaagttactaatgattgtttaacccagttggtatttcctgttgcagattgtatgctggtccagaggtagatatatggagcagtggggttatt

SEQ ID NO: 13562 - DNA, 201 bp, Bos taurus
ggggctcagtcatactacagcggtttcctctctacatccgacggagagcgcgcccgtgttctcggaaggctcaaggccactgtcaggcagcctgatgtaggggctgtcccgggagggagaggaaactaggctttcggggaaagaaactcggcgatgtaggggaaaagcacctgctgcacctagttagcgacggggcctaaa

SEQ ID NO: 13563 - DNA, 201 bp, Bos taurus
ttttgttctccaagttttcacctgagcagtctctggcaatcaatagattatagaagttttgggatttattatgttttggaggcaaagatgtgaaatgcagcatgccagaacttatttaaactagttaatataaggaaaattagatttccccaaatagttactgggcagaccttaccagtaatttaagtggaagtgatcaaa

SEQ ID NO: 13564 - DNA, 201 bp, Bos taurus
atctcaatattaagattgtcttaatgttaaccacatctcctgctaaaccttgtgctcctgctaaactttgtcttcacgtggggtcgccccctgctgaccagccacagtgggcacaaattccattgaaatcagctctaattccaagggaattacctgctggagatgatggctgttggcataattgaagtctcgagtcaggca

SEQ ID NO: 13565 - DNA, 201 bp, Bos taurus
atactgcttgggggagtcagacagttgttggtaccctatgatacacttacaatttgacattttctaagagggagaaacattttaccattgggccaactttttctgagtggaaccactctaagagattttggaagcaattgagatttacctcataactgtggctcttcatcttgtttctactttgatacatacgttgatatt

SEQ ID NO: 13566 - DNA, 201 bp, Bos taurus
tctgttttacacactgtattgtatttatgtaaaacctaatcccccaattcatcccactctcctcttcacaccacacgtccattctctgtgtgtaggtttctattcctgccgttcgaataggttcatctgtaacatttttctagattccacatacatgcattaatgtataatacttgtttttctctttctgacttacctcac

SEQ ID NO: 13567 - DNA, 201 bp, Bos taurus
ccgaaggcagttgcagtcaaggactcaggccccctggccagtcatgtgtttcacatattttcattccttgatttggtgggcacctgcctttggggtctctttatctgaggccttaggcagaggtcagctccaggtgcctttgcttgaggcctccttatttgggggagaaggaggaactcttgaatttacttaggagggtgt

SEQ ID NO: 13568 - DNA, 201 bp, Bos taurus
tatggcttagaaagctttcaacaattttaatgatttaaaattatgaatgttacagtttaataatatatccatagaagtggaatcaaaggacccatatgacgtattaattagtggctctagctctgtacactaaactaaggagacaaacaattccagcaatccagtgatcacattgaagggcaagtctcgcagaaggcaagg

SEQ ID NO: 13569 - DNA, 201 bp, Bos taurus
caatcagggaagactgatgatccaatgatcattcatcagacctcaagttttttgatgtctcagcagtatttgacacaactcatcactatcatccatttcccggattattacaatagtcttcttactgaagtctctatttcaagtacaccagttggtctaataaaatggcacagtaattggacaaaatcttgccaagggcta

SEQ ID NO: 13570 - DNA, 201 bp, Bos taurus
cttagaatgaagtttccacaaacttatatgtttccaggagctttgagccttcaaggcaaccactgtggcatgtacttgttagaaagataagtaaccataaaatggtcttttaaaaccatccaaaagcttgattttgattctcagagagtatctaggagtaagtggcatacacaaaaagagattctacaacctaggatgaac

SEQ ID NO: 13571 - DNA, 201 bp, Bos taurus
cagtgtggcatagcagtaactatccagggaattaaatacttcatggggttcgtatttgaactcttaggtagacgagaaagggcaagaacaaaggacagccgttaacagagctctgcctgataccagagcagactgtttaagtgaaacgatttaaagccagtatcacttgactggatttaacagatttttaaaactaaaatg

SEQ ID NO: 13572 - DNA, 201 bp, Bos taurus
tgggccaaggacaaaagggatggaatgctctgtgtctgcaggaacagagagccatcacggttgccgtctcatggagaaggcaggatctgaggtcattgccggccagctcagaatctgcagctcttttcctgataccctcttgtaaccatttcccagatttttctatgatgcctaacattcctctggttcttaaatgagttt

SEQ ID NO: 13573 - DNA, 201 bp, Bos taurus
agaagtccccaaaggctttaagcagggagtcccagggtttggtaggcaagatgaattacctgaagaaaagctagtctactgaactcaatatttaaaaccttgtctgtgtagacaccttcttggttgcctgcttgccctttctcaggagcctcttaagagcggggactatatttcatgttcatgtcaccagttcttgtctct

SEQ ID NO: 13574 - DNA, 201 bp, Bos taurus
aagaagggaagtcctcacttttcctgccagactgagcacagtataaccggccctctgagaggccaccccacaaattcaaagagacagatgtgtggggggagtagtcctctgacactcaggctttacactcagttcattttactgagctccagccattaccaaaggacctggggaagttggatgggaattcatgtttccttg

SEQ ID NO: 13575 - DNA, 201 bp, Bos taurus
tatagtcagcattactgtattacatacttgaaaattcctaagagagtacatcttaagtgttctcactacaaagaagaaatggtaattatgtaaagtgatcgaaccaatagaattgaagttttgatcgtaatcattttgcagaaaatgagtgtgacaagtcaacgcatgtacatcttaaattttttaattttaaaaataatt

SEQ ID NO: 13576 - DNA, 201 bp, Bos taurus
ccatgggaaaagaagagccatagtttcttttaaaaaaatccttggtgaaacattattacgattaaaaattgtagtgaaaagccttaagtaccaaattttaaagcagcagtaatttaatttttatatcagtgttcttgttttgcacagactaaatgcagtgataggtgagtttatgagtacagtagttgcctttatcacatt

SEQ ID NO: 13577 - DNA, 201 bp, Bos taurus
actgagaacaattgagtaaacagtggtgccatttgctgtatccacaaggatgtgcaggagaaggagcaggccttgagaagcacatggcctgggaataacacgagacaacagtgggttggtacacatcgggagtatgattaaggtttttatcagtttgattggttctgttttattttagcaagctagcacatacctgagtgc

SEQ ID NO: 13578 - DNA, 201 bp, Bos taurus
cagagacaccggctccgcaggactcagccaggctggaagcagggggcaggggggagggtttgatggcacaatttgctgtcccttcctcaagtgcatgggcgacttcaggatgttcgtgatgaattttaagtttccccgaggacagtcagttctggagaaatggaatgactctgtcttttgttcttctgcaaaagctgatga

SEQ ID NO: 13579 - DNA, 201 bp, Bos taurus
atagtcctaatattatatgccacatatatatatatataatatatatatatatataggactattatacatattatatatctcaggtatgctgacaggtcatagctacatggctcatgaagaattgtccttggctccagagaaccacttctcctaaggttatcctctctcccagagacagctagtgaccaatgactggctgat

SEQ ID NO: 13580 - DNA, 201 bp, Bos taurus
aattaattatataactgactcattatttttcggctacctgatgtgttagagaccttgagttagctccgctggcaaatgtgtaaccattaaaaattctccacagtcagaaactggaaacaaaaactcactctttcggttttagatttttttggtcttgtacagaacattgaaggctgtggattaagtgcattagttagaata

SEQ ID NO: 13581 - DNA, 201 bp, Bos taurus
ccccctctctgccctcctgtctccccttcaccccctgaaaagaaaacaaaaaaagctgtcacaactaaacagagtttaccaggactgcagttcctggtgcccttttgcctttatctttgcttttctccatttttttctcttaactgtcctcagcagaaagatctgggacctcacacatcctggaggcagagctctcagagc

SEQ ID NO: 13582 - DNA, 201 bp, Bos taurus
cttttctaatgtctatgaccagccctggagccttattatactgtgccagtttcagacttctaagtccaaggtggtccttcaaagacttctttgacactgtagagtctcattttatgtagttgatgaaacagatccattttcacgcatttaccttcattcctttgattccctgggaaatttctccccacttcaagtaaccat

SEQ ID NO: 13583 - DNA, 201 bp, Bos taurus
agatgtggaggccactcaggtgggtatagatttctgggaaacatgaaggtgaaggcatttggttcttctaagaatggcaacagcaatgacaattttagatgtatcaagttctgatgagggccgaggtaaccaggttctgggactcactgtggcagcctctcacagtgggtcagttctacagagtgattcttggaagcccag

SEQ ID NO: 13584 - DNA, 201 bp, Bos taurus
atactaccaaaatctcaaaggcatctttctcactccactacacccccatcatctgtagccaggtatgtggcaggggaaaggtctgcttggcctcacaccagcaatgacacacttgggctggtggtgacacacatcacctccgtgtgcatcttacagcccagagctagtcatgtgacccaagcacagccactcaactacaag

SEQ ID NO: 13585 - DNA, 201 bp, Bos taurus
agaggcgtgggagcgctttgtgtgaaggagacgttgtataatcttgactgaagtggtgattacaggtgtatacgtttgtcaaaatttgaaaagggtgcatcctgtattttattgtgaataaactatacctcaataaaactgaattaaaaagaaaatccaaacaaaacaaataagtagaaggtcaagaacaaaaagacaaaa

SEQ ID NO: 13586 - DNA, 201 bp, Bos taurus
aacacaagattagccccacacttagttcttcttcttatacttgtaaagttttaggaaccattttctatagttatctgaatgaataaatataaataaaaattactaatgaatatattattaacgcaaaaatatcatcgtgttcctagtatatgtcagacactgtgcacacagctataagtactgaaccctctttggtgcaca

SEQ ID NO: 13587 - DNA, 201 bp, Bos taurus
tgaagacagagcaaaaagaatataaagacagggtccttgggacttccctggtggtccagcggctaagactccatgctccccttgcagggggccagggttccgaccctggtccagaaaccggatccaacaaaccacagtaaaagatcttgcatgctgcaaataaaaattctacatgccacaactcaaaaaaaaaaagatgct

SEQ ID NO: 13588 - DNA, 201 bp, Bos taurus
cctgtcagcactgtataaaaagtcacagaagcgctgggctcgcgcctcaaaccaaggaggtgtgtatagagtatgagagagaagagactgtggtgagcccatggttggtaccttcagacatccgtgcgattctccacgagagtcacagttccctgctacaggtatgcattactccaagttgcagtttgcctggtgattatt

SEQ ID NO: 13589 - DNA, 201 bp, Bos taurus
gggtatgtccaggagtaggacagagaggtggcttaggtgttttgtccaccggttacgtggtgttgagtgcaggaggcatgctccgtactttgtttatgcttctgacaccctctttttattccaagctcttcaaaaacaatagttgggttttttggtctctttgtatcttatgggtccaaaatttgaccccactttgcctgg

SEQ ID NO: 13590 - DNA, 201 bp, Bos taurus
ttactctgggcccttcagggttgaatgacctgccatgatcagagctgttttgtaggacaccgcatgaggagtgctaaggacggccagagagtaaagatctgattgatctttatagtggtctccttccccctgtacccctagcttgaatccatgcccaagtagagtaattcccttcctggcccctttccttgttccctactc

SEQ ID NO: 13591 - DNA, 201 bp, Bos taurus
gaagagtaaaaacaagatattatacaaaggatggacagtgcttggcacagagttagagctcatgacatgtcaattgtggggaaatgagacagggaaggacgagagggactgggaacagtctcctcaaaggatggtctgggctggagcgtttgtccccaaacagacttcctcgtgccacctgtctagatgcagcccatcctc

SEQ ID NO: 13592 - DNA, 201 bp, Bos taurus
ccctgtcacgagaacataagagagtaacagtgagagagagaagaccagctcaacaaggacgtttatctcatttctagactcagaaggcaatttggaagaccgaatttaaatgtcaagaaagtgcaattttaagctatttctcattggcttaagaagataagatttaaatatttttaatttgaattttctacaagtctagtg

SEQ ID NO: 13593 - DNA, 201 bp, Bos taurus
ccagcaaagtagaagaggagacagaataaggtgcaaaaggtgttggatgtaggaagtcttttgtttagagaaaaaaaggagtaggaatgggggaggggccggaaggagcccagatggcgggggttgctgggctgatgtgcttggagttagactaggctcccagtgctaaaaggagctgactgtaatagaagtcctggctct

SEQ ID NO: 13594 - DNA, 201 bp, Bos taurus
ttcctgaaataaggagaacaatgaggagcccaactatggttcagtctacagagccaggggaggcatccaaatcgaactgggatgtcctgctgggctgagaggatagacttggatttgagggaagggcagcttcactggtagctcagttggtaaagaatctgcctgcagtgtaggagacctgggttccattcctaggttggg

SEQ ID NO: 13595 - DNA, 201 bp, Bos taurus
tagataatttctgaattttaaaaagggggaggctaactatgtctcttgatctctcttcttagaaccttggggagacgacaccatattcttcagcggaggtaagaggagggtgaagcccgtggtcccagggcctattgatattctcggcacacggtgaggtctgtgatttccctctaaaatatctgtccagtctttcttctt

SEQ ID NO: 13596 - DNA, 201 bp, Bos taurus
ttttccactgttcaatccctagcccctggaacagtgctgaggccctggtagatgttcaataaatattaacagagcagatgcatgggccatggggtagagcttggcaatttgttgttgttgttgttgtacaaataaacattgagactataatcagatttgaccactagtagcctatatttagggcttttcctggtggcccag

SEQ ID NO: 13597 - DNA, 201 bp, Bos taurus
attgtatgagtgtgaattattagtgataggaaccttggttaaattcatgtgtgtgttaaaaagcagttgttagaaggaaactaatgtaaatctatgactcaaaatgtcaagttacagcagccaacagcctcagaaaagaaacaaagaacaaaaaagcaggtggcatttactatttgttttaaaaaataaagagtatacgtg

SEQ ID NO: 13598 - DNA, 201 bp, Bos taurus
tataaggtgcctctggttgtgaccaacagtacacctcttattatagtcaatattattatttattctaacaggagaggccaggttatgaaaaatcttgtgattactcccatgttggaagagtctgactcaatagctttgtcctaggctcaggaatcttaatttcctaaaaatccctccagtagcttcatttatatgatgctt

SEQ ID NO: 13599 - DNA, 201 bp, Bos taurus
gtttcatacatatgataaacataaaatttctgtaataggaaaaaatttttggtggaaaaataggcaaataggaatttgagaatagaaaaatacaaatggtaaataaatataataaacatccaacctcattagtagttaaatttaaacatatttcataataatgtgaacaatgtctttgcttttcaactaggtgaatatttt

SEQ ID NO: 13600 - DNA, 201 bp, Bos taurus
acaaggccacttgggatgaagataacatatcccatcttccagtgtagctaggtatagctctcctacaaaaatctggccagaagaatgtgagaagcaattatggaagcaacttccaacttgtgtctttgaaggataagccattcttatttcctctccctgttttcgtgatgctcttgaaaataatcctggtgctaagccatg

SEQ ID NO: 13601 - DNA, 201 bp, Bos taurus
tgtgcacggagtatttggcagtatgaaaaagaacatggagaacaactaggggcgcttttaaaaattactgatgcccccaccttgttctagaattttcattgaagaatggggccatggtgccagtgctgttgttgttctttgttgtttgtgattccccagaacattctaatgtgaagtcagagttaaaagtcattgagtaaa

SEQ ID NO: 13602 - DNA, 201 bp, Bos taurus
caccacatctcacctacagcctcagtgtgtccctgctttggccaagtataaccatgtcctgtgaggaagggaaggaggtctcacccacggactcctgtggatgaggggctctgtggtgtgatggcccccaagtccatgtctaattgattctagtcctccaggttctacttttttttttcccatctgatcatttaagagtgc

SEQ ID NO: 13603 - DNA, 201 bp, Bos taurus
gcctcacagagcctggccaattagtctccagagtttaaaacatcttagacaaaatctagagccagataaactggaagaaatgagatagaaatcacgattccggatggccacagcccagctgatagaagcccacacccaatagcccagggaacgacatggttacaaccaaaaattattcacatttcgaaaagcaggcttttg

SEQ ID NO: 13604 - DNA, 201 bp, Bos taurus
gctctgctgggatgggctggactgagctggcttatctgggttccacctgttttctcattctgaaacccagatggaggaaggaggcaccatgtggaaaaccggagaacaagagcaggaaggcctcagtcaataaatacagtagcttgcagttgtatttaaggcttctgttcggatacaacaaaaacaatcacaacccttccc

SEQ ID NO: 13605 - DNA, 201 bp, Bos taurus
agggcccttttccttcaggctgggaaaggcagagaccaagctctccctgccccaaactcctggaaaagccaagcacaaccctgcagtccggaccctggtgtggccctgccgtgggcaggggctgctactgctgtacagtgagctgcccactccatctctcacatcccaggaccctctccaggaatgtgttccaggacagag

SEQ ID NO: 13606 - DNA, 201 bp, Bos taurus
gctaaagtgtgccagtcgatgggcctgcccactttggataagttttctcctcagtctcctcgcagtcatctgccatctgcattggccctacactttcaaaacctgattcaagtttggagagaaaatatatgcatgaagtactggctttttaaaaggatgcccagtggcaagtggtgtggctcacttgccagaggccttgtc

SEQ ID NO: 13607 - DNA, 201 bp, Bos taurus
cagatagcttttcctctgccctcctgaggaccacccatggctggcacagctctcctccctgcagacccgaggtctgggaaacatattcaccctgccacagaaggaggcccgctgtgcttttgacttgcccctcccaccccagcccacagtttgctctctttctggcccataagcggcttccctgatagctcagctggtaaa

SEQ ID NO: 13608 - DNA, 201 bp, Bos taurus
gtctttaagtcattcaagaaaccaaatagttgttgcttctggggaggtcaactaaggatcagaaggagagacttactttcagtttatctcatttatcctataattatactgtgatatagaatcatcgagggatgaccgtttcttttcttaccgtgccgttggcatatgacagttctttccatttaagaagcctggtttgga

SEQ ID NO: 13609 - DNA, 201 bp, Bos taurus
acctgggtcccccacgttgcaggaagattctttaccatctgagccatcagggaaatatttatctgagtaaatgtcagttccaattggcagtaccaaacaggaagcagttagtagttcttcatccaagggagttaggggcaagatttattgagaagattcagcaagcaagtcaaagaaaggacttgactggctatagcttaa

SEQ ID NO: 13610 - DNA, 201 bp, Bos taurus
cttattctatgcactgagaaagtctcataaaaatttaaaggagtttgaaggtgcaagcagataaatggatactcataggaataaaggccaagaagaacctacataacaggaattctccagtggtccagtggctaagactctgtgctcccagttcaggggcctgaggtccaatccctggtcagggaactagatcccacatgg

SEQ ID NO: 13611 - DNA, 201 bp, Bos taurus
gaggtgagctaggtttgtggacattccttggtgctctcgtcccttcctgacaccacttttcatgacaaaatttctaatctggtcagatttcaaggacatcaattgggctgcatttattattagatggagttattgtttgttaactgaacaaacacaatctttggtctctttcttttactttttcttccatgcaggtgagtt

SEQ ID NO: 13612 - DNA, 201 bp, Bos taurus
tctgtggaacggagataataatagcccccaactcacaaagcaggggttggtaaactacggcccatgggccaaacctaggccaccttttgtttttataaataaagttttattgaaacacagtatgcccatgcttttgacttacaacagcagagctgagtggtcaggatagggactgtgtgggactatgaggccccaaatatt

SEQ ID NO: 13613 - DNA, 201 bp, Bos taurus
ttcacagctagtgagaagataggaatctgaacactgcagggaaccctagagtctgagcattgttatttcttaaattaagctcttataaagatggaggtgacgaaagaaaaagaataaaataggctgtgctaatcttttgagttccggacctgggtcacactgcttttgtaaagctttagagaaaatgcattaagtgaacac

SEQ ID NO: 13614 - DNA, 201 bp, Bos taurus
agaacatcatataaggtggaagctcagagtggggagtcatataaatggctcaaccgcacccctacctgttatgtggccactagcttgaaagaaagcaaaatactgagcatattctgaatgtccagccagaaaaagaggtggcattaggaagagccctgctgactagattatttaaggcctggactctctggtctgggcttt

SEQ ID NO: 13615 - DNA, 201 bp, Bos taurus
ctccagcggatcttcccaacccaggaaatgaaccatggtctcctgcattaaaggtggattaatgatcagcaaatcttcacctcatatcaaatgtaaatacctctgacagcaccagaaattgtcaaaaggattaggtttccccagcatccttattggtattattgctcaatgcagtatttctaacagttagattcccaggtc

SEQ ID NO: 13616 - DNA, 201 bp, Bos taurus
ggataaaaccaaaatcgagcatggcctgagaaagtcctatgtttctaaaaccctccaggtctgattgtgtgacttttcatgacaaagatcaggataaccaatcaaggccatgctacaggcaggggtgaggtgggggggagcattccacctcaattctttcacacgtttttaatttggaagaagaaagcctcagtcattttt

SEQ ID NO: 13617 - DNA, 201 bp, Bos taurus
taaaaagaaatgataagtgctagttctgagctaggccatgagaaaaatcgtttgtctctttttaccccctcgtgcttccaccaattgccatgagaagagcgttccccagttcactgaaggccctgaacagcttacaatctctgctacatcatcactggtttaaaacttttaatctagagctgttagtcctaaaaatccact

SEQ ID NO: 13618 - DNA, 201 bp, Bos taurus
aggttggttgcttctcttctttggaagtggccgttaactttggagattgctaaggggcaatgtttgtgatgcagttgccaatcccatcaccttgtggctccggcatcaagatgcactggccagtctctggttttctttatccattatctcattataatcattagtattgctttctcttttcccaattatagcctcctcttc

SEQ ID NO: 13619 - DNA, 201 bp, Bos taurus
actacacagaatactacaggttatgacatacatttacttgctcagagttttcaaacaagccatgttgtttatcaaactatatctcctaatacttaatacagtagaattagtgattgtagttctcatatattttacttacaagtaccttattgagataactaacattttgacagcttcagactttccaaattagcacaacat

SEQ ID NO: 13620 - DNA, 201 bp, Bos taurus
ctgactgtgcggagcatgaaaaaccaaccactctcagtggttatttcactggaaaaaaaaaaaagtggtttcaattgaaacaaagggtatatagctcaggagtagaacatttgacagtaatttacgtaaatccttttcttaaaggagagattctcttttctgcttctgagatgatctgacttcacagcagggaaggccctg

SEQ ID NO: 13621 - DNA, 201 bp, Bos taurus
tccctcctattctcatccacgagagtggacggctcgtctctgctccacatggcatcagctgggacggctcagctgaaggccaggattcactttcaggacccctcactcacatggcttgcaaactgtgctgctaactgggagctcagccagacatgtggaccagggcctctgttctttctaggggacctcggaacagtttag

SEQ ID NO: 13622 - DNA, 201 bp, Bos taurus
tgactttggaaagcacggcaaaggtgatgtgtgaattccctgaccaggatcctgttaagtaaagctcttctgcctgaaacccagataccactacatgagtaaacactggctgtgtctgggttccgtttatttactacacctactaattaataaagggaaatgaaaggaagacagagccaggagactctagtttgatccaat

SEQ ID NO: 13623 - DNA, 201 bp, Bos taurus
tctggaggttgtctgtggatcagttcttccaccagcaaaggacgcacaccttggtgatggagttgaaatggcttcgttcaatagacaccaccaccacccattgaggaaggtgtacgattttaggcctaagacaaccagaaatacaccgagatgtgtatttcatgtgctccccgaatgtgaagccagcataaggtgtcaaga

SEQ ID NO: 13624 - DNA, 201 bp, Bos taurus
ctgcattaacaggtgcattctttaccactgagtcaccagggaagccccaggacagcattcctttttgtttaatgagcacacaaatattagttgatgatgataatgataataatagctatgaattaaactcttcctacaattatattgggcattgtgctagctactttatgtaggttgcctatttcattaattttttcagta

SEQ ID NO: 13625 - DNA, 201 bp, Bos taurus
gcacagcgaggttcctgccagatccgaaagctgcctcttcccatcctgaaattaaaaaacaacacgccaccaaacctaagccaagcagggccctgaggacagcagcagcccgactggaagaagtgccatcccatgcggaggatgggggtggatgggggatgggggggagatgctgcccttcccagccaggccctggggggt

SEQ ID NO: 13626 - DNA, 201 bp, Bos taurus
cacatgaactgtatgcaagctttttcctactcaaattctgccttgagaagtgctagtgaaggccagggattcatgccttctggatggccatcaggaaaggcaggttcagccagggtggcgactcatccaagatttcccaccagtaacaactgcaaagaagggccagccctcgtggaggtggagggcagtggggctggcccc

SEQ ID NO: 13627 - DNA, 201 bp, Bos taurus
tcccaaagtgatttcttttagatacaacacaatttctttctgatcctgagcatatggtcctatgctaatatgaaatggtgtcttagaaaggttatttttgttttttttgcagggagcagtcatcctttgacctatattcaatatgtgacaccgatctgattgtgcaacaaccattaacctcatccggaaccccttgttgga

SEQ ID NO: 13628 - DNA, 201 bp, Bos taurus
tactatgaattataaaatattcactcctagaaaaaaatagaggagaaaactactctacatccaagcctccatcttcctcgaaagaaaaaggcttgtaaaaatttttctggacctaaaaattcctataaatgaatagtaggcccaagttatatgaggaggcacagggaattgattcatgcttaataaaccctgcaattaata

SEQ ID NO: 13629 - DNA, 201 bp, Bos taurus
aggccagaaaatccagcagattactgtgttccacagaagaaaccagaggtcacattattctctaaggcaatcatcaaaatgctggtgagagggacactagcatcagaaattctgtagggcctcttttgtaggccagagctggtggtagaaaaagcagatacagtctttagaagccaggtatcagaattacacatcaaatgc

SEQ ID NO: 13630 - DNA, 201 bp, Bos taurus
ggtggatgtgtattttcctatgcatatataatctctactctagagaaaaaatataacccagatttttatgaataaaaaggcttatgcattcctgcttttggcagtgtagtaataacatacttctattacacacagtatattctttactaatcctgttgaaggtactgcagttgatgatttcaattcggaaagatactgagg

SEQ ID NO: 13631 - DNA, 201 bp, Bos taurus
agcatccaagtattttttagcccatgtatgccacactaaattaatatttccattaaatgtaatgtaatatgtgaatcagagtgctagccacttagaaacataaatgttgtagtaaacttatgcaatatgatatcaaaattgttttagtttactggattttcattcatatagtataaagtgatttctattagatcagtcatc

SEQ ID NO: 13632 - DNA, 201 bp, Bos taurus
ccagtacattctagcttgctgattcctaaaatgccgacattcactcttgccatctcctgtttgaccacttctctgtatctataagctcttttcatcataggttgttagtgggaggtataaatgcctgcataaaagactaaagtaatctgcctgtgatttatttttgctactctaccatctagtctgatgcaatgcttctcc

SEQ ID NO: 13633 - DNA, 201 bp, Bos taurus
tttttctttctttgttcagattttgatttctgctctaaatatacagtttgctcttacaaagatgtaaagtttggaaagaagaatggacatataataaaatgttattcttatcacagataaagaagatcaaaaaatataaaataaggagaaactaatcaaagttagtcgctcagttgtgttcgactctttgtgatcccatgg

SEQ ID NO: 13634 - DNA, 201 bp, Bos taurus
agacaacatttaagaaaccaggcttaacatgtcatattcctgtggccagaacaaagtcacacttaaagttaactgataatttattcttcttgtgtgactagtggaaaagtgaattgttttttagaaaataaaattatgtctgttataccacaatggctcatgtttcttctcccagtagtctacacttctcctttttttaaa

SEQ ID NO: 13635 - DNA, 201 bp, Bos taurus
gcagttcttaggagtttgtttggttgagagtctgtcaagcagcgtgattagtaatgaagataaaaatgcaagaggtcctttgatagttacctgagctttagcatccaaaggcccagctggaactgctgagacctagaagaatggaccccaaaatggcagagaagcccagcaagtagagagagggcagatatcaagataatt

SEQ ID NO: 13636 - DNA, 201 bp, Bos taurus
atcttattaaattggctaatgataataatgatagtagtagtgaggcaggatgtagattccccacccccaccagggtaaagcaattggagattcatgccctatggactgaaactaggtgaaaataacagcaggccaattaagggaggcggctgggccctgcctggaccacatacttctccttcccaaagtccggagacctcc

SEQ ID NO: 13637 - DNA, 201 bp, Bos taurus
cttggggagctcccttgaccttcatagtgactggggaatccactttactggtccgatgttttgatgagtctgtgtggtctggccatttctgcagcaccttgattgtacttatcatgtttggtcttcagcattgctcaaacatacaaatctaattattaagactcagctgaatgagttgaaaccctctgaacaccatggcca

SEQ ID NO: 13638 - DNA, 201 bp, Bos taurus
tgaaggaataatatatatatatatatatatatatatatatatatataaataatgcatctccatgctataggtacattactagaattactatatacttttacatatgttcgcttttactttcatatgaaaatgatgtaacttatttaaacaaagaaaaattttcaagctttttataaacaagctttttttctcacttatttc

SEQ ID NO: 13639 - DNA, 201 bp, Bos taurus
actagtcaacaaattcaaagcacatgttctaataatgccaggtgaacagtgttattttgggatacacatttgctcaaatatttcatataacaaggaaaatcagggtgcagaaaagattcattttctcacagaccagctatggaaagttaaacatgctattatacacagtatgagatataaataatgcatataaaatctgtc

SEQ ID NO: 13640 - DNA, 201 bp, Bos taurus
tgactcatatctcttatggtcactaaccactttttgtacctttccacaaaacaacatctcttaggagattcctccacctgctctgtcccctgcaatgcactgagtcacaggtcaaccgatgacaatgcgatctaggccgctcacacacacaatttcaaccagagtcacaaagacctccatagcatgaggtttgtttgttgt

SEQ ID NO: 13641 - DNA, 201 bp, Bos taurus
aacctggatgaaaactagaagtctagccacccagcaggccaaaggctagtggctaggagaaaagtgaccctggctcttggatctgtttgaaagaaagaatgtttcaaggaggcaaaacctgtaaaaacaggtgtaaagataattcttagaaatacagcacaacgaatgggacagaacacaggaaagcagtttgtttatcca

SEQ ID NO: 13642 - DNA, 201 bp, Bos taurus
aagtatgtaatttttatcatgttttttgatgattatttctgtttatattagctttataagcaaatttgcaagttgttctactaaatattctaaacaaatgcactcttgcaatgagaaaagatgataacggacatcaaagttctcaaaaaattgtatatgaaaagaaaatttttaaagtacgaaacagctatagttattaaa

SEQ ID NO: 13643 - DNA, 201 bp, Bos taurus
aaaaaaaattcaagacagtatgtcacttgtagagtcctttagaaacttcaaaagttcgtaaatctttgaaattcactgggtttgtcctcttagctatggggttgaatggttcttcctgcagacctgaaataaacggccctgggctggaaagtcttacaccatcaagcacattccagtcaaatcatcaaactgtcaaattgc

SEQ ID NO: 13644 - DNA, 201 bp, Bos taurus
caaatagtatttctagatggaccactgcatagtggatttttactgtgccaattcagctggactgacattgtctttttccaaaattctttcctatgtaattatagcttagctacatgaagtagttggcaagaaatttggaatacagaactatgtagcagactattatttttatactaagaagtttttttgtttttgtttctt

SEQ ID NO: 13645 - DNA, 201 bp, Bos taurus
tttaatattttttaactttacatgggctaggagcatctgttcttctgatttgctaaagaacacaacagagtataatgtgattattgttgttttacccccacgtaattctatcttaatttttcctgagttaaactcattttcttttgcccttcagttatacaatgttaattgcccacaactattgattgtggtttctcccaa

SEQ ID NO: 13646 - DNA, 201 bp, Bos taurus
tgcaggtggattctttaccagttgagccaccagggaaaataattcaattctgattttggacagaaatgattgcttttgaaccctgactccaattaggccagtaacaattcatttcctattccttgtgcacaatcttttattgagaagtgttgcatgttaaagaagggctgctgctgctgctaagttgcgtcagtcgtgtcc

SEQ ID NO: 13647 - DNA, 201 bp, Bos taurus
agactgcaaaaatttaaagcatcaggcaaagttgtacataggaagaaaacatgtaacagctattgtttactaaatatgcttctttagatattgaatgtaagagggatagcaaaatataggtgaagtgtgagataggatggaaatagcaggcatgaaaagacatatttgcatttatgctttgctttctacaaacaaatatac

SEQ ID NO: 13648 - DNA, 201 bp, Bos taurus
tcatgagattatgggggctaggaaacccaaaatcagaagagcaggttggcatgctggaaattcaagggtattttgaataacaggccatttgcagtctcaagtcccaaatgtaaaggctggaaaataaggcaacgtttgtacagtctagtggcaaaattgcttctttttcatcaaatcctgtctttggtcttaaggccttca

SEQ ID NO: 13649 - DNA, 201 bp, Bos taurus
gggcataaatttaggggcccctttgtgttccctttatcgatatttgggagaaaggtgaactacctaggtcttcaggtggaaagagaataggtctaactaactaaagagtttaaaagaacaaagaatgcaagaacaagctactactatcaggcaagagaaacaaccatagcatgtgtgtgtgttagttgctcagtcctgtct

SEQ ID NO: 13650 - DNA, 201 bp, Bos taurus
gttttttttaacccattcttgccagtgaaaaaaaccacagaaagattatgaatcaaccaattccaggaagtgtgccgtcttctgctgtcaaccttgtgataatttcttgtgagtttccaatgccataaaaagatgagagtcaagaaccatcataacaaaaatgtccataactgcagtaccctcattctttgtaaatttata

SEQ ID NO: 13651 - DNA, 201 bp, Bos taurus
ccacaaaacaccacaagacaactccttgctggcagtggtagaacttctacaattagcgattaactgtctgaaagcttttcaggttaaaaaatgtatccttccagtttaaacaatacttttcatataaatggtagacattttcaattccttcagatcttgcaaggatttggtctaagttatatactgctccctcttacagta

SEQ ID NO: 13652 - DNA, 201 bp, Bos taurus
ttttgctttagaagcagtgtgtaaaattttgatattaccccctttccaaaataaaatcagtaaaaacaggcagtttagtgaaacaattcactaatatcacctgatagcaataaagagaaatgctaattatttctaaaggttaattacatgatactccaaatttataaaaagaaaatccctatgcatagttatgatcaaaat

SEQ ID NO: 13653 - DNA, 201 bp, Bos taurus
agcagtccctcgtaccaaaaagttggggaccactgttatatagaatttgtacagatttcaataattctttgtcatacaagcacctctcatctgaaataaacaataaaagactgagacataatcctcatgaaatatcaatgaccctactataagcaacaagaaaatactgtatagcacagggaattatagccattataatat

SEQ ID NO: 13654 - DNA, 201 bp, Bos taurus
attctgattctatcaaaactgtgccaccaaatgattttacattgtctactatatgttttaccagtatgtgctactgtaagaaagtgcattatacaataagttaacattaatacaatatggatgtattagtagtagatgtattatttcactaaataataaattggatatataaatttaaaacaatagctattattttgcaag

SEQ ID NO: 13655 - DNA, 201 bp, Bos taurus
atatgaacaggttagctgataagtcagtgggttggcagtaacaacagatgtgtgtatttgtgtttcttccatgtaacatctatttttgtctcaaggcaaaatggagagttggctgctgaagggaactatggggcaagggaggcttaggatgacaggagaagatgtacaataaactctgtagacacaggctaaataagtaaa

SEQ ID NO: 13656 - DNA, 201 bp, Bos taurus
ctcttagcgaccccatggaccacagcctaccaggctcctctgttcatgggattttccaggcaagagtactggagtaggtcgtcattgccttctctgaatatgttcccttaatggaccaaaaaaatattgcaaaatagcaactgaactttcataattcattcccagggtcttccctgcctataatgataggtcaattattca

SEQ ID NO: 13657 - DNA, 201 bp, Bos taurus
ggcatttgataaaaaccaggtacagagtaaagcctcatcacactatagctttagaaactgttttaataaaatgtagctattgtatgtttcagacttcccatgtagctcagtggtaaagaactgcctgtcaatgcaggaaccttaggagatgcaagttccatccctgggtctgcaagatcccctggaagaggaaatggcgat

SEQ ID NO: 13658 - DNA, 201 bp, Bos taurus
atactggagaggattgccctttcctcctccacgtgatcgtcctggctcaagattgacccatgtctccagaattgcaggcagattctttacccactgagtcatctgggaagcccttattaagatataagtgcaaatatatcaatacatcttaaaataccaagacactacatgaaggaaaatggaagagaaatttatctggac

SEQ ID NO: 13659 - DNA, 201 bp, Bos taurus
ggtaatcaaggctcctctacaagcatttatttttagccataaacagaaacacttctttctaaatattgattgcacattaattaactgatcaccattactgtactgacatttaaaaatatacgttatgctttagatcctcttgctccttgttcatttttaattagttctataatctgtcaaaaaatagtgaagtgggacctg

SEQ ID NO: 13660 - DNA, 201 bp, Bos taurus
aagtctcattcttcatttaaaaatgaagtcctttcaaagactaaatgttttaatgagtattttttcttcatggaatatcttttaaagtatgataaaaaatgatgcactaaaattatacccaaaggattgataatatcttgcttgattgattttgtatttttatatccataacatcttaaagctgttccaaatattaataat

SEQ ID NO: 13661 - DNA, 201 bp, Bos taurus
tggaactaatttgctttcatgcctcaatattagaattgcaaaatattacattatgcatagtacttgaactatgcatatgatattctaagatttttaaatcaaagtgtagtcatttaacatttgtggaagtggtttcattctttgatacgtagtaatgcatgatgctatatatggacaataccatgtctcaaatgaaacaaa

SEQ ID NO: 13662 - DNA, 201 bp, Bos taurus
tctgtccttccctagtgctcaccattttttattaatattactagtcaccatcttatattcttattttttaacattaatattgtttcctattaggttgtattgtccaagagaacacaacattctctagtttaattgggaattcttagcaaaattatttgagtatatattagagtatataatagagaaaaagagacaaagaga

SEQ ID NO: 13663 - DNA, 201 bp, Bos taurus
tttctttattaaaaaaggaacaaaaaaacataccaaaaagaaacaaaaattaaaatctaagagtactcattatggtaagaattaattaaacaaggaggccattagactggtatggctctaaggtattcagtcagttcagtacagttggtcactcatgtctgactctttgtgaccccatgaaccgcagcacaccaggcctcc

SEQ ID NO: 13664 - DNA, 201 bp, Bos taurus
ctttctttttcctcccaattacatggctaatgtgtacacagagatagagattaaaacttagatagaaatatggatcaggtcagagatagaaacttgcatatatacagtaccaaaaaccagaaaacatgtctcattttacttcccatattgtttatattaaatctctttgggatcattattcgataagtctactttaatgaa

SEQ ID NO: 13665 - DNA, 201 bp, Bos taurus
cttggtcagtacaatcagtggtcatggaatgtaaatgaacctcagagcacgttgtattttgcttccctgttgaattcagaataaaaactatacacttttacttatggaaaaataaggaatgatatatttcttgcacacttaaatttgtaactgaaataagtatctgctactcttgtatacattagatttaaataagcaaaa

SEQ ID NO: 13666 - DNA, 201 bp, Bos taurus
atgataactcaaagcttgaaatttgtggctctgcagaaaagctgtcttttagctaacttccctcttacttgtgtagtctttctttaatgagttcttcaaacacctatggacataatctactataattagagaaaaattttaacctgaaccaaaactgaatgactttggcactatatattattttgaatcattgaagttttg

SEQ ID NO: 13667 - DNA, 201 bp, Bos taurus
tagaattattggcttattagtagcaagcagctgaacttagatgtgttacatttttactttaaaaggaactactgactgaaagaaaacaaaagctacacatccttagggttgtgagttcacttttatttgaagacctactgaggactataacagaatttttgagagtggagttagtgcaaatatacgtctcagtagaaggct

SEQ ID NO: 13668 - DNA, 201 bp, Bos taurus
gaaggcctttaaattcactgttttgtcctaaattattttctatactaattttttaaatatgaattatccatgtgtcttcagaagtttgaaaattgtttagtatagttgagtaagaagaccgcatctttgaaagaaagatatatccatctccattttctattaactatcaggcacgctggtcttttggttctactagggcaa

SEQ ID NO: 13669 - DNA, 201 bp, Bos taurus
tcctttgcctttcttacataaaaacacaagttattggagtaaaagcccaccttaattgtatgtccttacagcagcttaaaaatatcttcaaagacctcacgctaaataaaggcgcattctgagtttcaatgtgaccttgaatttgaagggatgctgttcaatctcctgcaaagtatcatttagttaatggttaattgatgt

SEQ ID NO: 13670 - DNA, 201 bp, Bos taurus
cttcatctgttggttctccgatcttttccagtggaaggcaaaacatgttgattattattaaagtcagtatgactttagcatcaatttacctgatgcctctcaaggcaatgcttcctatctctaggggagagggattatatatcaatcactggtttaaaatatataccatgtaatgtagactagtcatgacatgtgtaggat

SEQ ID NO: 13671 - DNA, 201 bp, Bos taurus
taagttaaataagtaaggttagtaactttactagagttccaggaaataaatcattgttttagctcctgaaagaaagtagcatacagtgaatgtgaccattcctatggagtaaaggtataagacaggctccttgtttccattgtcagagtccatctccattatttcatatgtcatgatgttcaataagagatgcaatcagag

SEQ ID NO: 13672 - DNA, 201 bp, Bos taurus
atcagggcactcagcacctcacttatctaccgtacccaacctctgatgcatggtgtgaagccagtcccagattccccatcttcaacctgtattattggaacacttctgttttagtgttgagcctctgaagcagatacctaaactaaagaaggcttttgtgtaatttattaagggcaatgcctaataaggaaaaacaaatgt

SEQ ID NO: 13673 - DNA, 201 bp, Bos taurus
acagattttacactttctccattgtaatccattaaagatacagtaaggccttgaacaacctgggggttagaggcactgagccctgcaaagttgaaaatatagttataactttagagtaggccctatgtatctgtggttctgcctctgtggatttaaccaaccctggatcatttggtactgtaatgcatatttatggaaaaa

SEQ ID NO: 13674 - DNA, 201 bp, Bos taurus
caatgttggaaagaagaaaagaggcacacaagtttgtattctactgggctaaagatacttaaaaaatcaatgaacatactcagtagataatgttatatgtcaggagtttgtgagtgatagtgtatgtgtgtgtgtttaaagattaaaatgtgaaaaaagaagactatgttaaaggggatcagaactggcctggaaggcgaa

SEQ ID NO: 13675 - DNA, 201 bp, Bos taurus
ttgtttgtttttaaaagcacaacatagagatatgatatgagttttaaaaaatgtcctttatgaactaagctataccagtctaataacatcagttttctagcattagatagtctattttgaataatagtgagtatggattgttttttctctttactaagaataattctaaagtgtgtcatctgttcagtcatgtccaactat

SEQ ID NO: 13676 - DNA, 201 bp, Bos taurus
aactaaacaacttagttgcaaggcttcaatcattatctagaactactagagggatattcataaaaagagcaataacaaactcaagagtaaataatactcatgtggccagaaggagttaacttccaagggaaatgaacttcacaggagacatacttaaagctttaagaacttctgactttactttccatcatgctaagttgc

SEQ ID NO: 13677 - DNA, 201 bp, Bos taurus
gagtcatgacctgtctttcttaaataatgaaactgaaagttggagatatttaaaacattttgcaagatttatgagtggctaagccaaggccagacaactcactgttgtcattgtgtacatagtttttcagtaaagtatatttctactttttttctcattatagctggatgaaggcctcactatgacacctctttactgttt

SEQ ID NO: 13678 - DNA, 201 bp, Bos taurus
acttccaggttgctgtaatgggatttgggaggcaagtagaagccagtgtaaatataaaagcaggctgcctattgttcagggaataataaactcccttattcgtggcccaggaattacctgttctctgctagaatctgtgaaactgtggcagattcacttcacagttctttacatctgtaatgacaaattctttttgtgatt

SEQ ID NO: 13679 - DNA, 201 bp, Bos taurus
taaggtgagatattgcatcaaaagaaagttgctctaacttaaaaattaaagattcactgctcagtaaatgaagttgtaaacaataaccttgctgaaaacaacattatatttaaattaaagggtaatcatccatgaaagcagataagacatgcttttcttagtagtacagataatagtctgagaactgccaagattacttta

SEQ ID NO: 13680 - DNA, 201 bp, Bos taurus
ttattaaaaataaaaataaagacagtatgtaatgaaacatgttttaacaatagatgatctacttctcaggctaaaacaaatttcaaataaaaattaatagtataagttagagaaaatctccttatcatctggtatctgatatacccacttggacgtaagcaattctaaacagagcaaatatctaaaaatttacaaaagaaa

SEQ ID NO: 13681 - DNA, 201 bp, Bos taurus
ggcctgttattctgtgaacagtaagagtttgggttcattaatagtttcagttctacaaacaaggcaaaagtacagccattttggaaaaggactgagggaacggccttgagccaggagacttgacacacccagtaaaacaaagtgctaaaggcttggatttcacagacgataatcaaagacccacaggagtaaaagattagc

SEQ ID NO: 13682 - DNA, 201 bp, Bos taurus
ctcactatactctagttacagtcactcaacttgtgttcctggatcagggtttgtttgtattaacctgtatctgcatgaaacattccagaatcttcacaagcgtggctgtttttctgcacttgatctcaactcatatgttcataagagagccttctcctgacgcccattgtaaaaaaggtacctccactcaggctccccatt

SEQ ID NO: 13683 - DNA, 201 bp, Bos taurus
gatgtggcaccatgcatgaagattctacccggcctcttgggggtaagtcaatcatcatggggtcctggtacattagaagaggatgccattcttatttcagatataattcctgtctgccaggccttaatcagcacagttatatgagtattgatggactgatacatgactagcattgcctcagaacctactttggagcaagta

SEQ ID NO: 13684 - DNA, 201 bp, Bos taurus
tagggtctctaagccctttcctcatccattacggcccaagctacagggaaggtggtcaatgcttccttgagtatcaactgccataccttcatatcttctcgtcctatttgcttaggcctccacaacttttttttttttttaaaccaaattctctacattaaattgcctcttcaaaaatatagtttcagctttcagacttgg

SEQ ID NO: 13685 - DNA, 201 bp, Bos taurus
taataaaaataaatgttaataatttgagttattatttgttttattttaattgattgttcatctaaaattttagttacccttgactcattaaacataaaataaaattagaatgtttccacaccataaaaatgtaagattcttagaattggtagattaatttgtatccaattatttccccatgccttttgttttattgtgtac

SEQ ID NO: 13686 - DNA, 201 bp, Bos taurus
ttctctgaagtatattaattttttaggctattttggggtaggacctacattctcccatgaggtagatgttctctttagcaaaccgtggcccacagcttccctatttgttactttatggcaaagactgccgccacctaattgaacaaggataatatcagatggcctttgtactgatttcagtgtttgttgctgtcttgaacc

SEQ ID NO: 13687 - DNA, 201 bp, Bos taurus
ttacatgcattcactaattcaacactctccaaactctgcaaaatattcatgattattaccaatttggagttactgaacaagatttgtagatattagttcctttctctcaagttacacttctgagaaacaggtgaaactagggcctgaaaactccgaaattttatcatttcaccctttgcctcaccaaaatgttgccacaat

SEQ ID NO: 13688 - DNA, 201 bp, Bos taurus
aaatccaatggccactacccataatccatccagcccttactgaaatcagtaaccttttgaagagggccaagaacacacattcaaagaatagcttgctgttgctgctgctgctgtttaaaagagagtttgatggaaaagaaagagagagcttttcttccagtctctgtttggaaacattcaaataacactagaaatatttat

SEQ ID NO: 13689 - DNA, 201 bp, Bos taurus
tgcaatgcagtccatggggctgcaaaagattcagacatgacttaacaactaaacaacaaatacaatctctagaggattgaagtatgaaagaaacattctcctacaagactgaaaaaataactgatttttaaaagaataattagcagtcttagcatatccctagcatccatcacaagtgctgatatcataggatatttataa

SEQ ID NO: 13690 - DNA, 201 bp, Bos taurus
tgaacaaaagactttcattttatcttttgcttaactcctgacacaaacattattgttggccagcatactaaaagtccaagaaatggcttaattaatagtgcatagaatgtatggaagaattggaaaggtgatacaagcaaatatataatgtatattctcctccactacttgataattcagacttctttccatgccataaaa

SEQ ID NO: 13691 - DNA, 201 bp, Bos taurus
aaatatatatgtctatcaaatcatcattttgtacacttatacaattacatttccgttaccccttaataaagttaatttttttttaaactaagacctgcctactgagaaaaacattgctactgtcttccagaaattctcacatagatgctcagaaataatgtttagccagatatctgggcttaatctaaacaagttcacgta

SEQ ID NO: 13692 - DNA, 201 bp, Bos taurus
aaaaggcctctcttcttgcagccttcttttaaaaagagcaagggaaccttatacaaaaatctccatctgtcttttggacattctttggttagagctgtcagtgggggccttttagactgactgaattggaatttcccctggagcttgatacaaggacattctaccctgaatcctttgatggaccttccagaactatgtact

SEQ ID NO: 13693 - DNA, 201 bp, Bos taurus
ccgagaggcctttctatattacctcaatttccctagttctgatttagttatgttaaattatacaatgtgtcatataacagaaataatgtgggatatgaatgcacatggcctgagacatcatcttaaaagctggaaatactcatcttactctttattctacatatgttatattgagttaacacttatcaaaatgtgggggaa

SEQ ID NO: 13694 - DNA, 201 bp, Bos taurus
cttaatgtattatatttcaacaaaacagtctaagctaaaacatcaatctatttttatatttacccaatccatttgcttttattttccttcctgtgagacacaaatatattaaaaataacttagagctaagttcaagaagttataataaaaatactgaatacaattctattaaatactatttcaatgtccaatttctttgtt

SEQ ID NO: 13695 - DNA, 201 bp, Bos taurus
ccataactgaaatgatagagttgtgtaagtgattgttaatcttcaaattatttattgttcaatacatcatggatccacctgggagtccctcaatggccaagtgtatgtaaacaattacccttgagacggaaaaaaagaaaaaagataaccacctcatgagaacagtgaagtggccctctggctggcttatctacataatat

SEQ ID NO: 13696 - DNA, 201 bp, Bos taurus
agaatttgactttggaggccagtgggatttgattacagatcctctacaggactggggaaacatactctttgagggcacagacaacacattgtgtgcaccacggcccaggagaaatgagaagtcaccccacaagagacttgcccgagtggccaggagtctctggaggaggcgtgggtcgacagtggcctatcatggaatcag

SEQ ID NO: 13697 - DNA, 201 bp, Bos taurus
ttcattattatttaagttcccaaatctctgaaacttatcagacttccttaaattagattgtaatgaagctctcaaagtcacatggaatctctccttttattgtcctgacttttattcgaaataaagcaacaaaacataaaataaaataaaataaaaacagtttgctttatctttacagtgtagaaaaatattttcttgcct

SEQ ID NO: 13698 - DNA, 201 bp, Bos taurus
ttcattctcagcttttacaagtgattttgaaacattttcagatgaaagccacttcaattattttatttttcctaacttttaaaaacttaaaatctattatatctcagatccttagtttaacttctttgatgatccaatgtaaatacatggttctatttttcttgctatattaaattctctctgtataggcacacacatgta

SEQ ID NO: 13699 - DNA, 201 bp, Bos taurus
aatttctacttatccttcaccatctaagttaaatgtcatatgcaccaaaattccttttctaaaacttagtaagacttggcaccaattgccaacattgctagttgtctttctgattttttttttttttgtttgcatctcttagtcttacaaactactgcacaattgcactcatctcacacgctagtaaagtaatgctcaaaa

SEQ ID NO: 13700 - DNA, 201 bp, Bos taurus
attagaatagagaaaattggctgcaattttatgcagtcatgattctaacatctttaaaggttaactgaatgaaacctacagaagatggtaaattatccagctcaagtcatagggaatggtggtgagggaaaccctattacctcagttcttagggtgcaaagggagaatgcagttaatggaacctaaaggaaaagatagatg

SEQ ID NO: 13701 - DNA, 201 bp, Bos taurus
atgcactgtcttatttaaaaatcttgccatttggcacctaagctctcagacagaattcccacccaattgtaagcaggaaggatgccaacttaacagatgaacagaaagtgccaaggccaagagtccaggttcacatatcaaatgtgcttacttagggcaggattcccaggtataagtcttcaaccatgttcagaaaaactg

SEQ ID NO: 13702 - DNA, 201 bp, Bos taurus
cttctaggctcccctttgtataattaccaaatcatagagactctttgttaacaaaatgttttcatttatctttcctcattattttaattgctatcaccccaattaagataattgtttattcttacatttacaatgataaggttacatataataatgggtttttatacctctttctgctaattctttcttcatatacatccc

SEQ ID NO: 13703 - DNA, 201 bp, Bos taurus
taacttcaggctccaaagtatccttttactttgctttattctatttttgcaaaactgagaaaattgtgattaccaaacatggctaattgtaattaccaaacctgtcatcaaagttttaagatcatacttagcaaactcaggattcttttcaattaaatgggaatggttgaaacagctttattctgaggccagcacaaaagt

SEQ ID NO: 13704 - DNA, 201 bp, Bos taurus
gtgctgctctgtgaagattagaccagactggacacagtgaaagcaggagaatagttaggaagctaatggaagatatgagagagagattattcaaggccccctccctccagtacattagcctgagcaacttgaaggattaaatatggagtgagtggaagtcgctcagtcgtgtctgactctttgctaccccatggaattctc

SEQ ID NO: 13705 - DNA, 201 bp, Bos taurus
ctggagctttgccttttctgaagctgatatttctagtctgaaaacaaagcatttgagctttgggagaaattcaaaggttatatgaagctcacacaagtctgatgctagaatcttctctatcatccttctgccaaatataagccagccagtgttagagggaacataatacagggaatttcattttccatgagggaaacttga

SEQ ID NO: 13706 - DNA, 201 bp, Bos taurus
gctggttagacaatactgaattcacactatgataactctatctgacttgcttcttacaagttttgatctctatcatccccagaaatgtcacagtccaactcaaacacaatgcgctctgctgaacttccaaaccattagaatatactgtcacttttaccaaagtatttctgaagattttcacaaaagtactgtctactgaat

SEQ ID NO: 13707 - DNA, 201 bp, Bos taurus
atggtgttgccaggagctgtggggaggggataatggggagatgttggctcaagttacacgtatttggttatggaaaattaatacattctagagatgtagcggagaaggcaatggcaccccactccagtactgttgcttggaaaatcccatggagggaggagcctggtaggctgccatctatggggtcacacagagttggac

SEQ ID NO: 13708 - DNA, 201 bp, Bos taurus
gattcctgaataatattttgatcctgtgggaggcaaagtcacttacactcccagtgcaatgatgttctgtttttgttgtttctattccctctacttttcctttgttggttcctttatttattttgaaagttcaaaaatcctgacacctgaaaagttcatctttacttttggtccattgcatgaaagcagtaaagacacaga

SEQ ID NO: 13709 - DNA, 201 bp, Bos taurus
ctaaatgttcactgactgagagaagtgccctaccaagaggctcagcatttctgtagcagaaggtgtaaagagaatcatcaggaataaagcatatatggggtggaaggaaagtgcaattgtccctgcacaattcaaagatgccaagaagaaacttgcaatcagaagctgtgtaacacaagagagaggagggagattatagtt

SEQ ID NO: 13710 - DNA, 201 bp, Bos taurus
ctaccaggctcctccgtccgtgggagtttccaggcatgagtactggagtggggtgccattgccttctctgaaggccctcctagaaagggccaaaatagtagatattttaggttttgcaagccaggagaggtctgtctgccactgggactctgccatatcaaaagaaagcagccacacagaccataaagacaaatggacaca

SEQ ID NO: 13711 - DNA, 201 bp, Bos taurus
catatctttgctattgggaatagtgctgttatgaatataagggtgtgtatatcattttgaattacagctttgtccagatatatgtccaggaatgagattaccggataatatggtaactctaatttcagtttttggagacatcttcatactgttctccatagtgggtgccctttttttctttttccctattggacacaggta

SEQ ID NO: 13712 - DNA, 201 bp, Bos taurus
tgtgtgcattctggtattaacattctggagtctccctctgtcacttcttaggggacagggtttgatgttttagtccagacagctttgaccattgggtcacagggccccttgaaaggaagtacttaacttttcaacaatggtaacaagaatgatattcttagaaatctgctgatttaaaatgcttcgccttctcagtccagt

SEQ ID NO: 13713 - DNA, 201 bp, Bos taurus
taccgtaaactcctgcgcggagggcgttgtggtgttccagacggactatggtcaggtgagcagagagcctgcagcttcgtatcagctgtgttcgcttcctcggggggccctgagtgagggcacgtgtgttcattccccgctccccacccatcatgccctaggcatcttttctcagtgatgaaacagaatcctaaaaggaat

SEQ ID NO: 13714 - DNA, 201 bp, Bos taurus
tgacatccttctgcttaaaaagtattcttgaaactttccattctgcctacaaaaagttctcagaacttctaatatggtctcccaggccccatatcagtgccgtagttatttttcgttccctttttcaaattttcattatttataaggcttttttttttctttaacagcatcaactcattttgacttatctggccgtgcgtt

SEQ ID NO: 13715 - DNA, 201 bp, Bos taurus
tcctctaattctgatgtcttgggggaaatgattctctgtacatttacttgacactgaggaaatttaatagtcctcttgattaaagatatgataaccccaagaataacaccaaccagaacataatttaattaactcaatttagtgagtatttactacattcttgctgtttggataaaaaagcaaaacaccatctcagcgggg

SEQ ID NO: 13716 - DNA, 201 bp, Bos taurus
aagagcccccttatgccatcactgttgggttcagtcagctgatgtcagaatggtgtccctcaaagagccagtagccaccagcatcgtcatggccatctccggggtgcttgtagagatgcagatcatgggctccaccccagtccttcaaccagaatccctggaggtggggccagaacatctgagttttctccagctccccag

SEQ ID NO: 13717 - DNA, 201 bp, Bos taurus
tttgctctctggccctttccagaacacatttgtctcctctgctctagggcataacagcttccactgtttgtctgcattctgagtcgtgtgttcattctcaaatctcttaatggccattgctgtcactactgtaatcgcataattttaattataaattataataaactgatgaagtaagagatcaaaaggagtattgttgtg

SEQ ID NO: 13718 - DNA, 201 bp, Bos taurus
agtcaccagagattcaactttcccaggttatccatccttggtggggcactaattctgtacattcctaaatctaaccatttacatacttttctgaatcttcagcctactggcataaattaataatctgctgtcagcaaaatcttatatttttaacctcttctctgcacaacctttgagctttttgtaccaactgaaatccat

SEQ ID NO: 13719 - DNA, 201 bp, Bos taurus
gaatgagaaactcaatcttaaatttaattttgctgaaccttcacataaatcaccacctgtggctcatggctaccatattggacagatttctagatgatgggatggtaaatgtgtaagggtttgatcgacaagtttcacctttataacaggttatagttcctaaatgatgaagtaattctgtttcatgagacgaataaagtg

SEQ ID NO: 13720 - DNA, 201 bp, Bos taurus
cagcctgattgcaagaagtttgtggtcttggggaggatgaagtcaaatatattggcaattcaattacagtaagttacctatacatgaatgagttccattccggagcatgttcgtaagtccaattttgtttgtaagtccaacaaagttaacctagttacccagctaacacaatcagctatatagcactgtgctgtagtatgt

SEQ ID NO: 13721 - DNA, 201 bp, Bos taurus
cctcgtcagtgaggcggacgcagcgccgcaggtacaggtgggtcagctgcgtgcagtgggccgcgatggtgtgcaggccttcgtcttccagcacgaagcaatctgtcatgtccaggtagcggatggagatctgtttgccgtgcaagggggacagtttaatggaggcctcgcgggtcaagctgatgcaggtcaccttggagc

SEQ ID NO: 13722 - DNA, 201 bp, Bos taurus
aggcccaaagagattaatgaatattttttaaacagtaaacaagatagataaaactcttttaaaaaagatagacagaaaaaggacaggaattatcctgcatttgactcaggcctgaaaatcaaaggagattcaagactgaggcagacttgaccacaaatctcctgttcaaagatatcctagagatcaactttagccccgagc

SEQ ID NO: 13723 - DNA, 201 bp, Bos taurus
tcccagaaggagctcataaatcgcgtcctagaggttcatcccaaggccctctcccctctgagaacctcagatgccctctggaattgtaagtacaaaacgacagctccaaatccctattactggcccaaatctctcctccaagtcaaacacacatctcacctgccagaccatgcccactgccctgcccacccggggtgccca

SEQ ID NO: 13724 - DNA, 201 bp, Bos taurus
ttcgtacaagacttgcgaccttatgcagaaattgttagtgacttgaccttccatagattctctttgggtaatttcctttcatttaatactattttcgttcttaaagataagcaaaaatatcatgtttccaaattttaaaatctagatttattgttccagagagatcatgttttgaaggaaaaataaattcatctattttca

SEQ ID NO: 13725 - DNA, 201 bp, Bos taurus
tcactgaggtgatacacttttgtgtgctctggttgatcaactatttattgcatgcctttttactctggccagtgggcacatgaactattctcagctctgcgtgaactctggaattttttctgtctatagcttttcagtgtatttttttccctctccccttggttattttcctctctttctctgttctgtgtatggagatca

SEQ ID NO: 13726 - DNA, 201 bp, Bos taurus
ggaccgcagcatgccaggcctccctgggatccttaaaagtgaaggtgagaagccgaggaagagtcacagtcagagagatgccctgtgcctcaaccagctgctgctggctctgaaaatggaaggggccaccaactaaggaatgtagacacctctggaaggtggaaaggacaggaatggatgccgctccaaaacctccagaag

SEQ ID NO: 13727 - DNA, 201 bp, Bos taurus
tttagacctctccctgccatgcccgtacctctcccctgaaacctaagaacagtcagaagacaatgatgaagattaccatcgtggcgagaaagaatgtcaatggccaaccctcttctacttgtcacagagtttgattctgccagatacgcagacagggaggatggttggatggattgtcttcagctatggccctcaaatggc

SEQ ID NO: 13728 - DNA, 201 bp, Bos taurus
tgaggtcctgcacggcctccacggactcggcgtacacgtcgtccagcagctccttctgcagctcctccagccatgtccacagctgcggggacagcgccatgaggggccctgtcctgcggcccgggggaggggaccgcgggcagctgctcccagggagccggaagggaggcgggtggcgggggaggcaccccacacggctgg

SEQ ID NO: 13729 - DNA, 201 bp, Bos taurus
ggtgatactagctagctcgtggaacagcaagtggaagttcagacaaggcctctactttttttttttttttttttaagaaatatcttctatttgaggaattcggagggtctaggctactagcaggcctaaactgaaaactaatcatacaagacaaaaactaatgaagaacgtacaccattaagggggaaaaaacctcccagc

SEQ ID NO: 13730 - DNA, 201 bp, Bos taurus
gaagtgtgaaacttccaatgtgtttttctgaaatccattcctttctttctggtccctttgcaaaaagaagaaagtccccagagagatgtttctgattcgagtttgcctctccaactcctttccaggcttcatgataggaaaagggctcattagctctggtggtatccacaatattggcaatttgagcaaaatgacctggtt

SEQ ID NO: 13731 - DNA, 201 bp, Bos taurus
actagggaattctggagttatagagctgaggaaaatagaaatagaatccagtgtaactgaaaaggaccctatggggccttcccaggataagtaaaatagtgttagtcagtcatgaccaactcttggggaccccatgtactatccatggaattctcgggccagaatactggagtaggttaccattccctactccaagggatc

SEQ ID NO: 13732 - DNA, 201 bp, Bos taurus
aaattgtttttgaagttaatccatgaaataaaatagaaaagagtgtcatagatataactctaaaagctgagtggagtacagattgctacttctatacttattggttttgtttgctattctatatggtgtttcaagggctttaaaatttttaatcatcaaatttctatagcaactccagtagagaggttagtattctggatc

SEQ ID NO: 13733 - DNA, 201 bp, Bos taurus
tcattttaccttcagttacccctgcggtatccatattgtgctatcagttaaatctcaaataaaatctttcaactttttcaaatctccattttacaagtgatagagttaagagctggagaaggtagcaggcaggagtgattgttcacacattttaacacttgtgttagggttggtacaatattataactgtctggggatctg

SEQ ID NO: 13734 - DNA, 201 bp, Bos taurus
acctagagtccatggggtcgccaagagtcagacagaactgagctactaaacaacaaaaaacgacttggtacaaaatctgggttttcagactcttgtaaactaggcctgtgcagtgagtctcagaggtaaaatgttcttatttacccagggcatctaaaatataccttgcatcaggagaaagatacttgtctgctgttgtgt

SEQ ID NO: 13735 - DNA, 201 bp, Bos taurus
gattccctacttagcaagtcttggaggaggcagatggcggcccatatcaacttctctctttgtagttagaatgaagctgctttgggcttctgctaaaatacccagtcagcaggaaggggtccagttctcaacccggttatgctaacacatggctggcacaagccctgttatccgagtgacacagttgacttgaccacatct

SEQ ID NO: 13736 - DNA, 201 bp, Bos taurus
gggagaggggttggagattgagttcaatcatcaatggccaatgatgtatttaataaactgtatttaataaattgtacctatgtaactgggcttcccaggtggtgctagtggtaaagaaccctcctgccagtgcaggagacataagagatgcagtttccatccctgggtcaggaagatccctgggaggagggcatggcaacc

SEQ ID NO: 13737 - DNA, 201 bp, Bos taurus
ataaaattgaaaactaccaacctataaaagttgttaatatagtaaatgtaactgtagttttgagagccatcttcacatttaaattagaaaggatctttccggggcaggggcgggaaaggggtggcggatattcctatctgtcttaagatttaaaattctgttggcatcaagcacagattctgagctcatgatttctctctg

SEQ ID NO: 13738 - DNA, 201 bp, Bos taurus
cactgtggagaagatggccaaaagtaacaaaatctgtctctagactaagtgattgtcttgtattctgtgcactgaatgcttaagaaatagaattgaggatctgcctccatcattggcctgtcttgagtatgtgacaactggagtgagtcattttttaacctgccctcctctagacaaaaagttattttccatgatgattat

SEQ ID NO: 13739 - DNA, 201 bp, Bos taurus
tattcttataaataccctcaacatcttttcaactaaagagtttgaaatcttttgtactttgaaatacaatatacaaagctagatgaagcttttgaatgtcatttccttcctggtccaaagcaaatgtttgtccttcccaaactactcgagacattaggttttttcttaagatccatttatgaaggtaactatcttgctcag

SEQ ID NO: 13740 - DNA, 201 bp, Bos taurus
atcagggccccattaccagtaaagatttattttgtagctctgagttatataccagccatttaaaaagttcagaaattatcatgatgtaggtaagggtcacccatgtagtattatcactaaacttggtatccaacttaatggattcttacatcatcttaaactcccaagaaatatccccttctttattttatggaatactga

SEQ ID NO: 13741 - DNA, 201 bp, Bos taurus
acttccctggtggcccagtggttaagacttggccttgcaatacagggaattcaggtttgttctctaattggggagctaagatcctaagatcccacatgcttatggccaaaaaactagaacataaacaacagaagctatactgtaacaaattcaataaagactttaaaaaaaaatgggtagcggaattacaaagtcacttac

SEQ ID NO: 13742 - DNA, 201 bp, Bos taurus
tgcttgcactaatagaggcatctgtgtctccccagattatacagacctctccccagtttctcatggagatacatagtgtttcatccaagtacctaacatcggtggtggaggactttgaaaaccccgactgcattttctgatggaatgcaaaatgccagcagttgggtccactggaacaaatctattttatgcgttttgggc

SEQ ID NO: 13743 - DNA, 201 bp, Bos taurus
atccttgggttgggaagatcccctggaagagggaatggcaacccattccagtattcttgcctgagaaatctcaacaacagaggaggctggcagtcatctacgactgagtgtgcatacacaaggttttccacaaacaacaaggcttttatgtgtcattggcatgcacagttgtgggacaagaattttgctgtccttgatata

SEQ ID NO: 13744 - DNA, 201 bp, Bos taurus
ctgaactacaacaaaataacctataaactatagtgaccattttagcaatatagtaaaataggaaacagttgcatacttactcaagacatgtcaggccctgatcacttgatatagaaatcacctgatatgagctgatttctttaagcctcaagatgtctccatgtaggccctgagagtttaagtcacttgcccgaagtgtcc

SEQ ID NO: 13745 - DNA, 201 bp, Bos taurus
cattccactgaggggggcccgttgccccatgggggtccagggtgtgaccccagttcaaagggtgcctcctttggatggagatctggtggtgtgtgatgctcaagaaggaaacggccttgaattcattgcatccaggtccacacacacagagtaaccctggacctgtgctacttcccagctcctggatcactgctcttgaaa

SEQ ID NO: 13746 - DNA, 201 bp, Bos taurus
ggagcagaggccagtgagggggcaaggagggagggcacgttgagacctgggccttcctggccaggacacacaatcagaagatggaagagaagatgtccctgcagaaaggattttgtttgttttgcgaaagcctgcttttcaggattccttttatcagttaaaaggaaaagtacagtttacacacaatacttgtctgtgcac

SEQ ID NO: 13747 - DNA, 201 bp, Bos taurus
gaagacagcctggcctggtggggtccccccttcccctcagctgcaggacttcctgacgtatccgcaggatccctgcagaaggtccagagtatcaggctcctgaaggaggatgtcagcacaggaaggccacgaggggtgcggtccgtgggtccttgtcattggagcctatgctgcccttggacccagacacggtggacaccc

SEQ ID NO: 13748 - DNA, 201 bp, Bos taurus
aagtgaaaacccttggccaaccaacgtccaacatgttcaaagctaaaacaatatagatttttccagagaggtgctggtggtatctatattagcgaaggagatgctaggaactggtccctggcccccaatacctctttatacaaagtacctacttgaccaaaggagtcagcttttcttcgttggctttatagattacaaggg

SEQ ID NO: 13749 - DNA, 201 bp, Bos taurus
caggggaaggggtagaggggacagactggggtgggcaagtggctgagggggactagtcaggatgtggttggcggggaagaacccaagaggcccctgcaacaagaagggtcttttgggagccgattgaaaactattgagaggaaaggtcatttcaaagaggtttcttgacttttgtaggccacggggacccccgagagggta

SEQ ID NO: 13750 - DNA, 201 bp, Bos taurus
atccaggaaaccagctcaacggcaacttgttggtgcagttgccctgccatcggtgagcccaccgtgagccctgtctggccaggcagtagtggcattcctctctgtagtcctgacacacatcaccatccccagcagtctcacatgtgggccagcagcagttcagtctctccagcctttgctcttcgttacatgggtattctt

SEQ ID NO: 13751 - DNA, 201 bp, Bos taurus
agcaacaatatacaggtattatgttattttaggaattaacaatttaaggatccattcactgaaccagagcatttgggctcttttctgagtgtttatcatcggctctcgaaagctctcaacccgggaagggctctttgcgtctgacgtgttgatttttcaagttgcttttccccattcaagctggaagtcctctccttgaga

SEQ ID NO: 13752 - DNA, 201 bp, Bos taurus
atttccttagggcttccagaataaagtgctacagacccaggattgtctcacagtcctgggggtcgagacatttgagatcaaggtgttagcaggcccgtgccctctcggaaagcagtaggggaggatctgtttcagtccccctcctggttcctgggctgaggcaggagaactctagtgttcacacggctgtctcactgtgtg

SEQ ID NO: 13753 - DNA, 201 bp, Bos taurus
gcccagggacattgtcagtcctgtctgtggaaggatcgcctggtgtcctgccggacttcctaatgtcccaagggacttttcctatggctgaaaataccctctgttttcctcaggccatgggtgtgatctagccctggataatgctgacctgggatgccttttgtagctaccgttttcttaataaccttctgtacaggtctc

SEQ ID NO: 13754 - DNA, 201 bp, Bos taurus
ttgattacctctgtaaagaccctgtctctgaataaggtcacattctgagatactggttgctgggacctaacatatgacttggaaggggtgggccccactccacccataacaacaggggtctgtgtgctcttgagcagttcttaagttcttccaggcttaccttgcatctgccttgagccctgtgtctggactccatctatt

SEQ ID NO: 13755 - DNA, 201 bp, Bos taurus
ggaccttgttataactgatactgcaattaagggattctattaaccctcagcttcaagacaaagccttgactcttctgagatgagatgtctgcttggggccgccagggacgataacagcagtaaatctgtcagtggctgccaagtgtctgcaggggacacggttacccgaggtgcagctctgatgcacgacgggtctgccaa

SEQ ID NO: 13756 - DNA, 201 bp, Bos taurus
agggggtgaaacgttccctgtactttctgttcaattttgctgtgagtccaaaactgctctaaaaaagaaaatctatcaaaaactggccaacgtgcctcatttcccttctctggaaaacgtgactcttctcactgataggtacagtccgaccttgtgcctctctttattgagataagcagcccaggaaaggccaccacagcc

SEQ ID NO: 13757 - DNA, 201 bp, Bos taurus
agtccccattactaaatgcatgataacaaccacatccatgcaaagcatgtcttcagactccccaggtcggtcttctagttggtccctcacttgagcctgattggaattttatctggagtatggtatctcttgtggctcagctggtaaagaaaccgcctacaatgcaggagacctgggttcaatccctgggttgggaagatc

SEQ ID NO: 13758 - DNA, 201 bp, Bos taurus
agatgcagtggtttatttgcaaacatttacatgagggtttttctatttgactgaaagagaaggagggtagttggggccattagtgtatggaggggtgggagggatggagattaggatggaaattggaacagccaggaagcatctgggtcctactcagccaacattgtgttggtcagagaggaagatgtgggcagagggcag

SEQ ID NO: 13759 - DNA, 201 bp, Bos taurus
aagccagttgagggaggagaggggaaggcagtggggctgcagcgatctgatggaggcgggaggcaagtccccttgccacaggagctgaaggcaaaccatgcaagcaccggctgtttgtcagctccagccacacccacccaagagccatgattctctcctcttgttcagaagtgtctctccttcccaggtgtcctcactcag

SEQ ID NO: 13760 - DNA, 201 bp, Bos taurus
gctctgatttccatcctgctctccctcacctccatctgcttgggaggcctgttgcccatctgagaactgggaacatctttattgtgcagcagaggctcaccgtggtggggggctgtgtggggccatctcacagcctgagtgaccatctctgagccagcggtgtaggcatggctgagccaatggaaatcggctaggggtctc

SEQ ID NO: 13761 - DNA, 201 bp, Bos taurus
gcttagaagggatgtgttggcaagctccaagaagtcagtgagagatgcataagggagaaactagatctggcaagatttccctcttctgaaacagatagcatggatggggccaggcacagaccacagtctggagttacataagcaggactgcctgagttagcaaatattttagtgttagtatatcccaagcgttgcatggga

SEQ ID NO: 13762 - DNA, 201 bp, Bos taurus
tgtagagtgatgtgggaagtaaggcaaagcatctatttgctcctcagtctcccacccagcacccattctctggtttccttccttgttttcctcgacaaacttgagcaccaagccagcttcccgtctgtgatcctctctgccctctggtcctgcttcccagtcttagcagagctgctttcagcttccaggccttgactcgtt

SEQ ID NO: 13763 - DNA, 201 bp, Bos taurus
agcagcccacagggaaatgggcaaagatatgagtagatagttcacatatgagtaacttctgctgtccagtaagtagatgacataatgttccatctacttccaactctcaaaggaacacagaacactgctggtggtaaggacgctaatgaaagaggactctcacccattcctggtggaaaagtgaattgcttgtatttgggg

SEQ ID NO: 13764 - DNA, 201 bp, Bos taurus
ctgttagtgatcatcttactttattggaatgtgggcctttctgatgtgaatcacacttggggttacagaagaagcagacacacagcggcagagagggcttcctgtgcaaagtgtggtcccaaggccaagagcttgggggatatacagcaaatgaagagagggcgctggtgaagtatcctcacaccacctgtgtttgtccaa

SEQ ID NO: 13765 - DNA, 201 bp, Bos taurus
gtgtggtgattaagtaaaggtttgcaataatttgtcatttctaagtccataattttgatctaatcctgagatcagaaaggcagtgactccatctcaataccctctccttctctaaatgaattccccagaaataagaaagtaagaattatcacattttgtagtcaccatagtaacaggaatggctacagctgattcaggaca

SEQ ID NO: 13766 - DNA, 201 bp, Bos taurus
catacataatacttataacagttcataatcaatgaatgatcactggagatgtttcagatacatattccttaatgaactcaggataacatatatccacttcatacatcctccatctgtaaagactctcctaggaatggaaaactggaaaagtaatttctgtccaaatcttctgaaattagcagatcgatcagaggccttgaa

SEQ ID NO: 13767 - DNA, 201 bp, Bos taurus
taagattttttaagcacaatatcttctacaatttattgactataacacagtttgttcaaaaaatgaaaatagattgttttttttttaaatattagattaaatgctttggccatgctgtgcatatttgtttgcacagagaaaaaaggaccgttcttttcatgtaatcttagtatatttgggaaaatggaaaccgatccttat

SEQ ID NO: 13768 - DNA, 201 bp, Bos taurus
gggacacttggcaatctgtggaggggatggtcgtgctcttggttcagggcagaggactctgtaagagaaagacaccagcagagagtgtaggctgtagggacggacttcatggggaccccatcttgaaggaggctgcttttctccacgaggcatttgctgagtgttgggatggcaaggaaaggtaagcagcaggactgcctc

SEQ ID NO: 13769 - DNA, 201 bp, Bos taurus
agaggctgcgccttaagcagccttggatacacctgctcaccaagccctctgcaggccagtctatcttctctggtccctgtgggccaatgcttttgcctttgtagtttgatgtcgtgacaactcacatctctaccactgcttatgaccaccatcaagacatattcatttgctgatacccaagtgtcattttggtcttatcaa

SEQ ID NO: 13770 - DNA, 201 bp, Bos taurus
gttttttttaggtcttggcacaagtaaatcacaagtcaagccctgcctctatcagttttctgtaacagagttggatcgacaggtcagagatgataaatagcagagcttgaggctaaatttgctagttggcttctcaatgttgcaatgtttctgttctcaaaggtaaaacactcctttactttttctatcttgcttaagatg

SEQ ID NO: 13771 - DNA, 201 bp, Bos taurus
ggtttatatgtctgttcttatgctaataccccattgtcttgatggctatagctttatagtaagttttttaattggaaagtgtgagttctccaattttgttctttttcaagattgtttgtctattcagattcctttgcatttccaaataaattttagatatgcttgtcaatttctgcaaaaatgccagctggattgggtagg

SEQ ID NO: 13772 - DNA, 201 bp, Bos taurus
gcccatggacacagagctttctgatcaccactcccagcaatttcctcagcatccccgagctgtgaagggctcacactgggccattcttcctccctgtgccgtctttgtctacttttggtccctgtataacaatggtcacagttgaagccacattccttgaaaagcttcatcctggggcagcttggcctttctagaaagatt

SEQ ID NO: 13773 - DNA, 201 bp, Bos taurus
ccacgaatccagaacctatttttcacataatttctctaacacagtagcttcgtctccctgggagctggacaatggacatgaaggccaaaagttgggcaaacgattggtgctgattcatgtgaaaaagcagcaatggagagacgccttgtgaccacgaagaggagcgtcaccctctgtgtggcccccacaagcattaaaaat

SEQ ID NO: 13774 - DNA, 201 bp, Bos taurus
tcccagtagaatgacctagacggccaccgagagctttcccacgtaaggaaaggtcagaggggtcagcacgtttagccagaggagcagacatggtggagacctttcactgaatcccagtttctggccaatcatgatataaatgaaaacctctttattaaatatatgaagtgacaaggtgcagagcacaacagctatatgaaa

SEQ ID NO: 13775 - DNA, 201 bp, Bos taurus
ggagaaggcatggcaacccactccagtgttcttgcctggagaatcccatggacagaggagcctgcaggctacatggccttggggtcgcaagactcggacacgactcagcaacccaagcagcactaaaccactgcccagggcctacctgccttcttggcacacctcgctgcagcggcggctgtggatgccctacgctgatgg

SEQ ID NO: 13776 - DNA, 201 bp, Bos taurus
gaagtgctccgtatctggtataagtgtttccatcatcactcaaagttttgctggacggcactgcctagagagtcagaggccttctcttttcacactgttgcgtcaaggacaatcagcccaaagaggacagtgttcctgggcttcacacggtcaggtctcactcccctccttcatgagctccttttacagggaaggccgggg

SEQ ID NO: 13777 - DNA, 201 bp, Bos taurus
acgtgactcgttatagctacatcctttggattggagtgtgttgtgaatttttctctttagagtaatacaggctcatagttctttatgcacagacatgattaaaatgtcttgtaagtacagtttcaaggtgttgccataatttccccaacacacagagaaaccttcaagttcagcggggatttcataaagaaagggtcacta

SEQ ID NO: 13778 - DNA, 201 bp, Bos taurus
cacctacagaatcccatggagagaggagctcgcaggcttctctgtccatgggatagcaagggtagggtacaacttagcaactaaaccaagccagttacattgatgtcagaaacacatacatgtgtattaagtgcgaatctgatgaaggtaaaattgttttatggttggatagtatcaccaactcaatggagatgagtttca

SEQ ID NO: 13779 - DNA, 201 bp, Bos taurus
attatgactatgaaacatgctgattaccaatccatattcatttgaaaacctagaagcagaagcaaaaactaccatgtgtgatgggaagatggacttgcctgctcttcggtttttagttttcaatctctcgtctattaatatgataattgcctttaatgactttgttctcctcagtgtaatcagacaggaaactttagatgg

SEQ ID NO: 13780 - DNA, 201 bp, Bos taurus
taaatatacccatgtctattaatgacattaactgtaaattcatagaaactggctgatattgcatttatatcatacagaatcagtagttgaagtatttataaaagaaaattgattagctccggtgactatttactcccaagttttgtcacatgcaggggcttccctggtagctcagttggtaaagaatccactgcaatgcag

SEQ ID NO: 13781 - DNA, 201 bp, Bos taurus
tggggtcacaagagtcggacacgactgagcgacgaaaccaccaccagtccttccaactggggcagtgcagctggcgaggggccggaataggaagagggcacctaaacataccatttcaggtcgtcctgggtttcccattcaggctgggaacacactgctgagggccccagcgagcaggtataattattccagctcacagca

SEQ ID NO: 13782 - DNA, 201 bp, Bos taurus
cattttccaggtcagatgggcttcactcggtacctcgactaacggaaatttaactggaaattgtctcaggtgaaaaaatgtaattatgagaggataaaatcaacagtccccatggccgaccccccggtgactgcttggccacctccacattacgtttaaggatgtattttcctctgtgtgtgcaagtaaacacacatatgc

SEQ ID NO: 13783 - DNA, 201 bp, Bos taurus
ccagtgttcttgcctggagaatttcagggatggcggagcctgctgggccgccgtctatggggtcacacagagtcagacacgactgaagcgacttagcagcggcagcaaaagatggctgaaggggccttccctggaagtccaattgttaagacttcaccttccactgcagggggcatgggttcaatccctgggtaggggact

SEQ ID NO: 13784 - DNA, 201 bp, Bos taurus
ctgctgaggatgaaggactgagatctgaggctgttgagaaccaagaggaacactgaaggaggaagaggctgcccgagttcggggccgtaaagctggagccacctttgtctactctgaggtgttgccttcgacctgggcagaactgggtgcaggggacaggccctttggaagctgaggagtctgcagctttgagtctctggg

SEQ ID NO: 13785 - DNA, 201 bp, Bos taurus
aagcgagactggatgccagctaattaattggctggagtgggggccatccaggaccctaccttatcgggtcagttacactctatagccatccgtgcaaagactgcatctcacccaaggccagtttattgccaatgacttcagtttcagcaaagcaaaagaatgcacaaaaaaaccaacccaaattaaccacaccctcatgag

SEQ ID NO: 13786 - DNA, 201 bp, Bos taurus
tgcagccacttacgacaacacacacaggtaggtgcaaggtcagggccctgcgtcatcagagctcgcctcccaagagctcagggaatgaaagcctggccagcactcacagcccccgtgtttcagtgattccaaagcgcatggaacccggacaggctgggatggtccctagggtcctcaggtaccgaaggggccgcaccccat

SEQ ID NO: 13787 - DNA, 201 bp, Bos taurus
agtattgacctttaggcagtgagcagcaaggcctgagttcagtaatgtaaacctgcaccatttatttagccaggggtgatactcagaacatgtgggagagctgtggccacatgagtgaggggtgggcggctgatagctcagctcggagaggtaaggagccagcttctgttctgagtgcagcgttccctggggttctgagca

SEQ ID NO: 13788 - DNA, 201 bp, Bos taurus
ctggtttactggccccttggttcatgggatctcagctcccagaccagggatcaaacccacgccccctgcatcagacagattcttaaccactggacgaccaaagaaatgcctgcatggccctcattcttcatgtgtaaggcttagtttgtttttcattcagcctttaactctagttctccaaattgtagtcctcaggaagct

SEQ ID NO: 13789 - DNA, 201 bp, Bos taurus
tgtgagttactaaagggaggcctgggaagcctggcatgtccgtgtccatgctcacagttaagtcggagcaccataggatcaccctgagcagctgagtctccataggcctgtccccacaccacacatacaagcacgtgcacacacactgcaatgcacacacgctccaaagcacacatacacaccatggcatacacgtgtgag

SEQ ID NO: 13790 - DNA, 201 bp, Bos taurus
gtggctctgggggattacaccaagacggggaggtcacaggaggattctgggtaatgagtgttttactctttccaatcaggcattgttggtaagaagggaaggtgtacacacaccaggagggcagagtctatgtgtcatcagccctttgcctccactctcactgagcagcagttctttctgcctcctggctccacttccatc

SEQ ID NO: 13791 - DNA, 201 bp, Bos taurus
attcagttctcttcatctctgggtatagatatagctatatagaaacagggatttattttaagcaattgtctcatgtgattatgtggccaggaagtctgaaacccatggagcaggctgggagttcagggaagagctaacactgcaacctccaggctgagtcccgcagggccaccagctggaacgtaaggaagagtttctaag

SEQ ID NO: 13792 - DNA, 201 bp, Bos taurus
ttcccctccttccatcactgaacacaattcagctggctactaatgtgaaagcatgttgactgaaggctgaacacaagcctgggttttgcttggagggtgcggagcacacagggtaggactcagaaaacccagcgtgcttgttgggaaaggtcttcacctccattatgcacgcacatgacaaacaaatctctggtctctgca

SEQ ID NO: 13793 - DNA, 201 bp, Bos taurus
acactctcaggatatcccacctggactttaatccaggacgtatgggatttgaagttgtctcaaacatgcttttagggccaccgtcgtttgcagtctcatgtggtgatgtgaggaaagagcagcggctgtcaatgcagttggagctttgtcgcttgccggccactcacctccagctgcgtggtctgatggctagcaggttgg

SEQ ID NO: 13794 - DNA, 201 bp, Bos taurus
ctcacagctgctctgtgtccctccctggtcattcctgaagccgagagggctcagcgcaccagctctcccacgaggcgggaagcagccgccccttggcttcatggccatttccaggtgcagctccttctgtcctttatggcgagattcaccagggacgggcccgtcctcacctgctctgctctcttgcctctctggaaatcc

SEQ ID NO: 13795 - DNA, 201 bp, Bos taurus
cccaccaggctcctttgtccttgtaagggacaagaataccagagtgggttgccattttcttctccaggggatcttcctgacccagggatcaaaccctatgccttacatctcttgtactggtagggcctttctttaccactgcgtcacctaggaagcctaggatgtaagtgctacccacatttgggctaactgacttgggtg

SEQ ID NO: 13796 - DNA, 201 bp, Bos taurus
agcttaactagggaatcagggaaagagacacgcaagaggggccagttaaaaccacagctctccgtggtggtaagaaacagtcatcctgtatctgtagatgaatattctgtggagcaacatcaggagctaaaggctgagagaggaaggtataactgaattagtccagccatcctctagacaaataacaggaagaaaacaaac

SEQ ID NO: 13797 - DNA, 201 bp, Bos taurus
tcatactcagtgaatcactttaacttccacaaagtctgccttactttatggacaggatctcagggtacagattatagaattagaaaaaagtcagatttgtggcttccatgctcactacagagtttctctttcatctttaaacttacatctggacaataatccctatactcaatgatctaggtgttctctagtgaagatttt

SEQ ID NO: 13798 - DNA, 201 bp, Bos taurus
tattaccctcctattttatttctttcccatagtcttgatctccctttatatctgccgtgcgcttcactttactgtttttgcaatctatcatttcagctttaaaaaaaaaaagggggatatttcttattatctgatcttccctagatgtacttaactttgtgacactcgtatttctctgagtgacctttgtgatataactct

SEQ ID NO: 13799 - DNA, 201 bp, Bos taurus
tgaacataaaacatataataaacataatgaatgaaagcccaaataaaacagattagtgatgtaaaggatatgaggaagtaaataaagctgcagcctggcctttgccttgttgtttatttctgacatgcggattcaagcgttatgagaacacagagacggcagccttctctcaaagctggtgatgggctggccccttacagc

SEQ ID NO: 13800 - DNA, 201 bp, Bos taurus
ctgtacgctattcagataactttaattaaaccagcctccaagctcccatataaagtgatggcggctccaaagagaacggccagcatgttcgtgaacgactcagcctgagaggctgtcaacttcaagttagtgcctgttctgaaaaggagcagggccctatggtctacgcccctcatgtcctctgcccacttttgtctgtgg

SEQ ID NO: 13801 - DNA, 201 bp, Bos taurus
ttggccatgtttggagacattcttgtttggcccaatcagtgacagtcagtgagcaccactagtatctgtggggtaggagctagagatgctattaaacatcatacaataaacaggccacactacaatagggaactttcctgccccggatatcactagcaccaaaattgaggacacctggatttgggcctttagtgcctctgg

SEQ ID NO: 13802 - DNA, 201 bp, Bos taurus
agactctgaggccctcagcgtctctgatcaccctcctcttcacctacgtgtggcctgggtccaagcccgagggcaccgcctgcccttgtgtctgacctgcatcttcttcccaacagtctccacggcccctgccgtctctcaggcttccttatctggacgactgcactgctcctcaaactcaacccactccactcgatctgg

SEQ ID NO: 13803 - DNA, 201 bp, Bos taurus
cgaataaactccatgtgttactgaagcctttctgtggccccaacgtgaagccaaggggaaacagtctctgagtgtctctggggcatctggtcacaacatggggaccgaggaggccgcaggaagcaaggatgaaagactgagagcaatttcaaattccaagagaaatcctttggctaagaataatgtaccttccgtgtcttt

SEQ ID NO: 13804 - DNA, 201 bp, Bos taurus
cagcctcgaacggctcccagtctctgccaagacagctgggatgtcggcaggtcaatcaggaagcgagggagcccgccgcgacccccaggcccacatccccgagctctgtgcttactgccctcctgatggcaggcttctggcacactcagagctcacccagggcgtggggtgggctggggtgtggctggccagcccctgctt

SEQ ID NO: 13805 - DNA, 201 bp, Bos taurus
tgctgtatctctgagaactccccaaagacccccctcccaggccccaggggcaggggacagccctcatgccaccaattaatgctctcttgatggactaagacgctaaaggcaagtagcaaattgcatttaatgttctcgccaccagcagaaagagggcctaccaccgcaggcttgtggaaagttaccatagaacgtgccgtg

SEQ ID NO: 13806 - DNA, 201 bp, Bos taurus
gaatgggggaaggcggccagagaacaacttttgtctcctggcaaggatgcaaaattatctcacgggtgttagtgacggaaggacacagtgaaggaatcgcgttcctgaaattctgccacgtgggccaggacgggtggatgctctgggtgggtgcaagctggtcacctccacctgggggggtccctgtgcaggtgccctctt

SEQ ID NO: 13807 - DNA, 201 bp, Bos taurus
cgtggaccctcttttgctaaagcaccagctttgccacgtgcttttcaaagcctttaagacttctcagagtgctaccctgcccccttcctcaagattccgcggaggccgcaggaccccccgtgccggcccctcatcacacctgggccggcaggtgacccgccctgtctgggctctgacgaccccggggcgtccaccgccctt

SEQ ID NO: 13808 - DNA, 201 bp, Bos taurus
agtccatggggctgcaaagagtcggatacaactgagcagctgaactgaactgaactgaggatgcttgggacagcgacgtctgaggtcccactcactggacccagagttgagggcctccaaagagaggctcacagggcaggggcgccaccccagacacctgaaggaatgcaggaggcaggagaggtgggggagtcaggaacg

SEQ ID NO: 13809 - DNA, 201 bp, Bos taurus
gggccctatcccagtgacgggtgtcattacaaagagacaacagacatggatggaaggagaagggagcagaggaggatggacgctctacaagccaagggatgcgagggaagctggaggaggggccccccacacaccgtgcctcagagagcgtggccctgccaatgtctgggattttcatggttctggctccagaaccatgga

SEQ ID NO: 13810 - DNA, 201 bp, Bos taurus
ccaagacagaaagctgtttgcctcctgcagcaccagcctgccctttctgcacatatcctggtcactgtgtgcttgtggccccctccctgcagccccacagcgccagccatgcttcctaccatcctgggagtgtgtactgggagcgtgttcacaggccagggctatgagctccctcaaactactggaggactgggaaggtgg

SEQ ID NO: 13811 - DNA, 201 bp, Bos taurus
gagagagctccctgggggggcccgggccttgacttccaggccaataacctgcagccctccaaagtccagtgcgtctgagaggccttccctgaatctttaacgtgactggagaccccgcccttccctgtgtgtctaagcatgtatctgagccaagaccctggtgcgcgtgtcccactgggcctggcagcttgctgcgctcgg

SEQ ID NO: 13812 - DNA, 201 bp, Bos taurus
gctgccgtgacctccccctctgtccaccctggaggcaaggggatcatgagtggggtcatcctgatggaaggaccatctggaagctgagtggggccacagcagacacggggagaggcgtccaggagaggatggcaccggggtctctgttctaatctcgaggcaagaggcccctttctctgtctcatcccctgaggattcctg

SEQ ID NO: 13813 - DNA, 201 bp, Bos taurus
tgaacctgaggatgtggagagctcagaaaacagtaagagcgggtttcccctcccccacggaagtcacctcgggggccccgccctggcctgggagactgctgtctttgtattcttccctgaagcccacagctctccacatatgtttaatgactttctgtggccaaaatcacagcagcagcatgaacgtctctatttcttcat

SEQ ID NO: 13814 - DNA, 201 bp, Bos taurus
actggagtgggtagcctttcctttctccagtggatcttcccgaccaaggaatcgaactgaggtctcatgcattgcaggcggattctttaacaactgagctatgagggaagggccatcttcctgtgtgactgccctattctgcatccccgccaacaggcagtgatgccgtagaaataatttctcacggaaccagtggcagcc

SEQ ID NO: 13815 - DNA, 201 bp, Bos taurus
ctttggatgctgcttctcttgaagccaggaatagccctttgaacgttctgccaatttagacaaattctaacagctaaagaggccatagtcaaggtcattcagtcgtgtccaactctttgcgaccccatggactgtatagtccatggaattctccaggccagaatactgcagtgggtagcctttcccttctccaggggctct

SEQ ID NO: 13816 - DNA, 201 bp, Bos taurus
agctgagtcctgtcagaagctgcacaaataagagaataatagttacagtcgctcattgcctcatggctgaaaggctgcgcccctgctaaacacggcccctcgatctcatccggattgcagggttcagccgccttgtggtcgcacctgaagtgcagagagagggcagtgcagaggcaggggcctgcggctcttgacctcttg

SEQ ID NO: 13817 - DNA, 201 bp, Bos taurus
tccctttctaggaagcacccaagcttctgaagctgtgggcatccgggagcatgaagtttcctctcccagggaggctgagcatccactcagccctcttaaccggccaagcctcttcacccaagtgcaccctaggcgagcaagcccatgctaaagatggtgatacagtctcagctcggtggaaggcttgccctggtcacgtgc

SEQ ID NO: 13818 - DNA, 201 bp, Bos taurus
ggaaatggccggcgtctccataaatgagtgacttgatgagattcatcgtgaagattctgcttctaaaagggacgcatttgtgaaaattgctggaaacaacacaggcctgagagaatctagttgaagcctttaaaggcatgggtgcccgtggaccccctccccctggtgccagccccgcgaggtgaaggtccagagggaatg

SEQ ID NO: 13819 - DNA, 201 bp, Bos taurus
tttaatttattgattcaatttctcatttattacagatttataaacatttgctctttcttttgagtcaattttggtgctgtgtgtgtttctagagatacgtccattttatttaggttatctaatttgtcagcataaaatcgttcatagtattcttacatttttgtctaagccaggtcttagttgcagcatgtggctcttaat

SEQ ID NO: 13820 - DNA, 201 bp, Bos taurus
actacgaccaacttcaaatttaaacaaagaagtgcatacataaatggaaagttggcatgtaacagaattgccattgttcacatatatttttatgtacatacaaatataaaatagtctacaaaatattaggaataaataaatttgtaagccacttgatacaaggccaatatataaaatcagttaataatatttctatcgcta

SEQ ID NO: 13821 - DNA, 201 bp, Bos taurus
accagccagtcggggtcacagtcacggccacggctccggccacgaccctacggtcccaggggaggcctgtgggcctggggagggattcttcttttgcctggaggttcacaaagtggaggaaacacccctcagatgcaagtgccctttgctttcgccctcccgccggcccctatgccagggtggggtgggggctctgctgct

SEQ ID NO: 13822 - DNA, 201 bp, Bos taurus
acagtgaccgccaaaacgcctacaagcaacacaccctggaaaggctgtggagagaaggggaccctccactactggtgggaacgcaactgacacagccgctgcggagggcagcacggaggccccttaacaacctaagacagggcccatatgacccagcaccccgcttctgggcaagtatcgagaaaaccaaaattcaagaga

SEQ ID NO: 13823 - DNA, 201 bp, Bos taurus
aatctaagtataaagaaaataaatgacaccatcgcccttttattttttcctggcttgggaaagaagcgttaatccaccttccttgcaggaatctgactttcatcattatggccgcccagaaaggtctagccttatcctcatatgatgaggaaacctagtctacaagggataaaacagtaacgtgctagtgacctcagaaca

SEQ ID NO: 13824 - DNA, 201 bp, Bos taurus
aatattgtgaagcaatcaataaaaataaatattaaaacaaaacttgcaactttcatattgtgcatcactgatctgatctgatctgatctgataaaaggccaaaaagtggattagttcagttcagtcactcagtcgtgtccgactctttgcgaccccatgaatcacagcatgccaggcctccctgtccatcaccaactccag

SEQ ID NO: 13825 - DNA, 201 bp, Bos taurus
gtggccactatagactcagcccctctgtgctcacattccctgtcctcaaagaaacatgcatggttcactacagagaaccttctgaaggcacttctgtatactggaaactggcaaaggccaaatgcgaagagaagacacagaaaaggaaactggcttctggggtgctccacaaattgccaaagctctgaaatccttgctatt

SEQ ID NO: 13826 - DNA, 201 bp, Bos taurus
cccacaggttaatgtgggccaaaaactaggttttgtatggatgagcttcttctttcttgatataagccatgaaggaaaatattgggaataattctgctttccatcctcaagggccaatgggaattctaatatcagtaagcattttaatttttaatcagacatttgtattatggatccaaatagatggtgtattaaacattt

SEQ ID NO: 13827 - DNA, 201 bp, Bos taurus
ctcatgtcatttaagatgctattagctgaagacttctggaatgatttgatgaaacagctcagccatgtgacttacaatctgggtgttttccctccatgcaactatccacgggtcagcagcatctcaaggctgcatgtgcatggtggtagggaggctgatgacaggacctggaatcaacagcacctgggaaaacatgcttcc

SEQ ID NO: 13828 - DNA, 201 bp, Bos taurus
cgaccgcctctgtctctcaagccacagcatttctgaggttctgcctctctcatgtccagtccaagacaagctgcttccacctgccagggctcgagtgcaaagggaggccacgcttccctgaagagcaaataaaggagccagctgggaaggtgggggaaaggctcttgggatccctccgctggttctggaaactaccccagc

SEQ ID NO: 13829 - DNA, 201 bp, Bos taurus
agggcttatggatggtgcagcatctgtgtgaacagaagctcctctgtgtgactccagctattatccacgtggtaagcaatggagtgaaaattaaaacagtggaagaaggccatgttggtgtttgtgatctagtcttgcctcaggaggaaagccctctcatgctgatgtggcttctgtttgtagtcctccttctcagccacc

SEQ ID NO: 13830 - DNA, 201 bp, Bos taurus
ggagggactagctgtaggggaatctgggatttactctgatggcttgggccatgatcagcaaattttaattcaacttcctgttgatgggtggggctgtgtctcctgcctgtacttggtctgaggccaagctatggtaggggtaattgtggtaatggcaaagtcaagaagaaacaattagaaccagacatggaacaatgaaca

SEQ ID NO: 13831 - DNA, 201 bp, Bos taurus
gtacttagaacaatgtggtatatagcaagtcttcaatgaatatttgtcaagaagaagaacaatatttctatttatagttgtaggagtgagcttagcaataactgtgtgatcgatgaagatgtgtcacatttaaaaaatagcagccagtcttataaagcagcttctgtttattatggcaggaagactagggtgccaggaaga

SEQ ID NO: 13832 - DNA, 201 bp, Bos taurus
gaaaagaaaaaaggaattggcaatggcagcagaagcagggtcataagaacagaaatggtagaaactctgattgatggactgagccacaaactcagtagggccacagaggggagtatgctgagcagttaccagtgtgatccagttcctccctcagattactaaaattgctattgagacaagcgttgtcaatgttctggatca

SEQ ID NO: 13833 - DNA, 201 bp, Bos taurus
caagcctatagctgatattgtaagcagtcattagacagaggtgtgtttagaaaggccacagggagttgatctggcccttggcatctaggccccgggaatgtgcacaagagagtgaagagtgtagcccctctgcggggcgtagcaggcagggtgcccggggccctgcttctgtctgcccctgcgccctatcacagtggagta

SEQ ID NO: 13834 - DNA, 201 bp, Bos taurus
atgtggcggtgctatagcagctagctcagggagcattctggagcccagaagcagaacctccacagtgtctctccagcatccccgatgacaaaacttactgccagttggccaaggaatcatttatagggcccagctccactttcatggatcaggcaatggagaaattcagaactgagaggcaatacattgataattggcaca

SEQ ID NO: 13835 - DNA, 201 bp, Bos taurus
tagttaacaaattgtatacacatgggcaaaaaagctttggttttatggaacagacactaaactagttacagctgaactaagtaagcagctctgtccatcaatggtgaagtcacaaagcctgagccatttcaaggagagggccttactctgaagagctcattcctttgcttcctgagcaaacagggttaccacagaatacga

SEQ ID NO: 13836 - DNA, 201 bp, Bos taurus
taaaagtttttgaaaatcattcaaggttgaaaatttattggtatgaatctgtgttagttggggagtaatacattgtctattaacaacaaatcctgagtaacggtaaggtgtagaggtttgaatctttttaggggcaatgattaatccagagtcttttaagtattgttgagctatgtcaaacatttgttgagtttctaaaac

SEQ ID NO: 13837 - DNA, 201 bp, Bos taurus
taaaagtaagactcccaaaagtagagtataaaaagaaacaaagtatttttttttaatctggagtttatttaaaaaataagtttttttttgaaaggtaaaatatggtgtaaaaaataaaaggtaaaggggtaataaagaaccatgttaaggcaccatgaaggaaaaaagaaaaagaagagagtaaagaaagaaaaaaaaaag

SEQ ID NO: 13838 - DNA, 201 bp, Bos taurus
ctcacgtggccttttgagactgtgcacttggggacaggtgtagggaaagagagagagagaagcaagcatgttcctgtatctcttcctctccttatggtaacaccagtcctaaaggattagggccccatcctagtgacctcatataaccttaattacactcttgaaagacctatctctaaatatggtcacattggagattag

SEQ ID NO: 13839 - DNA, 201 bp, Bos taurus
tttgtcacttactttttcctaatttgctgtttttatttccttatatgtggtaggttagtcatattttctgacctttgagtagtggccttttatgggagagatcccctctggacacctgaagtatgtgatctaggggttattatatatgttggctgtgtgcatccttttgttttattgtgctgactactgtgggtagattgg

SEQ ID NO: 13840 - DNA, 201 bp, Bos taurus
cacagtttcattgagttacacaaggttgtgatccatattatcaacttggttaattttcattcattgtggctttctctgcctgtgagagattaaaactttccctccctaaggttggccatttcaggagatatttgcaagataaggtctttacttcctcaactcctctccctctctgttctataaaagaacttagtatccaga

SEQ ID NO: 13841 - DNA, 201 bp, Bos taurus
gggagttaattgcccagagtcctcccagggctcgggtgccgtccaggtggacggaggtgaggagcagctgtgctccgagggacttgggaaggccctcattgaccctttgtcctgcccctgagaggtttgccaagattttctgtagagctaagcctgggttcctgttggacgtgccaccaggagagtggggccttttcgtcc

SEQ ID NO: 13842 - DNA, 201 bp, Bos taurus
tgttcctaaaaggaatgataagggtctatgatgagggctttatcccatggccttttgtaacctgaaccacttccttaaaggccccatctgcttcagttcatttcaattcagtcactcagttgtgtccgactctttgtgaccccatgaatcgcagcacgccaggcctccctgtccatcaccaactcctggagttcactcaga

SEQ ID NO: 13843 - DNA, 201 bp, Bos taurus
gtgacaggccatctcaggccaaagaaggagcatctaggggcaacggtgggctgtgctgtaacattctcccactgcctcacaatcaccccacatggaaggcgtttgcctgagtccccctgaggggccttttccacccatcggtcacccaccaggctgtggccagccctgggtcactgagcagtatccacctggtactgcttg

SEQ ID NO: 13844 - DNA, 201 bp, Bos taurus
accagctacaatcagggagcacgcctgcaggaagcagacgctgcaggcagagggtgtgggggcagccaggctcacagggtgagggccccccactggggccgcggggcaggagcccacctggaacagatgatttcatctgatgactgcacgctgggcagctcccccaggtggttgtctgagaggttcagcttccggaggttg

SEQ ID NO: 13845 - DNA, 201 bp, Bos taurus
gagcacaccgagcttgattctggccaaccctcatccctgtgcccactccccccagttggctccttaggctccgtggatgcctttcccccagcagggctgatgaacggccagctagatttcacccccagctccgtctgaaattcctaccactgtacaccaaacagaacaccccaggtcccaggggcccgtgaggctggctga

SEQ ID NO: 13846 - DNA, 201 bp, Bos taurus
cccctgcaccacccctgcctctaggaggccccacccagcccggcttcctgccgccttgtgtgcctggaggggggcgcgagggccgggaggcctcttctttaggtctcggttctcgcattcccagagtgagtggctttcatgtcacctaggcttgtggggaggaagcaggtgtgacccagggagagatctgagcccatgatc

SEQ ID NO: 13847 - DNA, 201 bp, Bos taurus
ttttttggttctttttttttcatattctgctatactatatgttaataacatcagaaaaacagtatttgtggaaagagtcaggtgggaacattggaaaatatcacaccttgaaaaaaagagtacaaaaatagaaggcaggacctccagcctctagctggcatctgcagtccttggttcctgggacttacactcaagaagaag

SEQ ID NO: 13848 - DNA, 201 bp, Bos taurus
ggggaaaccaaattagaaaattattgcagacaattcagtgagacaaatactatatatagcctgagggagcacttggccaaggcccttaatcctgacttgggtatgtggtaggctccccaagactggaggtttcctccttgaaggttgagagtgggaggggaaaggctgagtatgattttagggagaatgggccaagaaaag

SEQ ID NO: 13849 - DNA, 201 bp, Bos taurus
acttaactagtttatatgcactgagaagccaaaaagtccgtgtgattccccttactgtgatacttgatttactgtgataatttggaactgagtccagagtatctccaaggtctgcctgtgagggatttgtatactgagagtgtaactgtattctgctggtgagtctgtcattaaggcagtctaaaatgttatccttaaaac

SEQ ID NO: 13850 - DNA, 201 bp, Bos taurus
tctttacatataataagtccattcagggtgtttttttttttccccttgggtaagtttttataattgtgtctctttaggagcttgttcattttatctatgttatctaattggttggcatgtgttgttcatagtattcctttataatcttttgtatttctataaggtgagtggtaatattccatcattcatacgtgagtcttt

SEQ ID NO: 13851 - DNA, 201 bp, Bos taurus
tggtgcgcttggaggcagaaggctgctcctcccgctcaggtcctacagcagtcaaggccatgcacagagtcctttcctgctgagttttccgtggcctttcttgtccctgtgttttaagttcagatgacactgaggagcctgttcacacccaaagcagtgcaggcaggagagtcagagctgtggggtgaggcctgggttcta

SEQ ID NO: 13852 - DNA, 201 bp, Bos taurus
cgacctttggaagactgttatctagtaaggcctccctttactgcttccctgctcaaaggcatccctggctcaccagcccctctgttcctctcttgcacaccgcccaggcctgcctgtgagcccccaactctccaagccaggagtcagcgtgcaggcactttctttaccatctgagctaccagggctcctaaagtgaaagtg

SEQ ID NO: 13853 - DNA, 201 bp, Bos taurus
caagtgaccagacactgtaaagggacagacatcttgggatggctgtctcccagtcatgctccattcccttaaagataaccattgaatgtatatatggattgtatatatgccctttgattattttgcctgcttgtgacacttatgtaaacagatgcacttggaatgcattcttgtgtcttgcttgttttactaaacatttat

SEQ ID NO: 13854 - DNA, 201 bp, Bos taurus
tctaggcattcttggcccctgtcctctaaatgccaggtcaattgttatggtgaccacaaactttctcccttcccctgaccatgtttccaaaatttcccacagtgaacaactgacgtgctaggccctatacataattccctatagatgtcaataataatttattatttttcccattcaataaacaatacatatccttttatc

SEQ ID NO: 13855 - DNA, 201 bp, Bos taurus
cgcccggctcctccttatcctgctctttccgtgctgtctggcccctcccccatcttggtctctgggctcaaagcttgatcgtcctttctgaatagttctcagactactgcccggcggggcctcaggaccgtcccctgctggctcccttggcaggcctggcctttccagagctgccggccttggtctgccccaccctgctct

SEQ ID NO: 13856 - DNA, 201 bp, Bos taurus
ctccgctcctgtggactcgcccatcaccccagcgcgcaggccggtcagcaaaaccgcaggcggtaacaggtgctgtgtgccttggccaggtctcttggacggtgggtcttcaacatgggcagcagcgcccccaactgggagaaatctgatacaggacgaggggtggtggcaagtgatggttaattttgtttcaactcgatt

SEQ ID NO: 13857 - DNA, 201 bp, Bos taurus
agttctcgggcccctgcaccatcttcttttcccaagccctccagggggtttggatgcacgctcagggtcttgaattctgtccttcagcctgcaaaatgacgctggcctactgagcgcttgtctcagtctgctttccagcatccggtctgctgttccccttgttctcttccctgtctcccaggcggtacccctggggttccc

SEQ ID NO: 13858 - DNA, 201 bp, Bos taurus
ggccagaggtcacgtccaaggtctgacccctgcagaaaggcagctctggatgtcttcagcatcctctgggttcctgtggcctgccttcagtcctgggtctcagtcctcactgagaagaccagaagccttgggtggacggctggacaccccttctgacagctcccagacgttttgttccccagcagaatccccatcacccaa

SEQ ID NO: 13859 - DNA, 201 bp, Bos taurus
aatcgcacagcatatatggcagctaaacaagctgtagagggtgcggacagacttcaaacgcccctgctatcgctgcccccagatcctagctcttacccccgagaagaaagagaaggctttgtgatgggcctgttttaaaagcccagaatacctggaaaggatggttaacaatcatgggcagctgctcttcaagctactgca

SEQ ID NO: 13860 - DNA, 201 bp, Bos taurus
gttctcaataaattcactctcttctgagatactgtgtgtctggagactctttttcaacccacacatggaccacaaaatttttgtggccggtatggggactcgtgggggtccaccccaactctctcatttccttttccttgaaccctctgcaaacaggcaagtggctgtggaagcaactgaggcactctggccagggctact

SEQ ID NO: 13861 - DNA, 201 bp, Bos taurus
gaagccacaggtggggtgggatgtggacaggccctctggaacatgcctcctgcagcctggagctggatagtattttcctggacgtccagttcctggcgtccggcccatcactttgcttggaataggtacatagtttaccagtgagaagaatgtacatcgttgttgaaaaagatgtgcttgcttgtttccaatgcccccaca

SEQ ID NO: 13862 - DNA, 201 bp, Bos taurus
aaaacccataatcgaagcctgaggagaaggacattcccctaaattgacatttagataaaacagcatcttctttattgggagcatcagggggtgcctggttgggagtcagaagaaatgttatcctggagacattttgcagggatttgaagagctgaaggtaagctccatggggtccagtaggagggagggggccccagaaag

SEQ ID NO: 13863 - DNA, 201 bp, Bos taurus
tataattgaaagccatattggtgattaaaaggattttatatatcagttttctgggtcaccaactaattattttcaatggccggtaataaaacacagcaccgtagctggctagactctgcaaactgtcagatgttaaattgtgtagaaaggactacagcagattacgtgaagttggctggcctttcccttgggaggtgatgt

SEQ ID NO: 13864 - DNA, 201 bp, Bos taurus
tccctgagttccccgtggtacctggagaggaatctcaagcccccagccgcaactcgagacaaaccacgagattcccccatcaatgtgagatgaggcccttttctcctgcgtcgcctagagagctgagttccctctcaaaacttgagaggatgcttgactcccttcatgcaactcaagggggcccagagatccctgtcacaa

SEQ ID NO: 13865 - DNA, 201 bp, Bos taurus
ggggtgagagcaggcacgtgagagacaaggaggccagaaaacacttcaaaaagctgcgccacaaatactgagcctgcgtgcagcaaccgctgaaggccacgtgcctagaacccgctccgcagcaagagaagccaaagcgatgaaggcgtgtgctgcaatgaagagtcactcctgcttatggcaactggagaaagtctgtgg

SEQ ID NO: 13866 - DNA, 201 bp, Bos taurus
cttgaaaacattatgctaagtgaaggaagccagacacaaaaggccacatcccgtgttacccatttccacgaaatgtccagaagaggcaaatccatagagatggaaagcaggttagtgatggccaagggagagggggaaaggaaagtgaggagtgactgtctgtctaatgggctcagggttgactttggaataatggaaata

SEQ ID NO: 13867 - DNA, 201 bp, Bos taurus
cgggacttatttagaatctgcttctataatctctctgaagagatcacacacacacacacacacaaaacccacaaaaacacctcttcttgctctaatctgcacactgttcatactctctcccttcctgacacagtttatttagccaccccaactgcagtgatttaatttcacatatatgtgaaccaaaattgctttgtttct

SEQ ID NO: 13868 - DNA, 201 bp, Bos taurus
catgcataacttcagctgatccgcacagataccatcctgtcaacagggggtgggacaaatatactggttgtcctaggcctgttttccctgtgtaattactggtaacactcctttcactctaaaagagagctccagtttgaatgacaaattatatgatctagttaactctaggtaactgcaacctaggtgggcctttcttta

SEQ ID NO: 13869 - DNA, 201 bp, Bos taurus
gacagggagaaatgaagaagtccactatctcgtgaggaaagaaagatgagggcacagtcctaatggaagaaagacagaggaatccatctgaaaactacaggttttcaagcagacttcttcttcttcaaaagctgcagtaatggaataaccaatatatgcaagtgacagaaatctgagatgctaatgcctgggtagctgaaa

SEQ ID NO: 13870 - DNA, 201 bp, Bos taurus
ttccatattatgactaaaaatttaatttacatctgttcctcagtagaagaaaagttcagtacatggacttaatcatgtacaaattaaaaaccacctctgattgaaaggattatgggtcattaaaggcagaaaggataccaaaattaaaagtgtttacggagaggaaaaaatggttacggtggcagagttcagcctatgcct

SEQ ID NO: 13871 - DNA, 201 bp, Bos taurus
ggtgctcagtcacgcaggctgctcatgtcattagaggagctaagttcctaggtgttaaagattagtacactcatttcaaattgcttagtccaagggagtcgaagggagacctgcattcacagtctaatcatgtataaacatccaaatgtgaattagcactcgattaagtacttcctttaatttttctagagttaaggaggc

SEQ ID NO: 13872 - DNA, 201 bp, Bos taurus
tgatggatggagaagcctggtgtgctgcagtccatggagtcgcaaagagtcggacacaactgagtgactgaactaaactgaactgatacatgttttgatactgatacatgatactgaagacttgggaatagacatgtgcatctaaggagagagaatctggtcacagaggacgtatgaattactagaacttagagatccaca

SEQ ID NO: 13873 - DNA, 201 bp, Bos taurus
tcaatatttcaatcatgtgtctctctctgacatgttttttcctgtccacatgaaacctgagtaaattgcaacgagctttgaatagaactctcagaaactcgtctaccaacttctgcctcctggagcaagatcaggagacagaccaccaccttcattctactaccaaccattattaatcatcctctttgcaaaaggcatgga

SEQ ID NO: 13874 - DNA, 201 bp, Bos taurus
taaaatataattgctgtagatttgccaaagaagttccacaagctttattcaacagcttttgcatcatgttatatgcaggatactgagttaattttaaatcattattacctactctcactgtaacaaaatgggaaatgttgcaaattatgtaaatattttttttcttgaatttacaataactttttttttcacttcagactc

SEQ ID NO: 13875 - DNA, 201 bp, Bos taurus
ggggggggaggtgggagtgatggtgaaaagggtagattaaaatgatatgtgtcaaatattagtagccttttaagaagccatcgcccatggcccttaacccagtacatatggcaagtcaggtgcagagcaaacgaaattaagatgatagtgtgttgacaggagcaagcagattccagttttcatctccgcagacaacaggag

SEQ ID NO: 13876 - DNA, 201 bp, Bos taurus
ccatctccctcagggctgctaggtaccaatgcagccatcaccttgtccatgggtcctatggtccaaagactgacaagttcctgagatagtctcctgcatggcagcatctatttaattgaagttgactgttgataagaagtaaaaggcattgtttaaaactttttttttttttgccttttgaggaaacagccttgacattag

SEQ ID NO: 13877 - DNA, 201 bp, Bos taurus
tcctccctttgatgtcttccctccctccttcaccttctctgctccctggaggcttatcttcctagacctgggtagcttcccttggcctgtctctttcagcagcatttggctccctctccactgtgtcccacttccagtgggctgcgtacctcaaccaaaggccacagctcctgttgggtggccctttcgcccaatgagagc

SEQ ID NO: 13878 - DNA, 201 bp, Bos taurus
cctccaagtctcttttacataactaaagattagataggatgtgaaacaaatatttcaatacattggatgaaagagtattgagtaaacaggaggaaggcccctcttgaatgtgagagattttcctctgctttcctcctctgggttttccttgtgtttcaatcagtttgagaatagagggggaggcaccagccagggcacgtt

SEQ ID NO: 13879 - DNA, 201 bp, Bos taurus
gggggaaggcagaccttgtgtgattgcattgggactcaagggcaaacctcactccctggctgtggccatgtgccaggcctctgtgcttgcaaagacagaacagccttttgaagtgctgcagatttaaaatagggaatcagttaacatctccctaagcagtcagtagtgggaacaaggagggtgtttgatcatggggagaat

SEQ ID NO: 13880 - DNA, 201 bp, Bos taurus
cttgtcttccatcccaaggtggaacttgcccttcacttcatggtagtgggaggcaggtgaggaatgaggattcgtagcctcggaagacttgtgacccacaaaagtgtgcaacacttagtgaaggcataaaatcaggtctttccattctcagagtcaacatccctcagccttagcttttttaaattttaaatgaatttatgg

SEQ ID NO: 13881 - DNA, 201 bp, Bos taurus
tctctttcaagtgattaaggcctccttcaccttcatcactcttacctttgaggagttccactataaaagttaaactcccatgtaaaaattaatttgcatcacattatccacactgtattcaggccaggctgtcctgagctgaacatgttaggaagaagctggaagatttattcattttatctgcaaaattctgaaaagagg

SEQ ID NO: 13882 - DNA, 201 bp, Bos taurus
caaaatatctctcccagtggcccattagctgccttctttcttaaaatagcatacccttcagatacataccttcagggaatttatgcacctggccaaccacgttaagatatttttacactggtatagtctctgccaacagatattatttgttttccaaggatgccctcagatggactcttttaccaaatccaggccatgaat

SEQ ID NO: 13883 - DNA, 201 bp, Bos taurus
ttattatgaggattgcaacataacttcgtgaaatggacatcgctttcctctatgggtgaaatgccatatggttgaaaaaatattaagaactaatgtcatgctttgcccatcaactatgataaccatctcaaaatagtggtaactttttcattgtcgattgtgaatttggcaaggtaacttgatcttttgttcttccactgg

SEQ ID NO: 13884 - DNA, 201 bp, Bos taurus
tccacacccaatgcaagaccttcatgaagccctactgtgccttactgctttgacaggctccagtcaaatactcctgggcctttctagaggtctaaactttgtagaggtgtgtttcttccccagatcagcatctggtactctgtcagaatgccaggctctggccaattctgctttgactggtgtctctcctaacttttgaaa

SEQ ID NO: 13885 - DNA, 201 bp, Bos taurus
cctttgctgcttgttcattcattcattaggggaaccagtccattgatttcaaggttcaggggtccattgtagtgaaggtcccttagagaattctgaaataaatgctggtttggattggataagcccaacctatgttttttatggataatttttaattattaaattaataattagtacctgcacacaggcttggagaaggaa

SEQ ID NO: 13886 - DNA, 201 bp, Bos taurus
tcaaaatgcacagatgtaagtgttaatctcatccaaaaacattcttacagaaacatccagaataatatttgaccacataggtgggcacgatggcccagtcagattgacacacgaaattaaccatcataggtggtattctccaaacccacctcctttccagaacatcagaatgtggccaaggttgggaacagggcccactga

SEQ ID NO: 13887 - DNA, 201 bp, Bos taurus
tatgttagactacatggcaagtgatttcagattgcagatgtcattaagtcactaatcagctggcctgaaatatggacattatcctagattatccaagaggggccaaaaaatttacaagagtgagtccctaagaataggagaaggacttggaaaacacatcaagaaaagatggcagagtgagaaaaacccttcccaatatcg

SEQ ID NO: 13888 - DNA, 201 bp, Bos taurus
aaaaaaaatttatttttgcttaatttcactgtacaatcatgaaatcattgagactggctttatgttaaattcatgaccaattttagcaaaagagttaagcggacaagctctggaatcagatatcctggcttcacagttagcctctgctgttttcaagctttgtcaaattaacatttcaccatttggttttgtcataataaa

SEQ ID NO: 13889 - DNA, 201 bp, Bos taurus
actgcaaagtggaaaaagaggtcttgtcttcagatgtcccttcatttctctgacggttgaatccttgatgctgggacaaagtgagcaaaggaagagagccgcgaggccggaaaacctctccccagctgtgcttctccgaggcctcttcccttctgtaaacagcgccagatggagaataaggagactcttaaaaaggaacaa

SEQ ID NO: 13890 - DNA, 201 bp, Bos taurus
gaaaccagcccatgcacaactaaaaaggcacactgccattccaaaatcaaggtccccccgagcagctgaggacgggcgcgagtcaagggctgggccacaacgtgcgtcactttggggttgctgcctgcaaatctgggtccactgaccatcagatcagatcagatcagatcagtcactcagtcgtgtccgactctttgagac

SEQ ID NO: 13891 - DNA, 201 bp, Bos taurus
ctccatcttcagcagacctgaacccaacctgaaatctagggtcctagcagggctcagccaagctcaagttcatctaatgatccagcaatatactaagcaatgcagaaaagactagaattatgatatgcataatttctattatctttccttatatttactagtcgctcagttgtgtgtgactctttgcgaccccatggactt

SEQ ID NO: 13892 - DNA, 201 bp, Bos taurus
taaatgtcagctccaagagcctgaacaggggacatctaactgtcctctttagaatagggagaccaggaaccaggattcaagctcatctctctcatccaaataccatgctattaggctcacagactaagcttctctgactcctctaagcaggttgcagctctcctgggtcactcaagatgccatccaacaccacaggataag

SEQ ID NO: 13893 - DNA, 201 bp, Bos taurus
gtaggaacctggggcatctcagtataggcacccaaaagttgttttaaaacaagaggctactgagtgttttcaaggtgtggtttcaggtatatggtcatattgctgggaatgattgctgaagaatttcatgctggcactaaaacatacaaatgtcacttttcaaataacatttcctacttgctcatcaacatttcgcttggg

SEQ ID NO: 13894 - DNA, 201 bp, Bos taurus
ttcatcagcaaggattacactgttacttctgcagaaagaaaaagataaaaacaaaaagatcatcagttcacaacaaaaaacaaaacagtacatgcacaaacagcagaggcatcaaggcctcacgatattcctcagcaagtcagggattttgagcctcaaatgtctctcctctcctctgcaatcgtctcctgcgtcagaaga

SEQ ID NO: 13895 - DNA, 201 bp, Bos taurus
cagacagacaggaagccaagacagcagagacagaagcgggctctggggcccagggcgcactgcagacacaaggcaggcgggcccagagacagccgcacgctccgactccccaggcaggaccaccccaggggagacttactgttttttcagctgcctctggcctcttctctttgggctcccactctcagacccgctacttgc

SEQ ID NO: 13896 - DNA, 201 bp, Bos taurus
agcagggcgttaggggtatttgttatggggaagaaggggcaactagtaagactaaaacgtagtgatgctgagacctccagggccctgatcctgttggaacgtgcccacaacttgccaacacagcagccaagacagtctaggacagaagacaaccgagattccctctttgatttccggtagtgctgagttaaggggtcaatt

SEQ ID NO: 13897 - DNA, 201 bp, Bos taurus
tgtccaaggtcagagtcggaatggaacatggagcttttgacttcagtccaaaaggcggccgttggcctgccaccttccatgctatgttggccccaggctaagaagggcagggctcagtgtccttcagagccggcgtccctgcccatcagaatgtgtcagggccctcccctccagcttctgaaacatcatttatcattcttg

SEQ ID NO: 13898 - DNA, 201 bp, Bos taurus
cagcaatacaaatgtgcccgagtggtccagacgcagcagagtctaagcctgaccagctggcagagggattaatgactaggaatgtagtctgggtctggccgtgtaagtcaacgctcctagcctgcgatgctggatggttttgtcagttgcttgttactgtcagtactcctgagaatgcacggggccatctgcccagaataa

SEQ ID NO: 13899 - DNA, 201 bp, Bos taurus
ctttgggccgtggtgatgggattgaactctctggagggatttccgagcacctgtttcatggccgggagggacgggaagcagacccacgccagcacggcctctccagggcagaaaggcaccagggtctgccaccaagtgctttttgagtttccctttctggagccaggttcaaaatcatttgggcctttttggaaataagtg

SEQ ID NO: 13900 - DNA, 201 bp, Bos taurus
caaacctttatactcctgcagggaagatgcacaacctatctttactttcaccaagggaataacaccttagatttgcagtttgcaaagcaccttaacgttctttatatttaatccatgcaacacttccgggagggaggaggcagtttggcatgactatttaaaaatttttttttattaggaaaggtagagccataggagaaa

SEQ ID NO: 13901 - DNA, 201 bp, Bos taurus
agtccgccaccgcagccctcaatcttgtgtcacttctcttagccactacccttttaaagaaaaacaacagggaaaaaaaaggactaaaagttttaaaaactggccacatctgtctgtgtctgtctaaaactgccttctgtgtctgtccagtttgttctgaatatggtcacgtggccacacctagctgcaagggaagcatga

SEQ ID NO: 13902 - DNA, 201 bp, Bos taurus
agtcctcaaaacgtcctcagactcgctcacaccttctcacggatttatccctcaatggaccacttctgctttcctctgcatcccaggctgcaccatttcccgtaccttggccttcatcccctttgcctcctccactttcttgctctatccccactgtggcccacaccttcaacgtcttctctcctgcctctgcccctttag

SEQ ID NO: 13903 - DNA, 201 bp, Bos taurus
ccgcaaagagtcggacacgactgagcgacttcactttcactttcagagccaggaaggaaaagttatttgatggcacagttgagaggcaaaaatgtgtcttggatatgtaggctcccacctgggggagtgctagagttttaggagcccaagcatttgttcaccagctgcctgctttgtgaactggttatgtgacagtcacca

SEQ ID NO: 13904 - DNA, 201 bp, Bos taurus
ctgtcttgtttgtactggcaccaagcagcaaatcacctctgcagcgcagcccagcaactccagacccagctgggctctgaacggctgaagctgccaggcccgcccgggatgcccagatgagaacaggcattgtttggtaccagctgctgtggggccccccgtccacacaggctgtaccatggcactcaatggggtgggtcc

SEQ ID NO: 13905 - DNA, 201 bp, Bos taurus
aaaagaaaatttacctatttttaaaaatatatatatactatatttctcaacccaaattgcatcgtttaatgggaaacctcgagcaaactggtgtttcttacgcactctgttctagatcaaaagcatacaatgaaacccaggctgcggctgaaaccaggctccatcctgccgaagttcttttgaataagagatcatatataa

SEQ ID NO: 13906 - DNA, 201 bp, Bos taurus
gcacagaagaagctcacacccctggtacactatcctgaattttgtgactgctaccaaggtacacctctatatcacgttgctctgtggccaggggggctttctgctcatggatcccagaggacataagcaatggagaaagagttcttaaatagtcaccacccgcagggcacagcaagaggcaacagacccagaggcctggtc

SEQ ID NO: 13907 - DNA, 201 bp, Bos taurus
tagctaaaaatggggtcttcagacccagtgaaaagtgatccccttgtccttttcaattgcccagtggctttcagagatagaggttaaatgtggccagagcctaaaacatttcttttgaataacttgtgcagtggtaaattttgtcctttaagtctggcttttttgggaaacagcctgaagtcatttagaacaaatctggta

SEQ ID NO: 13908 - DNA, 201 bp, Bos taurus
gtgctcaaggttgtgatgctatttgatgtccattcaccagtgccattcttcaagttggctttattcatatctcaaataagggatggtaggaagctaatgagccagtggccccagagaagtagctcttcattatacatgattaagatgggaaaatgtacatcataaacaagatgcgttctgttttttcatttgcttttaccc

SEQ ID NO: 13909 - DNA, 201 bp, Bos taurus
acactaaaaacaaatacacaagcaacagctgtcctgggtgaaatattccccaagtacttggactgggagaagaggaaaaattattgttgatacaaactgagtgatctgagttaggaagaagtcccctgcagaaggaaatggcatcccactccaatattcgtgccaggaaaatcccatggacagagaagtctggtgggctac

SEQ ID NO: 13910 - DNA, 201 bp, Bos taurus
taaccagttatttccctgcctctgtcccagatactcacatcctccatgtactagggcatcggccatcagccctgcaccagtcagtattttacaaggagcttgagcagagctactggtccattacctgcttcccgtcatgcttctctgatgacagtttatcaactagaagaagataagcagagcagtttaaactgactctcc

SEQ ID NO: 13911 - DNA, 201 bp, Bos taurus
ctcttggacactactccaggaggagactcctgaagtacttctgcgtggttttctttatacttatgcatgtctcggtccatcagctgacaggaacagcgttatgcatgcctttttgtaacggttttccaaggccacactaaaagaagggaagaaaagggggcgtttaaaaaaaagtgagattgtatctacaagtaaaataaa

SEQ ID NO: 13912 - DNA, 201 bp, Bos taurus
tactttggccacctgatgtgaagagtcaacttattggataagaccctgatgctgggaaagactgaaggcagggggataaggggatgacagaggataaagtagttggattgcatcaaactcaagggccattagtttgagcaaaccccaggagacagtgaaggacagggaagcctggtgtgctgcagtccatgggactgcaaa

SEQ ID NO: 13913 - DNA, 201 bp, Bos taurus
cataatatctaatttcatttgcatgattacttgtaaaattgaacttcttctcacacatttattgaccatttggtttccatcttccactgactgtggatccgtatgcttcatcctttctacttcttgggcaaccatcataaaagtctgtttccaataatccctgtatctgtttactttagaagaggataatccattgaaagc

SEQ ID NO: 13914 - DNA, 201 bp, Bos taurus
cgctgattctgtcggtcccacagcatgactcagccatgactcagtggcagacaccgagctgggcacagacatcacagaagttgataagccaccatcttcctgcatcaggtttcgggtctaaccagaacactgtggctgaagaggacacagctcaatctgctatgcctgagacatcaccatcatctcgacgagattaaaaag

SEQ ID NO: 13915 - DNA, 201 bp, Bos taurus
ctttttaacaactgagtaatattccattgtgcataggtaccacagctttcttatccattcgtctgtcactggacatctaggtagcttccatggcctagcccctggtctttgccacagcacacagactttctccagttgcagcgcacacagcctcctcttgtcgggatccacgggccctggagcatgagggctcagtggttg

SEQ ID NO: 13916 - DNA, 201 bp, Bos taurus
ataggaaatcacattcttcaagtagaaacatctctaaccaaaataaggaaaggcaagagctctagtaatcagccttttttgtcttttatcaccactggggagctgtgccaggcagcacgtggaatcttccccagccagtgagtgaacccacgcaccctgctctgggagcacagtcaaacactggaccaccagggaagtcca

SEQ ID NO: 13917 - DNA, 201 bp, Bos taurus
ctgaagactcaggctattcaggtacttagctctgggttatctgctttcagagaaacatcgacagatgagttgtctgactgtccagttgatactcctgagcgctgcctgaaaccaggcgccccaggcagctccccaggcgattgacttcgggtggggttctggccacccgaacaaggctggcttctttcttgttttacttaa

SEQ ID NO: 13918 - DNA, 201 bp, Bos taurus
gctcagtcgcttcagtcgtgtctgactctttgccatcttatagaccgtgccctgccaggctctgtcagtggggtactggggcctcagtccagttcctgccaggtgacctgtggaagtgactttttccctgctgggtttccagatccagggctgctcaggagccttcccactggacgctaggcctcatcgcaaggtccttga

SEQ ID NO: 13919 - DNA, 201 bp, Bos taurus
ttatgatagaatgttttgcccatgttttcttggagtcttaggatgtcatcttctattttggtctttaagccattttgtttctttttgcatatgaggtgttttgatttcgtgtgttagtacacgtagccgtccagctttcccaacaccaccgccattgcccatgttttcttggagtcttaggatgtcatgtcttttattttg

SEQ ID NO: 13920 - DNA, 201 bp, Bos taurus
gttcttttccttctcagccagagctccagtccctcagcctgggacctcagggggccctgggcttctgtgccctgcaaggccacggttgtgcaagcgctcttgggtctcttgttacccaggagccggcaacagaccaaaataaagttgagagggggaccggcggggagggccgagcgagcctctgtagggagtctgaccagg

SEQ ID NO: 13921 - DNA, 201 bp, Bos taurus
tgggaaacattttgggtccaaaatcattcaggaagcaaaggtatgttcgccaagatctggctgtgccaaaaatgaagatggccaggctgccctatgatttgtgcgtgtgcatgttaagtaacttcatttgtgttcatctgtttgcaaccctatggactgtagtccaccaggcccctcttccatgggatactccaggtagaa

SEQ ID NO: 13922 - DNA, 201 bp, Bos taurus
tgacttacaaaatgctgagactgtgttgtaatgctctttctcttttcttaaaaataaggattgaatttaatggaataacactgatgtgaacgatattacactatccaatttgtttgtggtggtttcctactcccattctgcaaaccaagttggagggaaaaaagtagtttggtcacacaggcttttgtaaacaagaatctc

SEQ ID NO: 13923 - DNA, 201 bp, Bos taurus
aacccaggccccctgcattgggagcacagagtcttaacaactggaccactgggaagtcccaataaagcaattattatcataatttctctacactaggttatgtgaagggggaaggcctgtgtcctcagcctgagaacaatgtaatggcgtctggcacttggaaggaatttactatatatttttgaatgaatgattattaaa

SEQ ID NO: 13924 - DNA, 201 bp, Bos taurus
aaagtaaatggcatcatttaattattactagaactttcctggtggcacagatagtaaagaatctgcctgcaatgtgggagacctggatttgatccctggattgagaacagtccctgcagaaaggaatgacaattctctcccagtgttcttgcctggagagaattcccatggacagaggagtctggcaggtcacagtccatg

SEQ ID NO: 13925 - DNA, 201 bp, Bos taurus
tctcctacattgtgaacagattctttatcatctgagccaccagcgaagtccaatgtatctgaacttagatgcagcatttaacctctggcttcaggtggccgctccccctgcaaacccagtacttagagtggaaaggagctttgtcctgaccagcccttgctcatgcccctgaactctgcagaggccctcctcagggagaag

SEQ ID NO: 13926 - DNA, 201 bp, Bos taurus
gctttgagcctcttgtgactatcagcccacgactattctggttagaatatgggcttccaccaaaatgtcttcctagagaaatgcaaactggacccagttacggccttgggttctttgtatctccaaagatggtttgaatttttccctgggctcagaatggcttcttggtttcacacaaaacttgatttgtttatcagtctc

SEQ ID NO: 13927 - DNA, 201 bp, Bos taurus
gtctgatggctttgcaaagggcctttgaagggtgctaatggatgttcaaggcaaaagggcaacatcccaaactattgtctttgtaaattgggtctagcacagggcccaatacacagtaggtactcactcaatatggaataaataaacgaatgaaccaaaaagcacctccaagccactgctagagactttagcaagaaaaac

SEQ ID NO: 13928 - DNA, 201 bp, Bos taurus
caagggacccagcaagcccacggaagatgtgtggccctttatcccacccatatcctagatcgcaggcttgttacagctctcctggaaaaagataaaatattccagcagtgatgggtcaggggggcaggagaggggcccacaccactgcaagaatttgatgagcctctgataccagcagcataaataaggcctttaataaat

SEQ ID NO: 13929 - DNA, 201 bp, Bos taurus
ccctctgctgggtgcctctagaggcgtggattccatctgcatcggatgcaaagacagaacaggagaacaggcaactccaactccctgggagtgaacacagtcccaggggccagcgcctccctaggtacagacagaccaaggcctctggctgctgcgtggttgtgggagagggagggaaggttgaggaggaagctgggccaa

SEQ ID NO: 13930 - DNA, 201 bp, Bos taurus
tacgtctcttttattataaaaattctagggccttacctatttgaggccaaggtttaggaagagagtcaagatcaattggcagtattttcaaatacatggatgtgagaggagtggaggcccctatgccaaatgtttgctttccttgcatctaaacagaaaacaaattttcatacattcctcatgctattgtattagtaggac

SEQ ID NO: 13931 - DNA, 201 bp, Bos taurus
ggcagggatgagacattgctccctctctggaactccctcctgagagcacagtgacagatggagggacctcagggatcttccaggccaacctcttaaatctgaagtgctggacggggacacccagaactgaaagtggagcagaaagacctcctgggtaccagggcattggagggcctgtccctcatcactgatagtgagctg

SEQ ID NO: 13932 - DNA, 201 bp, Bos taurus
ggagagcgtgacacccaagtcccacctgtttgggggatgccacagctatttgtcttctgtcctggaaacaagcctcccttaggaacatcccagaaacattcagcggctcaccctccccagagcccctgtccggttaagaagcttgagcccactgggtggctgaacgctcctctgttgcagtcccacagccctcagttgccc

SEQ ID NO: 13933 - DNA, 201 bp, Bos taurus
aagtttgtctccgttgcttctgatccactgaacctctccaggccagccctgatcacgtagtttcagtttcccagacgcttactgagtgcctgctggggacaggaaggggttccctggggcctgtcacaaatgagtccctcgggacagactcatgggtgcagcagggaagcttgtgccccgggtgctgggagccccttgggt

SEQ ID NO: 13934 - DNA, 201 bp, Bos taurus
agctgaagtggccactaactcatggtgcggtactaagctagataacccggtcagtttccctatgccggcaggtgcatgtaaccctctattctttctgacgtcttcctaaacgggaaggggccacctagggacgggcacacatgcccaagggggcgcccctggaaagaaaagcccggggcggggcctcaaagggcagagcat

SEQ ID NO: 13935 - DNA, 201 bp, Bos taurus
aagtatcaaattctgggagggcattctatcgtccctcctctaaaagcatttggaataacttggtgccaagtacaggcaggttgtcgaagaggaaagatgcacacctgtaagtggtgagcttaggcacaagtgggacagtggttccaagtcacattctctctactgcgaaacccccttctctctcactctccccgaagtctc

SEQ ID NO: 13936 - DNA, 201 bp, Bos taurus
gaccaggaaggcaggagctaggcagccagtgcacagccaagggagctggtccaggcaccatggccattggaagcacacactggatgctattgcaggccccgcagaaggaaatgatctgatctgtgtctgtttgtcacctgctccttaggtgtgtgtccaagcccaggtgtgtcaggttaattattatttacctgccctttt

SEQ ID NO: 13937 - DNA, 201 bp, Bos taurus
catgacatccgcgtcattgtcctcaggcttggactctgtgaccaacaagagctacttcctccacttcctgcagctgctctccacctgcatggccttcttcctggtgaccagggagagcacttggagtgtgctcataagtaactggtccatgtttgtctggtactcctgcttcgccatgaccctccttaccctcatagctga

SEQ ID NO: 13938 - DNA, 201 bp, Bos taurus
catctgcttcacactgggggccgtggccatgctgctgaagctggtcaaattcgagaacagactacacaccttcttccctcgtttcctgttggggcagaccgtgctctctgtcctcctttatgccagtgccctgatcctctggccactctaccagttcaatcaggagttcggcgggcagccccagcggtccagtgatgtgag

SEQ ID NO: 13939 - DNA, 201 bp, Bos taurus
tcaggcaactgcagtggctggacactggccactagtctggactactccttagtcaccgtaagaagcctgtgtcggtgtaggaacctacccatagatgcaggcaccaggcagtcaggccctcctctgccctctggggattgccgaggctcttagaagaccttagcggtgtggtcctttcacacttagaataaagcccaaggc

SEQ ID NO: 13940 - DNA, 201 bp, Bos taurus
tccgcacgaagcgagcctggaacggcgtctcaaatatgttcttcttgtgggaattattgtccatgttaccagggaaaatctggtggaagaggaggtgtcaggaggccctcagacccagccctcctccccctcagaccccagatctgactcgcagggcacccctggagtggggaaggcaggatagctggacacacactcacc

SEQ ID NO: 13941 - DNA, 201 bp, Bos taurus
gtctaagctatttgtctttctagaatttagattctagagtctatttgtctttttagaatctagaacattgattaatgccctggggactagacagcttgtgtgatgacccttggctgggaaagctttggtctaccaagtccagaccccatcaaggtctcaccagcaaggtaacttgcagaaaagcctcttcattttcccact

SEQ ID NO: 13942 - DNA, 201 bp, Bos taurus
tcctctctccagccagagcaatagtcatacaccatgtgctcactgagtcactacctgtagtttcatgggacatctgtgtaggaatagcattctaaatctggattcccaggtggctcagtgataaagaatctgcctgccaatgcaggaaacgtacgagatgcaggttcaatccctgggttggaaagtatcccccagggtagg

SEQ ID NO: 13943 - DNA, 201 bp, Bos taurus
tcgctcacaaaatacagcatgtgattattcttacgtcagcacctctgtaaaagctgcaccagcgttatgagcacctccggggcgtctgtccctgaaataacaaggccttcactaccaggcttcagaaggcagaaggcaaccatctctcttgagctgtttctaccaaaaacacatggtaaagggagtcgagtgctcatttgg

SEQ ID NO: 13944 - DNA, 201 bp, Bos taurus
tcggcctagataaatccccaaaacagaactctgcggaaccagatttgagggagcagtgcaaatactcccgcgggaagggagtgcagaggccaggcgaaacttgttatttgacctcaaaactaggcttagtagacccttgcgtgttaattctacctcggaggtactggtggcccctgaaaatttcacgctgcagttaccatg

SEQ ID NO: 13945 - DNA, 201 bp, Bos taurus
catgcaaactcttagctgtggcctgtgggatctagttccctgaccaaggatcaaacctaggctccctgctctggaagtgtgtagtcttacccactgtaccatagggaaggccccatgtacatgtatttttaaccaaagctaatgtccttctcagctcctttttaaagttttacttactaagaaagttttaatttgctaaga

SEQ ID NO: 13946 - DNA, 201 bp, Bos taurus
caggcctcagctcccctccactctcttgggaccattcagaaacagaaacacaggtagccagatatgccaactaccacccttcataagaactgaaactcaagcagaatatcttgtccttttgggcccaaacagcccctccttcctcactgaaaccacacaaaacgtgtgtcctttattcttcctccagtttttgagacagaa

SEQ ID NO: 13947 - DNA, 201 bp, Bos taurus
agagccactcatcctgcctacccagagaagttccccgcattctagttctattccatcgggagacaggacctcttcagagggccttccagcccactcaggacccccagcttgagtcctgaaccactgacctcaccccatcctgctctcagccctcccagtcctggccccaaacacaccccttggtttagggcctggtctgtc

SEQ ID NO: 13948 - DNA, 201 bp, Bos taurus
tagctgctgccacatggcaggcgggatccttaattcccagacccgtgacccttgctgtggaagcagagagtcttaactgctggatggccaaggaagtcccgaaaaggtgtgtttttacactgtgtaacatacactggaaaatggcagaacctaaaccatagaatatgagggccactgggggcaataagaggattctggagt

SEQ ID NO: 13949 - DNA, 201 bp, Bos taurus
agggtcctctgccccttcagaggaggaggcctgttggcagggatcttggaaaggaccccaggcaagagcagtgtaccccaagatttccctgccggtggaagggtagtctgcagggcctctgcctgttgtcttcagaagggaggtgctggcagggggagaggcccgtattgtattggaatttgagggtccctagcctgcatc

SEQ ID NO: 13950 - DNA, 201 bp, Bos taurus
acggccccttgcgctgatcccagccctccaggccttcctcccttggcctggagatggtctgcccacgaggtaaattcaggcagggaccaagtgcccaggccgtgagctgtgtgccagctgggatggccctggcccttgagatctaaacagaatctcctctcactcctgtcacaggaagtgggacccctggcatcttcctca

SEQ ID NO: 13951 - DNA, 201 bp, Bos taurus
ctcccatggccccagacatgctgtgggcttgcagatgggagcatcttattagccaggctactgcctgcgtagatgcagccaagggtcgggtgcaaagcatctgccctgcatcaaccggccccattcagcccacctgggttctgcttcgtcccatctgaagctgagtgtgctggtgagggagaacactttctatttaaagga

SEQ ID NO: 13952 - DNA, 201 bp, Bos taurus
cagtttatggggtcacaaagagtccaacatgactgactgagcacacacctagctacagatagaagcatggacgtcactgactaaagatgttttgacaccattgatacggcattcccaggcctgggcaatgctagaactgtgggtaggtgttgctggccacgtgccaggtggaattctgtgtccagtgctggacgacccttt

SEQ ID NO: 13953 - DNA, 201 bp, Bos taurus
acttgattgcgcttccactgccagctccaggagcaaggaggaggtcccagaggcccaacaaaacctgggaaagagcaggagcctgccaaagggccatcatgagccaccagctgagtctagcaccgatagggctcataggtcttcagctctatttttcaaagtgaaggtacccctagtgctcccagcaattgcccatcacaa

SEQ ID NO: 13954 - DNA, 201 bp, Bos taurus
cttggggagggtgagggttgagggtggcgggcgctgaaggggccccgtgccctcacttaacagaggatgtagagccctaggggcagggccttacagaaacaagttctcgtctcccctttctgacacaagagctgcctcttgggttcagatgtcaagcaaggccacctcctgaccacagtgctatgagccatactggaatcc

SEQ ID NO: 13955 - DNA, 201 bp, Bos taurus
aaaaaagaatatacttcattaggctctagctgccatagatagtggttcctctaatgagtctgtacaaaagtcaattgaaaaccttctggaaaagattcaataggccattaagaacatgcatggctcacaggaaaaggtcaaaatatcaacattaaagaagtgggttccaaccctcacgcgtgactttgagagattcaaggc

SEQ ID NO: 13956 - DNA, 201 bp, Bos taurus
atgcgcttgtacacttgagtcagtgtgtgactgtcaaaacctagacaagcacactatctgcgaaaacaaatattctgcctgagcaaaagtttgaaagtaccgtatttttcactctcttctcccctttttcatgacaaaaatctttactcaaaagcccctgctttcttcaccatgctaatgaatgtacagaggcatgtagag

SEQ ID NO: 13957 - DNA, 201 bp, Bos taurus
ccacatctgtgctgctctgtcatctactggcactcaggcctgttagtgagagcttggctcctggaggaaggcagctggacagagtgcaaacagggaaaggcggtcacaggcctgatgcgtgatgttaaggtgctggggtagcctggccaggtgggatgtgtttcctccatcactgtttgcccgactctgtccttcaaggct

SEQ ID NO: 13958 - DNA, 201 bp, Bos taurus
cctgtgatggtgggggtagaggcttcacctgagtaaggcgggccaggtgggctgggccatttgggctcctcacgtggccaaagcatcccagtgttctgtttactgagcaccaactgcatgctaggcaaagtgcgaggtgtttagtatcccgattttacagatgaggaaattgagactcggagaataagtgaggtgtccaag

SEQ ID NO: 13959 - DNA, 201 bp, Bos taurus
cctgccccggcggcgagcagcgaggccagcagagaggcttggaggcggtagacgaatcctgcccttagaggcacacagtggcaccggaaggggagcccgatggcctccaggacactaggagtgtggcttcttcatctggtgctggttgtgcacggtgttcagtttgtgaaaattcacctactagtgcatttatggtatatg

SEQ ID NO: 13960 - DNA, 201 bp, Bos taurus
cgaggatcagttcaggacctcatagacactaaggccagagagcggagaggctgaagaatgtgggttctctggacagctgctgagccaactgggcctccagctgtctcctagcgtggtctacagagatggctgcaggtgtgtggcttgagagacagggtcaatgtcccaccacacataaaactagaaagaaaagaaaaatga

SEQ ID NO: 13961 - DNA, 201 bp, Bos taurus
tgtttttgttagtctgttgaacaagtggattttgggggcagatggtaccttgctgaaagctgagtgctcttctggcaaggccattcaggtcaaaagaatcatatgcacttctttagaagtgactcacatgcttctcagttgaattcaggatctttccttctgtgggatagtgttcacataaattccctttcctggacagtg

SEQ ID NO: 13962 - DNA, 201 bp, Bos taurus
ggctgcctgactagtcctgcctgcaccaaaatgcatggctaccagttggctttaggatggcatacttcactagaagctgccccaggccccttataacccatagtgcgctttttatgtgactcattaaacacaccctacatcacagctgggctttactggcctcggggctcttagttttccagacatctaatccagggaaca

SEQ ID NO: 13963 - DNA, 201 bp, Bos taurus
caccccaggtcagggtggtcacaggaggaattcacagctgtacgactgcatttcggaatcgattcaacattaagaatgaccaaggccttttgccaacacaatgcgtcatgtttattgggtgattcacaggtcaggaaaacacacgaaggggaaagaccggaggccatcagtcatgtcaggaaacaaactatttagcaattc

SEQ ID NO: 13964 - DNA, 201 bp, Bos taurus
atgcatgatacctatatcactgattttcagaaaagtcaacagtacgctcatcagtaaagtcacgaggaacacagcaatctttctttgaccactcaggggcatttttggctctttcagtatcagagtcaatattataaacatgccctgatatttgtcctgggaaagtaaaaatacatcttgttcgagataattacatactat

SEQ ID NO: 13965 - DNA, 201 bp, Bos taurus
tgttaaaatttaagtccacctcagcccctcaatattccagaaccctgcaatggcttctctttccactcaacataaatgccaaagtctttgcagcaaggcctcacaggaacagtctctcatcctccctgaccatccctctctccgttgctcattctgctccaaccagtctcctgccctggtactcagacaggttcctgcccc

SEQ ID NO: 13966 - DNA, 201 bp, Bos taurus
atctcggccacccccatgcagtgcattgtaaggctaaaaacttcaaaaaccggcccgtctcctctgttttccattctgcttttcctctctccccactgatgcgtgggggaacgacctcacctgatttttatgtagaaaattgagtccatctggcaatagctccctcccgccccctccccccaacttgaatgtggtcctggg

SEQ ID NO: 13967 - DNA, 201 bp, Bos taurus
aagttctgaggcagcagtccttagactgagtggccatagctgtccactccgccgacaagctgccctgacttagaaatacctgttgctgcaagcacctgacgtcaacaggtagagtggcctcagcaacatggacgcccctttcctggacacaccttttctggaggcctagactctttgcctctctgcctttaggtttgaaaa

SEQ ID NO: 13968 - DNA, 201 bp, Bos taurus
cttgcctgtgtcttctcttgtctactttaaccatcatcgccattgttctgcattcatgatttcatggttgaaccattgcaataatggttctcagtgtctgttggtcgctggtccttttatctctcccacgcttctgctcccagagttgggccctggccacttggaggggcacaggccacacctggttcgagtcaattaaat

SEQ ID NO: 13969 - DNA, 201 bp, Bos taurus
aattcaccagcaatggcgccttgaggatacgtcaaagataccatttccatttccagtgttcagcaggtgcaattgtcaatcaaagatgctccctgagtcctgggaaaccttggcatcacctctctgctactgggtgtcatgagagcttacagttattgaaaaaactaattacaaatagtttatttcactgactgaatcgca

SEQ ID NO: 13970 - DNA, 201 bp, Bos taurus
ggagtgacttttttcccccagatattttggttttcttaacatttgaaatggatgagaaaaaaattaaaactgatgacttttaattaatgaagcagttgttgtgaaatacattttctccatttaagtttgctaggtgtgtcaggattttatacagataatctaaatacttgattcatgagtagaacaattgtttcacctaaa

SEQ ID NO: 13971 - DNA, 201 bp, Bos taurus
tcattttcaaaacaaaaacaaaaatctattcttctgatgacatgtatgattacaggtctatgcaagatacattgctctacattcccaatgactaggaaaaaaaaacctcaagtcagtttttagtttgcagatggtcaaaggattttgtattccatcaggagttcaaatcttctggatcttttcaccaacaactactggatt

SEQ ID NO: 13972 - DNA, 201 bp, Bos taurus
acatattataaaatttaccaaagtgaccatggtgaggtggacagttcagtggctttagggctgtgtttcacagctggactcagtctggcctctcaaacacagactgaaatcctcagctcagcgtctgccctaagttaatatcagagaccccacaccgattataaaagtcagaccttggaaaaattgtctggtgattctccc

SEQ ID NO: 13973 - DNA, 201 bp, Bos taurus
aaataattaatatatataacacaagaggtgttatattaacatatgatcttcttagggtgtcaaaatctgcctggtatctacttctcctccagcaaacatgaggaggagcccaataatgtcaaaagtgaatactgtcattatgttgtaggatgtctgccaagctgaacattggataaaaacacctcggtgttttttttttta

SEQ ID NO: 13974 - DNA, 201 bp, Bos taurus
aaacccagttgcattcagtccggaccatccaaaagaaacatcccagggaaacagtgtgaatggttagtgttggaagctgctgaaggggaggcctctttgtcgcctgcttgcctgttttcttattacgtcgaggcaagaaaagggaaagtccagaaagcacaggctcccgttttagatgctggaggcccagctttgaaaagt

SEQ ID NO: 13975 - DNA, 201 bp, Bos taurus
cttcagctcaacttcctttcctattggagatggacgaaaagctggattgggaaggggaacaacactaggactttggctccaggactgtcttcctcattcacacctcatcttgcatctcccaggccttccagtggcttcctttggctgagcaagcagaaggctctcccctcaaaaaagccatgtggtggctgcctgaaccat

SEQ ID NO: 13976 - DNA, 201 bp, Bos taurus
actcatctggatgatcctgaatatacttacattgcagagcccctgagactatgtccacaggggtctctgatctccccagtggtggggcatggcccaggaggacagttttctgccagaagccaggaaggagcacatgacagtgcatctacagtgatcatctttcactgtatactttacggaactccatcttttttaaaagat

SEQ ID NO: 13977 - DNA, 201 bp, Bos taurus
ggatcttgtgaagagcttatgagatgggccatgctgctcatgctcacagatagagtttggaaaccacacttctgtccacttgaaatgctcctgtttcttttccccaggtatacccacctgaaaggcccaccctggggtactgcactgcaggtgcaggggtttctgcaggttgaccaaacacctcaatttgtgttgggtttt

SEQ ID NO: 13978 - DNA, 201 bp, Bos taurus
catccctgccttgggtggggctgggggagaggaaatggccaggtccagcatatggaatatgtatgccttgagtcccagtctagacatctacacagacaggggcagggtgaggagggaagggccagctggggaagcagatggacttggttttctttttctagttttggctgcagtgggtcttcattgctgtgcatgggcttt

SEQ ID NO: 13979 - DNA, 201 bp, Bos taurus
gtacagtcctttgtagctggcaaagctctcatttgagaatatatatggcttgtccaacatcacacagctcttctgccataaagcctggcacaggcctctcggggaggaagccaaccaggacaaaaatgtcagcatttcatcaccatcatcagtgtgatgagagagtccttggggaggctgagagaggaggccaagcaacct

SEQ ID NO: 13980 - DNA, 201 bp, Bos taurus
cctgacttttctgcctgcagcagggagtgggctgggagcaagctgcaggtgcaggggcttcagtgctgtcagtgggaagccaccaagggggtgggcaggatgcagatggtccctgccactagggcagaatgaaggtcaaggatgaggctagctgggcattgacgtagcagtggttcctctttcctctcctctctttttcta

SEQ ID NO: 13981 - DNA, 201 bp, Bos taurus
acccttggttaggacaccaggactctgctggttgggcccctaaggtgaaaacaagtgggctcctgtaacctcctgggaaggtgtaaagtagtgtagagtcgatctcctctccccacatttgtcccagggaagacctcctcttttccctttggttctatgtgatattaactgtttttatggctgtcatgataatgttgaaca

SEQ ID NO: 13982 - DNA, 201 bp, Bos taurus
cacacacacacacacagcacatattaaggtcttaaaacggatggtacgtgtttccagattgtgattttcaattgctgccagactgaaaaggcagagaaccgtaatgatcaggtctggattctttcttgggttagcttttgtaattcttgtcataccacactgatttcaaggacaagaaaaaccaagaggcaagaggttaga

SEQ ID NO: 13983 - DNA, 201 bp, Bos taurus
tattgtctagaatgactactaatcaaacatgtatgcaatttcttaaaaaaaaaaaaaacaaaatctaccctggtcctctcaacaggctatgggataggaaccaccagtcacaccaacccaacctgaccctcaagtctaccgagaagcatcaactccttctctctccctcttgtctgtttcccatccagttaccaatgacgg

SEQ ID NO: 13984 - DNA, 201 bp, Bos taurus
gtgtctaaattcacggcaagagaaatagcaaccattttgaagatgagggttgatggttgggggtatcactgaccatattctcctcttctttttctttgccgtcctcattttccttggatgtctgatagaagtcatcataggtgcgaaagtccaaaaacaagatggttggggggagaagaatccccatgataacctaggtat

SEQ ID NO: 13985 - DNA, 201 bp, Bos taurus
agcaggttcaaagaggttcactggccagcctagtgtcacacagcagagccagggacccagtccctcagtggatggtcctctcagctgcccccaaggctccgggcccctcctcctcctttcctgtcctgacctctcaaccttttctctccctcgctcacccctccctccctagggaggcagctgcctgggccagcctgtgga

SEQ ID NO: 13986 - DNA, 201 bp, Bos taurus
gcggggatgggttggtgcctcccgtcatggacaccactgacctggggcattgtgacaggcaccgtgctcagtaggtatgataacttggaggctgagaaaccggccagggaggcatggagctggggtttggtgtcccccttccccagcatcccaggcaccccctggagctccactggtggctccaaggctcctgaggagaag

SEQ ID NO: 13987 - DNA, 201 bp, Bos taurus
ttacaattcaacatttgcaattattaacttaattcaagtctttggtattaaatttttattataaagcattcggcgttcaaaaaggtaaaaagaataatgtgataaacacctgtatacccacaacctacttaacttaagatggaaagtattactgtatcaattatctgtttccatgccagcatgtagtggtataaaagaata

SEQ ID NO: 13988 - DNA, 201 bp, Bos taurus
cctatggaggacagacggggaggctcagaactccctttcagccctcctctcttccctcctgctgggtctttggtgtctgatcggggctctgggatggggcgtcagctcccgagagtggactggccagaagtcgccatttcctttgcctgctcgctcaaggtcaggccttaatccacgtgggctctccatcctggtggccac

SEQ ID NO: 13989 - DNA, 201 bp, Bos taurus
aggcggagggtttgctctgttcatacagtggggactggtcagaagggctgggtaggctgtccctgtgtccctgaaggggacccacagcacggccccctgacccagtgtctgccgccacctccctttgcacaaaagcattagcatcttgatatacaagctgagactgatttgaaaataatccagcaacaggcctggataaaa

SEQ ID NO: 13990 - DNA, 201 bp, Bos taurus
acacgacatgactttgacactaacaagcactttgagatgccctgcgtctgagcaccaagaagtcagtgtgatgccaggagtaaaggccacgcctgggacatagaagcagagaagagcttgaggttgggaccaaccccagtgctccgactcatgctgcctttagagcgagctgggcagggaggccgaagaaacctgtggaca

SEQ ID NO: 13991 - DNA, 201 bp, Bos taurus
gagctgtgtgagcctgaagccaggcctgggcccttaacccgctgacttgacattcacagttgcagctaagcagccctggcagtggactcggcatgaagacgacttgggatggcctcttgtctcctgtgtccatggtagtgttggtgttaatcactcaagttgtgtccaactctttgtgaccccacggactgtagcccactg

SEQ ID NO: 13992 - DNA, 201 bp, Bos taurus
tgaagtccttccgtgtggctactgggtggtctggtacagtgttgccttgtctgtgtggtccaaaggttgtagctcacttgtgttccatccacagagggccgggagggggtggattggtgccctgcatagtctaaaggcagagatgtggcagtgtttctgcccatctcctccaccttagccacacagccccctcctgctgca

SEQ ID NO: 13993 - DNA, 201 bp, Bos taurus
cttccccagacttctataccccctgggcactaagctctgggccagtgactacctcataacagtccttccacagaagactgagttgatccaaatctccttataggtgaggagactgaggcctataaagtttaaggatctttttcatgattgcatagcacctgatccttgatcacaggtggtgggcatccaggctgacaaagg

SEQ ID NO: 13994 - DNA, 201 bp, Bos taurus
ttatgggtgggagtggaggcaggggagggcagaggcctgtccaaaggccgaatcccccacccctcaaccataagggggcaagagtttttataggcagaggaaggcagctacatacagaaacagcatactaatctctggcagtcatcttgaaatggtcatgcagtagtctgaccagtgtcatcttgactgttttaggtacag

SEQ ID NO: 13995 - DNA, 201 bp, Bos taurus
aaacttatgaccatatgcaaaaatgtctcagtgccaatatgtacacaagtacctacaaatctgtaatgcacagccctgtgaacacagccattgagggcagcgtgttgaatgctgcaggcctgcgtgctgggacagaatgccagacacgggacagagctgcttcccacaaagcctcatgggaacccataatcccaaattata

SEQ ID NO: 13996 - DNA, 201 bp, Bos taurus
ggttttcttcatagactgtcttcaaggtgtgcaatttttacagcaaatatttgataatgttaagcttgagttgtagcatttcatatagtggccagtaaacgtaaaatcttaagtctgacaaagcagagcagagccaccaagggatttcaggtaacacacaagccctcagacgctggactccacacccaggcctgccttctg

SEQ ID NO: 13997 - DNA, 201 bp, Bos taurus
gttccatgaagaaaagtagcccaaatgaatcatagttttgctttcttaacttttctagaaagttgccatcaactttgaccaaggagacccaaacagtcaaatgtgagaagagacatcttggaagtgagcttcatatttcagtttccaacagcttaagccacacatggaggggaggtcctaatgtgatttatagaggcacag

SEQ ID NO: 13998 - DNA, 201 bp, Bos taurus
tgtcctgccctgataaacccactctgggtggggggtgagggactaaatcacatcttcctactccccagggtaggcagaggctgagtaggcccaccatgccatcactgcttgttacatgtgctgcagaagctgcatcttatattaagctgtgtctcaggatggccctggggctaaggaaacccgccacgcacgtgtcatgtc

SEQ ID NO: 13999 - DNA, 201 bp, Bos taurus
ggagtgagtggaaacatcaagagggtaggtagacgcagacgtccagagttgcagggagatgtctgaacagaggcaggactgtggccttctctgcatcacacagatgctgcatttaggggagtgtgtggatggagatggagacaaggggcagccccagttgagccctgcaccccaggaccttcgtccctgagagctggagaa

SEQ ID NO: 14000 - DNA, 201 bp, Bos taurus
aattgatgacacagtagaaattagagggatcatgtcccttaataatctttagtagatgaaggggggtatcctacaaaggaagttaatgggaaagacattgctaatcggtgagggtacagaagctaaagggttggtgatggaaagatgacaaaattatccacagaccactaaataggcagcaaaggcacaagataagactgg

SEQ ID NO: 14001 - DNA, 201 bp, Bos taurus
tggcctggagtctgagaccccagcagaggctgtggttgggcatgtgggctctggattgactggtttgtatatgtttgtacgcttgagaacaggttctttactgtctctaggaattgggcctctgttgtttagtcaccaagtcatgtcctactcttttgcaaccccatacactgtgtagctccaccaggctcctctgtccat

SEQ ID NO: 14002 - DNA, 201 bp, Bos taurus
accacactgactgcagctgatgcacttagactgacaaaaagacagacatgggtaagtaacacagagatcagcacactcagaatatcctgcagagaggtcaacaaactcttccaagagatgtgagcttcctggttgcaaaaagcgacaccagcaaatgcacaggtgcgggtggcaatgtttggatggcagaaggtcacagta

SEQ ID NO: 14003 - DNA, 201 bp, Bos taurus
agcaggctgcagacacctgacacacacaagggcccgtgtgcagagctggggatacacacgccaggacagacgggtccctgcccctggagctcccagcccccacctgggaggtggccacagacaagaacgcagagaaacagaataattataagtggaagtaaggctgtgaacaagaagcacaggggtgagtagaacgaggct

SEQ ID NO: 14004 - DNA, 201 bp, Bos taurus
gctgcctgggctggtgcccctgagggtgggagagtgggccgcgatgggcaaggggctgagagctagcatgacttgatttcagcctgtgcgaccctggacatggccgtcgcgtctcagaacgtctctttcctcacctgacagtgactataacttatacacagctgtttctgaggctcctcccctgggcaggagccaagggtg

SEQ ID NO: 14005 - DNA, 201 bp, Bos taurus
acttgttcagaaagatattagttacttgtttactcctggcaggtagactacaatataaatttagattcctcaaccttcagctattactgctcctttcctttgcataacagtcacaaagaaaaactgctgccttctcagctgctgggttaaagcagaggccacttttcagatccacccttacttggtcatatagtacctgca

SEQ ID NO: 14006 - DNA, 201 bp, Bos taurus
gcctaaggccatggggctgggccagcagggcccctgggaggctaaggctctggcatgactccaggcaaaagtagcaaagctcagcagaaatatcccgacaaggatgcaggtcagtggcctgggaggagctggcaataaggggtctgcaaaggcaagggctgccagccagagaacaaaagggtcttggagagaaggcccagg

SEQ ID NO: 14007 - DNA, 201 bp, Bos taurus
ttgggctctcatttttaactgtacttgtcttctatcttccttcaaatgaaggtgaaaagatctgtctctgcacttcagtacttgtgtctctgactgtcttccttctcgttattgaagagatcataccctcatcttccaaagtcatacctctgattggagagtacctggtgttcacgatgatttttgtgacactgtctatca

SEQ ID NO: 14008 - DNA, 201 bp, Bos taurus
aaaaaaaaaaacacaaagattgtgccttgtgccaggctttggagacacaagcaggatcccatgtggatgatccctagacctcagggacccaagcgtactgagtgtaatccaatccctcgccacctaagccaatcagggcagagcatagccccagccacagtgattggttcagaagagagtacttgaccttaagtattataa

SEQ ID NO: 14009 - DNA, 201 bp, Bos taurus
tgttttaatagcaaaatttcttgattttgttggctatatagtgtgtacatttacaacagagcaatagttataagatcaagtgcaacagttacaagtaaagagtaactaacatgccctatatcattacagggatttattcagtggaactcataaatgacagtttatatgactggcatgttaaactgcagaagtaagtgcttt

SEQ ID NO: 14010 - DNA, 201 bp, Bos taurus
caaacgggcatctgtacaagtctgttagaatgagtaacaccatctgctccatcacatagatccagacatccagtggcctgaggaggagcgtacttgtcccaccgcccaccccactgcagcccagtgcagtgacattgaggagggtaggggtacagggacactgtgtcacagtcactctggcctccaggctcttccatgtca

SEQ ID NO: 14011 - DNA, 201 bp, Bos taurus
gaaccctcgctcgcctgccacgcgggccctgccaccgagccacgaggctagcccgcgggccccggggtagaaaaggggggccttgacggctcatcctcggcgttgtccccagagtggatgcgcgacgtgatcaatctcgctgcatttattaattcccccgtctagacagaagagaaggccgggcggcggctccttatctga

SEQ ID NO: 14012 - DNA, 201 bp, Bos taurus
cttgtagccagggaaaatgagaaacattagacaagtctcagtatgggaagccaataaggacagaggtagcacaaatatgaaaagaggccaagatgaccacgtacatccctatgaaatgactccagaatgagcaaagtccaagagatgtttcaaaagtggagtccagactgacatcgagtagaggccttaccttccggtgac

SEQ ID NO: 14013 - DNA, 201 bp, Bos taurus
aggacatcattttactcaaacggtcacagaagctttccccatccttctacatagatttttcttctgctagtttaaaatcattttactgcaatgtttaataggaaactgatgtttcatctaagaatttcaaaactgcctgaattaaggtatgaaagggcttatcttcagttagacaaaaggttctttctagtcttcaagaat

SEQ ID NO: 14014 - DNA, 201 bp, Bos taurus
cagtatctttcaagaatttagtgtttatactcattttagtctagtaatatagacaaactgggttccaatcttgattcagtccttactggttctgtgactttgggtaatgtactctgatgtactttcttcatctgaaaaatggagataataattcccaaggttgttgtgaggattaaatgagttaatatatgtaaggcactt

SEQ ID NO: 14015 - DNA, 201 bp, Bos taurus
gtacttcagagtattggagtgaatattctgaggcaaattaagtatgctctttcatctagaccagcctgagtcaggaaccatccttatttggaagggcctatgaagtggctgattgagagcaattggtgagacgctgttagaagaaccttactgtattcttctccactgttgtcaactgtcaaatgaagaaagcgagactgt

SEQ ID NO: 14016 - DNA, 201 bp, Bos taurus
gttgataagtgttatatatatatataagaaatttatttgagacattgcagcaaaaataattatggtgttgtcaataggctaggttacctcactaaaattcgtagaaattcaaattaaacattaagaaatcaataaatcatctattgcattgctctaaaatgtaaaaacaaaaaacaaaaccaacttagctgttggttaaac

SEQ ID NO: 14017 - DNA, 201 bp, Bos taurus
gtctgtggcaggaggacagccaagccagttctggagtttgtgtctgccttctgccaaatactttgtctcctttcttcctcctcatatttctctctgtctcgcctttgtgttagttttgcacagcattattagcagtgctgtgcaccagggaacgctgtaatagggccagagctcatccttctccttcgtctggatagatac

SEQ ID NO: 14018 - DNA, 201 bp, Bos taurus
aggggccaagagcccccactccggcctgcaggcccctctgcctcagctcttggcggcttcaggcgtgctgggccacagagaatccactggccaatttcccgctgttggcatctgttcacaagcctcagggacatctggttcaccagtcttggagaagattgagacatcgtgggagccggcctgcaaggcctcaccctccgc

SEQ ID NO: 14019 - DNA, 201 bp, Bos taurus
acccttgtccacccccaacacatacacacacacgcgtgcgtgcactccagccaagggcacagagcagggggaggcggcaggactccaaaggccctggggttgggtatctaaggacagattcagggagcacccactcccactcagacagccttctggggttggaaggtcatcagtgaaggtctagagacctagaggtaaggc

SEQ ID NO: 14020 - DNA, 201 bp, Bos taurus
aggtcccaccctgggccgtgctctccattctggaaccagttagcagcttttgccttaaggggatgaagattgcagggactgctggccttctagctcagagattcctttgggggaaagtcaggaagaataggtttgtgttaggtctctgtggagaagttgtagtctgaaaattggggcccaggtatggaagcagggcaggta

SEQ ID NO: 14021 - DNA, 201 bp, Bos taurus
caggtgtgcctccagtgaggtggcaatatcactcccagttttcagaggcgagcccagagggtcagagggggcatggtcaatgggaattggcaggaaatcaactggcttggccacagcccctgctctgtccctcccctgctccatccccacccccagccctgaaaatgctgagaaagcccaggaccctggggagctctgact

SEQ ID NO: 14022 - DNA, 201 bp, Bos taurus
accagcatgcattagccacggcagccacctccacccaaggtctgggaaaaccctccaggtcaccgtcatactcaggtcaggccctgaggagcggaacatggcaagatggaggctgcagaagatgcgggaaggggaacagagctggcttcctcgtacctggcctgacacggtagtggggctagaggtattactggcctcaag

SEQ ID NO: 14023 - DNA, 201 bp, Bos taurus
gcaacatgctccccagtcctttcagacctagctataggcattgcctccttcagggagacccccagattgccttaaggtgctcggtcctctatacttcctcatgcttcccctccttccacccagcagaggaacagctagctccgtgctggtggtgttactgagtccaagcccgctctgttccctgaaagacaggccaatgaa

SEQ ID NO: 14024 - DNA, 201 bp, Bos taurus
gctatagaccatggggtcataacgagtcagacatgactgaagcaacttagcatgcacgcatacatgggccaggcattgtggccctatacatcacctatatcgttttacttattctacacaatccattttacggatgaggatgctcaggctccaaagaagtcagaatcacagagatgaaattcaagcccaggcctgtctgca

SEQ ID NO: 14025 - DNA, 201 bp, Bos taurus
ttcttttttgagggggggccatactgcatggcttagggaatcttagttcctcaaccagggattgaacctagtcccagcctttggcccaccagggaattccctaaacattttgaatttctcaagggctccaaagggaacacctgtgttgtcttttcctgggcctcagaatgtaaaccttgctctgggtctcttctggcaagt

SEQ ID NO: 14026 - DNA, 201 bp, Bos taurus
agccaggccacactgcggccacagagatgaatgagaacagggccgtagactcctgcaggaggacccagcccagcccctggggaggggggcaggaatgcctctgaaagggggtaggggtggccagtccaggtgcaggaacagaatgtactgagagtgagaggcctggagtacacaggtgccccccctccttgagcagcatgg

SEQ ID NO: 14027 - DNA, 201 bp, Bos taurus
ctgtcagtcactgctatcaaagcaggagcttggattgagggtaattaatcatggtccctctgacagcaatccagggccttatctgtaccccaagaaatgccgctggtctccagttccctcctcaataaaggagactgacagttccaacaaagaggccccttatcagatttcagccagggagcctgaagcagcccgagggag

SEQ ID NO: 14028 - DNA, 201 bp, Bos taurus
ccagcatagaaacagcttagtgttcttcgaagcacctcatgcttgtattctcccaagcctttgcgcttgttctcgtttaggcctatagcacctcttcccctggtcactgtctgttctaccttcaatactcttctcaaacgttctctccgggggctgtgggcctccatgtgcctaatgccctcactgtggtccatgtctctg

SEQ ID NO: 14029 - DNA, 201 bp, Bos taurus
aatacagtcacactgtgaggtgctgggggttatgacttcaacatatgaatttgggagggacacgattcagcccaggacaaggaggcagcatgggcccagacgaccacctcttcaccttaaagggctggatgacgaggtactgggtactgacaatgctaagaagaggggagagaccaatgtggccttacaggacagggagag

SEQ ID NO: 14030 - DNA, 201 bp, Bos taurus
tgagggctggcaggggcctcaggggccacccagtccagccttccactctaattccgatccttttcacccctgggcaggtgacagcccggcctctatgaactgctatgaacaaacctccagggacaggagggtcacaacccatgcagccacttgtcccactgtgggatggctttaaagaaagttcttgtttacatggagtca

SEQ ID NO: 14031 - DNA, 201 bp, Bos taurus
aaatgacttgaatgatatgaggatcccgaatgcagagtaccagggacagagcctcactccattaaggtgttccagggagggccaagttctcagtaaggaatgattcatggtttccaggaaagtacagccccagaaatgggacccaaaggtataaagattcctgagcctgtctatagtacagtcacagcagggcctctcatt

SEQ ID NO: 14032 - DNA, 201 bp, Bos taurus
aaggaaaacaaaggcagcacttgtatgtggactgatgttaagggcacggtttggtttcaggttctgattctagagtcctggggcagctgctgctttttttcccttatttatttttggctatgctgggtcttcgttgctgacaggcttttctctggttttggtgatcgagggctattctccagttgcggtgcacgggcttct

SEQ ID NO: 14033 - DNA, 201 bp, Bos taurus
gctgttacagcatgacagcaagcacaggcaacagataaatgaacaggcagcctgtgttccaagagaacgttatttacaaaaacaagtggccagtccacaagctggagtttgcagatacctaattaactcaatggaacaaacacgtatgatggacatacacatatgcagaacatcaaggccagatgctgaggagtgtgctgc

SEQ ID NO: 14034 - DNA, 201 bp, Bos taurus
ccagagagcttcatcctcgtcccactaagccaatataaatggtatggtcccagggacagtcaccaaccttttctaggcctgtttccttctatataatattatggaggctgaaaactatttcctgccagctgtaaaaccctgtgattctaaagtctctgtttatggtttggcctcagtagacagaattaccatgacatgaaa

SEQ ID NO: 14035 - DNA, 201 bp, Bos taurus
agcagccaggaagaactgtgtttcaatttctattcaatcacttgcatgctctctggctttgtggctttcatttaacttcttctaaccctagttttctattacatgagataagaaatatgtgactgcccatctcttagagatattgtgaagattaaataaggtcaatatgataagtttgtcacctagcaggcactcaacaat

SEQ ID NO: 14036 - DNA, 201 bp, Bos taurus
gcttttgaacacctgctgaccagcctgcttggtccagatctggcctttcctccaaacttgctggctgaagtgtttgtaactttctgtagaaggccagacatgctctccttgttctagaggagggtattacagatcattagctacctaatcactaaagttcttaactgaggaattctcccaggtagacgtgctttccctgta

SEQ ID NO: 14037 - DNA, 201 bp, Bos taurus
gactttggctgcttattcatgagagcgaggtctgtaggacagacggcagagccggcatgataaagatgtgatccgggggatagagctggaggccagaagagtcccatgtcaaaggtcaaaacggagtagcgacagcaaagaaagtctgttgtaaaaatccgtggccggctgtgaaagcgcagtacctgggtccacatttga

SEQ ID NO: 14038 - DNA, 201 bp, Bos taurus
aaatctttgctctcttcgaaacctgtcagaaaattaggtcaacatgattttgtattttaatgaaataacttaagggtaagcctgagacttggaggccgctgagacttttatgctagagtggcttgtcatgcttgacgtaatgtctggctccgtatgagaggggtatcgaagctaatgttctccatggctaatcggccttta

SEQ ID NO: 14039 - DNA, 201 bp, Bos taurus
tttatattcctacagagtataaagttgggtcttttttaaaaaaataaaatctgataatctcttctttttgattagaatatacagaccatttatatttaatgtggttattgataaagctagatttaaatctgccattttgctctcttatttctatttactccctctgttctttttctctgtttctatctaattttggaataa

SEQ ID NO: 14040 - DNA, 201 bp, Bos taurus
tcttttttttttttttaattctatattatagcaggaaataacaaatgaataaacaaactacttcacccaaacaggccaaagggcccttattgggaacaacgtcaatgccatattctctactatcctcaactctttgtcagctgagacctgtcagacatggcctcaaacatagtctgagttgatgggcctaattaaaaaagc

SEQ ID NO: 14041 - DNA, 201 bp, Bos taurus
atcaaaattattaccaaggtggtaaatgatgaggcttcagtgtattcaaatgatgttgtatcatcaggaaaaatccatccaaagaatacatttagatatccggcctttgaaagttctctagactaagcagtctatttcccacgtccaaattgaatgacagaagattcttttaatttaaattttaaagtttctattcagcct

SEQ ID NO: 14042 - DNA, 201 bp, Bos taurus
ttccagttgaggacactaaagcacaaagaggctttgcacaaagtcacagaacaactccacagcaaaggcaagaccagagacccatggccatggtctcccacttcactgttgtgtgccctggaccactgagtcatcctggtggcacagatggtaaacaccctgcctgcaatgtaagagacccaggttcaatctctgggtcag

SEQ ID NO: 14043 - DNA, 201 bp, Bos taurus
tttgagtggaaggtagtctcagaacctaaataaatccttctaaccagagagtcttgggtaaggatttgaatggtttccctgactgtctgaatactgggtttatcattttataaatggcttgctatgtataaaaataaatactacttaccagacacaaaggattaaaaacctaaaatcatcagcgttggtgtatttgttgga

SEQ ID NO: 14044 - DNA, 201 bp, Bos taurus
atacaaccaccaattctaatctacaaattctaaagacggcatgtttagatattcccatgatgccttggattaatttccactcaaagaggtggttgtttaatgagaagcaatgctgtttcccctgtggggcatattgatatataaggagctattactatatagggagctattgatatatagggagctatccagtggactttc

SEQ ID NO: 14045 - DNA, 201 bp, Bos taurus
gaggacacctacacaaacctgagcccttgtgtcagtgaggtacacgtggagtgtgttccttcctgtcctttgcgtgggggaagcccaaaatagcaatctccccttgtgctttcgtctgacaggtaaaagcctattaaacagtgcctccaattgtctcatggaaattagactcatttttctaaaatggaaaagatccaccca

SEQ ID NO: 14046 - DNA, 201 bp, Bos taurus
ccaggtttcatttctctagctgaaagaggaatgcgtttaggaagcagtgtatttaagctccaggagattaggatgtgggaatgagccaagacgtgttggtggctacttgatgaggtgacttatttgtggagtgggacgggcagctgtattggaatctaggtgatctcagcccgaggcactgtgctataatggtagacatgt

SEQ ID NO: 14047 - DNA, 201 bp, Bos taurus
caagaggatatcactcagggtgcggaaaaaaattaatatgtcaggtagacctcaaggacctacgtatttccactctcaagcttgatggtataaaacactccgggattgtccactatgaaaaatatcccattctgtcgagattgagcgttcctcaccaaactattaatgcacctccataagaaactagacaggcattgagaa

SEQ ID NO: 14048 - DNA, 201 bp, Bos taurus
gaaattctaaaagctacagataatgaaaatttgaaaacagaatatatggtaaaagatcgtacttgaagaaataaggaaataagaaactttgaaaacgtacgtagcgttgttcattgaagaagagttgcatccacacttcagaaaaatattccaactggaccaaagatttccacataaaatatgaaatgatgaaagtacaag

SEQ ID NO: 14049 - DNA, 201 bp, Bos taurus
cccagggatcaaacccgggtctcccacattgcaggcagacacttttaccatctgagccaccagggaagcccagtttattctgagagtctatcagatgtcagtgttccaactttaaatggcgtccctcttgttccagatgcacctgaaattttcacggatagaacttttaaattaatttctactcttaactattttgattat

SEQ ID NO: 14050 - DNA, 201 bp, Bos taurus
actcatcaatattttctattctaaaagtttttagtgtatgaataaggtttgccattagtccctttgtttttttttccaagagaaattcagcaaaataaattctttgcatctccaattttcttttaagtatctctaagtatttataattaacgaatcatgattcattttaagactattgggagattaagctactggaactta

SEQ ID NO: 14051 - DNA, 201 bp, Bos taurus
aaattcaagttttgtttatagatgttacattcataactgactgcatgttaaaccagcctgccatccctttaggaggtaaactgcagtaataaatgaagtcgaaattctttattcctcgtctggtacaagtcattagttttactaggtaggaggtatttgcaaggttgcattccaaccttgattttcttttttttctgaagt

SEQ ID NO: 14052 - DNA, 201 bp, Bos taurus
aggtacctagagtaatcaaattcaaagaaacagaaagtagaatggtgattcacagggactgagagaagagaatggggaattactgggtacagaatttcagtctgggaagatgaaatagttctgaagatggataggatggtggtggtgattgaacaacagcatgaatgaatttatgtcactaagctctacatttaaaatagt

SEQ ID NO: 14053 - DNA, 201 bp, Bos taurus
tcagaaatgcaaactgacttctgaaatcatataggtggtatcctcttccaagactatttgaagatcaagactagagcacattttttttcttgactatagcgaattttcccataaacttgattgatgttctatttcactgtagatataaattaaataatttctcattagaaaattgactgtattctcttctcttggagagaa

SEQ ID NO: 14054 - DNA, 201 bp, Bos taurus
ggatatgcttgttgcatgttgtactttggggaaagtgtaaggccaggatgttttttcatactagttcttttggcttagtaaatgtaatttttggttaaatactaatttatcaatggggcctttatgcagaggactacatctattttgttttagtggagattacagctgatcctgattctcttggctcctcagtgtatgtct

SEQ ID NO: 14055 - DNA, 201 bp, Bos taurus
ggaagttgaacctgcctatattattcattataaattatggatagatggattgattttatagataatatgcacaataaacaagttcatttataatatgcaagaatataatttatttagactatagcttggacttaatgtaggtcactgaattgaaataaattaatctcaaatagggcttccctggtggctcaggtaaaaatc

SEQ ID NO: 14056 - DNA, 201 bp, Bos taurus
taaattatctgaacacactgataaatgagtaatgtttcctcccaatgttttccttcctctcattcagtccatatgcaattgtcttctctaaaggctaccatggtagatttttttccgaatgctttcttatagttaagaaacatcagtccttggtattactcactctattaatctgtcaatactatttaaaaagaatgtaat

SEQ ID NO: 14057 - DNA, 201 bp, Bos taurus
ggatcatctccaatattaagcatactgtcctaaataagtttactaggccatccgtacacacttagtagaaatttaatgtagacaagatgaaatacgttcatggagtgcatctgactgcactgatgaagcacattaatcagtgcttttggagctgctgccgtgctctcggaggctgctctcgtttgctataaaagctcttac

SEQ ID NO: 14058 - DNA, 201 bp, Bos taurus
tagctgggactatgcaagtgcacacggaattcatcggaaagaacacgtgaatcacttggtgtgtgaaaagtacagggccctggaaaggacgctaattacaaaacaggtcacattgctaaaatgtgttaagcattgtcacactttaggtaactttaaactctggcctaacacaaacttaaaaatataaacattccagaagcc

SEQ ID NO: 14059 - DNA, 201 bp, Bos taurus
acatctcactagaataataatagacaccgtatagaaaggctgtatactttggcagatgttaaaaaggaaaaactgtgtatgggaggtagtcttgccagggcctccagaatttctgaaacagtgtagtatataaaagtttatatttaaagtaaaactgtagcaaaatggccaaactgggttagaaaaagaggagactgtata

SEQ ID NO: 14060 - DNA, 201 bp, Bos taurus
cctggggtaaacagggcagacttcagagaggagtggatgccaaagcctatacataaatgatgagcatctcaccaaggtgacaatggagaaaatacagttacataaagaataataagcatcaaaaataagagtagtaaggaaatgtagcatattcacaaaatgtccagtgatctagtttggctaaaataaagggttgcttga

SEQ ID NO: 14061 - DNA, 201 bp, Bos taurus
ggaatacagtctccattaaaggaccacagtgagagaatacaagctcactccatactactgacttcattttgagaaatgcctttgaatattttcagtgataaccaagtttttgtacttagaggatgaactttaaaaacaattttaatacacaaattatcaattttaatgaataaggtaatgaattgattgtcttagagaata

SEQ ID NO: 14062 - DNA, 201 bp, Bos taurus
acccatgaagtatgcgcatgcacacacacaaaccaacacaaacacctcctcctcctcctcttccacctctgaggacacattttgatcatggcctagcactttctcaagtcctggctagacttatcttgttcttttctccttcccagtccatcacatctcaacctctatttgtcctccatggcccagcttatatgtctctac

SEQ ID NO: 14063 - DNA, 201 bp, Bos taurus
aaaagtggctcattgatacagttaactgttctcctgttgtattcctattttcaggtcaacttacttattattggattacttatgtactcaaaagcctttcatttccctttactttaattctaatgcctttgatctcctagtgttactcctcatcaccgaaaagtatttttacctgctgctagtaggtttctaccattcaag

SEQ ID NO: 14064 - DNA, 201 bp, Bos taurus
tatattaagaagctaataaaatatagactaaataaagccaaaggatccaaaaagccctcacttgttatgtaaggggccagaaccttacgtaatatacattttcttactaattcttcaaattttgaatgctttgtatgataccaaggaatactggataatgggtttaaaatgtttttaaaagctgtttaaatatatgcagag

SEQ ID NO: 14065 - DNA, 201 bp, Bos taurus
ttgacgaatgacaagtgcagagtgcatggagaaggtgaaaacgtttgcttaaaataactcaactaactgtactatgaatagtccacagcctgagagcgcttgctcaagaaagcatatattctctgaccctgttgtaaataggctctgctcaagatttcctagagcccagaggactacagtgtctctgagtatactaataca

SEQ ID NO: 14066 - DNA, 201 bp, Bos taurus
atcttctttgttcatgaaatgctatagcattacttgaatagtgtttgtattcaaattcacctaattcactctggggagaaaaagggaataacagtttaaacatgcaaataacttgatattccattcagtaaacgctagccctaggtaattatacattaagccttactagtcttatgaaaaaaatgtcagtgactttaacgg

SEQ ID NO: 14067 - DNA, 201 bp, Bos taurus
atgagttccttcctttgattgtgtgcaggtttgagtacaaatgttgtgtatactaacagtatttcataattctcaatatagtattagttattgaaattctgtgaggtgaatctcaccaccaaaaggttcacatttgaaaaatctagctctccttggttatagatgatgagactgattacagtggcatttccccagcctgtt

SEQ ID NO: 14068 - DNA, 201 bp, Bos taurus
acaaggaccaagaatttgttagtagagtagcagggtataaattcagatatgcatctaagaaagaagggatgctgactgaagttgctgacctaaggaaaagaaattcaactctgaaataaagctggaaaggcagaatgggggcaagtgtctggacctgctgtctggacatgatgacagatttagaaattcaaatgaaaagtg

SEQ ID NO: 14069 - DNA, 201 bp, Bos taurus
agagaagactttcaaatgaagtaaccattgaatggagtcttcaataagtttctcaagcttgagaaaaataaggcctcttctttaagagagtttgatctgtttgtgagctgtgtattcacaattcttcaccacttttccctatcctaactcaaaatatctgtgcagtagcagtctgcactgtatttagtttgtgagtagtga

SEQ ID NO: 14070 - DNA, 201 bp, Bos taurus
tccctaagatccgaaagataaccagtccgtggacggggctcctcacgaatacggggcacgcgtgatcacacccaggttggcctgactttagaagtacaccgtaggaacaaagtaggaactttgctgccaccgggagcacgaagttgggaagtttgtttccgaggccgcgtgtgtacctggctctcctggggcccaaggcct

SEQ ID NO: 14071 - DNA, 201 bp, Bos taurus
gaaactggagcagaacccacttaggaaggtgttgcaggagtcagataggatgaaaagggccttgaaaagatgtgaataagatattcaagaagacacacattacttgaacatggtagtgagtttttgtgatgtggaacacaacaccaacaacaaaaaaccccagaccacatgtttcatagatcatagggctgaatccgtgtg

SEQ ID NO: 14072 - DNA, 201 bp, Bos taurus
ccttacacctgaaactgctgatatcttccctttactgaaaacacatcagtttacaaaaattattctacacatttaatcctttttatttttctaaaagcccaagtatatgtctgtagtctcaagttaaatccttataatttagtaggtgcttattcatatttttaaaaggaggaggtctttataaatagaggttcccgtagc

SEQ ID NO: 14073 - DNA, 201 bp, Bos taurus
ttttgttgttgtttgttaggcaaattgtagccaaggattaaagaccaggaattgtattccagtattttatctttaaggactctcctggtattcagtctgaaacttcagtctttgttagtttgggaatcaaattataaagcaaatataatgctattggttaatgaacaataatgtttccaattaaatttaagaagcagggcc

SEQ ID NO: 14074 - DNA, 201 bp, Bos taurus
gccaggatagagctcactgagaagtgacgtttgaggagatttgaaggcaggaaaggagtactccatggggctgtcagaaggaagagcattcagacagaagttacagatgggaggatggccctcaggcaggaactgattggtgcctttgggacagcaaattgccttgcgactggaacagagtgggcaaaaggggagaagagg

SEQ ID NO: 14075 - DNA, 201 bp, Bos taurus
agcaaacataggtcccaaatgcagtgaggctctgcctgtctccggtgatggaaggaaatctgtggtgggcaggcacgaggccttctccctggtagggagtcgctgtttcctccaagcctctatttaaaccaggagttcgttctccctgaggcagggtcaggcaagggcttcttggctttaagttgccttttgtggttcctt

SEQ ID NO: 14076 - DNA, 201 bp, Bos taurus
gaataatgtctccataaaggagtaacagggcgacgagataaatgtaggaaagtcaagagctcaacatgcactgtaaccttggccctaaatttctacgttatcccaggacccctgtgaatcccacatatcaatacatcataaggataacaggttgttgctggttggggatcagtaatcagaattggcaagaaaaagatccct

SEQ ID NO: 14077 - DNA, 201 bp, Bos taurus
aaatgacgttagctttatgctttaggtttgtacagtgtcatcaatgtcattttcagctaggtcctaataacaaattaaaaagagattaaaagagacagagctatgtctctcggcttccaaatcattaaacagtttctaggagttccagtcattcgctaactaatactttctggccactagggaatattcactacacctaat

SEQ ID NO: 14078 - DNA, 201 bp, Bos taurus
atcaagcacaaatgtaaaagagttaatgttccacaaactatgcttctaagtacatatttcctaatccattacgatcatttttcttgaggtgtgctgatatacaacattatactagtttcaagtatgcaaaataacggttcaatatttgtatatactgtgaaatgaccactgcaaaaaatctgactcccatctgtcagcatg

SEQ ID NO: 14079 - DNA, 201 bp, Bos taurus
aggcaaaaagggtgagggcttacggagggatagccacttacatactttttatcagaaaggcaaagaaaggcttttccagagctccaagcttccatctcacgtgatcagatcagtgccacatggccactcctccaggggatcttccctgacccaggggtcaacccatgtctcttacatctcctgcattggcaggcgggttct

SEQ ID NO: 14080 - DNA, 201 bp, Bos taurus
actcttaccagaaagctcgacagatcagaaataccctacagttattaaggagattgagatgttatgagtcagcaagagaaagactgaagggaagaagttccagaataaaacagtttaagggcctgtttaccatagataaatgttttactgaagtcagtaagaagtcatgtacatatttttattgtataactcttgatcata

SEQ ID NO: 14081 - DNA, 201 bp, Bos taurus
aagcttttgctacttttctggttattaatggttagaatttttttgctcatttttactaatcctgttgtagaatgaatttttttcatgccagcatatcttcatttatgctattttttcatatttatcttatgaatcttttaagttgctgcttttcccaagccaaagaaaagaacacaactagaattttgaagacagtagaga

SEQ ID NO: 14082 - DNA, 201 bp, Bos taurus
tggatgcttcctaaggccctggttgttgttgttgtttagccaataaatcatgtctgactctatgccaccccatggacaatggccctcctgtctcctctgtccatggcatttcccaggcaagaatactggagtaggctgcatttctttctctgggggatcctcccggcccagggatcacacccatgacttccgcattggcag

SEQ ID NO: 14083 - DNA, 201 bp, Bos taurus
ccctgatgtgttcagtgtagcattactaagtgactgaaatctaaataacatttggcattataataaaaaggaaataagtgactaaaccagcctaagaggcagtgatcctgtgccataataggaattctatttctttgaactgccagtcctgtgattgtcttgtcttgaagtagtctcaagataatgaggggaaaaaaaaat

SEQ ID NO: 14084 - DNA, 201 bp, Bos taurus
taaaccctgcctaaccaggatacctggggccctccagtgagctccttcaggggcattatggataacaagtgatcaagagtggtctgaggctgtccgaacatgggccctggtaagcagtggctggaagttttttgcagctttggggattgttgtagcctcagaagtaggtatatctgaatttgaagaatgggggtggggggg

SEQ ID NO: 14085 - DNA, 201 bp, Bos taurus
ggagtgtgtgaaagcctgaatgaatttcaggccactattgattacttcaaatgcagaggaaatcatccaagcatgggaagaaggtgaggaagctaaacccgtggccgagggttattaatattgtaatgcctttgcttattggcgcagaaaagcaactcttggtatataagggactaaagctttaagactatcatggaggag

SEQ ID NO: 14086 - DNA, 201 bp, Bos taurus
caatacacagagagcagcagaagaaagcagatgtaaaagagtggagataagagaagacaggttgccaccagcgactgaaggaatggtttagtatactgacggactttccagataactgggtgtatgttccatacctgccctgtgtcttttcagtaaattcactttgtacttgagctagtatgtgtgagcttctgttctttg

SEQ ID NO: 14087 - DNA, 201 bp, Bos taurus
aagtcccagagggaggggatgttatgtatacacacagctgactcacttcattgtacagcagaagccaactcaatgtcgtaaagcaattataggcccccccaaaaaaagaatcaaacaatgttaagttcaatgggaaaaataaatgtgatgcattcaagcaaaagtacgcctatccacccattgttttaccagcacaaacag

SEQ ID NO: 14088 - DNA, 201 bp, Bos taurus
gtggggcctccattaaaagagtgcatggtctactggggaaaacagtgtgtaagaggctgtgactctcctgcgtggggtgtgagggtgtcaggaaggcagaagaggtgacattccaccttggcctcgaagggtgtgtctgactccccagttagaaatggggagaagggtgacacatggagacattccaggcagaacactgcc

SEQ ID NO: 14089 - DNA, 201 bp, Bos taurus
ctgcatatagcaccctcataaacaaggccctagagagaccccacaccccttctcccatgtaaggttacagtaggtagatgactatcttcctatagtaagaagcaggccctcaccagacaccaaatctgctggtgccttgatcttggacttcccagcctccaaaactgtgagaaataaatttctgttgtttataagccactg

SEQ ID NO: 14090 - DNA, 201 bp, Bos taurus
ctatcctcacagggcatgagagcttccccttctggtcttccaactttatttaactgtagtttttgttgattcattttgatggagaaatttgtcttattcaagctgctgttacttggcctggactgttttttgttttatggaaccaaatctatcctaatagtcctcatgtatgattactcgaactaagtttccagtctttga

SEQ ID NO: 14091 - DNA, 201 bp, Bos taurus
ttaatatacaataaatgtgatgaaaagtacaattatttttacttatttaacagaaaaattttgtttaagaggtatgcatttgcccagtgtatctttttaacttctggaaaaaacaacctatttacctcgtatacttgataactttcacaaattcataatctgttaataaagattggaaaacatgtaagttatgtggctact

SEQ ID NO: 14092 - DNA, 201 bp, Bos taurus
gaataggtaacacattctacatagttccaaatacaaaagaaacaaaaaaagtattcattgaaaagtttccttcccacctatttcttctccgcagaggtaacctacattattagtttttgatacatctctccaaagataatctatgcacatataagataatacatatatatgtatattttttttcccttttttacacaggat

SEQ ID NO: 14093 - DNA, 201 bp, Bos taurus
cattctccatcaggcctcttctccgggccttccccaagcattccattccatctggctttaccatatcccagctgggcggatcttgggctacccaccccctcagtaggaccctgggccctggacggggctggacctgccccatggcccaggattcgaagtgaggttcctagttggaaccagggactggtcagactgccccac

SEQ ID NO: 14094 - DNA, 201 bp, Bos taurus
cactctgcaaggggcgaaccactggggagggttcttaccaaactcctcttgtccactcctatctgaccccccagggccatctttcagaaaactctggagtggggggaactggctccctgcccccagaagctggaggagaagggtgaccagagagcaggaggaaagaagtaatgggcggcaccaggccctgtgtctggagtt

SEQ ID NO: 14095 - DNA, 201 bp, Bos taurus
ctattgatagtccttaactattttaataatagaagtatagaaattatgaaattattattattgcacttagagataagtgtttgtgctcatatgtttatacctaatattttcttcaagccattctagaaaacctactttaggagactctgaaaattattctcttgcatttttcatagtttgcttctttctgacttcttgcta

SEQ ID NO: 14096 - DNA, 201 bp, Bos taurus
tgaggtcctgacttgcccaaggtcataaaataactggccagcagagctgagacttgaacttcagccctctggtttccaatctggggccctttctaccagatagtagttaaagcattaaagacagcttctatagtcccttaaaaaccccagtatgattcttttacaaatttaaagactgtgacgtcatatttacattttatt

SEQ ID NO: 14097 - DNA, 201 bp, Bos taurus
accagtgtcaggaacattagggttgtttcctggtcctaggatcctggaccttcgccagagtctgtggctctgcctggtggcctgccccatgctcacactgtgtctctgaacctacctcatgtccccccaatcccttgcttaaccatacgctccatagcgtgctgtctccaggacagatcatttgtttgaggaagacggaag

SEQ ID NO: 14098 - DNA, 201 bp, Bos taurus
ttcaataaaaataaagtaaaaatttacttccctttccctttgcaatagaagcacattcttagatttagacttactgatggccctccttattcacaatcctattctcttcccatctgctaaatctggagagtatagtcatgaggtcctctgggcaacaggctgaagaagtacctgtaggcctgaggagctcagctgcgtttc

SEQ ID NO: 14099 - DNA, 201 bp, Bos taurus
tgggtattttttcccaggtacacaaaactgggaatgaaaacaatcagttttgtttaaataataactggcaggtaaatcatctccatcgcttaaatggaactgatcaaagggaactaaattaacttccctagaggtcagtttagtaaaaggccacactcttaactccaaatgacacccttttgctctgaaacattaacatga

SEQ ID NO: 14100 - DNA, 201 bp, Bos taurus
ggtcatattttgaccataggtggattcctatgcaaattcatcttgaaagaactggtttcctattgcaacccaggaagaactgggaagatcactttgaaacgttgggcaatgtttttttttgttttgtttatcaagcagcacagctttctaccactccaactttttgacttaccattcccctcttctctatttcccctttgt

SEQ ID NO: 14101 - DNA, 201 bp, Bos taurus
ttcttgatcagcagaatggctagttaactaacaatatgtaaagtatggaagttagaataaagatttttcagatctgaaaaggcctcagaaatcctgctgttgaaaaataaagaagtgaaaacaagacctggggtgtaggaaatagtagattcaacccaggagaacagtgaaatgatgttccaggtgggagggctatatagc

SEQ ID NO: 14102 - DNA, 201 bp, Bos taurus
agaatttgttagatcatgaaaatgatccacagaaacaatatgaaagtcactaggaagatacagggtcttcacaccatatcatacagccggccaacacacaggcattaagagttttaaaaagttgttactaaattcacccagtttgcccagatgaataaactggctctaacaatagcagtaggtggcatttgaagcagactg

SEQ ID NO: 14103 - DNA, 201 bp, Bos taurus
tgttatggatttaatataaacagaaatgaagtaactcaccaaataaaaagatctttctgcctctgtaagtacagatctgcatcatcaatttgttgactctataaatccctgtgcttgatacataccttgtaattttctgtcttctgtttagagcatcttcattcaagctattcgatatcataagcaaaactttgaaaaata

SEQ ID NO: 14104 - DNA, 201 bp, Bos taurus
tcttttggcatgttacgaatcttgtttcactttcctgcggtctcagaggtgtttcgtgggaagttcatggtcatttgaattatttcccttaattaatgtgttgtttttctgtttccttcagtattttatgtttgtgtttggtttccagcagcttacatgtaattttctttatctagtttggaataatgaaagcctctttgt

SEQ ID NO: 14105 - DNA, 201 bp, Bos taurus
tatataacaatgaacttattttaatgatttaaatggtgtgttttattaataatagtatgtttttctgtactgtccactgataactgtgttcaagaatgccatttagatttttataattctgaagaaagaactctagaatatcatctcaatgtattctgctaaaaagaaggctcttacttcccctctttccttctaccaata

SEQ ID NO: 14106 - DNA, 201 bp, Bos taurus
gcccaggaaaacaagtcttagtgcaaaaaccaaagtgggtatgtggttttgaaaagaggtttctctaaactcacactaagcactaccctggccacactggcgctgattacattgggctgaagccaagactctgattttgcagttttagtgtgctaccagtatttcaaaggaagctgtaaaatcctcaatcctggccaactg

SEQ ID NO: 14107 - DNA, 201 bp, Bos taurus
atatgttttccactcttctcaaaaacttctttggaaattaggacatgatggagattatgtgtgtttttcattcctaataagttcaaatgtgattggattggttttttgggaaagaggaaattgaataccttgaacctatttcttttgaaacagaaactttttttcctatcagttggaaacactcagtagagtgcaaaccat

SEQ ID NO: 14108 - DNA, 201 bp, Bos taurus
gaaataagattagaaaaaatagattggagagaaattgtggaaagttctaaatgttgtgccaaggaatttgtattgtgtgtgtgtggcaggggggaccttccaaagggttcaaactgggaaacagtggctggcactttgttttggcatcagaacattggaaatgactaggggcaggtaaagatatgaacggcaagaaaacca

SEQ ID NO: 14109 - DNA, 201 bp, Bos taurus
cctttcctctgtggcttttcttccctaatctacacagagcatatgcaatcagcaaatttaaaatgtagagttattttaatacggtggaagaaaatgtcagtgtaagtaagatagagtaggtaggttttaagttcatagtctaacattatttaattagcatggcagggatttaaagaattaaacagcctcttgcagacaatt

SEQ ID NO: 14110 - DNA, 201 bp, Bos taurus
cacagccctgcatcagaatcacccaagaacttatgaaaatgcatattctctaagctctatgttagagaccttgattcattaggtctgggatgaaccttggtatttctaaagtacttaaaagtgtgagaactaccagtttaactgctaagagcatggagtttgccatcagcagctgtagctctgctttcttcattgggtgat

SEQ ID NO: 14111 - DNA, 201 bp, Bos taurus
tgcaaggaaaagttcaacatcgggaaatttattaatgtcatctaccaaatatatcacaattaacagagaaaataatgcagaaaaggcacttgataaaatttaacacttcattgagactaagagaataaatctcaaaaattaaaaattgaagaaaacttccttaatttaataacacctctaaatcaaaccctacagcacatt

SEQ ID NO: 14112 - DNA, 201 bp, Bos taurus
atatatgtgatgaagaactttctccttcatgtttattattataataggttgaaatgaatatggattgtttcttgctgtgtgtgtatggcatgtcatctgattgcattacagttgtaatattctaatcattataaaaattaactttcattatgcttcttcttttcttcttgtttggtaatgctactaattttataatattca

SEQ ID NO: 14113 - DNA, 201 bp, Bos taurus
aggaagtgttcctgctcctgaactcatggaaaagagaaaccagcatgtgaaggcttaggaaaatgatcacggagacatgcacagaaaaatgaacagtgacaacgaactctacatgcaagaaaggggtgatatatgtatggggtatttatcttgtttttgtttctttttgcttacctataggttcaaacctctctgtggtga

SEQ ID NO: 14114 - DNA, 201 bp, Bos taurus
tgaaagtacaaacaactagaccgtgactgctaagaattagtggccacaaacccatatggaagagtaagcagccatgtgcacacgtggcacccagcaccagtactctgcctgattgtatcttggccaaagacatcacgaggtaccccgctcttctttccacctcgcctcccaccctgccagcatctgtcttcacacttctca

SEQ ID NO: 14115 - DNA, 201 bp, Bos taurus
acagggacatcccttttccttattgccactatagccactgcccttttgattcaagccacaaaaaatcattgtgggatcccctttcaccatttttgtactatagaaagtacatgctatagaagccctcctgaattatcaccacactcaacacttctcagtcagctgcttttgttaactgatcctcacatttatgttgtaata

SEQ ID NO: 14116 - DNA, 201 bp, Bos taurus
aattttcaggtcttcattataaggggtggctactccaactgcctttgtgacataaatctattttgaccattagctctcctcttccttaaggagcccccaggttttcccagtactgctccttttgcccacaggaccctttgatcagtattcaaaacccaagaggtattaagccaagtggccatttgcctttaaggttataca

SEQ ID NO: 14117 - DNA, 201 bp, Bos taurus
acacagaacggtagtctgttggtgtaaagactgctcagactgttgagtttatttttctaattgcatgaatatccacgtctgtctaatccataatggttgtctagtgtgttaactgctcagtcatgtctgactctttgcgaccccacagactatagcctgccaggttgtctgtccatgggatttcccaggcaagaatactgg

SEQ ID NO: 14118 - DNA, 201 bp, Bos taurus
cctctagcttcaagaagaatgggaaaacgaaattgtaagcttttccaatctttctaatgggaaatggaaaaggaaaagaggattgggaataaacgtggatcgggccaccaatagttttgccactagttataaatggagcagatataattttatattttaatcttttctaccacgttgtcttccaaaggttggttttggcag

SEQ ID NO: 14119 - DNA, 201 bp, Bos taurus
aaatttctatagtaaaactctaagccccagtacctcagagtgtgaccagatttggagatgaggcctttaaaaacgtgatagaattaaaaagaggccattggaatgagacctaattacttaatctgactggtatccttataagaagaggaaattcaggcgcacagagggaggccaggcactcagggccgtgtgtgcacagag

SEQ ID NO: 14120 - DNA, 201 bp, Bos taurus
gggagaatcacttgaaatgttcaagtgtcctattcacttgtggattacactctggagcagcatctcccaaagtgtataaagaaaattaccttcatgatatgttgatttgatgaaataggttaaatgaaaagaatcaggaaggacctaataggtgaaagaaagtgaaaatgatttttttactgcaggatttcgcccaacttt

SEQ ID NO: 14121 - DNA, 201 bp, Bos taurus
ttgccatcgcaaaacatgtctctgtggtgtatggattattttaagctgaaaacaatcaaagcccaaaagactcaggaagaatctttgactttcccccaaccgtctaaacaaatttagatagaagacctattccaggaagggagctatcaccatagataagtattaataaaatatgaacgaggtgtgacagacaggaaggag

SEQ ID NO: 14122 - DNA, 201 bp, Bos taurus
attttaattaaaagactgtgaaatgaaaagatttccttacatattaataaacaaaaaatatcacagccatcagtgaatttcggcctccaaatatgaatcagttcagttcatttcagttgctcagttgtgtccgactctttgcgaccccatgaattgcagcacatcaggcctccctgtccatcaccaacttccagagttcac

SEQ ID NO: 14123 - DNA, 201 bp, Bos taurus
ttatgtactaatcaaactctgatttgttgaaggtaccaacaacttctaacttcacattatgaaggtaaagcaaagataatctcagtccagggccctgaccattaagttcagttcagtcgctcagtcgtgtccaactctttgtgaccacatgaatcgcagcacgccaggcctccctgtccatcaccaactcctggagttcac

SEQ ID NO: 14124 - DNA, 201 bp, Bos taurus
taatacattttgaaattttaacagtttttgtctttaatttaggggtgagtcttaaagttcagaagcctaacttggtatcctgctgacagtctttctgtctgtcccagttcctactgtcatcttgggatgacctgtatgatgccttgccaatatccttgagctattttgactggcttcatcacattccaggaacttaactat

SEQ ID NO: 14125 - DNA, 201 bp, Bos taurus
accataaatgccagtaaagaaggggaacctatatagtggtaggagaagtcatgaaaacaggaactttgtttttttagtaactgagtcttattttaactgggaagggttaattttgactgcgtactagatctgcttctgtgacttcaactcttattttgacgcttttgttattataggtatacataatggtctgcttcaggg

SEQ ID NO: 14126 - DNA, 201 bp, Bos taurus
ttcttttctcttgacaaacatcaattgttgataggctagttgaagtcccatttattgatttctgctctgctgtgggagaattctattgaattagaaaatatcacagagtcattgaaactactacagtcacagatgcagactttgagtaaaataaagtgtgcatttgtcagtctttctttgtttactttcttgagtcccatt

SEQ ID NO: 14127 - DNA, 201 bp, Bos taurus
ttgtagcaggcagatgtttaatcttaacatagtgtgtgttagaggaagtcatctagaagatacaaccacccacagacccaggatctggaccaaacccatcagaggttcttcatccctcatatatgttggaatttacattctctctactggtcccacagtgggagtcattttcaaggatgaagccctgagagagtgatatgt

SEQ ID NO: 14128 - DNA, 201 bp, Bos taurus
gaaccgcaggagttggtgatgaacagggaggcctggtgtgttgctattcatggggtcgcaaagagtcggacacgactgagcgactgatctgatctgatctttgatctgatttcagatctctggcccagtcgaaaagtttatttatgcatagatggcatcttaggaggaacttagaagaattggggtggtgcaggtcagaag

SEQ ID NO: 14129 - DNA, 201 bp, Bos taurus
atgttgctgaatctcagtattgatccctactctctgcttaaagactattttagaaaggtgatgcccttgcaactctttgtgtatatatctgacatagaatttaagaaagggatgaaatcacttctgatatccctttatatttgtcctggaattaatccttgtatatggtgtaacttatatagaaaagaaagtcacttttct

SEQ ID NO: 14130 - DNA, 201 bp, Bos taurus
atgcttaattgcagcccagaagggactgctcacgtttcatagagagctgtcctatggacccaccagctacaaggtaagagccaggtggaaggacaggagtttgggaaatagttcttgaaaagtagctgtttcctagcaataatactctacttgccaaaagaagggaaatttactacttaagtttctaattgtctctgccac

SEQ ID NO: 14131 - DNA, 201 bp, Bos taurus
tttgcattctcacctctgaaaatgaatcagatttatacttgcttgctaagttgttaaactctgcatgcctcagggaaacccaattaaaagtcttggctgtcgcaaaataatttctctttatttagccttccaagtttcccagtattttgaacttggaagaatgtagtcaaggaacaattataattcttcaatttattttag

SEQ ID NO: 14132 - DNA, 201 bp, Bos taurus
caggatatccgcttggccattggccttaatgacttgtacgtgtgatacagaattaatgcagaatcagggtaagcagcaggaggattgaggagaaatgctgcggccaggacaagaataggtaaggaaaacccttaagtgtacatttcccaaaaggtacagaaaatggactttagccttgcctgtaagaacaggcccaggaac

SEQ ID NO: 14133 - DNA, 201 bp, Bos taurus
tagtttttttttctaagacataaaatctaacaaagtagattacacataagattaaaaaatttctatcatattgcagccaaagttattactcatcaataaatcaaagagacaaacccatcaaatttgagtgaaattttctcaattttaacacattttattgttttatttttaaatcaactcagtcactctaagcaaagcaaa

SEQ ID NO: 14134 - DNA, 201 bp, Bos taurus
tacactgagtcagtgatgccatccaaccatcccattctctgtcgcctccttctcctcctgccttcaatctttcccagcatcagagccttttcaaatgagttggctcttcacatctatggtatacatagtccttatttataggaaatttgaagattattacaatcttgacaatattaatcttctgactcatgcccctaccca

SEQ ID NO: 14135 - DNA, 201 bp, Bos taurus
actttgacaggttaagtgcctttggttttgtagatctattttctctccctccctcaacaatgtaaagagtcatatttgcttaactaattggttttactagtttaaaactctgtagaatctttcattattgccatagttcatttactttaagctttagattcaggtatttattattaaaatattacatatcatgaaatgacc

SEQ ID NO: 14136 - DNA, 201 bp, Bos taurus
aatccttgcatgtcatgtggttctcattgcagtcatctgtgttcatctctcagaaggaaaaataatccattttatatttcaataaatatcaaagtaatcattagcaaaaaaatagcttccatggagcagagattcaagaaagagcagttctgatgaatgatttgtagaatcgagtgagtccttctttagtccagtgagatg

SEQ ID NO: 14137 - DNA, 201 bp, Bos taurus
tccatagttgatgctgagaaacaatgaacactatttttgtttatttttttaacaagttttttactgtctatccagtagcggaaaagaaaatgatgaaaacgtattttaaattgacatatattttgctattcaatttttgtgataacattttatgtttaatcttcctcttgtgttttatattacagctgtataatgcatgaa

SEQ ID NO: 14138 - DNA, 201 bp, Bos taurus
agagagaagtgatgagaaactaaattcaaaaggcagaatagaaagggcggggaaataaggaagtaaagtaaaaagggccatcggtcttgaaaaacatctccaggaatggtcagcctttggaagggatgtattaatctcttctttcttgcagctattcactggtaggcagggtcagattatctctttgtgagctgaataaag

SEQ ID NO: 14139 - DNA, 201 bp, Bos taurus
acactcagtttagttcagtttagtcgctcagtcactcagtcgggtccgactctttgcgaccccatgaatcgcagaacgcctggcctccctgtccatcacatatgcaccctaacactcttacattcttcagatcagtcagatgagtcattcagtcatgtctgactctttgccaccccatgaatcgcagcacgccaggccaga

SEQ ID NO: 14140 - DNA, 201 bp, Bos taurus
agaaagaaaatgataatgaaatagtatatctggaatgttgatttaatagaaaatatggttaaattattgaaatctaaagaatatctgtcatccattgatacattgggaaaacatacacatataaaaggggaaattgcagagaagactttattttttttgtaactacaaaatttaggtaagccaagaacacagttttagttc

SEQ ID NO: 14141 - DNA, 201 bp, Bos taurus
ccggccccgccgcccctccaggagtgcccggggactcaggcgcgcgcacagggcgcccaggcggcgtgggaacgcatccagggatccatctgttcttgtgctggaaaggcctgaggacttcacttatgcagcttttgaagaatttttttttccccccgcccggtcggtgataccagaagggccataacctggttcaaactt

SEQ ID NO: 14142 - DNA, 201 bp, Bos taurus
ttggtgaatccatctacactgaagatttcttaaaaacagatacccaaatatctagattttaatttttttgcctttctgatatctttagtatttgtagtgatatattcctttttaaattataaatactatcaattatgttttctatttttcctgataattattataggtatttacaattaatcttttgtcttcatagatttt

SEQ ID NO: 14143 - DNA, 201 bp, Bos taurus
cacagcatccaaagcaggagagctacatacactctttgccccagatggtgaggcctgctgtggtgatgttaacacagggaggggacaagtatgtggagcgcgagatgcagaggatccacagaggccttgttgacaagtgagcagtgctcattcctaactcagaccagtggaaatcaagactttctgtttctagtttgctga

SEQ ID NO: 14144 - DNA, 201 bp, Bos taurus
agcccaggggtacataccaggcctctgcaaggatttttaaaagaacctgataattaattgcaaaactgtaccccatctagtgagaagctaacagagcaaatggcctagtaaagagtggaacatcagatcagatcagatcagtcactcagtcgtgtccgactctttgcgacctcatgaattgcggcacgccaggcctccgtg

SEQ ID NO: 14145 - DNA, 201 bp, Bos taurus
gtgggaagattagctgaaggaatgtccttgaaaagagatgggatctagaaaacaagcagaagggagtgagcaatgacctggaggcctggacttcttgtggagactgacaacactgaccagcatcaacatgagtgaagtgcacagtgagagcagtggggatggttgaaggcagaaaacgctgggaggtgtgtggaggccagc

SEQ ID NO: 14146 - DNA, 201 bp, Bos taurus
ttttgatgcaatccatatcaaaataccaagtgcattttttaccaaactagaacaaataattctaaaatttgtatggttacacaagacttcaaatagctaagataatattgagaaagagaacacagctgaaggtaacatgctcctagatatcagactaaagctatactcatcaaaacagaggcacagaaagagacacagatc

SEQ ID NO: 14147 - DNA, 201 bp, Bos taurus
gaactaagaggaaatcaacatggccagaatgcaggcagtgaagggacgcatgctatgaagtgaagctggagagggaagcagagaccagattatgcagacacgtgcaggccagcagttaaagatgttggtctttatcctgtgaaaattgaaaatcattaatgtgctttaagcagagaataacataattttgaattttaagat

SEQ ID NO: 14148 - DNA, 201 bp, Bos taurus
cacaagatcttaggccactaacaatttaccttctggcttgagcaggcattttcttgggttcacagcaacagtttctaaggcccctctctcaactttcctcctagcatttacaaagtcagagtcagcaagcatcagttcagttcagttgctcagtcgtgtctgactctttgtgaccccatgaattgtagcacgccaggcctc

SEQ ID NO: 14149 - DNA, 201 bp, Bos taurus
ccttccccggaggaccttcccaacacaggggtcaaacttgcgtcttctgcattggcaggtggattctttgccactgagccatcagggaagcccctttcatatagttacccgctcaatatacatttttgtttagtaaaagaaaaaaatgtagcctatttacgtattaatttttgcaaaaatgtgcttagtttaatgatgtgg

SEQ ID NO: 14150 - DNA, 201 bp, Bos taurus
gtggataattattttctcttgtgggttaagtgctgtactatcattattaattttattgctcagattgttccagctgtggccattaggagctcctttaagacggctcctgtgccctttagacataggcttttttgcaaggggtcatcaggggaggccttttgtttagttgctcagtcttgtccgactctatgcgaccccatg

SEQ ID NO: 14151 - DNA, 201 bp, Bos taurus
gctactctttctctgtgtgagaacggtaatagcttttggttatttgttgctttcaagcgtgaggaattagctttctgtatatgtttaagagagcttttaagttttctctggccgtcagatatttgaggccgagaaggaacgttttgttcttgaggggatagtgaactaaatgcaaagttatagttgcaatagttaaacttt

SEQ ID NO: 14152 - DNA, 201 bp, Bos taurus
tttaaagtgtacaattcagtggtgtatggtatatccacaggttgtgtaacaatctccacatctaatcccagatcatttcatcacctctgaaaggccctccgtgcctgctagctgtcacttcccattctcccacccctccagccctcggcaactgcgaaatgactctctgtctctataaatttccctgttctgggcatttca

SEQ ID NO: 14153 - DNA, 201 bp, Bos taurus
acagtgcccctgagtggatgtggaatcgcgtttcatgacagtcactgagatgaagttattcagtctcttctcggggactgatggtatcttaggccaggagcgagctgtgatgtggtaaaacctctctgggtggagatgaatggatctggatatggtctggagaagcttcctagggccctctttctgctgataagagcagca

SEQ ID NO: 14154 - DNA, 201 bp, Bos taurus
catcaaggttaaacaacaatcatcagcatcctattctattataaaccatctaataaaacaggaaggcaatacaatgcaatcaataagtttcctaattgctgggccaagaccacactacttttgaaaacatacaaggtggtactttagtttcctgatacaacaaaggatgtgatcacaacaaaggatgtgatctggactatc

SEQ ID NO: 14155 - DNA, 201 bp, Bos taurus
taaaatacatatttccaggttctatcttcagaaatcctaattctatagatttacagtaaaggtgtgggatgttaaaacactcccagttaaatctgacatatatctttcgttaagaattatttctttaaagcttatttctggggcagatgtaatcattgtttactacccaaggaacaagtaagcaggaaaatgtagaaaaac

SEQ ID NO: 14156 - DNA, 201 bp, Bos taurus
tttctctgtgtcttcccctggtatctgtttatgccacgggttccccgaggccacctctcctcgggagacagaaaggttgcaggggcaggccgaaaaaaaacgagagcaggttgggcaatgtccccctcttccacccaacggggcgacgaacggagggttccgatgaaaccgagaggcttaggggaagggtgttagggtttc

SEQ ID NO: 14157 - DNA, 201 bp, Bos taurus
gagagaaagcagtttaaaagttgatcaagttcggccaagtcacccttgctaagcttctgtttcctcagctgtaaaatgatacatatctgatagattgttttaagaagtgatgagcaggccagtagctctgactttcattttgactctaggataattcttagattgtatctcctggcacatacaacagtgacttacatacat

SEQ ID NO: 14158 - DNA, 201 bp, Bos taurus
tacggtcattgaatggcagtgggaaatgaggctctccattgttcatccttctttaataagaaagggctgttggtggtgttgcaatgcagagaataaaaggtcagtgctttgttttttgttttggagagcagtgaagagccccacatatatctaaatggttttttaccttatttttagttgtgcttataaacacctaacagt

SEQ ID NO: 14159 - DNA, 201 bp, Bos taurus
gactccaggaggctcacaggtgggggcgctgccggccccagagtgagctcacctcctcatgcttgtgtgggcgacttgggcctcgcacagcccccacaggactcctgacaagctctgtgtaacttgcttgctcccggtaactgcaagctccttactccctgccttcttcccctcaggcccatccacacactcatggtccac

SEQ ID NO: 14160 - DNA, 201 bp, Bos taurus
aacattgtggttcctttgactttccctctggattccgtttctaaactcaacaatcctagttgctctcctggagggcacgctgtactcacactgcattctctttgtaatttggaaactgtagggatggagtatcactttcccagtcctgttactagactgctggtaacacagcctacctaagaccacactagctttacttgg

SEQ ID NO: 14161 - DNA, 201 bp, Bos taurus
cttggcttgagctgtgccctggcctagaacacccttcctccccacccttctgctagtcaaaccccgactcttcctttaggctcagccacttttcctcctccacctgcagtccttatggcccagaagtgctcagcggtgatagttacctatttatttttctgtctctccattggagacagacacaatggtaatgatgtgttt

SEQ ID NO: 14162 - DNA, 201 bp, Bos taurus
aatggggatcgatgggccagggggtgggactggggggtgggctgctgtcttaaacaagagggtcagggaagacctcctggagagggtgcctccttgaagtagatgcaggagtgaggcctgggctggctgcaggaagagcgtccctgggtgtgacggtggccatcagggagagtagaggcctggcaggcttcagacaagaca

SEQ ID NO: 14163 - DNA, 201 bp, Bos taurus
tctggccttccaaccacgtgacagaccagaagtcagaagagccaagttccaagaactcgcaatacagaacttcctcgaggtgatctgaaactctaaaatcttagtggtctcgggccgccatgcaactatggaatttcagaaccacaagggcccaccctcttccggacagatgaacgctcaggaggcccacagcaggaaagc

SEQ ID NO: 14164 - DNA, 201 bp, Bos taurus
acctcatctctcagtatttatgattgtgcatagtcctcctcccttaaatctgggcgaggctggtgattggctctagccaatagaatgtagatggtgttacactagtactaggcccaagcgtggcagtttcctcttgcatttttaggagacctgagctgccgtgtaagaggtccaactaacccgtaaggaagccacatagag

SEQ ID NO: 14165 - DNA, 201 bp, Bos taurus
agagcttgggttttctggtaagatcaccagctttctggtcaaagacattcttgaagtcattgggaacagaggattggagatttggtgtctgagcccatgtgttctgggttccatatctggggctcaagagccaacaggatcctgtgggactcatgtaaggttttccaaggtgacgagattctaaagttcctaaagctcagt

SEQ ID NO: 14166 - DNA, 201 bp, Bos taurus
agtatgagagcatcactgcctcttctatttggaagtagtcttagaggtcaaccagtctgatccccagcaggatcagatctgcagcagcctgagaaaggcccgcccacaaacacacggaggactcaagtgcctgccaagtttgctgaggacaaatatctccactcctcactaggcttttagggcagacccagggcattaatg

SEQ ID NO: 14167 - DNA, 201 bp, Bos taurus
cgttctcagctgcaagaactcctgccttggccccaggcatcgcctccagccccagctctgcccacccagcaaagcctcccaggggatcccgcaaataatgcttggccagcagccgctcctgctcaaatccgtatcgaagcctaggataataaataaagccactatcggccagcacatatttacatttttccggcgggaagt

SEQ ID NO: 14168 - DNA, 201 bp, Bos taurus
ctggcactctggggtggcagtgcagggcgtcaagagcccagggggtttgggcagctgtgagccagaggctaggtaagggagaggggaaaaaaggcaaggagtgtggatgaagcgtgtgcttgtgtgcttagacagtgcctgccaacattgtagacacgcagtaaatttttgttgaatgaatgaatgactaacgggtcagga

SEQ ID NO: 14169 - DNA, 201 bp, Bos taurus
ttatagcacctttattattagcagatttgtcttacagatgaggaaattaaagccccagaagtttcaggtgactcagagggtcccgtagctgaggccacaccgagtgtcagaccacatctggctccagaagcctgagctcttaatcactttgctatcctgtctccttcccctggtgtttggcctcttgggttctctactgca

SEQ ID NO: 14170 - DNA, 201 bp, Bos taurus
tttagttatttctcatctgtctccccttgagggctacctagctcactgctgtatgtccagaagagtgattctaaaccctggccgcacgttcagatcactgagcacttcatttatttctggttgtgctgagtcttcactggtgggcgtgggctttctttagttgtggagagcagagactactccgtgttgtggtgcccgggc

SEQ ID NO: 14171 - DNA, 201 bp, Bos taurus
taatacttttttctttttaggggaatactagatgccacccacttaattgatttcacaatcccatccactaatgggcctcatccaacagttgaaaaaaagccgtagaacaggtcaaatggggcattttctcttagtaaacaattgtgggccttgaggcctgctagctgagtggggccagatcagatgtccaaaccagatgtg

SEQ ID NO: 14172 - DNA, 201 bp, Bos taurus
ccactggaccgctagggaagtcctctgttttgtttttaattatctttttgtgtgtgtgtctgtaagcttgtttcagttattgatactttttgacaattacgcatttggaattttctagaactgtctcagagaaggcaatggcaccccattccagtacttttgcctggaaaatcccatggacggaggagcctggctgcagtc

SEQ ID NO: 14173 - DNA, 201 bp, Bos taurus
cccccggtactgcgcggaagggggcggccctggtgcctcttcaggacccaagacttggcgaaacttttaaacccagatgttgctcgccggaaaaccggccggcacgtccggggctaggttggtgggtatctgagggtcgtctctgtcagagccgaagcggaggggctgtgtgatcgcggccccctccccgtgttctggtct

SEQ ID NO: 14174 - DNA, 201 bp, Bos taurus
gtcttgaatgttcccgttggcatcttcatcttcacctgtagtcagaactccaagctgtcactcactctggcatcagctgctgctccttggcccaagtcttgtggctgccacagtgtggagacacagtcccagtgaccttctctggcttctgctctgctgatgcagctgtcagaagattttccttaaagtcccccagggcct

SEQ ID NO: 14175 - DNA, 201 bp, Bos taurus
agggcccgagagggcctcggttactcaaatcctcccttggctgttagagaaagcaagtttcagagacttaaaggctttggtctctgggcgcattgggggtagaaccaggagctcaggcctggtcagtaccgtaggggtttgggctttgcctggagtgggaacagacatttgccccgctctgtgctcccgtccttgtatggt

SEQ ID NO: 14176 - DNA, 201 bp, Bos taurus
ctctgagaatgaggggtaaatgggggcctaggaagtttcatcaggagtgccatggcagagggactcatctccaggagcatcttagcactccagatgacactgaattcgccagaaatggcctgtcaagctggaggaactcccaaacaggtacaggaatatgaaattcctgggtgtcatctagggcagatttatggaaatatt

SEQ ID NO: 14177 - DNA, 201 bp, Bos taurus
gtcagtttacatgcccttttctctattaagtcagagtttctcccttcccctccccagaaaaaaaatacaccaggctgggtgtctctagcaggcagaataacggccccctgtaaagcacgtccatgtcttaattcccgaaacgtataaatatgttatggcaaaagggacattgcagatgtgattaaggatcataacaaaaga

SEQ ID NO: 14178 - DNA, 201 bp, Bos taurus
gccactcctgcccagctcctgggtctgagctcagcttttggcgacacagggctggggggctggctccaggaccctaccgtgacaccgctcacattctgctttaatcacagctggcctgggacaggcaagtcttcatgggctcaagcttggcccctggaagggagcagcacatcaccctgggaaggactgaggcagatggct

SEQ ID NO: 14179 - DNA, 201 bp, Bos taurus
cttaacgccctcccagctaatggagatgagtagaaaaggtgacagtccaaactcaaacctctttcccgcaagctcattcagggaaaaccccaggaagctcgacctggccgagtcgcctgccccgaggaggatgatcgctcgccataatgcttctatccattctgggagggcagcagcagaaccatgccccacgcgacacct

SEQ ID NO: 14180 - DNA, 201 bp, Bos taurus
tcccagccttgacctgagcatctgatgactagttcatggttctctgggtcccaaggaccctcctaagagagaatggagatgggtggcagggggtgttcaccgaggccaccccttcccccaagcctcgatcatgaaatcagtgagatctgccccctccccaaggagctcaccatcagcaacctggcaggccgcagggagcca

SEQ ID NO: 14181 - DNA, 201 bp, Bos taurus
ctgcaaatctttaaaaaggtgtctatatattctttttcaacatattttttcccaaggtttaaatacacttgttacaaggggccctactgagcagtcttatgaactaatatgtgtggtcctgggatatcagccatggagagaggtcatgaaggtcagatgcagaaggtcactgtaactgaaggccaagttctaggggaggtc

SEQ ID NO: 14182 - DNA, 201 bp, Bos taurus
agcctaagtcaggatcagaggtgggaactgaatgttctcagccttcctgaggggaggtcagtgactcacccaatagagtaagataaaggccaccatgactgaggaagaggtggacctgtgagaccatggctggattcactagagacattggcagaggcttggatgaggaggaagtctagcagggaccacattcagcaggga

SEQ ID NO: 14183 - DNA, 201 bp, Bos taurus
gaaaagctgggcacacacggctgcctacatggcctggttcctaaaaccaagaaaaaggaaagtgagattttccttggctccacgtctgattcccaaatgccgtggggcggggcctcccacctcgagaaaactcccaccctgggggtcccatgttctctgcttggagggtggccctaatggctcgccaccagcagaatgccc

SEQ ID NO: 14184 - DNA, 201 bp, Bos taurus
tcctccatgcagccttcttggattccctctgctaacagaaaccatccttcctctaattcccagggcatgatatttgtgcgtgtctttggctggagttccatcgggccatggtatcacctccctgtcagtccctaagtcagctctggagggccgtcccctaatacggcttctccttacctgctcctccagtaaagggggcag

SEQ ID NO: 14185 - DNA, 201 bp, Bos taurus
ggagacacagaggacctggagggtgcagggcaggagtgaaagagggaaaagtattccgtgtatgagaagcgggtcatggccggaggcaggaacgaggatggagggagagcgcgggggagactgacagacaggcacagggctctgaaccaaagcagatggccgggtcctccctgtgtctggatgcagctgctgtgtctccag

SEQ ID NO: 14186 - DNA, 201 bp, Bos taurus
tgcagaagtgactggagtccgcccctggctgccccactgcgctctgccccgggcctccaaccccagaggtcaggggctatggctggtgcgctggccccgctggctttgcctgggcacttgtgaactccctcagctgctgcctggtgcataaactttcccattgtcgaggcaagctcttctatcctgtgccgggggctcaac

SEQ ID NO: 14187 - DNA, 201 bp, Bos taurus
ccatttgggagtctcttaaaacgtctgcgggaatttcagaaactgatctttataaggaaggtggcagaatgtattggaaagagtgtaaaggcctctgtcaaactccctgggcttgaatctcaagtcttccaaattcctggctgccagaccttaggaatgtaacctaacttgtgaacttgcttttccttctccataaagcag

SEQ ID NO: 14188 - DNA, 201 bp, Bos taurus
gggccttgtcactgaccactggtctagtgattaggagctggtctctccctgcagcaacctaacctcagtctctgacaaggaactgaaaacctgcttcaagccactgcaggttggggccactaaagtcaggaccaggccctcaacatcctctacaatcaccttccctctctgcctctgccatgcatctgcttggatatgatc

SEQ ID NO: 14189 - DNA, 201 bp, Bos taurus
actacttaacaaatggagtagactagagaatccaggtcagacacgcctaagaagagtcacctgctatgcggcaaagagaccactgcaattcagtgggaaataaagatcctttcaaagaacagtgctggaaggtctgaatattcacatggcagaaaaagaactttgacctcatctcactccacatacaaaactaatttaaga

SEQ ID NO: 14190 - DNA, 201 bp, Bos taurus
cagcccttactgatctggccaccttcatttacagagggggaaactgaggccatagaaggaaagaaacctgctaaatgccacccagagaccactgaccatcgaagaaccggcacccaggtctccagtatccattcccagctacatagctctcctctcggcctctagctgggggagcctattacttccacacctccctgctcc

SEQ ID NO: 14191 - DNA, 201 bp, Bos taurus
gtctggtcatgtgtggtcagggaggtctcctgacttcaagaaagagaaacgtgttttctgggtagggtccagcccactcccttacttgtcctgctattctcgtcctggagtttcggtccacagaaaatgaatctccaatcgctcttcccctgggagtccatctacctcctgcctcatagcccgtaatcgaacctgcgtcca

SEQ ID NO: 14192 - DNA, 201 bp, Bos taurus
aaaatggcagtgaaggaatggcctgctagaaaccaataaacaccgacttccttttagagagagagatcaaagcacacacagacactttaatgaacgggtacgcggccttgccctgcatttgccacacaggaattcagaggaccttcatctgccatcccagaaacagccatgctcctcagctggcgaagccttccttcttat

SEQ ID NO: 14193 - DNA, 201 bp, Bos taurus
cctggcctccctgggtgggggaggccccgaggccgtggagtgagcagtcatgcaactcccaccaaacgcagccattgtcctcacatcctgcaaagcccctatgcgtctctggggcctcatttcatgagggcccactcatttcatgacagggcgctcaccttcctgagaggtgaccccaggcccaaaggtccctgcgcaggt

SEQ ID NO: 14194 - DNA, 201 bp, Bos taurus
ataaaaacacaacattgaatatatacaaagatcattttaaaaactttgcttcatgtgtttagaactcagtaaaaggcctgtttagtaaagtttaggaaaacaatgcttgtttgtcctaaatgtcctctttctctggggcaggatgggcgtgaatgaggctgcatcccccactgacttgactgccttgcggctcagggccag

SEQ ID NO: 14195 - DNA, 201 bp, Bos taurus
caactgaagcaacttagcagcagctgcagcagcgcaccccagccactgacatctggtgctgccacagcgtggagaccaaaggcaccaatgagggcctctcgccatctgggctaaatccgccccaaaagccacacgtcaacagggaaaccaccggacccacccactgctcagagctaggtctccagggccttgggtaacact

SEQ ID NO: 14196 - DNA, 201 bp, Bos taurus
ccaggagcacactggagccaggctcaccagctcctggggcctggggacgatcaggtccctcctcaaccgacgtccagtacccaggtgtggcgtatgcaccccaaacatgggccaggcttcctgccacccttacaccgggcatgggaggctggcagtaagcgccagacagcacatcactgggaggaacccaaggtgagagtc

SEQ ID NO: 14197 - DNA, 201 bp, Bos taurus
cgctccttccaaggtgtggggggaggggagagggctctgtggtgtcagcttccagggagagaaagggtccttttggacgaggctggggtccctcaggccacgctgagacgccggggaattttctaataactaataaaaaccgatttacatcttcaaataagaatcttccttaagtcataatcaccaggcccgcgagttcca

SEQ ID NO: 14198 - DNA, 201 bp, Bos taurus
catggcttcccgtcttcagtgagtttggctggagaagctgctcagcacgtggacatctgacagcaactgtctgtgcctcttcctgcaggtggtgacgctcgggtccagcccacacggcggccctataccgtgggcctgcctcccgaggggtgggtcccccctctgccggagccgctgagctgctcaagttcagagagctct

SEQ ID NO: 14199 - DNA, 201 bp, Bos taurus
tttttctggagtttcaacaggggagtcagagcttccttcgtggtatgagaggatactcagggttccacttgagttggtgcaggggaaccaggccatatcttgagttgagagggaattctgtgtccttcaaattgcaccaggaatggtatggttcttcacgagtttcaaggtgagacaggcctcctcttgaggtgtgagggg

SEQ ID NO: 14200 - DNA, 201 bp, Bos taurus
agaaagagctttcatgacatcccgttcacaccatcatattggacatcaggtcactctggggccaggccaggctgacgaagggggccgtgggtgctgtcaagtcttccaaggaccagtcagcatcccacccacacagtggactagctgagtgccagttacaccgcagacccttcctcacctgtgaaggcctcgaccttccct

SEQ ID NO: 14201 - DNA, 201 bp, Bos taurus
tgcaagtgactggcccgaggtttatacttgggtggggagtttgtactgaacccagcagaattctagcccaaagtctccctaccatgtcacactgtcaccccaagctgaggccactgacctatcctctcagcgttagacaatgcccaggagacagagccaactcattggaaaagaccctgatgctaggaaagattgaaggca

SEQ ID NO: 14202 - DNA, 201 bp, Bos taurus
ggagctgttagccccaatctgcagatgggcctgctgaacctcgtggggtaggtggagggtggctttctccagcccacacaatgacttttgtgacagagccaggacccgggccagctctgcaccctcctccaggatgtgtcctgttatacagcagtgccctgaatgcagagttcaaggctgtcagctcttttttatgctccc

SEQ ID NO: 14203 - DNA, 201 bp, Bos taurus
ctggactgagagatgctcttgccttgaccccaacccctgcataaaccgggcccgcattctgcccggaaatcagggttcatccctcagtcagccttggccacgtggcatctttctccttataacctcttcagacacaccccttaatctcagaaaaagaagcttgcaaaccacacaatgcttcataggccaaaatagagattt

SEQ ID NO: 14204 - DNA, 201 bp, Bos taurus
ccattcagacaggaaatgtggtgaacacttctagtcccctgaactaaccagggatgcagaccagggtccaatcagatgcttgcaggagatgtcacaaggtcgctggctttgaggaatcaatcctctgtagggagcatgttaacatcgctgctatgacctgtttacactgtgcagcaagacatgaaacaaacagcgcttctc

SEQ ID NO: 14205 - DNA, 201 bp, Bos taurus
acagattcctggtagcttcacttctgggccagatgttcagtatatggttattcagtgacagagaatgcgaaactggcagtacagaggctttaggggtgacgcaggaaggcagtacagtccctggcctctgattggtgattcctatcaacagttattggggcccagtaagtagaaatgatttaacgtccatttccagcattg

SEQ ID NO: 14206 - DNA, 201 bp, Bos taurus
ttagattacacagctggaggttgagtcttgaggggctgggcaatattggagaggtcaggaggatgccgaagaaatggaagatgggcacagacgggcagctcggaccacaatggccagagcagggctcagccaacaaggtccagagcctcggagttcagggaggtaaacgctgagaatcatgtgacactgtgtgctccttgt

SEQ ID NO: 14207 - DNA, 201 bp, Bos taurus
agatccctccagcctcctacactccaccccagcatcacaggcgagctttttgctctgaactctctgccagtgacatttaagagaaatagaacacaacccacaaacaacttaacatttaaaaggccacaatgcaagcaacttaaatatttctagtagcacacacacagtccacaagaaacaggtgaaattgattttaataat

SEQ ID NO: 14208 - DNA, 201 bp, Bos taurus
caggctcacaggtgaggcaggatccaccctcgggtggaagaagaaggggcaggtggtgttggtgaacttgagcacctgctgagggccaggatctgtgctgggtgatgcccctatgagagcagggctatcacgtgcccatttcagagagcccgagggtctggcccaaagtccctaggcaggaaggactaagacaagctggat

SEQ ID NO: 14209 - DNA, 201 bp, Bos taurus
tgggaggttggccccgagctgctgcattaatggggttaccagcctgacctccaggtggctttgaccttcacttgacctgcagctcaagtggcggtcatgaacgctgagcattagcgtggcctttggggattgggagaagggatgttgcaccgcctctctggactctttgtggaaccgctgagcagagcgggcctcgccgtc

SEQ ID NO: 14210 - DNA, 201 bp, Bos taurus
cagtgtcgcttccaccacattccatcagccctgagacctgaccaatccatgttcaagtggcgggaaatagactccacttcacctctctaataataggaaccgctgctgtgtgccaggccctgcactaagcattctaggtatattttcttgtctgcttatagcaaccctgcaaggaaggtgtataatctcactttatagatg

SEQ ID NO: 14211 - DNA, 201 bp, Bos taurus
ttggctccagaaattctagtgtttcattttcgggagtttctcaagtttgcctaaaggtattacataatgtatgtcatatgcacagtgtctcttttctaaacatctggaaagtcctgaattctggaataatctgatccctggatgagctgtatcaatttataacacctctgaggacttctctggtgctccagttgttaagac

SEQ ID NO: 14212 - DNA, 201 bp, Bos taurus
gacctctctccagtggggagttcttgccacctgcggggcattcaatctcgactaaatgcttccacagcacagagtgttcaatcttaacagctcggtggtacggcctggggagaaggggacggctcagagcagtgatgggatgtgcctaagctccccactccagggcccggccaccagctagagagcagccccaacatttgc

SEQ ID NO: 14213 - DNA, 201 bp, Bos taurus
ttaattttggataagccctggactcagatgcttttgtccagttatttatcttagagcaatgtgatgtgattggaaggcttctgattagactgtatttttttaaatccttggactttcctggaggtccagtggttaagactgtgtgcttccatggcacggggcactggttcaatccctgatcagggaactaagatcccatat

SEQ ID NO: 14214 - DNA, 201 bp, Bos taurus
gcctggtcctggccctggccctggccctgggatgagtaaaggcaggataaatactgacttggtgtgtaagttacataaaaggggcggttggcttgcatacgtgaagtgtgcactgaggggtggatgaaatgctcactgtcattaataatgatccatgtgtcaaatattcgataagcactgactgtgttatactgaacatag

SEQ ID NO: 14215 - DNA, 201 bp, Bos taurus
atgctttgatttgaccttgcaaaaatttgctttgtggtggattctgggaatttaaaaacataagttactaaaagctgcctcactttattttaagaatcttttataggtcaatttccagtttgattgttgcagttttattaagcatatgaaattctgctttgcctataaccactttatttggtgggcgagggaagttttaat

SEQ ID NO: 14216 - DNA, 201 bp, Bos taurus
ggaacaaagcctgagacgcgccgggcagagtagccccaaaacagaaggcagggtgattcactgggagtcaaggtccccctgtgattgtgtgggtacactcagtaatgatgataaagcactcagaaagtaatgatgtacttaaatggacatgtgaagtgcttttaattttttttttttttgacaaagaggaaactcaagtgg

SEQ ID NO: 14217 - DNA, 201 bp, Bos taurus
aaggcacctggtggtaggtagtcttccttacaagggccaatgggattggagggaaggaaaaaagaaagcctgccccttacaggtgaactttgccagcctcggcagctagtaccaaggacaggggccactcaaattctctctccatctccctctctttctttttgaaacaattttatttatttttcacttttggctgcaatg

SEQ ID NO: 14218 - DNA, 201 bp, Bos taurus
atggtggccatgctggccttttccagggagacagagcaattacctcataccaatttagctctccttccaagagctggcctgagagtcgctttgccactctgtttttttaagcctggggttaattggggactgctgtatatttaataaggagcctctgagacaaagctgtgcgggttctctgtcgttcaatagtccattagg

SEQ ID NO: 14219 - DNA, 201 bp, Bos taurus
gggcttgagggaccttgttttactgtcaccagtggtttctctcaagctttgtagctgtgtgaacttggatcttcaattcagggagtgtaccttgtacgtcgcaggcacaaaatcgagaggagcaaggagaggtgcccaaagagagagacggactgtgaaagaacagctattaatttgcaaagtattaagtatgattatggg

SEQ ID NO: 14220 - DNA, 201 bp, Bos taurus
tccaagtcacccagcgtgtcagagatgggccagcaccttggtttctggagtatcaaatgaggattgatttactgggtcggggggcctgaagacttttttttgtaaagatccagaaagcagaaacaagaagcttggcactagggtctcattaagacctccatgagccctgggcactctggcctcctgggtcttctccataag

SEQ ID NO: 14221 - DNA, 201 bp, Bos taurus
ctccaccatgtgggtgggcctcattcaagctgtgggaaagccttaagagcccaaactgaggcttccagaagaagaagaaattctgcttcaagattgcagccttaactggcatcagcctgccggcctgccctatagatttcaaacttagtctctcaaggtcagcttctgatacgtttccagctgcctggtggattttggact

SEQ ID NO: 14222 - DNA, 201 bp, Bos taurus
gactccagggcgggtctgagagcaaagcctatcttcacctcctttttgttctgctcaagcccccagcgggttggacgaggcccactcacattggcagagggtcctctgctttacctgaccactcattcaattctcatcttttttagaaataccctcacaaatacatctgcgttctgggtgtcctgtggcccagtcaagctg

SEQ ID NO: 14223 - DNA, 201 bp, Bos taurus
aaaaagcattttacaacaagtgtggccatcatcagcgtcaaggagagggctcatcacaccggggatatgaaagtgctttcttatttaaaacactctaccagggtttctcggcctgcattgtgagatactgatatattaaactgaaactgacaaaatatatcaagttgtgctaaattgcatttcaactgctaagtgatccta

SEQ ID NO: 14224 - DNA, 201 bp, Bos taurus
gctggcctgatttgctcagccaaagtattctgttatttagaaagtttctctgcggctggagtggcagaagaaccaggcggacggctgtctatttttgctgtcttctggttgggtggccttggacaagcctcctaaatgccccaaggttcagtctcctctgttgtaaaatgggaagatggagatcagttaataagctgatat

SEQ ID NO: 14225 - DNA, 201 bp, Bos taurus
agctttaggggacaagtctgtgacttgcttattttggaggccccatgtcgttggcacaccgctagggctcagcaaactgacttcagttggatacaatggttgcattaccctgagcagttttagggccccacagaaatattttaatattcatttattttaaaatgaaaacaaagactaatgacaatacagttaataacataa

SEQ ID NO: 14226 - DNA, 201 bp, Bos taurus
aaaatatgtcagaatcattaaccattaggaaaatgcaaattaaaaacctaatgaaatatcactacacacctatcagagtggctaaagtaaaagatagtgtgtatctgttaatcccacactcctgacttattcctccactctgttatagataaaaataaggtcctacggtatagcaccaggaattatattcaatatatttta

SEQ ID NO: 14227 - DNA, 201 bp, Bos taurus
gtcaaaattgaatacaatgaccaactgccatgtacttacaaaaatcaaaattcaggaaatctgtaacatgataaattacaaaagtttagcattaagaggccgctagcttttaggaatgctcattctgtttgtcacactaagtcctaactctgttctgttataaacatgcatgcattttcttaactgtattgctatcagcag

SEQ ID NO: 14228 - DNA, 201 bp, Bos taurus
caattacttgtgatttaaatagtggccatataggaagcttttcagcctgaattaatgtagtgaattccaaaccaaggaccctgtggagtcacatgaagactaactgtgggccacggtgctgtgctggaggactgactcaggtctcttcctccttctgggaatgtcacccttggaggtgacattccagagacaggcatgagt

SEQ ID NO: 14229 - DNA, 201 bp, Bos taurus
tcagtactcatggcaaactcatggggtaagaacggccgtcactctttctacagctgggaaagagttgggttggagacgttggccacatgacatggtcatgtagtggatttcatcctgactcttgagcatgggtaactgcaagtttcacaaagtttgtttattcctgcagagcaccacaaggccttggactatcttacactg

SEQ ID NO: 14230 - DNA, 201 bp, Bos taurus
ctgctgtgtgccaataagagggtgtgaccaagggggttcagtgtgtgcaggtgggggctggctcttcaccaggagctcagggaccatcagctggcctgtccccttctgtcaccatcaggactcacatctgtaaactgatggggatgagtccctaccctatggaggtcacttcaacattaagtaagcccatgcacatgaaac

SEQ ID NO: 14231 - DNA, 201 bp, Bos taurus
gcttgttttgcattggcctgaataggtcacatggtcacccaaaccacaaggagggctggtgagtggaagatgagggggagtccagcaagaagtgggagtgagtctggatgaacacaggagggcctctgtacttacctgcaaacacacacacagaagtatgtgcacttccagccctggacctggacacaggggtttcacaca

SEQ ID NO: 14232 - DNA, 201 bp, Bos taurus
ctggggcctgaggcttggcaacagggtatgatgggcctcggctgccccctcctagatgcttttatagtgaagcttccattgtaccagtttctgggggtgttgagggcccttcaggaatttcctgggctgcaaagagccatgttggcccaaattccagcttcactgaactagctcacacccataagtggtccatgggacagt

SEQ ID NO: 14233 - DNA, 201 bp, Bos taurus
tttctataagccaaggaacaccagagtgccagtgggccacaaagctaggagacagacacgggatagcgcttctcacttgcagccctaagcagagaccagtactgctcaaaccttcatcttggacttcgagactccagagctctgagacaacaaattcctgctgtttaagccattctcatgatgataatgtgttactgcagc

SEQ ID NO: 14234 - DNA, 201 bp, Bos taurus
tggatggacttattttatggactaaaataagtcaccactgattccaggaatcctctgaatcctcagctgcccctcatattttgcagcaacatgttggaaaatagataccaggcatgcaaaagctgacacaacactcactgtgtagggaacaatgccctcagcttgatcctggactaaccttggctcaggggggctgcatct

SEQ ID NO: 14235 - DNA, 201 bp, Bos taurus
ctcctgcattacaggcaaagtctttaccactgagccgccaaagatgctcttgtctagttctcagaatctgtgaccttcagtggccagaacaagaagggggctcaagaatacccaccttcagtcctgcagacgagttctctgaagaagggaacggccaaggggacaaggatttcatgagcagctacttgctcctgtgcaaac

SEQ ID NO: 14236 - DNA, 201 bp, Bos taurus
ggaatagagtgtggccaaataaacaaataaaaagtttttaaaaagaaaagaaaaataggtactcaggtctccatggttcactaaagagtattgtgcctacctccatggccgcctcttcggggggtgactgtgaaggggtcttggcctctagagaggaatgggtagagaccgatgccctggacttcatgccaggctggaatc

SEQ ID NO: 14237 - DNA, 201 bp, Bos taurus
atccggggctcctagggagctctgtgcctcgaaaaggggaaatgccaccctggacaggcagagggagagcaagcagccaatgtgttagcatcctctccccccagcccaccaccaaaaaaaaaaaaaatccatcagtgacggacacctccctccagaacagggctcagccaccgatgagtgccaggatgtcaggggctgccc

SEQ ID NO: 14238 - DNA, 201 bp, Bos taurus
aggcccacagcagcacagcggaccgggagcggcatcctttcccaggaagaaaaggtgtctgccagcagagggcctgcagaaccttccgaggcgcctctcctctctgtgttctgcttgggcaactggttggtttggcctagaagcaagatggcaatcataatcagaaagggaagctagattttttaaataacttaaaaaaat

SEQ ID NO: 14239 - DNA, 201 bp, Bos taurus
tcttatttgatcctcagagccctgcaaggagggccttaggcttcgctgttgacaggagagaacactgaagctcagaaagggaggtggccacccaccgagggggggcaaggcagcgggactcctctgcaacccaccccccaccagccgcccctccagcaggagggtccccactggcccccacgctgtgcctgagctgctggc

SEQ ID NO: 14240 - DNA, 201 bp, Bos taurus
ctgtctctgcctagggggacggggtcccagagtccccacctttgccaccttgtgcccattttccgctgggagtggagggccagtcttatgtattagggggcatccacagctgttcagcagagcggcagggggaggtctctttgctgtgcaacccaggcctgcagccccagggcagaggtgatactagccaagtgtgtgaat

SEQ ID NO: 14241 - DNA, 201 bp, Bos taurus
gagagcttgtgacatgtggtagctcaggtcccaggttgatgagagccagtccatgcaacaaacctccacgtgactgcgatggcctctaagtgccccaagttatcaaagcctggtttctgatagaagtctgtgcacaacatgctctgcaggtgcagccactgggcagacagtgcttcggagcctgtcaggagttggccctgt

SEQ ID NO: 14242 - DNA, 201 bp, Bos taurus
aagcaaattcaagcagttttcttattcgagttcaaaatgggtcacagagtagtggagacaactcacagcatcaacactgtatctggcccgggaactgaacggcgcaacggggcttcaggaagctttgcagaggagacgagagccttgaggatgagggctcagtgactggccgtcggcagctgacagtaaccagttgagagg

SEQ ID NO: 14243 - DNA, 201 bp, Bos taurus
ccgagccgtgttgacccctgctccccttccgcacagactcggggacacaggtgtacattggaattggaaagtgtgtgaggttggagccgcccttgtgtctccctggcctgtcagctgggtggcctcgagaggaagagtgggaaggcttgagacgggctcaggctgagggtgtcagactctcaacagttggtctgagtgttt

SEQ ID NO: 14244 - DNA, 201 bp, Bos taurus
ccctcgccacacgtgtccctccctaacccccgtggtcttatggccccactgcagacccagtggaggttgtgggaagggagccatgaggcgtgggggagggtggtgacatccacagggccgtgtgccacagtccacacgttttgtgcagggccatcccgccaagggacacactccgggcaggctgcctgtcgccacgtctcc

SEQ ID NO: 14245 - DNA, 201 bp, Bos taurus
gcgtgtcctaatgcaagtgaaggaagccgtttgccggctaagagttaagtactttagggatacaggttaatgttgaggccaacatggcgaaagttaataaattgcctctcccgtgtatttgtctgtgaagacgccgaagagtaatttgcttcccgcagagccgcgccagattctccacttactttattaggtttgtggccc

SEQ ID NO: 14246 - DNA, 201 bp, Bos taurus
ccggccggtgagggcgtcctgaagtgctggctcccaccagggcggctgcctgggagacgcagcgcccttggctctgggttctgggcaccatccgtttttgcggtgttgcaggccggtggcttatttgccctaatgaggttttgattactctccatttgtctctttcatcagctttatgttaaaaagcctttttatttggat

SEQ ID NO: 14247 - DNA, 201 bp, Bos taurus
caccctaatgaattgggccatttccatgcattctcaggaagtgtacagaacaagggttttcattctcctggaaaagtttgtcttggggaggcaaggtggcgtgttggtgggcacgcaggtagttctgcaagggtcggctgagcactccggcacttcgctcctccgggcttcgacgccgccctccggggtgaagcttcctcc

SEQ ID NO: 14248 - DNA, 201 bp, Bos taurus
atctccacacgcctccacgcctgcgcctgctgtccgccacccattcctccacgtatctatcctcgcatccacacgtccatgaggaggaagggttggggccgagttcagagttcagagttcaggggcacgcacttgagccatccagaccttccaggaagtctcccgggacatggaactccctgcaggagtccctgattgctt

SEQ ID NO: 14249 - DNA, 201 bp, Bos taurus
ccttttcactggcgggggcgcagaggctcagggcgggcccaccggcccatgccgctctgggcaccagcctctgtcattgccaggcgccgctctgcctgcagcggagatggattcgcaggcctgggtcctgggctggcccatctggagtagagatccctcatcctttgtaaacgtgctctctgaaggagctgaaaaggttac

SEQ ID NO: 14250 - DNA, 201 bp, Bos taurus
gacgagcgggagtcacccctgcttagggtaagtgtgtctcgggtgagcatgcaatgaacgtgctcgcatgtcactcggcccactacccaagattgttccaccacttccttacaggcagctaccttggcaggacaggcaatggatttctcacaagtgttcacttatggtacttgaagagaggctggccgtgatgaattcgat

SEQ ID NO: 14251 - DNA, 201 bp, Bos taurus
cccagagccctgtgggcgggcagcagagacctcaggtcaccccggggaggcggggggtgctcacggctcccatctggcccagtgcccccctcggtgcctgcggttggcaggaccacaaagagggttttgttgaccccctgcaagggcaggcccatggggggctgacccctttcatttccaaggcccctcatcaccccattt

SEQ ID NO: 14252 - DNA, 201 bp, Bos taurus
ggttctgtccaaggcctccagctcagcacatttttcaagagctgctatttcaggctagagtgcccaacggagaaaagcgcttgtgaatgggaggcaaagtagtcctctcatggccaaggtgacagggcgggcagccagcaggcaggggggctgcaggcaggggaggctgttctctcaccactcaagtttctcccgatggcc

SEQ ID NO: 14253 - DNA, 201 bp, Bos taurus
ccagagcctctctcccaccatgagatgagtcactccgtgtccagggtgggcaggggccgaacagactcccgaactggccatgaaaagcaccctgaagatccggttgcttgagatcaaagtcaggtcagtaattacaagaacggaagcatggtttgttccagccccttccctgggcctcaccatctgtcgcagactcaccag

SEQ ID NO: 14254 - DNA, 201 bp, Bos taurus
ctccaaaccgcttagttcagctttcaaggcccgacatgatcaagccccatctagtccatggtacatttgctgccacgtctccaggatcccacacagatcaatcctgtttccctatacaaaccacggcctctatgtgctgctacgttcagctgagacccagtgtaacttctctgctttccagagaactcaggagctcatccc

SEQ ID NO: 14255 - DNA, 201 bp, Bos taurus
gtcatcccagccccagggcactaaggggttggcaggcacccgacctcaggggtctgagtgttcagtctggcgtctcctgcagtgggcctggtgtggccagattcttcttcccaaaagcacctcatctgctgagaaaatttgggaggaagcacagggcgagtcttggtgggactaactacacgagggggtctggggggggcc

SEQ ID NO: 14256 - DNA, 201 bp, Bos taurus
tggggacgccgaggccccgcctccaggccttccagccccgcccctccccgagcacacgtggctggaggaggggctccagacccgcttcttctttcctctgagggtgggggtgccgtccagggccggcgtccccctcctgtttagaaacccggaagcggaggcccagagaggccgaggtcacctgtgttgggcctgcctccc

SEQ ID NO: 14257 - DNA, 201 bp, Bos taurus
gagaaacatcatctcacaccgcaagtgggggaggaggccccacaggtgctattttagtgactcggggcaggtagggcctgaaagggccagctgggggccctacagcctgacttattcaccggatccctgggcacgccaggtgtcctcacgtgcacaatgtgtgttcctgcagtaagaacagaggagtgagcatacgtctct

SEQ ID NO: 14258 - DNA, 201 bp, Bos taurus
tttagaaagactggaaatcccaggaccagcgaatggaaacaatgaacaagcaggggttcgattctgatgttagacaaggtaggattcaggccaaaaagcattaaatgggacaaagggggtatgttattaggcctgaggggacttaataggaatgcctatgcaacaaataacacagcaaccaccttcctagagagaaggcta

SEQ ID NO: 14259 - DNA, 201 bp, Bos taurus
cacagcctacttgccatgacgtcaaccacctaacagccaccgcggaaagcgtctccctcctagtgggcttttccgcaggccaagtccagcttatagacccaatcaaaaaagaaactagcaaactatttaatgaggaagtaagtagcaccctgtcttagctgttaagaacccctataagaatgtatacgttcttaccgaggg

SEQ ID NO: 14260 - DNA, 201 bp, Bos taurus
ggcggggggagccgtgaggacccctcagagaagcacaggccaggtgttggggctcagaggaggggctgggagcccatcctgtaggcttcacggccccacttggcgctgtgttactccagcgcttgagagtcacgagtggcattgactctggctgccctgtggagggggcgagggcggccaccacggaggccaccagggtcc

SEQ ID NO: 14261 - DNA, 201 bp, Bos taurus
gcgactgatctgatctgatctgaaggaatccagctcatgtcacagaatgaatgaatgttgggctcttttctgagagtggccctttgttcctcctgccacccgccaccatcatggtggaatcatagcacacctgtgataggagggggatggaaatcctccaggcctcttggtcaacaggagaaactgaggtagaggtggagc

SEQ ID NO: 14262 - DNA, 201 bp, Bos taurus
agttgaactggattgcccacctgggaaggaggacgcaggtgtcccgaagctgttgggcagtggctgccagcatggcctgccagagccgtgaagagacacatcggggcacagccctctccactctgtggcggccgtgagctcgccggcccgagcacaccctactccttccccagcaacgagctggcgcccttgtctgaaacc

SEQ ID NO: 14263 - DNA, 201 bp, Bos taurus
acgtgtggctgtgactgggaatggactgactccagaggcctctgtccacggctacaaggtcggcaggaggacttccgcctcttgactatgtacgggctaagtgaacaaaaaggccacaacctcacctccacgtttcctgtcttcaagactctagtgacactgggaatgatacacaacttcctatgatgcttctaagcgcct

SEQ ID NO: 14264 - DNA, 201 bp, Bos taurus
cctcgtgctcctggcggagagtcaccgtgtcctcgagctgccgttccagccgactggagtctgagcgaaacaggaaacaagccgggatcccttacacgcgcgtggccgccagcacatctgacagaccccccagacttggctctgacgtgtgtccacaccctctccctggggacgtgagccccggggcgcctgcggcccgtc

SEQ ID NO: 14265 - DNA, 201 bp, Bos taurus
ccgcgcggtgccatcacctccattcaagctttggagggtgcgtgtaggggaggggaccggtaggagaactgcagcctcgctgaggccagggagcctcaggaatgtttggtccttactcttcatttggcacaacactctcttactgcattggcaggaacaccacagcccagagcaggcagggcctcccaagggcacacagcg

SEQ ID NO: 14266 - DNA, 201 bp, Bos taurus
gtgactaagactgcgttcccaatgcaggggtctcaggttccatccgtagtcagggaactagatcccacatgccacagctaaaggtcctacatgttgcaaccaaggcctggcacagccgaacatatatataaagttttgtaagccagaagacagcgggccagtatatgcaaatgctaaaatttaaacacttgtcaaccaaga

SEQ ID NO: 14267 - DNA, 201 bp, Bos taurus
aggacatgggtcctgctgaggcgatcatgcagtctgctggaggcacagtttgggaagctgctggaggttacttgagaggtggccttgcacagttgtggttcgtgtctgtgagtgaccatcagtgacggtttcctgagaggatgcagagtggaggagtccatgagtttagtaacattctctgggccatttgggagacccgaa

SEQ ID NO: 14268 - DNA, 201 bp, Bos taurus
ctttattttcagaaggctacttcatcggtgactgattttctgatattagacccaccttgcgcccccagcgtaaacccagcttggttgctatgcgctggcctttctgtgtactgctgaatttggagtgctgattcgtctagcttccatctgcagtggaaggctccaaccctctaaaaggttttcagttcccacccagaggag

SEQ ID NO: 14269 - DNA, 201 bp, Bos taurus
actgcccctgcaatgctgagaggtctactccctgaagtttctctacaaaagaggaaaacgaggctcagagaggaaggatctcagggtcccagtgttggtccgaggccaggttggctttaaatcccagtctgttttcaccaccagggccagaggggcccaaagaaggccactgcggccagaaaggatggcccatcctgtgcc

SEQ ID NO: 14270 - DNA, 201 bp, Bos taurus
gcttcagccatgtgctccatagtcggcttggaaaaaccagcctttagccttcgttgtttggggtgggcacaggcaggttttgttctccttctaaactgagcgtgttcaaaagattgctggtaggtatgtgtgtgtaaatttgccatgcccagatgcatccttagagcaactgtctgagttactcatgaaagccattgtgta

SEQ ID NO: 14271 - DNA, 201 bp, Bos taurus
gaaccccatgccactgtgtccttgacccctgatggcggcctcagggcatggaatctggagtgaatcccgggagagcaggacaaggacttgtcaaggggggacggggtacccaggcccccagggaggagaggattccccatgcacggtcctagggcttccaggcccccaccgatcgccccttctgctgcttgatcgcccctt

SEQ ID NO: 14272 - DNA, 201 bp, Bos taurus
cgtgggcagccttcctgttagctggcgtccactgctctcaatgggcagactctggcccagggtcgtgcagtcagggacaggggggcggggggcctgcccattgaatccagcaccaagttcttcctcctgttaccgtgtagatccagacagccatgccagaggtggcaggacaccccatggccctgcttcaaaccccggctc

SEQ ID NO: 14273 - DNA, 201 bp, Bos taurus
gaacattcggcacagggtagacaggaattctgtgctgtttctgcaccttttctgtaactcttaaaactattctaaaataaacaggccatttttttttaattgcatttactacggcatcattgagacccatcgcctacaagatccggaacaagaaaggagtggggagccagccccctccctcctgttccccacccccagctc

SEQ ID NO: 14274 - DNA, 201 bp, Bos taurus
agaaggcccactcccagggggtgctgctggagcagagacaggactggggaggagccaggaagggctcttggggagacttgtgtggaacctgaggactcacgaaaggccccagggtcttgccgtgtgctgggccctccagttaatctcccccgtttgcagatgagaatattaaggtctggagaggttaagggtcatgcccaa

SEQ ID NO: 14275 - DNA, 201 bp, Bos taurus
tggggccagctgcccactgacaccccgtgccagctcgtcccattctcctctgttcacccatccaaggtcaccacgtgaggcttacccacatctggatggatcagctgcagcagcggcctccgcgtccggcagacattcaaggcccctggacccagcggggcccggcctcatgtctgctgtcctcagtcagagacaggggta

SEQ ID NO: 14276 - DNA, 201 bp, Bos taurus
tcggtccccccggcccacagccacctccactgcagccccggctgccaccagcttccaggtcaccctctccagcctggctgtctgcctggcccaccaacaccggtgccctccctggacctttggagctgggctccagaccagccctctctcccgacctctgtccttctcatatgcagcttcctctgccatctcactgtcatc

SEQ ID NO: 14277 - DNA, 201 bp, Bos taurus
gggtgtccacgcggctgggcgcgcggcgggggtgggggtgccacttacccggaccaagcgtgctccctgcagcagccacacctgcctgccagtgggcgggcggcctgtcatcagctaaggaagagatccctccgacgaaagagcccagcaggcggcactgacctttgtaaaattttattaaatcaaacagcccggacaagc

SEQ ID NO: 14278 - DNA, 201 bp, Bos taurus
aggaggccgaaggcccatcgagaagggccggacggctggccctgaggcggtggaggtgacggcccgcagggtgaccccaaagtccaactgcgccctcatctgtttccccctgtttttaaaatcctagtaaaacatactaaggtgtatgtatatggagaaggccctggcgcccactccagtgctctctcctggagacaccca

SEQ ID NO: 14279 - DNA, 201 bp, Bos taurus
aataattcctaaactaatgatttctttttcttatcttatgcattggccagggcttccagaataatactgaacagaagctgtgagaatgaacatttttatattattaccagcccaaagggaatgcatgcaaattgtctccgttaaacttgccacagatttgagggaaatagtcattatttgttgggaaaagtcgctttagct

SEQ ID NO: 14280 - DNA, 201 bp, Bos taurus
aatcagaagaacgcaggattttgaagacctttgagggaactccatgcccatgacgtaaatggagagaagtatgggagggcctcctggccaggctactaacggggcttttctaagccccttttactgggtcaagagtgaatcatggagccctgagtgtctgggcaaagcaggagcctgaaggccagggaccaacctccctgg

SEQ ID NO: 14281 - DNA, 201 bp, Bos taurus
ggtgggaaggactccactcggaactgcgggaactggctcctggtgtaagaagaggacctggggctctgggcgcagactctggggccctaattaaccttgctttctttgacttgtgcaaacctgtgaagaccagctggatggcagtgactctagaagtacatagattaagctagtggccactggattatttagccatgggct

SEQ ID NO: 14282 - DNA, 201 bp, Bos taurus
ggagggagagggtaggtaccactcaaggcctagttaattgttgataggcctttgggctttttcacaaaaggctaaaaaaccttgctttttctgtaaagtttccttgtcataaaactactgtgggccaaacaaaacacatacatgggcgctagttggagataactgttctcagctcagcttctagtaagggcttgaatgatt

SEQ ID NO: 14283 - DNA, 201 bp, Bos taurus
cttaggaaattactcttacctagaggcagagtccaactactactatagctctatgctagcagacaggctgcctgatggaaaggagaggactccccagcccgcggccccacagtacctctttgatagctgactcacacacagcgcctggacctatctccgtgttcacgtagagtaaggcgtacagataacctgcccgtccat

SEQ ID NO: 14284 - DNA, 201 bp, Bos taurus
tgtgagatttagtccagtgaccaaaggatgaaagacgataaaggaaaagaagacagagatggcataatacacccataatacattccttgggattttccaagttcctctcctatgcctaggattctagaagactggctgtgccttctgggtggcatgctccaggtcctggcaggacacatgaggttctgttccatttctttg

SEQ ID NO: 14285 - DNA, 201 bp, Bos taurus
gagctgaggctctggtggagagcagggccttgccagcttttctaccatcacatccccagtgtccagaacagttcttggcccttggtggccaagaagtgttaggtactgtgaagaaagctggtgttctgcagcaagtgcctaacacttctcttggcacagggtgagtttgtaaatgtttgctgtagtaggccggtgtccttc

SEQ ID NO: 14286 - DNA, 201 bp, Bos taurus
gtggccagggcagaggcctgacacagactcacgactacggatttcattttaactcttctgctatccttgggtggaggaagctgacttcatttaaaccaagtgcatagctgggcctcgtttttgtctaagaattagggaatcctaaatttctaccaataaactcaatctctttccctttagagtacaaggatgctgaccttt

SEQ ID NO: 14287 - DNA, 201 bp, Bos taurus
ctgcacagtggccaagggcaggtgcactcagtactgcagctcaagttcacctgcaccacagcttcctgggacctggcctttgttgggagtctgcaacacagagcaaagaagaaagcagatccagggtaaacacatctgcttcataccagcagcaggaatggccaagaggaggatgcatgtcctctgtgagtgccacattct

SEQ ID NO: 14288 - DNA, 201 bp, Bos taurus
ttactgttttcccctcactctttctagagaagcacagttatctgcgacttcctccagcaaaggcaatcaacaaaaagcaggctcacatttccagggcagcgtttcagcctgccttccctgaaaacattgttcatgtgaacggacccttttcattaagagaatgtttttgaagctatctcaggcgggcagtgggatgtgtct

SEQ ID NO: 14289 - DNA, 201 bp, Bos taurus
aaataaagttagtttttgttattctatttttagctctctttcctgcccctgccgtccaccaaaataggaaagttggatttcatttcaagtttgcaatttctcactgaaagccccactgagctcttcttgttcctttgttttctggtgggaaatattttttctctctttctgagggagagtacgctgcaaaccttctctcat

SEQ ID NO: 14290 - DNA, 201 bp, Bos taurus
tgctgtttggcctcatattgtttatgataacgtatcaactcagacataagagggagacagatgttgcttgagaatcattcctctcatcaatggcatttagcgattctgcaatactctggcctggaaaatcccatggacggaggagcctggtgggctgctgtccatggagatgctaggagtcggacacgactgagagacttc

SEQ ID NO: 14291 - DNA, 201 bp, Bos taurus
actaaataaatatttatatgtttatgtaaaactcacaggattatgtctggcacatagagtgttcttaccagatgctaattatttttataattctgttccagtaatttgtgttgtatactcatttggaagttatcacaaaatagtttttatcataatatacatattggtgtgctgctgagaaaataactcaacctgattttg

SEQ ID NO: 14292 - DNA, 201 bp, Bos taurus
aacttacaaccttttttattatacctcctcacctctcccctctttgttctataaaggaaactagcatccaaaccttgacaagatgggcctttcagacactagtccactattttcttgatcttctgggtttctgaataaagtcattatttcttatcctaacaagtcatctcttaatttattggcctgttatgtagtgagcag

SEQ ID NO: 14293 - DNA, 201 bp, Bos taurus
aaacaatgtggcccatgagggacctggaggggctgcctgtgaggtggctcagcccctcccacagcagggagtcaggccaacccaactgccctgcaggacactggatcctcagagaggtgacatgcagacagagcaaataagctggaggctcattcaggcctgcattagagccttggcaatcttccaggagtgcctactcca

SEQ ID NO: 14294 - DNA, 201 bp, Bos taurus
gggctgcctcaaatatacacgaatgggacgataacacttcctacaggaaagatgagtattgacgttgatgtcaagtgtagcccatgcacacgcatacacatgtcgtatgcatgccgtggtctccactgatgcatgctaacaggcttggggcggtgaagtcttccagctgcctgactgggatgcagcagcggtggaggagac

SEQ ID NO: 14295 - DNA, 201 bp, Bos taurus
aaggcccttaagcagtaactggccccacccacaggccacacaaagctagtccactggtgctcgtctattacagtgtaacagataattctctggaggccgcgtggaaaatgttatcattttggctttctacaaaaatcttctcaatgatcatgatctctatcagatacctctctcggcccagtctaggtatagggtgatgac

SEQ ID NO: 14296 - DNA, 201 bp, Bos taurus
gtccaatagaaatatacctgttctgttctttaaaaaaggagaagggtctggaagtgatggcagaggagtgggagtagaggctgggcggccaacacagacttaaatccctcacaggagatggacttgaaattgatggtgggggtgggggtcacaaggatggggagatgtgctccttctgtatctgaaataaagaagaagcct

SEQ ID NO: 14297 - DNA, 201 bp, Bos taurus
cagttttcaaaccttgtttttgctggccctgaagtcacttcctcaagctgtcattcagaggctgccccagagattctaatgtaactggtctgtagggaggcttggccttttggatttttgaaagatcctgatgatttaatagaatcagtgctagagtaccacgaagataactacctataaagaaactagtgactaaatcac

SEQ ID NO: 14298 - DNA, 201 bp, Bos taurus
ctggctcctgccccacccctaccccattgcagttcctgggcaggaaggcctgcccaggatacctgggtttcagcgtgcccagctggcaaccactgtgccccgctggtcctcctttaatctggaggcctgcagaaaatggtacaaaaccgccgaagtgtgatgacaccaattaactacctcttggcattttccttggaaatg

SEQ ID NO: 14299 - DNA, 201 bp, Bos taurus
ggtaaactaattaaatgatcatattatttctgcctggtattagaaagctaagaaaataacatatcacagtcagaaaaaatagaaaatgggaatctactacgcagtaaaatgaaagaaaattacttggattgttcaatgccgggtcagtctcaaaaggatccagtacagacacttaacactatctcagagggggagatagtg

SEQ ID NO: 14300 - DNA, 201 bp, Bos taurus
aaaatttcacaagggagactttatgcttctggcctggcctaatagctgtatcacacacatccttctgtagaaaacaatataaactatgaacaaaatttaaggagaaccacctgaaggccttggaggataaacaagaacagatggaattcaaaggaagtcaaacactgatgtttgactgagaggaagctgctgctgctcctg

SEQ ID NO: 14301 - DNA, 201 bp, Bos taurus
tccacctcgcaaccccccccccccccaacctctgttgtctaaatcccctcactaactcattattttaacagttggttgcttgtgggcagggcccactgctgcactcttcagtggctgagcaggacccctaacagtcgctcactgacagttgttgaatgggcggggcccactgaggcactgactaataggtgaacgggacac

SEQ ID NO: 14302 - DNA, 201 bp, Bos taurus
taaatattttaaaataaaatgacaaatatcccaagatactttaaatcctatgaaaggggcagatccaactgagagctgcaaccatggctcttacgatgaactcttcacatggacgtgtgcggctgcctttccacatttctgagtctgactctcagctttatctagagaatgctagactcactggccaaaagagaataaatg

SEQ ID NO: 14303 - DNA, 201 bp, Bos taurus
catgttttttatgtttttacattggattgaagagcttgttctcactctcagcgtctttgtgaactttgttgccatgcagtggagtggtgcagagttccctaacttcagttctactgatgtcgacccacctcctttgctgcagtactgccctgtgaatggcatcctgtgaaatgccccgtgaaagcgcatcagggacccgac

SEQ ID NO: 14304 - DNA, 201 bp, Bos taurus
tttcatcattttcatcaactgttgcttgtaagaagattctaaaacttgtagttgttttattgcatattcgtttttctccaatgagaaagggttagtgtaatagttaatttgatcttacaaagagtttctaaaactaggcacagacacagatttgagtggatgaacaggatttgttctctgtcccagaccactgtagacttt

SEQ ID NO: 14305 - DNA, 201 bp, Bos taurus
aaggcactctttggctctcccaagaaatggggaccaagttaacgctggacgatcattagggcgctgctgctggtattcagtggagcagtgcggtagggttgagggtgacacagggggccctgggaggtgcaggatggcagactctttaagacccgtgtgtatgcacgtgtacgcacacaggtgtgtgcacgtgtgtgagag

SEQ ID NO: 14306 - DNA, 201 bp, Bos taurus
tggaatgtttactctagaagaagctgtctgtcacgcagaggccccattaccctaagattacagactatgtggagcctggatcaccttgtgaagaggctgcatgaaaagagagagatggccaggcaatcgccacctggtcccagtgtcttgcagaagtagtgaacctgggagaaaagatgccttcagatgatgctaactctt

SEQ ID NO: 14307 - DNA, 201 bp, Bos taurus
caacacatggtgcctcctgcaggctgagggtgggggtgtgcaaggctgctcagggatgcatgggtatggattgagagcaggcctgaaccccacctcggctcctgctctggctcccaccacccttgggtagccctgggcaccactgcaagcccagggcccagactctggttttcattttgattaaactagcctcttaaatgt

SEQ ID NO: 14308 - DNA, 201 bp, Bos taurus
tacctactatgagccctgctaaaagtcatcacaaacccctgggctggtttctctttgattggctccatcattgtagaggagggattttaagaaaatggcattgaaatctgcttctgaaactttgtccccttatggtcccaagcatgagggaggggcctggggtggggaacttctttccttcacgtagaacgaagaacggga

SEQ ID NO: 14309 - DNA, 201 bp, Bos taurus
caataatgagtatgaagatactgtaaagaagggcagtggccttatgttgatatgcattcagttgtacaactagggcacaagaaacattaccaggaaattttaagagatattatttagggcccaactcctgaagtatagtggccaagttcatattctagaacctttttatgtaaatgaatccagccccagtcctgaaacttc

SEQ ID NO: 14310 - DNA, 201 bp, Bos taurus
ttttgcagaaagtaatgcctgttgccaacaatttgttatgtaggcaaatattgaaataatcctgtcgataatgttcaggtaacaaaagatgtattaacaccactctggtcaataagttgctaaataacatacttagccctctatttcttgatcttaaactttgaacagtcctactaagtaatatgaggatattgttaaagg

SEQ ID NO: 14311 - DNA, 201 bp, Bos taurus
aattgaacccaggccccctgcctcgggagtgtggagtcttagctacttgaccaccagagaagtcccccgttgttttaaatttggagctactttcctgaaaagatatctagaggttaacaaaaatcatagttatcatcttattaaagaaatgtaacatattttaaatcctgtgtttcctgacttgttgggtaccctgtagtg

SEQ ID NO: 14312 - DNA, 201 bp, Bos taurus
gtgaaccatcaccctgtgagtagtaaattcctcttacatttgcctaactcctgcaatacagggcatgctaaaatacagccgtaagactctccagcacatctatcagcttggcattgctctctcatgccccttaatagaataaaatggagagatgcccgatgaatgctgacaaggacaatcccagatcatttttatgagagc

SEQ ID NO: 14313 - DNA, 201 bp, Bos taurus
ggcttctgtggtgcccggccccccagtatgcttgtggcttgataaaacttcagcttgttttagataaccacacacaagacccgtgggttatgatcagaaagccttggctttttatatggccattgcgcttggaaaacgtcatgcagcattaacctgatctggaataacttaaatggctgatcctgagtgcttggtgaaata

SEQ ID NO: 14314 - DNA, 201 bp, Bos taurus
tggaattcgtggcaagcttgccttcctctgaacaatctcattcttaatggtcttaaccattctgaactgacatgccagaaaattgagtttgatgtatcagtctgtcatgacaaatttgtttgctactttgtagtggtatcaacaacatatgagtcacttactttgcatgggagccagttgttagctcttgatgtgaatgac

SEQ ID NO: 14315 - DNA, 201 bp, Bos taurus
aggcccatagtttcctcccaatggaggaaactttttgcctttataaatatgtattttttttaatactatgcaactcatctttctcaacactaccaaaagcttcttggtgatccatctttggcctgtctttttgaatctctgctgctaattccttaaagtgaattagaaggaaaatagcaaagaatagtttgaaatgcactt

SEQ ID NO: 14316 - DNA, 201 bp, Bos taurus
ttaaacataagaaatgtttaatatagatacgctgaattgagtttcaatacattgaaactgtggtttctcaaccacactgtgtcttaatacattcaatcagcaaatagttattaagtgaaagtagaaaccaactgcaatgattccatacagaaatattttacatagtgtgttcctctttgtaaattttaaaatgtttaaatt

SEQ ID NO: 14317 - DNA, 201 bp, Bos taurus
tgtttggacctgtcctttggatctcagggaaggtcaaggagctggaatgaaacctatgtcctacaaacaagaagtaggggacaggaaaaggatttgtatccagtagggccccacagggtcccacgcagtttcaaaatgtcattcaatctgtgaaaaaatttgccaagtaagccctaggtagttacactgtgaagtgacatg

SEQ ID NO: 14318 - DNA, 201 bp, Bos taurus
ccagctgatgggtcttgctgattcaagctgtcacctaccctaatccattctctctccagccaccagagccatgtttctgccacacacatggcctgccttcgacccttccacagccttctaagcatcaccctcggtccttactgcttgtccacagcccttcctgaccctgggcctgctgctccagactcaccttctactcct

SEQ ID NO: 14319 - DNA, 201 bp, Bos taurus
atcaaataaaacttttcttgtggcttccttcccctctcctataatattaagttttcctttttctaatctttctgagttctatttcatgtcacctataaaccttaaatcatccccctacagaatttaataaggagaatgcatgacagccacaagtttgaacagttttctgggaaacatggactttcaaactaggggccccag

SEQ ID NO: 14320 - DNA, 201 bp, Bos taurus
ttaacttttttaaattttttgctggttgggcctacaaaggcatttctgcaacagctaattatcttgtgccagccactttgaacagttagctagaggatgtttcactaatgatctccatcaggccagttggccctacctgtgaggaacatattgaaccagggaactttccactccacaattagtagaatggaaacattcccg

SEQ ID NO: 14321 - DNA, 201 bp, Bos taurus
ttcatctgctttgtctatcctaggctaatatattgctggttgctaaacaccttcttaagaaaaataaagacaaagaggtaaacgtggctgtttgtagactgaaccaggacaagctgaggtcttggtccaggctgatgagattgatcttcctacctcccaggctcttccaggcattccagtcttatggtgataaatgccaag

SEQ ID NO: 14322 - DNA, 201 bp, Bos taurus
atggcctgtgcctgcctcaccctcccaagccccacactttgtgcttcaggcaccaggggtcatgcagattctgtactgtatccacccttggcctttgtcctctaaatacacacacacacacacacacacacacactgcaagctcaagtctttgattttgttcatgcttcctcgttatatggaatgctcctcccactcccaa

SEQ ID NO: 14323 - DNA, 201 bp, Bos taurus
agcatccctattgcccaggcccctctgagcaccagagctcgagatgcggacttttcttctgccagcctccaaccagataaagagatgccaaggggtgggggtgaggccctggccctcaggggagcctgggatgggggtggaaagaagagcagcgaggtctagaagcttcctagagcggcagctatttgaagccttcaagga

SEQ ID NO: 14324 - DNA, 201 bp, Bos taurus
actccagatggggaaaaaaaaaatctatttgtaactcactcaaggttccacattagaaaaatacccaacataccatatatactttatacaatttcacaggcgaaaaaactaggccttggggactttgctggtggtctagtggctaggactccagactcccaacgcagggggcctgggtctgatccctggtcagggaactag

SEQ ID NO: 14325 - DNA, 201 bp, Bos taurus
acgggggcactcactggagccaggtgtggagaggatgtaggaaacacgggccccaccctcgtgaagcttcccgaccagtggaagagagagagatgcaagcgggcaagcaccgtttcctggggccagagctctgacatctggtaaagcggatgctgttgcaacaaagcaggggactctgtcttcagttttggaagaagtcct

SEQ ID NO: 14326 - DNA, 201 bp, Bos taurus
aaacagcccccacccccacagacccccacccacagcagaggctggcaaacaccctctgtaaagggctggttagtgcatattttaggcctggtggctgtaccgtacctgtcacaactactctttcactgttcagttcagttcagtcgctcagtcatgtctgactctttgcgaccccatgaattgcagcacgccaggcctccc

SEQ ID NO: 14327 - DNA, 201 bp, Bos taurus
caggacatttccctctttattgttgtttttctgatcttcatgtggaccagtgtcatatcccagtcttagcttcacaacaagctttgtttccttatggcccaatcgttggcttgacaactgggctctgtgtacctgtgtttacggctccacttcctctttccttcccctctgtttgcaggcaaggccctgtgacttacactg

SEQ ID NO: 14328 - DNA, 201 bp, Bos taurus
gcctgtgggctgggccggatgtgcctgcatgctcagtcgctcagtcatgtctgactctttgcaaccccaatggacagtagcccacctggctcctctgtccggttgcaatttttacaggtggcaggccacaaatcctcccccaacccttgttcagttcaattcagtagctcagttgtgtctgactctttgcaaccccacaga

SEQ ID NO: 14329 - DNA, 201 bp, Bos taurus
ggtatctaccttccccactcttctgaggtctggttgaggctctatccagacatggtcaattaaaacagcacagtgattggtctggggataacatggatctcgggcctgtccattcagagcacagagtagtccccttaggaccactgggaaagtttcctgcactttcatgctggtctagagcctgggagaagatgagaccag

SEQ ID NO: 14330 - DNA, 201 bp, Bos taurus
tttcctggtcctaaatctgtctcagattactccaggtattgttcataatttatgggaaatcagaatgtccagaagatgatagaaaggaaaatgtttttaggatttgggatgtaaggagaatggtttgagagaaaatgaaagacaaggcacctactggagaaacatatacatttaatatttttttcttgatcacttttgtca

SEQ ID NO: 14331 - DNA, 201 bp, Bos taurus
agagatgggcggcacgtacttactctctggaaaatatctgacagtgtttattgagagcctattgccagcgctagagacaggatggccacctggaggggacgccaggactggcggtgggtggatttgtcagttacagtgactgcagaacagctggtgctgagtgggagggggcgggggtgccacatgctccacaaatcaggc

SEQ ID NO: 14332 - DNA, 201 bp, Bos taurus
ccctccccgggcatcagcagggcatttggccgcccagctggggactgtgttgccagcctcacttgcacaaaaggcgtgaccatgaggtcaggttcatgcatgtggttcctgagcagaggccagaggtctacattctccatctcaccacaaagtcagctcagagcccgggcctctctttcccttcttcccaacagctgggga

SEQ ID NO: 14333 - DNA, 201 bp, Bos taurus
tctggtagcactgacattttatgacctgtggtgtcggtggcttgagagtccttcaggaagcaggtttttccaacacaatctacttttaccatttggtctttggccacagcctacataccacctgagttccagccgtaccaaaccatctccctcactccacacttcccaacctttgtacccacagagcttctaccagggaag

SEQ ID NO: 14334 - DNA, 201 bp, Bos taurus
cattcctcacgctgcgaagcaccgcactccatcacagacctggcgctcagcaggcaggcgagtgggtgtgtggagtgatggctgcttgtgacctgactgggcttgggcagtgacagaacaaacctgaaacacacagactccaccatcgtggctgtgggaccccaactcccactgcggccacgccacgcaccgcccgcctcc

SEQ ID NO: 14335 - DNA, 201 bp, Bos taurus
ttattgttgggtgaggtttttatgcgtttttaatagaccttcattaaactaatgggtggtctcactgctcagcacggcccatgtgctccaaaactgtcatgaagtgactgggttttattttgggtggtggatggagaagctctgaaaacccacccagaacaaaggtgcagaggaagagggtgggagagaagaaagagtcta

SEQ ID NO: 14336 - DNA, 201 bp, Bos taurus
attggtaccaagatccaccccaaactgggccagaggcaagagtgtacccctctcagatgatggagctgaagatgagagcctgagcatcgcggatggccacaccctccatgcctgggagaaattgactgcacagtgaagacagtgccgggtgtggcaaatcgtgtttccagaaggtggccatggtcatatgggtcatgcgac

SEQ ID NO: 14337 - DNA, 201 bp, Bos taurus
aaggtgccaaactccgagacccctctcagaagagggccccttctcaccttgggctcttctaggggagagggtcatgagcttcgggatgttggggagaaactcgacctgctgggccctctctgcggtcgtggcgtgtgcccggagcgggatacttggtgaacattgagtttgtgttcatgagtgtcagagatacctggtgcc

SEQ ID NO: 14338 - DNA, 201 bp, Bos taurus
cttaacctgttcatatcattgtcttgctcaaaaccctcccttagctcgtaggataaagtccaaagtccttaggtgtcctggcccacagaatctgaccatcgccaagccttctaacatcttgtacccatgtcctaacatcctccacttttctacaggttctagaaggcccttcccctgcagctctctgctcgcatcatgccc

SEQ ID NO: 14339 - DNA, 201 bp, Bos taurus
accatcagaatgaacggcaatactgaagaaatattcttctcaatctacgttatagaaaatgtaatacgctccctgtaaaccaggggattccctggccgtccagggattagacctccaggctttcactgccaaggacaagggttcaatccccagtcaggaaactaagatcctgaaggccatgaggcgaggccaaaccaagtg

SEQ ID NO: 14340 - DNA, 201 bp, Bos taurus
gtactcccccaaactggagagacaggtgggcggacacagagaatcacaacttactgaagcagaaacttccaggcagaaaccttctaagggagacagcgctggggtgagagggcctggacgctgactaacagattgcggcagctcagcatggacaggtctcattaaacactatggggatcataaggggatccccacagttct

SEQ ID NO: 14341 - DNA, 201 bp, Bos taurus
aaattacaagtgcaaaataacaagtggtaaagtctaacatacagtaaaagtaggaaataacccgcatacaaatatgatatcaaaactagcaatagtgggctgtccctgagtccagtggttaagacgcggcacttccaatgcagggggcacgggatccatccctggtcagggacctaagataccacatgctgcacggcacag

SEQ ID NO: 14342 - DNA, 201 bp, Bos taurus
tggtgaatgagccctgagactaggaggcactgagccttgtcctgcatccacagctctgagttcagggatgtcatggaccaggctgtgtttactgaggttcggcggggtgatgaccagtcacgcggagggtgccccacagtgaaaccccataggatttggctgctgtgttggtgagagtcacctggtctagcacgtcccagg

SEQ ID NO: 14343 - DNA, 201 bp, Bos taurus
tcacccagccggggagtccaggtgcgttccaggtaagacagcgctccagagcgaacacaggacttgggtgtggtgtgctggggcccacctgtaccagcactcaggagctgattgttaaatcttgagaaattttgtggggcagttggtgatttgaccttggccatggtgggagtgtttgggcttccccagtggcccgatggt

SEQ ID NO: 14344 - DNA, 201 bp, Bos taurus
aggctaagaatgttactggtttaccatgaattttagagcagaaatctgtgtcagtatctatataaattgttaacgtgtgaggccagatcactgtgagaaagaatgataaacataatcaaaggatcctgactggaggagagttttgttatgctgtcagggtttggttgaaagcacctagcacagcctcggcctctgtcctgc

SEQ ID NO: 14345 - DNA, 201 bp, Bos taurus
ggaagccatttttctccagttttcaatgcacaaatacctagagcaatgcctgacatttcaataggtgcccaagctcttgttacacaagtgactcagggttttcattaatacatttgtacatagatgtcctataagaacatgtaatgtaaaaacacacaaacatgctgctaactgggaagacttaaagtggcgcccataaac

SEQ ID NO: 14346 - DNA, 201 bp, Bos taurus
ggtccaagtgttataatactaccaatcccatgtcaacatccccgccttcccacacttcgttagcactggataccattaaacatcaattttgccaatccaaaaggtgttaaatagcttccattgtttagatttgcatttctttaactgtggctgaacttaagcctttttttatgagtttattgatcattagtatttcttttt

SEQ ID NO: 14347 - DNA, 201 bp, Bos taurus
gcacagtagagggatggccatttccctcacaaaccatgtgatttctatgggagaggaatggattctgtagcggaggtgctagttttttcataacatctgcccctcctttcttagttctaggcccttagttttcagttggacatatgacttccttaaataaagattacattttctggcctctatcacagatatctgtatgac

SEQ ID NO: 14348 - DNA, 201 bp, Bos taurus
tggcacctccttcggttgcgggtggtgtgtgctgtgcccagggccttctctgcaccttctttcagaggctcaaatccacaaggaacaagcagagggaggcggaggctgccacgtgtctgcccttggcctcatgctgttggatttgcggtgcctcatgaaagaataatcacctacatcaatttttaaagctgcctaatgctt

SEQ ID NO: 14349 - DNA, 201 bp, Bos taurus
caaaactaggtgtggcacagggggtttctttccttgtcctccccgtgttttcttttacttctgtactcctggaagtccaggcaaagaggccaagactcacaagttatactgaagaagggatcagcattatcctgagaaagatcttgtagatctttgagcctataagctttaggattcctcttataaatggcagtaggctct

SEQ ID NO: 14350 - DNA, 201 bp, Bos taurus
tggacatggtggggaaaagtgtctaccataagggtgcagggagacactacagcagggatggattcagacatggcagagactctgaggggcctaggagaggcgtcagtgagagccccaagggagcaccaatcagccggaaagcactgctgggtcttgaagtagctgagaggccagttggcaagtcacagcagccagaggtat

SEQ ID NO: 14351 - DNA, 201 bp, Bos taurus
atgtccacttaggtgggaaacagactctggtggttaaatgacttgcttgcggatgtagaaaagtgaatacggagagaggaggcccgtaacaggtgctgtcgactacacctgggctcatgaataatcacgactttgtttgaggggggaatgcacaagagacctataaaaacaccaagaggagagaaaatgttggctggccaa

SEQ ID NO: 14352 - DNA, 201 bp, Bos taurus
ttaaaacagttgttccaattttcccatgacactgacttttttaaagagcacaaaccactttgcttgtagaatgatttgactcctgaatccacatcttttattcactggcctggtggtctttgaagtggccaccttgctgataaattgcctaatgggaccctgaatccttcttccagcctgcaggaaaattatgaatgagtc

SEQ ID NO: 14353 - DNA, 201 bp, Bos taurus
tttactttcctcctgccttcattcctgatccccaggctaactatgagcatcaactctgatgtgtctgacatgtgtttgtaaatatgcatgcatgtcttgagtaagaagaatattagtttgcatttgtttcaaaagtttgttttggtattatgctataaatcaccactgcttgtttagaaaaacttcaactgtatttaacat

SEQ ID NO: 14354 - DNA, 201 bp, Bos taurus
catcagtatgtgggcgataataacatcctcattttaggattgtgaagcacattaaaggagatgcagatgaagcttaagctgcagggcctctcacttgcatgggcttgcaactcatttcatagttaaaatgcgtgtgtgtgtgtgtgtgtatgttgaaatgtataaatttgaggcccaataaaatctagattcatgcttgat

SEQ ID NO: 14355 - DNA, 201 bp, Bos taurus
acaccaggcattactgtagggatgaggcatagaaaggctgctgtgtgattctccatgctctgtttcatgaccttgatcactgctgccattccaaatagtatacctctgtcagcctagtcctagagagtgaatgaactcaaccctactcctaccccaggcaagaacaaagagcccataagggaataaaggaagacgtgcctt

SEQ ID NO: 14356 - DNA, 201 bp, Bos taurus
agagggaaatggcaacccaccccagtattcttgcctggaaaattccatgaatggaggagcctcgtgggctacagtccatgggatcgcaaagaaacacaacttcgaggctaaacaacaacaacaagggtaccgttctaagtacatacatatcaagttcctgagttgccatagcaaccaacaaggcaggagatatttttgtgt

SEQ ID NO: 14357 - DNA, 201 bp, Bos taurus
agtacagttgatttacaatgttgtattagtttcagatgtacagcaaagtgatccagttatacttgtacatatattcattcattgtcagactttttccccacatgagttatcacagaatattgagtagagttccctggtgctatgcaataggtccttgttggttatctaccttacatatagtagtgtgtatatgttaattgc

SEQ ID NO: 14358 - DNA, 201 bp, Bos taurus
tctacctgagtcataaactgtgaggtagaagccgagcaggacagggaactctggcaagaaacaacgagaaggaaatctcagatcccatgtggaaattcctatactctttttaaaattttacttattttcatttttttccgagggtctcttccttcttttaagggcacctatcccatcaggcggagaaggcaatggcacccc

SEQ ID NO: 14359 - DNA, 201 bp, Bos taurus
gtggtgcagagaaatgaatcacccagatagtaaaatatgaaattatatcctagatcacagcattcataaaagtaagtatctaaatggcaatagtaaagtccataacataacatatacacaaggaaacaatttaagcataaaagcctcccctatgcccttaaataatagactgacaaaactacaggttatggatcagaaggg

SEQ ID NO: 14360 - DNA, 201 bp, Bos taurus
aattgtccagagctaaggataccactatgagaaggttgaagttgtcacatgtggtcatcacacagtgcagaggacctgatggggcctgtttctcctagccctccacctgctttctgtccagctcttcttcccaatgctggtcctgcaaaccaacagtggcccagagccccacacaggatcctgggcttcaggcccacagag

SEQ ID NO: 14361 - DNA, 201 bp, Bos taurus
ctgcaagtaactaaatgcagcaacaacctaaatgagcctgggacaggattctctcgtagagaaacaggagggaagaagagggaataggacctactgactctttgacattggccttgtgaagcccagagcagagaaaattagccaagcccaccagatataggacttagaaagctgtgacaccagactgttggggtgttcgtt

SEQ ID NO: 14362 - DNA, 201 bp, Bos taurus
tgatgactatgaaaactccatccgcaacacaatagcaaattattttaccagcttccttcaaaacacaaacaggaaactctacaatatgaactttcctggaaatttcaagaagtatgcttcccattttcaaacttaagccagccctgaaagagctgaaaagagatgtctgtgtagccagcagacagctcctgcagaggctgg

SEQ ID NO: 14363 - DNA, 201 bp, Bos taurus
aatcttttcatcaccccagacagaagttctgtaaccattaagcaataactcctttgccccctttcagctcctagtaacctctaatttactttatgtccctatgaatttgtctaattctagatatttcatataattggaattatacaatatttgtcctcttgtttctggcttaatgccttagcgtaatgtcttcaagattca

SEQ ID NO: 14364 - DNA, 201 bp, Bos taurus
agaggctaccatcgtccagaaggtgagctcgggctcctatggctgcagcaagggttcaagagaatggatagaaattccaaggcctcttgagatgagagtcggaacaggcatggtatctcttctgcagcatttagtgggccaaagcaagtcatctgggagatcatgggagatcttgtcatctccacgcttcaccttactctg

SEQ ID NO: 14365 - DNA, 201 bp, Bos taurus
aagtgtgagggggcactttggcttcatgccagcgctctggccctcgccccaggtttgacagtggctgcctgctcttcagaagtacagtccctgctcagctcggcagccacaggccccttactctcctcagccttccactcgctacccaggctgggccccttattgcagagcacccggaaatgcccattttccaggtcccgc

SEQ ID NO: 14366 - DNA, 201 bp, Bos taurus
gattcagtgaccttatatcccaactcaactgtgaactgcattggaagcttttcctcccctgtgggcaggatgctcaggactttctcacgtccctgaggagcaaaggcctttagggcaagggtcagttgtcatcacagcatagccagcttccttgcaagcagctctgggagcatgggcatcaccaggcagactgcccaaggt

SEQ ID NO: 14367 - DNA, 201 bp, Bos taurus
taacaggggcagtcttaactagcatctgtacgacaagaatgaaggaaactgacttgagtttgcactttgcatttaagaagggcctacagaaaagcttgctaaccccaaatgacacccgcaccaaggtgaaaagacgacagcagtggaagaacagccgacctgaacagctgaaccaggcctgtaagaaccgcccagctcact

SEQ ID NO: 14368 - DNA, 201 bp, Bos taurus
caacatgttgtcaaggagaatttcttcccgaggctaccatgcacggtttgctaaacgtctaccgcacgtgcagcgagggctgttagacgccaaggcccggcggcgcctgtccacagagtacgctctgatcacagaatggggcgcgagtgccagctgtgcgtgtatcacccagggggctcagggcagggacggggcgctcag

SEQ ID NO: 14369 - DNA, 201 bp, Bos taurus
ccagggccccttctcagggacacaccaacatccaagctcccttctccctcctccagcacaggacattttaaaattttccagaggggataaataactggatatgactaaggccatgctttccacaccctgaggcaaaacaaaggctggataagaagacaggtcttatactcagggtaagaaagatacagccatgctctttgg

SEQ ID NO: 14370 - DNA, 201 bp, Bos taurus
aacacactcacagttttggccgtgaaggttcatgcacttgttacatgtaattctagaacaatctgtctggatctgtggccaaaaaaacagcagagctgcagctaaactaaagaagaatggctggcagatgggtgggaactgtgttgagagacagctgttagtgcaaaggaaaagggtgcgtcctggcccacaactactctc

SEQ ID NO: 14371 - DNA, 201 bp, Bos taurus
gtgctctcacctgaggccttggaatgggcctttgaggttttttggatcctaattttttcattgcattatagtatttcttctgttcttctgtcagaaagacatcttggccacctaagtatgtggagaagatgagagctaattatcattaacagatttttggaaatgaattctgaattttcagaaatagttttaaagttatat

SEQ ID NO: 14372 - DNA, 201 bp, Bos taurus
aaaccatgggatcttaccctgtcactccaccagggaactgctcatagcagtggggcaagtccgtccatctacttcaaaggcccctgaactccctttccccgtttcaggctcagatatgcacacccactttctgcctccttcatctttccactacctcaggaaggaggctctagccattattccctggcctgtatctcctac

SEQ ID NO: 14373 - DNA, 201 bp, Bos taurus
tgctgatatgggacccctccctccatatctttggtctgggcccctctatgagcctaacggagctctgaattccctctaagggcacacaccaaatcaaatggtaaaggtgggacttttgactgggctgaggctagaaggccaggccggaggcagcttttatggtaatcattagcaagggctgtgggaaggtgagggactctg

SEQ ID NO: 14374 - DNA, 201 bp, Bos taurus
cacaactccagaccacctcctccaggctgtttctggattacgccagactggctgggacctgcccctcggtaggcctccggcctgtggcagccactctgagtgctaccatggggctcacggtaactctctggcaacttccttgtaggatctttatatcagagccctccactcacccgctccaggtgtgtggccccaccttcc

SEQ ID NO: 14375 - DNA, 201 bp, Bos taurus
tttgggtttcacaatgtcttcgctgccttctccagacgctgttctcagctgttcatggagattctgcccaaatcagcatgttgattcgtgcaggcccccatcatcaggtgaccgagagtgatgccgagaggggtgctgacccacacccgcgtgtattctggctccaggtctctccaatccctatcctacacttccctaact

SEQ ID NO: 14376 - DNA, 201 bp, Bos taurus
agtaggctcaaatgagtattggttgctcactctgctttgaaagatgatgggtacatgagggcctcttcctgagtctaggagtaaaaccaggccaatttgagctgcacaaatcaataggggaaggaaagtgagcagacgtcctgtgtgagtgtgtgtgtaagtgtgtgcgtgtgagtgtgaggttcgctaccatgtagaggc

SEQ ID NO: 14377 - DNA, 201 bp, Bos taurus
gtgaagagcagcgggggcacttaccctttgtggggccactgttgttttagtgctcttttcattaactcaggggtggcgttttatggagagatgcgctgttactgaagctggtgtggcccgcctctgggaggcccagcactccggtccagttagccctatggctccttacagcaggcgcttgttactctcaacctaaggact

SEQ ID NO: 14378 - DNA, 201 bp, Bos taurus
cctctcatatacattgtctatcctatacattacagaatggaaggaagagctgtagaatgacatttcagagaggacaggcgctaggacactccaggggcctggggagcaggaagtaatatctccatttttgcattactctgttcagaagttgaattccaaggagcagtatctcatttatgccaagtgtctatctatctcttg

SEQ ID NO: 14379 - DNA, 201 bp, Bos taurus
tgtggtctgtgtgtgtgtgtgtgctgttttattgttgttgtatttaaaaaaaaaataaccgtgttgaagatttgagggccatgactcagtactaactgcaaatatataaggaagggagaaatagtcttgcagacaaatgcgtgtaattgatgagactggttgtgcttccgtgaaaatgtgtcctgtcgggcctcaaggggg

SEQ ID NO: 14380 - DNA, 201 bp, Bos taurus
gcccttggggtcgtcatcagttgaagggaaaacaaaggggactgacccagagatgcctcaatgcactaggcacagaagctaagaccttggtggcccgcccacagagggagaggtctgcaatgaacgcctgcagtgatcctagggactgcagtctcttcatgggagtgggccactagaagcggagatgaccatgaggcacaa

SEQ ID NO: 14381 - DNA, 201 bp, Bos taurus
gccctctgagagaataagcccaggtgagcctcctggagaagaggctgcatggggcagaacaggccccgctgtcccagccaaggccccagatgtatgagtccattcagcggtcctgcagtgccaccatcctgacgggcagcagagcagaggtgcacgagacacccaagcaaggccagcgaagaaatcacccgcacctcccag

SEQ ID NO: 14382 - DNA, 201 bp, Bos taurus
atgaaaatatatcatcaataaattaaaaattcaagtaaaaattttttttaactttgttgaagtactaaaatgagttaacattcacatattcatgagtgagaaggcctccacagcatgacaacaaatgagaaatgaacgccaaaatctcacagctttcaagttttaaagtagtaagtatttcccaatgacaaaatcaccata

SEQ ID NO: 14383 - DNA, 201 bp, Bos taurus
gactattacaaagcaactgcgccttgtcaacatacaacagaagtcaccaattcattatgagcagggagctgacacactccagtttcatgttgcagtatgcggtctatgtccccagcaccagctgcccctcccagtgtccttaactttctcagaggtatcatctttatctctgttaccaagcctgaaaattgtcacagtcaa

SEQ ID NO: 14384 - DNA, 201 bp, Bos taurus
ctgaaacattcattaactcacgtttcccaacttgaggatgtttaatgatacattgataaagactttctagcatgcactttcagtgttatttactgagttttggttttgttttcagaacagttttaatctattaataataattgcaaagaagcaagatcatgcatagatgaccaaaataccactgtaacataatttaagtca

SEQ ID NO: 14385 - DNA, 201 bp, Bos taurus
actgtcaggtgaccgctgatgccccgagtcgtgccaggatgtgcctacgttctgctgctgagtcaggatctgaaggctcctcctctgtttgctttgctacaagcctcactgtgcctttcctcacctcttgcccaaggcctgcttgcttgttctctctctagctatcttctccagatgcctgggacattctcatcatttgct

SEQ ID NO: 14386 - DNA, 201 bp, Bos taurus
gccaagcctctgagccctttcctccatcactggtctcagtgctgggcttctcagcctctgcagagcaggcgtaaaccaagggctcaaggtgccacatcccgccccagacaggcctgctgaactgagggaggtttgactggctgataacagagctgaccctagagccctgggaggaaacgcagagaaggcagagaatcctta

SEQ ID NO: 14387 - DNA, 201 bp, Bos taurus
ggtggctcagtggtaaataatctgcctgccaatgcaggagacatgggttcgatctctattccgggaagatcccacagccacaggacagctaagctggagcacgatggctactgcacccgtgtactgcagagcccgtgctcctcagcaagagaagccgctgcaatgagaagcccgcacactgcagttagagaaaagcccagg

SEQ ID NO: 14388 - DNA, 201 bp, Bos taurus
ccagagaagaaggccttccctggggcactgtgaccagaggccatcagaaacaagcccaggcatttgggaggcattcatccttgtggagctgaaggacacacaaaacagcttctaggccgccttctctgagctctggactaggtcaggatccccgttacttgcacggcaccctgtacttcaaaacaattcagcaaataatta

SEQ ID NO: 14389 - DNA, 201 bp, Bos taurus
ccctgctagctattccctctttctcactctctaccattcatctccacttcttccaaacccaaatcaactcacaaatcctttttctttcacagactattctattctcacccaggcccctcagggtctcacctgtttcccaatgactttaaaaagcagttctttcaaacacatccagggctttctgcagaagaacatttggca

SEQ ID NO: 14390 - DNA, 201 bp, Bos taurus
tccagtcccccactcaagcaatgctaggttgccctagaggggtcgccagtgtcttaagtcactgtgacatccccagtacttatcatagggccaggtcagtggaggtggtgatacaaaagggatgaaggaatgctattccctgcaagctgttacagacaagatgaagggattattgcttctttaagcaacgggcctctcctg

SEQ ID NO: 14391 - DNA, 201 bp, Bos taurus
catgtgattctggcctgggatccccctccccaataacttgtcccaccttggactctccagaaagcctgccttgaccaaccctgagaggaagatcctgtggcacggaccttttcaaggccaagggaacagaacaattctgcctatctccatccggctactcctacaggacaagaatctggattctgctacatcaaatcacct

SEQ ID NO: 14392 - DNA, 201 bp, Bos taurus
gtgggcctggagttagaaggcccttagagactcctcttcaggatggatggtctctgggagaatagctccccgtgggccccagtgtcctggcagtgacaggaccagaggtagcgggctggtcaccatgagctgggagctcagggaacaggcctgggaggcggtgtgtgagtgtgtctgtgtatttcactttaccttgcatca

SEQ ID NO: 14393 - DNA, 201 bp, Bos taurus
agtgttggagctgggatcagatccgccgcagtttggccacagagggcatgcttttgccctctttgctgactcagctgactctggaaaagacatttcttccaggtctcttctggatgaggctggcccatttccttcccggggggccgggttcagtcatttgtgatcctgtgtttgttccttgttttgagtgcaaatctatag

SEQ ID NO: 14394 - DNA, 201 bp, Bos taurus
actccgggagcccgtggagagtatggctcagggccgtctcatctgggcaggacgggactgggggctttacgcgactgaccccatcaggtgttggtgcaagccccctggcctgtgattggaaaaatggtaaaacttaggcagtctgatgctcagggctccatgctttatccaccgcactacttatcagaaaatgtcctgtcc

SEQ ID NO: 14395 - DNA, 201 bp, Bos taurus
ccttaacacacagctggcttcttccaagggccgtgacttctttcagtccgatcctcacggtagcgttgactttggtagagaaaggtggttcagtcgtggggcagggcatctggagccaggccaggtcatcagtgggactcctgtggagctgatgctttgatacagccacgatgccaagtcgtgtccttcaccgagtttcat

SEQ ID NO: 14396 - DNA, 201 bp, Bos taurus
atcagcgccttccatgcagtctccttttacccagctggggattagggagtggaggtgctgtggggcctgtcctcctcctgggccctggcctgctggcatgtggtagatgtctgctgacttgccttgcttcattgtcaaaaccccggaccctaactcagttccattgctgggtgcgcctcaggctcagggtgacctgtgcag

SEQ ID NO: 14397 - DNA, 201 bp, Bos taurus
tctcaatcaaatgctcatctttacagggaggcgctctagtaccacttctcagtcagagagagagagtactcctttttgatcaaatgaaagaaaccatacatgaggcaaacaatggcctttattccctgctttgtttgaacaatgaaaatgatgtgcactatgatctcaaacaaaatcttggctatgatagagccataaaaa

SEQ ID NO: 14398 - DNA, 201 bp, Bos taurus
gctatgcttttcatgaaatacaaggccattacctagagtcttacataccatggggagaaactactgctcaacagcacttgtaagcaggggttaagtaggcggttctcaggccacatccttcatgggtcacacctggagcttactacacaaggttatctttgggtagcctgtgactctagaatccagtttgagattctaagc

SEQ ID NO: 14399 - DNA, 201 bp, Bos taurus
gttttggggtcagggaatgacataatgaagttggtattttagcaaagttcctctggtataaggtaggaagataaatttcctgataaggcctggaccactgaaaaacccaaaagtaataaagactgtgaaagtgaaagtcactcagtcatgtccaactctttgcaaccccatgcactataacagtccatggaattctctagg

SEQ ID NO: 14400 - DNA, 201 bp, Bos taurus
ccacctggagcctcctcgtgatcctggggcacaccaccacctctccagtgagcactctggtactcacctccctggctctggccttcagttattcttccttgctctcctttggagtcttcctttccctcatctcccatctcccaccccattggccccttatcaccctgccctgtgtctttcttccctggtgacttcgttcct

SEQ ID NO: 14401 - DNA, 201 bp, Bos taurus
ctcacgaagacattcagacgttcgagaaattactctattaagctcagctgcacttcaaattaaaacagaaaggtccaattctttctggaggcaacacaagtcctgggggcctgggccacgtgattcacctctgcatccttgggttctggaatacagccacacctgttctttggctgagaggaatgaaaacctaagagcccg

SEQ ID NO: 14402 - DNA, 201 bp, Bos taurus
aataatctgccaaagtctctgattaaatggataattatatgttatgtgagagtataaactactctacaaatgtatgacattacttattacctgaaatactgcattttatcttatctattagaaaaaggcaggtggaattagaatcagagattcagtctttgcaaaaagcgaaccttaatcttgaaaaccttttggaagcaa

SEQ ID NO: 14403 - DNA, 201 bp, Bos taurus
ccttaggccagctcaggacggagttagaattgagttttgcaaaaagccaaaactggaggaatgccaggaccttaagtcatcctggcatctctgctgcctggaataggcctggcccagagtatatatttggagaaggcaatggcaccccactccagtaactcttgcctggaaaatcccatggatggaggagcctggtgggct

SEQ ID NO: 14404 - DNA, 201 bp, Bos taurus
gggctatagaaaagacaggactaacagaggcggcctgccgttttgtgtcgtgatctgttatattgttataaaaggagctaggactatgtcgctgatgtctccggccatgtattagagcagcttgttttgggagctgagccacatggaggagttcagaaataaaagaagcattgagaacaggtgtgtctttttgagtgagga

SEQ ID NO: 14405 - DNA, 201 bp, Bos taurus
gaaagcactggcattcagcccctgttggagatggtccctgccctgctctcctgcagtttcttcatctgaaaaatggccttcccttggagaggcctgaaaatgagctggagtcctataggcttgaggctatgagagcccgagcagaatcccttatggaaagcagcaaaggccagggcaggacacgctcctgagatcgagtga

SEQ ID NO: 14406 - DNA, 201 bp, Bos taurus
caatagagaggcgtgagtgagggactggacatcagggctggggggaaaaggaggatgacactcttcatccagtcagctggcaggtggacaggtgaataactgtattaatgcatgaatgagggagaaaaggaataaatgataggctgagttaagggacataaatgaccatgtataagcactgagacaccacacttaccatcc

SEQ ID NO: 14407 - DNA, 201 bp, Bos taurus
actcactcactcatctgctatccattcatccatcccacccaccagtcctcttgtacacccatccacatacccatctattcattcaccagtttatccattcgtctgattgtctatccatgtatctgctcattcacttattcacttgccctttcatccattcatccatccacccatccatccgtccatctacctattcatcca

SEQ ID NO: 14408 - DNA, 201 bp, Bos taurus
gtggccagcacacctccctgcagctggtggcgcggggctcccaccaggtgggcacaagtggaagcaccagctgggagctctgttctgatgtgcactgacgcggccacatggagaccgcctgttcagccctgatgcccccacgcagggaggatgtcacccaactggaggacaccaggccatgggggtgtcaccaaagattgt

SEQ ID NO: 14409 - DNA, 201 bp, Bos taurus
ctgcgagtgctgccggggctttccggagggcgcccatggcccccatctgaccatctgtcactgctgtcctaggttcaggtgggcttggccaacataggaaaaccctagcagctgagacgccagggctggacgggtgacagcggggaggaggctcacatcctcctgactctcagtcagcggggtggcctcccccaggagctg

SEQ ID NO: 14410 - DNA, 201 bp, Bos taurus
ccccaggatggggctaggatgacataaaacctgaagacacccctcacccacaattccagacagatttgaggatactgcagagcataaaggccccctgtctggcttcaccagccatgattcagaagcttgcagggcttgtagagaagcttcatcatccagcagtatgtgagtgatggggtcatgagtggctgaggaaggtgg

SEQ ID NO: 14411 - DNA, 201 bp, Bos taurus
tttggtctttgtccccattcctgtaacactcccatacccctgacctccctagaggggaggcggctagatattgaactgtcatccatggccagtgatgatcagtcatgcctgtcatgaagcctctgcagaaattcttagaaaggatgcatttgggacagcatccgggttagtgaacaagtggaggtcctgggagagaggtgt

SEQ ID NO: 14412 - DNA, 201 bp, Bos taurus
gagtaataatactgggcagccagggggaggccaggcgtttggtcctggtaggacattctcaggaattgggtttttattagagcagtgggaaaccaatgaggttttgagtggaatggcctcacaagatagaatttacattttgaatggatcctctggctgcagaggacaaatgcattggaaactagtcacagtagctgtgag

SEQ ID NO: 14413 - DNA, 201 bp, Bos taurus
ggtggcctgatcacttcatctctagacatgcaattccccacagcttttgcccacaactcttggctctaatgggctattgactcaaagttaatttggcttccaggatatggtttgtgtgtgtgatgtacagtttgcaagaaacacagggctaattttgttttaggaaatgaagattaataaccagcagctggcccattaata

SEQ ID NO: 14414 - DNA, 201 bp, Bos taurus
ctctgactctgcagataaatggagttgtgtgagacacaggcccttcctttaaaactggtttggaatccatgtcagggaaagccaagccgatggggcagcactttaatgtttagtggaggccctacatatttgcagtatacatttgcacctaatccaagttcactttcagataatactgtagcacttcacaggtagaatgaa

SEQ ID NO: 14415 - DNA, 201 bp, Bos taurus
ctctgtgcaaagtccttacgtgggttttcattgctctttgtgaaagtacataattcacatggtggcctccagcagcacctgcccttctggcctcacccatatgccacagtcccctggtgttcagtcactcagtcgggtctgactctttgtgaccccgtgaactgcagcacgccaggcctccctgtacatcaccaattcctg

SEQ ID NO: 14416 - DNA, 201 bp, Bos taurus
ggaagtctcctgcctgtccacgtggcagaaagaatttcctcagagaaaggagattgtgttgacatcagagcatgattacaatgacaacagagaaagggaacgaattggccctgcctgtgctctcccacagagtccgtgttccatgatggaatagcaggaataagccatttctctcaaacacttaattaaagtcaagaaagc

SEQ ID NO: 14417 - DNA, 201 bp, Bos taurus
tggccaacaatgcaagtcatgagctaaaagggaaagtcaaggttgtactcagatttttgacgtcaaagagcatcaaggtaaagagacagaagaaaaagtgtactggagaatgcagacacatgaccagcttggttttgaacatacaaagtccaaagcagaagcaatacttccagaaatataaggcattttttcttatacatt

SEQ ID NO: 14418 - DNA, 201 bp, Bos taurus
taatataaatgatatagagatagacgtaagggatatatggagaatattggaggagtccagacaactttctgagttgcctaaggcctccactctcagaataaattttagatttccaaaaataaagagcaatgtttggaaataaaattaaaaatgaagctaacaacatcttcaattaaccaagtagttattatgggccagact

SEQ ID NO: 14419 - DNA, 201 bp, Bos taurus
ttttaaacagcttttcagacattggagatatcacaggtttggttctagaccaaagtaataaagtgaatatctcaataaagccagccacacaattatttttggttccccagtgcatataaaggttgtgctgcttatactatactgtaatctattaagtaagcaatagcattatgttttaaaaatgatgtgtgtaccttaatt

SEQ ID NO: 14420 - DNA, 201 bp, Bos taurus
ctttgctcacatggttcactcggactggaaagccttcaatcctggcctggtgaattccattctcagttaaacctagttcaaatatcacctcctgggttacggtaacgggttctcaggcctctcaaagaggaactcacagtcctgcccctgagcttccgagtgcacccttcctccccgtgagcactctctcgctctgtgtta

SEQ ID NO: 14421 - DNA, 201 bp, Bos taurus
aactctagctatagataatacttccaggcttaagaaatagcaactgcaaatggacctttgtcagaaaagactatctatgcctgcagtcttttgacctccacgagagcgagagctgaaacatttccttagcaagagaaagcatcctgacaacctacgctaggcttgtcaccttgtgtgggaatttctccctgattcagacgc

SEQ ID NO: 14422 - DNA, 201 bp, Bos taurus
atgttttaaattattaattattagggcaaaatatcattcctagaaataactagatccaacagaaatacattgactataaaatagatgattttggtataaagaatcttatatggtcttccccctccttccaaactaggttctacacatgtatgtcagttggtttattctgtccagttcatattccaagttcactatacatta

SEQ ID NO: 14423 - DNA, 201 bp, Bos taurus
ctccagttgaggcttaaggttacacacagcttgttaccagcacagccagcacccaaatcttgtgctcttctcactccaagcccctaaatcacaggcctccctaaatcacagatcagatgagatcagatcagtcgctcagtcgtgtctgactctttgcgaccccatgaatcgcagcaccccaggcctccctgtccatcacca

SEQ ID NO: 14424 - DNA, 201 bp, Bos taurus
atggctcccaatgatggccgcccctcagtgttcatgcttttgtgtcattccttccctcagaattggtctgtgtgaccaacaaagtacagaagtgatagtgtgtgatttttcaaggctaggtcataaaagaaattaaagcgtatgccttgctttttctatagaactggttttttctggggtaagccagtggccatattgtga

SEQ ID NO: 14425 - DNA, 201 bp, Bos taurus
tcctagtaaacagtagcaagggccccctcatgttttcagtgtagactaggtgggaagcaggggttcccaacttcacccaaaagttgtgaagagtccatcatatgctgcagtaatgtacgaacaggcctgtggaggtcagggcttccactactctccagttataatgaaaccatcgcttctatggtgtcagtagaagctatg

SEQ ID NO: 14426 - DNA, 201 bp, Bos taurus
aacagatagaactcccacaaagaataaaaatttgccactgagagagctttcaggccatggtagaatcagaaaatcttttaagttacagaacagaaaactagggattcccttgagcttctgtgaagcattttacaagaaaaatttaataagagaatatctataatctgacccaaggaagatattcctggtgcattttttccc

SEQ ID NO: 14427 - DNA, 201 bp, Bos taurus
cctcccaagcaaagtatttccttggctattcagggtggtgaagagaaaacactggcacagataaccttacaatatgccaagcccagacccagggacacacatttaaaaagtcttacataagacttccaatttttcaacaaatgctcatttatccagtaagaaattattattggtttcctctttatcaagtacattctctat

SEQ ID NO: 14428 - DNA, 201 bp, Bos taurus
agaacacatataccaggaactccattatccaaagtcatgggacatattgatgaggtggtcaaagtagagcaaagaagtaacagaaaatggcaaccaagacaatggatgaaagagccaggtcacttttttattaaaaaaaaaaaatccaaaaggcaaagaaaacaggaggacaaaaaaggacagggtacagggaagtaattc

SEQ ID NO: 14429 - DNA, 201 bp, Bos taurus
cttctctaccccatatgggctacttgttcaccatacaatcacatttcccaccattcacttaaatccttaaaaaggtctttgactacgtatgaatttcccttggcttgacccatctgattcaactgctcaactgtactcactccactttcataataatgctcactactttccctgactccctatccccatttcattctctct

SEQ ID NO: 14430 - DNA, 201 bp, Bos taurus
cagatggcagggaccgagagaagccctgcttatgagaacaggaaggcgagctgcagccacagggaagcatggagtgtggagtacccacaagacatccataagacagggccccagctgtggaagaatcacagtctaaggacacttccaaaaattcagaaaaaggagtggaagacgctggttaaaaacctgggccttgggatc

SEQ ID NO: 14431 - DNA, 201 bp, Bos taurus
agttttgactttgcctatcgtcggccgggccccaccccccaacacacacagagggtccgacgcagaccacacttagaactggagacgcaaagtgatctagaagtggagaaaggcctcccagtggggtggcgcttaaaagggtgctctgaatgaaagagagtcctaacgggaagacttcacactttcaacagcatagagatc

SEQ ID NO: 14432 - DNA, 201 bp, Bos taurus
ctgctaccccaaactttatttcttaaaaccaaccagcaactgcaccactaatccatggtgctgcagatgtttcccaggagaacagagcagaggcccagagcagactctctcccagagcagagagtcaaggacagggacgtgggggaaggcagcagcccctcccactgtgagccagagcaccccatcccaaccccccagcaa

SEQ ID NO: 14433 - DNA, 201 bp, Bos taurus
tgttcaggcagaaggaaacacctggtataaaacttgggtccggcagggcctggggctgaggcaccaaaggaacagaattaatatgaggaagcctagcaataaataccacaaagctctagaggccttttaagaattcaacaacctatacacttcacgcaaatgctattccattgtctttccttctcttccttcaccacgaaa

SEQ ID NO: 14434 - DNA, 201 bp, Bos taurus
catttattacttatgtcatagatgaaagcagctccattttcattgggaaatacatgcacaaaattgaaagcaaccaccagtaaagagagtggaaatagagcgtaggaaaccatgattactgatcattactttctgttacttctgatcttgtttttcgaacttttctgctcttattgctaagccacgttttctgtttttgtt

SEQ ID NO: 14435 - DNA, 201 bp, Bos taurus
tgggagtttgtgtctttcaaggaatttatccatttcatctgagttaatgaatttattcacataatctttgcattttcacttgctgtttagaccatttacatttaacatgattattgttatggttgggtttaaatttgccatcttgagatttatttttctctttgtctcatctgttcttttccatttgctctctctcttgtt

SEQ ID NO: 14436 - DNA, 201 bp, Bos taurus
ggcctcggaggagctatgcagttaggtgcagaatcctatattttaaaaaacgctgagctggggtgaaggattgacatcctcctgtgaaagaatggtgagtaggtgtacctgcgggggaaggccaatactgcttaaaaagtgatttgtgggtggagagcggaaatagcttctcttgtttgtgtgggttcttacagctttagc

SEQ ID NO: 14437 - DNA, 201 bp, Bos taurus
tggttagcacagtagatgggtatctagtacatattggatgatgatgatgatgaaatcaccacatctataccttaaaactttggatgggccctgctggaaggtacttccctggaaatagtggtccctcaggggaagttcttcctatggctccagtgacctgtgtattggcctaatttttagtggagatactttaacactgct

SEQ ID NO: 14438 - DNA, 201 bp, Bos taurus
agccagattcctgtctacttctggggccccttggtgtggacttagtgtagctgggaaagctgagtatcatagcccttctcctaacagggagtctggtaaggtttactctgctgtggcctcttccaggccagtatgggcagagcccttgaggttcctcagtcatctgtttcttatgcactaaactattcttatgtatctagc

SEQ ID NO: 14439 - DNA, 201 bp, Bos taurus
aatgggccacagggaaggagaggaaactacttaaattgctggtgggctttcttgctctcgctgtgtctggcttgaacagttaattcatgccccttcctcactcctgtggcctttggagaatactttaaaccgtgtccctgttctgagccaatgggacagggcttggggcggcctttaggcttaaaatcacacttctctgcc

SEQ ID NO: 14440 - DNA, 201 bp, Bos taurus
ttttcctatggcctctcaccacttcgggagtaacactcccaaactaaattcaaatatactaaatccatgtgtgacaccctcagatacaaaaccattcctccctttgtggccagtctattgagtccttttgcctttcctagagcatgtgccacacagctggaccataaagagacagtgcttactaacacctgcattcacaca

SEQ ID NO: 14441 - DNA, 201 bp, Bos taurus
ttgctcaaaacagaaatcacacaccactcagagcaaataaccctgtcctcccaccaacagcagagagctatgtgcgtttgatgtatttctctttgtgtgtgtacacacatttgcaattattttaattccatgtatttgggatgataaaatatagcgtgggtaatcagtaattggctggtgttgagaccggcatgactcata

SEQ ID NO: 14442 - DNA, 201 bp, Bos taurus
cacaggcctaagtctcaattgtctctgaaaagtgcacctaatgaaatgcatctttccatttgtctagaactaactcctgaccctgtgagcagatactgttactgttaacatggaaaccctaaactctacatactcattatatactgctccttttattctaatttgatgatgttatgcctttggtcatttctttcattctca

SEQ ID NO: 14443 - DNA, 201 bp, Bos taurus
ggccctatctgtgcagtcctggttgtaaaaccacaatctttcatcattcaacttttcatttttcataacacttctttacctcctgcacaaaactgttcatcgatgcctccaaatagtgctgtgacagcagctacctgtatcttggctattgaaggccctctgcaaatttttaaggtattttatttaaaacagcatatgatt

SEQ ID NO: 14444 - DNA, 201 bp, Bos taurus
gccagacaacgatggctgttcccccaaaccttttatgtcttcctgaaaacacagctaaactacatttcccagacttccttagagtaagatatacacatatgtaactgagttctggccaacggaatggaagcaaaagtgatatgtatgacttccacgtctgggcagttaacatcctgcaagtctttctccttcctacagatg

SEQ ID NO: 14445 - DNA, 201 bp, Bos taurus
gtatatgaacatgctgagttaccagcatatcacgattgactgtgaatcattcatgtgtttaaccagaggttctttaattccctgtaagcacactgatggcgctaaggcctggcatgacattgtttccacaagtaaggatcaaatggcatttatgctcaatgataaatgtataggagatgagttttttttttttttttgtgg

SEQ ID NO: 14446 - DNA, 201 bp, Bos taurus
caattaaaaaaaaaaaaaaaaatatatatatatatacatatacttgttccaagtatttcctctccatacactaacacaacagatgttacttttcttatttccaccaacagatatgaattaagagacttatcagggtaagtctattatatgctcttctattattttcatcattctattctattattattaccattccattat

SEQ ID NO: 14447 - DNA, 201 bp, Bos taurus
ctgaatgaggcccacatagattatataggataatctcccttacatgaagtcaaatgattttgcactttagtcatacctacaaaataccttcttgagagtcccttggactgcaaggagatccaaccagtccatcctaaaggagatcagtcctaggtgttcattggaaggactgatgctgaagctgaaactccagtactttgg

SEQ ID NO: 14448 - DNA, 201 bp, Bos taurus
tatttaacatcttattggtcatctgtcactgtgtgaatggtagtcaataataatttgtcagccaattaacagagttaataaatagtaacagaataagctaatctgcccgccaccagtagtcactagttatgaattaatgtactgaaattctttaacatcacacctgatacccagcaagatggagagcaaacatgacataac

SEQ ID NO: 14449 - DNA, 201 bp, Bos taurus
tttggcaatttctatgacatttttctgggcctgaaaatgtttctcttgcaagttgctggtgagcatcacaccagaccccatgcattcacctttgctaacaccttcaaaagaccacattttagatcaatcatacatatctctttagctgagagtggtgggtttcttggcaccattaaaattctcacaataattgaactgaca

SEQ ID NO: 14450 - DNA, 201 bp, Bos taurus
aaagaaattcacttctaacatcttcaagtatatggattctgggaaaacaaaatccacaaatcgaatatgggtatctttcagactcagtttgcctttatccgataagccagaaggtttctgtgactgcatgttatgactacattctatggatttctgtgatcacattcttctgtaaaaaatgtcagtcatatacctcatttc

SEQ ID NO: 14451 - DNA, 201 bp, Bos taurus
tactggagtggggtgccattgccttctccatacgtatcctctattacccactaattgcattctttcaatattcaatcaatagaaatatttgtgatgagcatcaaaagacaaggaaaaaacatttacagtagcatgaaatctaacagccccaaattgataaagtccaaaggttcatcattgattgaatagataaatagagca

SEQ ID NO: 14452 - DNA, 201 bp, Bos taurus
aagggaaaagagaatcccctcttatcaccaacaatgagcatggcacaaagccaaaacatttcaaagagccactctcaccttcctggccccaattctttctgtgtagaagaaactgggcagctaaggtaatggttggggtaatctggcttctttgaactcttgagaaacccctgagtggtatcctagtgtgaccaagcagga

SEQ ID NO: 14453 - DNA, 201 bp, Bos taurus
ggaccaatttcagaatagccaattccactttggaccttcatcttcttttggtttgagaaatgtaatatttacaggttatttcttgcatgattactcactgggtatacctggagcggatgccactgaattgcttctgtgttctagggcaagatttcaatggacacaaggggaaaggacctggtcagtgaacattttgggaat

SEQ ID NO: 14454 - DNA, 201 bp, Bos taurus
gcaagtttgttttgaagtttgaagcttcaactgaaacccacttctggccatgaacatgcccacctggggcaatgaaggaggatcagaggaaggaataacagaggggaagggaaaatgatggcctcgaatgcaaatttcaggattctcccttttgtccagctttcggcagtttgggttttcttcttcccccttatacaagtt

SEQ ID NO: 14455 - DNA, 201 bp, Bos taurus
ttaagccgaggaggtaaactggggttaaataacttgcccaaggtcacacaactagtaatggtgagagccagaatgggaaaacagaggcctcactgcagcatctatgttcttaagcatctcgaaggacaggttttgttgttgattgtattgtgtttgtttttctttctaattaggtagataagctccaggaaatggtgaagg

SEQ ID NO: 14456 - DNA, 201 bp, Bos taurus
atcagctgtttcctctgctaatatctttatcctcctctcccttcagaagttccaggagggtaagaggttatgcttatgtactaatgtagcttcatgtggagggcacagggcttcccaggtggccctagaagtgaaggacctgcttgccaatgcaggaaacataagagacccagggtcgatccctgggtcagggagagccct

SEQ ID NO: 14457 - DNA, 201 bp, Bos taurus
tcacgcaaatgaaaagttcgtgggtggtatggcttcaagaaaatatctttgccagcatctctaggtttacatattctcatcatctctttctaagaaaaatcccagaatcaaatctcatcaaccagaaaggataatgtgccacatttcagtcctatagccagtaggctctatacctatgctttgaaccagggatgaagacag

SEQ ID NO: 14458 - DNA, 201 bp, Bos taurus
tggagctatgagccaagctgtacaggcccaccaagatggacaggttttattgaggagttctgacaaaatgtgatccagtggggaaggaaatggcaacccactctggcataattgcctggagaacctcatggacagtaggaaaaggcaaaaagatatggcacccgaagatgagtccaaagatcgggagatgtccaatatgtt

SEQ ID NO: 14459 - DNA, 201 bp, Bos taurus
agatggcaagggcagtctgacattaattaatccataatgaaaagtgaaagcacaaagaaaaacagacaatttcttattcattatcaattcaattaatcaaatagttagacagtagtgggacataaatgctgaaacagaagctagttatcagtttgtccaagtcatagagaagactgggttagatacactgaaaagcttcat

SEQ ID NO: 14460 - DNA, 201 bp, Bos taurus
caggaataacaacaggctggtgttttctgctgagaaaacgagtccatcaatcatctctaatcattgatcttcagataaggggcccgatgccggcccatgcctacagtaaccatactgtgttttgaagactactgccaaaacatattgtattccacaaatctcttgagaaggcctattctgtttccacttgtgatttgaaat

SEQ ID NO: 14461 - DNA, 201 bp, Bos taurus
agatcagctaaatctttgaagcttcacgagccatatagtctttgtgtcagctactcactctgctctcacagcccgaaagtggccctcgcacaacgattgaggaggtgtgagtacgttccgaaagatgtagtttacaaagcaggtagcagtctgggtttgacctcctgggtgtttcttgctgacctgtggccacctggtatg

SEQ ID NO: 14462 - DNA, 201 bp, Bos taurus
atgaagacaggtatcagaggacagttatagtaaaactcaaatggcaaagtacagaatgttcagtgattagcggaacaggccccatcttctaattagagagcagagcaggctttctggcagatgtaatatgtatagcaagacttgaacgatgactgggatccactggagaagagtgttctgggcagggggaacagcatgtgc

SEQ ID NO: 14463 - DNA, 201 bp, Bos taurus
acttctttatagactcatgcctggctagactgtctctactatatctgcagtctggttccacaatgtgatgagtaactgggctccagcatttttttttaaaggctttgatttacttcccctgtttcctgctcacccgctgctcccatcccacaaatatttgccctgttttactgataagactgtctcatgtgtgtgtattac

SEQ ID NO: 14464 - DNA, 201 bp, Bos taurus
cgggcaactctctagttgctgtgcacaggctgctcactgcagtggtttctctcgttgcagagcacaggctctggggccctgactttaatagttgtgacgcgtgggctcggtagttgcagttcccgagttgtacagcacaggctgagtggtaagaaggaatcgactttgcaaagccatcacagcagtgcacatacagggcct

SEQ ID NO: 14465 - DNA, 201 bp, Bos taurus
tagaagaaacaaatggcttcctcctcccctccagttgagctgacccagctaattccaaaggccagtgttcagaactttacctaaggccttctttagccccttgaactcactaggtctgtgtacaagtcaggcagagagtcaggaactctaatataccctaggaacaaccctcagtgaaaggccaaaagaaattggtagttt

SEQ ID NO: 14466 - DNA, 201 bp, Bos taurus
cagcatggacatgagtgtgtgtgaaaaagagggagaactctgagagactccacctagagaaagcgagtgtgtagtcagagttccacaattatttttaaacgaatgaagaaaaatacatgcactgcataattctcagtaattctttttagctgacaactcaataaatggatgaggaagtgaacagatgaatagatcctcgag

SEQ ID NO: 14467 - DNA, 201 bp, Bos taurus
cctttaaatttcaggccttcttgcttcccgtgactgctcaggtccagaggatgcactgagtccagctgcacactctacctggccgctggaactgtgtgtccgtggcaaggcaggggtgaacagcttgtcttgagtggggtggaaagcctttaatatttgctgtgatttttttttttaaattgtcacatcatgggttacttt

SEQ ID NO: 14468 - DNA, 201 bp, Bos taurus
tctttggtccatgcttagaagttcatattctcgtgacctacttttccacttaactcttgataactccgggcttctttgttttctttttgactttggagaactaggttagtggggaaagtcagggttccctggcagacaggctgggttgagagcccttggctggcatctcctcagagccccatctcagcgcccctctgcttc

SEQ ID NO: 14469 - DNA, 201 bp, Bos taurus
tccgactctttgcgaccccatgatcgcagcacaccaggcctccctgtccgtcaccaactcccagagttcgctcagactcacgtccatccgcaattagacatgcgctgtaaacacatgcatacaggcctcctatggccctgggacacaggacaagagggagtgaagtgaggggctgtgggcacatgagtcttgtacgtaagc

SEQ ID NO: 14470 - DNA, 201 bp, Bos taurus
aggctgttttacctcatcaggtcgcacatagacaggtagtcggcagctcggccccttgctgaaaccaattctgctttggtatttttctcctgttcatttgctctctttagggaccctgtttggcccatctctgcaccatggccaaagtgacagactttggtctctgttggattaatcagtgtgctctttgatccatggcac

SEQ ID NO: 14471 - DNA, 201 bp, Bos taurus
ggtccattagcagatgcaaagacctttacatagctgtattatatctaactagaacattaaaagaactcatttccaaatctttttgcgaaaatgtcacatcctttaaggcagatccactgatttacaggatgctgttagaaacaggaaagaaaaaaaagtcctgagtacagtttcaccttgagtccaatgtcaccctacaaa

SEQ ID NO: 14472 - DNA, 201 bp, Bos taurus
tccctccaggctccctttgtgctgcatcagtgacagaccagcttgatgtacggtctccgtgacgtgcttcatctcattagaggacaatcctttgctcaatccttaatggactttacaaattggccgtcctccctctggtgcaagattattataattttattattcatttcaggaattagttgccaggaatgacaacatgat

SEQ ID NO: 14473 - DNA, 201 bp, Bos taurus
caaagagatttgatcttgatgtagaccactgactttctctttataccagggtcatggggcatttcaactatggtgatacacctggccagtagtgtcccctgtggactggggtgaccgtgccaacaaccgaggaacactcagccctctgtggagcatcctacgctcctcttttcacaacggtggggcagtgggctcatatga

SEQ ID NO: 14474 - DNA, 201 bp, Bos taurus
tatatataacaccatgtagagtcacaattcttgaacaaaaagtacaaatacagaatatatcacaacactaatactaacaaaattaagatcaggaaaagtaattgtgagaatgactttgttcagcagcctgcaccacacctgatcatctaactcacaacctcctacatgcttccatccaattctcccaaactcctgatccaa

SEQ ID NO: 14475 - DNA, 201 bp, Bos taurus
aaagcttttgaagtagacagggtgtcttctcaccagtctcctgtgcttcctaattgggcaagccattagaaggtgaggtcatctccccagagaaggaggcggggccttagcactcagtagcaggggggccctggggtgaggacaaaaccagcctgaacatctgcagtgtctgttgttactggagcagcggctgaaggggat

SEQ ID NO: 14476 - DNA, 201 bp, Bos taurus
caactccacctcagatcatcaggcattagattccagggatcagggaccccctgttctggaatatgtgagtgggcccaatgacatgacattcctgtgtgtaagctcagtcgcttcagttgtgtccagctctttaagaccctgtggactatagccctccaggctcctctgtccatggaattctccaggcaagagtactggagt

SEQ ID NO: 14477 - DNA, 201 bp, Bos taurus
cctcatgcgtttctgggttggctaccaaaggccagccatggcgtatctgtctatgtcgtcagctcaaggttcatggtgggtgaaataaacccatgacataacatttctggcctttttgggttttttttgactcaatatctcaagtcagtttctggtccctatattaaatcaaattaaatatttacttgagttactggcaca

SEQ ID NO: 14478 - DNA, 201 bp, Bos taurus
cctaactcctcataattgctttccctttatttaagttagctcaagtgggtttgtttttgccgagtaaatgatccctgattaagacagcccttccgggagaggtgaagcctggcctgactcttgtaagttaagaaacagtggttgagcccaggtacacggcaggcactgggataggatggagcccctgctctcctgaagcct

SEQ ID NO: 14479 - DNA, 201 bp, Bos taurus
ctgtacccatgggtgtgtggctttccattagtcttcatctgtattgggttctaatttgtatttagtgagaatggaggagactctgcagggccgaggagccaagcaagttcctttctgcaggtactacatctgccaaaccaaggaaaccatggccatgaagcagttggctccacattcagaagtaaactagaactgagccct

SEQ ID NO: 14480 - DNA, 201 bp, Bos taurus
atagaaatgtaatccatgtagatgggccaccagcttgctttttttccttccatttgtttctgttgtattgatacatcttctaataaggaaaaacagaccagtggccttggaagaaggatggctgtagtgattggaataataaatactaccaggaaaattagaggaaatgtgaaaaataatggagagatttactccaaactg

SEQ ID NO: 14481 - DNA, 201 bp, Bos taurus
ttttgctggggggtggggggaactggatctcagacaggtgaagtaatccgcaaaaggacacagctagaaatgagcaaaccctggccatttgaatccagagtattttgggatagactattgatatctgtttattttacttattaacaaagcccccattattattgggggccacaatggatctagtgaaaagaccacatcttc

SEQ ID NO: 14482 - DNA, 201 bp, Bos taurus
atccaataggccagtaagtagcacgaaggcacgatgtaagtatctcccactacacacagactggcctttcctttgagaaacgggccttttggattttacatggggactagctcacgataagcacagtgagtactgccccactggaggaatctttctaaggcctgtcaaccaacaaaactgtggatattgaaatatttctgc

SEQ ID NO: 14483 - DNA, 201 bp, Bos taurus
agaatatacttgatgtgaggaaacactaggagctgagcactgaacatgcccaaagtgcatctggaactcacatgtttcttttcggcctacaagtgcttgcgactgaccaggcaacattggcatcaaggcatctccgaaatgaaagcaactgtttcagccaaatctcagaaactctataaaagtaaattggatgataaaggc

SEQ ID NO: 14484 - DNA, 201 bp, Bos taurus
aatgtactctgtgtgtccaaaaagaagtagattgggctcagcggacatccagtcagtctctgtcaacaacataaatctgtataagctaaaatcagtataattgagagtgttttctttagccatatttgaagcactggggataccaatttatgcaataaggagctttcagaatatacaatgtccctattacatgcactggtg

SEQ ID NO: 14485 - DNA, 201 bp, Bos taurus
tgaaagctactcaaagggaggctgattaaaataatatggatttctaattaaaaatcagtctcctagccatgcaaatttaggaaaagattcagtggttccctttctcattttgaaaaattcccccataaacacaggtaacttcattactaggtcaaaataacactttaaaagctaaggaagagcaagcacaccttctgttaa

SEQ ID NO: 14486 - DNA, 201 bp, Bos taurus
tacactgtagacctcttgataagtcacaattaaagcagaagtcctcaagctggtggcccataggcacagtccacaggtatggcttaatggcctacagagtatttaattaaaaattaggagttctcatactaaaatttggatgtctggtttctctgaatacaaagacctagcaacaatgaacaaccacccagtgggccagta

SEQ ID NO: 14487 - DNA, 201 bp, Bos taurus
caagagttctggaaccaatcccccagagatactgagggaggcctctattttgttcttactcctcctatcttatggcactattgcccatgtgagcataaatcaccttatatttatatttaactttcaatctacatgttactgattcttgatcaggccaaagctgtaattcagtatattgagtccaagtctgaagattttgtg

SEQ ID NO: 14488 - DNA, 201 bp, Bos taurus
ggtcgcacagagttggacatgactgaagcgacttagcagcagccctccagtctaagctggtctgccctgaggaaactcagaaaggaaaagaataccggccatgtagtagccatcagactgtagccactccctatggtgagccctgtggaaactcaggatatgaaaacacaagatattggccctagataggtgagatgcata

SEQ ID NO: 14489 - DNA, 201 bp, Bos taurus
cccatctccatacatctggaaccacgctgtccagtacagaagccagtagccacacatggctgctgataatctgcagtgtggccaggctcaactgacatgtcgtgtaaacacaaatgcacacaggattctaaggcttagagcataaaaagatagaatgtaaagggccgcattagtaaactcaaattgctttcaggttaaaat

SEQ ID NO: 14490 - DNA, 201 bp, Bos taurus
ggcagaggaaacagggctccagggaggagacattttgagggtcaatacatggacatggtcaaggcccagtggggaagaaactggcctgagcgtggattaaggtataagaagggctaactcaaaggtgagccctgagagtcacatagatggagaaagcacgctggggccattgaagattgttctgcacgaaactgacatgat

SEQ ID NO: 14491 - DNA, 201 bp, Bos taurus
ttcctagatatctcttctaaattatgaagatggtgtattagatccaagctccattgtccctttgatagatggggggacagaaggttttaaaggaaatgcccgggtgattctgcctggaatgactgcttgtattgaatgcacgctggaactatatccaccacaggtaatcacaaaagcaccccgcatctgtttgatagtatc

SEQ ID NO: 14492 - DNA, 201 bp, Bos taurus
ggccattctgcctgttgaatctgaaggcagggagcaatttcattcggtgagtcggattactgtggtgagaaccagttggattgcttgctcttgggaatgttttatctgttgagtgtcctgttggcctgtaccagttggtgccggtatgaagtgggtcatgtccttcctgctcactcttagaatctcttctgttaagttact

SEQ ID NO: 14493 - DNA, 201 bp, Bos taurus
tgtgggtataaagaagaactccacaatggttctgcattttaaatcaaaggggaaatcagattttaaaatgatatttacaagcaactttcaagacacttatacatctgtatacttttggatgctagctctctgttcttacaatgtaggaaactgctccttggagggatatttttatttctcaatttgaaaaggtaactttaa

SEQ ID NO: 14494 - DNA, 201 bp, Bos taurus
agtggctgctttcctgtacttgagatcacagcctctccatgattccttcccttcaactgaagagaggaggcaagcatctgcatgtcctgcttctgccaaacgctgagcctgacttctctccatttgcactgataaccacacttgggggcaagatttaattacacaactggggacactgagaatcagacagtgctttgcctg

SEQ ID NO: 14495 - DNA, 201 bp, Bos taurus
gtgcctggtgaaagatctaaaaatgtccttctttttaaagaaagaaataagtataattagatttcacaaatggcccttgctttagggcatggtggaggggcgggataaattgtcataagtgtatactgtgtgtgacacaggccaggaaacacccacgattaaaatcatttcctaggatatatttttaataccctgaaaatg

SEQ ID NO: 14496 - DNA, 201 bp, Bos taurus
ttttggaaaattttaaacacaatcaggactcccatctgcaaaccttttcagaactttcatacactcacacacactgcaaatctccaagagaaagacacattgtacagtgagtgtttcctcagcagttaatagtttttctccaaagagcatcttgaggggacagtgtttttgaattgggaaatgctaatctgaatattttat

SEQ ID NO: 14497 - DNA, 201 bp, Bos taurus
cctagtttcagattttttttaatgtttcctatgacacttcactctctccacataaaggaattaggagagaggagattggaaggagcatctctgggagtgcagtgatcaggagttcaggtgaacacataggaattggtccattatgttctaagggtcagcatagtgtagtggggcagtgcacaggtcaggttaaaagctcag

SEQ ID NO: 14498 - DNA, 201 bp, Bos taurus
cttgtgtggatttgggtaataagcgtgcatgtctggactttccaagtgctgttcacttcctataaagctacatggatcttgtgtgatttgggaactactactccttccctatatattttttcttttttgtaaagctatcctatacctactcccttggggtgcattttattgttgactattaattgctcaatggcgcagttt

SEQ ID NO: 14499 - DNA, 201 bp, Bos taurus
aatttcagtttaaaacccaagtctttttcaagtgctcatatacacatgctagattgaaaacttgatgcttacttgttaatctaaatatttcttatacatggcaagtgcacagaataccttattttacacaaatgtgttgaacattttcatgtcttaaacatttctttacctgggctagctgcagtattaaaagctagtcac

SEQ ID NO: 14500 - DNA, 201 bp, Bos taurus
gggcccggcactctgttgcaggaagagaggttggttgtggtcacagcagtaggtcttgaattgtgaggtggtgcagtgaatcaggccttggccagtattccgtttgggctaagggctagggaaaggaattcttccccataagaccctctccatgaataaccatgaagtccttaccaagaaggcaacatcgactaggccaga

SEQ ID NO: 14501 - DNA, 201 bp, Bos taurus
ctgtccggccggaccgcccacctccctccacgccattcatcctccctctcctcgtctctgtccacctctccatccttctctcccagtcctcatcgccgccgcctaagctcgcagcccgaacttggcctccggcccacctcccctccacacctccctagccaccacacgacccacctgccgacgcggccatttctagacgcg

SEQ ID NO: 14502 - DNA, 201 bp, Bos taurus
ccctttgcattctgccatgcttgaggagactctttccctgaaaatgcagcctccattccaactatggtatgtatttataggccccttctgcccagggagattttagggaaagccaaagccttctgggaaggattttctttgaagagtaagatcatcttaaacaggcgtctgattccctttgtgctcttggttgttttgtga

SEQ ID NO: 14503 - DNA, 201 bp, Bos taurus
ttactataaggctgtaagcttgctgcctgctagccttttcagctgtggctctcccgtggctggcacttgtactttgttcacctcttgtccaggcctctctctccctctctttctgtcaccttaggatggtgacttacacttagagacctcacctgtgaggtagagaacagtactagcgcctggttctgaacccagagtctg

SEQ ID NO: 14504 - DNA, 201 bp, Bos taurus
ggcaaggggagaaaaggagggaaaaaaataaggggcttgatcaactcacctagaggggaagataaagccaagaggggccatgtcagctttgaccagaagagagaagctctctgggcatttctgatccggaatgcctctctgtgggtgggagttcaggtggagtggctctctgttcctgactttttaatgtcctggcccagc

SEQ ID NO: 14505 - DNA, 201 bp, Bos taurus
taggatctgggtcagggtataagttgaggtcaggatcagtgagggagttactgtcagggtgacagaagagaaggtctggtacaagttcagagtgagggtgggtgtacatttcagagtcagtgtcagggtgagggtcaggttgaggatcagtgatcaccatcaaggtcaggctaagggtcctgataagagttagggtaaata

SEQ ID NO: 14506 - DNA, 201 bp, Bos taurus
gggtacgaagaagtaagtggagattgtgcgggtagaactttacaggaagagactgatcataggctgaggagtcctctggaacacacattttcctttggcctttcccctgttcctgccgggaatgcagacactgacggagttgaggcagcaaacttgggaccgcatggagaaggcagaagcagacagggtccctggtggccc

SEQ ID NO: 14507 - DNA, 201 bp, Bos taurus
tggtaatgcacttccctcaaatcttgcagatttgtcaaatgctgtaaatgaaccacagttttctctcttttcgtctctggggcccagctctagtttttcaatcagcacaggcaactttaagcagacaggacagctgggaagggaaacaacccttccaaagaaggctgagctccacgtgctggccccagctgtgtgtgaagg

SEQ ID NO: 14508 - DNA, 201 bp, Bos taurus
cagtctacagggttgcaaagagttgaacacgacttagcgactgagcacatatatttttagactgtaacttgtgtctaagcttttatattcctcaagtgttgttagctacaatattcacgatattagataaatgtatttatattttctacactattactaatcaatccatggaatatgtgtgtgtgtgtgtgtatatatata

SEQ ID NO: 14509 - DNA, 201 bp, Bos taurus
tgctgtatctatccttcaaagaggtctggacacctgcttcagtgacattcattcattaacactatatactgagtgttgtgaggcagacaataagaagcctataagtagatggacttgataatttcagatcataagtgcttcaaagaagaagaacttgattgagtcctgaaaaatgaggctatttacataataggggatgca

SEQ ID NO: 14510 - DNA, 201 bp, Bos taurus
tttagtattgttctcggcaggctataaagcacagactcagtctatcacatggagagacccaaccaaactctgggaacctgttctcttcaccatccactcattcggaaattctagggatgagaaaggtagcacttgaggccaacatcactgtgacacagggagtgatttggtgctgaatttttccggaagcagaattggcag

SEQ ID NO: 14511 - DNA, 201 bp, Bos taurus
tgtattcagaaaggaactgctcctagaatatcgcacttggaaaagtagtgtgtttgggggtttatttttttggctgtgtcacatggcatatgggacctgagaacctgaaccccatgcagtggaagcacggagtcctaactgctaaacttccaggcaattcccagcagtggaatttttttttaaattttacaaaactaactt

SEQ ID NO: 14512 - DNA, 201 bp, Bos taurus
tgatgtgaagacctggcaaagagagatttgaagatgccgacctgtaagactggagtgatgtcgcagcaattcaaaaaatgctggccgatacctggagctggaagaggcaaggaatggattctcccctagagcctctggaggaagaaagacactggcaacacagtgcctttgattttggcacactgctactgatttcaaact

SEQ ID NO: 14513 - DNA, 201 bp, Bos taurus
taaacaatttcaacttcactgagccttccctctacttgcacatgagtatataaagtaacctaaatgtggatttttattgactactttctttccaaggccaaatattaacagtaacccttcagggactgatctagtggtaatgagccaacatttcttacagcctggcaatgcatcactctgtggccatcgtgctttaaagat

SEQ ID NO: 14514 - DNA, 201 bp, Bos taurus
catttccaatggccttgctgcatcacagtgcatagcaaggaaagtcactttgagaaaaaaaggacaatgagattccttgtattaggcccagttcttctgttactattaaattaaactgtttatccaattaccgccactcacatttctgtctggaggctgagggggttgcacaagccaactgggaatatggcctcttaagcc

SEQ ID NO: 14515 - DNA, 201 bp, Bos taurus
tcttttgaaatactgagaattgactactgtgggaaagccattaactaatgaatgtatagagatccaatcccatagactattccatttgacaaagttgttgatgatcgctagtatggctccttggtccatcccatctaacccttgaatagcctttcagcattcctcataattggtcattagagcccttcttaaaaccctcca

SEQ ID NO: 14516 - DNA, 201 bp, Bos taurus
aggatggaaaataacctttccacaaggaagtgatgatgaaggcaaagagaaggtaaccaggaatcaaagggcagatggaagttccagatgcctctgttgaactggtccatgtttcttggctcacttccttagggaagtgagagtttgcccagattaaactttgacaggatgagataaagcactgttgtacaatccccatat

SEQ ID NO: 14517 - DNA, 201 bp, Bos taurus
gtggtggaggaggagaggtcacacatggcctcctgagacattcactccatacccttcgccatgccacagcctctgcttgcctttcctctgcctggagaacgctccctggtcttccccagagctggctcctcctccatcttgtgatcacaactcatgtgtcattttagtggggaggcctgtcctgatccatccttggcccct

SEQ ID NO: 14518 - DNA, 201 bp, Bos taurus
agtggttaggcacataaatgtaggtgtattttaaaaaatcatatatttttaaaatatataaccagtgcttttgagcaccctcaagtaatgtaaccaccagccgtccttcgtcctcccaccatgaaatgggcatcattattcctgtgtttgccctaaaagtagataggtgatggattcttctgcagttcctgaatgctaatt

SEQ ID NO: 14519 - DNA, 201 bp, Bos taurus
tcagtcacctggctttgtcggttctgaattcctgatattgaccagagcttctctattcacttgcttctgctttgttccgggccaccatcaccactggttctgagtagcggtgtgatcgcctatcaactgtacctgcttccagtctcaccccaggacatctaggctccattctgctgcaaggcctatctttccacaatgcaa

SEQ ID NO: 14520 - DNA, 201 bp, Bos taurus
tacagcaagagaatggggtccatcaaagagacctgaggcattatttcaatttaaaggcttctgaaattttcgaaaaacttctctctttggcctgagcatatattctgccagaagtgtctctggattactatgatatggaatttggtcacttgacttaaaacaaatggtctttttggccaattcatttggtcaatctcttaa

SEQ ID NO: 14521 - DNA, 201 bp, Bos taurus
atttcaaaattaatatgttaggataaaaatcttttataaaacatatggatttgtccctccatatccacttcccacctctctctcccaggaggtaacctggatagaccacaagcatgtgttcccttgggctctggtttgggctggattcagccaatgggagcccagcacgagatcaaaggatggggaagatggggagagtga

SEQ ID NO: 14522 - DNA, 201 bp, Bos taurus
acttgtccgagtattcctcctccacgtagtccccctgatctccctgagggagttagtgactttccccttagacattattctgtatcatcacaacatgatacgattgttatctgtttgctttcctaagttgtggcaaatttattttgaatctttgtatcctctgcccagtgcagtctctggcatagaaatgtgactcaatca

SEQ ID NO: 14523 - DNA, 201 bp, Bos taurus
atagtgcccacctgctgtatagaaataaatgataaaagaggattgaaagctacagaatcaatccactccctagtttggggcctagacatggggatggaaggtacaaggtcaaggcagggggaaaggacatagaaaggggcaagggaattactttggttcctaacctaccaccacttaccataggtcatggcctcagatatg

SEQ ID NO: 14524 - DNA, 201 bp, Bos taurus
tcagtttatagtgggccatcagacatttaaatggatgggtttttttaaaatgcattaatgttttttttttcatgagcatagccgtcatttgttgagaagctgcaatgggccagatgctgtgctagagctgggactctgacagatgtgaacaggtcagatgtatttttagttctatggcgcttttattctggtgaaagaaga

SEQ ID NO: 14525 - DNA, 201 bp, Bos taurus
gtcgtacgtttgcatctacagaaagagggaacggagtatggggtggggagggtgggcagagaaagaaaagaaattaagtctgttcctcgggccaccagctggggtgttgtcaaggagacaaagcgtccaacgggagggtctgtgtcccccttttgcccagcggtcacttcctgcccaggcttggaggtgggaaatctgtag

SEQ ID NO: 14526 - DNA, 201 bp, Bos taurus
aacttgctggctaaggaagctacctaccttggaacttggggcagaggcttgtgagatttgaaaccatctgccaccatctggcaggtcaagtcccatctataaagtctgactccagatattcatacaccattaggtatatctaggaccctgtcccctcattaaagtgagagtacgctgggtctgaactccattcagacactt

SEQ ID NO: 14527 - DNA, 201 bp, Bos taurus
tagaatatatttgactgtggatacatctatcagatgaacaaaagcaaaaagaaaaaaaggaatgaaaaatatctatctgtaatgccctcacagcctgggagttataagatacgagtattagcagttacagtattagactatgttgacaagactttgacttctgttttatttgaagaggcactgcatcgggaagcctttaaa

SEQ ID NO: 14528 - DNA, 201 bp, Bos taurus
ttctgtaacttcattcctttctgagtttctttgagctctgagctttatcctcttcattcgtctctttctgataaggttctcccctggagaatgcgggccttattacaacccagctcaaactcttgcgacccacagaaaaacatccatgaaactgacagacagcacaactgggtaatataaagtgaagaccaaccaacacgg

SEQ ID NO: 14529 - DNA, 201 bp, Bos taurus
tgtcagctgcctggctttaaaaacaggagtcagcactcgaaaatatttggagaaattaggtttagcatgggatagaggctttttcaggtaagggacagagtattttcaagcagacacttgctttcagccaggatcctgaacatcttcaatgttcagcctgactgctgactggggtctgaggagacaatgccctcagataca

SEQ ID NO: 14530 - DNA, 201 bp, Bos taurus
atttttatccttttgggcttatctatggaaaacataatcttaatttgatgtctaatatgcactccacacttcaaatgatactcattcatttcccccttttaccagaagtatttaagctagaacgtaataacactggtacctttgatttactttcacagcttataggcataattttttacatacgtctatcacatgtcaaat

SEQ ID NO: 14531 - DNA, 201 bp, Bos taurus
accacacatttcctaaaaggggaaaaaaatacatccttgacttggaattgaaaattacagttccatggagaattgactactaattctaggccaatccatagcaacagctgttatcaccgcttcatttacatgtcacccattcagaaaactgtcctgagcctgagcgacgggtgtcattctcattttgctgtggccataagt

SEQ ID NO: 14532 - DNA, 201 bp, Bos taurus
gtggctcctgagctcagcggcctctccttttgagtttctgggtaaagtgagaactcctgagtatccaagaaagccatagggccaagagtccttcagatgtaccctcaaacatcagtgttttctgcataaacaccgggttggcaaaaaagtttgcttgtgcattacggaaaaacccaagttaactttttggcctacccgata

SEQ ID NO: 14533 - DNA, 201 bp, Bos taurus
gaggcctggcgtgctgtggttcatggggtcgcaaattagtcggacacgcctgagtgagtgaactgaactgaactctccaacttttgtctctcttattctaggctggatttattctaagcttggccttccctttgatggaagtgactagcatttgaccaacttgagtccattgtcttcctggaattttggaccaagccaccc

SEQ ID NO: 14534 - DNA, 201 bp, Bos taurus
ataggttgtgctgaattaaactttctaccggaacctttccaagacatttcacatggattgtcaccaaattgacgccgctgatgcagtggtagttgtgcatctaaaatctgttggtcttctctgtggattgatctactcataggcgtggaacatctatttgttaaacttttccctgttcaaacagaacattttctagtgccc

SEQ ID NO: 14535 - DNA, 201 bp, Bos taurus
tttagcattcctagcagtctctcaggttgcaggggcagagcacactttgagaaacaaaacttgtagaactctattgccattctgtataaataaagtgtgtggtgttgtttgatttcatagatacagtgttgtttgtgtttcacaaatatccacaaccaccctgttcttcaggcaggggtggtgaatttggtggccaatagt

SEQ ID NO: 14536 - DNA, 201 bp, Bos taurus
ttgatggtgtgatcacatgtgctttcccttcctctggccttctgcagataaggtcagtttcatcctctttccctccctgctcctgtgttagacagaaagcgggggtgattggccaaaattgctccttaaattaaattttgcctcctacctccagcataatcataagcctgcaaattaaagatgcagataattttgcaatca

SEQ ID NO: 14537 - DNA, 201 bp, Bos taurus
tcaagaaagtgagccttccttgaagtgaatggctatttctgtcttatttaggtaatttgttcttgtccagctcacattaatggcaggccttgtgtcatatctaatagttataataaggcactcaccaaagcttcctcttacgggtagaagatactttgggttttactctcatggagtaagaaggaagagagaatagaagcc

SEQ ID NO: 14538 - DNA, 201 bp, Bos taurus
acttctcaggctgtaataagggctatattagctaatgtatggtaggtctttggcatgctatatgttgtgtgatttttaatttttcatgattatgattttcattataaatataatctaagtctcagagctagttattcgtggagatgtaactgaaactctagtgggccttttattcagtgctttctcttccttactttgcta

SEQ ID NO: 14539 - DNA, 201 bp, Bos taurus
ttcactctgtatgacatactctagatctactgttcctaaaagccaagcccagtggcaggtactggaaattcagaagatagacatggtcctagggccgaccatcttgtggagcctactgtctccttagaaacagataaagtaacactgtgatctcagtgctatgatggagacaggacaaacagctacccatgtacgttcagt

SEQ ID NO: 14540 - DNA, 201 bp, Bos taurus
ctctgtttattatctatgtgattggcaaagtgaaaataatgggaggatggtacttagagttaagaaggcagcaggcaggccatgtgggtactagaagaaatgcactgcatttgacattacagaagcgagttctaatgtctttagttatgtctgactctttgcgaccccatgaactgtagcctaccaggctcctctgtccat

SEQ ID NO: 14541 - DNA, 201 bp, Bos taurus
tgatttgaatttaccatcattccaggctctgtgtgattcgggaaaaggtagtttccgggtatcccaattatcaatcttgatggtaatatttaaaataaaaggtatctccaattggcctgaaatttaagtccttcctagctttattcccatgcaacccaagtattaggagtttttcataactgtgaggaaaaggggagaaac

SEQ ID NO: 14542 - DNA, 201 bp, Bos taurus
ggcagtcagttagctgaacaggaaatgtatatctttgggtggaggtgatttgggagttacacagggtttcaatctcagctaatcatgaggccaagaatgcgaagttagctagatatagaagaagaagggtctgtgtctggccttgacacaggtaaacatatgccatcttatggaagttatgagagcaagtcttatctaagt

SEQ ID NO: 14543 - DNA, 201 bp, Bos taurus
agctctgatgactctcatgtcccatctgttgcatcagcattcttgagatactttacgttctgctaaaacgttgaaaaggtgccagtacagattcatccaattgtatacctgacaaaatacaatattgccatattatcctattatgacttattgaaagtctttaagtctactgtgaagtaaatataagttcatgctgacttt

SEQ ID NO: 14544 - DNA, 201 bp, Bos taurus
actctcttatttgataaagagtttttgggtacctcctatgcagcaggcagattgctgaatacttgggacgcaaaagtacaaaaggtagaagagggccctgacactatatggaagcaagtttaaaaaaaaatcaaataaatacgaaagtgaaagtcactcagttgtgttcgactctttgtgaccccatggactatacagtcc

SEQ ID NO: 14545 - DNA, 201 bp, Bos taurus
aaggcatctgtgaggccatgttccttttctccccacagcggtctggacctcagttccagtcagagtttaacaagcaggagctcccctccaggcagttagcgaagcacgggacagacctggccatgcttggaacgggcctgctgccagttttcactgagctcggcttctccaaagccgaccaagcccagtgacccatgtggg

SEQ ID NO: 14546 - DNA, 201 bp, Bos taurus
cgagggttgaaacactgagctgaaacagccctggcccatggcctagttcactttctgtttcctcataagagacaccccgatacacacttcagttgtggtggtgcagttcagaaattataggcaggccaccctgttattttttttaagtgagggtccttttcagtagagaaacacattggctttcagtcgaagactgcagga

SEQ ID NO: 14547 - DNA, 201 bp, Bos taurus
aaatgtagcccagttcttcctgggaccccccgaacgggtgcggggctcgctggctctaccatccagctcagtcagctgcttgctgaggcccatctccgaatcccaaacactgctgctcccaaggttttagttacccttgtcaccatctgcaggacaaacaatgagatttggggggagtctccaggcctgagaaagtcccct

SEQ ID NO: 14548 - DNA, 201 bp, Bos taurus
taataaatgtgtcttatttaaggccgctaagttcatacagtctaattctgcacaaatgggatccgagtgctggtgcagatagtcagtgttccctcatcctggaggccttccctgcctcccttcagaagaaagttttcctgcttttgctgtcttgggttattcaatgacctgctttttcactttgtgaagcagggacagagg

SEQ ID NO: 14549 - DNA, 201 bp, Bos taurus
tgacacagaaatcttttgacatgtactctggaggtaggcccctctgttggccccaaagttgagggtgggctgagctgctgcctgtggcatggaggccacctgtgtgccagagagcttagctcctattttcagagatacaaacagacagaggcagaaggggctggggggtggagggccgtcctgctgcctttgaaacccctt

SEQ ID NO: 14550 - DNA, 201 bp, Bos taurus
gtagagttactagctggtgctgattccggccccactgggagcagcaccaaagaagggctttaaagttcagaggaatttaatttccatcatgaaagaactcggaggtggggcaggaggggccaaatcaaagccggcttttgagaaggcagaaacccaaaagcagctcccttgcggggcccgggggatctgctttcggaacat

SEQ ID NO: 14551 - DNA, 201 bp, Bos taurus
cccctgcattggcctgaggacccctaaccactggaccaccagggaagcccaacaatgtatgtttaataagccacaaagcaggccactctggtcagtacagttaaaccatatataaagccagaatgacattcccatgcctcaatatgtgaagatttttccccatcttttcccctttggatagaccaaagtatttggcccccg

SEQ ID NO: 14552 - DNA, 201 bp, Bos taurus
tgcccagggcctggcacatttcaaggggtcgaagttccttctgcccccatatctgtcgtcccttcttgggaaaccgtgacgggggcacagcatggctgttaagagtccaggccacagactttggacttgggggtggcgcaggggacctggttctgccattcgtcagacgggtggtgacccggccacctcacttaccatctc

SEQ ID NO: 14553 - DNA, 201 bp, Bos taurus
gatctttcttgaatcacggccttagccaccagggaagccccagtgggcttcaataatcctggcgcttgaagacccgtctgccaggtgagggtgtggtagtactgccagcactgccccggggccacacttctctaggaccctgtgacactagcagtgccagatgtgtttccagctcacccctctttccattatggccaccaa

SEQ ID NO: 14554 - DNA, 201 bp, Bos taurus
ccatcccggagtcaataacacccctgaacactcacagaggaatcaagggtgggtgggaggacagggagcagtccaaggggccatccaggttccaaaaggctccttcagtcatgttcagtataaactccttattacctgacaggtctcatcccagcattaggaaagagttcagaaacctgtcctctgccagcatgtgcggca

SEQ ID NO: 14555 - DNA, 201 bp, Bos taurus
gtggaatctaaaaaaaaataaaacaaatgaacaaacaaagtaaaacaaaaacaaagtctcagatacagagaacaggtcagttgttaccagagggtaggtaagctgggcaaagtgggtaaggggttaactgtatggcgatgattgatggtaacgacttgcggtggtcatcactttctagtgtacagagatgttggattataa

SEQ ID NO: 14556 - DNA, 201 bp, Bos taurus
tgttttgagttaggttttcattaggtgcctcattaggacctttcttggtgggggaggtatctgcatccccaatcctgtgaacctgaagtactctgcggccatgtcttctcattgcagttccagaaaatgtccacaaggcggcagcacttcctcatgccccacttgttcactgggccatccttcctgggttttcaaggagag

SEQ ID NO: 14557 - DNA, 201 bp, Bos taurus
agccaccctctggcctaccttaatattaatactattgttgtttttgctgtttgccacagcatccttagattgtatatatatggctaaagcataaatccttacaaaggcaaattctatagcttctgcttcttgactctgaaaagaatgaaactttatttctaggataattgtatatggctgtttcttttatggtcaccttga

SEQ ID NO: 14558 - DNA, 201 bp, Bos taurus
agaatgcgaaatcgatatcttgccaattgaggcctgcttcgggttgcttcagctgcagttggacctctccagtctccatgggatacgaagccctagtaccggctctcgtggccgtcagagcttaatccttttgaaagcagctagttggacgtgcagtgggggaagctcaggtggcaggaggctgggccagtccctttcagt

SEQ ID NO: 14559 - DNA, 201 bp, Bos taurus
attttttaaaaacatcaaatcatgtgaagtgtaggcattgggcaagtcttttataacagataccaacactgaggcccaaaggtataacctgttcaagttagtaccctcatcttctgacaacagccagtaatttctgccacaggttgccttgtgtccggaggtagagatagcttagagccatgttcttttggaaggaaagat

SEQ ID NO: 14560 - DNA, 201 bp, Bos taurus
ttttccccatgggggaggggtctgtagggccacatggaggttcccacctggaacctctgcctggcattccagagtcagctctgggtacatacaggcctggtacctccactgcttaagtgaacctgagtggtcgtccaaggtctgcttggatttctttgccaaagtctttccttctgaggacaaaccactgtgtacactgtt

SEQ ID NO: 14561 - DNA, 201 bp, Bos taurus
ctacatggattgactgagtggtccttcgtgttgcacagtgttcgctgtcactcacgcactgatttcagatggcagctgggctgggctggaaggtgcgaggcggctgtcttaccaggccggcatcttagtgctggctgttggctgggttacttgtgctttccttcttatgatctctctccatgtcgtatctcatcttccagg

SEQ ID NO: 14562 - DNA, 201 bp, Bos taurus
tccctttggatttttaaagtaaaaaaataaaacctttaaagacacagcaaaaaatttccactcattttttttaggcccccatcttcactggttttgtacatcaaccttttcctactccacagctaaggactcataatggtgagaaggacaatcgtgcatcttaaataatgtacaaatgtatggattcaggagagccatagg

SEQ ID NO: 14563 - DNA, 201 bp, Bos taurus
tccactggaggaggaagtggcaacccagcccagtattgttgcctgggaaattccatggacagaggagcctggtggaccacagttcgtggggtcacaaagaatcagaagactgagcacacttgcaccataattgctaggttttcctacgggaagtatttgtatttaggtgaagcctaggacctggtcagaatgacaactgag

SEQ ID NO: 14564 - DNA, 201 bp, Bos taurus
aggccaagttgtccctcccaggttcactactagagatacagctgctcttacaacttgtaatgccatggcacaagacaggtccctgttcataagtgttctcaaagtcaggctcctgggccacacttgcctaggtaaaggtaaaacagcatggaccatggctttcttgttattttaaaatgtagattttattttattcagctc

SEQ ID NO: 14565 - DNA, 201 bp, Bos taurus
gaagctaagtacatgctgtcaggcgcatggaaaatagactcacaaacagaagaccttggctggcacagacttcttcctgccgtgtagagtttgggtgttgcgagtagtgtgttgatcatgagcaactttgctctccgttttgttcctggagaaatagtcttacttaagtcttacttaatagtccttacaaaagcttgggtt

SEQ ID NO: 14566 - DNA, 201 bp, Bos taurus
ccagagttcacccaaactcacgtccatcgagtcggtgatgccatccagccatctcatcatctgtcgtccccttttcctcctgcccccaatccctcccatacattgctcaaaaccccaaatggaagaattgtttccacagcaaatccattagctgcagtggtgtgaaaaaagggggggcttttataatgtttaacactagca

SEQ ID NO: 14567 - DNA, 201 bp, Bos taurus
ctgtcatgcctgttattcgtgtgtctctgggaggctccatggagaccttgtatccagagaggaagatgcaactcagattctccttccctgtggacctaaattggtcctagttagggtcagttcagagtaccccctataaagctagtaagcatcctgaaatccaaacacaagggagacagcacagcaagcaacgcaaatgag

SEQ ID NO: 14568 - DNA, 201 bp, Bos taurus
ctcctaggagcaagatggccaccagatgcgggtgtggtggcatagagaaggtggtagtccagtaaaactctccgttcacctcattgggtctgactgagtccttgtaggccagcgagtgcaagtgactggtgaagctgagtcctagactctgggcgggagcgggtgtggagcatgtgggcagagttggaggaggtgggaatt

SEQ ID NO: 14569 - DNA, 201 bp, Bos taurus
cacttgaggcaaaatagaacttctttgttcaaaggaaatagactttttaaagtcttgtaaaatagacccacaatgctttttgggactcaaataactctgaaccaaaacgttttaataaattaaacataagtggattagaaacagacaggttgtcttttcatgaaatacacccaggccagactcagaaggagaagcacagag

SEQ ID NO: 14570 - DNA, 201 bp, Bos taurus
atcttccttttctttctgataacggaagggagatgaactctgctattatttctgagtctatttctttgtgcctttccagtatgcatctctgaatggggccgtgtgtaaccccttgtggtactgaattgtgttatccccaccttcaatgggtaacctttaatcaggcacaggaggtgggggtgatggtgtgtgacttggctg

SEQ ID NO: 14571 - DNA, 201 bp, Bos taurus
gagaaaaagactgttttcaaaaagaaaagtataatatttagggttaagctgttaaatcgtatattcttacatagccatagttttagctagagaacttgttcctaggtcatgtgctggaaaaaatggtatcagtgtttcctggggttatccagagagaacataacttccagatgttctttcaaggtgcatgttggggagcat

SEQ ID NO: 14572 - DNA, 201 bp, Bos taurus
cacatcagacttacattaagtcttcagatacaccctgctctttccatatgtgttctcctgtggtatgatgttcccaggctaaacatatgctctaaatcccgaggcctcagcatatgtcctccatctcaacagctgtcatgcacttctctttttttcaagcatgaagtcagggctcacacctatcagagtcactgataactt

SEQ ID NO: 14573 - DNA, 201 bp, Bos taurus
ccagaaagatatcacataaaattgcaaggtgtatgttttgggttatatctgggacagggcaatggtttcttcaaatgaaatggtggtaccatccagctggtgagataaggaaccatctcaggctgaaccaaagtcagaattatggaggcagaaaactctgttccttctgagccagaatgatcgctcatgcctatctgcact

SEQ ID NO: 14574 - DNA, 201 bp, Bos taurus
ctgtccagttcttagaatgattgttaggttcacaggtgtttgttgtattatgacccactggtgactgactgccccacacaggccactgacagtcctgtatcgtacaggaatattattaaatcctgtgcgcctgaaagtagacagaggaaaaggagaaagaaaggaaccctttagtccttatgaagatttaaaggcctcttt

SEQ ID NO: 14575 - DNA, 201 bp, Bos taurus
accattgttattctgttattactgctagtatgatgctgacgcaaatggggtggcttagttatttcactctatgattctaaaccaaactagggtcagactccggacatgataaaatcccacagtctccctggtctctcctacacaagaactattaaatttttcagcttaagacccatctctgctcagggtgatttctccttg

SEQ ID NO: 14576 - DNA, 201 bp, Bos taurus
atatgggaaacacacatgacaagcttcaaataaaatctctcctctgacctccaaaatgccaagaatgccctccttagaactgggctggaccatggccaattaggtctgaattcattacatatgttttgggaatagggtttttgcctggactcaccctaatgaatcactgggccttcatggaaatgctctaatgataacaat

SEQ ID NO: 14577 - DNA, 201 bp, Bos taurus
cttgaatcctagcttgagctacttcattagagtactctgggcaaaagctcttggtacctaatgaacatccattaatgtcagctcttattattgttgatgacgataacaagacaatgctgatgataattaagtaaatgagaagaattacactaaaagctgggccatgaggatgaccaacacattcacagttcagctctgagg

SEQ ID NO: 14578 - DNA, 201 bp, Bos taurus
tatgctgaaacatattttaacaaattcaaattgtaccatatatgccattttatggaagtgtttttatgcattacgtgatgaaaagctttctatatcaatacgcacttttgttgtaaatattattattgttaatcatactctgatttgctgagaccacctaaggaatcaaccctttttaatattataaatgttgagagagtg

SEQ ID NO: 14579 - DNA, 201 bp, Bos taurus
tcctgcattgcaggcagattctgtaccatctgagccaccaggaaatccccacccaaccgtgtgtacatcgtacatcaccttaacctatatttaaagggccattcagacagcgagacccaccttcctacacaggagagaaggggcaagggcacaaccttgaaaaaaatgacacagcccctgaggataccacataaactgctt

SEQ ID NO: 14580 - DNA, 201 bp, Bos taurus
ggggattctttaccactggaccaccagggaagtcctggtgattgctctaacctttaaatcaaaacaccagcaccaggatagcttatcacaggggcccttgcggggcgtgtttccctactggtttcctagcaaccaatgaaccaatcagacatcaggtcacttctgcctataaccagtaaccttggcttgcagggtgtgaag

SEQ ID NO: 14581 - DNA, 201 bp, Bos taurus
tgctgcaactaggacccagtgcagccaaataaataaatatgtttttaagaagatataaattccagaactgtatggttaaggccctagagatcatctaacccaaccccatctattttcttacgggtagagaaacagaaaccccacgagggcagtagattggatctccaggaatgaaggcctcattgacacgcagccaggctg

SEQ ID NO: 14582 - DNA, 201 bp, Bos taurus
cagacaaggcaatttttatagaacaagagatctcataattttcctccttatattaaaatgaccctttttattcgtctggggaactcagatgaatcaggcatttcctaagaacacaggcagaatagttacataataaaggcagaggagggaaaaatgcaagctcctttctaaagtccctccaagtaccccatggctggagca

SEQ ID NO: 14583 - DNA, 201 bp, Bos taurus
ttatctccaccttgaaaaaacttttaaaattaaaaacaaaacaaaacttagaagagtcaagctactcacccaatatcagggggcagggcccttttccatctacttactttgcaatgttttttatgatgcaatgggcttaatgataatcatgctgacagggccaggctaatgagttgagccttataatgcaaagctttccac

SEQ ID NO: 14584 - DNA, 201 bp, Bos taurus
acataaactcttggctttgcctctgaaacctctttggcattacccatctccagtctgaaggacaaaaatcccaagactgctctttttatttaacgtcaatgatacattttcaaaagacctttccagctcacaccaggaaagatctctgctattccaaacactttaaaaattagtcagcttcttttgggggaagaaaagact

SEQ ID NO: 14585 - DNA, 201 bp, Bos taurus
agagaagagaggttagttcagggggaggaggaaccctgagatgttgctcctggagttatttacttttctgtccctatattttatcccttttctccctggtggaagctgtggcccaggggctgagcagggctccaggcctcatgcctcctaaggtgctcagcctacccactctttcctccccacagatagctacccgcaagg

SEQ ID NO: 14586 - DNA, 201 bp, Bos taurus
agacatggagcttagagcggtggggccaccttctgatggtctcatagcagtaaagggtagtcggctgggccagtggggaggggccaggaggcctcacccacgtgagattccccaagtgagggagcaaaggcaaccttagcgggtcctggtttccagggtctgggtgagttgggccctcccttcccacccctcccaccccca

SEQ ID NO: 14587 - DNA, 201 bp, Bos taurus
gctcaggctcaggctccagatttgcccttgaggcaccatcattcccagccaccgctgcaacggccagcaactgtcctcgtaaaaccaaggcctgggtgtctgaagggaggagggaaaggggatagtgactaggaggacaaggatggagaatgtactttgggtccttagcatccttcacattctggcttaacactgtgtcca

SEQ ID NO: 14588 - DNA, 201 bp, Bos taurus
ttgagtgccccatgtggagctggactccgtactgttgactgaatgaaggacaagtgccgtcttctcgcctaggcacataagagacctgtgccgtcctctacgtagttacctaggccacattgtcatggccgtaccttgatgttttcagccagcacccactgggggacacttcagttgcttaccttttgataaacctgatta

SEQ ID NO: 14589 - DNA, 201 bp, Bos taurus
gcagctcatcactgagcagttgggcaagcgggtgtctcctccaactgtcagaggcagtgttgaaacaactttccgtgccaacagtgatgggccagtggtcgtcttccctggtgggactggacccaggctgcagatgttccctctgagaaattcggattctggggccacacctttttctctttgattagccatgaggtgcag

SEQ ID NO: 14590 - DNA, 201 bp, Bos taurus
ggctcagccccgtgtccctagtcccagccctgctgcctggcacagaggagatgcgcagtgactgacagccaagtggatgaatgagaatgtggtcaaggccaggagggctggtgtgccggctgagcttggctgggcgtagaagccacagcaggaagtgggcttgaggaagacttccaggatgggagactgactgagccagca

SEQ ID NO: 14591 - DNA, 201 bp, Bos taurus
caatggcagagcagggggcattgctgccctgttggatggagggggagactgagacccaaggggtcttgtgtgtcgctgatggcctggacaagccccagctgtgacacccgtgtctctcctttccctgagtttggaaggcaggtggaaggtgacaaggccttccaccagcaggcccccagctctgtgctcctgggggtggca

SEQ ID NO: 14592 - DNA, 201 bp, Bos taurus
gggtcacagatatgactacctcacaacctgccaagcacatggacctggagacgttttctgaaggccatctagctgctggtgtcaaaaggcctaaaaatatgcacagcctttaacccagcagatctgtacctgggaatgtttcctaaggaaatagccacttgaaggagaagcagtgagcctctagtttgctctctgggcctc

SEQ ID NO: 14593 - DNA, 201 bp, Bos taurus
tctcacgcactcatttccccggctttcgtagctcattaagggagctaatggaaccgattttgcagctatggatgagttggccccacgccagatgagacctcgcttcattaagttctggctgtatcctgtcctcctcagcggctgagttccagggaggtcggctcacatgatgctcctgaccccagatgcctgggccccgtc

SEQ ID NO: 14594 - DNA, 201 bp, Bos taurus
tgctgcaagactgtccatgaggtcaaagcacgtctagagagttagggggttggcagaacctgggtgaggagattctagacatgtccagctgtctagaagagcagcaaggccaggattctgaggtcagccagaacgggcagcatcaccctggagtttctagcagaatcgctatggtgtgtgtatggggtggggggcagtgag

SEQ ID NO: 14595 - DNA, 201 bp, Bos taurus
ataaccttcaagtagccccaaccatctggggccagaaaagtttcactgctgaaaacatttcagatggctgcagacccccttttgagatgtggatagaaactcacagagcctcatccaggcctggggctgctgacttctcatggagcctccttccagggtatccagggacagtggacagatctgtccaaactgtggtatctt

SEQ ID NO: 14596 - DNA, 201 bp, Bos taurus
gcaatgggaagacagcagatggcttgggttttgccatatagaatccactcttgaagagatgaaaagggtgtttgtgcaggaggcccttccagccagcctgcatccaggcagtaattcattccccagacctgagggtggacccacagccctccccgggtggggagggcacagctggccaggtggggaacatgaggggcgtgc

SEQ ID NO: 14597 - DNA, 201 bp, Bos taurus
agtttccaactagagaagccagagtactgtggtccaaggtgctacgtgttagtgcacgtggcgtgccacagagcttgactgtgggccttactttgtgtctccgtggctaaccaatcctagagaccgagttctttattaatctttactggtggaggagatgcagccagaagggccgggcctagtggaaactgaactgtcctt

SEQ ID NO: 14598 - DNA, 201 bp, Bos taurus
gtcaagagagccaagactgtcagccacgtgagtgcaaggtcatctggggttgggtgcctcgaggggcccacagtgttctggacctgaccctaaactgaataccctctgcaggaacccctggacacagccctccttcaaccccgtgtggtggcccagagtgcccagaaagttcgtgcccgctgcctgcatcagtccttccgc

SEQ ID NO: 14599 - DNA, 201 bp, Bos taurus
ttggagatggcccagtggccacatgccctttcatgggagttccaagttagtccatggtgcctgaggctgggtcagggcagtttctgatagtgattaccagttcagggctgcagagaggcctggagatgagggcagtacccacaacacttgcaccaaccaggcccaccccatgaccaccccacggccctaccagagctgcag

SEQ ID NO: 14600 - DNA, 201 bp, Bos taurus
gtgggtaaggcctgtacatgccgccacgcaccatgggtcgcaggactgaggcaggctgcgtggtgatgggcagtgttgcagcaattggagtattgatggttgagtagatcatgccatcggccgcccgcacggtggctgtggatggcagcagctgtctgactgatgcggcctggccagctgtaggccggtactgggccaggc

SEQ ID NO: 14601 - DNA, 201 bp, Bos taurus
taggcctcttccaggatggatgatttcaatttcactaaattcaatgtagttgaatttaaatttcagttcagtttggcactttcgagccctaggacaaagacagcatcacactaggccccagggatgcagcagaaactaagaccgttgagcccacactaccctcacggaagctgcagtctccaagtctggcctttgcctgct

SEQ ID NO: 14602 - DNA, 201 bp, Bos taurus
actgttgccagacacagcttgcaggaggccctcaggacacgcggggtgtcacctggcaaatgcacaaggcttcggccagctgtcccatccatctctcttctgctcaccactcaggacccataaccttcaaaggtccctccctgcagctgccacttgaccagaatggacggagggcccggttggggtcacccggaaatgggc

SEQ ID NO: 14603 - DNA, 201 bp, Bos taurus
taaatcatcacaaacttctctggttggttttaggggtatgcttccaaaggctggagcaaaaaagccagaagatggccttgcagactctgggaacccctgcactggaaagccacagtgactgtgtgaccaggcagtcaagcaatgaagaagaccaatgccgagaaggttatgccatgcgtgacctcagattcaggcctggag

SEQ ID NO: 14604 - DNA, 201 bp, Bos taurus
aggcagagaacaagtcacagccaggacaacagagaagcgtgtgttgcaactcccctgggaaagctgcaaacaaggaggggggcatcaggcggcctggcccgggctaggagtgcacctggaggagaggtcactgaagctgggtctttcctgctggcttggggaattcccaggagggcttcggccgcatcagagccagtccag

SEQ ID NO: 14605 - DNA, 201 bp, Bos taurus
tacacagtcctgtgagttttatcacaaatttaggatccatgtaacaaccaccacaaccaggatatgagacagtatcccccaaacaaatccttcaggctgtctcattgtggtaaagaccagcccacacccctaatccctggtaatcactgacctaatacccatccctatagttttgcttttctcagaatgtcacataaattg

SEQ ID NO: 14606 - DNA, 201 bp, Bos taurus
ctggggtagtacctgaaatttgaatgactcaagggagtaaagtgagaagggttttatctagcctccaggctagaggagaaccccccaactgcccattcttgctctgcctttctgtgggccccctagagctgacctattcttcctgacaccatgcccccttccttgtgtcctggtctcaggccttgattaggtgatcctctt

SEQ ID NO: 14607 - DNA, 201 bp, Bos taurus
gacccctttctgtcccttctgagaagtccctcggtgtctctctagattactagttctctaaaccgaggccctggcactgacagatggagagggccacctctggtgagactgacttagagaaacctaggtctgatgaggaatttccctcagaatacatgcttctttgctgaggcctcagagcttctctagaggggcacgact

SEQ ID NO: 14608 - DNA, 201 bp, Bos taurus
ctcgtagcctctcaaggcccagctcaggctgtgcaccttccctgggaacagggtcaggtccacagctgcagtcggagtgttgatgggtacaaccttgacgcgcccttccccgttggccagagcacacagtccgaagccctcgggaccaggggctgcctccaggaggcagtaggactgaaagcgcttgtcctccagcagctg

SEQ ID NO: 14609 - DNA, 201 bp, Bos taurus
agggcttctctgggaggtgatggttgggcacctcatgtaatagggagtgagcgtggaggagtgtgatgagcagtctgcagtttggcctggcaggaacgaaaagcatgtgtgggggagccctggcaaggatcccacaggagagcgtgtggatgggaggggcttgacctttatcctccaggccccggggggggggtgcctcca

SEQ ID NO: 14610 - DNA, 201 bp, Bos taurus
cactccccatccctggggtcctctaggggccggcagcaccccttagctctaaaacctcttgtctctcctcctcctagaactactccggagacctgggggcgcgagtggccctacatgagctctacaagtatatcaacaaatactatgaccaggtgagcagaacctgggcgtgggcagaatgacgtgagtgggtgactggct

SEQ ID NO: 14611 - DNA, 201 bp, Bos taurus
cctgcctcttccaggtgggaccacaatctccagacccatgcaggccctccaacagctaagtgaaggcaggtgcactcaaaatgtcatggatcttcttgggaaacagtcttctggcctcctggtgctgggtttcccacctccagccatttgtcttagagggaccacagctatggatgttagcaccctcagggcacctgtata

SEQ ID NO: 14612 - DNA, 201 bp, Bos taurus
cctccatttcttctatccctctctatgctccccaatgtgatcccattcagacagaaccaaaaacccactgaagtgactgtgctatgtctggcctggacaaagatcaagtggaacaaactcagtagtgcaagtagccacagcattcaggtcttgtgaccacagatgaaggttatccttaagctccctcaggccaaagaacaa

SEQ ID NO: 14613 - DNA, 201 bp, Bos taurus
tgcacagagaaagtggaagctgctcctgggagccaaggcctggagggacccccacccaccgaagggagtctactctcctctctgctgccacttctctgggcgtgccatatgccaggccactgctcagcttcctaactgcatctttaagaggccctggaaggccctgtctctctcccaccaattgactctcaggtgaagttt

SEQ ID NO: 14614 - DNA, 201 bp, Bos taurus
gattgaacttgcatctcctgagtctcctgcattggcaggtggattctttaccactgagccaccttgggaaacccccattcacttttgtacttaaggccaaaatgtatcttttctcataaatatgtcctctgttagtaaatcttatgagaatgttttaagcctaagtattaaatgcaattttcccttaaaaacgtatgaaag

SEQ ID NO: 14615 - DNA, 201 bp, Bos taurus
ctaatcgtaaactatgatgtcgatattttcccttggctgatgcagcattaagtacctcgtcagaggatttttttttttctttatctttctgtctttggcccgtagctcactagtttatgttatgtgctttcttataggttgggaattttcttttattcattctagtatctttaattaactctgtagacatgggtcaggcca

SEQ ID NO: 14616 - DNA, 201 bp, Bos taurus
ctttatcttccttcttctccctgtgtcttttcctccgtgtgtcccttataaggacactcagcattggatgtagggcccaccaagataatctaggatgatcgcaagatcctcagctaaaatctgcaaagatgctttttccaaatacagttaacatttacaggttccaggtgttagaatgtgtgtgtatgtgtttggaggcca

SEQ ID NO: 14617 - DNA, 201 bp, Bos taurus
tggaagaatttgagaccgattggccttaactcctctttaaatgtttggtagaattcaccagtaaagccatctagtcctgggcttttgtttgttgggaggtttttgatttctcattcagtctcttctggctttcctggtggcttagatggtaaagaatctacctgcaatgcaggagacctggttttgatccctggatttggg

SEQ ID NO: 14618 - DNA, 201 bp, Bos taurus
accccatccccatcattctcttcacggggctctgcatcttagcctgctggtatgtttccaagttgccctgtatgtggtgggccagtcgacctcctaaccctgactgttgtgtagcccttggactgggtctttttacacagtggaacttgaggctcatcccggcccaccagcgggaagctctagtcctggggtggaagccac

SEQ ID NO: 14619 - DNA, 201 bp, Bos taurus
gcagtggaacactctcaggtgaagagatgccagtgctggcagctggaaattgagccagcatgtccagagatcagatgagggggatcaagggtagggcagcggcaggccctggagaggtgttgggtggccagccgtgggctctgcgggcacagcaacggagaggtgtgtgggctgggaggtggggagattcagagtgtactt

SEQ ID NO: 14620 - DNA, 201 bp, Bos taurus
tcgcgggcctggcaggcggactgtgtgcgctccaggagagcagccactttgctctccaggtctgcgtagaagtccttcccctcctgggacttcttcatcaaatcctcgtaggcctcgtaggaggccaccaggctctgcagtgtggagttccacctggggcagagggcgggaggtgagtcgctgcaggccggctccggggcg

SEQ ID NO: 14621 - DNA, 201 bp, Bos taurus
gtgggggccctgcacatttcaagctcacctccagtttgggatggagggatagtgggatagtgagaggaacccaggtgagacccttggcttgcctgcatctgccgtcggcctttgtggtggacctggtgggattctggaaacacatccacagaacactttacattccgagcccagctgctccatttgcaaactgggcctcag

SEQ ID NO: 14622 - DNA, 201 bp, Bos taurus
cacccccgccaaggtccctgagccccagagctggtggggcctcagctttgaggtggcgacgctgagccacagtctgggtaggtcatggagaaagttggtcgtggagctgtgaccagtggccccaggagcccttccccagcttggctcggaagtctttctcagagtctaaacttggagaatgcgccgtgactgccacctgtg

SEQ ID NO: 14623 - DNA, 201 bp, Bos taurus
cgcaaaagctctggtggtcaagaaaccatagtactggcacagacataggtaaattgaacgatggaaagactggagaggccagaaacagactcagtatctacggacacgtatatatatataaaagaggtggcactgttgatgaatgggggcatagtaggccattcagtacatagtgttaggagacatggttaagtagaaaaa

SEQ ID NO: 14624 - DNA, 201 bp, Bos taurus
cctccaataagggagcagccctcccatcctgggggtgctgccagcgtgcagtaaagtgggggtcatgatgataatttgagtatatccctgcaggaccaatgtccagggcttactggccttatagctcctgtgcgttcctagaacttgggaaagaatagtatttctcagatgatggtaaagtgttcagctctcaaatgtcat

SEQ ID NO: 14625 - DNA, 201 bp, Bos taurus
aacaaagactatttccttctgcaattctagctttattttttaaagctgtattgttaggagtacaagattcatgcctactataccatcttggtggaatatatactatcagtgtaaaatacaccttttattgcatttaatatttgtttttacagagatccagatcatagagttcagtcctaactctgctgtaataattgatta

SEQ ID NO: 14626 - DNA, 201 bp, Bos taurus
tagaaggtaacaagtgctgacttgttactcagaggcctttgggactatcccttacctttttcaggaaatagggttaggaatagaagtcagtctgtgtagttgaggtccaagtgcctctttgggcctgacactgcagctttcctatgtggccctaggcacttccaccatcttgggccaagcagagcccgggagaaaccactg

SEQ ID NO: 14627 - DNA, 201 bp, Bos taurus
tccttctcaacagctctagcagagcctctaaagttcctccctggcatggctaggttcttgaatgtgcccctgaatgctggctgtggcctagattggccaggctgacctcagtatctactgctggggctggggtaatatcacctgcttccagctcttggactgagagtgggagagagatgatcctcaagggggaaactgagg

SEQ ID NO: 14628 - DNA, 201 bp, Bos taurus
ggggccccacagcctcctcgagggcctccaagacttgggctggctcttcttcgccatggtgccaagtgccgcccactgcatatccacccccaacagggccgcctcctgaggtgttgcccctctgctcctggaaaccctttgtgtactcagtagtctaagcaaagaatcaaggccagcttttcaggacagacagatttcaga

SEQ ID NO: 14629 - DNA, 201 bp, Bos taurus
tattttatgatgccttaaggtttcaaaatgactgtgggcccccctcaccttcttcctcttaagctccaccctctgccactcttggttctggagacagagtgggtcaggttatggaggcagttgccgctgacagaaaccttgcttttcaagaacctgggctcagaacaacacggcgcaggctccccaaacccctcatggcgt

SEQ ID NO: 14630 - DNA, 201 bp, Bos taurus
agaaacctgttaaatgacagtgcaggacttatcgaccaaattcaacccacttaacaggcttgcttcactatctcaccctgggtccccttcctaataacatttcttcttaatggttccgaggcctctgagggctttcttggaggagaatgactcagacgttctcttgacagagactctccactcttctccagagaaaaagga

SEQ ID NO: 14631 - DNA, 201 bp, Bos taurus
aagccttttgcttattaagtacccagaaacataggttttaccttagggccacaaaaagtcagacatgactgagtgacttcactttcaacataggttttaaggttgttgatcctagaaacagccactgtcaaacctgggatccaagctacctcagggctccaagatatgaccccagcccagaccagttaggcctgaatggaa

SEQ ID NO: 14632 - DNA, 201 bp, Bos taurus
cccagggaaacaagccaatggcaggacctgaaagcaattggaactctttgattacatcactggcctcccgggactcaggagaacaacttcagtggactgggctgaaagcggttttcactcaagcgctgtaaccacggagaaacagagtcctgccaccacgtgcaatgacccaacaggactcaatgcccttccttataaaaa

SEQ ID NO: 14633 - DNA, 201 bp, Bos taurus
aattttggaggcctgttttgattcagggtaaggtttctgtccggtttgccagatggactctgagcgtagcttcgtccgacatttgggtttaaacatctagacacaggcctggggttgatactgaccctgagaccaagacaccctggctacctccaaagaaactgtgggctggcacacccccgtccttgcgcacaacatttg

SEQ ID NO: 14634 - DNA, 201 bp, Bos taurus
ctgggggtgcctcccacccactgatgagcggtgctctgcctggcaaagtagtgggcaagtggcagggagcacctttacctgtagcgtccatctctttgaggggttcttctgagaaaacaaagtttgcctctgtgctgaaatatcaccccctgtgaatttgtgcagcagggtgagcccttgaggatcagcagcaatggctgc

SEQ ID NO: 14635 - DNA, 201 bp, Bos taurus
ccaccacacgagaagcttgcacacctcaagggagagtggcccctgcttgtcacaactagagaaagctcagtgcagcaaggaagacccaatgtggccaaaaataagaaaagagtatgtaaatgaagaggtgtggctgtacgtatgtatgtatttttcataaagaaagtgaaagtgaagtccctcagttgtgtccgactcttt

SEQ ID NO: 14636 - DNA, 201 bp, Bos taurus
gccgctccatccctgggctggcacagaatatcaatttgtctcgttaagctgaaagtctgcactgcaccaaaatcagaacccggcccgggcagaggggccatgagaggcagagaacggggagcaccagcagccacacagatacccccttgcccttcatcacaagcagccccgccggggtccccttctgccactgggccaggc

SEQ ID NO: 14637 - DNA, 201 bp, Bos taurus
ggccggcctccgcagtgcctgtgcttgccgaaacagcgcctctgccaaaaacagtgggggtgatgggcgcttctctgtggccccggcttcctcctgggccgccgttcacttgaggcttccaatcctatcagcagcacgctggctccagtcctgttatctggaagtccttttgttctgaggactcccggtacgacaagctgg

SEQ ID NO: 14638 - DNA, 201 bp, Bos taurus
ggagtcaggattcctagttcccttcttcttgaaagccaaggtgagcctccatcctcccgaatccgcacagcaccctgggcctcacccctctccccatctctgctttccctccctcccttcccttacataggaatatttaggtaggagatagtaacagctgccagagggaagcttggcccaatctctcctggctttagccca

SEQ ID NO: 14639 - DNA, 201 bp, Bos taurus
cgtttcccccagcatcccagtgctgggaacttgatttgccccagagtcctccgaatgaagtgatctgagccagtggagggccacatgatgctgaggtagcgtgcatgtgtgtgctaagtggcttcagtcctgtccgactcttgcaactccaaggactgtagcccaccaggcctctctgtccccgggactctccaggcaaga

SEQ ID NO: 14640 - DNA, 201 bp, Bos taurus
cccgcgtgacagcaaagatcgaggctcccgcgtgctgaagccaaggacctggtgtgcccaaagaaataaataaacacttaaaaaataaataagtaaacagatgtgatcttggccaagtctctccacctctctcgcacctctgtcctcagctaccctgacagatcatagtgagcatcagtggaaatctgcaggaagtttcca

SEQ ID NO: 14641 - DNA, 201 bp, Bos taurus
caataataaatattcaagaacattatccactatcatatttttttgtttctatacacattgctatgatgaatcacttaataaatatatctttatatctttaggtgaataaaacatttggataaatcacagaaatccacttccttcaacatcatcaacttcttagacattgaagtttttcattgttactttaatgttatgata

SEQ ID NO: 14642 - DNA, 201 bp, Bos taurus
tatctcaataaggctgatgtttttaaaaagcagatacagtcatatggcagcagctgctgtgctgtaccaatcagatcctgcttcaaggccaaggtactcactccgctacctgctgggaatgttggctgactccttctctcagagtgcctcctagaactggctacagccaagggagctgcctctttccaaagactggaaaat

SEQ ID NO: 14643 - DNA, 201 bp, Bos taurus
ttttagtcttctgttgaaacatggattgttttttctttgtctttgtggaaccaagctccctaaacagtgttaccctatttagaatattttttacctccttgagctgttctctggttgtaaatgagagtacaaatgtggatggtgaatgaacgtcctgtagctttaagcccagccctttggatgcttttgtcttttataaaa

SEQ ID NO: 14644 - DNA, 201 bp, Bos taurus
cctgggctgggtccaggtggggtgacgcattgagtgcgtgactgtggacaagtcactcaactccactctgccttgcttcccatctgcagaatgggtataacagaaggccctccctcatgggccgctattgtgaggaataaatgtgatcatccacgtgcagctcctgggcagcctcagtaaactgtagctgttttattttcc

SEQ ID NO: 14645 - DNA, 201 bp, Bos taurus
ccgcagccgcgggattgcagggggtgggccctggggaaaggagcgggcagccgccttccagggctgtcccccaactcaggccctgtcaggtagggtaggtccaaagctggaagatgagcaaaaagtgataaggcagtctgggtggcggcatctgaggcagagagactggcacgtgcaaaggccctggggcaggacccagct

SEQ ID NO: 14646 - DNA, 201 bp, Bos taurus
acatgcaaacctcagcccggggctcgaagtccaatcacccccaatatccacacctttgtttccctgccgccaagagaagtccccttgggaacgggcccaagcagcagatttccacacacttgtgtacacacgcgtgagagtcccaaagatgacggaccccaggctggtttccgggcttgctcaccccgtgagcagtggaca

SEQ ID NO: 14647 - DNA, 201 bp, Bos taurus
agaccacagtgaggggcgtgcagagagaggaagtcccatgaacttgctggtaccaggcagctgctctggctcgaagcgtcccatagctggtggtaaaaaaggaaatgtggccagttagctggttcagcagtgggtgcaaggcccaagcaaacctgagctatgaaaaggcagggctcagatttccctggtggcccagtggtt

SEQ ID NO: 14648 - DNA, 201 bp, Bos taurus
ttgggaggatatgggggttttgcagaacagagcacgcaagtgaggaagccgactgcagagaagatggtgcccaggagcagaaacgagagggccctgttgccaggcagagcagcgccggctggctgacagcttgtgtcactcacgctcatcacaagtcagatccctgggaggaagaggctgagagtctggcctgggtggagg

SEQ ID NO: 14649 - DNA, 201 bp, Bos taurus
gtgttgggagtgggttttagttctcctaacttgaccagtgaggaaactgaggctcagagaggtagagtgactaggccggaatcacacagctagagtggccaggcaggattagaggagatccgctttcttgaccagcagctctgtgcctaccattacatcacaaaactgacgggccaggggctgtgtgtctctaggtcagag

SEQ ID NO: 14650 - DNA, 201 bp, Bos taurus
gagactgccttatgtttggcttcactggctagtcacttgctgcagattgttaagagttagcttctaaataagagatcgtctgtgtgcattttgaaatactcactcggccgcgccaggccttggttgaggcaggcaggtctgcggttgaggcgctcgaacccttagttgcggcatgtgagctctagttccccgaccaggaat

SEQ ID NO: 14651 - DNA, 201 bp, Bos taurus
agtggtttctggccagccccagtcaacgggatacacacctgagacagagggagagagagagtggggctggggcttactcccctggctcctaggctgccaggggcccgtgcgcgggccacctccctggaccactctcctcccaggctctcttctccccacagctgactctccctccaggttctggtgactgctgtctgaccc

SEQ ID NO: 14652 - DNA, 201 bp, Bos taurus
cataaataagctcaaccttataggagtgtggtaaggctcaaatgaaggttatccatctatctacatatacagaatattacacagtatagtggaaagaaaaagcattaggagattcaggagatctgcgttctgtttggggtcagcccatcactgtcatgccatgttaccttgagcaagcaatttctttttttgtaatctgca

SEQ ID NO: 14653 - DNA, 201 bp, Bos taurus
agaaaggggaataagatacatggaatcacggtgataatgaatcccaggaaaacatgcagaagtcccctttgggcacagaggttacaaagagtggactttttaaaaagtctcatgaaggggaccagtgtggctggataactggaccattcacactcagtgagccactttgccttcaacagcagcacccagatctttgcaaca

SEQ ID NO: 14654 - DNA, 201 bp, Bos taurus
ggaacagagtggggttcgagctgggagtcaaggcccttactttcttgcataggagacagttcacaaaagaatggatttttaaacaatccataagaagaatgtaaaatttattatctggacaattcacccttaattacaggcttttccaatgagtccctactagtaaactggtgggttcctaggaggcatgttcacttttca

SEQ ID NO: 14655 - DNA, 201 bp, Bos taurus
aaaaaaaggaaaaaaaaaaaaaaacaacaaacccacacctattagttttgtacaggtgtttgtcatcagaaattcacttttacaaagatgaggaggcccacggcacacagaatcccagaatgagagtcaagagacttgggtcagtgttagaccttagtttgctaccggatcaccatgagagagcctccaggcaaaccatgg

SEQ ID NO: 14656 - DNA, 201 bp, Bos taurus
tgcatgaaggggacgctggaaaataagaatacagaggtagattatggccagactagagagctctgcctgcctgatgactcccagagaagaggcttaaatgcactccctcaggtagtggctagaggcctgtgacaaacagaagctaatcaggaaattgcggttataaacacctaccacctccaagggcttggaaggccctga

SEQ ID NO: 14657 - DNA, 201 bp, Bos taurus
aacagaatatagtgctttaccttccaaacgtctctaccacatcaccctgtgatatcagggctccagcatatttatttccatatccaacatgctataaacacataagtatataagtacagaaatgttggggggagagagggacatgtttgggctgaaaaactcagtagttatgccagtacgatgtccaatttgcataagaat

SEQ ID NO: 14658 - DNA, 201 bp, Bos taurus
ttgggatttttaaaacctcccccagatgattctactctatcgcaaagtttgagaaccacaagcgtcagtaacagtcatatagtttgaactcacagagctaataaatggccgagccaagtgtctttcttttctttttttttttaattgactgatctgatctaattagttgattcacaatgctgtgtgaattcttgctgcaca

SEQ ID NO: 14659 - DNA, 201 bp, Bos taurus
acctagtgtgggatcagggagctggccggtttagatgggttgggtgcttatggcaacggtcactatgggctcagtcagttccggaggtgaccagggttgcgtctgtggccttgctatgggactccacagtgcatgctgctcgacagccccacctcctcccaacagtcatttaagaatttcgaataaattcactgttacttg

SEQ ID NO: 14660 - DNA, 201 bp, Bos taurus
cctgatctgcttatggacatcatcatcccaataaagaaaagtacagtcacattctgaccccccaccccgctgcccggacctggtctgtgatgccggcccccgaggtgcacccgcgtgaccaccgctgcttacctgaggctttgtcgccgcacaccacacagtactccaccacctggggccgctggacgtcggtcttcccca

SEQ ID NO: 14661 - DNA, 201 bp, Bos taurus
tactttcacaagcctgacaagcatcaaactttttgagcttttgttcaaggtaaaatctttaaagtcaccatattgtatgcagctaggccaccctattcacgccaaggaacttgaagagtcaacgtttctgtggttttaactgtcttcaaaggcagcaccctgctctggatttggcccgcacgctgccttcatcgggacggt

SEQ ID NO: 14662 - DNA, 201 bp, Bos taurus
gagctcacctcccttccccacacgcccactcctcccaagccaagagctcctcctggagggaggggaggaagcggagaggcaagaggaggccaccaggatcgcagcagagaaacagacagacaagcccgggtttggagtcagcgctgtttccagccccttcaatcgcgtgcagtgtggccttgggcaagtgacttaaccttt

SEQ ID NO: 14663 - DNA, 201 bp, Bos taurus
gtgctgtggagcggaggccacgggctcctgcgggcccttggaagatctgccccagtgcttcttacaggactcactggcgaggaaggaagctgtaacagcctggtgggcctggtggccaacttctacttgtctgcagctgtgaagaggacactgggagagcacacagatgtacccaggcacaggaggtccttctggagcact

SEQ ID NO: 14664 - DNA, 201 bp, Bos taurus
ccctttgccccctctcatgccctgagtcccacagcagagggctgggactgccgtctttttcttcccagcattgccccagggcctggcacttagcaggcgatcagcaattcaggagctactgtgggggtagcccactccctcccgtggtgacggggtagcaactgacacggattggcggcatccacgcagctctgtcttcca

SEQ ID NO: 14665 - DNA, 201 bp, Bos taurus
agctgagattcaaattttttttagcattatctactgcaggctttttcctgagaatagggtcatgacacaacccaggccttgtgaatcagaagggaaaacaaacttgtgggaaagttgttgttagaggaaacgtccaaaaggtggcagcacttcttcatgcccacctctggttcttagggccaccaagctagagggaaaggc

SEQ ID NO: 14666 - DNA, 201 bp, Bos taurus
agaacacaacgggccaggcctggggagacatctcggcctgcgggcaggagagggccctgacaggcagtcctggacccctcctgccctgttcccctgggcccagagatgccgtcctcacccccagaaacgagtccatgctctctggggagagggtctggtgggcgtccgttaccacacgcattccacatacggttactgagg

SEQ ID NO: 14667 - DNA, 201 bp, Bos taurus
gtgggctcctgggtgccagcaacgaggcggagcctggctgtttcaggatgaagaagaatttatggagaggctgccaggtattcgtggaatcttcgggaaggctggagaacgaggcccagcgggagataagggccaggacggggaaggtggaaggggtgagaactaggtctttgccaccgctgcgccgtctcagcaccactg

SEQ ID NO: 14668 - DNA, 201 bp, Bos taurus
acgctggtccttcacagacgcctggcagcccagactccatcacagcaccggcttgtggaggacgtggactcagagcagctggaacgctcaggaagtcccgtctggcccggaatttactgccccttcagaacacggtctgacagcgtctgctgagagccaagggtgcaaaacaccctgcagccggcagactctcccctgggt

SEQ ID NO: 14669 - DNA, 201 bp, Bos taurus
tacctagggtgtgtggctcccgagctcggttcacgccgaagcgccctgtccccggtcagtaagtggctgtgatgcttgtcactaacaatgacaatcgggcgctgccaggcgatggcctggctgctggccccgctccatcttccccctactccagtttgctttatgagaaataatctactgctggataagaggtaaagtagc

SEQ ID NO: 14670 - DNA, 201 bp, Bos taurus
atatttctgctgcttctccgggccctgcatctccctacccgcctcgtactgtctctgcagccagttcctctgaagttatcagcagagaaggtgacgttcctgggccttccagaggaaaggctgggtggtcagggaggagtgagaaattacctgagacttaaacagacctgctcctgagactgcttttaaaggcttcctccg

SEQ ID NO: 14671 - DNA, 201 bp, Bos taurus
tcggtgggcgcgacgctggcggtgggagtgccgccggagggcacgggccaggccctgcgccaggagccttgagtggcctgtctcgcagcgactttactaaatcaagccctgcccttaacccaaagtaaaccaagaccccagaggtgacttgcttgagccacgcggccggctactcgcggagctggggttggagccccgcgg

SEQ ID NO: 14672 - DNA, 201 bp, Bos taurus
tatttgttcttatgtcactcagcacaatgtcctcaaggctcatccacactgcagcaggaatcacaatttccttccgactctcagaggcccctcctcctgtttgctctttgtcaaaacaacacggtttctgagaaaagaaacgggaaactcaccctcatgcagtgtccatctccaaaatgctccttccataactggcccact

SEQ ID NO: 14673 - DNA, 201 bp, Bos taurus
cagccctgctcctcctccagcctggaggcccgtcagcattttgattccagcgcccagctctccatggtttacagctccaccgtgaaacagccctgcgccctggcacctcgagtgattcacttgctcaccagttctatatttagtgccgttgaacacctcagggccaagttttcagagagaaaaaggaggaggaatttaggg

SEQ ID NO: 14674 - DNA, 201 bp, Bos taurus
gggaggggggcgggggacccctcccgggccccaagacgtcatccacgccccacccagacgccgccttctgccggagcggagcctgaaacaccagaccccgagggcctcaacagtaatagcaatatttaacaatttattctgatattaaataatattaatttatttaattaaacaagaacccttccacctcctcgggatccg

SEQ ID NO: 14675 - DNA, 201 bp, Bos taurus
aaagagggctttcaactccagctcatgtcagtgtagaccgagagcagaggtgacgtgatgacaagctttctctccagggccctcagtctttgacttcctcgccctgaccgccttttcaatcttatttacaggaagagttattttcccaagagtaacagtgagccaggccctgttctaagcactttatacagacgggtctca

SEQ ID NO: 14676 - DNA, 201 bp, Bos taurus
caccatgacttgttgagggacaggaatttccagtaattccttgaagcctccccttctgggaacgtgggacggaaaacacatctctatttaaatcatgaagtttggcctctgaggctccaaataacctccaggtacccaacagggctccacccgaccagtccgcgggtaccgaggagtttcgggtgctgatgctctcagtgg

SEQ ID NO: 14677 - DNA, 201 bp, Bos taurus
tcacgctgtcccttcagccggttactccaaggccccgagtctccgtgggaagtcacggattctgcggatccgtccgtctgaatgtttacctacccttctgcccaccttcacgtaaccttggccctgagtgtgctgggctgtcgtgcctgttgtcttggttcccgtgggcaggctctgggtttgcagagcttgttggggatg

SEQ ID NO: 14678 - DNA, 201 bp, Bos taurus
tggcagaggggggcacaggcctccccagcaggtgcggaaagccagaacacctactgtgcgctgggcccccagcagtgaggactcagatggccgggtctcacggggctggagctgaacaataaataaacagatgaagacgtcttcagacagggactcggggaagagggtgagacgggggggagtgatggagcagccgggcag

SEQ ID NO: 14679 - DNA, 201 bp, Bos taurus
gccctcagggggccttccctccacaggctgccctacttgtgggggagggaaccagatggtgtgacaccgcccaccctgctgtggacctgtctgctctttgggggccctgacactcccaggcagatgttgctgtcagggcttcgatgagagtgaggggcaccagcatcgtcctctcgtggggctctgggaggaagcagtgag

SEQ ID NO: 14680 - DNA, 201 bp, Bos taurus
gaggagttgtcacagtgggtagggctcagtgttaacttgaaagttggaatataacaggatcaggaggagggtcagattcaaggtcatttcaaggggcccatgcttaggatgatttgtcagtgaggagatgaaactgagatgtgagtcaaggtcagttcaaagtcaaatttgacttaaaatcggccggctgtgcttgggttc

SEQ ID NO: 14681 - DNA, 201 bp, Bos taurus
cccttcacctagattcactgcattccttttaaaaattacttgcacaccacggacatgattccacacctgaggtcgtcatggccaacatccactcctggccaggcgagccctgtgtgcacatgacctgctgtgctcaccacgaccccaagatgaacactcattatccagcctcacagattaggcctccagtgctcccaacag

SEQ ID NO: 14682 - DNA, 201 bp, Bos taurus
gttttgagaagagcttgtgctcccagggtccagggaggtactgaagcagcacacaccaagaagctggggcccgaggcagccctgaggcctcccgggcagatgagtcagtccgcagttttcaggtgtaattgctcccttcaggttccagattctgggacagcgagtctggcctagactggggtctcgttcccttcgagcacc

SEQ ID NO: 14683 - DNA, 201 bp, Bos taurus
gtctgggaaccggccacgtgaccccgggggcaggcggcccgtggaagctgcaggaaggacctggatgcttactctccctggagagaggctggactgggactcacagatttgaggccagggtgggggtcgtccccgccctcctggtgcccctcagagggggcaggccgttccaagatgccccgaggacccaggcagcgtgca

SEQ ID NO: 14684 - DNA, 201 bp, Bos taurus
cgcagggtcagcgcgtaactgacaggatctgtttggaccgctgtggcccctcgctgggcaggatgtgtgtgtgtgtgtgtgtgtgtgtgcgcgcgcaggaaggagccccctttgcaggccaggttcaaacagtccagatctcctgcccaccggggcatacactgctcccagccacgggctggcactcaccaggggccctgt

SEQ ID NO: 14685 - DNA, 201 bp, Bos taurus
aacctctcccttttcttctggatcggaatgaggaaggccgtttagccctgggaaggttttggctgtcgccttggggccctggaggaaaatagtttgccttaggaaatagttggtaccatggaagacagagcagagagatgaaagagctctagagtagatgccagagtccaagtgagcgatacttaatggccagaggaaagc

SEQ ID NO: 14686 - DNA, 201 bp, Bos taurus
ccttaacgttctggtttcaatgtctggggtccgcatgcttgccatcagcggctttcatctggaggggggtctgcttcctgaaacccagcttaagaacatgcgtccgggctttatctgcgtcctttagggaaccaggagtttgatgattctgctatgtggcagaattatagtctaaattgtcacgagtttctcagcccaaca

SEQ ID NO: 14687 - DNA, 201 bp, Bos taurus
actcggggagaaccgacttttaaagcacgcccttttctggagactcttaagtgttttttgtgccccttcccatcaagtcttaagatgtttgtgggccgtcgcgtgttgtcaaggtgaatggatgggttgatttcattcaagtgtcttaaagccagatccacggttctcagtctccgtagagagagagatgtgggcttgaac

SEQ ID NO: 14688 - DNA, 201 bp, Bos taurus
aggggacactgagcatccgagcagggagtcctttctgaggccgggaggggtgggaagtcaaggagcccggcgcaggtcagactccgccgccgtgagtgacccacaccctgtggcctagtcagacacacagaagggaatagagcatgcttccctggagcatcgagagccagggtgggcacagtgccatccccgcagatgcca

SEQ ID NO: 14689 - DNA, 201 bp, Bos taurus
ctgggcaagggtgtgcaggcacgcggggcatcagcgtgtccacagcctctcccctctctgggtgcgtgggtctctgccgcaggcctgcaggggctccccacagaccatcttcctgccgaatcatcccccgagtccccttggctcggggaacgtctgcccggcccgaggcgcctccaaggagcccctccatgcccgcttctt

SEQ ID NO: 14690 - DNA, 201 bp, Bos taurus
caggtcacttggcctggaatctaagtttcggagggagcactcagagtcacagtttcactgaaatagtctgaaagtgtcgtttccaaactggattcatggtttggactgggggcgagggccaggcgctgactgggctcctcgggggagaaagctggcttcccacctccggctcctgttacagactgacctcctcgggcttcc

SEQ ID NO: 14691 - DNA, 201 bp, Bos taurus
tccaggcctctgggaggggaccgttatcagacccattttacagatggagacactgaggaattcagcagctacagcagagagtgacagtgcagtgaagggggaaccaggaagctggccagaggctgagcccccctccacggcactgaggttggggcaggggtgggcaggctccccggctgacctctgagccgggtggacggt

SEQ ID NO: 14692 - DNA, 201 bp, Bos taurus
agcatgcacacgtgcaagaaacagcctcatcgaaggggatggagaaaaagagctgtgaaagtaactctggacatgagtagagtctgaacaactggcggccgaagaagcatcacacgagtgtagactctggtcggtgaagctgcttcctgtgcccacaggatgatagttctgaggccgtcctgtgcactagagcacacaggt

SEQ ID NO: 14693 - DNA, 201 bp, Bos taurus
gcgcccaccgccatgcggttctcagcccagggcctcgcccacgtgcctgctccccatggttcagagccgccctgtctgtctgtctgcgtgtctgtgtagcttccaggccactcccctgtcccgcttccgcaggaccgccgggcgcgtcctgagggggttcgggggtggtaagcggagtggtcggcatctctcctgctcgca

SEQ ID NO: 14694 - DNA, 201 bp, Bos taurus
accatcactaaactcatgggatgcaatccaaggcctttggaaggtcaccctgtcagacgggaggctcgaagggcggctgcccacaccagccaccgtgcacggcggccatgtcctgacacaggacatctcaaaggagctggtgctgtctccctgacctcggcccccagggatgtcccttgtgccctgagcccacccaggccc

SEQ ID NO: 14695 - DNA, 201 bp, Bos taurus
ccctgggcccagactcggtccagagaacggctcccctcagcccacgagggctccctctgttctctctgtggctccgattctcccagtgaaacctcctggaaggcctccaccctaaggtgcgggctggcgggacctgctcagcaacgcgggcagcaggcctgtggctggcccaggcccggggggacccacaggcacctgccc

SEQ ID NO: 14696 - DNA, 201 bp, Bos taurus
tggttctcagtctgcttgaacttgccttcagcccagacgcccaggctccaggccctggaaccccaggccatggctgggcagtgcgggacgggcctgtaccagggcaggtgtaggccaccacgaacatgctcagcaatgagacgaggaaacagagaaacaaagaaaggccacaatcaaaccttcggctcaaacaagcctgca

SEQ ID NO: 14697 - DNA, 201 bp, Bos taurus
gggacgcaaacctgcagcaccacgctacggagagggcctgacagcaggtgtctaggatctctgatctctgagtctgaaaaaataagacacttcaggagaagagcggcttcttcttcttcctctggccattcagctaaggcttctgaacattacacacaaaacagacctgaaaggtggagagattggggcacctgctagggt

SEQ ID NO: 14698 - DNA, 201 bp, Bos taurus
ctgtctccacgctgagaggtcagcgggggcgcagcctgcatttcctgggccccttctccagggctctgacctgaacgtggccagcgcccccgggaaggaagtctgcgcacctttccactggcatcaccttgagtgtgacagcacttcaggctgtcacgggaggccttccttcctgcatgaacccggggatctccaagcaaa

SEQ ID NO: 14699 - DNA, 201 bp, Bos taurus
gtcagcctcggagcctctgtactcgctgccccctctgcaaaatgctgttacctcaattccatgcagctggctcctcttcagcatttaggacttgccttgagtgtcatctccccacagaggcctctggtccccctgaccccctaccccagtctcaactgcacttgtttccttctcagcccgcagtagtcttggctctggtgc

SEQ ID NO: 14700 - DNA, 201 bp, Bos taurus
cccacaggggtgtggccagggcttaacctcgtttcgtggggagaaacgccgactccccacttgggtggaaacagtcttgggacgatactagctgacactccagcccctcacaggcctcagtccccagacccccaaacgggctcctggccccagatggcgcgggtgaccctggccccggcccatcacatggccacctggggg

SEQ ID NO: 14701 - DNA, 201 bp, Bos taurus
gggcccgggtctggtagggaggcggcgtgagctgggtgagtgctccacagggtgctggctgggggtctcatcgtctgcccggcagctgtgagtcaaaggcgggagtagctgggccctgggactggggtatgttctccctgagttatcgcaaggcagggcccttccaccactggtgaatcccctgaaggtgcccagtccagt

SEQ ID NO: 14702 - DNA, 201 bp, Bos taurus
gtgccagaaaacttgctttttgcttctaagtctctcagcagaaggtgatgttacatatttttttgcataaaatattgaaaattagaactagcattttttaatataaaaatctttcctaatagtcataggaaatgaatcatattctgaggcattttaattgctattcgactgactttggactggattgtactcagctttgca

SEQ ID NO: 14703 - DNA, 201 bp, Bos taurus
tagcaggcaagcagagggtcctattcagagttggaccctgtccatggagacagtaggcaaagaatgtctgagctgagaatggataagttatacctgggccagacagataaaatgcagaagagccctgatctataatgataccagtaagagccttttgtggtggacaggggccccaatctggcattgggctcccccaaaagg

SEQ ID NO: 14704 - DNA, 201 bp, Bos taurus
cgtccccccacccaacaaacctccaggactcatataccttccttctctgtacatctgacctcaccagagaaaactatggccacaagcagaccaatcccatgtgagccatatctacagggactcccgctgtgagcctcactgtcattttgtcagctgagtggcccctcacttgccacaagacaccccgaccccctgagacca

SEQ ID NO: 14705 - DNA, 201 bp, Bos taurus
tcaggatgggatggtggggatgaggagcggcctttccaggcagagggcacgtgtgcacatgtcctggtgagagagagccagggatgttgaagggcctgacttcagaccactgaggctgaatcaagaagctgtcttggtgcaataatgttggggaggtagacaaggctcaagttttctgttttcaggcctttaaagatttta

SEQ ID NO: 14706 - DNA, 201 bp, Bos taurus
atgggctttgggacactaggagctccacctcttcttcacacacaaggatatccttgcaatcatctggcagggatgaggaatctgaggagcgcaagggcccggaatcagcctgatctaggagcaaatcctggtcaattccttaaaatataaagtttgtgtaagactatagttattgtttgctcttttatcaaaggccatggg

SEQ ID NO: 14707 - DNA, 201 bp, Bos taurus
ctcagcctcagggagccttctgggaacctaggccagattctctgcacatggaagtcagaggtccccttggctgagtggagcccaggaagccacccacccccacccagggcctttcttggaagcatgggtcctgaatcatgactctcccttgcctaaatctcacttgcccctaaacacctctaacacccaagtccttctcta

SEQ ID NO: 14708 - DNA, 201 bp, Bos taurus
ggtcagtaaagacaaagagggaataaaaccacctcatgtgtgcagcaagctgctaggtgatggagcatttccctgacagctacagatctagatttgagtcgagtaatagctgaagtgtcagaaaatagaaaaagatatttaaaactcatttgttttaatagtgcctttttttttttttttagaaaaacccctctgtatcac

SEQ ID NO: 14709 - DNA, 201 bp, Bos taurus
gaggcctggcgtgctgcgattcatggggtcgcaaagagtcggacacgactcagcgactgatctgatctgatgttacactaagaatctttctgaagtttctgataaagacaggcccacagcaagaaaacaacaatgtacctttgaaagagcaattcacacagcacatcagcaactatgttactaaacaggacagaatctcac

SEQ ID NO: 14710 - DNA, 201 bp, Bos taurus
cgccctcctggcctcacgctcactctctctctctacccgtgtggtctcagctcttcatctctcagcttgttgacttaaattttctctttctttgaaaatcagtatgattcagaatggccaccccacaatagcagcttctgttcagaaatatgtgtcaccccaggcaagacaactgaagaaattaacagtgtttctgcagcc

SEQ ID NO: 14711 - DNA, 201 bp, Bos taurus
ggacacagcctttacacactatttggccaccacagccatcaaccaccaggaccaggaaactgctctgggtttccataaacaaagttgcattcagcaaccacgtcaacctgggccattactctgacatacaagttctacagggggcctccagtccctgtctgggctcttcaggaagacaccttggtctgagccttcttcaaa

SEQ ID NO: 14712 - DNA, 201 bp, Bos taurus
ttccaaattttttatgaaaagcccttctctcctaaaattattggacacctatgcgtgtgtgtgtgaaatctttgcttttgttgttgttttgattctgacacgcatcatacaggatgtcagttctccaaccagggactgatgccacaccaggccctgcagtggaagtgcaaaatcttaaccgctgaaccaccagcgaagtcc

SEQ ID NO: 14713 - DNA, 201 bp, Bos taurus
ctgtatgagggccactctgtagttgtggtgcatggacttttcattgcagtggcttttcttgtggagtacgggctctaggctccaattcagaagttgtggcgcacggactcactggccttgtggcacatggaatcttcctagaccagggattgaacctgtgtcccctgcattggcatgcaaattcttaaccactggaccatc

SEQ ID NO: 14714 - DNA, 201 bp, Bos taurus
cagtggtgccatccgtgaagatgccgaagcagcgctcctgcagctctgtgtcccctccattcttgagaaatcacactgggaaagacctggagcttgtccagggcctcagtgaggaggcctcccgtggtctgatggcttggatttgtagccaatcatcccacttgagaatcaaagtgcggtttcttttctgggtcatgaatc

SEQ ID NO: 14715 - DNA, 201 bp, Bos taurus
tttgaaagtttccacaccatggcctcaggttgacatttgtgtcctgaggaggcagaagattgggaaactaatagaaactgcttttggggtttcagatgctgagctgtgagggccattaagtaatcgtcagtgagtactgaaagcaaaagctgtagtcagttcatacgtaagtcaagttcctgtatacagttatttgctaaa

SEQ ID NO: 14716 - DNA, 201 bp, Bos taurus
atgcttattgtctagacgctttctgtcttgcaacgcttcccctttcctgtacctttgactagagagaggctttcctgggggccttgtctggcctctgggtgcttctggggggcagtttctccagcatcccgtccagggtatgggagcaaaagaaaaccaggggactggcctctgtggtgttcctggggtccaagactcgta

SEQ ID NO: 14717 - DNA, 201 bp, Bos taurus
aggccagtcagcacggctgtctggtgtcctgccagccacactgaactgtgtcggtgcatgtgtgcagtgggtggaactggggtctggcagagctgggcacggagcagggtcgtgatgaagggccccgggagcaggggcactgaggaaagggttgctggagaagggagacacaaggaatcgtgcagccagtgttttgggaaa

SEQ ID NO: 14718 - DNA, 201 bp, Bos taurus
atcgctgtcactgtactgccctctagtggtgtattcttgggattgcagttacttcgctgccacgtgcagaaagcggccttttgctctcaagttagaaagggaactgtgcttttcttcaatttagagaatgcaccaggtgccataatatcacaatatctatgtaggtcttacctaggaaagtcacaagttaggcccatcaga

SEQ ID NO: 14719 - DNA, 201 bp, Bos taurus
tcagtcagtactgtgtttcatgagccatgctgcaatgtttaggactgtgatccttggattaaagacctgggttcaattgtacgcctgctaagttgtatgcgtatggccttgcatgtagtattaaatatttttatataacaaatatttttaaaacatacctgccatttatttacttttgagttcattttagatttaaaataa

SEQ ID NO: 14720 - DNA, 201 bp, Bos taurus
agccagcctaaggcttagctctcgctctcgttatccttacagtgtttccctgggtgtgtttatcaaggggtactctgccctgccagattcgggggcccccatcttgcacaggttggttccatgctcacccagttctttgatggatttcacctactctttcaggcagtgagtgtcaatgaagtcacacaaatgggggtcatt

SEQ ID NO: 14721 - DNA, 201 bp, Bos taurus
agagtgtatggttcaatataatgagtaggggataagactctcaatagcagtttagggtcctgccttccgtttgcttccatttacacaagcagacattgttgatcctgctttgtgctcatagcccactgttcccttgggaatcttggatttgaattctcaaaagtcatttatatctagttagtcagttactgatacaaaatt

SEQ ID NO: 14722 - DNA, 201 bp, Bos taurus
aacatccaagaattaaaacacagaaatacaattgtccatttcaatgagattcttttgaaagtatattttgtgcttccctcttaaacaaggagtacaaaataaacatttctcaacacagtgttgtaattattaatgtaactgtagcagacaattgtaattgtcacctcttttggccttgctgttgttcccatcctcttcacg

SEQ ID NO: 14723 - DNA, 201 bp, Bos taurus
tatgtctttctctgtcattggcttgaaaattcttcctgtggggtttttttttttctgtctttaaaatcttccttatgatttcttcaactaggtcatgaaagtattataaaaatacttatattctcacttcacatctttttctggccagtcttatcctcctgcatgcttgtatctgtttcttacaaaccactgactcacaaa

SEQ ID NO: 14724 - DNA, 201 bp, Bos taurus
ccccagtccatatgttctaccaacctcccagagtccttggtactggaatccatcttggctgagcagtgctcactccatcaggaatggctccaagtcagtatgattggccagagagagacaacccagaaactaatctcattgccataaaacctgagactgtgagccacatggtagagcagttctcctgggttcccctgacct

SEQ ID NO: 14725 - DNA, 201 bp, Bos taurus
taggcaaggcgtgagctaagaggccggaagaagacccgaggagctggaggagctgcagacgcatttattctcttccggctgacacagcagccgtaccagtattctctcctgactcacgcggccgcggtcgcattcactcacgcggccgcggtcgcattcacgctgtagtctcgcctctcatggccaacccgagggacacgg

SEQ ID NO: 14726 - DNA, 201 bp, Bos taurus
caagggttcaccccagacctctcagcatcctgagaggaggtggtcccagagcaccccatgttgacagagcaagcagccaggaggctgtactgtcggtggtggagctgcagggcccagggtgtattcagctctctgaagtcagcctctgcaggaagccagggtttccacacgggatctggctgtgtaagcagacaggacaca

SEQ ID NO: 14727 - DNA, 201 bp, Bos taurus
tctgggggtcatgtcacctatcaacaccatgagacgaggcctcactgaagactggactggaatacaaggactaaacaccagccgtggacaggatgagtgcataaaaagagacgcttcgggccgcggtggaaccctgagggctgacttcgggctcgctccgtacatcaaactgcttcactgagggctgttcacccctcgcgt

SEQ ID NO: 14728 - DNA, 201 bp, Bos taurus
tgacctttgatttggggccccacagatggctgtgcagggcgaaacagttttaaggggtgacattcacctccagcatgaggagtgctttcccaggcagtgcgcgacctgggcaaacacacccagggcccccatcttccagcccctgcacctgggagctgtgttctcttcacacccaccagaacctggaaatcttcacacaca

SEQ ID NO: 14729 - DNA, 201 bp, Bos taurus
tggagaaaatggcagcagctgatacatcacttgtgaaggttagacaaaggcccttttcagactttagaggtaaccatggtgtgttggagttttatttcaacaactcataaaaaggaaccaaaaaagggggactattagacttcttgtaaatctggcagctggggttttggaactgtcttcaacttaatatgaatatctaaa

SEQ ID NO: 14730 - DNA, 201 bp, Bos taurus
caggggatcttccctacccagggattgaacccacatctcttgcatctcctgcattggtcggtgggttcttaccactagtgccatgggggaagcccaatgattagagtaagtgccatggtaaattttctcaaagagacattcaaatgacctagtcatgtttattgaaaagaccatcttcctcccattgctctgcagtgccac

SEQ ID NO: 14731 - DNA, 201 bp, Bos taurus
tgtaggaaaaggtagcaaagtcaaccgaagagagaaggcaataccaacctgggaatctcccttaccggtggcctctgaaacagcttgaataaatgaaagcgtcaggttggtccaatcagaagctctgttgttgagtcgttttctgtgctgctcgttaccgtccccagcgggaggatctgggtttcccaggctcttcagaga

SEQ ID NO: 14732 - DNA, 201 bp, Bos taurus
gatgggggtcaagaatcttcattccccggccccccccaaaatcctgatattcccagtctttctctctcttttttcagtcacactgcacagttcctcagacgactgagcacaggccacagcagtgaaagcactgactccaagcacgggaccactggggtcccccccctttacgttctcctttgaggcccccaccgaaactgg

SEQ ID NO: 14733 - DNA, 201 bp, Bos taurus
agacagagcaggatgaggacacaaaggtgcaaggagcagccagggggagaggagaaacacaggagagccctcagtcctgaacaccaagggaagaccagactgtgcttcaataaagaaatggcccaaagtgttgaatactggtgagaggtcaagtagaagacaactgaaaaatggatttaatgacatgaggttcacagaaaa

SEQ ID NO: 14734 - DNA, 201 bp, Bos taurus
gtccccaaagtggctctctggcagtgacaggccaaaaggtggaggctgcatggacccgagaaaaccttagaaagcaaggaagtgatgcgctagaaggcccctttcgctagaaggaggaagggcaaggttggtgaccagatcctctggagaaagggacttgcctggtggcccagtggttaagaatcagctttgtaatgcaga

SEQ ID NO: 14735 - DNA, 201 bp, Bos taurus
tttctcctccataactctgtctgcatttgtttggccttggtccacaaagaaccaagattttggcaacaccaagactgctgccgccagtgcccctcccactatggcaggccactgctgacccagtcctctgcaggagaccctcacacgctcacaggtaggtctggctcagtcttctgcgggtcactgttcctttcccctcgg

SEQ ID NO: 14736 - DNA, 201 bp, Bos taurus
ctcaggccctattccaaaccatatcctccgtctgcccttccgtgccccagcactcacctgctactctgcagtcacctttgctgcctgcaagaaatcactcgttcctctctggccctcatgggtcccgtgactccctgccaggtaactctcctcccgtcatttcctctctcccatttaagctctctgcaacatcagcccttg

SEQ ID NO: 14737 - DNA, 201 bp, Bos taurus
cccgaggctcatgtctaactcttctatcccttctccaagtcaggggttcagggaacatgaccacagcctctgccctcaaggtcttttaaaggcagctagcggtgggcttggggcctgaggggggacaccttttgccctggggctcctttctctctaaaggtgaggtcaagggcagcattgaaagttcagattttcacaggg

SEQ ID NO: 14738 - DNA, 201 bp, Bos taurus
gccacctgattttgtggaaaagaaatactgaaacacagcggtattcgtttctttatggatcgtctacgtcttctctccacaacagcagagttgagtaactccaacaaagactgtatggcccacaaacctaaaataattacaatctggcatgtgaagaaaaagtctgcaatccactgatctaaaacacaatattatgtgttt

SEQ ID NO: 14739 - DNA, 201 bp, Bos taurus
tattctgaacagacatgtggtttgtttccacttttttttgctgtttcaaatagggttcttttgacatgcccatccttgtatatgtctcctgttacgtatgttggagagtttctccaggtttatgttcctgaggaaatagttgctaggtcattagggtaggtatagctgtcattttgctagataatgcccattttttcccca

SEQ ID NO: 14740 - DNA, 201 bp, Bos taurus
tcccaaacggctagggccatgtctgaatgtcccgttcagctgtctggggattggagtcccctcgggcagtctgacatgagccagagacaaagcctagaacccggcagggctgggccttcctgagcttctgaaggaaatccctgtgatttttaaaatctcaccgatgttttgttgctcaatgctcctcatttctgactgaaa

SEQ ID NO: 14741 - DNA, 201 bp, Bos taurus
ggggagagggtgtgctgcttggtgacatcaccccaggaagatggcgggcttcgctactgggtccaaggagccagggcccgagccagcgccatcagagagatgccacttctgtctccagcacctgagctggggggaggaggctctttaagatctccgtgtagtaggggccgaacacctgctgattgtggtgtgtgaggctga

SEQ ID NO: 14742 - DNA, 201 bp, Bos taurus
aaaaaaaaaatcacacttactatacaaggagggaacttatatttgctctggcactctatctatatatcatcttactctgccctcacgggccctctgcgtgatgggtattatcccattttactgacaatgaaactgaggcttagggagtgaagaagtttcttcaaggcctcacaactagaaagtgaaggtccctggccttcc

SEQ ID NO: 14743 - DNA, 201 bp, Bos taurus
ccaaggccacccaaccagtaagtggcaggttgttgttgggctgaagccctgcccttgccttcacaccagtctgcctcctctgaggtggctggtcatcgtcgaggtggtgccaggtgctagggcccggaagcaggcgagccccagtgcctggagaatgtggggagagcgggcagagggggcacctgtcctgcccaggtcccc

SEQ ID NO: 14744 - DNA, 201 bp, Bos taurus
gggacaggcccagggcacagagcttaggtctgagccttggactctgacctgagctgcccatagggctcttgagtccattctcacccccgacaccaggcctgctgcttctgagaacctggaaccaagttgggggtcgtccgaagccctgacctttgagcccagagaggggagcggtcacgttccctgaccccctcgcccagc

SEQ ID NO: 14745 - DNA, 201 bp, Bos taurus
tctccctggggacacagctttccccgccactagctcaaatggtgactgtcttctctctctcgctcctcttgccatggggccaagaagaggtggggtcggcgatcgactcgttccacttccagaatgtgacccttccttcttccctccgccccacagctttaaatctcatgctatttaaccgaactggtattacagagctac

SEQ ID NO: 14746 - DNA, 201 bp, Bos taurus
caagtgacaggttccctcgctggctctgctagaagggcgggcttgttccttgaatagggtgagtgtaggggaggattaggggctgggccagggatggctcggggggtatgcccaccctcttggtggtaaccgtgtacagaaattatgctcaaggctcatcctgctttggctcctagcatctcagaaatggctagaaggttt

SEQ ID NO: 14747 - DNA, 201 bp, Bos taurus
cacagagaaattctggctgcgggccaggccctctctgtcactacctccctcccaaaaagaatgccaagcagtggctctggctttctggccactgaacaaacccaaatcaaagcttcccatttgggatggttggtgaggagagagatccccaccagcagaagggcctgggactgacaacaagcagaagggaggagaggggtt

SEQ ID NO: 14748 - DNA, 201 bp, Bos taurus
agccagttacccctcaggcagagcctcctgacccttctactctaattgtctgtgacctttgactccaacaaagcaagcccagagtgggtgtggggttccgcggccccgggcccttcacacacgctgctcaaggcttctaaatcctacctgccctctttagagctttactcaagtttcaccgcctgcacgaagctgcctatg

SEQ ID NO: 14749 - DNA, 201 bp, Bos taurus
ctgagtatccccgtcctgaggggccagagctctcggcatcaccaaaactcttggagacaggtttctgttctggatcaaacatcagaataggtccaagagccacaggccaggggaaggagaggtattcttcccaaacctaacaaggtgaagccttgggcaacttcacctcagaggttcttggggtgtgtttcctggacaagc

SEQ ID NO: 14750 - DNA, 201 bp, Bos taurus
tttcctcatccctaaaccagtgcagctagtcctgtcttcagagcatcagtataaagatacctgagaccaggtgtgtgaagggcccagagcagggcctcggtgtcccgttttccacgcatgctcagctgagtcctctctcacagtcagctgctgctcttcactgtggacggccctcccccagcctcaagagccatcctggaa

SEQ ID NO: 14751 - DNA, 201 bp, Bos taurus
cagtgctatctgccaggccgtgtggcagagagccccacatgcccacgggcccagacatccacgtgtggatgcgtccgcccccatgcagtgggaggggacacgtgcttgcttgtcatggtgttcctgctgagtgtgtgtgtgcgtgcgtgtgtgtgggtccctgcattaatcagccagcatcgctgctggcgtccttctggc

SEQ ID NO: 14752 - DNA, 201 bp, Bos taurus
gaggacaccacaacctttcacaggctgcacggcctgtcctgaggctggtcctccccgaggggcccacaagatgtgggcaggaaggtgctgtttgctggccggattaatagcctcagtgctttgctcttgccataaaaatagctcgcattctgtgatggacagcccgggctactctctctgagggcaagctgcgcccgcggc

SEQ ID NO: 14753 - DNA, 201 bp, Bos taurus
gagcctgggacagtcacccagttatggttttgcattttaagatctggaggaaatcttgaacatcatcaaatcccactgtgtcgtttcatcactgaggcccagagaaagattaatctgcccaaggacacggttcttagtcctgcccctgccactaacgagatgtgaagctgtgggccagttgctttccctctctgagcttag

SEQ ID NO: 14754 - DNA, 201 bp, Bos taurus
catcactggcaggttcctagtagagcaggattatctgctaccttgggcatttacttcagacaaaatcatggaactgagctgggagaatataactcagagggaccagatctcaggtcctctttgttcctgtctggtcaaatccctgttggaatctgaagtttagaaaaccatcataaggcaaacagagagtcccacaatccc

SEQ ID NO: 14755 - DNA, 201 bp, Bos taurus
acaggagagagaggaggcatgaagggtcgttgtcgggagggaccatggtctcgggtctcatggtctaccttcttgcagagaagggcctccagggagtcgcaggaagctgacctctccttgtccccaaagtgaagctggaaagggaagctggttagtccctctcaagtgatgtccccgaccatggccttctggcctgggtca

SEQ ID NO: 14756 - DNA, 201 bp, Bos taurus
ttagagaagggtgggcaagacaagagagtgaggggtgggagaaggataagagaggacagggaggggtcatgggggagctctgtcctttgttccctggaggaggtcagcaggagtgagcagggactgaagacaaaactcaagggtgaccagggatgggccgacacctcctgggccaggtgtgtcctcaagcctctccccagc

SEQ ID NO: 14757 - DNA, 201 bp, Bos taurus
ctgactttcttcctctcttcccacagcttttccctctgtccccttcctcttcttcgatccctcgctccaaactcccaagcccagggcccatcaggaggctgaggagtggacaagatgacctcccaaagctctctgccattcccatctctcaaaagagccctccaaggccagtccttggagagatccatcatcacctgttag

SEQ ID NO: 14758 - DNA, 201 bp, Bos taurus
gggagtcccagatgcccaacaggccatgccctccacctgagcacctgcccagaccctggtgtgactgtgggggcagcattgaggagcagaaagagcaaaggtctaactaggaagccgggccctcagtttcctcatctgtaagacagagcagtcaccccttccatgcccctcctcccaggctatcttggggcaatggtaaag

SEQ ID NO: 14759 - DNA, 201 bp, Bos taurus
ttctatgaattttatcaatagcacgtagtccccatgtaaggtgccccctggaatctggggaacaagtctgaaactgtcaccccctgaaatggaaatgcatcagaagagatagccatctgtggccaaggtcctcaggaaatctcatcaggaaacaacccaccaatgtatgatgtgtgtgccagttgctggtaagaccagagg

SEQ ID NO: 14760 - DNA, 201 bp, Bos taurus
ctaaccgctgtctacatagcatctcttctgggatagagaactctagtgacctcttcctgcctcctttcacgccccgtctcctcattttatcactctgtgataattactgacagatcttgggtctcagtatattagaagacagtcatgatcatcagggaatacttcctgagggaggctttcattaattgtaaagtttactga

SEQ ID NO: 14761 - DNA, 201 bp, Bos taurus
gtttgatgacttgtgttctctagagccatgtattacagtgttacaggttcagagggggaaagttccagacgtacagttaaggcccagctttgtgttaattctcctgcatcaattacattgctcttcccttgaactggatgctaccccaggattaattttcctcagaatctggagtaattggccaaaatactagggtaaaat

SEQ ID NO: 14762 - DNA, 201 bp, Bos taurus
gttctggttcccagggggaactggtagacacggccttactggcgccctctactcaccctagaggctgctctagtggccccaccgcccaaggcagctgttcccttcatccagatgtgtctgcttggtcttgaagagcaccggctccatggagatctcggcctgactcctcaccactggctccgcagcaagacacagctggac

SEQ ID NO: 14763 - DNA, 201 bp, Bos taurus
ggggccactggagttcctgccttggtgttccatgagaaatttcccaaccactttaataaactcaccatttaaggcttaagccatcttcatctggtttctgcagcttggaaacaaaagggcctaagataagctcctagcggagtgcacgaggcagaaacgaacagacgttctgatgatgaggatgacaatgacaacgtgatg

SEQ ID NO: 14764 - DNA, 201 bp, Bos taurus
gactaactcagtttggacaaaacagagagaccaacagcagcatccctcactacaaatgattctgagtttcattcctgcagtggcctttcatgccagataggtttgtttcttcgataattacagtgcctacaaacctgtccttcatccactaagaagggaaaggggccttatatacaacatgctcaaaatgcagtctaccag

SEQ ID NO: 14765 - DNA, 201 bp, Bos taurus
tctacatttcattgcaacaaatgtctctactctattaaacaagtactgaaatttgcccttaatatgccacagagttaagggtttttcctgagatgttctgcagacatgcaggtgtctgagactaagggcctggtgtggggcgttttttaaatcccctcacacccaaatttctacatggaatatgagactctcgtggatctg

SEQ ID NO: 14766 - DNA, 201 bp, Bos taurus
aattcaagtgatttccttatttgagttcaaaatgggtcctaaaacatggagacaactcacaacatcaacaacacatttggcccaggaactgctaatgaattcagagtgcagcagtggttcaaaaagttttgcaatgaaaacgagagccttgaagatgaagagcataatagtggctggccatcagaagttgacaacaaccaa

SEQ ID NO: 14767 - DNA, 201 bp, Bos taurus
agaaatgtctttaggaactagaaacgtttctcaggggactagaagcacatcctaacattttaatattgcctgtctgcataccctgtatttacagcataaacagactgtataaaatgataccaggatgcatctcactctctggaaatatgtttaatctgacaccattcactaaccatagcagcaaaattaaaatcttgactt

SEQ ID NO: 14768 - DNA, 201 bp, Bos taurus
caggattatagtagaggagagagagagatgagaaaaaaattaagcaaaaacttcagacagtttgagttctaatttgtacatcttggatgtgggtgggtcagcaggttggctggcagctgaaaggtcagtgtgtgtctttctgttctggaatagaccaaagtagtatatcaaagaaaatttcagctgtttatgggtgctttg

SEQ ID NO: 14769 - DNA, 201 bp, Bos taurus
actgggccagattgtcctttatgtctgagagaacaaaaatacattttcaggagtttgaaagattaacaaaatataccagccagacacataatatcctccacttcccggccccagcccatcccataaaactagaagagttggaagtggttgctctgtggaattgaaagtggtgagcaagtgggcagggggttagtgttttca

SEQ ID NO: 14770 - DNA, 201 bp, Bos taurus
ttcacagatgagggtttgctctgaaatggccccattgtgctctgggtggcgctgaggaggtgggagtggtgtggagaagaggaggcggcgttccgagcccttatgatgagggtaatctggcctcccactgccgggtccgtcaacaggcctggcatggcgccttcctccttggcactttccaggccggattatggttcagtc

SEQ ID NO: 14771 - DNA, 201 bp, Bos taurus
tgcaatgattctctgtcttggtttcctcctataagcggcagggctgggtcaggaccccactggatggagacccaggacactggacgcctaccagggcccccggtcatggtcagctgagctgaaactggaggagaagcagaggaagagagggcagggaggcagaggcaaggggcaggactcaccggccacgaagtcgccgaa

SEQ ID NO: 14772 - DNA, 201 bp, Bos taurus
tagccctggggaagccaagtgggggacgagtcacaagtgtggctgtagctgctggggagattcagacaggaaccccatggccaagaggcaagctgtactttccccttccaggtctttgattttttttcttgaaagcttggactctggctgccctgacccacaaatcctgcagggtcagggcctgacaggtccataaggagg

SEQ ID NO: 14773 - DNA, 201 bp, Bos taurus
gagtgtggcctgacatccggcagtgataagggaccttctgaggctgaactaataaggagattggaggaaaaaagaagaaaaacaaccctccccgccaccccgatcaatttcatgtacagtggccagaggatgcagggcaaacagagcagctggatgtgggcctctttccgtctgaatgagcccggagggcagggcaggcca

SEQ ID NO: 14774 - DNA, 201 bp, Bos taurus
ctcatgccaaggaacagccattcattgttctctgaggccaaagacaatgctgccagaggtagcacactgctgtagagaagccaacgccaggattctaatacgtgaaaaacggcctagattgtgcctctgctttggaagccgtctattccttttcctgtggtttaatggcatttttagagatatgatcagtggaggcagggt

SEQ ID NO: 14775 - DNA, 201 bp, Bos taurus
aaaaccactaccactgatgcaagagcagcctctaggccggtgccctctccctaggagggttgctgctgctagaacccagcaggattctacccagagatgaacctgtagggccatacctactgcttccctcaaggtgggggcaactcctcccccatgtttttccatgctgtatctgtgtcccagcctccgcagaggctgggg

SEQ ID NO: 14776 - DNA, 201 bp, Bos taurus
gaagaaatcatctaggaaaaagtacaaagaaaaagagaaaaggaggtcctaggacaatgcttgaggaatgtccacatgaaaggaggataatctggcccaaaaggccaaggagcagtcaggagataaggagaagacaagagaagagagtggtcaatcatgctgaatacagggacttccctggtagtccagtggttaagactc

SEQ ID NO: 14777 - DNA, 201 bp, Bos taurus
ggcagatgcctgcactgttgttcagtcgctggcagctgttcttggcaagggccagtttgtagtcaacaaaccgaaatccgctgaaggggccgggtctgctcttgtccccggggcttttaaagggttacctggcacctgttgctgaagccgtggcttcttcaggtccctcactctcccaggcacccaccttcccctaggggg

SEQ ID NO: 14778 - DNA, 201 bp, Bos taurus
tcattcctttactattgcactctgacagctctccagcctcttcggaccttaccccattttctcacaggtgtttcttagattccaaggccaggttaagcatgcatcttgcagaacctagatcacatttcttcagtgacaggattcaccttcacatcagacacttgaagtgatcctacaaaaactcattttccaacttgctga

SEQ ID NO: 14779 - DNA, 201 bp, Bos taurus
agcagctacctcaaataagcgttcttacttgaaaagaaaaggaaaagaaagaaaaatgcagtgtttaggaggaggtggccgcgttctgatcttcaccacctctctgcacttagggaatgaaccacaggtgggaagtagctttcataagtcaattcacctgagtcagtttgagtttggccgcgttccccttctggtcctgag

SEQ ID NO: 14780 - DNA, 201 bp, Bos taurus
tgaaggacatgagtgtgggaggagcaggcagggggccacctctggagaaggctccagagaccacagggagcagacaggacaagcttagagccataatcagcgaagcacatcagggcccaggaggccagacaaagagtaggtatcgggagaaggaataagacgggggagtaggggttggtgctccattcattcattcaatca

SEQ ID NO: 14781 - DNA, 201 bp, Bos taurus
tgcagccacagcacaagtgggaggccatctctggagcccacccccgctagaaatagctctcctttgtaaatagttaatgagcttattcatccgcgttgcatgtctccatggccccgctctcaccctgggctggcacatcacagtctgtggttctgtgtgatcctgctcgctcaccaccccccaccacctctgaggctctga

SEQ ID NO: 14782 - DNA, 201 bp, Bos taurus
cacacttatttagtaaactttatgtccccaagcatcccacgtgctgatggcacagtttcagggacccaataacctgtctgaacgtatgctccaccccacaaagaggccttgatggtaagcctcccttatgtgtacacagaggttagagacaaggtggttataaaaaaaaagctggaccctcccccacctcccacttaccct

SEQ ID NO: 14783 - DNA, 201 bp, Bos taurus
gggccccccaaaccaagggacgccccacctctgtcaaattagaggagagcagaggcaaaggagcaggcaactcagagggatcacccaggtcgcatgacccgttgttggcaaagctggccaggacttaggtttccagacccccagcccagaggtttctccactagccactctccatcggccttctcgcccctgcctctgctc

SEQ ID NO: 14784 - DNA, 201 bp, Bos taurus
cagattctgatctggcaagatctttgcttaaggggccgcattctagttccaaagttggtgaaaggtttgtgtcttctaatctgaacttagaaggacagagttcctcaggacagggcccaggcacagctgaatggatgcatcaaatcctcaagtgcagctgggcatcccttccgccagttggcatggccatagcctgcatat

SEQ ID NO: 14785 - DNA, 201 bp, Bos taurus
cagtaattaacgctacagatttaccctatatccctggaggccacgagccattgtaataactgagatgattcctcttcctccctggacagaaccagcctgtaatcccagggaccaatctttccctgattgaaatgttcctgctctgtttcagtgggccccaggagagaaagctgccagcccttttaaagggaggtcagaggg

SEQ ID NO: 14786 - DNA, 201 bp, Bos taurus
ctgcctgtggaagacatgccttagtgagcaactccaccaggaagccctccatgaattgctccctctcccttccccctcctttgaaatctggcctcctgccgccgtgggctctcacataccccttaggtatccatttctcctgggactcgccagagtttactgaaatcatcctgttgcacatgtggccccagtgaactgttg

SEQ ID NO: 14787 - DNA, 201 bp, Bos taurus
tgagatacctgaggcccagggagattaaggacttgtcccgggtggtgggctcatccacagtgggaggaagaccagagccagggcctccttcaggcccttttctccacagtcactcccaacctccatcctggggagcccagagtctttcctaggatatctgtaaccccagggcctgcttccccctggagtctgtgctctcta

SEQ ID NO: 14788 - DNA, 201 bp, Bos taurus
tgtggcccctagtagaatgctcggcacctaatggatcctaaatccataacagacactaacccactgaagccagcacggaaacctgcagctttgcaaggacgcaaggccaacaactaaacacccttttcaatcagatctgcccacaaagaatggtgtttgagtctgtatcacttaagaactttcaggtggcagaaaacccaa

SEQ ID NO: 14789 - DNA, 201 bp, Bos taurus
gttccatggagtgctggaggataagaggtttattatccagttgttgcaaccagagtagagatgccctggaaagttcactaaacacgtgacatagcaaggacgaaacaggaagtgacttatgctgccacccgagattgctactcttgggctcacaggcgccaccctcagggcttctgcccacccttggcaggcaccatatgg

SEQ ID NO: 14790 - DNA, 201 bp, Bos taurus
acaaagtcccccttggtgatgagggctgtaatggcggaacatgaacaggtgggggcgctcaagagaaagcggtcacgccgccccataaggcgaagcaaaccgtccagatggagatgactgatgcttaggctgagtgagcctggaataaagacatccacgtagccaacaagcagaaggggtttcctgagcagaggaagagca

SEQ ID NO: 14791 - DNA, 201 bp, Bos taurus
gggatagagactgagaagaggggtgtgtgtgtggggggggggggggagggggttggttaatggtgcagggctggggtctgcgcttagggaggggccgcacgtgcaggagaggaaagagacagtggaggctgccctggagacaatgtccaccccctgcttacgtccttccacttccaatcttggaggcggatgaggccaagc

SEQ ID NO: 14792 - DNA, 201 bp, Bos taurus
gggaaagcctctggtcatctggcctgcagccctgtcccacctctctcctctgcctttcacttcatgctgctggtggagcgtgtcagcaggagcctgaccgaggcccagtttgttttttgctggaatcggagggaggaggggcccagggggagtggagggcacgacctccctgttagacagtagacgagcaggagtgtagca

SEQ ID NO: 14793 - DNA, 201 bp, Bos taurus
tagtcggcccagattctaagaagctgagaccatgatcccaaggctccaggaggatttctgagggtctcacctttgtccctttgtaggagaaggtgtcaccacagctcagtgccagggccagcctcccgtggctcatcctctgggcgctctcagcctacatgggccaccctctgtgtgccgagctcctccaggcctgctctg

SEQ ID NO: 14794 - DNA, 201 bp, Bos taurus
ttaaggaaaatgaaactccatggaagccatatacatcataagactgaccccaaaggagtttcaaaccttcttctgaaaggccggggctacattacaattacagaagcctccctcagaggctctaggtcttcaccctgcttccagatagattcaggatccatggcccagagccatcagattaatctctcacagacacacctt

SEQ ID NO: 14795 - DNA, 201 bp, Bos taurus
tcaggatggggaagtaacttggtcaaggacaggcagctcataagtggcagagctggggtttgtagccaggctcccgggtccaagttctattgggccatcctacctgcccttccacccacgacctagaagcttttccttcttccctcccaacatcagcctgcagaaccacctgcatctcctgtgtctgcctctctgcactcc

SEQ ID NO: 14796 - DNA, 201 bp, Bos taurus
acaggccctccaggccaagccccaagctgcaggttgaggtgctctgctgaaactcgcccatgggtcataagggtggggggacctcacccggggtgtgggcgagccatctgcaactgatctggcctttccagggcaagctgagagcaagtcacccctactcactcagctccccttactaaagaggaaaaagtgctacgtgct

SEQ ID NO: 14797 - DNA, 201 bp, Bos taurus
agatcagggactgaactccttgtctcctgcactggcaggtagattcttcaccattaagccaccagggaagcccaggcctttggcttttaactcaaagtgggatgtgagcgtacagggcagtgagcaggggactcattgacctgacacagggtttcccaggagctcctgaaaccactgttaccaggcctgtgctggggacaa

SEQ ID NO: 14798 - DNA, 201 bp, Bos taurus
tagctgaagaccagataggagtctttccatcgatccactaaaaaatacttatggaagttaaacctgcaagtcaaaaaagctcttggttaatggcagtttaattaaacaagactaactggctcctactagagccctagtgaattcgtttattaaacaaatatttattaaaggcctaatttatcaagcaataagttttaaaca

SEQ ID NO: 14799 - DNA, 201 bp, Bos taurus
acacctatttatttccttgtttgtgttgatgctgggcaggtcctcatttgtccctttcaggtaccttggaggggtgaggggctggggagggccagacccaggttccgagggcacaggcagtgcagcttttggctgtgtacatagggtgctttattctccacagagtgatacatgctacggtgggttgggcttgggccgatg

SEQ ID NO: 14800 - DNA, 201 bp, Bos taurus
aacaatggaagcttatgctccctcagttctggaggccagaagtgtgaaatgaaggtgttggcaagcttggttccttctggaggttcttcaagagtctgttccaggcctctctcccagcttctggtgggtgcaggcaatccttggaattgcttggcttagcgatctctctccgctcactcagtcatgtccaactctttgcga

SEQ ID NO: 14801 - DNA, 201 bp, Bos taurus
gatgtgagtttatttctgctatgtctatcaggccatcaaaaacaggaaccgatcagtatagaaaagaaaacctgtgcaggaaggagacagaacccaggctcggggaagctgaacaccgtggcctggtggcgctgtgcctgggtgtttatctgagccttgacccacgccagcacggtaacaccggggccttgtgcctttccc

SEQ ID NO: 14802 - DNA, 201 bp, Bos taurus
tgagcacagggcctggcacgtaacaggtgcccagtgtatgtttggtgaatgggtgaaaatgacctacgtgtgatgacagatcactgaggctggggttggtggggggagcaggagagacgaggggccccagcgtttatggagaaatgggtacaagaggacttccctggtggcacagtgggtgagaattcgcctgccagtgca

SEQ ID NO: 14803 - DNA, 201 bp, Bos taurus
gtgtgcagtgcctgtcccagtgcccctcacaaacaccttccctcagtttcctgccagactcctcctggcctcactgttccatctttcctctctccctcccaccggccacttcctcatgactgacgacctcctttagaattatctgaactcttggcccaactttgtcaaatcccccaccatcctcagccctgtcctagcttg

SEQ ID NO: 14804 - DNA, 201 bp, Bos taurus
catctaatcccactctgcagcttccaagctctctctttctctttctcacctcttaaagcctcatttcctcacctgtgagatgatgctgatgctggcctcccaggaaggtcaaggatgagtctggtatcaagcagatgctcagccaaacatttattgaatgaaaagcgaatgaaagtggggcagaaggaagcctggtggcca

SEQ ID NO: 14805 - DNA, 201 bp, Bos taurus
ggggtacctctcctggcccccagtgccgggccttggggttgggttggcagcagaaagtgccaaggatctgggtcttgacaagataaatccctctccccaccgtcttggccggcagaccagagccgaggcaggccgcccacccgctacaaggcaggatcctccaggggccgccaggctgaggccatcgtaaatagcttaact

SEQ ID NO: 14806 - DNA, 201 bp, Bos taurus
actactccccttcttactcattccactccagcccctttgctcttccaatcaaccagctcggctacaacccgagggcctttgcacatgctgttccctcttaggcaacgctttcccgtcattttgcacatggctccctctttcaggtctttactcaaatgttatcttctctgtgtggcctgccccacctctctgttacaatcg

SEQ ID NO: 14807 - DNA, 201 bp, Bos taurus
ctccagggcactccacagagcacactttacaaacctctgaaccctgaaatcccctgaacaaacattctggggccctgccacatctgggagctccagaactggggatgaggctgggaatgggggccagcccggtgtagggagcagggctgagaggtcccaaggtgggggtcgggttgggggcagagccagtagggggagtcc

SEQ ID NO: 14808 - DNA, 201 bp, Bos taurus
cctgggccagccgctccagtccagcagtgtccagcggcacccccttctcctccagcatcagctccaccaggtccagggggagccccaggttcccagacagtgacaaggaccaggccacttcggctttgaggaaggaagacgatgggcgtcagggctatcgagggagggagtgggaagaagtacgggccagggcttttctga

SEQ ID NO: 14809 - DNA, 201 bp, Bos taurus
gctgggactctaccccttcccagtgacacgtcctacactcggctggcctccacacctgctcctggcacccgctcccctcggcactcgctgccctcggtgaggcctctctggcctcttttcagcatccttgcttgggggttgacatcgctgtcaatggcccaccggctacagcccagggctgactccccccagggatgatga

SEQ ID NO: 14810 - DNA, 201 bp, Bos taurus
ctccttttgcagggtgaactggctaaagatctttttgctctggcctcctctctgaccaccagcctgtaattagcactggctccaccatccccatcaacatgcaatctggttccctggcctctttacgagagttgctcagtcttcccagaacaacatgaccaccccacccccacccccagcctctcctcctctggccagaac

SEQ ID NO: 14811 - DNA, 201 bp, Bos taurus
ctcagcacatagctgctgggagctgggtctgccaacacctgaatgagcttggaagaacattcttcctcagaacctgcagagcagaactcagactggccaacgccttcatgtcagtcttgagactccctgagcagaggaccctgcctggatcctgatctacagagactgtgagataaggatgtctgtttgaggccactcttt

SEQ ID NO: 14812 - DNA, 201 bp, Bos taurus
tagttagacttctatgaggccataaactggaaaaaattaaacagtgtaattgctgtatgagggacacacgtaagactggatgggaacggaacagatacattccagaacctccagcaaaacgggccaagaactagatcttccaggatgtctgcagtatatggtgtcacagaggcagatggcttgaaggtgagcagagaattc

SEQ ID NO: 14813 - DNA, 201 bp, Bos taurus
cgagccacgccgcggcctttttaggacgagggctgctgggagaggggtggggatgaacagaactggaggatgttcagggccattcctttaagaatgagctgagagggctggcgttttcgagggacggaggaagtttattttcaacttcagggcagagattggcctctaacggtttccttcagaattgagatgaaccggagt

SEQ ID NO: 14814 - DNA, 201 bp, Bos taurus
gccaagaaggaaatgacacatcgagaggcattttgtgttgtgcaatattctgtggaactgatgcaaggctatatggcctgtttacacattccttcgctcgtagacagcatggcagtaattgaattcagcagcacatggcatgctgcagcaaggagccgggccttcacatcctttcatggcaaattatcgcagccgttaaaa

SEQ ID NO: 14815 - DNA, 201 bp, Bos taurus
tcagcatgagcactgtggagaaggaccgtgcagaaggaaggcgtctccatacaggcgacaggtgtttactgggcacctactatgtgctgctgctgttctcggccttgctctgggccctcttccaggcgcccttctcagcatggactgcatacccttggtggcaggaagtgtgtgggaggaagccaagctgtgagagtactg

SEQ ID NO: 14816 - DNA, 201 bp, Bos taurus
ggctgaattcagggaccctcttgaaccttaagccttaaatgggccatttacaggaaaagagcccttctatagaagtctcatggtgaaggtgcaaaagctgcgtgcccttctggcccccaaaaccctcaccgtgggcatgcacagccaggggccttctcgacatcttttgctctcatctttacctctgaaggactgaaggga

SEQ ID NO: 14817 - DNA, 201 bp, Bos taurus
tctgagggtgtttctagaagagattagcattttattttgatagaccaagtaatgtgggttggcatcattcaactcattgggggcccaaatgtaacaaaaaggtcaagggagagtgaattccctttctctcttcttgagctggtatgtccatctcttcctgtcttcagatatcagagaccctggttcttgggccattggatt

SEQ ID NO: 14818 - DNA, 201 bp, Bos taurus
acttcattgaattacttaaaatgatagcaaggctatgacggttcacagagcccccatactaagaacgttctctttatgagctttcaagcccaaggataagcagagttaacttcttgccctacagcagttaaaagaaggcaaaagggaatgactgcattttttttcccctcagagaattacctccaacaataatgagaattt

SEQ ID NO: 14819 - DNA, 201 bp, Bos taurus
tgagtatttatttttcatcctccttacaagggtcatttcaattaaagtcttaagctaaagagagttggtcagtttatcagcctaaatctgatctaacgtagcttctgtttctttgcagggccatgaaattcttcatgcttcaggatttttgttttactgaaacctttgacacagagctttcattgagagggggaaatgcag

SEQ ID NO: 14820 - DNA, 201 bp, Bos taurus
ttttccaggcaagagtactggagtggggtgccattgccttctccgaaattgcatattagtttggtgaattggaaaaatttggtgaagagtacctgggcccgctctgtacatttttttgcaacttcctatgacataccaaccagtccatcctaaaggagaccagtcctgggtgttcattggaaggactgatgctgaagctga

SEQ ID NO: 14821 - DNA, 201 bp, Bos taurus
ccgagaaagcttgctttgccatccccaccacggaaacaaaacatggataactggacgcaaacaccaatgggcatgtgaccatcagagtcagacctgggtgcgggggcctgagaaatcatgaagtgggatgctctcccatggaactttcaggagtggaaggggttctggacaggggcacaggtaaactcatgacttactatg

SEQ ID NO: 14822 - DNA, 201 bp, Bos taurus
ggagcctctgcccccactcaagcagaggggccgggagagaggacgtgtttagggggcatcagctcttgggggctgggctttgtggagcaggctggagacaggcagccctttgggggtgaggagggccatacaagactctctctttgcaaagagggtcctgagctctgagtgtttttggaaatctactcccagggtctagag

SEQ ID NO: 14823 - DNA, 201 bp, Bos taurus
aaatccagaatagaagtttcttaagaacaaaacccgtatatcgcttggggagacattcagtgaactattacaactggcctgtagtgttgatggagtggggagttaatctttttggaaaattggagagattactctttgggtccatctagaaggttctgcaactaaagtgctcagagagtccaactgtttgaattggtggcc

SEQ ID NO: 14824 - DNA, 201 bp, Bos taurus
cacaaatgtccctatgaatcccactttgacaaggagtggcgggcggggacacagagcatcgctgggtgctggctccgtcatttcttgcctgtaaggccttggacaagttactggaattccctgagacttagtctcctcacctagataaacgggaatccaaaatggaacctacttcaccagagtgttgagaagactctgtat

SEQ ID NO: 14825 - DNA, 201 bp, Bos taurus
ttcctaattcttcctgtttctcaattgcgttcattttccccatgaagcattgaccaagttattttgcccacaaaacccaatcccttgtaggagtttccatatgcttatttccaatatcacacaaagtaactcatggtctttttgtctgagttttcatctattgtagtgctttacacaagccctttctctctacctggaata

SEQ ID NO: 14826 - DNA, 201 bp, Bos taurus
gacaatgttagtacttatcacagggttgtaatagatacatgatcttagacaagcttttgggagggagaagctctaacttctcttctaatgaggacattcttgaggtcaagctgtgattttctggctttccatgatgctatttcctcgagtgctgtattatgatatagacaaagttcagcacaaatctcaacatgtagagtc

SEQ ID NO: 14827 - DNA, 201 bp, Bos taurus
ttgtcattgattttatgctaagagcattagtatgaagaatattattggactagatttagtatttcattctttccaaatatcaaatcccccttccttaaaacttggaagctgctacatattacctttcaatttcatttatttgtatctacagcttatgttctggactggtagcttctattctgggaacacctgctgatgtca

SEQ ID NO: 14828 - DNA, 201 bp, Bos taurus
ttactgttctttagggccagggctgcctctgaactcaaacccttcctcattcctccccttgtttgtgtttctaccattgcagatcctggccgagagcgctgccctgcagagcatacctggaaggcattgaggagggtgaacacaatgtggaacacagcgttgctcccctggaacacggtggccagcccgaaaccccaggtg

SEQ ID NO: 14829 - DNA, 201 bp, Bos taurus
tgctatggcccttggcaatgatccagcatggagcaaggggttgctgcactgcatggaggttgtccagccccctccaactccacgacctaggtcagaacaatgagtccaagtttccaagttcaagacctttcctaactacatcaccctctataattcaaagccagcctcttgggatcactgaactatttttagagttgatgc

SEQ ID NO: 14830 - DNA, 201 bp, Bos taurus
atactatcactgcttcaattttaccattgaaaacaccgaggccttaaaggaatgaaaatcgcttgccagaggacacagggctaagtgcaagagctacagtactgggacttccctggtggcccagtggttaagattctgtgcttccaatgcaggggccccaggttcagcccctggtcagggaactagattccacatgcctca

SEQ ID NO: 14831 - DNA, 201 bp, Bos taurus
aagggcccattaacctgagcatttttattttcagcaatgggtagaatgttccccagggtcaaggaggtcatgctgatgatagtatgtggaaggtgcttcttgaattgtcctggcccaatagacacatggcctgtgatgggactgggggtattttggggggggaattcagtttcataattgtaaccttgattgctgagattt

SEQ ID NO: 14832 - DNA, 201 bp, Bos taurus
acaccacaaccgggagtggcctctgctcacaactagagaaagcccatacagcaatgaaaacccaacgcagccaaaaataaagaaagaaagtggtgcccctatttgtacactggtacacagaaggcctggtgccaatccctggcctgccgccctagcagtgtaccctgcggcaagtcctcaatttctatcagtctcagttcc

SEQ ID NO: 14833 - DNA, 201 bp, Bos taurus
tgtaatttctgttagtggccattttaatgaagttcagcactacatgctgggttgatgattttcaatggcaaggtaaatgtagacagaattattattattgaggatagtgggccagaaagagcatgctgctgctgctaagtcgtttcagtcgtgtccaactctgtgcgaccccagagatggcagcccaccaggctcccctgt

SEQ ID NO: 14834 - DNA, 201 bp, Bos taurus
ttttaatgtggaaataaatccaaagaagtttgctaaaatatagtgattcctgtatctctactcaaagatttactcagcaagtatgcattggggtctaaatttctacattttaaaactcagaagtttctgatgcaggtgagcctggggacataccatgggaacactgtgactaatataggttaatcattaaaaaaattaaag

SEQ ID NO: 14835 - DNA, 201 bp, Bos taurus
tcattctaaagaaatgtctgaaatatctgcaagagttaagagcaagataagcactaatttaccatctccttcatccccataaggaggtacttaaaagaggacaaaatgcatcactaggtattgtcagggtcaaactaagacttcagtatttctttgaataaaagtactatgctccactgcctaagatgaagagtgtttttg

SEQ ID NO: 14836 - DNA, 201 bp, Bos taurus
agctatgggagcagggtcatccagagtcttgggggcccaaccttccccaacaaaccagcaggtgcaggaccagctggatcccagatggcaaaccactgcctcagtgggcctggaggacagagtgtcaaggcaaagaggattatcctcaggccttaaggggtttccctaatagctcagtgggtaaagaatctgcctgcagtg

SEQ ID NO: 14837 - DNA, 201 bp, Bos taurus
gaatgaatgtgtcattcttgataaagatgaaaacacttagacaaggagggaggagcccctgttctagactcagttttatatgcaggaacaaagatgaacctcaagatttttacctatgatgtacactccttgtataatcctctccctttgagaagggtgggcctggcctaatcaggcaaaccttttaaaagagcatgtgga

SEQ ID NO: 14838 - DNA, 201 bp, Bos taurus
tcccgtgttctaggcagggttgctcatcctgccccttgcatacatacatctaacctgtaagttcccaccacgttttactttggcagaagaatggcatcctggagaccaggcctcttacagattgctgccctagggatagcaaagctgtctgttacagccagtggcccccaggcacaaacttgattatctcttcaccagtaa

SEQ ID NO: 14839 - DNA, 201 bp, Bos taurus
atgacagctttgtattcctaagaaacttactctccaaacatgttatctctatttaagtaattgtgtgtgatgcatagatcagtagaaacttaaactgagcgaagttataaaagcatattttaggatatcaattaacactagcagtatcttaattaagctgagtggtgatttgaacaaggaaaaccacagtgtcttaattat

SEQ ID NO: 14840 - DNA, 201 bp, Bos taurus
ccaaaacatatgagcaagaacattctgtagtggatcccgtagagaaaacaatggaacttaaatctacaaatatttcatttacaaatatggtttcagtagatggtttcacatcctcaagacccagaaaaaactattttgactcaagaagccgtaattactgtgaaaggagtcagtctcggcagttaccttgaagggctgatg

SEQ ID NO: 14841 - DNA, 201 bp, Bos taurus
gaaatcttggccatactccttacaagttatgagagcaaaggtctcaggtagaatcaggtgcacagtcagccagactagagcaaaaggaactgttactaaggtagaattattattcctgggcctcaccaccatcacacactgaagagagctatggaaaatatccctggacttgtatttcagcagattaattgatcactatgt

SEQ ID NO: 14842 - DNA, 201 bp, Bos taurus
agcagtgtgtacatgtccatccccaattccctaactatccctttcccccattctcccctctgttgactctcttttccattgttaaaacagtctttactaatttaggcatgtttgtagtcctgccacagttccatttagagataacatatatatttgtatgatgttgcctgaattttttgaaattcccagcatctgagatca

SEQ ID NO: 14843 - DNA, 201 bp, Bos taurus
gctggagtggaagtctgaattttgaatgcaaactggctctgttccttttaaatatatgttctcccttctgcaagctctgggccctttgccccagaggggagcaatgctggaggaagaggagcccatgggagctcctggctcatggcagagacttgtgctacctctgatgtgctgctatgtgagcaccagcaatggccctgc

SEQ ID NO: 14844 - DNA, 201 bp, Bos taurus
agggccaatcatattttaacctcttcttaggctgagtttagaagtgtggaagtgctatttgtcatctcttgatatgacagatatcgaaagctgcagggcacggggcccatacacagacccaaggatgcagggattctcacttccaaccccacctctattcacagtagccaacatgcttttatggttcaacatgttcaagga

SEQ ID NO: 14845 - DNA, 201 bp, Bos taurus
ttatatcctcaccaacagtaaattgagagaaagaaaaaccattttaggattgcaatgaggaataaacacagttttacgtaagatggccagaggcaaagggcaagcaagggagccagtggggtgtctagggaaagagcccttggcagagggaactctgtgcagaggcctagagtgggaaccgacttggactcccggagagcg

SEQ ID NO: 14846 - DNA, 201 bp, Bos taurus
catcctcgtaaatgtgtttatgaaagagggaactgcccactatacagacgaaataggagttagtgacgacacaggccttgggaagtggcctcacctccctggggtcaacctcttcatttcaacagattaatgagccattttcctaaatggctaaacttactaaggaggaagggccttcccaggtggctcagtggtaaagaa

SEQ ID NO: 14847 - DNA, 201 bp, Bos taurus
ccggggttttgtggagaaatatgaaacaataataaaagaaaaaaaaaggcgaaggaaaacatcagctttgagcatgctgatgcaaataaagtaaaccttggctttaccccagctgagtctggcccagtcatatactgccttacagggtacagtaagttttgaaacaggtatgggaagtattggtctaggtatttatagcag

SEQ ID NO: 14848 - DNA, 201 bp, Bos taurus
ttttgataatgatcaaattgtcctctataaagtttatgccaactgaaagccaccccaataattcatggaaatacttattagggtgtatttttgccaacaatagagtattcttatatactgggtattaaaagtccttcaagtatttgccaattggataaatgaaatgtggtgtcaccttgttttttgaattcagtttgacca

SEQ ID NO: 14849 - DNA, 201 bp, Bos taurus
tgataatttacagtaaaggataaagtgagaatctaattttatatttttccaaagcattgaccaattattccagcacaaattttcaactaaatgggaagcccttaaaattgaaatgctaatttattccaattctaaataatgatacatacctgggtctattgctatgtagtctctcctgttctggtgccaataacaataatt

SEQ ID NO: 14850 - DNA, 201 bp, Bos taurus
cccacgcccttgccatttaatcatcaaggcaaaggaaaagagagatctggagagtcaagccctagacataaaaatttctacccacaagctaagcaagtgaggtggcccatcacccttcaaaatggtgtgaagccctcctgggttcaaaacagatgaggactggatggtggaggaagctaccacgaagcgaactgactgcag

SEQ ID NO: 14851 - DNA, 201 bp, Bos taurus
tgattgataaaaagtctcactgctgtgactcctaaggccagttagcaattttaaggagggacaggtgaccaaagatggttccctaccttgcagtgatgagcgggagctccaggccacaccctgccaaccaggaggtcacactgtagacgggaggtgatcccactactgagagcaattctagcagattcccgccagggcgag

SEQ ID NO: 14852 - DNA, 201 bp, Bos taurus
ctgtcgcccaccctcagaaattcagtctcaggcctcaaatgagaatccggaggaaagacttctgaagtgtgaacccagcagtctcccagagcttctctagcaggaaagaggcccaaatcctcacaaagaggacaaagggggctgtaacgctctctgtccaagtcacctccaccctccaaccctctgcagcgttggtctggg

SEQ ID NO: 14853 - DNA, 201 bp, Bos taurus
gggctgtggcctgagacaaaggtgtttactcctgtggaggtgggatttttattgttagtttcaacatcaaggaggtgtgagggttaggtacaaatcctgacaatcagtaccacctgaggaaggccagaaaggggctccatgggccggggcttctcagacttcaggtgcacagcatggaagcagctgggaatctcatgaaaa

SEQ ID NO: 14854 - DNA, 201 bp, Bos taurus
ccccacctcacctgagaccctcctttactgctagctctcccctaagggatcaaatctccagagtttctccatgattctgaggtaggcgattgatgggcctttgggctgggctgctggtgtttgttaagtggaataaagctgatgccttgttttcactcaaacatcaaggacagagcccttgtccttgaagctgagctctgc

SEQ ID NO: 14855 - DNA, 201 bp, Bos taurus
ttgctaagaaacattgtcatgggggtagaatgagtaaaataaccttttctaatttagaatttaacatttattaattattaaagtcttaaaaatattgttatttactgaaaaataggatatgctctttttataggtcagtgtttcttcagaggaggaaaatacataggacaggttgaagaacatgtacattttttctcaatt

SEQ ID NO: 14856 - DNA, 201 bp, Bos taurus
gtgcagtggtaaagaatttgcagctaatgccagagatgaaagagacctgggctcgatccctgatttgggaaattcccctgcagtaggagatggccaacttgctccatcattctttcctggaaaattccatggaagagaagcctgggtgggctacagtctagggggttgcagagagttggagagagagaaaagccagtgtcc

SEQ ID NO: 14857 - DNA, 201 bp, Bos taurus
ggagcatgtgctgtgccaagacaaaaggaacgggtacttcagggttcaggataactcagataagataagaaccggagtggccaactctgcagtgtggctccaattaggtctgtttagtatgcacgccggagaaggcaatggcaacccattccagtactcttgcctggaaaatcccttggacggaggggcctggtaggctgc

SEQ ID NO: 14858 - DNA, 201 bp, Bos taurus
ccagaaggacttcctggagcgggcgcgggccgcggtggacacgtactgcagacacaactacggggtcggtgagagtttcactgtgcagcggcgaggtgagcgcgggggtggacggccagtgtggagcagtgtgcgtgtgtgtgtgtgtgtgtgtgtgtgtgtgtgtgtgtgtgagagagagagagagagagagtgagtggg

SEQ ID NO: 14859 - DNA, 201 bp, Bos taurus
caggtgtttccactaaagcttctctctactaaacagaaggcctatgctctaaagtagcttttggctcagggagacttaatttgttttccttcttactacaatgctttaacatgaggcccttgaaagaggagcaaaaaactgcttgcagaattagatctggaaacaactctctcttctatcttttgcaggactcctgagctg

SEQ ID NO: 14860 - DNA, 201 bp, Bos taurus
aggaggtggaagcgatggggtaaatcctggcccagctcaggcttggaggtctccagccaagtgcagagctgactgcatcccacatggcttagaatcagagaggccttccccgaccaccatggtctggattgatcctgcagatgaaagatgaaccatgagtgctggtaattaggggtgccagtggagccaatgaaggagttc

SEQ ID NO: 14861 - DNA, 201 bp, Bos taurus
agagaagaccggggagcacaccatcttctccagagtagagaacagtataacattgacggggtcctgaaaatagctggagtaaagataaaaatgggacccacgaggtaaaaaagattacagctaagtggttcacaggacttctaagaaatggcctcctgaaaccctagtgtctctctcagggaccatcagggaagcctttga

SEQ ID NO: 14862 - DNA, 201 bp, Bos taurus
ttagaatttcagtgattctattcataaaatcccattattctgtagtatcaaatatgcctggttcatgcttagctcttgtcagcaatgacttaagcattcaggttcatcttatatcttcaccatctttaccttatggcttctaagttcatcttgcctaccttaagtgagaagaggggggaaagcttttagatcatgagtggg

SEQ ID NO: 14863 - DNA, 201 bp, Bos taurus
ttcaggcccacaggtgctgtgtttagtcccaccatatgcaggcgccttcgtgtgtggaatctcatggcttaactgactagcgcacactcggttgtgattggattggcctgttgactgtctgtgttttcttaatcctggttcacaccacccacatgcgtgccccttcgcatgatgtgctgatgtgacatgtccacaactcgt

SEQ ID NO: 14864 - DNA, 201 bp, Bos taurus
ggacccaggcccaggactggaagggagaaaacatgggatttctgggattgggcagcaacagccagctccttcttcttagttgacctcaggccttagatcgggtcttgccacaactatagctgaaaatttgactctcgtgcgtggctttatgccaccaccatgctgaccggatttcaggagacatctgatgggcaatgacca

SEQ ID NO: 14865 - DNA, 201 bp, Bos taurus
tggctcagcagaccggccctactacatgtccaagagccttctgaagattcttggcaagaagaacaaggggaccccgggagacaagaagaggaagaagtgaaagatgcagccctgatcctggactgtctcccgcctgtacagcctccccgccttccagatcacgcttttgtagtaaaaagattttattaaaaaattgctatt

SEQ ID NO: 14866 - DNA, 201 bp, Bos taurus
ttcaaacatttattgaacacttactatatacttggcattgttctaggttctgtgaatacagttatgaacaaaacagagcaaaaatccttgccttcatgggatagggaatggggagacagacaatatacataataaataactaaatgtattttttgtgttaagaggtaataaatacagtggaaaaaaaacaaaatagggcaa

SEQ ID NO: 14867 - DNA, 201 bp, Bos taurus
gagaagacagtggctgccctgaagatgggacagaagtagacaaatttgggacatactgagatacatttcaggggtagaattgacaggcccagatgatggattgatgatgaggggggtggaagatggggagactgagacagaagcaggattctgatgggatgggagaaccagaagttcaattttggatttaaatctattggc

SEQ ID NO: 14868 - DNA, 201 bp, Bos taurus
cacagcactgtctaccccaccccagcatcagatgaatccttgttcagggggaaatcccaggacttcctcctcagggccacgtgacctctgctttctgttactggaagtgtgctgcgtcccgcagaagaaaaagctcatccatgggagagaagagaggctcaaggggaccagtcactcacaaggaatgagggcgggacagac

SEQ ID NO: 14869 - DNA, 201 bp, Bos taurus
cttccaagctgtgcactctcgggcgagtcgtgtgacctatcaaagtcttcacccctaaaactggggtaaggcagtacctacttcagagggccataataaggatgaaaggaaataatgtttctaaggtgcccagcacacagcagcctcagctatgatgacatgaaaagatgagcgcccgctgggaaagacagaggcacgctc

SEQ ID NO: 14870 - DNA, 201 bp, Bos taurus
ctctgagtgctgggcttatgtcctgaatccattcatttccctcagggggactagtgtttgaaacataggagccagagaggatcagcaggccctaccttctgcctcctctctccatctcaatctctccctcctcctaccatctcttacctacaacatgggcaggactatgttggacagggttctttttctagaagagactgg

SEQ ID NO: 14871 - DNA, 201 bp, Bos taurus
tggagcaatcaagatccagcagaatcaagagaagccttgcacctctcatttcacggcctaaataactgaagtagggggcctggtccagcgatgacattgatcggaaaaacttaacctgcttggcaggacaaacatctcattaacaatcacctgctcttcccatcttcctgtgaattacccacctccccttcaagccccagg

SEQ ID NO: 14872 - DNA, 201 bp, Bos taurus
aggcctgaatcagaaagttttctgctcttattagtggactgagtaactcagacttcttccaggtgaagataactgaaaaagctggataaaatatttttcaggtatcttaaaaattcagagggccagtaaagaatggctgggccaaagtttgcgaaaggaatctgtggatctgagcccagaacttaaaagttgcttctgtct

SEQ ID NO: 14873 - DNA, 201 bp, Bos taurus
gtctagggttctgctttcaatgaggctgaaggtggtggccttgggtttctgggtttcctcttcattggtgaaaacataagagagggaattaaaagagcaggaagtgaaaaacaagtggcccaagttgtcagtcacccaaaatcaaccaagacctctgaaacaaaagagtctaagagtatgggattgggggaagcctggctc

SEQ ID NO: 14874 - DNA, 201 bp, Bos taurus
ttcatgtgttgtagatggaagggaggcctggcgtgctatagtccatgggcttgcaaagagtcagacataactgagcgaccaaactgagctgaactgaactgaaaaaagaaacaaaaggccccaagtggagtcagctgttctcagaccacttcagcaaaccaagaccaagtacctaagttaaatacaacctctccaagcaat

SEQ ID NO: 14875 - DNA, 201 bp, Bos taurus
tgaagatgttttcttctctgaaatgtataatggtaagggtcttcttgaatgggtacatgaactgcaaaagatgataggcagtggctgcctcctgccattatcacataggatctcaatggcaagtgggaggaatggtataatgaaataagtaatgaagaattacatatttagtcttatttagggaaagagagaaagaaacat

SEQ ID NO: 14876 - DNA, 201 bp, Bos taurus
gagatatccattagagacagaggtcagaagggatctcaaatacgggacaaggtataagctgacccttcccctccaatataggtgacaatttgccaaaagattgaagaatttcaaatgctccacgcttttaaaaaaagatgtaaatgcatcagcagaaaaattaaaaacacaacccctagcaaacactaaggcaaatgcaac

SEQ ID NO: 14877 - DNA, 201 bp, Bos taurus
ccctggccaactcccacagtccaggatatctcctctggtcttaggcttccaatcagtgaccacaaaccagggtctagagagcacttgttaactcatgatattgtagggccccagtaccaggttgactcctatttcaggcttttgatgcaccccagcaccaggtcaccaaaatactccagcagcagttgaccatggatgcca

SEQ ID NO: 14878 - DNA, 201 bp, Bos taurus
caggccactgcagatttttagcatgaggaaagcccttcaggggacatgtgccagcagctctttacaatgaacagggaattagaccaccatcatgcctaaaaattagggtttcacaatggcctttctagcccttcaaatttaaatgtttcaaaacagacccacctacattccaaggctccatggggtcttctgagtgcatgc

SEQ ID NO: 14879 - DNA, 201 bp, Bos taurus
acacacataccaaggagcaaatcttggagctcctggtgctcgagcagttcctgaccatcctgcctgaggagctccaggcctgggtatgtgagcaccatcccgagagtggggaggaggcagtggctgcagttgaagacctggagcgagagctcagtgaaccagagaaccaggtgagaggaggaggatggccttctggacata

SEQ ID NO: 14880 - DNA, 201 bp, Bos taurus
agggtttctcccctgtgtgaattctcagatgctgaatgaggccagtgttcccattgaaagctttcccacattctttacatttatagggtctttctccagtgtggattctctgatgttcaataaggcctgacttttgactgaaggccctcccacactcattgcatttgtagggtttctccccagtgtggcttctctgatggc

SEQ ID NO: 14881 - DNA, 201 bp, Bos taurus
acctgggtggatttctccctcttctgatgagaagccggggccctatttctacaagcacccatttttttctcctcgttggaacccaggtccagcctgagggaagatcagggaggcctcgtgccccttgtacctgtgcgcagcagcgcatccttcctgttctccaggtgtctgtggagccactttatgcagtcgccctccagg

SEQ ID NO: 14882 - DNA, 201 bp, Bos taurus
caggagagacctaccagcgtcacatgggtcggagcacagctgggaacaaaactgaggctgaaccagagccagtgtggtgggcagaggcttgtttcacagcgagggtggaacgaacccttgcaccccaaccctgctccaagcacaccctgacccttcactcaaagcaaaacttcacgccctgacccttgtagcaacgactgt

SEQ ID NO: 14883 - DNA, 201 bp, Bos taurus
ttgaagcatttcaattggatctggaaaacccaaggcctttgacctgtccttctgtttccttgccacaaggtggcagaagagggcaatacttatatcacccactgacggtaattatccctcagatctcttaacagtggaaggaaaaaaatctcagaaagagcaaataatagaggtgatgaataggaagtcgatgtgttcagg

SEQ ID NO: 14884 - DNA, 201 bp, Bos taurus
gtcagtcctatgagtgggatgatggaaagcaggggctgttcaagcaaggaatgtacagagagcaagagaacagccatcttgtgtggcctgatcatacacacgggttcactaaagtaaaatccaatatatccagctagcaagtattggcataacttcagtctcaaatggttttctggggcctatgctacttctacctgttta

SEQ ID NO: 14885 - DNA, 201 bp, Bos taurus
caccatggaaccccacagctagcaaggctgatagcactccttcctgataccatatagtttcagttctgccataacacgtcctctgaaaagccgaaatttgtatcctcatccttattttcgtatctgcctccatagcacacacaccttttcttgcgcgcaccagagctcctagtgcaaaactcaagagcaaatcggtttctc

SEQ ID NO: 14886 - DNA, 201 bp, Bos taurus
tcaatgagggtgggaattggccctaagacttctgggaaatagagtcttagcgctctgtcgactgcgagtctctgagctttctgggaattgtagttctcaggtgtaggacaagttctttggccgatctagcttcagagcgccccccaggaagctggaagatggcttggggcggttgagacggtcgctggcccccatccagtg

SEQ ID NO: 14887 - DNA, 201 bp, Bos taurus
cgacttcgcttcattgatccgcatgggcagttacctgggcaagctgggactttcgccatcatccccagcagaagggcgcacagacttgtcggagaggccaatgaaccgccggctaactcagtcccttcatcaagtctaccggattcagcaagtccatcgtacccaccccgcccctcgacacagacctgcgagaaggccgtc

SEQ ID NO: 14888 - DNA, 201 bp, Bos taurus
acccccaaactgctactttccttgactcgttcgacatccttgccctcttcctgtcggtttaatttctgcctcggattccttacaactctgaatagtctcttagtttgatggtgaggctgtagcgctcttctgtttgagatccggggctgggcggagagatacgagtctgaatagctttctcaggtgtcagggcgtatcttc

SEQ ID NO: 14889 - DNA, 201 bp, Bos taurus
ttgcataataaggtctcactgaactcattgaactgtgatgccgttgcttcttgtttttcaccctccacttaagtgtgaggcctggatatgtaaactacacgggtaacttactcagttcagttcagttcagtcgcttagtcatgtcagactctttgtgacctcatgaaccacagcacaccaggcctccctgtccatcaccaa

SEQ ID NO: 14890 - DNA, 201 bp, Bos taurus
tacccagaagacaggtggcccagactccctcggatggtttggtcttgtggcaaaatcatgcagcaggttgtctcgtaggtcagtcccagaaaagtaaactatggcccgtacggggatcgaacccgcgaccttggcgttattagcaccacgctctaaccaactgagctaaccggccacttgccgcctcacccgtattccaag

SEQ ID NO: 14891 - DNA, 201 bp, Bos taurus
aaaaaaaaaaaaaaaggtgaatggaaacaggcaaggcatctcaagaggtcttggaatagaaatattgtcaatttctacatgccactggttaaagcaaatcacgtggccaaatgcaaagttaagaggtggggaaatatactttgccatgatgagaccatatcaaagatgaggattctgggaggattgaaggactggggttag

SEQ ID NO: 14892 - DNA, 201 bp, Bos taurus
gctttaccatgtctggacgcggcaagggcgggaagggccttggaaaaggtggcgcaaagcgtcaccgcaaggttcttcgcgataacatccagggtattaccaagcccgccatccgtcgtctggcccggcgtggaggagttaagcgtatttctggcctcatctatgaggagacccgcggggtgttgaaggtgttcctggaaa

SEQ ID NO: 14893 - DNA, 201 bp, Bos taurus
ttaaatcagaattacatagggtgttggtatgactgtgtgtgtgtgtgttgtaaatgtgttttaaatatagattccagagtcttggcccagataatcctgaattctcctgagaagactcctgttaagaagtgcatccaggattccagcttacagctatctgacttcaaagcatttgctctcaacacacgtgtttttcaggcc

SEQ ID NO: 14894 - DNA, 201 bp, Bos taurus
cccagaagggcagagaaaaattttatgtctgaattttccttgtcttgccttaaactgtgaatttctatttcgttacttggcattgtactaagatgtatgtgtgtgtgtgctatggtagggtatggccagctttcggaagatatctaaaacaaggttttctgaacttgaaaggagcttatcacttcattggaaattacaaaa

SEQ ID NO: 14895 - DNA, 201 bp, Bos taurus
cccgaggcctctcgggtccctcctggatggtaagacagccatcagacccaggggcactaggggtgctcgtttccaaccctctgctgttctccttgggcctctgaggtccacagaacccacaaacccaggcacactgaacccctttcccacccactagcccagcaggaggaccagggatatggagaaggatgggaaaagacc

SEQ ID NO: 14896 - DNA, 201 bp, Bos taurus
tcatttttgcatgagaacacttaaagctgtactctggcctctgctcctgaccttgctacaaagtgctatgggtcaggatgaatgtccacacctgctccccttccacaaactcaagccctgggggcaccttctctttcccaccccaaatgtatgtgtttctacaacaagacactcagaagattgacctggtaggccacatgt

SEQ ID NO: 14897 - DNA, 201 bp, Bos taurus
ttaaagaaaaaagtaatatttaaattaaaaaatagaaaaaaaaagaaactgtttacaaatagatacttttataaggcctgtttcatcagagaaaggaagcgaggctgaacagtgttataaagtggctgggctatggtgtgaaccaggcaggattcaaggcccaaggccttaaccgctgggccctacggcctcccgagggag

SEQ ID NO: 14898 - DNA, 201 bp, Bos taurus
aaaggtttacatttcaatcacagacaggctttcacccaaagaggtgaatttgtgcaatagggattttagtcttcagtgccaagctgagggggccagaatattttgaagtgaggttagtaagaagagacagcccagttctgccacaccagggactgtctcatctgcccagcattgagactggcccaaaggagtaccttggtt

SEQ ID NO: 14899 - DNA, 201 bp, Bos taurus
gcgatttgtggggttgcaaagagtcggacatgactgagcgactgaactgaactgagtgatgggaaactggttgaagagaaagaaaagcaatgagctgatgtaactggccacctgtagaagcaggcaggagtcaaaggcactgtctctgaaaggtgtaaccctattcagtattgttcaggcaattgataccttgatgtagtt

SEQ ID NO: 14900 - DNA, 201 bp, Bos taurus
gactccctaagttctttattctttcaaggtcacatcagcttctgaacgcaggattggaaaagaatttccagacacagagtatttcagaagggagtgagttgataaagaacgaagaacagagattaagtgggcactgggagcacagcgagctgacaactcctgacagaccaaggagagttggcagttttcatgggttaatag

SEQ ID NO: 14901 - DNA, 201 bp, Bos taurus
gaacatcgttaagttagttgcagctttgtggttgggggaccagagggggggatattcctccttttgactgtatcctccattttaccacttgaattttggtcaggtgcatacattatctgttaaagtttttaaaaaagtcaacatcactgtaaatgttagcttagggccaagaatctctgggtttaaaatgaaagaaaatta

SEQ ID NO: 14902 - DNA, 201 bp, Bos taurus
gaattagagaggggagggttgggtggaaaagatttcaggttgccgctaagggctggacattgtgaaccctggacaaagtgaccggtatctttgtttctcccgggcccggagctcttgtaatgggctgagtgtgggccttgatgtctgcgattcgctctttaaacctttgctgaaggaatttctcttctttggagtagcttt

SEQ ID NO: 14903 - DNA, 201 bp, Bos taurus
tccatcttggatggccccacatggcatggcttagtttcatcatattggctagttttctgtgattatggtttcagtgtgtctgccctctgatgccctcttgcaacacctaccgtcttactggccctgcctcctgaccttgaacatggagtagctgaccctgttctatagtctgccccattgacaatgcatcctactcaattc

SEQ ID NO: 14904 - DNA, 201 bp, Bos taurus
atgaagcaagctttctgttcactcacttgatacaggaccggaggtataatgacagtctgctttcgtccggtctgccagagaattttctgagcctagaatagagattacacagaagctgcatcttgctcaactttgaagcttccagaatgaatgtcatataggcagtagagagttaatgcacatactgtgatttgaattagt

SEQ ID NO: 14905 - DNA, 201 bp, Bos taurus
tctaggaaagcatctgttctggacctttcttatagcttctggtaatttcttgtttcgcagcagaatgattcccatcttcctgactgtgcgtctccatgtacagatctctccaggccaaaattttaatattaacaagtgctttagtgcttatttttttaaaaagaaattttccctcggttaacatttggctggtgtttgctt

SEQ ID NO: 14906 - DNA, 201 bp, Bos taurus
agtccagttctctcacagatatttttaatagtaatccaaagaataaatatttaaaactcaatgctgggcaatacttgataggaaagtgtattggtattgtggatattggtatgttgaaagacataaatttaaacattcaaggaattcagcaaagcccaagtaggataaatacaaagaaaacagtacctaggcaatctcagt

SEQ ID NO: 14907 - DNA, 201 bp, Bos taurus
tttcagagaagcatgcgtggagaaaaactaatttcctaaccaatgctgtatacatattttcaagtcctacctaattacagagacttcctttccaaagtgacggatttcattgaaatttgtattgcctgctccttgtcatatatcacacagcttttatcactcttcaaaaaaaaaaaaaaaaaggagtatatgagttttctg

SEQ ID NO: 14908 - DNA, 201 bp, Bos taurus
gtaactgctgtttccaagtctaccacttgaaggataagagacacagtatgattacaaaaatgactctagatccaaatagtgattccatggctaaggccccccagttgacttcctggaaggagagtgaactcctatccttcttggaggaacttttctctcagacaaaagtagaactaagaagtaagggctggggaggccatc

SEQ ID NO: 14909 - DNA, 201 bp, Bos taurus
atacgtcaacgataccactctagtagcagaaagtgaaggggaactaaagagcctctgatggggatgaaaaaggagagtgaaaaagctggcctaaaactcaataccaaaaaagtaatatcatggtatctgatcctgtcatttacatggcaactagaagggaaaaaggtagaagcagtgacagatttcctcttcctggcctct

SEQ ID NO: 14910 - DNA, 201 bp, Bos taurus
gcctgaattgtgttcttgtacagtgagatagttcaaaactcattcctcattacagaaatcacctctctcattcatgaaaatagcaaggaagctttcatgaagctgctcacctggccaaatatcatctccatgccttccagaagtcgtttgttttcttcctcaatctctatggccctcgataggatagcatctggggctcct

SEQ ID NO: 14911 - DNA, 201 bp, Bos taurus
cttcagaaaaacagcctgactgctgtggactgaatgagttttcatattcccctccaatttttaattttaagctgactcttatcatcttccttttccaattcccacttcggccttgattttggatgtgggaggtattaatagatagaggcaggagctcagccttaggtccccaattttggatatgacagtgcaccttaataa

SEQ ID NO: 14912 - DNA, 201 bp, Bos taurus
cagtcatcttccctcccatgttctgtagggaacaagaagcaggtgatggcagcattttgatactgtgtgacaggaaaaggttcattttacaaagtcacataataataccaggagctttgtatctgcctctctcttttactctttcttataaagccaaacccaattaaacctgaaaaatctttgcaattcactttcctttat

SEQ ID NO: 14913 - DNA, 201 bp, Bos taurus
caaataagacatggcattgactattctccattgattcccgggcaagagactgtgctacagtcgagtctccttcctcaggcccaaagcatggagttgagaccaaattgtagcctagttttcccttgtcctgtggacaaggcatgtgttaacacttctatgggccaataatcagaaatttagagtttttctgtggagttcgga

SEQ ID NO: 14914 - DNA, 201 bp, Bos taurus
acccatacaagagcaatcattcttctttgagaatccatggttagaaacgacaaccctcaatgataaaaagaaatcacatacctccacccttccaatgaggctgtcaatatatataacaagtgttacaaagtcatgtcaaaacaccattagaaaacaacaggttaggaatataattggaggcatacacagattactaaatca

SEQ ID NO: 14915 - DNA, 201 bp, Bos taurus
agaactccagggactgtatagtctatggggtcgcaaagagttggacacgactgagctcctttcactttcactacccacactaccagatacagaagaaacacgagcagaagcaggggccataagtgcagcagaaggaggcgagtccacgttcaagggagttggcatggtcttgttccccatttctgttagtctcttaaggaa

SEQ ID NO: 14916 - DNA, 201 bp, Bos taurus
ccaatgaagaagcaattagcaggaaataacactagaatcaattattcactcaagttgtgattaagagccatgtgtataacccttaaaatttaataaagccaacactaagcaggaatccatctttttcatcaccaggaatatagataatccaatcataggaactaccttcgattagtatcaacaccgtttatgtactctgaa

SEQ ID NO: 14917 - DNA, 201 bp, Bos taurus
accaatgtctgataatctaaaagcccacgtctaaaacttgtgagcagtagttgaagcttccatcaatgcaaatctgagataacaaacacttcacggcagcgagtggttgcttcatctcaatgaggttaagatggtaggcaatggaagctctgattggttttgagaaacggacacagtgtttcttttttcaaattggggtat

SEQ ID NO: 14918 - DNA, 201 bp, Bos taurus
taatagtccaaggggtaccaacctgcctttggacacttaaaaggactttccttctttggggtttgccaaaggctgacttcagtattaaaagaaggtctcctattatctggtgttacaaccttggaacagccagcagactgaacagtcacacactaggaagcaaaatgctgaacagaaacacagccaattctgtcagccatc

SEQ ID NO: 14919 - DNA, 201 bp, Bos taurus
attcttatcatagtatcctgaacattgagggtgctcgataaacatttcttgactgaagaaatatttcactttgtaatacaaaatatggattgcacatagtataacatgaacagtgataggtttcttcttttcagcctaactgaaataatcaaagaaatccaaagacatactgttttactaaaatgttgatctctctctatt

SEQ ID NO: 14920 - DNA, 201 bp, Bos taurus
tcactcctcttaggatggttgttatcagaaaagtcaaaagattggcaagggaatactaagctagatggataggcagaaatgttgggaagaatggaatcattgatagaaaaagggcatgaggaaactctcttggaggataaaaatgcccaagactttgacctgggtgatagttacatgggtacatacctatgtaaaactttg

SEQ ID NO: 14921 - DNA, 201 bp, Bos taurus
cctacaggggaacccctgccaggtgttctttgcaaaatggcctgaggacctggtgagatgaggcagcccaagaccccatggattttctaagtctcagaggggattttgcaagggccaggctgagcaggtgtctactcacccctccttttcccattctaatgaagccacagggactgggcaaccctaaaccactggtgatag

SEQ ID NO: 14922 - DNA, 201 bp, Bos taurus
taggactgggtgctttcacggctgtggcctgggttcagtgcctgatccgggaaactaagattccaaaagctggacaaactatcccaactagtgtggccaaaaaagaaagaaaatataaatttactatgcccactatttatttgaatgaatatagaaattaacaaaaatttgcaaaagaggcccatctgagtgaaagaccca

SEQ ID NO: 14923 - DNA, 201 bp, Bos taurus
ttttactactgcagaaaagtgactcttttggttaaccactaatttgaaagcccttttaatatggatatgtttactggcttatttactggcccactcggtagctcttaaagcagcaggtaccgggcaggaggctaatttcggactctgggtgtcgggaggtatgtatgtcagatgaattggctggactgcacgttctctggg

SEQ ID NO: 14924 - DNA, 201 bp, Bos taurus
actgtatttaggacagggcctggcaaagagtagatgcttaatattcaaagactggagtaagaagaaacaacagcaaagatattttaaacaaactcacagacaagtaaaacaggcctagtggttaccaatggggagaaggaatgggggaggggcagtaaagggtatgagattaagagatacaaacaactctgtgtaaaatag

SEQ ID NO: 14925 - DNA, 201 bp, Bos taurus
ggcatgttgccacatgtgtccttgtcacagccatatgtgtgcctgtggctgtattgacagaggagcagattttgccggccacgctggctgggtgacgagatgctcactccctctctcgctgtcccaggatgcttccagcctgcagggcacaggccaggggctgggcgttccttaaggagacagtgaggggggctgagtgaa

SEQ ID NO: 14926 - DNA, 201 bp, Bos taurus
agactccagggtatgtagtgttttttatgtaggcatagtttttcaaaactattttgaagtgtattcgagtatctaaagtaatttaccagacttctgtatacagcattttattctttgaagagtctcataaataatataatttactgtgtcagtatgcaagcattcacataagtctttttacctttcctgaaatgaggtaga

SEQ ID NO: 14927 - DNA, 201 bp, Bos taurus
taccaacattaacttatcaatcctcctaacacttctgaacaagacatcaggattcttgaactcagcataaaaatgggttctgtggaatggcctagccactaccattaaataaggagggaggaggggaattaaagctaaaatcctccatttctaaactacttcttggtggcctgacctgcgcgcacacacacacacagtctt

SEQ ID NO: 14928 - DNA, 201 bp, Bos taurus
gacacagcttagtgacgacccagggactagactgcactaggcggcctctgccctcctcctgtgagcttggacattaaggtcaagtaggtgactgcgtgtgggacaccagcatgtcgaaagggccccttgcccggtatctcacgtggcctgccggttcagaacttgtggtatctgggtaggttctggcccccagggcagatg

SEQ ID NO: 14929 - DNA, 201 bp, Bos taurus
tccccttcctcagggttcatcaggtactgactctgatctcttcactggaacacaagcttgggagccctgagggaaaggccaagctataagcacagattaagctgaagctccccccaaggcactggggtgggaaaggggcggaccaggaatgctgggccaaccctgcattcttggtgacttcagcgagccctcaccctctga

SEQ ID NO: 14930 - DNA, 201 bp, Bos taurus
tcttaggctttatagtttacagtaaatgcatctcagtacagattcattcattctacactgaaagatagacatcatatgtgttggatggccatttcatttcattgtttattgcattcatgtcattcacctattcattcattcattcaaagaatgtcctatccatgggccaggtttgttacagcaacaatacagagcaaaagc

SEQ ID NO: 14931 - DNA, 201 bp, Bos taurus
ttagataagggagtcaaggaaagcatcttggtttttgagctaagacctagagaatgataataatcaggctttaaaagagctggggtaccttcttctaggtggaaagggcagcaggtacaaaggccctgaggcctgagaaggctcagtgtatgatctgaaggaggctggtgggactggagcccggtgagctggctgccctgg

SEQ ID NO: 14932 - DNA, 201 bp, Bos taurus
ggctcctcctgagcgtgatgtccagaggcttagcagaactctgttggcttgcaggaatgtctccctggaggaatgaaccccaggcctgaaaatttatgcatacagagctgttggtggttcctgcctctgatccatagccatcaagggagagggcgccctgcttactggttccacggaaactcattgcccctacatcaaggc

SEQ ID NO: 14933 - DNA, 201 bp, Bos taurus
ggtgtgacacagcactcacaaagcacacacagaggaacaagcaagatgcgagtgtcgggaacagaaggagacaaggcagactagagcaggtggcctgctcagcgtagcacaggacagacaagtggaaagccatctgggctcccagagaagacgtcaaatggaaatggcctgagccagagtgttaaagccctagagctccct

SEQ ID NO: 14934 - DNA, 201 bp, Bos taurus
ctgtctgagggccttcagcccggagtggaggggagcctgggggcagaggggtgaaggcagcctcaatgtgttaagctggaagccaggccggctcatcctagggagcaggaagtaccctgcttcctttgaggagctgaattaactctttcaggctcacagaattggttcagtaatgacaacccccggtggccttaggatttc

SEQ ID NO: 14935 - DNA, 201 bp, Bos taurus
cctcctttaacacgttctctgtttgctcagcaacggggtagaaatgcaggaaatatctgtgtgtggcaagtttaggaccaaagtgtgagcgttagcaccatttcctcctggcctaacacttctctgtctcaagtcatcctgcgtctattacactgtctgtgtgaccttggcagatgatttactcctcctggcctcagactg

SEQ ID NO: 14936 - DNA, 201 bp, Bos taurus
ggaagatacccaatcaggccgattctccatgcttaattcaaggtgacaggttaacaacaggaaacagagaacaatcatgagtcatcaccctctgggtgctagtgtaagaacaactggcctcaaaagtaggggagagaaatgtggtcctagagacctgagtagaggcatccaccctgctgtgtgacccgctaacgcctgact

SEQ ID NO: 14937 - DNA, 201 bp, Bos taurus
tctgagaagaccacggaagctgtggatgggacgacatccaccaggcttcctcacgggacccctggaatcacactcagatctctggcctctgcggtccgcccggcagaatcctgatcatgggcacacgtcactgtggtcacaagggcagagaaggaggccctctctttcttctcctgcacactccctggactgagggatgct

SEQ ID NO: 14938 - DNA, 201 bp, Bos taurus
ggggaggtcctgctcgttggttccctcctgggcctcaacttgtttggggaatcttgaacagaagcactttgaaaggggtcttgggaagaaaaatacaatcatacagggtcatctggtggcctgagtaggggcatttaggaattgaatatctacctggaataatggttgcatggaacattattctgcatctttccaagaatg

SEQ ID NO: 14939 - DNA, 201 bp, Bos taurus
aaaatattttaatgtagtcaaatttattggttttattcattcatggtttatgcttctggtgttatggttatgaaatctttttccaccctgagatcacaagaacattcttttattttcttccaaaactttttaaagtcatgctttctcatatgtaggtctttaatccatttaactatggtttgatgtagggatttgaattat

SEQ ID NO: 14940 - DNA, 201 bp, Bos taurus
ggggccccaggaggggctgagcctggagagaaattgatcgagaggcgtggccggcggtttctcacagcagccactctgtgtgtctgcaggtgtaacggggcgggcagaggtgactgctggctggcaaagtgagctatttgaacagaaaatgcccaacctaaaaccaggttatctccagttcctggtgtcacttaatcgggt

SEQ ID NO: 14941 - DNA, 201 bp, Bos taurus
gtgatgagtccgtgtttcaaacgatggggcaaccttccactcatgtctcctgatgggatgcaactccaggtacatgccatcatcctaagacaaactcttgccccaaatctgaatccaatcacgcttccaagcctaactctcagtttacagaaagtagaagtgatagaagttaaatatcaccatttgtctgacagtcagtcc

SEQ ID NO: 14942 - DNA, 201 bp, Bos taurus
gttgaaggtctcagtaacttagcacctccataagctggaactctctactcattggtagcccttggcaggaggttgcaacttaggtttggccaactttgaacgttgagtgagtgatgaaaagattgggggtcagaaaggtggcagaggcagcatctgatgtggctgatggaaccagtggtggggctactctatgttgcctgg

SEQ ID NO: 14943 - DNA, 201 bp, Bos taurus
tacatccatcacaccctagtaggggctcaaagaatatttttccaaatgaaggagagaaggagaaaggaaaaggaaaggccctagatttcaccttacacttcgtaagcatttaataaacgtttatgaatgaataccaaggtttgagagaggccctccaaactttcccctgaggcagtcgagtgatttgattggcaggactca

SEQ ID NO: 14944 - DNA, 201 bp, Bos taurus
cacgtggcctttttatatgtctcaaatggaggcagtagtcactataatcgtgattaacaatacggctatgacgtctcattcctaagagaagagcagactgtcaggccaaggctatttgggaaacactcagctgaactgagagtacccaggatgggaaaagccgcagttgtgagcgttaacgcagcgccatccagtaacgga

SEQ ID NO: 14945 - DNA, 201 bp, Bos taurus
taaatttgcatcgataggaaacacagtttcgaagtatgaatgctaatgacaatgcagaggctgttttttctatgcataataggacattagttcttccctacgcgtctaaaacgtacgctatcctgcctttatctgccatccctgctttttcctttggagcacaaatgcaagaaagggtcttttcactcatccagaggtcac

SEQ ID NO: 14946 - DNA, 201 bp, Bos taurus
gggggctctttattcaggtttagcgtgtagaggcctaaggggagcctcagagagctattcccttgtccagtggttccttttcctaaacagtctaccctgagtttgagcttctaactatgctggccaataatggtatcaactagctgcacatggctatttacacttgaataaatggaatgagattaattttggtgcctcggt

SEQ ID NO: 14947 - DNA, 201 bp, Bos taurus
tgtacaaacgagctatgaacatcttactgtgccagaaaagcaaggatgccatcagactaccggagccaattccaaaagcccaggagctaacctgaagggcgtcctaccggccaaacacgacacagtttgagcctcaaaaggaatgatgacagcagtgaactaaaacacgcttggtatgttagaacccatgtgatcacaatg

SEQ ID NO: 14948 - DNA, 201 bp, Bos taurus
tatttttctaaggtcacacagctagcccaaggctctcaacttcgaattgcaccctttccatcgtatatctctttgtacctccaggacttaggacagtacccagcattttgttggtggacagaaaatacttttgtccagtatttaaataagataagtttatttctagttcacatgaattcacacattttatccttaactcga

SEQ ID NO: 14949 - DNA, 201 bp, Bos taurus
ccatgttacacataagggaactgaagtacagagacattcattatctttccatgttaaggaacactttgattacctcctgtttatgatcatacctttgaggccattacacctagtgggtcagttgcttcctcttgaattctgttgtgcttgagatttcattataactgactgttatcttgggtttagtatagtgtctgctgc

SEQ ID NO: 14950 - DNA, 201 bp, Bos taurus
tactattggttgcccacccccaaggtggcttggtcttttgctctaggaagctccattcacacaaactggagtgctacctttggggcccagcagtgcaagtctctgcctccgtatgcccatctgcaaattgaagagagagccgagtgttattcattgatatgctcacctcctggccaatgtgggaacctaggagacgtttgt

SEQ ID NO: 14951 - DNA, 201 bp, Bos taurus
ggttgagatgaagttggcctgactggcatttcccacttagagaggaaaagcaaaatggagatcccactgaaattagaagacattctaaagagaaaaatcaagggaaagaagacaaagaaaattcctttttacttattgtacaacaatttttaaatgttcctaatataagtttgtgtgagagcatcctgctatttcttcttc

SEQ ID NO: 14952 - DNA, 201 bp, Bos taurus
acatgggcctcaggattatttttaagttccccagaagattctgaaatgcaacaaaatttgagaatcaaatgagtcaatcaaatgtgctttagcacggtgcctggcccactgtaggtacttgataaatacttgggaatcagtgctcgattctttagttttctcagagattccctccagagcctgcaggcgagcacaaatgtt

SEQ ID NO: 14953 - DNA, 201 bp, Bos taurus
ttcccaggaaaaccagaagctgaccaagacattatcaaacagttatgatttttcaaataaatattatggtgggatactctgtagcaacactggcctttagagagcctttaattttgttgaataagtgaaagctcagagatgatatttcttcatgattatgtatgctacagaaaagatcaattaaatggccaagcgccccct

SEQ ID NO: 14954 - DNA, 201 bp, Bos taurus
cctcttcactgtctccactgtcttccacatccgaatggatgctaagtgctttgggggactcgtgtgacacgaacaagccgccggcatctggctgcaggacgaggcccagtttgatagtgtgtgcgtgggactttttgtgcttgtacaggttgcttttagtcttaaatgaaaacccgcaggtcacgcaggggtaggggcgct

SEQ ID NO: 14955 - DNA, 201 bp, Bos taurus
aaggggtacatgaaaagtaaaatgtaccatacataacatgtacaaaggtccatatagtcaaagctgtggtttttccagcagtcatgtacggatgtgaaagttggaccgaaagaataaagatgactgaaaactgaagaactgatgttttcaaactgtggtgctagagaagactattgttgctgctgctgctaagtcacttca

SEQ ID NO: 14956 - DNA, 201 bp, Bos taurus
agcttctctcaggccagcactgtaaaaaatgaaaggcactttagatgttactcaatgcaatgcttatactttggagacaaggaaatggaggctcagataggataaaatgttgtggccaagagcctgcagctggttggaagcatgccaagagccgatttcagattctctgattcccaggctctggggttctctgtccccatc

SEQ ID NO: 14957 - DNA, 201 bp, Bos taurus
aatgactacagttttcaatacaaaatgttttcggtattaaaaaaacagtttggcagaggacccatgggacagaggacccatcaaaggcccctttgggagtttgtcttcagcccatccttccatcacttaccaccagctcagcaacccaaacctccagaccctccatccatatgggactatttgcaatttctgatactgcag

SEQ ID NO: 14958 - DNA, 201 bp, Bos taurus
ctcatttctaatgaaaccacagagtcaggccttaactaaaaatattctcagtctcaacgtccataaccatgttgggcacaaagcctgagggatgtgagaacggccttaatagccaaaggcaggctggttcaaaaccacacaaccacacattgcacacacaggtcaaagcccacaggtccggacaggctctcccagaggctg

SEQ ID NO: 14959 - DNA, 201 bp, Bos taurus
caagtttacagctaacatggacctcagatggagggaatagatgagagaaggacttccgtccgtgggcaaagtcaaaggatactcggaacagtagggtttacgaacagggttggttgttttggggataaaacttcccatagtccatattcgtctctgtgttatttgggcttcttttaacaaaaacttgacaagaaaaaagtg

SEQ ID NO: 14960 - DNA, 201 bp, Bos taurus
agacacgacttacagactgaacaacgtgatagtaacaacaagcaagacttgtatttcctgagtctttttccttccgtctttccagtaatgtatttttaagtgtggcctgatggcttgagaatggaaaaggccgcgattttacagtagggagcatgtgcgtggggtacaccggcctggatgcagatgggtggagagggtgtc

SEQ ID NO: 14961 - DNA, 201 bp, Bos taurus
cccttgtagaaatgatttgatgacatagcttgatccaggccaagagtagcccctgatactagcctcactgtcttgatttctgtcttctctgatcttggtcattcatttcttccaccttgttgattctttgatgatttttaaaactgcattttatactttctctagctttatctttagcaagagggttggtctgaatcccca

SEQ ID NO: 14962 - DNA, 201 bp, Bos taurus
gtactatgtctgttctctccatgccctttgatcccttctgtccctagtcaggggaggagtgacttgtctaaagggtgcattttaggaaaacaagctggctctgctgaattcagctcctcccactttcctcctgggtctgagccgccttctgcgtggtctgtgtaggccttcagcatagggaaggcctagttcagccttgtc

SEQ ID NO: 14963 - DNA, 201 bp, Bos taurus
tgactggacaaaggaagagaggattccttcaaaacactggattggccaaaaagttcattagggtttttctgcaagctaaatattaccccttggatgtatgcggtcaggggctaacttccttctttggctagccaaagataatacaggagatgaagcaagcttgtggacgttgatatggcaggacaaacaaaacactctctg

SEQ ID NO: 14964 - DNA, 201 bp, Bos taurus
agggaagcccaaggcccctattacccagctgtaactttgacctaatttgcaccagccttggtgcaaagcagagatacaaagcagaggctacacaagacaacgaaggaagaggccaggaatgcatctcttcttgcttcacgagtcttgaattcacctgggtgtaaaggtaaataggtggataaagttctatatggcggtttt

SEQ ID NO: 14965 - DNA, 201 bp, Bos taurus
ttagttgctttcatcaacactagatggtcccttcatttggggggccatttttcacaaagaagcacagcttgctgcagagaggcagaacttgagttctggcttacacctgggttaacgttctggcccctccattgactagcagggtgaccttgagcagattatttaattgatccatgcctcattgtgtttctccacaaaatg

SEQ ID NO: 14966 - DNA, 201 bp, Bos taurus
tttaaacgtagtcttttgtaccttgatgtgaacagagagttctgagcatattgtaatgcagaaggttgtggggctgggagttgtgtagttaaaagaaaaaatttctcagccttggggagttgagaagacgagatgggttgctcaagtgtgcccggggactcaggttactgctagaatacagtttcctgtggaagggaaatg

SEQ ID NO: 14967 - DNA, 201 bp, Bos taurus
gggcagtccagtggaggggatggctcccgggaatgagtaatctgatacagacatctttcccctttatgtcacctgttacaatttggcctccctgtgcctcggctggaaatcactagcagctgacagctgtcccaagcctggtgtctgcaaccaaagtgaagtgtagaacgctgctgaagttgggccaggattgacctttat

SEQ ID NO: 14968 - DNA, 201 bp, Bos taurus
ttaacaaatcaagagtgttgatgggtaaaccaaatctttgatataattcttggtagcagtttcaactttttattcagcaagattgaataaagtatctaagcatcttataaagaaataccatcacatttgaaatttgaatgactacaagagcatactgtaagcagtcaagtaaggtgtgcaaatcaaatatttttaattggg

SEQ ID NO: 14969 - DNA, 201 bp, Bos taurus
cctgaggctctacctgcattatctcagccagtggtttttcctccaggccatttcaactcctgttacaaagtgagtgcttccccgaaagtcaaaggcatgcgttttcgtcttgagaggccaatgagagtacaaaactcctctctcacccacttaccttaagacctacaatgcaggtataagttgaaaagacaaaaatgtctt

SEQ ID NO: 14970 - DNA, 201 bp, Bos taurus
tattacatttttatttctttgtgagcagactgaatttggctttttaaaatctaatattaattttactctttgataaaagaatttataatgttttgcactagtcccagaatttccatttactaactgattctctcatcttgttttataaactgttggatactttatcttcttttgaattttcttgatgccgtgttttttttt

SEQ ID NO: 14971 - DNA, 201 bp, Bos taurus
acaatgtttttctctacggattttaattttttaagatcacaaaacattttttcgtactctacaatttgttctgcaactgagaggccactcgggtttggctataaaaacatcctgccatgcgatgccagattgtgttaaccccggatagagcggtaacagatgtgccgagtggccatgtgtcctggaaatgccggcatcttt

SEQ ID NO: 14972 - DNA, 201 bp, Bos taurus
caatgggatattagatgagacgccaacttgaacccacgcttgccagacagactgccatgggtgtggaagtaaaggcgcagtgagctagcacagaggaaaacgaaatacgcatctgagtcgtccgcaaactgcctttaattgtgagctatcatccatccaagcttacgacttaccccattcactctactcgggcttgtgctc

SEQ ID NO: 14973 - DNA, 201 bp, Bos taurus
agaaacagcagaggttcaggtcttaccccctagcctgttgaggattctttcctctagagcacagggcctcccctcaaaaggcattaggaaataggccaccggatcttgctgcaaattgctgagacagaagatgtgatgaaagcaagcagaataatcactacaatgcaggtagcaaataaagttttctttaaaaatagacca

SEQ ID NO: 14974 - DNA, 201 bp, Bos taurus
actcagcaactgagtgatcactaagacagtaagggcgtgagagtgaaaacagtaggcgacaaacatggaaaggccaaggataaacgtttgtgccgtcccagtctgacaccagctccccaggtagctcacgtcgtgaaatgctgcacttgctggacacagcggccaaatggctttcctcgcctcccgctcattctgcacaag

SEQ ID NO: 14975 - DNA, 201 bp, Bos taurus
attcatcatctgttaggcaagggaatcacgttggaattgtcactgactccatgagggatcacacaagagcactataaactgtgatgctactgtttgtcaacttaaaaatattctttgaccaaaacaaccacgatttttaaaagagaagtaaagaaattgtacttttcgtaggtttcaataagaaaataataataaatacaa

SEQ ID NO: 14976 - DNA, 201 bp, Bos taurus
ctgagctatgagggaagccccaattgtagcagcctctccattgcttgctagctgttattatcattcttccaaacacctagtctttcagagggactccccacgttttttatacatattcctaacacaaccacccagatcttagcatctcttaacagtttcccctccaccacatacttcctcttccagatgattcttcttaaa

SEQ ID NO: 14977 - DNA, 201 bp, Bos taurus
ctccagtattcttgcctggagaattccacggacagaggagcctgagggagccttggctcccacagttgatggggtcgcaaagagtcggacataactgagcgactaacattttcagatgttttttagatcatccactccttgctgtaggactgttgcccaagttcaccttgtctgtagctcttgaccacctgttgacatctt

SEQ ID NO: 14978 - DNA, 201 bp, Bos taurus
gatgtgggaacgctttcctctttcctccagccggagacaatttcccccttctctggtactctgtctacatccggtaatcacagcaatactttgctgtttacatacaggctttctttttttcagtagactgattatatgccctctgaaggtaggtaccaaggccacgtccatcactgtacaccttcatgcatcaaataaata

SEQ ID NO: 14979 - DNA, 201 bp, Bos taurus
ttggctggccattcccagggggagaacgtcccaccatctgcttgcatttgtctggtcccctcaagagtcatgatcacatcgtattataaatcaatacattcgatactaaccaaatgggctgtgggcctttacagctatgggacaggctcaagattcagccagaaaaagactcccctacaggtgtgattctgcgcaggcaac

SEQ ID NO: 14980 - DNA, 201 bp, Bos taurus
gcctgcagccggtccgggctctggttggcagccacgtgcgtctgcttgtgtagggtgagcgaggagagcatggggaaggccttgtcgcacgtgtcgcagacgaagcggtgctgctcactgatgcacctgcgcaggttcgtttcacaccaggcctgcggggaagccggcagagaggagtcagcaactgctcccggctgcact

SEQ ID NO: 14981 - DNA, 201 bp, Bos taurus
ggtgggactccaccgagtcagggaagccaagcaaaggatgttcacaccatgtggacgcagagcagaaaggggaacggccacctcgctcctcgggcactgtcgagcacactgctgcaggacagcaacactttctcaagtgcgccatggggacattaagactcatctcatttcccaagggaggaaacacggcctttcataaca

SEQ ID NO: 14982 - DNA, 201 bp, Bos taurus
tcctgcatgcagggcttcctgttaccacacttgctggtgaccaccttcttcctcctgagagggactccctccctccctgccactcaggtctctggctctcgcagagccgcatggaaagagcgcccacctgctgcagtgggcctttgggctcaggtcaacccgcaggacacccgaggtgggtacatgaagagaggggagggg

SEQ ID NO: 14983 - DNA, 201 bp, Bos taurus
actgttggcgtgttatttacttttggccgcggtggcgtttcatcgctgtgctcgtattttctctagctgtggcgagcagggctgctctaattgggatgtgcgggcctcattgcggtggcttctcttgtcgtggagtgcaggctctaggctcgagggctttggtagttttggcgcacgggcttagttgccctatggcatgtg

SEQ ID NO: 14984 - DNA, 201 bp, Bos taurus
taccggtgggacgcatcaagatggcctctgcctggaaggtgctttgtcttattttctactacagctgtgtgaggtataaggtgttttgcagaaagtattcggggtactttttccaaatctaggcaagttcttcgtttcttagacccacaaaaagcagcacttagagacagtgaggcagtggaactctggctgatgaaacgt

SEQ ID NO: 14985 - DNA, 201 bp, Bos taurus
ccattccccagggataaccggagcctgacttccacgagcttaggaggacgtggttttttatattataaacatttgaggccaaaaagagattaaaaagcaacggagatgagctttcatcgaaaacaccttgccaaatatctcaagggaaaaaacgacccattcgaagctcttacaattgatcttttgcacttcaaacactaa

SEQ ID NO: 14986 - DNA, 201 bp, Bos taurus
aagacaaccagtgtcactcagttgcttctctgcctggtgctctgcacatgtgattatctgaaaccctcaaaactgccctgtgataaagtttggcctgtgtgctgttttatagatgagcaaaacagattgtaacaatatgtgtgcataagaatctcctgagaagtttgctgctgatgaaggtgacttgaccagccaatggtg

SEQ ID NO: 14987 - DNA, 201 bp, Bos taurus
cttggttacgtgccggctcgggccatttcttcctgaatgccaagatgattcagatgtttaccgcaacaaaatcacgcccgtcagagtttcagcacatcccatggagccagcaaggggccgtcagtgtctgcatcccaactagggctgcgctcttgttgtctgtgtccaagacaaaggtgtgatggtagcagccagtgcgcc

SEQ ID NO: 14988 - DNA, 201 bp, Bos taurus
cctgggtcctcactgtggcgcacaggccttctctgatgatggcgagcgggagctgctccccaggtgcagtgcacaggcctcttgctgtgctgtcctctcatgctgcgggctcgaggtgcacaggtgtcagcagtcacagcgcacgcacttagcggccctgcagcgtgcaggttcttcatccccagaccagggatcgaaccc

SEQ ID NO: 14989 - DNA, 201 bp, Bos taurus
gtaccatcatcaaagagctagtcaagaaacctgaaggaagggcatttctgctgcaagatataaagtgacagcctaactctgaggccaaagcatctgcccatggatggtgagagcagagggaactcccagaaagccccagtgtggtgtctgcggggcactgccgtggttgccgggaaagcaggtgacctcgtggttgtctgg

SEQ ID NO: 14990 - DNA, 201 bp, Bos taurus
agagcctggcccttcagagtcatttcgggggctcctttgataaaagggctgggaagtagcccagaggacagggagagctttggagtcagaatcccagttacgccacgtggagccgtgacggcctcacttgaccccctgggtggccatttcctcaaggcaaacagggattatagtacttgagacagttcctcatggattgaa

SEQ ID NO: 14991 - DNA, 201 bp, Bos taurus
ggatgagaaagttctcctggtcaccctggcagcgcggtctccctttgaacctccacaacatttagagtcaagaaaggccgtctttcggatgctgtgctgcacaaggtatcacgcggaatcctcccaggagcctcgtgagaaaccgaggcccagagaactcaagtgactggcctcgggacgcacagcagcggccaccgggct

SEQ ID NO: 14992 - DNA, 201 bp, Bos taurus
gagaaggataagcagaaaaagaaaatgtgaagaatcatggcttcacctctacttctctttttagccgaacagcccgcacgcaccgacatggcagcacttttttctccacacatgacggtctgggagtcggaggaatgattcggtgatgggcgggactccactgggctcctctggacccatgaattcagaaggagagaaaag

SEQ ID NO: 14993 - DNA, 201 bp, Bos taurus
cagtggggccccccggtccgcagatcacccctggtgccccttctccccgtctccgaatatctaactggattggacatacttggaggctgtcacagcatccacactgggcccttggcctgtgggctaagagctatcacagtggatgaagccaagctgtgcccctgacatcactgcccctcccctcgccaagcgtgccagtct

SEQ ID NO: 14994 - DNA, 201 bp, Bos taurus
tggagtcgagtctttgcttctgggatttttgtccttagacctcagctgcttctcctcctagcaaacgcaaattggttgaatgtggaccccgctccccacattggccagaacactctatgcagtttccaggggtttccaccgcatctcacatgacaacatcccaagacacagacaccccttagcgaatgcaaatgcctaccg

SEQ ID NO: 14995 - DNA, 201 bp, Bos taurus
aaccacatttaaaaatgaacacgtgggcccagcccagcgtctggcatacagtgagagctcagtaaacattcactgcagaattaaaggacttcccaggtggcgctggtggtaaagaacccggcctgccaatgcaggagacataaacaatttgggtttgatccctgggtcgggaagatcccctggagaagggcatggcaaccc

SEQ ID NO: 14996 - DNA, 201 bp, Bos taurus
cagtcactaactgctccagccccctgcactgaggccccgccttctggattccacccatcagccatcagcacttcctcaccccatgtgcctggggcagagatgccacctctggcccctgaggccaggaaggtcccagcagggcccctcttggtctgcccagacatctgcttccctcgcaaaggaatcgcccgtttggtggcc

SEQ ID NO: 14997 - DNA, 201 bp, Bos taurus
tctccagcgctgctgcccgggggccctccccggccccgcccccagccacagtcctcccgtcacacagaggagctggagctgactccaccttcaaatgcccagaacacgggccgtggtggggcggagggctggctaggctgtgctctgtggtgccccgagggcctgggagagtggctggcacccagtaggggcacgatagat

SEQ ID NO: 14998 - DNA, 201 bp, Bos taurus
tctccgaagccaacgaaactactgttctttgattgtatggccccatttaattgccttcattttcctgcccttccttattcgtttttttcatatttacacacgcatttaatatcttcttaaagggccctgttcacatatgttatctcactttattctcatgggaaacagtactatttattaccttgggctttaaaaatacta

SEQ ID NO: 14999 - DNA, 201 bp, Bos taurus
aggggaaggagaggctaagctcttccatccgcattggagcgcacagcttttgcacgcctgccccattctcatgtctgctcttgagttccattttctcttttgacgtttgtgtctgcttcagagcatctgctgtctttttctgcttccttataacctctgactcaccacggatgtatgtactttatggattttctctctgca

SEQ ID NO: 15000 - DNA, 201 bp, Bos taurus
tagaagggcgtgttgacgctctggagacaccggccgtgcggggaccctgcaggtgtgggcacggtcccggggagcgatgatttcctcacgtccccacagcatctttgcacccctggccctggagtaggggctggtctcccctgtggcgggcagagcctggagattcgctgagcagggccctgatgaatggtttgcatgggg

SEQ ID NO: 15001 - DNA, 201 bp, Bos taurus
agggaattccagccaagagatgggaggacggtgacagtacttggtgagtacacccccctggatttgtcaatcaggggcacaacggggcaagctccttctcagcatgctgactatactgtgcttctaaaaccttactacgtagctctgaagtgaaagcgaaggaacagaattttcaggaattatttcaggcaattcataagc

SEQ ID NO: 15002 - DNA, 201 bp, Bos taurus
cacgtcatgagcccgtcccagagcggggctccggaagctgcgcctggaaggtgctgcgatctcagccagcccgggagactcgtgagctgccttccgcctctgccggcctggccgcctggagacccacgaggggtgaagggggccgaggggccgcatggggaggagctgctctcacggagcccgtctttgcaggtgttcggg

SEQ ID NO: 15003 - DNA, 201 bp, Bos taurus
agacgggcctccaggcccaggagagagagtccctctctgctgggggcaggggctggggtggctgtttacgaaactcctgagagaggccttaattcgtgagtctgcacttgggtttaaaacaaaatagcctctcttggcaacagagagcttcaaacggcgagccccgcgccagcgtagacgccacggagtcgacatggattc

SEQ ID NO: 15004 - DNA, 201 bp, Bos taurus
ctttcgcatgtcgtatctcgtctcaggatctgttttaatttccttgaaaccttacagatgaattgcccatccttgacttcttcccgcttctgatcgccctgacccactttatgctgaaatatggccaatttgacagaaatgaaggcgccttttaaactggtgcttccgagtcgtctgagtctttttttgggtcagagaccc

SEQ ID NO: 15005 - DNA, 201 bp, Bos taurus
gccctccagggctgcatggagcaaggggtccccgtccacgggaagcccccagggcccccaggtcactcatctctcccacatgagacagtctcgggacaccggtctcttcagcactgtccagacggccaacaacggttaataacaccttccgctgcggggtcctgaccccagctccagaggacgacggagcagggcgtcaca

SEQ ID NO: 15006 - DNA, 201 bp, Bos taurus
gcatgaagattatgggataatatgaaagaaaaaaatgatcttttcaactctctccttttcagagcccaattaggcttcttgttgggttgggccttggccacgaataggtcgtcctgcatagcgggtggtttgctgtcgggtcccttttccatcctccagctgtgaaaggcaggaagtgatttttacgcagacacagcaccc

SEQ ID NO: 15007 - DNA, 201 bp, Bos taurus
caaatgcttgccgagtacccactacgttccgtgtgtagataccggaggaagagcagtgaatggatgagatgcggtcccggccttcgtggagctcacagtctggtgggtgagacagacgttgaacaaacagtgataaacctccacgacctcactgcacgctgtcaccccactgacaactcccatcagcccccaggccccctc

SEQ ID NO: 15008 - DNA, 201 bp, Bos taurus
gtgcctccagggacaaggacactcggggggacatcgctctcctctgtcgtgctttgagggctcggtcacaagcagccaagggtgccagctgctcctcgccagtgtctggcctcagtcacgcacacgtgcctcctcatacgcgtgtgtctgtgtgtttgcccgtgttctccgtcagggctgtgccccagcccccagggacgt

SEQ ID NO: 15009 - DNA, 201 bp, Bos taurus
aagagcagtgtgttgatagaacaaacggtggtcagccccacggaaggtagggtttacagcggtcgcatccccagccaccgctttctgtagatctaggagcagttgcagtttaaggccatactgaaggattactgaagggactctttaaaatgacggtttagaagctgcttccccagtggtgaatttcttgccattattttt

SEQ ID NO: 15010 - DNA, 201 bp, Bos taurus
ctgcctctccataaacagtgcggggaggagcgggcgtttacacatgtggcctgtgaaacacgagcctccgactgataactgcaatcggccgtaaacaaacgctggctcacagtcccagagcttcttctaaatcgactttggaaaaaggagaggactcagcgggttatgtttcggagatcacagagccatcagcagagaggc

SEQ ID NO: 15011 - DNA, 201 bp, Bos taurus
cttcccaacccagggatcaaacccatgtctcctgcctgtcctgcactgcaggcggattctacaccactgagccacagaccaagcctggttctctgggccagcatttcccagagtgtgcctattccctagaccacgagctagctctatttagcaacgcacatttggctaccacttggagtttcacagtgttggtttctgcat

SEQ ID NO: 15012 - DNA, 201 bp, Bos taurus
caggtctgcactgaggccccctctccctcttggaagggtcctccgcctccctgggagctcaccccagcaaacaagaccatttacgtcaccactgtggctccgccggcctctccctgtctgccctctgccccccgtctcaacacgccagtgcccgtcatacagcagacgctcaacaaagaattgtcgattaaacgcacacac

SEQ ID NO: 15013 - DNA, 201 bp, Bos taurus
gacacctgtgatcagaggcgggcctccccctgctcgcttttcagaggtgccacatggctcacgcttcaggtttgcttgtaagaaagcggaggcccttgagcatcattcacagcacattcacagcgagagatagttcactgtctatcagtgtgtgccgcaaaagggtggcagcgcatcaccgcgtgctcgcgtcgggccgtg

SEQ ID NO: 15014 - DNA, 201 bp, Bos taurus
cgggacggggttcccatctccggccccgcgccgacacccccagtgtgaggagaagagtccatgtcgctggaggtgaagccactgcttcatggttttcacgggctctctgatatcacgtgttcttatttacagtaaaaattaatgacttatttcccatctgagtgaagggctattttattcactggttttttcctttgtcat

SEQ ID NO: 15015 - DNA, 201 bp, Bos taurus
cgatcagagatactttctttgatcgtttctctaaagcttgtcggtggatggcttcccagaagatgacataaaccaggccagagagtgcagcacaaggactcccggtccagctatccccaaacagactccaaaggtcccgcgaacaaacatttcccgccggctgggcaccaggtctggggcttctgggcccaggactggccc

SEQ ID NO: 15016 - DNA, 201 bp, Bos taurus
ccttttttgaagaagagactatcagtgttttattgtctggaattatatacttgggaaatattactatttatattaatagctgatataaaaattcattagaatatcttgctgccatagggagttacaagaatttttgcttcttaggttttgccttttatgtcttctctacaaagaccagtgattttcacattgtgttttaaa

SEQ ID NO: 15017 - DNA, 201 bp, Bos taurus
ctcccattcacgtagttactaccaagttgttcccgctaatgtaatcagggcagaatgacgaagaatagaagattgagaaattctctacatccgatgacccttgcctctgatacatatttaacctatgccaaaagatagacgcataagtgaattttgtctaaaatagacattctggaataaactattaaaaatataatattt

SEQ ID NO: 15018 - DNA, 201 bp, Bos taurus
acgtcaggcagcaccaaagggctaagcacccacgatatgcactttctgccgctgcctccagagcctggccgcccgccaaggagggtcattaactcacagcacaggagtctaggcgaataccagggagagcctattcaagaagccttaacgtaacggacattcataaaaccgtgcctcatctctgaagacagatgcggcctc

SEQ ID NO: 15019 - DNA, 201 bp, Bos taurus
aaactttagcaaagaatttgtattctagccttcagattcttgctctgaaaaatggacttttctaataatcttctagctttaaagtgatggatattgttcacatttaatctcctaacatgatgtgcataatatatttcttttaagttaattacctatagccattttcacatttagtataatattcttacatatatatctacc

SEQ ID NO: 15020 - DNA, 201 bp, Bos taurus
accagcaagacaagactgacaagtggccttaggaggtactgtcccaccccaccagcctgagactcccacatcccacccagggacacgggggcatccaagtagcactggttagggcccctgccacaaaaagaggttagaggcctcagatatcaaggccttccttgatgtctccatgtcccatgagcctgagactcccctctc

SEQ ID NO: 15021 - DNA, 201 bp, Bos taurus
caggaccctgtgcggccccaaggcttcccggaacacagagggggaggggtccgggatggtcagcaggactaatccaggatgcctggaaaagacaggcccacggaggggcgccgggatgccaccccagagcctcaggtctccctggacccgagctcttgcctttaattaacaaacaggccaaccctgatctctcacataaac

SEQ ID NO: 15022 - DNA, 201 bp, Bos taurus
gggcagtcgccaccttcccgagctcagggcaccggccagccttccactatcccacacagggctggtgtaagcagggaaaccaccaagaagaagcatgaacgttggaggaacatggccctggatggaccctgacaggacctgtgtttccaggctgagagctagaggctgctcgccgttggtgggatgggcacttggcacgtc

SEQ ID NO: 15023 - DNA, 201 bp, Bos taurus
tggggccgcaggaccttctgatgtggggggacatgggcatctctaccccaggctgtgtgcacactgtaacacctgttcacacaagaacaaactgagactcagagaggttaaaggaggagtgcagcagctagctcctggtgggactagggcttaggcttaggggcccttcctgcccactcacctgtcctgtgggaccagccc

SEQ ID NO: 15024 - DNA, 201 bp, Bos taurus
ctggctgtacctctgtgagcggaggatggacgggctttcatgcctccctgacctgctgaggatgaagcggggaagagcaagagggtctaagatggaggcacgagccagggagggaagagtcctgagtcagaggggacagaggagggtgtgcgggcagggggcagccaggcctcctaggaagcaggccagtgtcccgcggcc

SEQ ID NO: 15025 - DNA, 201 bp, Bos taurus
gtggaaaggcacatgattcaccctggcctcctctgtgcacctttcacacgttgcacacgtgtccctgaaggctagcatttccggccacatgcagggcacacgtctcagcctaacggtgcctggacgctcagtagtgcctccctctcaggagtctggggaggggccagctcgccgcccctgcccagccatgtgagtggccac

SEQ ID NO: 15026 - DNA, 201 bp, Bos taurus
tatagcccccaggccgctgtgctaaattagtagtagttaagctcccattcatgggagcttgaaataaagcgataccaatgcccgcctcccgccccacccccctgggtccttgccttggcctggaaaaccaggagaccttcagagggtaggtacgcaccgcatacatttggaaccttgccagaaatatttgggggacctatt

SEQ ID NO: 15027 - DNA, 201 bp, Bos taurus
gtctaaggggactccttctacaaagcaagatttagtgacttacgaccgacacttctgagtgtgtggctgtgctgcagaccccactagattggccccacagggcaggtgccctttgcccgatgctacagatgaggaaaggtgaggctgggacaggtaagtgggtcatcaaggagcagactggtcatggcctccctgaaccaa

SEQ ID NO: 15028 - DNA, 201 bp, Bos taurus
gcgtaatagtctatagcctttagggtattttatacttataaaatcatatctgcagctaaaacaagctttatttttctctttccaatgttatgccttctcttcctttttcttgcctattgtcactggcgggtcatcctgcacgagactgcagagttgatgatgggtgttcttgtcttgttcccaaactcaaggaagatttta

SEQ ID NO: 15029 - DNA, 201 bp, Bos taurus
gagctgcaatagagtggcaattagggattcacccccagggtttctttatggccagagtgaggagagagggacatttgccaaagacagtcacacaagaagagaaacatttacagtgtgtgaaggccttggccattccaggactcatcaaagaacatttgggaatgatttattgtaggcacactttaattttgtacaccgaaa

SEQ ID NO: 15030 - DNA, 201 bp, Bos taurus
ttgcctttgggactctaaaaggcagttacttttaactaacataatatgaaaagattgttaagtttcctatgaaagagaactgcacccctgtgtcagaggaaagtgcgcaagctctggtggacatctgactcccccgagccccagcctctgccccggggtctccacgctgcaattttggcttctctggttggcttggacatg

SEQ ID NO: 15031 - DNA, 201 bp, Bos taurus
tggctccactggtgccggagagggaaccacagtgcgttcccgctctggatgctatagagccaggactccacgcaccagggaaagccacgtgccggtgctgctctcattctgcagagtactagactcagaatagtcagtgatacgctcacttttcctttatgaaggagacctgggtcttcaacgctcactcccagttcctag

SEQ ID NO: 15032 - DNA, 201 bp, Bos taurus
aaaaaagcaaagggtggtcactgtctctactcagctggagccctacaaccactctaattttattttgccctaagggaagtgctggtcagaggagcaggccgtctggggcaattagaagtctttggctggtgaggaaacctgccagctcactcctgccttgagccagcctcaaacgctgtttctagctctgtgtcctcttgg

SEQ ID NO: 15033 - DNA, 201 bp, Bos taurus
tgtggacgcaccacgaacagccagtttgaactagacagacaacagtcacttcacgttggcaggtcgttaggacttggggcccagaaagccaggccaccacgcggggtgctgaaccagccacagcccactgtgggaatctctctgtggctgaaggtcccccctacagtctgacatctgcctgtagacgcaagctccagggcc

SEQ ID NO: 15034 - DNA, 201 bp, Bos taurus
ttgtctcgtttggacccggcccccagcttcgggtctgcgtgaccgacatggtgcagcagcttcgctcaaaccgtgtctggaaaggctcagttttcaaagctcccggggttaccggccagacgtgtggtgccaccccagcggaagtcagtgcaacccccgccccccaccccgccccctcgcttccccaggacagcagagcag

SEQ ID NO: 15035 - DNA, 201 bp, Bos taurus
ccaggagctccctgccctctgctctgtgccctggtcttccccccgcctccgcctctcctgggggctcttactccacagaaacaccttccactttgctttccattgcctttgatttctcatccttcctctcagtgtttgacttttctcaaacttttttcttctgttgaagactcacttagtgccacgtcgctgccccgtttc

SEQ ID NO: 15036 - DNA, 201 bp, Bos taurus
cgacaccctccctttcttgcagagtcacagtctgcggccgtgacaggtcctctgaagaatctggcactgaagagtccatttccgtcagcgtttctccatcgatcccgccctgcggcccttggggtctctggggacgctgccctggggctgtggacgccagccctcgggcacagcacagggggtggctccacccggcgcccc

SEQ ID NO: 15037 - DNA, 201 bp, Bos taurus
gagaacggaaagatgaaaacaaaaatcagatgagtaccagatttctttgcattctctttgaaatagatgtcaatatttgttgaaatacaaattgggccacgaaaatgatgagacattgccttcaaggcattgagaatccaagaagctggggaatggtgattgcgaacagtggggacctccttctcctgtgaggtcgttaca

SEQ ID NO: 15038 - DNA, 201 bp, Bos taurus
cccctggaagggagtggggcagcagtagggcgatcggttgctgggtgaaaagtaaaaaatgatggatacagatgagagctgaaagatacatagatggatgcatgtccatcacataggttttaaagaagcttcccaatagcatactaaagtatactgtgccagaatggcatacttttaattactgtacaccttcaatatgct

SEQ ID NO: 15039 - DNA, 201 bp, Bos taurus
attgtaccactgctggttggaaaattttatccctgtcaattttgttcctttagttatattttgctaataaaaatatcaatacacaaaacacattctgttgccttttttttttcaaaccaagcttgcatctatctcatcataatttatgactatttctgctaaagatttgcaacttgctgagtatcctctcatgcttaaaag

SEQ ID NO: 15040 - DNA, 201 bp, Bos taurus
cctcctggagtcggggcccagggtaacctgacctttgtcctctgggcaccctgagaaatctattcctgggctcctggaatgcccagttccaggtgggggcgcaattgtcacctgttaccatggccactgccccctccccaggacttgccaagggggtactgctgacatcacgttgcggccaagacaccaaggttggctttc

SEQ ID NO: 15041 - DNA, 201 bp, Bos taurus
gtggccggccctggaggctttctgtgcctacgcaggtcctcacgggaaggagagagaggcttgggctccgacttgtcaaccacgaggcagaagccaggtgttttggaggaagcgacggccagcccagagctgctggggcatgagataaaaagggggcagaggaggcaacgaggtgcaccacctcccttccctgagccccgg

SEQ ID NO: 15042 - DNA, 201 bp, Bos taurus
gcatggtctaattagcctatgtctcttaaacaaatccaaaacaaagctaggtgagagagttttatgcaaacaaacaatgaaacctaatcactccccgcatccaggagcctccattattatagttgttcaaccctttttaactctccattgcttggaataataataacctgttagaactttgaaatgaaaatctttctacct

SEQ ID NO: 15043 - DNA, 201 bp, Bos taurus
tttcacttttccacttcttgaaaatgtaattacaaattctttaatcagagaatggttgatcactgttttgggggtcacatgtcttatttgctgagcctctgttttctttctgaggaataagaaagccaacactccagggccctgttagtctgatcaccatctcccagactagcttaatttccattgatggaatgtttttgt

SEQ ID NO: 15044 - DNA, 201 bp, Bos taurus
tggcccacccggaccaggggacactgtttcatgatggaaaggagcgagctgtcaccgtgagaagacacagaggaactgagaggcacactgctgagtgaaagaggccaggctgaaaaggcgaggcactgcatggttcccactggaagacactcagaaaaaggcaaaacgatggggccagtaaaccgatcagcagctgccagg

SEQ ID NO: 15045 - DNA, 201 bp, Bos taurus
aacaggcagacgtagatgttttttaattatacaaaaaaatttgaccaaaatagctaagaaaaaactgccaaaaacagatgagtgtccccacctattacataagaaaatatcaacaatctaagggtaatgattggaagatacagtaagctgcacacactcacaggcatttaatggatcaaactttctgaaaagcaatggact

SEQ ID NO: 15046 - DNA, 201 bp, Bos taurus
ttgagtgactaagcacagcacacacacagcagctagaatcaccctaacaagaagctaacgccctacttccataatcgcggtaagaagtggatttgcacacggctcaaatccaggttcacatctcactcctgtaactccccaggccagtgctccaggtaagcaggttggcaggcaggcagatcctggcgctttccatccgga

SEQ ID NO: 15047 - DNA, 201 bp, Bos taurus
cgccccgcccctccacctctctaggggaaaagaggtggctgggggctgggtctgtgaacggacgcccctcccctccaccaccgcagaccccagggcccctgagcacagcacacttggacccttttcagatctacccctccacgtcctgacaaaaacgcttttcttatctcatctcaaggtaagagcaagatgcagaaactg

SEQ ID NO: 15048 - DNA, 201 bp, Bos taurus
gatcaggggttttctacacatcaggaagtcatgggtgtttgttttcttatccacagaggagtgatataacttggtttgaatgaggtaagtcaggaaggccgttcaggaggctttttgcctgaagctgtagctttcagagaattgcatgtggagtacggagtctatgagcttccctggtggcgctagtggtaaagaaccccc

SEQ ID NO: 15049 - DNA, 201 bp, Bos taurus
aaatacatgttctccctatgtcctcagtcctggtgtgtatatggtggggaggtgcgagagatggtttccctgttgctagtgcatcatggccttggttggttccctttattgtagcgattttaatttaaacctttgtgccattcattttttgctgagactcacctgacaagtcataagtctagggctgaaaggggcctttca

SEQ ID NO: 15050 - DNA, 201 bp, Bos taurus
tacatacacatgcatgcatgcatgcacatatatgtaacatcatttataaagtgtactgtgtgcatgcatgtgtaccattaaacttgttatgtaataaatcagtttaaaaatcacatgctggcattatctttgcctcttgttttctttttaattctttttcttagaggtcacttaactaaatcttaaaggaatcctaaacac

SEQ ID NO: 15051 - DNA, 201 bp, Bos taurus
aaatgtataatgacatggatctaccatattagaaacattaagaatagtttcattgttcctaaattactttgccatatacctattcatattttctccctccagcttctggaaaacacttatttttattgtcaccagagttttgctttttccaaaacttcatctagttagaatcatacagaatgtagccttttcagattgtct

SEQ ID NO: 15052 - DNA, 201 bp, Bos taurus
gctcagtttagtgccaagcactctggcccaaggacgtgcagtgttctcagtatttagtgtatttagacactacttctgtctctctccttttaaccagttttatttattttaatttgaatttctggccacctgctgcagcatgtagcccctttgttccccaaccaggggtcaaacctgcaccccttgcattggaaaccagag

SEQ ID NO: 15053 - DNA, 201 bp, Bos taurus
agtagaagattcgttggtgaaataaacaatgaccacgatgatgccctcatttcaaaaaccatattacctaagaattgttcttatgttaaacagacatggtgagtgagagccagagaggggatttaatggaaatgctctatggccatcttgctacagacaaatttgatccaccccctgcccccgccctcgaagtacttcacg

SEQ ID NO: 15054 - DNA, 201 bp, Bos taurus
tctaataatacatcacaaaattagtgagccaaaaatttaaactaggctttaaaataactttctcaggagacttctgcttcattaccaactccagttctccatcctgaaaacggaaattataacatagacatacataggtatgtaatgtagacataccataatgggaggttgtgaatgattaaccatatgctttagcttatt

SEQ ID NO: 15055 - DNA, 201 bp, Bos taurus
acaaccagttggcaaaatgtcccaatgcctctccgtgctcacaaatagtcctccatggtagacacacatcacaaccagttggcaaaatgcccaaatgatactgtgtgctcacaaaatgtcctcaccatcaaatacaagtcaaaacacttcgtgcccaaaagagaagttagccgggcgcacacccgcagacttactcggtct

SEQ ID NO: 15056 - DNA, 201 bp, Bos taurus
tgagattgactggtttgatcttcttgtagtctaagtcaggagtcttctcaagcatcacaatttcaaagcatcagtttttcggtgcttggccttctttatgttttttggaccagggaggaattggcagaagtcatccttctcctggacactgggctgcagacatcagaggcaaggactggaatgtgactcttggcccacagg

SEQ ID NO: 15057 - DNA, 201 bp, Bos taurus
tggattttactatgagttaataagctgctttctatgttcatgaagcttattcaattaagtcaaaataacctaattttgtaggcagtacctcccttgggcacttgggcaagaggacccccctgccttgagatccatgcactgaagaaccccacatattacaaacacatgaacacaaaaaggatgcaagatcacatgagcaca

SEQ ID NO: 15058 - DNA, 201 bp, Bos taurus
catttagggaaataaaagaaccttttatgatttgaatagagcattttattggtcagtaatgcccctctgctgtaagtcccctcctgccatacatgtttaaatcttcagagtaacctcagaaagatagtgggagaggaagtcagtcctgcgctctcttccctctacagaaacatggatgaaaagacaccggggccaaaatgc

SEQ ID NO: 15059 - DNA, 201 bp, Bos taurus
cttcacacatacttctgcacatctttctgtgaggtggggagtccagcctgacatttccacagtgtgtaagctcttcctctcactgtccaaatatccatcccgccgaagagttttgactgactatatgtgggtaacatgcctactaccacagccattcacttcaccaaatgaaaccctacattcaactaggacaagtcatac

SEQ ID NO: 15060 - DNA, 201 bp, Bos taurus
tcacagtatgggggctttgctgacacaagatattttgttatcatgtgttagaatgtatgataagtcaacaaatcactggggtgtgaacagcctccccaggagttgtgaattttatttgggttcttcaattctaccttccattttgatactttacagttctgttttctgaatgacttttattaaatcactgagtttttcaat

SEQ ID NO: 15061 - DNA, 201 bp, Bos taurus
accaaattcaacccttcaccggaaaagccataggattttcaatacagtggccaaaaatgttagttctcactgcatattttatctttggtctgattcattatgaagttcttcctcacgttggcctcatatcactaaaatttcaatctgtgtgattcctagttctatcacttgggactgaatagtatctcttagttttttaag

SEQ ID NO: 15062 - DNA, 201 bp, Bos taurus
agccaggtaggggagggccacaggtacctgcagtgatcagaacaccccacagcacagagttagtggtgcaaaatgtcagccatgctgagcgtgtataatacgtaggatgcatctgatggacaggcccaatgggggagggaggaatatatatatatacacacacacacacatatatggaaaatatattttctctctcacatc

SEQ ID NO: 15063 - DNA, 201 bp, Bos taurus
agttctggactggtttcatgtaaggactactcctgctgttaattgttaagatgcccagaagaccgttgatgttgacagttttcctgttgtcacaggtttagatgactcgttcaagttctggagggctccatctcgaatgtccagtcaagatcgagatccaagttctctctctacctcggaaacaatggtacttccaaagaa

SEQ ID NO: 15064 - DNA, 201 bp, Bos taurus
gacaagagtctacagggggttagaggtgagggggaagtacggaggtggcggtgggctgagtcacattccccccaaattcgtatattgaggccctgatccctggtacctcagaaggcgactatatacggaagttgtctgtaaagagagaaccaagctcagatgacatcgcgggagtgggccttaatccagtatgactgctct

SEQ ID NO: 15065 - DNA, 201 bp, Bos taurus
ataccacattgtaaagcaattatcttccaattaaaaataaaatattttaaaaatgcagtgttcttgcagaaagcttcaggccatctggctgttgaatttttagcctgttggaaatctcagtaggagaaggcgttgtctcaggctgtgcccggggagaggcctgaccaagcagaggttatggatgtggcctctctcgggagg

SEQ ID NO: 15066 - DNA, 201 bp, Bos taurus
aggccacaaacatcttcaaataattaagcaaatattttttgtgtatcagctatgtcccaggaatatatatgcttgttggccaaaggaaaagtagggatatattttacaacacttactaaagtgatcttctgaaagaacattttaatctagacatttgtgtaatatcctaggtacgtggcgataggctcttcttatttatgg

SEQ ID NO: 15067 - DNA, 201 bp, Bos taurus
ttcatccgtgctgtgtgtgtcatggtaggtagaatcctgttgcataactatcttaatttgtctactcagtcacatggtgacttcataattaccttataaggccaccgattcatttttagaacgtgatcaatcatatccccaagtgtgaatacattaaacacttcttatatagaatccccaaacctaagtcttatcttggat

SEQ ID NO: 15068 - DNA, 201 bp, Bos taurus
tcggactgagcaccgtgggggctgggggtggggtggtgatgggcaagagaggcaaggtccctgtcctacaggggcctatggggatgagttccctctatttcattatttgctaatagtataaacgggcttccctggtgggtcatggggaaagaaactgcctgcaatgcaggagttgcaggttcgatccatgaatcaggaaga

SEQ ID NO: 15069 - DNA, 201 bp, Bos taurus
agtcaggaaagtgattattttctccagggtgacttgaattattcttttagtaatgaatgctagcggtgtgtggtcttttctgttaataccctgatttaatgtctttcttggtcaactactaatcttatacctatagtgcctaatgcctcacttagaaggaatgagaggacatttataggaaagaaccgtatcctctctgtg

SEQ ID NO: 15070 - DNA, 201 bp, Bos taurus
ggctttacaaaggtgtcctacatgaacaaaaaatacagccaggttattaactgaatgtaattgcctggtgataacagactctttgagtctctatttgacactatttcacttgaaaaaggctatcaattaggaccccacatttaaagcaagtggggaaattatgcacagacacttttaacaaaacggtgatgcttgcataaa

SEQ ID NO: 15071 - DNA, 201 bp, Bos taurus
aaccaaacagtatggttagaattaagtatgaaagaaaaatgtattacatgaataaattaaaaaatgattactgaaatcttggccaatgagaaacatttcattgatgtagttctcatctttatttaatagttttaatttaagcctcatgaaataatcattaaacacattggccttctataaaaatggcacagttcagttcag

SEQ ID NO: 15072 - DNA, 201 bp, Bos taurus
atgctcagtcagaactgcaatagtatgattgagatacaagctttttaacattttattttatttttatgaaaggagcattaataggaaatacagagtagaaaaagaggatagcatatataagacagagagaattacatatgcgtgacacttcttagttaaaaaaaaaaaagagagagagagaaatagtattcctggtggatc

SEQ ID NO: 15073 - DNA, 201 bp, Bos taurus
ggagcaccactgttctctgtagttatttggtgggttagaacatttctcgtccagacgtttcctgtcttgctaagctggccattccctggtccttcgattaaagcaaacggatttcagttgtgttttgttttcatctgattctattgtatttccaggtttctggcctcttcagctccaattctgggatatatgctgctgctg

SEQ ID NO: 15074 - DNA, 201 bp, Bos taurus
actctccctagcaaccaatatagaaaaaaggccttagccaagtcaactatggaaaaccgatcatctttagcttgtggaataatctgcatagcagctgaatattctggcccatatggggactgcagaagctgttggggtgctgtttactagcatcccctgtagtccagggtcaacagctacaatccatccttcttcctcatc

SEQ ID NO: 15075 - DNA, 201 bp, Bos taurus
cctttagtaagttggacttctgccttctctttcagttgcaataaagttctctttctaacttctgaaatccaggatcctagatgcttgctgttgcttaatctggtgctcacagtttttaaagatgtttcagcgagagtttttatcagcagcacacttcattatagctggcagtcctttttgcttcattgtatgcattaatag

SEQ ID NO: 15076 - DNA, 201 bp, Bos taurus
aggaactctttaaaaatatgataattttcttctaggataatgatgtttttgaatgccacacagaaaacagcctctttctcaccgattgtatttctgtaaacgcacttcagaggagcctacttctcccttttccaccttaattcattcattagtggtggtttcctttggtcctctggatttcctttcatcagtgaaggagca

SEQ ID NO: 15077 - DNA, 201 bp, Bos taurus
atcatgaacaaacaccatgctgtcagtgaattttcttgatttgctctatggcaaagaactaaaaactgccatctggcctgtgataaaggaatacttcttaccaccatggaaatattgggcatccattaaattatgacattaccatccagtattgggccaaaataaaacagctgaacaactagttttaaagaggtttgtgtt

SEQ ID NO: 15078 - DNA, 201 bp, Bos taurus
agctaggtgatcgtgaaaaggagttgaacaaagcaaaattaataggcctgcttggcacccctcctacctgcaatggtgctgcctcttgaatttcagacaaagtctgatgcttaaggaagatttcctttactgacctagggtagaataaatgttaatctcagttatactcaatagcagcccacccccaggggctttttgtag

SEQ ID NO: 15079 - DNA, 201 bp, Bos taurus
tctggttgttttactcaatttgcccaggaccccagcttgtgcttattctgcttatgctactggtaccccactgactgttcttaaggacctactagcactgagtaagccacagccctttgtaaaactttaaatgtttgtttcagcccagccttcatttatagtctggcatctttctgtcccttgggaataaggatcaacaga

SEQ ID NO: 15080 - DNA, 201 bp, Bos taurus
tttggcctgctttgagtcttggttcaggtgagctgttctaaatggctcattaacatcagaaatccaggagtgactccagcgcatccctcagacagagtgtgattgggccgcagggtggtctttctcaagggtctcacgttttctaattttggaaggcagtgggggtatctcattcctctgtattgaatgtctatctatatt

SEQ ID NO: 15081 - DNA, 201 bp, Bos taurus
tgcctggagaatcccaggggggagcctggtgggctgccatctatggggtcgcatagagtcggccacgactgaagtgacttagcagcagcagggagagtataatggaataagctacacattgtggattgctcctttgagacttacgtccattaatttaatgtgaagccagtcatcctatttgtctgtcttgcttgtctgaag

SEQ ID NO: 15082 - DNA, 201 bp, Bos taurus
agcgatatggagatatgtaaaaataattctaatgtcaggcagcagcacatgaaattttattgttcttggaaagataagcggacctgtattgtgcacagtgaaaaaggctatttagaatgtgtcagcttgcacttgtgagcaagacaattgcatttcttctggtacccagcctcacttccaaaggaatttttatcattccca

SEQ ID NO: 15083 - DNA, 201 bp, Bos taurus
aacacttttgaattgtatctctaatgattgctcccttactctacttattgtacttccaaatgcatctattacctcatctccaatataagaatcctgagttcaaggcctttctgaagatttaatcagtactgaatatgaatcagaaattttattggctttaagaagaatcattaggagaaatcatcttttccaacattaaac

SEQ ID NO: 15084 - DNA, 201 bp, Bos taurus
ctgaaccttttctcaggtggaaatagagtcccaggtggatccccagcttcctcatcacttctggacgcttcccgggaggcccgctagggcctcgccttccggggaccaccgccggatcgtgggcgcggagctggagaggcggaggagcggcggggcttcagctgccctcacggctggaagtgagcccaggagcgttctcag

SEQ ID NO: 15085 - DNA, 201 bp, Bos taurus
cctaagagcagaatgctgcccaatgtcccaattgatggcatttgtagcaagcctttttagtagacttgtcacggtttggaccctctttggcctcatatcccgcctgtctacagatttggcatttgcctcctgccttgtccatcaaagactcggggtttgccataggccttccctggagggcagccagcatctgggcatgcc

SEQ ID NO: 15086 - DNA, 201 bp, Bos taurus
caaaataagagtagacaatgcaagttatcattgaaatggcaagatagatttataataacgatatcacagcaatgtaagggtgaaggtaccctactatttgtaccatgggtaatacaaaccaaggagaaataaatagtttaatgccacttttctcacctaatttttcaagaaaagattcttgtattctccaaatatcttaac

SEQ ID NO: 15087 - DNA, 201 bp, Bos taurus
atcagagttaagaaatctgtcactcagtattttgaagagattctgaaccacctgcaagatggcatatgctaaaaattagtcagattttagttactaacctaaaaaaaataaccgcattgatgcacctgatgacatctaagcctatctttcaatacacatccccaactgcctctcctgccatttaatttctttataaaataa

SEQ ID NO: 15088 - DNA, 201 bp, Bos taurus
caaatgctacagggatgacaatactgctgtttggaactgagaaatataattagcagatacatacaaaatattttaacgacagcccccttctgaatgcctacacctgccggacaccataataatgaggcttgtctgccacttgaacattgatcagatgtcccactggggctcaaaaaatgtgtgcttcagttgtcatcatag

SEQ ID NO: 15089 - DNA, 201 bp, Bos taurus
ttaagttccatagaggtgtgatgcagaacatttcagaacttatgtgatgtcttccaaagccaagtgtaattaaacatgtagaaagctggagactgctctacgggtgagagtgaaatgcaacaatcgtgtgttcttattaaaatcatgaagttttcttctaacttgtatccttcaggtggcaaaactattatcaatttcatg

SEQ ID NO: 15090 - DNA, 201 bp, Bos taurus
cttgcctatacactggaattacctgggagttttagaaagcctagcttctctcccagagatattgaatgaattgctatgagatgtggtctggccatcagtattgtggaaaactccttggagttattttaatttgtagccacgttgaagaaccaatgttccaggccaaaatatcatctggacagacatcttcttttatgaaaa

SEQ ID NO: 15091 - DNA, 201 bp, Bos taurus
gactctgagtcatcttgacctcctaacagtgacagacagctaatctcagaaaccttacttcttccatctcatctgtaataggcctcttcatttatagtctattataaaatatcttgtagtatatttctgaaagttagggatgtgtgtgtgtgtgtttgtacatatggccatacacatgtaacaaatatcagaactatttaa

SEQ ID NO: 15092 - DNA, 201 bp, Bos taurus
agtttagacaatgtagttccagaataaagtaggaaattaccaaacttacttaaatagtagcacctatttaaagtacgcaaaaagtaagcaaaagctccccatcagaaaaatacaaattgaaacaacacagtatcattacacacctatcagaatgaccaatatccaaaaccccgacaacatcaaatgctggcgactctgtgg

SEQ ID NO: 15093 - DNA, 201 bp, Bos taurus
actctgatgatatttcttccaaaattccataacctcagtctaattgcaaaaaaaactaacaaccaaaaaagataaacctaaactgaggggacgatccacaaaatacctggtcattcctctttggatgtatcaaggtcatgtaaaacaagaaaaatccagagaaactctcacagtccaggggagatagaagaaacatgataa

SEQ ID NO: 15094 - DNA, 201 bp, Bos taurus
tactcatgactggacagatggatgacctaaactgagcactccaactcctttcccatcaatgatggacaaaaagaaaacacccattaaaaagaaactacatcaaagaatccacctgccaagcaggagacctgagttcgaaccctggatcagaaaaatcccctggagaaggaaatggcaacccactctggtattcttgcctgg

SEQ ID NO: 15095 - DNA, 201 bp, Bos taurus
ggacagaggagcctgccaggctacagtccatggagtcgcaagagtcagacgtgactaagcaactaaacagcaacagcaagcactgtgtgggaaactggccacaaaactgagcaaaccagtgaaggtcctgtctgctgtagctgacagcctagtgggtattttcgttaccaatcatctctggatgttcctgggactatggcc

SEQ ID NO: 15096 - DNA, 201 bp, Bos taurus
ggtctaggagctcagggaaattcagggacaggtaggcaaaggaacagaccccttcatcttggacaccaagcatggagggtatcaggcctgtggaaggggagtaatctcctctactccagagtttgagtgaagctgggaccccaagagttctaagcagtgagtaagtatcagtactaaggaaggaggcaaagaactaaaaga

SEQ ID NO: 15097 - DNA, 201 bp, Bos taurus
caggatgggagaatgtgggcctctgaccagcagctggttggaagaagagagaccagtcctgagggttccctgaattcttggaccctagtggggacatgggtaggcctggagcccctgtgatgaagccacagcaccactgggctcagaagtctcctgatggtgtctcaaactctgacaccgtgttttacaaaggaacaagag

SEQ ID NO: 15098 - DNA, 201 bp, Bos taurus
cccaaaagtctgaggaatgtcatctagttgtgtccccaggaagaaaaaactgctcataagtttggtgaacaggtagtctatttttgctctactggccaagcactctttctactattccaagttaccacccaggttaatttatacccgtcttctccaccaaggtcatgaaaacctgaagactgatgtttattctttgttaga

SEQ ID NO: 15099 - DNA, 201 bp, Bos taurus
catgtctggggagtgcccactgtggttgggacctgcaagaggtcaccatagtctgaggcggctcatgcacttccccaggggagttggccctgcattgtgggacccttgtggagccaagctgctcaggcttccaggaagatgtggcagtgatccaccccagttcacagcttgacagtagctgcaaacccttgggctgggact

SEQ ID NO: 15100 - DNA, 201 bp, Bos taurus
ccttaggaagaattactatgatcaaagctggtcgaggtgatagaattctagatgagctatttaaaatcctaaaatgtgatgctgttaaagtactttactcaataggtcaacagtggccacagattggaaaaagtctgctttcattcccataccaaagaaggacaatgtcaaagagtattcaaactaccatacaattgtgct

SEQ ID NO: 15101 - DNA, 201 bp, Bos taurus
gagctcttattccctatccaatgtcaattctcatggtctttccctctgaactgatactgtctgttatccactgaatcagatcaatcttgaagcttcctgttccttaccagcagattcagattcattgtgtattggctggtatgccacaatctgcatgacaagtactttaagatgattctaatgtaggtaagggatccacga

SEQ ID NO: 15102 - DNA, 201 bp, Bos taurus
gactctatatttaaaaaaaaaaaaaaaaccctcaatttaggaaagggtgaaagatctagacatttctccaaagaaatatacagatggccaagtggaacacgaaaatatgctcaatatctctaaatattagaaaaatgtaaatgaaaattacaatgagataacacctcacagcagccagaatggccatcatcagaaaaaaaa

SEQ ID NO: 15103 - DNA, 201 bp, Bos taurus
cctacataggtcccacagcagggccaagtgcacggttactgcattactgagacctaagctcagcagacctgaaccagtggctgtatgataatgcctgagagtcatcagggccaattgctagcatacctacatttaaggtgggactaagagcagttctaacaacagtatattttgtgacccttcataatggaggaagggaca

SEQ ID NO: 15104 - DNA, 201 bp, Bos taurus
tgtagaatctcagtcctctggccagagttcaagcatgaacttttggagtgggtgtactgagtccaggacctagaatgcaagataactcccttacctcagggattattaattagtgagaactatcactaaagcttccacctatatacaagacctggcttcacacaaatactggaagcacccagtgcaggacacttcatgcac

SEQ ID NO: 15105 - DNA, 201 bp, Bos taurus
cgtgtggggaaaggtgttagtaagtgtccactgggcacaggccacctcctgctcagaacactctcctcttggacagttacgccctgagtggtaatgcagcgctgtagtgatagaaggaggcccagatctgactttgggaatggatgtgagtaaaaaatttggttttaaacaacaaaggtttttagctggtcttggtaaaaa

SEQ ID NO: 15106 - DNA, 201 bp, Bos taurus
tcatactgtaaagtaaactttttgcagtctatttagtgtcacattgttttgcatgtttgtattttttattggtgacttttctgttaaatacaggccctagggacttccctggcagcccagtgattaagactcagtgcttccattgcaggagcttggtcctgttcaggaactaagttcccacataccatgcagcgtggccaa

SEQ ID NO: 15107 - DNA, 201 bp, Bos taurus
agaggcctttgggttatgtccagtgccatggtggccacacccatgataccttgcactagggccacatttttctctggcctttctccccagcatcacaaaaactcaattagggtggtagaaaaaacccaaaaaacccgaggagtctcaaggccacagggtcccttatcctggctacctggacttatgcccttgaacctcagc

SEQ ID NO: 15108 - DNA, 201 bp, Bos taurus
ctatccttcaagctccggctgatactgctgagaatgaccgcttgagtgactgataaaatgtcaagatgccattatttccaagagagtgtttgggagcaatcagatctgtttcaatttatctcatacacctgaatttaagtcttcagatttaacttcgttggctgctacaaccaaattgtctctgggttttgaaagaacagt

SEQ ID NO: 15109 - DNA, 201 bp, Bos taurus
aatgtactttcagagagtgataagttttctctttataggctgaatgagattcttttttaaatatactgaaaataacttgtagacacttccattcttctgtcatttatctaatgtggtctgtacttcaacagggtagatggcaatggcactccactccagtattcttgcctggaaaatcccatagacggaggagcctggtag

SEQ ID NO: 15110 - DNA, 201 bp, Bos taurus
aagcacacacacagagttgtcttaccagcaacacatgcccagagagttcccctagcaaatatcttgcaaatagctggtgctcaaaacatgtttcatggttcagaaaagatgctcaacaccactatttattagagaaatgcaagtcaaaactataatgagttatcaccttacactggttagactggccaccatcaaaaacta

SEQ ID NO: 15111 - DNA, 201 bp, Bos taurus
taagtcctggaagccatgagagatgaaatgtacatgaaatgtgtgttcagccttcagaatctttcatttacatttgggaaaaataaaaattgtatataaataactactatattgagttatgagataggtgcttgtttaattgaattaaagagtcaccagggagagggtaaagagagaactgtcttttattcatgacatcat

SEQ ID NO: 15112 - DNA, 201 bp, Bos taurus
accaaccacagtttggaccagggtatcttgtgacctgtaagtaagttctctataggatgggtaaaagagagtgtcatgatctatgacataacttggccaatttttcatgtcatcaaaagacccatgtttggatcttttgtgtgagtgtgatgagttcttaaggtttcctacttatcactgcagaaagtaggccctttattg

SEQ ID NO: 15113 - DNA, 201 bp, Bos taurus
taattatatgtacagtgcaattgatatttaatcacatactgccttttgacaggtcgtcttttgctatcttgaattcatatttgcaatttgaactattattttcattcattttttacaaaatcagaatctaagtcttgatgccaatgtccatgactaatatttactttgtaattttcacaaaattcagtacagtattttgtg

SEQ ID NO: 15114 - DNA, 201 bp, Bos taurus
taagggcaggccgaccccaaaggagaggtcgcaatccgtcttggcttccttcttttatacatttatctcctccccgtcttgagcctgcactatacttatatgcaacttgggctggccaagaagggtgagtgtttgtttcatctgaagttctcactctggtctgtggattttcttttgttccattttcaggggcttttccct

SEQ ID NO: 15115 - DNA, 201 bp, Bos taurus
aaaatatctttaatctaatattaatccagaattaagtcttaatatattccagacactatatccaaggggtctcttcacttgggcctgatttagatgatgagttctggactatgagtagatgctataatgagatgagacccttggatgcttgaaagagtatcagtgtattttgcttatgaggaaatggatcactggaggcca

SEQ ID NO: 15116 - DNA, 201 bp, Bos taurus
agccattgtgggaactgacaagtgcagaattagtagggcaggctagaaatttgggaacagatgctacagtcttgaagcagaatatctgctccttctggggatactcatgttgtccttaaggcctttccactgattagatgaaactcaatacattacagaagataatctcctttacttaaaattaactgattgtacatgtta

SEQ ID NO: 15117 - DNA, 201 bp, Bos taurus
ggctgacattaagaccatttaggaggctgatgagttaatttaggtgtgatgagataaggggatgaacactgatagtgtttatccagcaggtcccagacacatgggacattcttccaatctccttcctaacactgcatgcctgacccctggctctactcttctccaactctacaaatcgtatccacttttaagtttcagaac

SEQ ID NO: 15118 - DNA, 201 bp, Bos taurus
cttcctaaaaccatttgtttctcaattttatcaattggtattttcttcagatatacaaatcttaggttgctttctatctttaagaaatttgcaggtactgcctggtgctcttcttgtgttgacagtttttgtggagaagctgtggccaattttcttctattttattcccttgtacatgtgaagcacttatttctcatgata

SEQ ID NO: 15119 - DNA, 201 bp, Bos taurus
tatggtccctttcacttggcatcagagtgacacagtatttctctggggatctcttgaaagtgtagattctgattcagtaactctatgttggggcccaagatcctgcatttccaacaaacttcagctgacgatgatgctgtccagagaatcagtttgagtcataaggccctagaagctcactgcttaatatcttaaaatttc

SEQ ID NO: 15120 - DNA, 201 bp, Bos taurus
cctggcctggacttggttttctcatttttgtaatgtttgtgtatgtgtgtgtggttcttttgtgagacaaccttgaaattctaatcatggcaaagaaagtatacaacaggaacactacaaaacaatggattgcagttcttgtaatcactgcattttgactcaagaagggggcctcagacctacttccacaattctcaaggg

SEQ ID NO: 15121 - DNA, 201 bp, Bos taurus
tttccagagtatggattccaacagatggaattataagaaggtccaagtctaattattaactccaagaacaggtggtgtatttcaaacatcccatttccaaacaaaccttgacttaccaaagaagtccagggagcataaatgaggacttaccagttagctgctagcttatgttaacatataatttactattaaaagaaaaaa

SEQ ID NO: 15122 - DNA, 201 bp, Bos taurus
aagtaagagagccccaggcatctaagaaaggtctcgttttttttgctatttccttttcacttaaaaaaaaaacaaaacactttttttagacaataaggtagcaataaagcagactgtatctgcatggcctaaaatagtgaggcactgccttgcaggtgaaggtggcagaagcccctccctgcagacaggatcatccatcta

SEQ ID NO: 15123 - DNA, 201 bp, Bos taurus
aatacttataaatcttcatttgtgagaaaaatttccataccaattaatcccactttgggtattctaaatataccagaatatactcatattccaaaaggctatattttcaaatttcatagaactgtcagcagttattaatgtacttaacagtatttttaatctgtgttggtgtttctgcttccactgccttgtaagctactg

SEQ ID NO: 15124 - DNA, 201 bp, Bos taurus
aggtgggttaaggtggaggttctttgaaccaataagtgacctgtacactaatgtatcgatgtgtatgtagtgcctttctcagatctattccatccattgtctaaggaaacattttcggggaatttgaatgcagtatttttccccctcagtattcttcaagacagagactgtctaagaatgttccagttctctctcccaggc

SEQ ID NO: 15125 - DNA, 201 bp, Bos taurus
ccttgagatctgctctcaatttcattcacctgaggcttcagtgtgctttaggatagcatctgtctcatatgtatatggcttatctccatacagagttccagggttttgtggaataaatactagacatctgaaatctttcaagtttgcttcataattctgcagttataccagaggatcgttgtatttgttggtgaatattca

SEQ ID NO: 15126 - DNA, 201 bp, Bos taurus
aaaatggccaagttagctccctgcaaataaatgactggcaatggccagagaagtgaggcttggagagcataggtgaaaattaccgaatagcattcagtcaccctcttctcaactggcctcaaaaaaggggacacttgaggcagagagggatcaggatggctgacgtaaacagtgtataaacactgtttatataaagtgtta

SEQ ID NO: 15127 - DNA, 201 bp, Bos taurus
ttacaggctgtaatccaaagtgggctcaacttgtggaacatcagtccttcacaggacaaagggagagggcaggctgcacagtcctggggagcaagaaggctggcctctgagattttatgtgcagagctaggatgttaccagtgctagctctaggtaggaaaaagaaatgattctctatcaagagttgtgtgtggccaattg

SEQ ID NO: 15128 - DNA, 201 bp, Bos taurus
tacctactttcaaggaaaaaaaaaaaaagacctttctattgcctttcaaaatctctagaaaagcaacatggctcctctcttagctttcttgccatcatattattaccttttattttctttaataggctacagaaaccagtaatatgataggaagtcattaatacaatataatcacagcagaagatcaagctcatctctttc

SEQ ID NO: 15129 - DNA, 201 bp, Bos taurus
tctgtttaggtttgtcagatgggacatattagcaaaagcctagagtgaagttgcagaaagaagtaagagtgtttatcccccatttcttcccgctttgctatggttgtaatgttttcactcttctagggccacaacttctgaatagcttccccttaacatcactcatcattggtgacgagacacaccattttctcttaccga

SEQ ID NO: 15130 - DNA, 201 bp, Bos taurus
gccatatatctatccatctgactacgaatgggcatttttgtagtttccagtttaggagtattaagaatagtgctacttctggcttctgcttgaaatgtacgaggctgaaagagtttgtaactctcactcttacaacaacaaaaaaatgctgtacaatctacaaatttataactttgcttgaacttgtcagctatctgagct

SEQ ID NO: 15131 - DNA, 201 bp, Bos taurus
acggttctgaggcctggatatcaaccttgggagctcattagaatcacctggggagattttgaaattcccagtagatagaccacatgcatgcatactcagtcgttcagtcgtggccaactcttaccaaccccaggaggcccaccagcctcctctgtccatgggatgtttcagtcaagaactggagtgggttgccatttcttt

SEQ ID NO: 15132 - DNA, 201 bp, Bos taurus
aggccactccaggactcagaggttcactggacgcctgtttccaaaagctttcccttcagtacctttctccctccttctatgagaaggacgtgacctcctcgcagtggtagaggccctggcatttcactgcgagccaaggtagttggccctcagccatggacacaggcagaaaaactgaacatccagccaaggaacttcaga

SEQ ID NO: 15133 - DNA, 201 bp, Bos taurus
gacccgcccggccacctctgtgcctctccccagggcagaggcactgttcccctgggctcccagcgaactgcgaagcagagagcatcccgtgcctctgcctccccatgggccctggcctggccagcctgctgaggcagccttcccgagagccagcacctccgctgcccatgtggcctcagccctcgacccaggaacacagag

SEQ ID NO: 15134 - DNA, 201 bp, Bos taurus
gctcacagggagagatctgagatttctgtccttagaaataactgtataaatgctccttatctaaggggggtggggtgaggtgaagaagaggcctcctccccacccagggctgtcattcagatgaggggaggtgtctcaaggaccttggctagggtccccgggagcagagtaggccaacaacgtgctccatgaggatccagg

SEQ ID NO: 15135 - DNA, 201 bp, Bos taurus
ggctttggagggccttgataaaatgcttctatcctagaaagaaagcctcttcccctcagggtccaccattagcgctctagaagccgctggttcaaggggaacacagggccttgctatgctgggacaagagactggggacagctttttatgaaggttagaaagagggctggatctaatcatgggtgctccccgagtagagct

SEQ ID NO: 15136 - DNA, 201 bp, Bos taurus
caaggaactgaggttggcctccagccaagagttgggtaggaactgaggcctgcagttcaatagcccacaaggaacggattctttgcaactacatgtgagcatggaaagtggatcctcccccaggctgtcaacacctttattgtagtctacaagagacctgaagcaaaggaaccagccaagacttgactggaattctgaccc

SEQ ID NO: 15137 - DNA, 201 bp, Bos taurus
ttttttcaagcaggctaaattgtaactactgtaacaagtataaacatatctaaggaagtgtgatctgtttgtacagtacagaaacggcctcaaacttttttagtgtctagatttgcccaggaaaaaggtattcaatcaaacggtctgctaatcacaaatattctgtttctttttcttgctcagcctaggcctactctttcc

SEQ ID NO: 15138 - DNA, 201 bp, Bos taurus
acaggcggctgcggcacacctccttccccagtggccagtgctgacggtccaccacaaaatcctttcgttgaagaccacacgtgggccctccgggcaccacggacaattcactaaatcccacctctgagtcatagggtcatagagagccaggaggcagctcccaggaggccgagtctggcgacctaactccgaggcacttac

SEQ ID NO: 15139 - DNA, 201 bp, Bos taurus
ggttccactcagtgtgtgcaggtgtcacgtgggcttattcacatcaccttgtggaaactgcgacttgcagaaatggcacaaatgctgctatcttggctactactatcgctgtgagtaataaagtcctttgtttctgacccaggagtttcgtgtcttctgccaacatccatgagatcatggcgggctaacttactagctttt

SEQ ID NO: 15140 - DNA, 201 bp, Bos taurus
atcccagctcatttccgtcagcagagagtgaactctctcttgctcagccttttgttctattcaggccttcagtgggttgtatgaggcctgccaacagggaggagggcaatcttctttactcagtctaccaacgtgaatgttaacctcatccagaaggttaaggatacacactgcaccgacacacagtgatgtctgatcaaa

SEQ ID NO: 15141 - DNA, 201 bp, Bos taurus
aatatttgcctcaatttttttcagttgtttatttttttcttgggcagccagttagatctcatatcctgcaacagctctgaaaatgcctctttcgataatatcaaataatttctcgatgctatattttagccctaggacactcctctcagaaacacccctctggccgtcctccaccctcctgctcctctcagccctttccta

SEQ ID NO: 15142 - DNA, 201 bp, Bos taurus
agaggcccccaggacagtgaagaagatgggtttgcaaccagatcaccgctccatgctgcagagtgctggagaaggggcctgccttcagaaggttgagcctccctcacctgggactccagagggtccagagaagggggaggcggggagcgttccatgttcggtggcctagaggcacagaaggctcagaatattcccaaagca

SEQ ID NO: 15143 - DNA, 201 bp, Bos taurus
tctaatgaccacaatccaggcccctctttcgatcctgttctgtccattagcattagaactatgtaacaggatctttcctctttgcctaactaagacagcctgtggccagaggtgtccatgggacactctaggaagtgcagctggacatttcttttaaaacgattctgtttttctcccagactggtgctaatgtccctgcct

SEQ ID NO: 15144 - DNA, 201 bp, Bos taurus
tcagccagggtccctcccggcccgctgcttggagccatcccacagtgtgctaaccagctctgccctgggagaacatgccaggggacaatgccgacagcccgggcccgagccccagtgcccgaggccttcccgaccagcggtcaccgagaggggcgagtggcctgactcagccgggcatgtccagccagtgtgagcattcac

SEQ ID NO: 15145 - DNA, 201 bp, Bos taurus
tttgggcaagctaggagaagctttgtagcatttgtagcatagcaatcttatataatctgataccaatggttgggatttagaagatgttaagaccacaggtgtgggaagattatataaaagaggctgacttagcttttagataactgcattacagtgttaaaacacttcaccatctaatagttagaatttactcttgctttt

SEQ ID NO: 15146 - DNA, 201 bp, Bos taurus
gtggtgagttccctggatttttgcattgctccatatataccagacaaggatataaaaaaccagaaactcagatatgccaaaaggcacagataaaaaatggcaggccaccaaaagcatgctctttcagccaaaggaccaagaaaggagcaacaaagcaaaacaaataaaaaaaataaacttttataatgagtaattgctctc

SEQ ID NO: 15147 - DNA, 201 bp, Bos taurus
gggcctgtgcagatttgtactcagttgaacacaagctgcatattttccttcctttccacaaacttaaaatacatcagtgttcataacagctctacatgcacctgagatagtgttatggcacttatatctaatttacaactcatttattcctcctgcttatctcatatttcagggaccagtgtcagtgttagtatggtggaa

SEQ ID NO: 15148 - DNA, 201 bp, Bos taurus
tctgagatgaaaagaaataacacaaaaatatgcattggattcctctcttcatggaaattattttgtgatgggaaagataaatatctggattttaaaacctgtaaaggtatttttcaagcatagccagactagaatgttcttatttggtggcttgtagccaacttactttagaagttagttttgttttttatattgttttat

SEQ ID NO: 15149 - DNA, 201 bp, Bos taurus
acctgttttagccatgatagatatgtatatcaatccagtcttccaattaaaatgtaataaaaacataaaccctacagattatatattatgttcaagaagaatgtaaaggcaaaggaatgaaaagaatacttttaacaacatttagatttaatttaacaagtatttttggattctcatgttcagttcactgtattaagtgct

SEQ ID NO: 15150 - DNA, 201 bp, Bos taurus
tgcttaatatttaaagttttacaagagtttaatattcacattttagagagagaaattttagctgtaaaattttgacccggtgttgttaaaattgaaaggtcgcaaaaatataaactcgatggaagaatattatttatcataccttcaacatttcaaaattaaaatggttaggttagaatatttgtatttggtgaccattgt

SEQ ID NO: 15151 - DNA, 201 bp, Bos taurus
tcctatactttcatttgcttttacagctcacactttagttcggctttacaccacacagctcacgatgttgtccgtaatggccccctccattgccttttctcctgttctgtcttcagtgtactctgcagctcactgaaagcacacagctcgaggactggtacagccccaggccactggctctcagtcctcacctcaccttga

SEQ ID NO: 15152 - DNA, 201 bp, Bos taurus
aaggtcatttactgccactttatttggctttgcttaaaaaaatatctcagctatccgttaaatgttctggaatgtccctggcctcttttaggaactggaggcgagaagatatttaaaggtggttaacctgtcctccctaacccagcctttaaaaatgcattttaaacctaagcatcaaattggccatgtggccttaacagt

SEQ ID NO: 15153 - DNA, 201 bp, Bos taurus
ctgtgttgatgcgagacaggagagcgaatacgcagatcacgcactggccccttaaagcatccacccagcagcgctgcccctcatgtccctcttgtattttgtttttcatggcagatcccacggccacatctaacgtcgggagcatggaggtgtgcagtcttcagtgggccaggagtgtgactctcaagagtcttgtgctaa

SEQ ID NO: 15154 - DNA, 201 bp, Bos taurus
ctctggtgactcactgggtgctgctcttgggtgtaccttgttagtactcccttgcaagaggttgtctgacttcaagaggtagagcttccagggttctactactaagactgcatgtttaaccccctggaaatacttcaagtgggtaattgctctccaccttttaaaatcaatggattgggtgtgtctgtttcctcagctgac

SEQ ID NO: 15155 - DNA, 201 bp, Bos taurus
aaaagttcaaaggcagtctgcaggcagaatttcctcttcttctggggacctctgtctctcattgctttaatccttcaatggattagatgaggcccacccacaggaggagcaagtcatctgctactcaaagtctactaatttaaatgttagtatcacctaaaatactttcacagggacatttatatctgtgtttgacaaata

SEQ ID NO: 15156 - DNA, 201 bp, Bos taurus
tacaaatggcgtcagaacattaaaatggaacttcttaaagcccaccaaaggaagaaagaagtaagctaagagtaagactatctgggacatcttggaaacgtcacagatttatcttcttgtggcccagtttgattccgaaagaaatccggagatgagaaaacccataactgggtttttgcttgctttatggaatgactttga

SEQ ID NO: 15157 - DNA, 201 bp, Bos taurus
ccccatctctaaatacaaataccatagcactcagagttagggcttcactatatgaattttgtggggacaaaattcagtccatagtgtccttcttcatatttccctagccattctggcctaataatttgcatggagaatgagatctcatgattggcttggctgactcagttgaagtaaaaggaacttgggggagttgaccac

SEQ ID NO: 15158 - DNA, 201 bp, Bos taurus
cgtggacggtttaagccggctccagagaaacctccaagaatccggccggcagctagctctctacagcgagcaggtttccctagtcattccaccagaagtgtgggaagggcggggcgagccggccggaagctgcgagaacagccacacaaggtttgtccactgtttccagggaggaccaagtcggcgtggaaggcgaatggg

SEQ ID NO: 15159 - DNA, 201 bp, Bos taurus
ttcaaagcattctcttgtaacgtttttatatccaactgagctttcatccttcttcatttgcataaatttttgtccagaggtttgaaatgtgacaattgtacctaccatagaaaaattttcttttatagctacgtcagaacagtattaaattactttttactctttgagatatatcctctctcaatggtgccagtgagcttg

SEQ ID NO: 15160 - DNA, 201 bp, Bos taurus
tccccttcctccatcatggcctcattgggacacaccctagcaggtgtctatgcaatcatcacccacttgctcacatcagcccacatcagaattatttttctgaaggccaagcaatactctctggtgtttgttcaacagttggtttatattactcatctgtgaagcatcttaagatgccccatgataagttgcttctcctcc

SEQ ID NO: 15161 - DNA, 201 bp, Bos taurus
attagcctccaattaaaataaatttatattttaaaaaaaatccagtaaccaactatagaaggagaaatgatcatctctactggaataagagaggatgaaccgttttgacttgaaattttgtccaatatcaaggtcctaatgaaaataaaagactcaattataatacttttaaaatttaggactcattatgtatggatgtga

SEQ ID NO: 15162 - DNA, 201 bp, Bos taurus
attcattcttgataattctgccagcaaactttggacagtagagacaagggatggtgtgtaattatgctaaaccttctaatcaataggacttagaatgtttggtggcctagacttctaccttagttacttatactaaataaatcttaattttagtaaattattttattgatcccagataaaggataatacattgtttcttaa

SEQ ID NO: 15163 - DNA, 201 bp, Bos taurus
attagggtctatagtggggtagagtgtgtatgggtgagggtgaggttggatgttagtgatggtcattttcaataggtggttgggccagcctaagtgagaaggttatccttgatgatttttgaaagaggtgaaagaatcagccaagagctttgggtcagagggtaaagtcagttcagaggccctaaggtgagggaatgcttg

SEQ ID NO: 15164 - DNA, 201 bp, Bos taurus
tgaacaacagaaagacaagagaagaagctgagcaatcagtgtggagaataagacagtcatctaggaaaaatgacactgtggccttttcattaagctcagggcaaaacttaggctcacaggttggtttcaacactggatcagtgtattaaagtctgtcagaaatgtcgttttctaaagaactgttattggaatggggccaat

SEQ ID NO: 15165 - DNA, 201 bp, Bos taurus
caaggtcaggaaacagtgaaatctaacaactaaaagtattaaactagaaacttaagatacctggattttagctctgagactctgtaaaagaatttttgatctgagggaagtcataacatttctgtgtgctttggtttccgcatctgtaaaacaaggacaattcatcttcttcattagaatgctgaacagatgcatgaagaa

SEQ ID NO: 15166 - DNA, 201 bp, Bos taurus
ttttaaaaagtcaaaatgtataccttccacagaccacttaagtttaagcatcccatctcattttaaaagctgacttagggagctatttcccaaagagaagtatgtaccttcagctggaaggatctctcctcttagtggttgtatcagtcagttcagtcactcagttatgtccgactctttgcaaccccatggaccacagca

SEQ ID NO: 15167 - DNA, 201 bp, Bos taurus
gctataacccaacaaaataaaaagtaaaatgttctctttagaatctttttgagatagggtagttacgtagcctgtaaggatgttctggcatcagcaaagagcagttttgtatggatttacttctagaaaatagaaaaatacaactagaaaaatatttcataaagtatttatgaaaggaggttaagacaagggagatattga

SEQ ID NO: 15168 - DNA, 201 bp, Bos taurus
ctgcaggcaaatcataccttcctctggacattctttgaaggcagaaaaatgtaatactgggaagaaagataacattatataattattcactttttgctcttaaaataatgctgttcatggaatcttctaagtattctacttatgatgcaggcatttagttcatatatatgcccagagcattgcatgtgacactgaaattac

SEQ ID NO: 15169 - DNA, 201 bp, Bos taurus
gaccagagctcttaccctttatcgtgtttgaagttctccaggctttactcggggcctattttaagttttagttctttctggagaaggcctttttctgtatgtgagtacttattaatactttggtctgattttgaagtcagattgattcaaccgcagttgtctttccactcctttggaagtggcctgcccactgaaactgtg

SEQ ID NO: 15170 - DNA, 201 bp, Bos taurus
agagtcaaattataaatagtatgaagagtttggagaacaactgtgcttgagggtgacttactttttcaatctatccccattcaatgtactcatctagatgttctatgtatttattgtctaagaaacctcatgagccattttcccaaagttgactatttaataaagggaatcagataacaacttccactgaaaatgtttaga

SEQ ID NO: 15171 - DNA, 201 bp, Bos taurus
aaatgtatgcaggccattttctaatggtcatcatatcccttggtgagagcttaattttattattcagttttagaagttacttgaaacagaaactttgaaactttttttttttttttaactcagtggccatgatactggaaagtcagggatatacaaaagttgtcagccacaatgaacattaagaatttgaaaaacaatgaa

SEQ ID NO: 15172 - DNA, 201 bp, Bos taurus
tttgcagttatagcatcaaataaaatgttagcaaagacaagaggaaataatctattttagggagctggcaccttgaacattgacagagtctcaaaggttatttctttcatcagaataggctataactatatatagacaataaattctatttctatttcagcactatacatagtactaaaatcttttttttttcctcctggt

SEQ ID NO: 15173 - DNA, 201 bp, Bos taurus
gtgggcaatcctgtttgcaaacagtgagtctgtcaaagacaatccctgggaatggagcttgcaactgtggttgacacaggttaaatagtgctagttctctggggatgaagatttggggtagctcccagcttgttttccctcctccgatggctgctatactacttgctttgacagcaactatagctgcttctctggtggctc

SEQ ID NO: 15174 - DNA, 201 bp, Bos taurus
gtgtccactggctccagtggccccgggagggttccccggcctcgagctgctcccaagtcaccgagttctgcggctgcagcaaaccgaggcctgcaggtccggacaccagcggcttcagacggcttccctagcaccaagttctcgcgaggaggttctccgtgaactgaggctcagctcacctgggcatcagcgagctcctgg

SEQ ID NO: 15175 - DNA, 201 bp, Bos taurus
gtaataaaataggaaggttgttgaagtagcaagttaacaaagaagtaacaaattttgttcctacaggcttcttggccttgaacttcctatttctggtgataagaatgtcttcaactctcttgatggatagtaccttcacaagcgagatttatttcttgctttcagaacaaagggtaggttaggagggttaaggtgtccttc

SEQ ID NO: 15176 - DNA, 201 bp, Bos taurus
attgtattaacaaaatgtcagtagatgtgcagagagtagttttgttaaacatatagttttaaaacagagactgtgtagtttacttttgatttatgtatgacgttttaagaaaagagaggaataaagaattattcttagctttgagcctgggcttcataatttaatatggataaggataatgtaaggtttgttgttgttgtt

SEQ ID NO: 15177 - DNA, 201 bp, Bos taurus
atgtatctgcatatattcttcagtttgtatgatacgtttgtttttgctgaaggtctgccctgctctggtcgtgctcattacagagaacactggctacacaggacacatcagagagactgttaaagggtcagctttcttggccttaatttctctcggtaagatacaatagtgttgctcttgtcttgtcaggaaggaaaacac

SEQ ID NO: 15178 - DNA, 201 bp, Bos taurus
tagagaatgtttttatttcaacccgaactgctaagaggtaaatttaagaaaatcttgaacaacaacaacaacaaaatgcaaatggaaaataaaggatccaatgaagagtatctgacactctcactgttaaaaattgtatatgtattaatatactctagattaaaggtccatttaaaggcataccactaattaaatccatta

SEQ ID NO: 15179 - DNA, 201 bp, Bos taurus
ctgtttttcatagaatgaaattaaatacaacaacaatggaataccactaatcatctattaaaaatggcaacaatccagtacaccaaatgctggcctaggtatggagctataggaaatctcactcattgatggtggaatccaaaatagaacagccattttggaagacagtttggccttcctttcaaaactaaatatactctt

SEQ ID NO: 15180 - DNA, 201 bp, Bos taurus
tgtagaatttgccaaaccaaactaaagctccagaatttgaaggtaatggacactttccttagcccttctgaaggacaatcagggcaatttggaggcagctcattttacttaacaagagctaaagcatttatagagttggctgtccttaaggggaaaatactgaattatagaccataattttatgcataatttaactcccct

SEQ ID NO: 15181 - DNA, 201 bp, Bos taurus
aactataaatagtatgtaagctaaggtaactctcctagaatacttaaagaataagcagaaataggagtacaagtcaggtagttatagccaggtacttttacacatttatacattcttaatatatgtgtacaataatatataatgcaatgtatataaatatatatttatatataattgaattgctgttgtatacattttcat

SEQ ID NO: 15182 - DNA, 201 bp, Bos taurus
aacttgaaaacaatgtttagtgatagggttatatgaaagctgttgagaaatggaaagattgctttctctaggctcaaataggtcagattcagtgcaaatggcctcatcttatttgtgtgtatccaaagcacaaatcttaagacaaatttatttgtgctaattttatagtcagttcagaatgttagaaccagttgcccctct

SEQ ID NO: 15183 - DNA, 201 bp, Bos taurus
gaattcagtaatttaggcctatgattatgtattgatttagagattaaagtagaatcaccactttctcttagaatttttcctatttgcaaaagaaagttcacgggctttggaaaagtactttagctttacttattgtttgaaaaattcaagaatattttgaaaatatttatttaccccaaggagaatagcacaagtattttt

SEQ ID NO: 15184 - DNA, 201 bp, Bos taurus
cccttccagaaccctgctccttcaactccatgtgtttgcagtgagttttttaattgatagacttgtatcttgcttaccccacccatccatgagcccaagaacatgtgacccaaggtagccccaacccctctcccttacagaccttacagaccttgtgaatgacactcatggggtgaaactggaagaatctgaagacctttc

SEQ ID NO: 15185 - DNA, 201 bp, Bos taurus
agatctgtgccacagtttcctttttcttcttggcagcaatgttattaaacattcttcatgacgataacccccaacagaaactttcttacttacatagtttttactacctttcaacttggtttggttctgttgatgaacctcactgactttgtatttttcacatcaaaagaccctgataagctattatgtgaaaattgtaaa

SEQ ID NO: 15186 - DNA, 201 bp, Bos taurus
ttgcagtagagaagtgaaataatccttataattgaaaaaactctctctgggctctcctgctgagagagactgcagggtgtcaaatgtaagcagggaggctggttaggaggttatggcagaaaccaggtaagaggggtggtgactagaaagagagtgtcactcccttcatgtgatgaaaacagtgtttaatatgtgtattat

SEQ ID NO: 15187 - DNA, 201 bp, Bos taurus
ccttttccaggggatcctcctgacccagggatcaaacccacatctcctgctttggccagtagattctttaccactgggccacctgggaagccttatatgctaatatacatgtgctgatatatatgctaatatacatgtgctgatatatatgctgctacatgggaaaaataaaaagaccagaaacttgaggccaagattatt

SEQ ID NO: 15188 - DNA, 201 bp, Bos taurus
gagtttaaataattaatctaaggttacataactagcagaaaggggacctggaattctcaaatgcgatcttactccagtgctctcatgcatggccagctacgtaatttgcagaacctagtgaaaaatgaaaacgtcaagccacttgttcaaaatgcaagaaacactgctgttaaaggtagtaaaatactaagtgttttactt

SEQ ID NO: 15189 - DNA, 201 bp, Bos taurus
ttagcatgtgtccttatttggcatatttgtgactgccggtcaccaatatcaaattttatttgaggtaaagcatctttgaaggttcaagtggtttaaactgcaacctacgtcctcatgctaaacataaaaaggtagactgatcatgatggatatagaaagggaagtaattgattccttggtctgaatttttctctcagttaa

SEQ ID NO: 15190 - DNA, 201 bp, Bos taurus
aatccacttacattaaaagtaattattctttggtaagaacttactatactatcaccatcatcttaacttttttccaggttggctttcagttccttttttcctcttttgctatcttcttttgtgatttgatgattgcccatggtggtgtccttcgatttcttttatcttttgtgtatctactgtaagtttttgctttgtagt

SEQ ID NO: 15191 - DNA, 201 bp, Bos taurus
caacttgcctctcataaaatccagtcctccagcaatccccaatttatgtcaaggagacttgaagcaagttattaactttctcacagttttgtggtttttgcttggttttggttttttgtttgtttgtttagatagatagatcactctagattttaaaagaccaagtgagttaggtctggaaggttgaaggaaggaagtgtc

SEQ ID NO: 15192 - DNA, 201 bp, Bos taurus
ttaaaggtagtatgttgtgaaaaacacggtcatttccttatataaaagtcactactatttttctttttccctgattaaaaaagtttggatagtaagttaagggagatgtttatctgaaagaatatctatctataccagtcatgacctgatcatgggtctctgcactggcattgttcttgacctataatggctttaaacttg

SEQ ID NO: 15193 - DNA, 201 bp, Bos taurus
aatggactcccttccacacagaagagcacagtcctggccaagcagctaaaggctgcagggcattgtgatggggtttggacaacaaagcaagtgcaaagcagtatgggcaactcccagatcacatttctatcacaaagctattcttccctttcccctctctgctggatgacagagaaatggaaaccacataaccacatgcag

SEQ ID NO: 15194 - DNA, 201 bp, Bos taurus
gggctagtccaagactaacaaacagggcagagctattcacagggaaggactacatacagcagagcctgtagcatcacctagggattcatcagggcttcctcgagatggccctgaacaagtcttgaaagaagaaagcaacttaagaaaaaacggggaggacttttaaaccccaactgcatcataaatgaaggtcttaagggt

SEQ ID NO: 15195 - DNA, 201 bp, Bos taurus
tctttattttttatttggctctgtttgggtcttagttgtggcatgtgggatcttagttccctgacctgggttcaaacacaggcctcctgcatcttagccagggaagtccctggtcttaattcatatatttaaataggatgatttccagccattagccaatgcctgaggatgcttcctgatggggtgtgtgttaggccggga

SEQ ID NO: 15196 - DNA, 201 bp, Bos taurus
ttgaggtgggagtcagccagtgatggaaggagaattaggcaattatgggttctggagaggaccatatggatgaagcagacttgaaaagctgtaaacagtaggtgaataaagctgagcaaatcagttgtgtagttggcatcatggcggcctttcctgagattcattccttgattactgtacagttcatagatttagaggctt

SEQ ID NO: 15197 - DNA, 201 bp, Bos taurus
tatctccagtcataggagtttgtagatacagtatttatggcattagcagggtaattattttcccattccacgatggccatggttcagatgctggtttaataagattagtcaggctgcttttagtactggagaaggctctgtcgctgttgtcaaattactgtttaatgctcaacacgaagggggcctgttggggaggactgg

SEQ ID NO: 15198 - DNA, 201 bp, Bos taurus
gctggttggactcgccactcaccgcttttaagtgcttctttttttcagactttttcttttacctccacatgaccccaaacaaatcaatcaggagccctccggttgaaaactcttccactatatgatgtgacaccagcagaatgtctttaaaaagaaccctgtttccctctgaatgtacaataactcagagcatcagacgcg

SEQ ID NO: 15199 - DNA, 201 bp, Bos taurus
aagcagctatgcacaacccgatgaaatgaaagtggacatgaattcaaagctatagaatcacaagttagatacagcatgagaaattgcttcttgacagtgatgctattaaacacaacaatgagttactagggaaaattatggaaaaccttccttttctgaaagtcatttaacatggcaaaatatatctatgtcagatggttt

SEQ ID NO: 15200 - DNA, 201 bp, Bos taurus
aaccaatcaaagagttcatgttcagaatgaatctagagcccgtggctataatgaaatgtcctggtacttcatttctcattcaaaaatcaagtaatatccagttctttatgggtcactgcaacttttctatcagattgagtaaaaactatttccaaatgttaaggacatataaacactcaaaatcctcccaggctgtgtaca

SEQ ID NO: 15201 - DNA, 201 bp, Bos taurus
cagccataggagttaatttctgcaaaaatcctttggtcaataatgtgttaaaatgtgttcctaaaaagcttgcagttagaaatcctttctctgacctttgagatggaactcttctatcacttaaaattgactcctcaaagatcttggagaagtctttgtaatgaaaacatccagagaaagaactcccactcttaagtttcc

SEQ ID NO: 15202 - DNA, 201 bp, Bos taurus
tttcccactgaacaaggtgttgtagttcttgcaaggcttaaaattttcttaccccatggtatccagttggagtgttcaaagaacgactcccaacactgcttcaagggggtctgttcattacagatccagttctgaggttcaaggcaaaatatttgcaaattgctacccataatgcacaactaacccctaagctaatttttt

SEQ ID NO: 15203 - DNA, 201 bp, Bos taurus
ccatttctagtcagggagctgggttgacaattctgcctagtttgggtctccatccaacaggccacactgactaaagagaccactctatggcctgtctgggaaaggaaggaggctcaaagcctggcttaactattgaatgtaacctctagccctgtgctactagaagcggggccagagatgcctggcagccaaggagcatgt

SEQ ID NO: 15204 - DNA, 201 bp, Bos taurus
aagtaatattttttaacctatcaaaaattagcaaaattaaaaagctaattgcatttatgttacagcattctcatgtgtccataggcctcttcttaaaaaggaactgagcagtatccctcaagctttcttgaagaaaccacactgtaacttaaaaccttgaccaattaatccctctttaggaatctattctaaggattttgt

SEQ ID NO: 15205 - DNA, 201 bp, Bos taurus
gaagtttcctgatacaaatcaattgaattaaagtaaataaaaaataaatcataattaccaaatatgagtttgtgagctaagattatttcatcatattattctggtggctcccatttcaagtagagtaaaatgtaaacagtttgtaaaactatacaatctggtccctggctagctctctgacctaatttcttgaacacatat

SEQ ID NO: 15206 - DNA, 201 bp, Bos taurus
atataaaacaaaagagagcaaaagacatagcgtgctctttaacccattggaaagctaagaaatacgaaagctaaatgaaagataagctattgctcacagaagactgacatagtagttttcatccctggagggaatggaggaaggagaaataaggagaaatcacgccaaattgctgaagttttactaataaagtgtgagctg

SEQ ID NO: 15207 - DNA, 201 bp, Bos taurus
agctgcagaataaaatcaaggtgacttgcctacctgagggttcttttgcacttgccaacttcattagctgtgttgtttgtgtctgtgaaatgactggcctaagatatactttactgctgtttatttatcctggagtcaccatatttataggataattgttttaccatttgttcaaagttgtaaggagctctctatctaatt

SEQ ID NO: 15208 - DNA, 201 bp, Bos taurus
ggccagtttaatttgctgaagtgacaggctacctaagataggtaatggtacctataaatatttactagttctttccatcaacagatatgttttctaaatattcacggagagtaggaaggaataacaaacactgggtttctcccttcctctctgcgtgatgctttttcatcgaatgtaagatcatttctgggctgctctttg

SEQ ID NO: 15209 - DNA, 201 bp, Bos taurus
ggtagaaaggagacataatttcaggaaagaaaagaccaagatccaattaggaaaaaaggaactatgatggtgttgcaggctctagaagagcagggaagcccaggagtggatagtggggctccaagatgctcgagagcagaagggcactgccaccaccaccagcactaggaggacagtaatgttgctggagcccagaagcca

SEQ ID NO: 15210 - DNA, 201 bp, Bos taurus
gccaaggttgtctactctcctaccagctaagctccagacatagttgtctgctcagagacccgccagacccttgcccgcctctcctaccctctcactgaccacccttggctcacagtccctaccccagcctctcttccacttgagttttcatttttccctagcacacgagacaatgagaaacatttctatctcccctggaat

SEQ ID NO: 15211 - DNA, 201 bp, Bos taurus
tattatgttctcccaagtgaaaagtaactccagttctttcagatggaatgacagccagattgagaggatggagactggggagtggccaaaatcttcagccgcccggagaaagctccatcgatgccctgggcaacacaccccatccgcttagggaacgagcatggcctaagaagtcctccctgtatatttccacatggtatc

SEQ ID NO: 15212 - DNA, 201 bp, Bos taurus
gatcttcccgaccgagggactgaacccactccacttgtgtctcctgcattggcaggcagatccttaaccacaagcgccacctggggagcccagtttttaggatatgtgtaaatacaataatgaaattttctgcattccatttggttccatcacaaagttttgtcaagttcaagaaaacacgtcaaggtctccaacaggact

SEQ ID NO: 15213 - DNA, 201 bp, Bos taurus
caccaggctgcccttctgagacaggtggccactcacaggccacagatgaccacgtgggcacgagtcctcaagcatctcagggcctcaggatgaccccggagcaaggtccattcacggggtagtcctctgaaggagagagacatgagtaccaggccaggcttagggcagcccagcgtgatggcactgcagccctggctggtg

SEQ ID NO: 15214 - DNA, 201 bp, Bos taurus
ttttgttgttgctgttttggctgtactgcatggcttatgggatcttagttccccaaccaaggatcgaacccctgggcccccccgcagttcagagtcctaactactggaccatcaggcaattccgataaccagcttctaatcaactcatgttttcatagttgtggccaggcgttaacattttgttaattgtattatttcaaa

SEQ ID NO: 15215 - DNA, 201 bp, Bos taurus
aaaggccatcctttcatcactgtagacagatttcaagcaagaagagtttcttcaaatgggactgcatgttgtatatgagacctcttacattttcaccttgatttaggccaaagctccatttcagtgatttatgaaaagttcactttcgagttatcatttggtgtctgcatcgccatttcaaaagcaaagttgatacagaag

SEQ ID NO: 15216 - DNA, 201 bp, Bos taurus
tctgataagtcaaacaaacaagttgtagtaaacatttcagtaacaacttatatttactgttttcaaaactgtctacaattcttagtaaaaattgcgtaaatagaaattcaagaacatattctaactaggtactgctgcaatacttaaggcagatacactgttttccatgaaaacctgggttttaactgacaacattaattg

SEQ ID NO: 15217 - DNA, 201 bp, Bos taurus
aacctataaatatatcttcatagcttctaggtaaagacgtctttttcaaaatgaaatctcatgatttttgattcattttataattatatcagtaaattcagtagtggttatttaacttttttcagggtaattgatatagtggctcttagtggaatctttgggaagtgaactgcctcacaattaataggttaataattaagg

SEQ ID NO: 15218 - DNA, 201 bp, Bos taurus
ctgctgcctcctatacccatatccattatgtcagatattaataatctttctatctcccctgttatctttctttctacttccttcagataagtataagtgtttctcatcctatgatgtctgtattctcttaaaccttcttttcatcagtaaattgctcaggcttcataatcctgtgccacggtcattgttttatgaatcttc

SEQ ID NO: 15219 - DNA, 201 bp, Bos taurus
ccttacatgaggggcttctgacgtggcattactgttactaataatttgtctttttctacgagaaatagatagcaagagctccttggaataccttggtaagcacgtgtgggatctgtacattcatatttggactgatgcatagagaagtttgccacgatagacaaaggaaagggtatgaaaattcagactaacaaagataag

SEQ ID NO: 15220 - DNA, 201 bp, Bos taurus
ggctctcttggatcctcagtagagtgagaaatatgctaacagtagtgttccttgacttgactccatcaccactctaggccagcaatgtttagattccacgggagttacaaatgatgcccatggcaggcagaattccaagaggacccttaatggccatgtccttgagtatgagcaggaactgcaacttgcttctaactaata

SEQ ID NO: 15221 - DNA, 201 bp, Bos taurus
cattcctgggtcctccgtgactgtcacgtgacttcagttctaaatgagatgcagagggtcagagaatcccacactttgtaagttgggagaatcttaaagatcattttcatatgaagataaagagaatggaaagcaatgagataaacacatgtcccttgcagataccaggaatgaaatgtggagaggtggctggatggtcct

SEQ ID NO: 15222 - DNA, 201 bp, Bos taurus
aacaactgtctcatgaaacagagtgagcaaattgcgagcggctggtggtagacaaccagcagcaagctcaccatcgaaggccagtcagcttgacaaagaactgatcaaaggggagaaataccattatccttggaattgattgctacggtcatagcctttggaggacaagtggccagggtatagcatagccatttccagccc

SEQ ID NO: 15223 - DNA, 201 bp, Bos taurus
aaggaacttttcgcctctgctgtggggccgctctgagtgggaggcatggctgccatcttgctgtgctgaaagcatcctcatcccatatctgaataaaggacagagaggcccccgcccaggcggcatgtgggggagtgcgcatctcacaataaccgtatattgtgtgaaagtacgagtgtggacagtctgcacttctcggaa

SEQ ID NO: 15224 - DNA, 201 bp, Bos taurus
atctacttaaataaaagaggaaactgaagagctacagagctgggcaatttcacagcaggacaggagtgggaggagctattggaaagaggctatttagaaccatctagtaagctcagagtagtaattaacatcagcatcccaagaagaaatgaaggtcaagctggtgtagaggatcagacaactgacaaaaatgacctggga

SEQ ID NO: 15225 - DNA, 201 bp, Bos taurus
actctggagagaagagactggttgactcaaggtcactgagatagcattcaggttcgaggaactgggtgtaaagacaggccagctcttcaggttaaagatttccaccctttgttagatgtcaatcatagaactttgcagatcaagagcagaatgagaataagttggccaattccccgatggctccgaggaagagaagacggg

SEQ ID NO: 15226 - DNA, 201 bp, Bos taurus
tatctttaatttaaaactttagtaagtatttataaaccacctatactgggaagtggaggctagtaattactcatactagaattgaaagtttcattttatggtaagtttcacctgaggatatcttgaggccgttagatcaaagtttagatatacaaacatgtttctagaaaatggattatgtcgttctttttttagaaacat

SEQ ID NO: 15227 - DNA, 201 bp, Bos taurus
ccttgtagccaaaggaaatcagcaaagattattgagtatgtgggggaagagtatctgacacgtggtcagatcttccagaaaagcagttggcaagaggcacggatgaaactggaggtagggaagactgagttagagacggggggagaccaatttggatcagaaataatgcagttttgtgtttctcagactcagattcctgat

SEQ ID NO: 15228 - DNA, 201 bp, Bos taurus
ccaagatgtgttgctgatgctgggggcagagctgtgaaggactgagggactatgagaaaagtagtagactaggggctgaaggaaagataaagaaatcagaagagagtctaaggaacttcactgacagcagagcatcagtaaagcaaggagagaatagaagagagagaggagaaaaagcagacagacaaggagagatgatga

SEQ ID NO: 15229 - DNA, 201 bp, Bos taurus
tcaacatgaagcttgcattggcaatggccctttaaaagaaaattaatcatctgacatcttagaatgaagaggttcccaaacaagcattctgagaaaagcttgtcacagaaatatattttggccatgaaaagtaaattaagtatattcagggggagtgaaagtactgggttgattttaacaatgtgctaattgcttttgttt

SEQ ID NO: 15230 - DNA, 201 bp, Bos taurus
acatttactcaatcaaactattttaaaccagcatctgaaagtgttggaagaaacaacccctgattattacgtttccctctttttggccctattatctagggataagaagtaggggattcaatgaaaaggaacccgttagcttgactatcaagtgagaatggccatctaggtaacaccctggacctagagatcacctgagca

SEQ ID NO: 15231 - DNA, 201 bp, Bos taurus
cagcctgccttcctccttataatcagggccaactacccttgcaagatggtgactccccttctcccctgctactcctggaaacaaagaaccttaagtgcccaggccatggccataggttatagctcaatggaactatcattacgcccactggtggaagtgttttcccttttggaaaccaggacatgtaaactggctgagcct

SEQ ID NO: 15232 - DNA, 201 bp, Bos taurus
cagctgggtgccgtggggtgagggtggtggatgtggtgcccgtggggacagaccaggtggagggaggtggtgaggtagacagaggaggcctgtgggctcccaggggagggttcagagagggcaagggtgagggagacggcaccagggaggcttcccagaggctggtgggagaggacccggagctttaaaccctactgaaga

SEQ ID NO: 15233 - DNA, 201 bp, Bos taurus
tgtggggtgactcaatgccttaatccagagcgggctgggctcccggctcccgcgcctgcagagacagacctgtgcaaactttgcaggctgttaggccaaatgggctggattgtacacagaggaaacctaatccccatctctggttctgccccaagaatgtgagctcatcaaatctaatgaagtgaaggcgcgcatttctgt

SEQ ID NO: 15234 - DNA, 201 bp, Bos taurus
acagagtggcacatccttttgccctgaggggctgtgcggacagaggagcatggcagtgagggttttggtgatgccagcacatacaaaggacaatgagcaacggtgctccccaagtccacagcattccaggtccttcatgcatcctggagaggagaagggtggtgcccagtgataaagtctgaatttcctgtcagttttgta

SEQ ID NO: 15235 - DNA, 201 bp, Bos taurus
tctttagcacagaagttggcaaataccacaaacctgcacattttttttttttcccctggagggtctgtcgtcgaggtttttgaaggaggagaagtaggaaaagaaagcgtggatgaacttctgggtagacttttcctgggctgaatccaggggagggggtgggctgcagaaaaatgttcagacaggcctggagctaggagg

SEQ ID NO: 15236 - DNA, 201 bp, Bos taurus
gggaattttatggggtaaaaggcagatgtgtcataagaaattgagggagagagtagagatttccagaaatagctgggccacgtgcagtccctcaggctcccttgcatatggcactaatgtgcaaggaagatatcatgcctatcaagatacaaggccttgggcagagatattagcagggtagtgaagcaaaggcaactcttg

SEQ ID NO: 15237 - DNA, 201 bp, Bos taurus
tcaattattttagtgtacttccatttcttttttttcttttaaaaccagtggaggttatatttaattctttatgaaaatgtaacatatatactgtgattctgttttaatgaactttaattgatctgcttctttacctatcatttatctatctagttaacctatgtgcatttaagcatgtagagatatctagatgatagatgg

SEQ ID NO: 15238 - DNA, 201 bp, Bos taurus
ctcaatttttctgtcaccctaaaatcaatcagagtaaagtctattaattaaaaagaaaagatataaatactcctggctaaagcaggttaagtggggtgtttatatatcttcatcattatcactactattttcaacattcacaagaataaatgacataattcatgtgaaagtacttagaaagcaccacattatgtgaagatt

SEQ ID NO: 15239 - DNA, 201 bp, Bos taurus
tgttctgcttaccttcacagcttgggacagactcagagagaagctgtcctcaagatgcaattgacatgatgttccagctggtcctccttaatccagcatcgcggcatgtaattcagacaagatcaacaacgatgggtcaaacctatgtgttttgatgtccccactgcagaccagaaaacatttgcagctagttttggaatc

SEQ ID NO: 15240 - DNA, 201 bp, Bos taurus
aatatttaaacttgagactctctccaaaatttcaaattacaaacttggtaccagaagctgaaaggaaaaacgagaaagctcttcaaggccttgcatacacaggaatcaaatgattacaaaaataaccacagcagaaggtgccctcagacaggtgccccaaaaaggcacaaactaagctgtgtggctgccctgcatgcagat

SEQ ID NO: 15241 - DNA, 201 bp, Bos taurus
cacaaaataaaaatgggtggatgaatgcaagcctcctgttcttaggaaacagaaaaatgcttgcaattttatttggcacaatttgcagaaagggaccctctttatattagagtgactgaaaatggaaaattgcctaactgttaagtcacactggattattaaatgtattatagtctagacatgctctagagacaattaaaa

SEQ ID NO: 15242 - DNA, 201 bp, Bos taurus
ctaaggcagacacgtgagctcttgtgaatggcagtgattggtatttctatgtttcttcccgcaggatatacctgcacatgagctctttctccccaagagcatgactgccaagaatggtgtgctcttatagagcctgacactcctcaaacacaagctgttgagcctcagacccacaccagccatctcaaggtcgtgtcaggg

SEQ ID NO: 15243 - DNA, 201 bp, Bos taurus
tgaactgatacataccaacagattaaataatgtgtaaaattatcttgtaaactaagatttttaaacctctgaaaaatacctgtttttacataagataatgaaactatttataggacagatatatcccatactataaagcatgcagggaacaggaatatcccttcaaaacctgctgcagtagaggatttgttacactttacc

SEQ ID NO: 15244 - DNA, 201 bp, Bos taurus
tggcataaaacccatgtgccacaactactgagccagcggccccagagcctgtgctgtgaaaccagagaagccactgcaatgagaggttcacgttccacacgaagattagcccttgctcaccgaaactagagaaagcccacatggcaacaaagaccccacgcaaccaaaaacaaataaacaatacaaaaattaatgccttcc

SEQ ID NO: 15245 - DNA, 201 bp, Bos taurus
tcattggtttaattctaataacacccctcaccaagaacaaaaacagtccagctcacactttcccttaaaaaggtgcagccatcgtttcttcaggccctaacagggtcatgagcaaggctacacaaacacagaaggaaatactttacagctaatgggctgatgttacctgaggcagcggtccccaacctttttggcaccagg

SEQ ID NO: 15246 - DNA, 201 bp, Bos taurus
aatgacggattccttcttagtgatgattgggaaggtcctccatctgaacgatgggggacattccatgattacatcctggttctgctctcaagaatgaataaccttttgcattaatttctgtggcccttggcttacagtctcttccttgttcattatcctttatgcccacgtctgaagtggtccttgggaagtaagccctac

SEQ ID NO: 15247 - DNA, 201 bp, Bos taurus
aaaagtgacatgaggcttcttaacataataatagtttagattttgctttgagctgatctgttttctagcagagttaagaggttttcaactaatattgagaattgccagatagttaagacagctaagggcttctcaagtgataaagaacctgcctgccagtgcaggagacttgggttcaattgcttggttaggaagatccct

SEQ ID NO: 15248 - DNA, 201 bp, Bos taurus
tctggtttggggctgttataaataaagtggctgtgaacagtcccgcacaagtctttgggagggtagatatgtgtccttctccccgaccttccccttcctcgtctccatcaattcctaggattggacctgcctgatcatataaagttaagcatgacgataagaagatactaaaccggtttccatagtgactgtaccattgtg

SEQ ID NO: 15249 - DNA, 201 bp, Bos taurus
aatacttaactcagttgctttctctggcagcacacacgctaagacgtgaaccagacagaaaagacggacacagcccccacgcaaggacaggcaggcttgtgaggggcttagggcttcagagatttcaagggaagaaaaaagtaagaaaatcctttcattaaacaaaacggctacacgtcagaacatttaagccagattttc

SEQ ID NO: 15250 - DNA, 201 bp, Bos taurus
agctggattatttccgctggattattcggtcgtgtcttcaccgccggctccttgtgtgcgagcttacccagaggcagaggtggacacggagcacacgcatgtaaacactgcagcccagatcagcgaacgcaggcgatggagaaaaacgatccattcctgtgtagatgtggttttaatctttactgcaaatgggcaatctga

SEQ ID NO: 15251 - DNA, 201 bp, Bos taurus
tagtgtcacatacttgcctgtggaagccagatgcttcatcctacagtgagctggggaaacaaatgatgcttttagcattaattagatggaagctatcttgggactgtggttttgcagggacccattttgctcacataactttcatcattatgtaaggagctgatgatcccatttgcagataccatcttctgatcatgagat

SEQ ID NO: 15252 - DNA, 201 bp, Bos taurus
gttatgttggaaatttgattggcttgactttggtcaaattccagctctaaacaagtgtgtgaccaaagggtctgatacgatgactggtacattgagggagttatttctgtgtcagaaaaggggagcagaaaataataaatgtcttcacatttgttactatttgagaatttactgtattattaatatttacctgtcttacta

SEQ ID NO: 15253 - DNA, 201 bp, Bos taurus
tcttctttagctgttgcacacttttaattatgacctaagaaacagcataaatcccaactgcatctttaggagaagtacaaattcaaaaccagtgctactcctttataatagaagcagctgatgtatatctatatgtgaatatctgtccatcatgtatctatcatacatcaatttattccccccacacccgccacccccctc

SEQ ID NO: 15254 - DNA, 201 bp, Bos taurus
gcagaatggtgaacaaactgggtctagaatgaaactaagaagaaacaaaaacaaaacccactcacgcttgtcttaactcttgacaagttatggtagtgcttggagcttctggttcttattggtagagttgggaggtaataatcgtgtctactttacaaggtcatatatagataaatgccatgatggggaagatattgtctc

SEQ ID NO: 15255 - DNA, 201 bp, Bos taurus
aatcacatcaaaacaagcatggagaggggctctgagcagacaagtggacagtggtattgaagctgcatagatttatggcctgacaactctcttgttagatgtgtaggtcctaggtatgactatcagttcggttcagttcagtcgctcagtcgtgtctgactctttgtgacccatgaattgcagcacgccaggcctccctgt

SEQ ID NO: 15256 - DNA, 201 bp, Bos taurus
aggaataggtggccccctcttctccttccttcttccgctctgcttcagccacaccggctccttgctctctgcgaatgtgtcaggcacattcctgacttaacggctttgcatggcctgaagctacctggaagtacttctcccaggaagccacctcacctccttccgctacttcagtgttttgagcctcctcttggtgaggtc

SEQ ID NO: 15257 - DNA, 201 bp, Bos taurus
atttagctcaagaaaacacatgattagagtgtaaacagagctgccctccagataggaaggggctttctttctgtggccagcagctcaaaagcaaggcagggcataaagggactgagcaaagctgattcccagccaccagctggagtttggggtgaattctccagggattggggaaggactctatgtagggttgggtttaac

SEQ ID NO: 15258 - DNA, 201 bp, Bos taurus
gcaaagatctgagtgtccagtaactggtttagtgaatgctgagaggcagaaagcagattatccattttgctcctgtatgtattgtaatctcagcctggctctggagggcctcattctgatgccagaatctaaaccccagatcatagccaagacagtgtggtcttggagcagcagttggcatgaaacttcatgactcccagt

SEQ ID NO: 15259 - DNA, 201 bp, Bos taurus
caatcagagtccatcagtgaatgatactgttcagttctttcttttccttgttgattttctgtgtagcagtgacttaggggtattgaagaactccacttatctgcaggtttgttgatcttctcttttcagttttctgagtttttgctctgtgtatctttaacttgtgttattttgtgtatgcacaattaggattgttagaac

SEQ ID NO: 15260 - DNA, 201 bp, Bos taurus
aggctggtccacagctacacctatggtggtaaacctggctcagtgtcagaatgaaagagatgcagctacaacatcctcaaattttctttttagaatgtcccacggcctgagtttttgcaagccctgagctgctgtcaatccatggttgaactcatacatgactaaagggccacattcactaaagttgactaaaacatgatc

SEQ ID NO: 15261 - DNA, 201 bp, Bos taurus
tgtatgaccaattcaactaagttttagctcagaaagctattacgtattgggcaagtatattgtaaccaaatgtaaacatggttcctagacatttagggctacttcttacctatgcagtactcctgtacagactaggaaaagatgcccctttctcaaataaaaaagtgcttagataattatattatgatgtaacatgactaa

SEQ ID NO: 15262 - DNA, 201 bp, Bos taurus
agtctgatgaaactcgcacttatttttattaaaacctttcaacagaccatgacttatatttagctccatcgtaaaatctccaggcagaaaacattctctatgtggaagatttcaaaaggatgatcagttttgatgtgattgagctcgtattttctgtctttcatctctgtagatggtcttggaaagacagacacattttga

SEQ ID NO: 15263 - DNA, 201 bp, Bos taurus
acacacacacagtaaaagaaaatatttttgtatctatagcatatgaaaattttaaaaaactatctaaaaccatacatttctgcttcagtttattctccttatgaataaagtctaagtattataactagtcatttatcaaaatattagcatttcatgatgaataacttagatttgatgcacaaatatgatagaatcctgaat

SEQ ID NO: 15264 - DNA, 201 bp, Bos taurus
atttgtaatctatcatatcaggtacaattatatgtgcatataaatatgtataagagtgtactgcatgaatactgagagtataattccttaacttttattaagcatgaacctagggcatgcctaaattaaatccatattatgaaataatatgcagcagttaagtacagtgacatagagacacaggcactgaacatggaaaga

SEQ ID NO: 15265 - DNA, 201 bp, Bos taurus
atgttttccccttccatatgcactatctcttcaattagagctgaaatcacataaaaccaataaagtatgtttgggtaatttccagaacatcgagtagcagcgatcagaagggaaatatattataatgagaagggaaagatactaggttcaatgagaagtatacaaagtgtatttggttaggaagatcatttgtgattatga

SEQ ID NO: 15266 - DNA, 201 bp, Bos taurus
tttacagtcgaaaagcaaaggaagagtttgatcagcactgagaaactcagtttgtatgtaggggggaaaaaagataatgtttttgccaatgctgttgctatgcaaccactgtaatatgacaactagcactaaaatgaaatgtaacttcataagtggaggatggtttttaaaagaatgtggttagagactgttaatcaaagg

SEQ ID NO: 15267 - DNA, 201 bp, Bos taurus
gttccttcctgcctgcagccttattttttccatctttaacatatggaaaactggaatttgcccaatctacctaatgggagtgctgtgaggaaaaactaaaataaaatgaaataatgtggatcctatgtgaaaaaaaaaaaagtggaataccatccacatgtgacagggacatgtctatttttccagggctgtacaggggaa

SEQ ID NO: 15268 - DNA, 201 bp, Bos taurus
gcaaggttctggtcctcctttccctccctgccatctctgaatccctggacacatgacttaggtcatacatagacatgtgactagaccatacagtacctgaaaaatctcctacccaaccccagtatcagcagaaataataaatctgtgccaaaagggaaaaaaagccatttctatttgattttggaatatatttttaaatgt

SEQ ID NO: 15269 - DNA, 201 bp, Bos taurus
aaatgcactttaagacccgagtcattctttcagttcatctcaccaagccatcctctcaccacatcagagatgagctggcctctccttgtggttcagatcagatcagtcgctcagtcgcgtctgactctttgcgaccctgtgaatcacagcacgccaggcctccctgtccatcaccaactcccggagttcactgagactcac

SEQ ID NO: 15270 - DNA, 201 bp, Bos taurus
ttttactcctactggccaagcgtctgccatgaagactccccaggcgtttatcaaccccctgaaccctgcacacaccagactctactgaatcagtttacacacaggtgctgggaggccatcagcctgtgcagaggccctggcctagaagcatggggttcgaagtgcacctctggtcctttctgagctcttaggaacaagcct

SEQ ID NO: 15271 - DNA, 201 bp, Bos taurus
aaaagttcagaactttcaaagtcaatcaaggtcatctgaattaccatggctctatgggtgaaagagacagtaaaaaggcccaataatatcattacaaactataatcatgatgcttcaatgaccaaacacagacataatcactgagaagcaaaggccacaaagaaacgatggctaacggataaccaaaatagtaagaaaatt

SEQ ID NO: 15272 - DNA, 201 bp, Bos taurus
tattcggcctctgctctgtggatctcacttctgaggatacagatattctgactttagctgcaatgtcttagagcagaaaagcacaccagtgtgtaactctgcatggccacagaaaactgccccatgacgcagaaacttgctgaatactcccttttatgccttaaaaatgttacttaagtgattgagtgattctctccccat

SEQ ID NO: 15273 - DNA, 201 bp, Bos taurus
gacgtcagtttgagcaaactccaggagacagtgaaggatagggaagcctagcgtgctgtagtccatagggtggcaaagagtcagacatgacttagcgaccgagcaacaacaataacgctcaaccacaatcactgctgtaacgttcccacggggttgagcacatccagttcctaagcgaggggtacggcccgaagagactgg

SEQ ID NO: 15274 - DNA, 201 bp, Bos taurus
ggaacagctggctccccctctagaggaaaggggacttgcactggtaaaggattttaacagaattcagtgacaccactaacgggaggagaggccaagttcctgagaccattaagctgctggcaagttaggtctataaagcgagtggcagaacaacaatctcagttttgctttagtacacctgcattacaaccactgggttaa

SEQ ID NO: 15275 - DNA, 201 bp, Bos taurus
ctgtgggcagattgctgacctccagcaggggcccctctgctctgcatcgctgccagtcaaggagcccctgccctgggacaagcctgggccagctgctgtagacacactaacggtgacccttgcaggtcctctcacatcagtgtgtttacagagcggggaggagagaagtgaggcaagctgccgtggtgactctgcaggtct

SEQ ID NO: 15276 - DNA, 201 bp, Bos taurus
ctattatcatcttgtactcaccacgttttcatcttcttagtcccaagcagctgatgtggtccctgcttctctataattcccttgtcctgataaaaataacgggccatgctctgtcaaaccctgggggatggacagtctggaccaggagagtgtaactaagctgtcaccacacacctaattggaagattcccaagtgctggg

SEQ ID NO: 15277 - DNA, 201 bp, Bos taurus
atttaccacccaagcccaagagctattggaaatgggcaataaaatcaagttttagtagaagtacagtataaaagcaacagtcatcctgtgacttcctgcccaatcattggcgcatagctgctaatagacaaagctggctgttcacggtttgcagcaaacaagaactgtttgctctcctggactcaaaacacacttcctcct

SEQ ID NO: 15278 - DNA, 201 bp, Bos taurus
ctaatagacgcatgcattcctgaaccacattaggtaaaagtcccttttggcccttaatcggttttatgtagtttcagcctatttaattccatttcttgtccgtccgaaaaatgtattccagatgttttcgtggtttgagctccaggaaagccagtgtggaagaacgctgggtcagtgaatagaaacaagggaatactgcag

SEQ ID NO: 15279 - DNA, 201 bp, Bos taurus
cctggctgtaactccacctttgttctcgctaacaaacccccagttaacctgggtttcagatggtctgtgtttgagggaaggtgggttcgtccctatcctgggcatgaatcttgataagtctagatccattagggaattctattccgttctccaggggctggcttagataaggctcatgactcagttcttttcttaatcagt

SEQ ID NO: 15280 - DNA, 201 bp, Bos taurus
aaacaatattgtaacaaatttaataaagagtttaaaaatgaaaaagatttccaagacccaaggatccccaagaaggactggtgggcagggggcccttgaagagaccttgtggttttgaacatggttaagatgacctagagccagacatcctggaatgtgaaatcaagtgggccttagaaagcatcactacgaacaaagcta

SEQ ID NO: 15281 - DNA, 201 bp, Bos taurus
cccaaggcagggtaacaaagttgtggaacagatatgtctcaattaagaaagtccctctgataatcaaggtaactgtgctatagacaaagcctcaagtcagtaatcctcaggaacacaggtggggccacctgagttcataacgacacaaacagaagagtttcatgctcagcacccctcccccacccaggctggctttagcct

SEQ ID NO: 15282 - DNA, 201 bp, Bos taurus
agcgtcctcgaagaacgaaaaagaccacagaaatcttaaaatgctacccggtgcccatccacttccagaacgcctccatactgaattcccagtactactttgctgcagaattcccagccaacagcctccaagcggctcagccctttactattggtgataataagacttacaacgggtactggaacacccctctccttcccc

SEQ ID NO: 15283 - DNA, 201 bp, Bos taurus
ctaatgaaataagtccccacttctcagttgctggggaggaaagccatgtctaaggccctctcccagtctgccagcggccacagcagcctatcaggtcatctcatcacaacgtcaagaggtgaactctgaaaaagacctaaccaaggtccaaaggctgacttgtctcaatgtgaaactcttttctttgtgattaatacaggc

SEQ ID NO: 15284 - DNA, 201 bp, Bos taurus
ttgtctatttccctgtgttctctcctgtgctgaccggcccctggcagcgaggcgtccacgaaatccgagagatcagacagttccacttcacgggctggccagaccatggggtcccctaccacgccaccgggctgctgggctttgtccggcaggtgaagtccaagagcccacccaacgcaggccctttggtggtgcactgca

SEQ ID NO: 15285 - DNA, 201 bp, Bos taurus
ttgattatttgcatcttcaaccccgctgtcatcatcttggaaaatcaggttgagtcttttgaggatgagagccaaatagcatcagggaaaaaataccaacaaccccgagaaaaatgaatatatctggatttatctggaacagccattgagtttgaattttactttattttttggttagataatccctaggaggtgatactc

SEQ ID NO: 15286 - DNA, 201 bp, Bos taurus
acacgcacacaacaataatgtgtgcttgctcgcagtttgcacagcagatagccgggatgcggttctgtgaagcgagtgccaaggataacttcaacgtagatgagatcttcctgaagcttgtcgatgacatcctgaaaaaggtaaaaaaaaaaaaaaagaatccgtgtcctgacagcatgttacctggaaccgcttcgtcat

SEQ ID NO: 15287 - DNA, 201 bp, Bos taurus
gccttagagttgtcttattagcttgggccatacccagcatttagcttttttgaggaacctctctttttaggccaaagggccacagtgagcacttctctaccggactgtttggggtcccatagacccccccccccccggcagtgtttaatctgtgggaaatgtcagttgccatttcctgtggtggtcatggccgaacgtttc

SEQ ID NO: 15288 - DNA, 201 bp, Bos taurus
ttgaatctctgacttaggatgagcctctgagaaaggagtgggaggcctgagcccccagggcgcttccccttgggttggccagtttttgtgcagagaaaagactcgtgtgggaggcttggctctgagttttcccccagcatcacagatactctcctctatgacccacagcagaatggccgggatgagggaatgtccaaaacg

SEQ ID NO: 15289 - DNA, 201 bp, Bos taurus
gtagttgtggtacacaggcttagctgccccacggcctgtgcgatcttcttagaccaggaattgaacccatgtccctttcgttggcaggtgattcttaaccgctggaccaccaggtgaggccagcaattagttttgatattagcccaaacaaaacataattcagaggagaaatcaccctcagaacattacgtatgtgttttc

SEQ ID NO: 15290 - DNA, 201 bp, Bos taurus
tttcatgggctttactccaacatggggaaaccttggaaatgaaatacatacattctccttgccctacgggccttgtgaggccacacagcctcatgtgaacttccaagggttggtcggttggtcagcaggagcactgggaacgccgtgggtagaggcctacctatcggccccaccctgactcaacaggcagggctgctggag

SEQ ID NO: 15291 - DNA, 201 bp, Bos taurus
catcccaggagctccacgcggcacaagccctccaggaaagacacctctgccctccgaagcctctgtccactccgagcccagcatttatgtttcaaattccgtgacccgtggctactctgacacccaacacgtacccaccctagcacaagtaatatggcaccgtgtctagcgtcacctcctatggccacacaccagttcatc

SEQ ID NO: 15292 - DNA, 201 bp, Bos taurus
gattttaatgaatactgagattgagattttcccagcataaaatatgataaaggtaatactaaaagggaaaacaacagcctaatctcacacgtggatatagctgcaataataaaatattaatatataaaagtcaaccatcataaaaatttcactaaatagactttattgcagcaacacatgaatgagtcccccacagaaaag

SEQ ID NO: 15293 - DNA, 201 bp, Bos taurus
gctggccttcaggccgctgcaggctctgtggcccaggacccgctgcgctggcccgcaggctcagcattgctctctgtcctgtctgcatcagagtggccgccgtgtcggaagctgctctgcatcagttccgtgtcgaggaagcaagtcccacagctcagaggaacgagcacaggggccgggtctccacgtgtcagcctaggt

SEQ ID NO: 15294 - DNA, 201 bp, Bos taurus
gaactggactcacatcccctccaccctgctcagagaacagaggccatctcagatcatcgggagaaagcttggctcagttcatctcattaaagagttgccttaaacactcccaggcagaggcccaagggggcttggcctggaacagatttaattcttttatttagtgcccctgaggatgtgggagtggcgttcacctggcct

SEQ ID NO: 15295 - DNA, 201 bp, Bos taurus
gattccccatctctgagcctctgtctcagggcccttttcctggaacagatgatagcagtcccctttgacctctgataagctgactgccaagtcaagcctatagattaaatggccaagagacaaaggagagggagggagaaacacaaatggccccttaaaatcaaaatgaaaactaagtatttatatttggctttaagctta

SEQ ID NO: 15296 - DNA, 201 bp, Bos taurus
agagaatgccaagttttgcctcaggtcgttcctgaggcggccgccaggtggcgctgcggcgcgggaaacctgatgaatgcggggcggccgctcccaaaccgtggtcctcactgcctgccctccattaacagggaaaccggctggatctgagctcccaggtgtgaacggtgatgctgggagacagatgaaggcgatggatgg

SEQ ID NO: 15297 - DNA, 201 bp, Bos taurus
aactcattgcaaaatgcattgtggcaattgatgagttactaaacacagtgctgtgaggaagcctgagactaagatagaggggagagcccccaggaacactccaggcacttcacacacagggggctcagaactgacttaagctaagatgttccttgttcagtgacaactatcagcaacatcataaaccaggggaaaacagta

SEQ ID NO: 15298 - DNA, 201 bp, Bos taurus
ccccacctcaggataactcggcctcagaggaagtgtgggctgtccaccctgagcacctggtcttggttgctccttcatgtgagtgtgtccccaacgccaggacaaaaatctgtctggggccctggctgtccctgctctgtgcacacagctcttgtagggaagaccagaatattgtcctaacatgaggccacggaccccagg

SEQ ID NO: 15299 - DNA, 201 bp, Bos taurus
ggcctgggggcatgactgctgtcccctggggctccccactgtccagctccacccccagggctttgtggttgctaccgagacccctctccccagggctgtgcgtccatcactcacttcactcaggcctcgtttgggtgtcctgcctgtccagatttcctccacggcccaggacagcgagcataggacccagggagcacaggc

SEQ ID NO: 15300 - DNA, 201 bp, Bos taurus
atgacaagaatactgaagtggcttgccattccctactccagtggaccacattttgtcaggcccttactagcagggacaggcctttcagctgctcaatattgctggatgatgtccctggtgccctggctgtcccactgttcgtccttgttgatcatgtaaaccttcactggcaatctggtgtcagtcaacgtgcagccagtg

SEQ ID NO: 15301 - DNA, 201 bp, Bos taurus
taagattaaaactatttgaattgtgaattttttatccaatgccataatgattattaacctgctgtccaaaccacggagaggaaaaaagtacagctttttgttataccttagttttttaatttgagaagtccttctcactgtcctcattaataccaaactttatagagattatcgtctagttcagagactctaaagataaga

SEQ ID NO: 15302 - DNA, 201 bp, Bos taurus
ggatccaggggccttcagaataggtaacttaaaattgcatggaactaattttcagatgaaattctttgccagcttcagactttcagtgttttaggatctggttcttagataaacagaaagtggcctattagggaaagtagataagaattcctgtcatatttagctagaatttgaatacagttcccactccatcaacaagca

SEQ ID NO: 15303 - DNA, 201 bp, Bos taurus
gtgggtattggacaaggtcagcattttacaatacgtggtctgtggaacacacttattcagaacattaggaggtattggaggccaaaaaagattccatgagcgaaacgattaagaaacacctggttaaacgaagctactttgggagatagtgaaggacagggaagcctggcctgctgcagtccgtggggttgcaaagagttg

SEQ ID NO: 15304 - DNA, 201 bp, Bos taurus
aatcgaaccaaggtctcctgcattgcaggcggattccttaccaatagggaagcccacctattgaataagggtccataattatccatttgtggcctacagcgattttttaaaaagttgtagactgtagaggaagcctgctcaccaagggctcctaggtttgcggcctacagaagagactcacccagctctccctgctggtgg

SEQ ID NO: 15305 - DNA, 201 bp, Bos taurus
gagaccatctttttattagctgccagtgttggatagagagggaaggtatttttggatacaaataaaaactcctaagccaagctcacacagtcaaggcctccacaaggtttacctggcttcagacagacctgagccccaaacctctaagcattattgtctgaatgctcctactccatcccagggttctagcgggctgaccag

SEQ ID NO: 15306 - DNA, 201 bp, Bos taurus
cagccaggcctgctggagcagggccaggcagccccatagatcccagaccagacccagagcctttgaaatacagctgcctcttcctgggcctgctccccgcgcccctgtggtgtcatttccaaatccattacattccaatggctttgggatcttttaattacatgtgacgaagcctcgccattgctggaattagacggcctg

SEQ ID NO: 15307 - DNA, 201 bp, Bos taurus
agccacacataggccagtgaagagaagtgctcaattcctctcctccatccttcacttgattcgtggaagtgggaggaggaaggaagccaggccaggggtgggacagtgtgaaggtcgttgccccttcagagcagagacaactggctccggggcgtctatcggcctcgcccggtcgatctgcctgcttcctcagcctttcct

SEQ ID NO: 15308 - DNA, 201 bp, Bos taurus
tccacagaattcctaatgtcctgtatctggagttaacaagttcccaggtggtactgacgttgctggtcctggggccatacctcgagactattatattagcacatgtaattttcatatggcctttttaggataatgttacattataagtacatctctgtatcattagtcttcataatttttgatgactgcataatgtttaat

SEQ ID NO: 15309 - DNA, 201 bp, Bos taurus
gtacaggattcgtgcataagtaataataatcgcactcaagcatgacacaattctccttaaactatgaccagtacaatccatttaacatttgtcctaaaaacgctatttccaaaaatccagaaacctctctaaacaaatgcagtggtgacacattccgattctaacgtgtttgtattagaattgaaacactaaaagtacaaa

SEQ ID NO: 15310 - DNA, 201 bp, Bos taurus
ttttttatcctttatggccacatcatatgggcataccatgatgttctatttatggttgatgccagtgtttgtgattaatatggacatatttaagtggtttcgcctgcaatactggttgcttttttaggaaacagaagccactgtaaatctcaatacttaaaatttaaggaacttgaaaggttgatgtgtcatattgaaaga

SEQ ID NO: 15311 - DNA, 201 bp, Bos taurus
aaaaatgaagagagaagtggtggccctgtgtaagaaggcttgactggcactgttttgtcctcagccccgtgagctaggagccccgtgctcagccaccagcgggccaaagcagagctcgattcaaatctagtccagcacacttgcagaccattatacactgtgaagtatttccattgtgctcattgctttcaagagtttcaa

SEQ ID NO: 15312 - DNA, 201 bp, Bos taurus
aataggcattcagtaaatatctagtgagtggataagccaagtttaaagtcaaatgcaattggccaatcaaatgcatgtggccagacagcaaagagctgtcgctggctgtctccatcctcagaaccactggggcagagctgtgagggagataaagtcaggttttctttcccagccttgccacctcacttggcctctcaatga

SEQ ID NO: 15313 - DNA, 201 bp, Bos taurus
tttgtacgtagtggaagccaggggccattctgaagggcaaacccaacagagctctgagaatctggtttgcttccagaccaaaaaatttcctagttcatggggtttccactgggcctcaggatgatttcttataggcacttaatttcctctagagaaaaacatctctttgccttaaaggaatccctatctccattagaaaca

SEQ ID NO: 15314 - DNA, 201 bp, Bos taurus
aatcctctagatgggaaataaagcatgtaaacagcgcacctagaagtcccaggggctctggcaagttcaaggtggtcgtgtaagtcctcccagagaagagctgatgtgcagtgagcgaaaggcttgggaacagtaatcacaacgtccagcctctgaagcacatagagtgctcagacagtctgtggtctgtcatttcatcca

SEQ ID NO: 15315 - DNA, 201 bp, Bos taurus
ctccaaggactgtgcttgcccgagttcaagaccaaaggaaaacctaggagtcagaaacagaaataatgatgtaatggatgagggggcaggaacaggaatacttactgtcaaaagcaaggccctggagtgacaccccaaggtgggcaagatatggcagcaatcttcattcctggggaatggtggggttggcgggtagggatg

SEQ ID NO: 15316 - DNA, 201 bp, Bos taurus
tactctgaatctgagctggcctttggacttaactttgatcagtagaacgtggaagtgataagtgcaagttctggaacctaggtcacaataggccttatgacttctgccttttccttcttggaacacttgccttaggactgcagtagaatgaaaaagcccaggatgagagaccatgcatggaatgaaaggccctgacagctc

SEQ ID NO: 15317 - DNA, 201 bp, Bos taurus
cttggctttgggacaaggaggtggccttgtttatcaagtgcttttgtccaagctccactccaaatagcccctaccctttttttttttttttaacctgagatcaaaggtaaaggaggccgtttagggtgcgtagctgctagggatttgcctggatcaacttaagctaacattttggcttcttgcaatttggtttctttcgat

SEQ ID NO: 15318 - DNA, 201 bp, Bos taurus
attttgatcacggacagagtatttactagaagtttcccagtaccatcagttcccctaaagaatgttcaaaagtagggaatgtatattttaaatagggaaagtgaaatgcttaaccatccaaagtgagtagctaacagtgaaatttccaggaagcatcagcagatagagaatataggccaatggatggacaagactcaagag

SEQ ID NO: 15319 - DNA, 201 bp, Bos taurus
atcctacaggcatgtgccaatggccctcttgtgcctgatacagagttgggctcctgggtggattcaagagcaaagagatggtctccgccttgagtaactgcaacgtgatgcaaaacaggccacagagctgtgctgtggggacacacgcacacctcgggttcctggcctccagcccctctgccgggacacctgctccctcac

SEQ ID NO: 15320 - DNA, 201 bp, Bos taurus
tcttccgaacaagaccctaatgatcccctgtgtctcagcctgtgcggtcccctctgggcaggaagactctgtccccttgtccactgtggatcctggagggcggccagtggtggtaacttagggtccactcggtggtctctgtttagccactgggcagagtccagtgctcagtgttcacactcaggccagagcctccattca

SEQ ID NO: 15321 - DNA, 201 bp, Bos taurus
gagaacgtcctcttttctcaatgtttctgtaaattcctgggcacgtccctcccaccctgtaccctactcagtgcccagaaagcatctccgggcccagccaatgccaaagcacttgcacgcagtcaccatttccgagtgtttggatccaccttaaaccacattttccacagccagaggaatgctgagaaccaggtttccaaa

SEQ ID NO: 15322 - DNA, 201 bp, Bos taurus
ctgtgtctctcatgtcaccctgtgattagttagactgtgagaaacaaaggcccgaaatgtgatgacaaacactcatgagtctactcactcatttaaaaacttgttgtgaaggtgggcagtctgaggccagtgtggcagctccatgaaatcgtccactctttcttctccagcatcctcaccacaaaacttcatcctcaaggt

SEQ ID NO: 15323 - DNA, 201 bp, Bos taurus
tgattcaatcattgtatatactgttaagtggtcacccagacaagttattattgctatttaaaaaagtttatttacttatttggccgcaccgggtctcagttgcagcacacaggatcttcttagctggggcgtgctatttctgtgtatggtatgtggaatctaattccccggccaggaattgaacccgggccccctgcattg

SEQ ID NO: 15324 - DNA, 201 bp, Bos taurus
ccctttcttactgttcctgggcatctcacctctcctgtgaagggagcgctgggtgcaggtcccacagcagaggtgctcaggaaggctggccgctataaagttgagggtgacctctgtcgaagcagagacgtctcatccaggggctgaggcggcacgtggtgtgcagaagcctcggcctcccctctgtgcctgcctgtctgg

SEQ ID NO: 15325 - DNA, 201 bp, Bos taurus
catggggaggtgggtgctttgcccaagctgcccagctaattggtacagtgagccctggatttccaggggggttgagaggaggccctcagaaatgccctgactgtggagtgagactcagagacccatctaatagcccagagaaagtggttttcccatggccctctctgctgccctaggatagaggtgggtggaaggagccca

SEQ ID NO: 15326 - DNA, 201 bp, Bos taurus
taaatggcccacaggggaaagtcggccagtgagtttcagaactgttgagagctctgactttactgcgcgactccttgaaggagccagcctgtctattgcttatcgctgctgggccagccagccccgagcaaacagggcagctgccagactccattcacagctcgctcaagtgcgattacgagggcttcacaagcatgtggt

SEQ ID NO: 15327 - DNA, 201 bp, Bos taurus
acatgatcagattttaccaaaaatatcccaacagcactgtactgctctaaccaaatagtttcagtgacaatctaatctatgttttatattattttattctaaggaaatttaaaagaccataaaattttcagtaataggttttgtcattaacttcacaagtttcagatcagatctgatctgagaataaaataatataaaaca

SEQ ID NO: 15328 - DNA, 201 bp, Bos taurus
tcttgtctctctggtgatggcccttcctggtttcttcctcccttttgctgctgaaatgcatctgtgctttggaccaagaggcggagagtcgcaccctagagatggcggaaggctcagaggaaaggccttgagtcccaccagcccgagaacacccatctgtggactttctatttccttgtgagatatttagttgcagctgaa

SEQ ID NO: 15329 - DNA, 201 bp, Bos taurus
cttcagtcctggctgggcagatgtacggggtctgatttctctgagcttcctgtccctcatgaaaagaactgggtgggcccagcttcccccagcctgctgccgtgtgtcactgagcagccgtgaggggctcagcacaggggtggtctgactctggcctgcagtctgcgtgagagctggctcaggaaaggacacactggctcc

SEQ ID NO: 15330 - DNA, 201 bp, Bos taurus
tttacaacacagtgaaaaatgacaaggtatggacatgccaactttctttctgaggaattctgtacagagatgaatctctcaaggacacagcaacaaacattgctggtattaatttagtcccaaatcaacataagtgatttttatctgagtagcacctagaggcttatactgaaggatttctgagaaggcaggctgaaaata

SEQ ID NO: 15331 - DNA, 201 bp, Bos taurus
ctccaggagtgttgctagctcagcactcagctggctccaagctttgctgcatttattattacaaagccatcacgacagcatgagaaaatgtgcataaaatttaaaatggcaacaggctcttaaaattttttcatagcacttaagaccctttaaattctccaccttagtcagagttagcagtaggctctgcactttaaaagg

SEQ ID NO: 15332 - DNA, 201 bp, Bos taurus
ggtccgcacggcggccctcagtcctgccggctggaggggagtgcggtgggggacgctgagtcagctggtctgatctgaggcccctccagatcgccttctgtgtggggagcaacggttccactggaagcgtggggaaaccagggaagggagaggaagagtggaactatggccccggggaaagcaggagctagacccagggct

SEQ ID NO: 15333 - DNA, 201 bp, Bos taurus
actgtaccactttcccaggccattttttccctcctacagatacttaaaatccgtctacccaaatacacacaattacaaaacaataaaatgtcagagtaggaaagaacctccccaaatcaggaaggccacaggttttccagagtatggcttgtggagtcatagttacaaagaccagtaattggctgtacccaacacaagtgc

SEQ ID NO: 15334 - DNA, 201 bp, Bos taurus
ctgcctgaaaccacaagatggtttgtagtgatggttttaggttttagatgaagaagacaagagatgttcatgcaggactcagaccgcagaagctggccatcggggcttcaccactcctaaccaggataacttttgcattattacttgtattctagtgatctttaggagtacttaggtctcacccctcaccctctatttcag

SEQ ID NO: 15335 - DNA, 201 bp, Bos taurus
ggcatggcccaagcatcaaccaattcgaaaggaaactggcagagtcctggaggtgccctgcttgccagaagttgatccttcattgctccatcgtagggacgtctgggagtatctgggaatgaggccaaggtgatgagcgagggaacggagctcggagcagcggctacttcccagccagtctgcaggtatttccttactgac

SEQ ID NO: 15336 - DNA, 201 bp, Bos taurus
ttcagcagtcatggggcgcttctggctccttctaccagcagcgacttccttccgacacacaggcttccttcccctggtcaggggccttcctgcatcaggagccctgaatgaccaccacctcctcccgccgactcctccccttctcgggacccgggagagaggggtttctaacacctgcagcccaaggcctgacccctccca

SEQ ID NO: 15337 - DNA, 201 bp, Bos taurus
ttgtttgttttctcctttctcctcagttgagttgtgagctgaaacagttagaagtgtcatagaaaccttcctttcttgtttcccaggcctaacacttaaacattttctccacttacttccttttcctgaagtttgtttattaagggaaatctctggggccagaagatgctattcagagcaaaaatgaagtatgtatttgaa

SEQ ID NO: 15338 - DNA, 201 bp, Bos taurus
cctggaggtttgggccccagtccacagagctgggcaggtactgtggccatgttggtttgtgaggtttggggacagacgtgaatgggtttctgccagctgccggggcatctctctgctgtggccttgtcattactgtcttgcccccatccccccaaattttgaaccacaaaagcggccttaattacagctagtacccccttc

SEQ ID NO: 15339 - DNA, 201 bp, Bos taurus
tgaggttgttggttcacagactgcacttggaatagtgaggtctggcatggatggttctgaagtgcctggaggctggctgcccttcttctataggacactttcaggcctcctgatcatcactcttccttagctgctccatctttctgtgtccggccttctgattttttgacatttcttatcataataaggttttctctgatt

SEQ ID NO: 15340 - DNA, 201 bp, Bos taurus
agtccctgcctctcgtgttcctcctcctttttctgggaagacactgagtgagagagaaatcgtgctgcttccagtggcctctggcacagaagtttcattgttgaaactagcacctgtgctgtacgggctgcctttcaagaaactgcacccaggccaaggctggaggagacttttctttacccaccaggcaaatgctggctc

SEQ ID NO: 15341 - DNA, 201 bp, Bos taurus
ggaataaaaaatattaaaaattttccattaaaaaagtagggatagaaagagtctttaaacacaaaagataagtcataagggaaaggataaaaatactgctttgaaatttagtgttttatatccccaaaatactagaagtttaagatatttataatacatacaagaaagaaaaccgtatgtccctgtaacttatttatttta

SEQ ID NO: 15342 - DNA, 201 bp, Bos taurus
agtttcagtctgtctgtctttagttcattttgtaggaaatgttgtcctgtggccctttagtgcctcacaggaagactgagagagtgctatattatctaatcagagtctctgagacctacatgtggcctctggccagtgttggcaaataacttctttccactgtttcggatgtggtggattgggttgctgaagaatatctaa

SEQ ID NO: 15343 - DNA, 201 bp, Bos taurus
gcctctagggagcattaaatgaataaggtctgatttgcttctaaaaggcacacaatagtctagaacttaatatattatatttctctgtaaacagatttatgttgcaaaggactacagagggccttaagccaaaggaacagaaagcatttagctgtcgtgaggtatgacctcacaccagtccaaatggccatcatcaaaaag

SEQ ID NO: 15344 - DNA, 201 bp, Bos taurus
agtaagtttatattccccggtctgcagattaggatttgaacgtatcgcttgggggagacccagtttaacccactctgccctcttttttcaggttttcactgtctggccaagctcattgctaccctatggtagacatttcttcttcactttctattttatttatttgggccacactgggtcttcattgctttgtgaggcttt

SEQ ID NO: 15345 - DNA, 201 bp, Bos taurus
ctctgaatgaaaaagaagacaaagcattcaaatgagactgaattcaaatgcagtacttcattcagggcggccagagactgaggcctatttgggatccacttgtttttttttttttttttttttgtgaaatcacttgacaactcagtcacatgaccctgcattttctgtggataaatatcctggccttcactgtgaacacta

SEQ ID NO: 15346 - DNA, 201 bp, Bos taurus
atctcttctacccactttatatcgcagaggattaagattatttgtcccttgttttaatcagagatttaagatgtttccgtctaaatgcattagtgcagagctcccctacctcctcaacttgcacttcctgtttgaaaagctgattaaatggtttcattgctgattggctataagcctatgcaccttcctggctacaagcca

SEQ ID NO: 15347 - DNA, 201 bp, Bos taurus
attgcaggcagactctttaccgtctgagccaccaggaaatagatttccctattctggaagtatgaacaaaatggtagaagacattgtgttttgtgactgattttttagacttagcataatattttcaaggctcatccttgccatatgcatcagtactccatttcttcagtggtcaaatagtattccacttgtatagataga

SEQ ID NO: 15348 - DNA, 201 bp, Bos taurus
tgtgtgtgagatgtgcagggaaattctttgtcatcaccagtgttacaggcctggaaaaaacaacacacctggggttatagccagaagccagactcctctataggaagacatccaggcctagcaagaagaggaatttcctgaaactggccagctttttgttttcctcctctttacttgcagtaacattcttaaaacagaaaa

SEQ ID NO: 15349 - DNA, 201 bp, Bos taurus
gtggatacttgtggctggcctccagtgacaattgcttgtcaaaggacacccgaaaatgtgaaggagattatttatcaagggtgatggaaactacagttccgaatagtccagattatatgtaggccattgccaaaaagaaacgctaaagagaggcagagtgcgaaatcatgtcacttaagctctttgcactttaaaatatta

SEQ ID NO: 15350 - DNA, 201 bp, Bos taurus
tcctcactgactcagagcaggcagtgttggtgagtggcgaccgccaggcttgttgtcaaggaaaccttctgtaccacacctgcccagagtcagagaggaacggggggaagacatcacttgacacttctgacacatcaccctaaatctggtggatgctctttaaaaactgcatcttcattgtgagctagaaccttaaactcc

SEQ ID NO: 15351 - DNA, 201 bp, Bos taurus
cattagagaagctatgactacccctaaaagcttcacatttcttgcatgcttccagaatgaagcttccagaaggatcctgatgtgggccacggtgctcagctgtgcccatcccaacacaaagcatgtctggaggtgtcctcaggtgctcagtgcagaaatgagtgtgggcaaagacgaactcggtcatggccgagaacaggg

SEQ ID NO: 15352 - DNA, 201 bp, Bos taurus
gagtacagccacagtagcaaaaagaaaaaattagaaaagaaaaaaaaaaatcaatgagctacccctacatagctataagaatagccaaaatccaaacacattgacaataacaaatgctgtcaaaaaacagaaaccaacaggaactctcattcactgttagtgtaaacacaacatggaaacagcactttgaaagatagtctg

SEQ ID NO: 15353 - DNA, 201 bp, Bos taurus
aaccatttgtatggaaacaattattgatcttgcctgggccaccccatagcaacttttgtgcaatgtgggttgcatcattacccatggtgccacattatctgtgaacactggcctcatacaactctctctcaggtcattaatatactaagtgatgactgtgcaaattcacatcttatccaaaatatggaggaaatgtgtgta

SEQ ID NO: 15354 - DNA, 201 bp, Bos taurus
tgatatgagtcactgacaagttttagatttgacaagatatggtaggaaagtcacaaagtcactccccatcatttgagcacaggttaaccttcagcctcgtcggagtcagagctgcctgacccagataggatctatatttttactacatcctctcttaataagctacttctcggcagccagacatataaaatagaatggaag

SEQ ID NO: 15355 - DNA, 201 bp, Bos taurus
gtgcaagcagttattatctctggagaactgagtcctagacagaggctgatgggagttgtaagtgaagaagacaggctagtccatatagggacccttgggcatctgaagaaatgggactttatcctgtccctgggggacactaaaagttaagagggcaatgaaacagccaggtttaattttacattctggcagttacctagc

SEQ ID NO: 15356 - DNA, 201 bp, Bos taurus
aagtactgaccagggctagactagaaacaggctcattccagatcaagcactcactcaattcaggtacctagttcaagagcacaggctcagagatgccctttctgactcccatcactttgtaactgtcacactgttttgctcttcttggagcagttacccctccctaattaagctgtgcattgatttgttcatgtatttatt

SEQ ID NO: 15357 - DNA, 201 bp, Bos taurus
gtatgattttaaaagaaacattcctacatcacagcttctagcaggctcccccaagtatgttctcattgctggggacaaaagacaggacaagggggaacacgcctgggcccctggggcctggatttggaccatcacattgtgacttccgatgtcgtcagtttaccaaagcgagttacaagttcggcccaaacccaaggtggg

SEQ ID NO: 15358 - DNA, 201 bp, Bos taurus
tgagtccatatcagctttgattacctctcaagcttcctgactatctccccaatctgtctactgtcccatccagcttggccaccaccttgacattaagctttctaaaacagtaatgttctgattttccttgtccaactacaaagcctccaaggcctctaccaggaaatgctgtggactaatggacttcggagttgataacaa

SEQ ID NO: 15359 - DNA, 201 bp, Bos taurus
aaacgggacatgaatctgagataacattaaatgaagccggtttccatttttaagtccaaaaaatctgaaaagctgtagtcataactccacaagcgtgtttcggtttcctctgtggtttacttaatgtttaccagactaatgaactgagactgcctcagttagaccgagctcctcctaacacttccccaaaaagcaagtcgg

SEQ ID NO: 15360 - DNA, 201 bp, Bos taurus
accaaatgacgcttcctcactttttctttctcttctctagtttgaccacggacttgctgaagcctcggctggattatcatcatgctctgaaaatactcttgaattctacacttccaatcacaccctttgtttcacataaaacttaatcaagaggagtttcatgtaagtttccacttgtacataatgataaacagcttaagc

SEQ ID NO: 15361 - DNA, 201 bp, Bos taurus
tgcacttccactgtagaaggcaaggactggatccttggtcagggaactaagatcccgcatgctgcatgttgcagacaaaaatagaaaagaaaatgaaatttaaaaaaatttttcaataatcagtggctgtgagctttaagagatgtcatgcaagctctgaagaggaagtctgcagaaaaggtacaatactttccaaatttg

SEQ ID NO: 15362 - DNA, 201 bp, Bos taurus
ctggggccactggtactgagtgactggatcgccttggggaatttgcctgaactgttcgatcttcgttttcctcacgtgtgtaaaggtaagcttagaccaataatttttaaggcctcttaatcccaacagacctattagtctaattgtaagcccctaggtaggaggatcatctaagcaattatgagtgaagataactttaat

SEQ ID NO: 15363 - DNA, 201 bp, Bos taurus
ggccttttgagttggaattccagagctcttggagcattgtctcaaaggagtgggtggtttcttggtgagcgctttcctttggcctagtgggttagagaattcttgatgcagagagcacagttagagaggagtcggagcagacccagtaaagcctgggcccgagactaattctagcacttggggcttcttaactcagcattc

SEQ ID NO: 15364 - DNA, 201 bp, Bos taurus
agccttgcctgagaagaccttgactccgaggaggggcctttagcttagccagactggtgggaagacagtgactcatgaaattggcaagtgatgaaaagagggtggtaggcctaaaaaaaaaaaatgaggttacttgactcttcatttcaccaatgtttagcctccttctgcacatgcccctgctttgactcaatcaaaatc

SEQ ID NO: 15365 - DNA, 201 bp, Bos taurus
cccatggccgaggcatctgccttgaaaacctagaccagacgagaggagcacggacacaggtcacttgcctaggtgaaaccttttatcttcagcctgtcacgttatttgtcatttccatatgggccattgacagctgtcagtcaagcaagacttaccctgccaccagcaaatctcaaggcatacagaaaaagagacgaacgc

SEQ ID NO: 15366 - DNA, 201 bp, Bos taurus
actggaaaaaagaagagccttttttttgctttgcctctcaatctggtccctactggtcaaatatcgctcatgtacggacgttgtcaaagcctttggagatagtcattattatcagtcatgatgttaatgggctgtcatcattggctgaagttgacttactctagatgctttgtttacttagctaacaaaaaggcagcttgg

SEQ ID NO: 15367 - DNA, 201 bp, Bos taurus
ggacattagcggtggccaaagtgtccccaagcacctcccttgttggcacagcaaagaacccccagtaaggagcagaaaggtggagcttcaggagctactcggttgtcctccacttctatggccatttgcccatacagcgttgagcattcggctttagttctctccttgaatgcagggacactgggtccagactgcctggct

SEQ ID NO: 15368 - DNA, 201 bp, Bos taurus
ttagggcatgacggtcttgatgaagcgtttgaacatctccgtgtcccacaggaagaaagaacaatttccaggctgtgctgggacagaggatggggagcgtctgaccatttttctgaaggaaacaattctgttgattggaacaggattttgcaaatgactacttcgtttttcagaggttgcagcttttaaaaatctcctaac

SEQ ID NO: 15369 - DNA, 201 bp, Bos taurus
tggctccaccactcagatgatgatcaaagaggtttacagtcagcacagctgccggctgtgacactgcccctgcccggccagccttgcgccgagggctctttttccccttctcccttctcagggatcagccaccctctccacttcacagacctttctcccaaggccctggagctttcagaaaaggacctgacgctcaccctg

SEQ ID NO: 15370 - DNA, 201 bp, Bos taurus
cccctggtaggaaagttttctctgagacatctaccttgatggggaaacagaaagaacttcaaagctgttcctcagggagacttccactctgccaacctttcccgtcttggcccagtggttgacttttccagaaggaacaccaaggtgggtgacggaaagaaagagaaagttggggcagtggtgcaggtgagatcagaacta

SEQ ID NO: 15371 - DNA, 201 bp, Bos taurus
ctgttgagcatgttacgctcttctgctctctgcccgacagacggtacagggctgggaggacagaagggcccggagagctggccctttgaggacgggagcccgtgtcgggcagagatagaagactgaagacagccagcaggacacgagcaggagctcagttacgaggaagagactctgccaacgagggagtttcaggaagga

SEQ ID NO: 15372 - DNA, 201 bp, Bos taurus
ctctgtcattagtgatgctcaccaggggccacaactcagaaaccaacagaaagcactgatcctttaaaaagaacccaagtttggaacagagaagagttttcgttttttgtttaagcaagaatacagggctttctccataattcagcacttaggacttgaccttccaatgcaaggggtgcaggttcgatccccagataggaa

SEQ ID NO: 15373 - DNA, 201 bp, Bos taurus
agctccagccaacagtcaccaagggaacgtgtcagtgtgataaccaagcaagggaataacaatggcgtggccggacaggcctttcttttttttcctctgtcgctgtctcacgaggcagcttctagcattttccagtacaactgtcttttggttcatttggaagttgtggccgacactggaatagtggtcagaaaacctgct

SEQ ID NO: 15374 - DNA, 201 bp, Bos taurus
ccagctaaaggcagaccgttccgcactgctacgtgcctggagctcaccacgctttaatcacatgactgccagatattcgatccagaaggaccttggccgcgtgagtccccagttcttgccctcgcttcctccctgggtgcccagtgcagttgacctcacttgttgctctcaggggcggccctgcagagacccaggatgatg

SEQ ID NO: 15375 - DNA, 201 bp, Bos taurus
gggtctgtcatgaagggctcttaccatgttgagctgtgttccctggacacccactttggcaagagtttctttttaatcatgaaggataccgaattttatccaatgctttttctgcatctatgatcgcgtgtcttttgtctgacactgactcgtttgcatatgttgagccatgcttgtgaccctggaatgaccccaacttga

SEQ ID NO: 15376 - DNA, 201 bp, Bos taurus
cactccagcatgcgcgtgggccaacagatacttgtcagtataataacctcagtgggtaaactctgcgcctccgcgtcgtgctccacggagcagggactacactcccacggccctgattttccaatttgcttttccctgatgcaccaccgtctttacttgttgtatcataggactgagtttttcgcgatctgctgttctgtt

SEQ ID NO: 15377 - DNA, 201 bp, Bos taurus
attcctcagtagagtgcattggtctactacataaagtgatagcctagctctaaaatgaaataaaatgaagaaatcttatctgtaaagccttctttttttgcgttttgtttttaaactttatatcctcctttaaatgtctccccctcctcctcttttttttttttaacagcaaaggacaaggttgctcttttgataggaaat

SEQ ID NO: 15378 - DNA, 201 bp, Bos taurus
tgagtgtgactcctttctctggcctttctgagcctgaccatttcagagaacgttgctgaatagcttggttctgagcaccaggaatgagaacgtgctgacttctaacagtgggtggccctaggtaaatcttaattttcttttgtttacagggtacttggtagtaggtggctaggtaacagcacagatggagactctttccgt

SEQ ID NO: 15379 - DNA, 201 bp, Bos taurus
ggcttcatagacatgagacctttgcagtcacacagggccgcgcatttaaaggggccccatgctttctttaatgtgattttctgtcaccatcttgaaatgcgtaattaattcttaaacaagaggccctgtattttcattttgtattagtcctgcaaattatgtcatcagtattggctagaacaaaggctgttcaagaataga

SEQ ID NO: 15380 - DNA, 201 bp, Bos taurus
gattatttgagttgatccctgtgcagctatagatatgtttgttcatgtgtatgtactttaaaggttcatttatttggctgcgctggctctgagccgccgcacccaggcccttcggtcttcgtttcagacctctttagatgcagtgcgcagggtctgtaggtgaggcatgtgaacttttagcctcagcatgtgggatctagt

SEQ ID NO: 15381 - DNA, 201 bp, Bos taurus
ttcctggctggcctcctgctgggtaattacctcctggctcccgccagttagacctctaagtgtccgcaggacgagtagagagtaaactcgctgggtctgggaggcagttggccggaaatcctggcttgacgttctacacagacatgtttgggaagaagtttgtaagaagagtctgcatttctcatgggttccaatcagtca

SEQ ID NO: 15382 - DNA, 201 bp, Bos taurus
agccgaataaataaattaaaaaacacaacattcaagctccctgcgagggcctatcgggtcctgtggggtcaagtccctgggttcccctccaaatgggagtcatccctggtgcccagctccaggggcctgtctctgcccctctcatctcataaccacgcccatcacgccttgtgttcttcctctgacacatgaatggctgaa

SEQ ID NO: 15383 - DNA, 201 bp, Bos taurus
attattcatacatcttccagccataccttcgcgcagtaatgttacgtaacggcactccatctggattggactggatctgagagcccgctcctggcccagtgcctcctctactggaggcagatttctcccaagtggtctaagagtggtccctctcattagcatcaaccagaaccttactaaaaaagtaaatcttatggcttc

SEQ ID NO: 15384 - DNA, 201 bp, Bos taurus
aggacgggacgaatggagagcgcggcctggaaacaggtacccgccatacgtggaacagtcagtcagtaggagtctgctgaatgactcagggagctcagactgggccctgtgagaacccagggggtgggatggggtggcgggcccagagggaggggacacatgtacacctggggctgattcatgtatggcagaaaccaacag

SEQ ID NO: 15385 - DNA, 201 bp, Bos taurus
tcctggcgttcaggaggacttcctgcagattggctgcgaaggtgcaacagggggagggctgaagggtgcgtcccccgcctggaggtgcgtcccccgcctgcaggcgcgtctcagggtggggatggcgctccgtgtggacattccaaacctggaggttgagtggatgttctaagagttcacttaaaaaaaaaaatcttttgt

SEQ ID NO: 15386 - DNA, 201 bp, Bos taurus
tcccagcaatgctttcttaagcaattctgatcacaacatcctgtattaaaaaacccgcgaagactcgtcagtggttgacctacagaaagaagtcctcatccgtcctattttagtccccttgtctttatttccttacacagatgtcctgtgtggacagattctcgtgccacgcaccttcccactttgggtctctgctccaat

SEQ ID NO: 15387 - DNA, 201 bp, Bos taurus
caaagcatcttgacacaggaaatgactggcttgttcgaggcccagcaggcaggctgacgcggttggaacgtgatgagcaaaagagagtggtaggagatgaggtctaagaggtggccgaggccagggcacgggagggccttcgggttttccttttggtgtgatgggaacctgttggggcacgggcagaggagaatgatgctg

SEQ ID NO: 15388 - DNA, 201 bp, Bos taurus
ttggtgaaagacatagttgagaagtttgaaattatactgtctactagaattggtgttgatttaccaagtaaaaactcttagctttatgaagaaactctcatgagatttttttttttttttttttgccatgggacatttatattgagctctcctttggtgagacattttggtctttcagaaattcagcctcttggatgcact

SEQ ID NO: 15389 - DNA, 201 bp, Bos taurus
caacaaatgatctctttgaaggttttcctcagttcttggctccgcagggcataaatcagagggtcaatgatggaattgcacatgatgaggatgaggtacaggttaaagtgagacatgaaacacacacagtatgggttctggggacaagagatgtagaatatcaggtgcaggaagaagggggcccagcagacaacaaagacc

SEQ ID NO: 15390 - DNA, 201 bp, Bos taurus
atgaaggtgaccggagtattgagacaatcattctcttgaaaggctattttgaaataaaaggagaatgaagtacaattgtcttggccatgtttagaggaaagggatttctttcgtggtttttagaaacaacgaaaatgcctccacagctttgctactttagcagaagaaattctgttctagggaagatttgggccaagactg

SEQ ID NO: 15391 - DNA, 201 bp, Bos taurus
aaggatacataatatgctactgtaggtatatactaaattttgtttctccactcacccgctgatggacatttggcttattttttaccttttggctatgagtagaggtgatggaattccagttgagctatttcaaatcctcaaagatgatgccgtgaaagtgctgcactcaatgtgccagcaaatttggaaaactcagcagtg

SEQ ID NO: 15392 - DNA, 201 bp, Bos taurus
tattaattaaaaaacaggccacatttgcaattacaaacatagaaaaatatataaataacaaattttgaaagatttaaagaagtcagtgggttttttaagagagagaacatggaaatgtggcctccttaaaattaactgatataaaattaagaagcaagcaaatgcctagttactttcaatttttttttcttatttgaaatt

SEQ ID NO: 15393 - DNA, 201 bp, Bos taurus
atacatggaataagatcttggagaccaacatttaggtatatggtctttaaatatgcctaaactcagttgagaaacaaggaaagaaaatgaaataagcaacctgtctaatatccccgggcctcatttgttcatttctaaactggagggttgtctgttaaaatccctttcagccgttcttttggataatccaaattctctcct

SEQ ID NO: 15394 - DNA, 201 bp, Bos taurus
cagtcgttccgagttcaccttttaaccaactctcaaagcaacacaatttttctattcattttctgaccagaaatcaagttattttacagagaaacaactgcttttctggcagaggattcctttgactattctttccaaaatttaaacaaacccagattccaatttgtgtcttaatctccttacctcaggatcatcaggccc

SEQ ID NO: 15395 - DNA, 201 bp, Bos taurus
ggcctgctccccgtgctcacagcagccgggacgtgggagccgcctgcgcatccgacaggcgcgcgggcagaggaggtgcacacacacggtggagtgtcacccggccactgaaacgacaagtgaaataccgctgttgccgcggcacagaaggacctggagactatgacacctagtgaactaagtcgggcagaaaagacaaat

SEQ ID NO: 15396 - DNA, 201 bp, Bos taurus
caggcagataatgtctgattcataagggagaagcgttttggtattaccgaaagaggaatgcggggcccaaagcctgcgctggccttacaagtcattaagaatttaagacacaaataactcccatccccactaaagaggtacttttgtgctaagcagttgtagaagcttgacctagaaacaggccctcccaaggaagcagac

SEQ ID NO: 15397 - DNA, 201 bp, Bos taurus
gacaagctctcaaaaagggtttctctcctaggcctcagggttttgcctagaagcaagcaaaaatcttggtttctgaacccaactgctgatcctgacaaatatgagcggccgcagcggaccccctccagggaatgctgtcccttctcctgccttccccaccgagttcctgccccttgctttccccaatccctgaaattaact

SEQ ID NO: 15398 - DNA, 201 bp, Bos taurus
aatccgcctcccccaggaacctcactttcgaggatggtgtggagttcattttagcagccctcagtgtattcatctgggcctcctttcttaaggtttgtaatatcccttcctttggattaaatttttctttattccataaagaatttttctatcaccagtataaaataccaggctggaggcaagggcccatacaggctgagg

SEQ ID NO: 15399 - DNA, 201 bp, Bos taurus
ctgggttgcagcgctatctaaatttacatcagaactgaaatctgtccttctttaaagcagattcacgtggtatgggagcatcatgggacactgagggcctttggttcaagttcgctgattccctgctgacaaattgaagttttcatctccagataccatcctacaaggcccaccaccctctcctgcttccatccgaaatcc

SEQ ID NO: 15400 - DNA, 201 bp, Bos taurus
ctgcgaaccgactggaatctcctgaaaagcttctaaactgtggctttagtggcaaggatgtagaagaaatataagcaaatggaatgctgcttttattttattattctttctggccttcacagtctttccctcaacaggtgctcgatgagcatccactagtaaccaaagtatttcattcacatatgacccgtgtttaagctt

SEQ ID NO: 15401 - DNA, 201 bp, Bos taurus
ccttgctggcctttccgtggaaactgcaatgacagctcgtgccctcatttcctccccctcgcccctgacgctttctcacgtggcctgccatgccctcttccctcaggaactgtgagtcacagactctcttttcagtggcaactgtctcttgatctgtgagcctcatcatacctgaacagtaatagaacccattctttatct

SEQ ID NO: 15402 - DNA, 201 bp, Bos taurus
acatggagcgtgggatcagagtgagaccagcacaaaaaagcgagttttacgtgctgtgtgagccccagggatccacaaatcctctactaagaaggcccattctagtgctgcaagtggaggaaaagaaacagcttcttggaggcaaagagcaaagaacaagggttaagtcagttcagtggctcagtcgtgtccgactcagtg

SEQ ID NO: 15403 - DNA, 201 bp, Bos taurus
gtaacatttgtggccaagggcacctgctgcccgtcccttccacaggcagcagcatgctggctgggagatgctgccccacttgacaaacgtttgctgagcgcggtctgctgccaggccctattctccggaacagcccctggaaacgaccccgtggtccccgttcccccggtgcagcctccgcagacatctttgcagcaccct

SEQ ID NO: 15404 - DNA, 201 bp, Bos taurus
gggatctccccgtagggacaacctggcacagttgggcggctgggacaccactggccgttcgtgtcacttgcccagaggatagaaattgtgggcctacaacaacatcccctcataacttgttcaatcttatttgggacacaggaccgcgttcctccccagtgtatttacagagacacacagggagaggaagcagaccgtttc

SEQ ID NO: 15405 - DNA, 201 bp, Bos taurus
atggattttggcctcataaagaaaaccgtatcgtagtacaatagcatttgcagtacctgaagataatgtcccaaccggatgacaagtctttaaaaagattgtggcctagaaaataggtgattttttttttttttataatgtgggagcaacaactaaattctcctctcttgcggctcatgtaatttataaaatactgttatt

SEQ ID NO: 15406 - DNA, 201 bp, Bos taurus
aactggtttaaattgaggatttgaaactgaaatcctatgctaatttcaaatgaattgagtcagagacagtgtcagaggtgttaaatctagatggctgaccacacgatttatttccaggcccccaggcaagacagtaatgtgtgcctaatggactgccttatgtattgataatcggagaaaggtagttggaagcaaactaag

SEQ ID NO: 15407 - DNA, 201 bp, Bos taurus
gggaaggcctgggacggacgccccgggactcacgtgcaccagcctgctgtccccagagcccccagggcctccgctttgaccttccgagggccttgcctttactgcccgatgacagtttagtgcccccaggcacgcttgggcagaataactaggtgggcacccagttaatcctgccacgtgaaaggctggccggcactgagg

SEQ ID NO: 15408 - DNA, 201 bp, Bos taurus
aggtgctaaatgcatctcgggcctcagtttgctcatctgtaaagtgggattagtgacagtactgccacacgacgtttgtgtgaggattaaatgagtcatatgtaatatgcttaaagcagtgtgggcctggcacgtcgtacgtgctgtaggaatgaataaatcatggagctaatcaacagctagcagacggggcagcactca

SEQ ID NO: 15409 - DNA, 201 bp, Bos taurus
cgggcctgctgcagttcatggggcggaccgagcagctgaacagaaacagcagcactcagatggggacgctccaaaacgaagagcccgtgaacacgtgacccgcgcagcaggcgacccaggccccccaaccatcgcggccaagccgggctcccagcagctgcccctccacctccaccctgcagggcggtccaggagccacag

SEQ ID NO: 15410 - DNA, 201 bp, Bos taurus
ctactgagtcaccagggaagcccttgtctgtctacatgtctggtgctttttctctatataattattgataccaatattgccagtattttttaatatgtgcttgtgttttctctctcactcattccattaaataaaaatgtattaagcaccagttatgtatccagtggtgaaagattctggtgtcctccttgactttctctc

SEQ ID NO: 15411 - DNA, 201 bp, Bos taurus
aacatcttcatattttcattggtataacaagaattactaggtttaccagccaagtaattatgcaagggaaataaaacagtgaggccgaaggaatgtggtagctgtgatagagacatcacacattattttttatgttaaatgcagttaatttcacctatctgaaagatagaatttagactattttaaaaacaagtaaatata

SEQ ID NO: 15412 - DNA, 201 bp, Bos taurus
tagatttttaaaaatggtgactagaaccttaactataaacactctaaataaaaaataaataaatatttggaagtttccattttgtacaaagtcctgagataggtgctagcagatgcacaaagcagaataagaaaattttgctctcagggaacttgttctagagatgaaaagatacgaacatatgaaaacagaactagcagt

SEQ ID NO: 15413 - DNA, 201 bp, Bos taurus
tcctccagaatcttacaaggaaagttcaacataaacgatctttgaacaaattccgtttcggatgtatgtatgtgttagaggtagagggtggaccagggaggtggccggcattcagggcccccaggagaaaaagatgctgaatacagtctgtcctccattcgttcagaggttccacttctgcagaactcacaagagactgca

SEQ ID NO: 15414 - DNA, 201 bp, Bos taurus
tcttgtctgatgcccctctaagcccagggcttcctgaggacaggaatccaggcctcaggagagagcctgggcgtggagtgagggccccggcctgagctgcgccacgagcccaaggacaccatctatgcgctccgctggtgttggcttccacgtgtgtaagacgagcggcccggctgctcttgggtgtttcttgacttttca

SEQ ID NO: 15415 - DNA, 201 bp, Bos taurus
cgcgctgcccccaaggggtcaggaactaccctggccctaagcctaccctgaactccacctgacgagctcagtgccagcccctctgcccagtggcacccacgaggctcacaggccaggccaggatggcccgccattcctatagcacatgtctgtcgccaggagatgcccaaggcaggacagagttgatgaaccagggtggcc

SEQ ID NO: 15416 - DNA, 201 bp, Bos taurus
agggctcaggggtaagaaatgagggttggacaggcctggggtcgctggtctgaacctcaggaaggaaggatggagcagctatctccaggagggatgggagacaggggaggggatgtgagcctgggcggggggtgggggtgtctccagagcacaggtggaggtcagtgccgccaggtggactaagggcagacggaggggggt

SEQ ID NO: 15417 - DNA, 201 bp, Bos taurus
taacccaaggcctctcttcacagcaactgtaaagccagtcaggccccatcacatcagctgaacaccttgcacgccgggcccttcctggaagcagacggacacagatgggaggtgctcactaacacggacaagttacactcaggatgcactctacacacgggagtgatgctcagagctccaagtgcccagtctgaggcctca

SEQ ID NO: 15418 - DNA, 201 bp, Bos taurus
ctgggtcctctggctccccggccagccctggacacctgcaattcagctggtggttgtaaagtctcctcaaggtgcacaagagataagacctcccactcccggggccacccagcccctccatcccatccccagccctgcaccccgacctccctgcccaagacacccactccattatcttggtgaatgtaccaggccattcac

SEQ ID NO: 15419 - DNA, 201 bp, Bos taurus
atggttggcttgtattctaggtaggttcgttatttgggagacagtgaaggctaaaaatgttcacttccttaccttctgtgccaagggagagggatgaaccctagagcactgcggtgaatacagactccacagaactccatcagatccacctccactcttgtaggacaggtgaggtgctgggcaggtgagggaatgcacagg

SEQ ID NO: 15420 - DNA, 201 bp, Bos taurus
tgagtgtgtgcctcctttgaacctggggtgtgggggagggaaggaaagagatggaggggccggaggggcgagctggtttgaggggtggcctgcccggggtctgccctgatggttatttctctgtttctgcgacccagtgtggtgccgcgtccctggacaggcccagctgttcctggggctggaggttggtttccatcctca

SEQ ID NO: 15421 - DNA, 201 bp, Bos taurus
gtggttgggctctgtctgggcagcacatgttctcccagctcggttccctggatccagtgggcaaacagcctgctctgtctctgccgggcttggcctcaggtgagctagtaggattgtgagttcaggctgctatctcttcagaacaccccctttagcttttctgggagttctcgctctggcctcagggccttgagctactgc

SEQ ID NO: 15422 - DNA, 201 bp, Bos taurus
ccgggaggaggcggtagggaggtgttgtgcctcgggcctcatgccagcacagtgaggctcctggccctagaccacaagggccctgggatgaacagggcagcgagtcatcagtggtacctgctcagacagagcgtccacctgcccactaccccaatccaaggccttggaagtccccactccaaatggtaacactgcgcaagc

SEQ ID NO: 15423 - DNA, 201 bp, Bos taurus
ctgggaggtgggggccgaggtccagaagccccacccagtagcagcctgaacactctgggtgtctacccacctcatggccactccctgagtctgtccacagggggggatggttgagttgtccctgggggtggggattcaggggtggacctctgagctggtggcccctgtgagcctcagtctccctgtctgagcagggggctg

SEQ ID NO: 15424 - DNA, 201 bp, Bos taurus
cctctggttgccatgtgggtgctcagcctgtctgggcctctgttcccttatctggggaatggctaatagtcatacacgtgttggattgtggtggagagaatggggcacattccgtgcaggccttccaatggtgcacaggagcgctctaagaatttgttaagtaaccgcctctctgagcctcgcacccctccttatgaaggg

SEQ ID NO: 15425 - DNA, 201 bp, Bos taurus
cttgcgagttgctggcccatgtccctgccgtctgggtgaccaggtctctcctgtgcagagatgtacatgcacgtgtaagcctgttcccaccacagtggctatgtgtcccaggtgtgagctgggccttacctaacacacgcaagagcttgagaccaggtgtaccaaggcctgaagaactccccgcctgggccctgcacttgg

SEQ ID NO: 15426 - DNA, 201 bp, Bos taurus
ctgtgcggacccagctgcagatggacagggcccgcagacccgtgaggaaaccggggcggaggaagcccacattcatggtggaggcatttggaaagatgagcgcagggcccacgttgcaaactagaaacaaacaaggagggagagtcagcccgagttgcggggggcggcggctcacttgtcctcacgtgactggcgccatct

SEQ ID NO: 15427 - DNA, 201 bp, Bos taurus
aggcccgaacccctcccgtcatgaacgcagaacaggccgcacgagacagcgggcgcggccgtctgtcctggtgggcacagaagcgcccaggatttcttgccgccagtgtgcatgaccaacagaacccgttatttctaacagaaagggagcatggacaagcgtcaggtgtaacaagatccaccaaataccatggagaatgag

SEQ ID NO: 15428 - DNA, 201 bp, Bos taurus
tgtagcatttgggccatgggctggtgtggaacagaactaaaacctacagcccttcgtcctctgggcttgaggtctgagccccctttgtggtttcctcacagtgtgagaactcttctcataatggccctccatgcctgaatggctgctgtgtggcccacgggctgtggccaaggcacccctgccagcaggttgagggaaatg

SEQ ID NO: 15429 - DNA, 201 bp, Bos taurus
atgtgagactgaaagctccagcctttactgagtggggcgggtgagcatccatacagcaaggggaagaatgtgaacagtatttagggcatgacccagaggaactttcatgggtgcaatcaggttagtggacttcactttgaagcactgcatcaggaaggacagggataaaaagcatttctgttggcactcagctgccactca

SEQ ID NO: 15430 - DNA, 201 bp, Bos taurus
tgacatctttctgctctttttttacatgtttcagctaatatcatataagtttaatttttaggcatttttctcagttttggaaaaagggtacaagctggtaataatgttaaataattatcacactctgccaagaagagagtaaacagcaaaagcagccccccgcccccgctgtgtcgtgacaagagaccccctcaccagcac

SEQ ID NO: 15431 - DNA, 201 bp, Bos taurus
ggagtccttctagaccatcttccttgttttcctttcagcaaagttgatcaagaaatcgtcaacattatccaggaaaggctcaaggcctgtcagcagagggaaggtgagagccacaggcagaactgtgccaaggagctggagcagttcacccaggtggtcaaggcctaccaggaccgctgtgagtgagccctcccacccagc

SEQ ID NO: 15432 - DNA, 201 bp, Bos taurus
tccctggaggggcccaggggaggggccgacacacacagtgggagtggagcatccgggcatcagagttccactgctctgcggtctgagtcacccgagtgtcgggaacctggccgagtctgtgccggtgttactaacagggccctgcagatgtgagctcaggccctgagggctggcctgctgccctcctgccaccccgggctg

SEQ ID NO: 15433 - DNA, 201 bp, Bos taurus
tctttaatcaggtgaagtcccaggaagtggggaggggcattcattcgagggacaaatatgcaccaggatgcaacccaagccttcttttaggagacggcccccgccctcatgaagcttacagtctacttcaggaaagagaggatacctaggtaaacacaaattcataccaaatacagactgatcatgggcaccaaggctgtt

SEQ ID NO: 15434 - DNA, 201 bp, Bos taurus
tccaaacccctgtcgtgttttggtctcggtcttcatgaggggtttagggtgactgtcctctctgggccctcgaggatgaactgctcttagaaaactaagtcgccagtctgcagcaccttgtagagtggccacactattgacctgaagctttgggcttgcaagccccccaagtgggaatccaagtcccagggtttatagtgt

SEQ ID NO: 15435 - DNA, 201 bp, Bos taurus
ggaggaagggacagaaggaaggcccagccggggcccctctgggggtcttggaggaacactgaagaaccccaggggttggttctgagttccccagagacacacccatgtaagggcatctcacactgacagatgctggaccccggacggtgcctccacagcttccggaagctcagggactttgctgccaaaggctgctgggaa

SEQ ID NO: 15436 - DNA, 201 bp, Bos taurus
tttgctgaacttaaactcgaattccttgctgattttaaaacctaagagggggaatttgggctcaggaagagaaaagtagggtcaacccactggtcagttacctgggtcacccagggttttctaaaaggggaccttcatggttggggccccaggctccttagctggtggtcagctcggagctgtgtcgcacagctggcattg

SEQ ID NO: 15437 - DNA, 201 bp, Bos taurus
caccacaacaacccagcagcagtgctgacagcacaaccccagcaacacaacggcagccacgcagtaacaaccatgccagcagcagagcgacaaccccacaatgaccacaggaagagcagcatcaacagaaaacaaggcaagtcaggtctgcttcctgacctgtgtcctgggctgagctcggggtccggggccacaggtgga

SEQ ID NO: 15438 - DNA, 201 bp, Bos taurus
ttgcagaattaattccttgcccctgacttgctaaaagggacatctgtttcagtcctgaggagactggaccccttttctggtgcccacctgtcaggacccacgttaggcattattgacaaaatggaggcatggccccagccccctctcctcattctgcaggcatggtcccgggatgaaggagttaggccttgtaattctgac

SEQ ID NO: 15439 - DNA, 201 bp, Bos taurus
gctttggaggggtcgggaaaccccagaagccaggtgagtcccgctctgccctgtcgggctctcggtcggtctgtctgtccgtcctctctgtgtctgtgctcctttcaagccctgcttcagtctcaggcctctcactgtctccccaggattcaggactgggaacggagcccagccgggtgaggcccggagctctagggcctg

SEQ ID NO: 15440 - DNA, 201 bp, Bos taurus
gagactcttgtgtccatccaggaccaggtgtgaagggtgatcatacccagagggcagtgccatagtttggtacgagctggtgttcagaatcagatagcccggctcccagtgcaagctgtggggcctttgtgagcaagtgtctgtagctcttggaaactcagtttgcccatggaaaatggtagctcgcgcctgctgctgatt

SEQ ID NO: 15441 - DNA, 201 bp, Bos taurus
aagggccgtatgtgccaactgtgatgggcagacttctgagccagcatcacagctgagatccaggagccaggtttggggttggcagtctctctacctgccctgtttgcaagatcagaggttaggggcctccctggtgttcccgtggttaagaatccaccttgcagtgcaggggacacaggttcaatccctggtccaggaaga

SEQ ID NO: 15442 - DNA, 201 bp, Bos taurus
agctggcccagctggccttagaagggcagcagaaagatgagaataaacatggaaactttctccaagcttctcctgttcttttggtggctgctgggagtggggggtggaggggcctggaattcatcctgggcctcctgacctggtggttctgtagcatctggtgctggaccgtcattgggtggggccaccgtctcagcttct

SEQ ID NO: 15443 - DNA, 201 bp, Bos taurus
ggtgcatgaagtcctgggttcaaatcctggacaaatccacttgtttaaggcagttcagtttcaagttttatgatgctctatatatgtttgattctggagatatatatatatagcatctaataaatatactactgttcaggcaccctaccttctgagattctggatgaccgtgagcattaggacaccattcaacccagcaca

SEQ ID NO: 15444 - DNA, 201 bp, Bos taurus
aagtgtccggtattcagggaggccgtggccacccccactggacagatggtcagaggatccatgttcttctctccatcatgtgtcctggggctgaggataggttgaaggggcccagggggaaagtagccagtggctgtgagggatgtgggatttggctgtcacattgtaaaaggagatgtccccatcttgtagtcgacggag

SEQ ID NO: 15445 - DNA, 201 bp, Bos taurus
ctgatatttgttaaattgtctcagtcctttccccagatttcctgaatcaaaggcaccgtcctacggactctgtaacacgggctacacgtggtaaacttgactagacttggctgacaattgaaagcggacaacctgagatactcagattcctataaatgactcagtacatatttatggaatgcctacattacccaggaaact

SEQ ID NO: 15446 - DNA, 201 bp, Bos taurus
cccaagaccaggggttcttaaccgtgggccatgttgccactcaaagatatttggcagaatctgcaatcattgccaggtctggcaggtgctcctcatagctagtaggtggaggccaagggtgcggctagacatcctgtgatgcataggccacccatcgacacagacaacaaagacccgtctagtcccaaatgtcaatggtgg

SEQ ID NO: 15447 - DNA, 201 bp, Bos taurus
gtggacacacaggtcgcgtacatcctcagcctgggagtggtgaaggagttcaggaagcacgggataggtaaggggggcctgtaagtccccccagctcgcccctgctccctgccgactatctcagaagacctgctcggtctctgtcttgctgtatccttcggccctctgttggggccagactcgcacccttccttcgttccc

SEQ ID NO: 15448 - DNA, 201 bp, Bos taurus
aaaagacacagaggtgaaatccaagacacttagcaggtgactatggaggaataaatctcttacacattaaaaccacattcattgtgacattcacagcatcactcaaaaccttcaagagtgctttacctcttattacatcaagtctaaatgtcttccttcattcatttacacccacggggtcaatggcagagcacctgcagt

SEQ ID NO: 15449 - DNA, 201 bp, Bos taurus
caggaagtgtcagatgccctggctgggtgatcagaggtgaacactcccagtcttagggcttctcttttccttagaggggatggccccgtcgggccagcctctctccagaatgttcttgggacacctcgtgggtctctcctgcccctcccgcccactgcagccctgcccccccgcgtcagcatgggctcagccgcctcgggc

SEQ ID NO: 15450 - DNA, 201 bp, Bos taurus
cagtgggccgcgctgggcctcgtcgtctacagccacgcctcctttctttttaaccaggaaactacttcgcatcgcactttttcatgggaggtgagaaattcgataccccccaccctgaaggttacctctttggagagaacatggacctgaacttcctgggcaatcgcccagtccaggtgggtctcgtgggggctgggcacg

SEQ ID NO: 15451 - DNA, 201 bp, Bos taurus
ggcaggcaagctggtccctgagtaccccaagtggtcaggatgtcagctgcagcaaaggagtcccgtccagagtcgctatttgttgcaggaagagaaaccccttccagggcccaaaagtcggctcttgtgtaacacttggaaatgaattgtccgaggagacactcctgctgacaaagcaagagacttgatcgggaaggggcg

SEQ ID NO: 15452 - DNA, 201 bp, Bos taurus
ccatgttcctttctttaacaaatccacacttttatttatttacttttcaataagtttaaatcctccaagggtacagtgtcacatggattctgtgtccagtgttcttagcaggaaggttgcttcagaatttggcagaaaccatgccactcatgtttccatgagcgtgatttgtctttccccagattactctggtttgtgagg

SEQ ID NO: 15453 - DNA, 201 bp, Bos taurus
ggactcacttgtctcaaagaggtaaacttccaccatgatttgtagagcccctcagctagaagggagtgttcagcctccctggccagagtcctgtcaacagctctggacgtgtttccaccttccagcccctctgtagctcataccagcttcttgtaaggaccaaggtgtctaggttttctgggccatctaggtaagagcata

SEQ ID NO: 15454 - DNA, 201 bp, Bos taurus
gtgaagattgtcacttactgatactaaatgaagggtgacttcatttaacacggattctgaaatatctatatgcgggttgccaagcagtgctatgtagatcgtcttctgaagaggaagaggctcctggaggaacccagcatttgaggattaatttgaacgcatttgcttcctcctctgtcttcacatcttgggtgggctgtc

SEQ ID NO: 15455 - DNA, 201 bp, Bos taurus
ctcaacctgccccaaactgagtttccatcctgatcccttccttgcttctcctcctctgtgctccccaagtcacaggatggaaccatgacccttcctgctatttaggacatgtcctccttatttcctatttcttcagcctccatgtctggttcatcatcagagctcccactgtaccttctgaacacaaatccatctctcagt

SEQ ID NO: 15456 - DNA, 201 bp, Bos taurus
gtgtgatccatattcatggcatgctctgttaggtaaataatagtggctctgagaaagtgcttctgtgaggtccttttccttctcaaatgactttcctttttttccccctaagtacagacaaacagttgtaatttaaacagaacaaaccccacctgtggaggagacgttggtaaagacagacaagaagaattacaaacccac

SEQ ID NO: 15457 - DNA, 201 bp, Bos taurus
cctggccttgtcattctaatgtaattagtttgcaaaaatatcaattaacactcaaaacagctgacacgttttacatgctggtttgaaatgtgttaattacaccttatactttgcccttgtaccatcccgagcggcgccatagacagggattctggtcctccatgccctcctccttacatactgggggcaacatggatactg

SEQ ID NO: 15458 - DNA, 201 bp, Bos taurus
agcggtcctcactgtgaggaccataaggaagcaaactcaggggcctcggctgtgcgagccacatgtgtgcgccgcggagccggcatcctctccccttgccgagggaagctggtggaggcacgtctccatctaagccaggcatatgtcaccttcgggcaaaaaacgagctaatagaattgagatgaatgtaattggcagaag

SEQ ID NO: 15459 - DNA, 201 bp, Bos taurus
gcccatccttagggctgagatgaggcccttgtccaagccacacagcgttaaagtggggaacagctggaccgtaaaggaaagcaggggccctaacagagagaagagtgtttccagaaagcccagcaggtttccccatagcctagcatgtcctactccattttgactttctatgtaggccattggtggggagggcatgatgaa

SEQ ID NO: 15460 - DNA, 201 bp, Bos taurus
gggacagatgtattaatcgaaagagttcttggggaaggtatggaaagaaaaaccatcaggccaaactagagaaaaggaaataactaaccagcagggagatcctgtgtggctctagcctgagctgggaaggtatgagctggtggggtcaagtctcttactcaagaaactgagtaagattcatacggatgcaggaatctgaag

SEQ ID NO: 15461 - DNA, 201 bp, Bos taurus
tgagaaagccgttctcatactttggcctaagtgctttggtgagggaaacataagatgctatggggctacggacaggaggtcaaggaaagtactctgcattctcagtgaggccacttcagctgggtgaaggagcttcagtcgagagaagggtcggtttaggcaatgagagaagggcagtagaggaatggtgttcagtctaag

SEQ ID NO: 15462 - DNA, 201 bp, Bos taurus
ggtcatttaagagtggttttatgttctttaaaattcaagcacaggcgaacaaaaggctgcgtggcggcccatatgtaattagccagatcatgtaagcatctgatcagggtcttgttaatgaaggtggcttgacctcagtgaccccttgaatcagtgagaaagtgagtgcgaaaaacagtactaaggggaggttttgagaag

SEQ ID NO: 15463 - DNA, 201 bp, Bos taurus
taagggaagaaaagtctttcctcctacctgtcttatggtctctgacaggggccccataaaacggattgatgaaagacagatgaacaagagagcagtgtacgaatttatttaacgtaagttttgtgtggctccagagccttcttaaggaaatgaggacatgaagaagcttgagcattttatgttaggtttgataaagagtgg

SEQ ID NO: 15464 - DNA, 201 bp, Bos taurus
cagctctcactggcgggatgttctgcctctccgtgtggcccagatctgtctcaccgaaagctgagcccccggtcatttgtctcccttcagtgaagatgtggaattcatggccccacatctcctcgacaacacaacttaaaggtacttgtttctaacagaatctcgcgtggccgctttacatgaatcatgcggctttccatc

SEQ ID NO: 15465 - DNA, 201 bp, Bos taurus
gatgctatatgcaactgttcttcaccagtcctattttaatttgcatgatatgaactctggtatttccaaaaaaagagatcagaatctggtttggaagactttcctccttaaaataaacaagcttcatgtccaagccaaggactggaaagtctctctgtggtccatcagggtaatgattcatggggcagcatctgtccctgg

SEQ ID NO: 15466 - DNA, 201 bp, Bos taurus
gttttgtaaacgtggccgaatcttaatgtgccctcttggatatatttgttggagacaagagacagtggaaatgacaatgctgggtttgacccaagccgagcatgttagagaggacagggccaaggatggtgatttttaaaggatggtgaccttgttgtatatgcaattgataaccaataggacctactgtatagcacaggg

SEQ ID NO: 15467 - DNA, 201 bp, Bos taurus
gaggagaatgaatgattgatggatggcgagcttctcaggtggaaacaggctggtgggaagctgcctttaaaatcatattttatatacaactgtgggtcagtgcaggctcccagtatacagtgcctgaccttagtatgggggagcgatcgattgtgctcaaacagcgagccatccaaatgatttatttatgcagcagtgcag

SEQ ID NO: 15468 - DNA, 201 bp, Bos taurus
cctgctgtgtccacactccctctgcctgtcatgacaaaccctcggtgctctgtgatggtgtcttttctcttggtaccaccacaagcccagagcacgttgacgtcaagctcctctggccgtcctgcccacaatagcattctgagactctgcacacccagtgcctggcacagtgcctggccctctgcccatccttagagggag

SEQ ID NO: 15469 - DNA, 201 bp, Bos taurus
gaaaggaatccccacgagtcctctctgtccctcgtgttgctggtttcctgtcaaccccttcaaccctgcacgtaggactctgggaaccacacttacagcctcagctatgcccaaactctgggccgtggaatctgaaacagatgctttctctgccagtctcagggatcgcatctccccgtcctaaccgccttttctacccag

SEQ ID NO: 15470 - DNA, 201 bp, Bos taurus
ctctcttgcatctcctgcattggttggtagattcttttctactgagccactggagttatttctaactaggtgggtattttaaagggtagaaatctatgacattatattctcttttttatcataagaataatagcttctgcttagacagtagctactcatgtgtcaagttctgctggctactttatctcttctgctcaggca

SEQ ID NO: 15471 - DNA, 201 bp, Bos taurus
taaaacctgagttcagttggttttcattaatgtggtgtatctggtccaattaagcctcattttaaaaatcaagtgccttagaatggagtggcctctttcacatacttaacgtaagataattcaattgtgtgtgttgagtcaacaaaaaccaaccattttacacaccctacaactcctcctcctcaacaactttaacaacac

SEQ ID NO: 15472 - DNA, 201 bp, Bos taurus
attgccaatggccttgtgctttgcagctaataaagactaaattacactcatggtttggaggtatctcgtgcctatagtaagtcatgttacttgagcttgtataactgtagctccatcctatccaccttttatttgggaatgaataccccagcctcaaatctcacatttttctcatccaaagctaataactatatagcattt

SEQ ID NO: 15473 - DNA, 201 bp, Bos taurus
cgagctagttatgaactgagcatccttgcacttgtgtttctgctcttttcaacttgaactcgttgacaccgcatacccaggcagggaagctcgtggagttcgagggtccttgactcagaagtggactctgatctccagcctcaatcctgtcattacatgcagagcaattgtgtctgaatggttggaatccagtctgtctga

SEQ ID NO: 15474 - DNA, 201 bp, Bos taurus
tccctgggccctttctattcttggacatcgggagcaatgaggttacatccccgatcagtgattctcaggcaggtggacagagtgcccagaggccatcaaccacatccagagacgcttttggctgtgctgactagggaggaaaggagagttgccatggacatccatggtccagaggccagcgatgctgctaagcatccttca

SEQ ID NO: 15475 - DNA, 201 bp, Bos taurus
gtgtgcgtgcgcatgtgtgtgtgtgtgtgtgtgtttctccatgaatatgaccaaagaaggcactccttggcgcaatgcttcactatcatcgtagcaagctattttcttctatcacacagcaacctcttttcttctctctcccctatgattgtcagttgtaacattttctttttccctctctggtacattttttctggggag

SEQ ID NO: 15476 - DNA, 201 bp, Bos taurus
aatttcttgccagagaagtagaacagaccaggctgagaaactcaagtcgaccaaactgtcagcaggacggagaactgcaggcagctgagaagggacagtcccctttctctagtcagagttggtgggaggggtgggtcccagggcaggagacaccgcttttctaggtggtgtggagaggtataatcagttggtttaggagga

SEQ ID NO: 15477 - DNA, 201 bp, Bos taurus
taagaattgtgaaatttcctgggtttagggggaaacaaagattcaatttcccacatttatttttaaaggaattcttgtatgtaatgatttccatacaaatcgttttcaatcactcatgcctgagttcagctgatgggtacaagcaagtcattgacctaagtctgggtcagagagagcaaggttagggtttattaaagggat

SEQ ID NO: 15478 - DNA, 201 bp, Bos taurus
gcaggcgaattctttaccacctgggaagcccaaaggtaggtagcttaaaattttacccgacaattcagaagggatgttagacttacagggcagtgaggccgtgctaaacactgatccacaaacactcatagggcaggaaggtgcatgtggtgaaagtcacagttcagatgaagacctccaagtggccataccttggggcta

SEQ ID NO: 15479 - DNA, 201 bp, Bos taurus
gcagttcagatctaagatagggttaggttttgatgatgggaaacacacaaaatcaaaaggagagagatacagagccagttaacttggagaccttgaagacaatgatgaacaatagtctgggtggggtgacgctattatcattagtggatttggcggtggggagagggggaaagaagggggtcctgagtggatctttcttct

SEQ ID NO: 15480 - DNA, 201 bp, Bos taurus
ttattaagttcagaaacatgtctactttgggaacaccaaactcactgctcagaatgcatccctgtatcggcattacatgctttaatgtatattttttacctagatgactcatttctttccaaggaagagactatttctaaccaagctgtgaatctagtgacattcaagaaagtgagttgctcagtcgtgtctgactctttg

SEQ ID NO: 15481 - DNA, 201 bp, Bos taurus
attctattaggcacacgtggaatatggaaatgacaggtccccataggaaaaaacaaacggtgctgttatgagaagaacaggaaaggggtgccagatagtcgaaaggaagacgtgctcatctcagatacaggtttttattccttaagtaccctggactgtgtacatctttccaaaagattattctgtaagagatcaatacac

SEQ ID NO: 15482 - DNA, 201 bp, Bos taurus
actgtcactagaaaggaaggaaagactggtaataataatatccatctctattgagaaccttctaagcgtctgatgctttatactctccatctttaacattccaactgggttcatgagtatagtttagacaagtcacttgatactgagctgtactctgtcttacttagatcacctaataaattaatgattgaactggtgttt

SEQ ID NO: 15483 - DNA, 201 bp, Bos taurus
caaatcgctgttgtgatcgaggatacatttttcggaccatcagatctgcagctgaaacacttattttcacccagttcccaaagtgctgaactccggttgccgaccaacagtaaggctgcagtgaagggggccgggagggggtgtgtgttagtaatgaggaccagcccacacggacagttccagctgatggggagcggggtg

SEQ ID NO: 15484 - DNA, 201 bp, Bos taurus
ggtctgtcttctccaccctcagagcctagcgttgcactgtctggtcttcattaaagatggactgaatgagtaaataagcaaaggaatgaatccctatgatctggggctctgggccccaacctgactctgacacatctctcttcctcactgagtttattccattttgaccccaacagcaaagatccccagaactttatttat

SEQ ID NO: 15485 - DNA, 201 bp, Bos taurus
acctacctaaaaggacggtagtgagaaggaagtggaatcagatctgtagaagtacttgaaacatctcaagtctgttcatttgcaacacaagctggcctccgtacagagaaggcaaggaaagatcaaagagagaggcagatcactccaattggtggttgttgttcagttgctaagttgtatctgactcttttcgaccccatg

SEQ ID NO: 15486 - DNA, 201 bp, Bos taurus
agagaaagtgcatgaatgacatcaactcttctgattgttggaaatatattgtgctgagaaccaatgcctgatagagatcaggtttcgttataaggtcagtttcaactgcgggccactgaaatgtcaccgagatatatttcccaatgtgacattttgtaattgaaagtgtacgggtgtgactttcacttttgcatagcattc

SEQ ID NO: 15487 - DNA, 201 bp, Bos taurus
gtggagcctttcattcttggatgtcgctacacggcctggtgggtgagggctcctggatcaagaggatcagagaggtgaccccaggctgggtatggtcatgtccactgtgctgctgctggccactcagaggtcaggttcagggctcagtcatcctgggtctcggtgtttatgtttattttttagcatgggaatggtgccatg

SEQ ID NO: 15488 - DNA, 201 bp, Bos taurus
gttgctgctgctaaccatcccccaaccctcaaatttatatccctttgcaaaagctgaaacccaaggggaactgtgatctcgcagctttcatggccagaaccggcctccaggtactaggttttaaaaagatgcccaacttcctgggaactacacgtccctcctccctcttgggagtccaaattccaagaaatgtagctaaaa

SEQ ID NO: 15489 - DNA, 201 bp, Bos taurus
acctctttaggcctcataggagggcttaattgacattcagccaaatgagagcccctctaagatagggatagtctattcaacttagtcagtctcacagtttagtagggccttgcacataatacatgctcagtaaatatctaataaatgaatattaggaaaaatgagcagggatttgatgtaatctattcattcatttgacaa

SEQ ID NO: 15490 - DNA, 201 bp, Bos taurus
aaggaaaaataattcaggagttggagctggcatttctgtgcatgtgtgtgtggaagcactgggcgcattgaagttctctggatctcctcaaggaccctcccaggtagatttcatgtagatatcatcacttgggtcttccagaggattcacaaactagctcctgtacagagagggcagagaaggaaggaggaaagaggcagg

SEQ ID NO: 15491 - DNA, 201 bp, Bos taurus
agggatggaaagaagtggacaagttggaaaatgcctaaagaaagaacagacaagatgtggctgaacgtagggtcgatgatggccagatgttctacacattggagggccttactattttgaaagcaattttttgttgttagactttaagccccaattcttggtttgcaatccatagtcccttaacaattacaggtaggtcta

SEQ ID NO: 15492 - DNA, 201 bp, Bos taurus
cagggcggggcctggaaagtcagagggaggcttgttgatacagcaaagtctgatggcagggacctggcatctagtaccttgtgaagagtagaatcagaaagttagcacaggggccctgctccaaggccagcggtcagtcttgggtgatcgggtggcctgaggaagagggtgaagctcacaaacttgggtctcagacttggc

SEQ ID NO: 15493 - DNA, 201 bp, Bos taurus
tgtcatactatggacacctcccatctcagtgcgcaggcctgcagcctcagaactggaaacacggggacccgaaagaggctgtatggctcaccagtggcgacggtggtttgtccccatggcctcctcgtgctgagcggttcagtggcaggagtgaggcgtggccacccctttacggaccctgtgctgcctgctgcctgcccc

SEQ ID NO: 15494 - DNA, 201 bp, Bos taurus
caggctgaagaggcccagcgctgtcggggggcttgttctctgattcgcagcctcaggcttgagggtgtgcccgtgaccccggccatggtcaagaccttctccaaaggagacagaggggctgctagagccagtgctccgtgcaccttctttccagggggctggaaatgttgcaaaatcacagccttggccctggttggaaaa

SEQ ID NO: 15495 - DNA, 201 bp, Bos taurus
tcgtgacatgtctcctgctgttctctgcaggcccggggagttgtcacagagccgtttctcttcccctttcaaagctctatatgattatatttgatgagcacatacctttcatttccttggatgagatgttataagtagaatataaatcagggctaataggcgactggccacttcgatgtatttttcttgtcccatttggct

SEQ ID NO: 15496 - DNA, 201 bp, Bos taurus
gtcacccgagcatctgcattaaaggactctctagcaggacctgctacataaagtgtgggtcccagcatacaatgaaaacacagggcccctcattcaaaaattaagattcaagacagcgactcagagcacgcaggaaagtgtggggagtgggcgtctgagcacagggccctggctgtatgctttgcttactcgtgaagctgg

SEQ ID NO: 15497 - DNA, 201 bp, Bos taurus
aatgcaattgtccgaactcattccttttaccgaccaagtcctagggtccttgacatcggcatgttcttttccaggcaggcccagccctcttgcaacttcaatctcatgagccatgagaaagggaggtagatggagtgaggggggatcagactgggggacactgcctgctgctgtacaggggccaagcagggctgggctagc

SEQ ID NO: 15498 - DNA, 201 bp, Bos taurus
acataaacagagctccctctccagctgggagaaaggagagctataaataaagttggggttccgcctggaaccagattctcatgggagaggacactggtggtggccaaagtctgtcagtcttcctctttgctgatgtccaggcctggcttctgctgatccatgtgtcttggcaaaccgaatggaaatgatgccctcctgagg

SEQ ID NO: 15499 - DNA, 201 bp, Bos taurus
atgtttctcgttataggtacacttatgaaacggtctccaagtccttctgtgtccacagctcagtgcttggtgggtggcccaactgtttaatttggtcaagaacttactctttaattctcacctgtgctccttgccggctgtgtgccttcaggcaagtctcttgacctctctgggccttgttgccagtgaacaccaagcctg

SEQ ID NO: 15500 - DNA, 201 bp, Bos taurus
tcgactgggtcctccctatcagcagcatgctggaggagatgcccatgtgagccaagctgggttgatggcatccaggccctcgccagagcccatgagccacgagcgtgtattccgggatgtctcaaggtccggatgcaagggctcaaccccagttcagtggaaggagagtttctgcagtggggccaggacacccttcttgtt

SEQ ID NO: 15501 - DNA, 201 bp, Bos taurus
caatctgaatctaggaataatttcccttagaagagccttagccacttcagttgccctctctgttctagtagggagagcctctatccatccagcaaaggtatctgtaaagactagtaagtacttgtaagtatccatgaggggttgtaaaacccttctttgcttccaactttacggggaactttattgtctctcgttaaaata

SEQ ID NO: 15502 - DNA, 201 bp, Bos taurus
catggagcgggacctggccttccagcaggcacatggtgggtgctaaacagagaaatgagctgggttgatcagcccctgggccggttggccactgagggaaagagcctgaggcaaaggtccagttctccactcattccacaaactccaatgaagcattcattacgagctaagacctgggccaggcctcccctgcactcaagg

SEQ ID NO: 15503 - DNA, 201 bp, Bos taurus
gccaccaggaggagggcacttctcccacgcggtgccgaggaccatcctcgcagacccatcgaggaatcaccgtctcagtgacagtaaagaaccgacagccttcacaggctttcgaccataaacaacttgacccctgggtttatgaggtatggttagtatttcccaacatgcagaacagaggagaatcctagagaattcctg

SEQ ID NO: 15504 - DNA, 201 bp, Bos taurus
cgaccagtcagacaagagtatgttcacaagtatacatggataagggctcaatctgggatccacagggatctgtgcacctacatgggagaaaaaaaaaatacatttccactgacctctaaccgaaattcagcatttcctcctaccatgacgtcaggcagaaaaccacagaggtattcatgctcctgtgactctgaaaccaac

SEQ ID NO: 15505 - DNA, 201 bp, Bos taurus
gaggacagctgaaacctagactgacaaggggtaatgttctgacagtcagaatgatggaggaaaaaatgatggatggagatacaatgaaagagggaacgtggtgacagagtggatacagggactctaagaccaggataaaaagcttgggtttcctctgactcagatgtagagaatagacttgtgattgctaaggtaaaagag

SEQ ID NO: 15506 - DNA, 201 bp, Bos taurus
tgcatttttcatataacttggccaccaaacagaagccacttacttcatctggtgctcaaccagagaaacagccattgtgggtaattttggctgagcatgattttagctgctccctctggccttagatttctgcacaagacaggattccaatgaatagctttgtgaaattcctacttggtgccatggataatcccacaatgg

SEQ ID NO: 15507 - DNA, 201 bp, Bos taurus
tagtctatcttatatttgcaacaggttttggcagtttccaaagccttttttatttgtcatcccactgtcactggaggtaaatggagaagagacatatataccttcaaaaaatttaaagcatattagggttcaaagaggttaagtgactttcctaagattctgcttctagtaaacgacagcactctgtttcagtcagctatt

SEQ ID NO: 15508 - DNA, 201 bp, Bos taurus
aggttctaacctgctgcttggtgaagttttaacaccatgcttgtgattgctttctgctcattgacagaatctgttcctttgggggctggtattaggattactgaaatggcacatttactttgactgtaattagtgggaaatataatgacaatttataggacaacatatagctgagccaaactccccaagcaccgacaggct

SEQ ID NO: 15509 - DNA, 201 bp, Bos taurus
ccgtccgcacgggacctgctacagctacaagcaagacgcactagaacaggcttccgaagcctttgcatatgctctgcgctccagccagagacataaatacacctcacacacagcgttaaaagaatcgttctgcagcctacacagatgtcaaaataataacaggatgatgccaggcaaggaaatatttctgatgactcttcc

SEQ ID NO: 15510 - DNA, 201 bp, Bos taurus
tggagaatgagtttttcactttgaatatgtgacctctttgtctttccttgaagctgtaatttatctgaggcacagtctcatctcactggccaaacatctctctctgggagcctttgtcagaatttcagggtcaaagatgatatgtaaaacattgtcctggggccaaatgtcagatgaagaccttctgctatgcagagcttg

SEQ ID NO: 15511 - DNA, 201 bp, Bos taurus
atatcaaatttgcctagataaggagagaggccggagtcacaagggacagatactacagatgtgacttccctggtttagtaccaggtctctggaggccaagcgggcttccctggtggctcaactggtaaagaatctgcctgcaatgcgggagacctgggtttgatccctgggttgggaagatcccccggagaagggaaaggc

SEQ ID NO: 15512 - DNA, 201 bp, Bos taurus
tagttcctttcaatactcagattgccccataacaaagtcaatccatagttttctgttcctgagcagcttgagcaatggtacatataggccattcatgtacatatagactgttatggcaattgccatccatattggtagaagagctctttatcccttatccatttgagacacagtctggctcatgggggttcaccctgttct

SEQ ID NO: 15513 - DNA, 201 bp, Bos taurus
taactttggggtctgcaaccatattgagtcactgcaagtccccgaggagcaagagaaggagaaggcaaaagccttcctccaaaagaggaaaagcaagttgagtgggggtgggggtaatagtaaacaaagtttccatggcttttcactggctgagtccttgccggcaaagaaaaggagtccttctttcctttgggctgtgct

SEQ ID NO: 15514 - DNA, 201 bp, Bos taurus
cagttggctggaactccccagccctggcccatgccaggtaagagttcgcattgcattcagatctcctggaggcaatgccgtttctaatccctgtctttaccgacaacaggcattttctctgttctgcgtaattccgatataccatccttcagctctaatgaacccagtcttgaacttcattcagtggaactcaataaaccg

SEQ ID NO: 15515 - DNA, 201 bp, Bos taurus
ttcctgaagataagtagagccccactgttgctctcaactttacagaggtagcgtgcacagaagtaataaagctccggccaaatcctgctaacgatcttacatgaaatagcatgaattaaagaaagtctttgtctcaagtttaattatagatgcttcagaaggagaaagcaagaaagagcctcaaactggggccttacttca

SEQ ID NO: 15516 - DNA, 201 bp, Bos taurus
aggacagggaggaaccacatctgttttgttcactgaatatatgcaactagcacacagcccctgctgcacactgaggcctagtaaatcttgaatgaatgaaggaaaaagaaaatcacttggacagaggagaaggtgtgtattactgacctctaggcttcagtttcatctgtcaataagaaatagggccagcaatatttcccc

SEQ ID NO: 15517 - DNA, 201 bp, Bos taurus
gacatagaaataaaaaattcctgatggctcactctcacaccaagttattaacacctatggctcaaccattcatcacagacctcctttcccattttaggcacgacatcctcaaaatgtcctggcctctgccaacaacatcccagacacttccaagcactcagaactagagaagaaatgccaggttttggttaaatgagttac

SEQ ID NO: 15518 - DNA, 201 bp, Bos taurus
ggaagtgaaggacccaaggccctaaaggaggaaggaagacaagacaggaagaggctgctcctcagttcaccacatgaaaagctacctgtcctcccatcaagtacaacggagctggaccccatgggccttcctgggacaggcctctccctatatcctctgctttagctcctctccaaaatacctttgttgttgttcagttgc

SEQ ID NO: 15519 - DNA, 201 bp, Bos taurus
caagtggcctttgccctcaataaaatagaagccacgttcatctgctccgagtgacggggggagggtgatgctggagactgaaagaaagtagaaaaccaccacttgccgtgggctttggatgggccttatcagaggtaaataaaggatttactgaaaaacattaagaatccagttgaaatgaattaatgagtttgtggtggg

SEQ ID NO: 15520 - DNA, 201 bp, Bos taurus
tgttgtggggaaacaggcggccgtgggagggagccccaaatgacaagaaaccgaagccttctcaccaaaaccaggaaaacacggaggcccttagtccaacaggctgcaaggatgtgagttcatcaacagccacatgaatgtggaagcaagtcccccgctgggtgctgtggcctgaatgtttgcagccccccaaaattcacg

SEQ ID NO: 15521 - DNA, 201 bp, Bos taurus
catgaaccacaaagtccacttggcggccctctgatagaagctggggtcaaggtcaggcttggaggctctgaggtagacaaggccaggttacagactccctcactagaagggagggggtgaggggtcagagatgaggagtcccccatcttaagcagatgtcagaagaagagacctccactaactctgactgaaattccaagg

SEQ ID NO: 15522 - DNA, 201 bp, Bos taurus
cttcttcatcctttttagtttcttggcctttttccttccctctgagaggggttctgcacagggatctgtctgctcaagctcagtgtcagaaatctcccccgatgctcgggcctccaggccggcttctgctcgactgggactcaggtttctctttcctactgtgctggtggctgtgagactgaaatgcaaatagaggaaaaa

SEQ ID NO: 15523 - DNA, 201 bp, Bos taurus
ggggacctcagagcaacggctaagagcatggcccccggcgtccactgtctgagtttgaatctttgctccatcacttagctgctatgtgatcttgagcacgttgcccgctctgggcctccaccatggtagcagggcgatgacaatcagagctccctcgttaggcttttggaggatcaaatgagctcaagtaagtaaagctct

SEQ ID NO: 15524 - DNA, 201 bp, Bos taurus
gccaccatgttaaggtctcccatagcttgactgctggactaaaaggcacaggggctgctgccgatggtaaaggaagtgacgcagtacttagaatcgggccgaagttaagggtttacttcggcggtcttctggcttgatcagcctgagaaagactgcccttttggatcttgtttctgagttgggcccaaagggctgagctgc

SEQ ID NO: 15525 - DNA, 201 bp, Bos taurus
ggctggtaagaagactgaggcctgtggtcagcagcagggtcatctcctggacagcagtgtcagcagagcagggaaggacccgtcacaacagaggaggcaacggggaaaggccctcctcgacacggcaggcgggctggcctctcggtgggtggcgatacggcacaaagacgagaggctggggctccagtcctggctctgccc

SEQ ID NO: 15526 - DNA, 201 bp, Bos taurus
atgaaagagtcctataagctgctgtcattagtggcctcacccccagcatcttaccaagaggcagtgatggggctgggatggaggtgtgccccaactgggggcttcgggccagagccaggttcagctcctcgctcttttcccacttcttagccatgtgcttttttggaaatgctacttaacttcccaaactctagcttgcag

SEQ ID NO: 15527 - DNA, 201 bp, Bos taurus
gacctggcagccaggtgtttggataagcatggttgacttctaaacactgatggcaagatgacttctgatatgtaatcttaggttaattttacaggtaaatgaaaaaggccagcaatcatccactaagattaataaacagtactaaaaaatttactgcatgaggactgtgctctgcagcagtttcccaagacaaagaaccca

SEQ ID NO: 15528 - DNA, 201 bp, Bos taurus
tgcggaggcttctcttgttgcagagccacgggttctaggcaggcgggcttcaggagttgcggctcccgggctctagagctcaggctcagtagttgtggtgcgtgggcattagttgcatcacagcctgtgtgatcttcctggatcagggatcaaacctgtgtctcctgtatttcaggtggattctttggcaccccactccag

SEQ ID NO: 15529 - DNA, 201 bp, Bos taurus
cataaagtttgggagtggagaatcagttgacccttaaagacacttgtatgtatttcagaagttttctcatgccaagctaagagcagtttcacgtagtatacttcagggtcaggaaggccgcccataaagggcattgtttgtgatcctttgaggacgttgaggtgctgttatggtgttttctttctccctctctgatttaca

SEQ ID NO: 15530 - DNA, 201 bp, Bos taurus
tgggaaactggcttttgacttctgcctgtcctgcttctgcagaaggtggtcaccctgcagctttaggcctaaatcaccccaatttgcaggcccaacagaaagagaattcccaacccacagaccctgtgtccatctggggaaggtggactgatgggcaaactgcaggatctgatgggcaaacagcaggattgcaggggcctg

SEQ ID NO: 15531 - DNA, 201 bp, Bos taurus
ggcctgtgcataggtctccagaaggacgtggggcacacgatcatggttattatgacctgtttgcaagatggagttgcatctcagatctggtttaaagaagagtggccttgactcgccacttcaatgtgtctcttaggcagcgattgtttcatttctggaacagaaactcaaagagattaaagtgaataggaaattttattg

SEQ ID NO: 15532 - DNA, 201 bp, Bos taurus
cccttgggtgtatttggaaccttcctgtctgttttaagttccacacatctttggcgttaaaaatccaaatggtgccaactgtggttgggccccttggctgtgctctctgggttggactgtggttttcaaggtgtcagtactgaaaaggaagatgtgtccttatagaaatggcctttggtttgggctgcgtattacctgcca

SEQ ID NO: 15533 - DNA, 201 bp, Bos taurus
gtctgagtctgaaggcctgatacccaggaaatcccaccgtggaagttccagtccgaacattggcaggctcgagacccaaggagaaccactgtttcacaagctcaaaggccagaaaaaaacattctctcagctcagagaagtcagccaggagcagtttcctcttatttaagagagaacctaccatagagcacagggaactct

SEQ ID NO: 15534 - DNA, 201 bp, Bos taurus
atatatacacacacacacacacacaaactcactattcaatgtgtttatattattatggtgggctgctaaatgtttaacaactagctctctggagaaacacgtaagcttattcatatctttactgatatgaaggatgtgtagcgcacaatttacaaatgagaacaaaatataggctattctttcccatctaaccacttgatt

SEQ ID NO: 15535 - DNA, 201 bp, Bos taurus
ggattgccatttccttctccaggagatcttcccgacccagagatcgaacctgggtctcccgcatcgcagacagatcctttaccgtctgagccaccagggaagtccttatattaagagaaggaaagaggtagaatagtcagtctgtgaataatgaacatctgactatgtataatcactttgagaaacacagatcctctgagt

SEQ ID NO: 15536 - DNA, 201 bp, Bos taurus
cccctctctctttcaggaacacagcagacacagttggaaacatgaatccaccttgcaaactgccaaggcagctgtggcaggtcagaccttctagaaccagatgttggcctggagcctgggctgctgctgctgctgctaagtcacttcagtcgtgtctaactctgtacgaccccatagacggcagcccatcaggctccaccg

SEQ ID NO: 15537 - DNA, 201 bp, Bos taurus
ggctccccacatccacagaagggggacactgcagtgcaggccccaggacactttgggacttgttcagcccactttgtttgtagaagagaagcatctcctcgttgtcaggagctgagggcctgggctcggatactggagccacccctaactattggtctgagttcagaccagtcacgttactcttctctgcctcagtgttcc

SEQ ID NO: 15538 - DNA, 201 bp, Bos taurus
tggagtgtctccaggctccccagcgcctcagggtgaatgaatgggttttcagtctttttatcagcctgtcttggctgtgaccacagcaagctgtggcccccgaggaagatgccagaagcagggtctactgccaaagcgctctctgatgccatccccgggaattccgactccctggggctcccagcgggtgagaacaagggc

SEQ ID NO: 15539 - DNA, 201 bp, Bos taurus
ccagaagagaaaatatttccctttcctcttacactcaaatcttttggtttcccttgacagctgagtagcacctggggccagggggaaggccatggggtcacgcagagctgacagtccctgttgtgtgggtgacaccctgttgtgtctctgagtggacaacccttattaatctcgagtcctattagaactgctactggcccc

SEQ ID NO: 15540 - DNA, 201 bp, Bos taurus
attggactagaaggagggaatgaagtacagggccactttgtgggctgttgagaatctccatcgggtcacacggccctggggctttgcatagggcctggtttgcacactccatccctgggagtcccatgctgatagcatagaggaaggatgctccttccgtcagcaggcagtccccgagtgcctatgatgtgtgagggtggg

SEQ ID NO: 15541 - DNA, 201 bp, Bos taurus
aagagacaatggagggttagaaagtggaggaagaaaaggcggtggggaggctgatggataaggcggatggaaatggtatggacagaagggaagagagagaacaaaaggaggatatagaagtattcatctagtgagttgttttatccacaagaaggaaaacaagatttaattgacagatttacaagccaagataaaataaaa

SEQ ID NO: 15542 - DNA, 201 bp, Bos taurus
atatgactgaagtgacttagcatagcatagcatagcatggcagttctatttccagttttgtaaggaatctccacacaacactccatagtggctgtactagtttttgaatacagaatctacgtgtaactaacatgagttttagaaataaaggggaaaaaaacagaaaaaaaaatggagaggaagaaataactcattatatat

SEQ ID NO: 15543 - DNA, 201 bp, Bos taurus
tctttaacaaactgtcaccttttggaattaattttgacttcatatagagtatttaagactaaacatatctgagaaggcaaggactggctttcagtttattctgcagaaagaagtttcattttcatttctaaatagtctttaaaaaaaaacaaaaccctgtcataccaaattcccactgcactatatatgctatctatgaga

SEQ ID NO: 15544 - DNA, 201 bp, Bos taurus
ataatgtttccacttttggggctactgtgagtaatgcatgtattactgtgagtaatactatggccattcacatttgaaaacctgttttcaattttgttgcgtacatgctgagaattggaattgctgggcccatgtggcaattctgtgtttaattttttaaggaagtgctgaactgtcttccagaatggtttctccatttta

SEQ ID NO: 15545 - DNA, 201 bp, Bos taurus
gatttcctcaacttcagtcactatcagaataaaattcaaagttctcagcctggcctacaacaggtttttctcaccatgagcactgttgacgctttcggccgaatattctatgtgtgtggtggtggaagagctgtctggtgagtgctaggatatttatgggcattcctgggcctcatccagaaatgccaacatcacccccat

SEQ ID NO: 15546 - DNA, 201 bp, Bos taurus
ccaaaacatgattatccattttattacaacaacaaaatacaggcctgtggattggctttgtctaaaattaaaaggatatacacgtgactgcatcttccaccgattttgacatgcatggcccagctctggaccattctaaatatggagcagacaatcaggcatctcagtgttgaaaattggtccctttatccatttcaatga

SEQ ID NO: 15547 - DNA, 201 bp, Bos taurus
ctaggagacactacatttgttaatgtgagcagcactggctgttggccaacaagttggtgagcccaataaggcacagaagaatttatctaaaaatagaacacgaacataaagtttgaggggccacgctcctctgagacgcactgtccaacatttgcttccttggcttctttgagacaatgaagatatgaaatgttcagtatg

SEQ ID NO: 15548 - DNA, 201 bp, Bos taurus
gcttttgcctggtgagggcagaatcagaagctgccgggcctttggaggtttaaaaatcacacagtgaccagtgctgcctcctgcttcattctgttagtcaaagcaagtcccagggccagctgtctggaggggagggaaagcagacccacctccggctgggaagagtccacagggacactggggagggacgagcgaagtggg

SEQ ID NO: 15549 - DNA, 201 bp, Bos taurus
aggcagattctttaccgctgagccacctgggcagccctgctgacacttagcactgggtaattcttctttggtggggggaagggtggcctgtacacaatagaatgttgcacagcatctccagcacccccaccgcatgctggtagcgccccctgcagtcatcaccatcgcgcctgtctccatgtgctgccaaatgtgggatgc

SEQ ID NO: 15550 - DNA, 201 bp, Bos taurus
acaagcaccttcaaactggagaaaaattcattcaccttttagatttgatcatggtttatttttcactgcttcttcaaaatcatgttcagaataatactgtcttgtttaaggctccaggtgttcctgggaacttaccatttgattctagacggaattcactcttggttgcttttggttagatttcttccaccactaagctct

SEQ ID NO: 15551 - DNA, 201 bp, Bos taurus
gcttgtttagcctctacagtgggaggtgggcaatggtgaagtaacattgaaaatggcctctgggtcagttaataagtgtttgacatgattaccactgtgcacacagcaattcatctcttcttcatgggagcatgacctaggggaggatgggtcctcttcaactccaagggatgaatcatgattgaactaagaaattcagtt

SEQ ID NO: 15552 - DNA, 201 bp, Bos taurus
tttccaacacagctttttcattttttccctctctttccctccctcctctctacccgcagccccttacatacacacacatatatctttggaattccaatcatctgtctacttctctgccccgtctattagactgtgagcttcctgaggtcagggactatctcttatctctgttatgttcaacacctaaattactaaatatgt

SEQ ID NO: 15553 - DNA, 201 bp, Bos taurus
aaaaagttaaaaaataaaaaaacaaatttatttttcacagttctggagattgagaagtccaaggtcacagtaccagcatggccactttctggaggatacctccttcatggttcatagctgaagtcttttccgtgtgtcctcacacaagggaagggggatgagaactctctggggtctgtttcataagggcactaatccatt

SEQ ID NO: 15554 - DNA, 201 bp, Bos taurus
tctccaggggccatggagcgctctcctggatgagaggctgaatgggctttggagatgcttcctcagctgcacaaatggtctcagtttccaggccccttaactctgttcacttctttctatcgtccttgcttgagctacaactagggtgaatcctcagtcccttataggcctcccattcccttctggcctagtctgagttcc

SEQ ID NO: 15555 - DNA, 201 bp, Bos taurus
gcagctaggggccatgctcacccaccagcatgccacagcagcagtggcaactctacacaaaggaaggttaacatagcctacataaaagatacttattgagcacctcgctctgtggccaggtgggactgcacttccgaaccccataggacgtctcctacataagtcactccttaaagattcagagaggtagatgactttatc

SEQ ID NO: 15556 - DNA, 201 bp, Bos taurus
acaaagacccagggcagccaaaaacaaaataaaaaaaaaatttttttaaggatcactgtggccagcctcagaccacaaaatggcttctctaatattgagacagtcatgtctggttgtctttctccagcgaatatctgcttatatgcttactgaggtctttagcttactgacatcttaagtgtcctgagacaaaactattca

SEQ ID NO: 15557 - DNA, 201 bp, Bos taurus
gggaaattaaactacatacttctaaataacacatggtcataaaagaaatatcaacagaagttttaaaatattttgaggtaaacgaaaataaaaattaacatcaaaagttgtgagatgtcacaaccattataatattcagtgaaaagccttcccactaaaatctggagcaagacaaatatgtccatttttaccacttttatg

SEQ ID NO: 15558 - DNA, 201 bp, Bos taurus
agaaataattgttctcattttatagttgaatatgcagaagttcagagaatttaaataatgccgcaggtaactgagaaggccagatttgtgccactacatagctctttttcccattgtgctatagcctcttccagtggcagaaatgactgaggcctctaatcctacctgtcaagtctgtttgacccccaactgttaccagca

SEQ ID NO: 15559 - DNA, 201 bp, Bos taurus
ttgtgctgggtgctggacagggccatctttgccatttcccctggctcagggaattctgtctaaagcagtggtcaagtaacaaatttctataaagtgttagtaaatatttagactttttaggccacgtatgcttttaacatttttaaaatgcttaaaaaactaaagccattcttagcttgatgaccatcacacatagatcat

SEQ ID NO: 15560 - DNA, 201 bp, Bos taurus
taaacttgcaaggtcatatggtaattatatgtttaactttttgaggaatggccaaacatttccccagctgctatactactttacattcccaccagcagtgtgtgagggctccagttttctacattcttgccaatatttattttctgtttaaaaattaaaatattttaagttatagctcttagtgggtgtttacacattgtg

SEQ ID NO: 15561 - DNA, 201 bp, Bos taurus
gagtagaggttttggaattcaaaaggaaggaggacaattcaaatggagctgaaaaaagcaaatgtttggtaaaaaatacatttgctgggccaggcagaaattatgggacacagaacagactctactctatagtccctgcctgagtttcctccacacagctaacctatatgctttgcaggtacctctcataatagctctatt

SEQ ID NO: 15562 - DNA, 201 bp, Bos taurus
gtcacacctgaactggcccaggcgtttctggagaggatcagctcctccaactttgacatgaggaatacctctaccatccacaggcaaggggcgtgggtgccgggcccccggagctgtttcccatctaagcatcagcttcctctgagcagcaaaagagccggggagggggagggaggtggctgatccatctctttgaatcgt

SEQ ID NO: 15563 - DNA, 201 bp, Bos taurus
ttgttgccccccgccccccccaggaggcctgaagaagctgaagttctattttatgagcccagctccagctctgtgagtcttcccctgacctgaagtctttcgtggggacctgggccctcagagttctcaatgttccgcttcattttcctgggcaggtccaaagtttccaggcctgggaatgaacgccctgtttcagtggaa

SEQ ID NO: 15564 - DNA, 201 bp, Bos taurus
ccctctattcaatcagggagcaatcagtgcactttcctcatgggacatttgaagaggagtggaaccagcagaaaaagaaaaaaaaaacagaaccaaaaagccttttgggcttttctctcaaagcctaaaccttttattagtgaaaagagatttaagaccagagacaatgacttgaagaaatggaaagatgtcatttgtttc

SEQ ID NO: 15565 - DNA, 201 bp, Bos taurus
tggggaaagcccagtatggtcagaagggagaaagcaggagcaaggagaaagcatgactgggatgatctagtctaaataatttcagcaggctcttagctatcggggtggccctgagttacctggtatctgactctgggatgattaagatctggaatattacttctggaataataatatctggaatattacatggtgtggagg

SEQ ID NO: 15566 - DNA, 201 bp, Bos taurus
tgtccaggcccaagtccaggttgaacaatcgtgttttgtagcggacctcctagggagaagcagacccactctacatgtcttcctcaaatcgctgatcagagcagagaggccggatagcctaatgggtagaagcaagggccttgccttaaaggtaaaagttgctaagtcggcctacataaaaattaattatttctacatgac

SEQ ID NO: 15567 - DNA, 201 bp, Bos taurus
atcatgtgaataagatattcatgcagtccccaagtctctacctcacatacccagagtgtaataatatatggtcaatgggttaccaatttcatatcaataattgacttttaattataaactaacagtataaaaaccttatggtaccaataggaagcaacctgggcattgatattaaaaaataaagagtcccccaaaattcat

SEQ ID NO: 15568 - DNA, 201 bp, Bos taurus
gcggaacttggccacctcgttgtggaacttctccccacagtggttcacacacgtttccagcacctgcacagacaaaggacccccatgagaaggtgaagccattggccccacagctcgtcccaaacctggtaagtattggttggaaccatggctcaaggctgaggtcactaaagtttgggagaaaggatgagactttcagat

SEQ ID NO: 15569 - DNA, 201 bp, Bos taurus
acgacctggtctgcaggggcaagagggaggggtggcttcaagcctgtccagcctctgccttgcttacccccctcctctgccagcccaggtcaccctcaccatgggcctcttcctccaggtgagccagacagggagcccccacaaggatgtttgcctgacgataaagactctctccgaaggggtggctgccaccggaaagca

SEQ ID NO: 15570 - DNA, 201 bp, Bos taurus
gaactggttatcctgggggataatgtgggttgaggaagaagtgttttatgaacagaatcagcacaggggtaggaaggaggaggtgttcaggggcctcacggagctgccgggagatgtgggaagagcgtgcaggcaaagaggtgggctgtgtcgccggggtgactctctgccgacggcagcctccagctgggccttccgagg

SEQ ID NO: 15571 - DNA, 201 bp, Bos taurus
aacttgtacagtgtagaacattgctcaaaaaaaggagatctaaagaaaaggagagacatcctatattcacagatcagaagacttgatatagttaagatggaaatattcaccaaactgatctatggatttggcagaatccgtatcaaaatcccagcagtctttttgcagaaattgtcagaatgaccttaaaattcatataga

SEQ ID NO: 15572 - DNA, 201 bp, Bos taurus
ggtaccctagccaggctctttcttctgacgatgtttctgcttgaccttggtcaggagcccagagtatctgtcctgcctgccttgcctttgtctgtaatcatttggctgtgccacgtttgcaggatatttattaaggaacattggacaggattgaaaacattagattaacggcatacgtttttctagaaaatgaaagttgtg

SEQ ID NO: 15573 - DNA, 201 bp, Bos taurus
tgatgactaaacaatagcaaatggcttaaaaaaaaattgtggctatgaacccatggcatcctatagtgggaaacgcaaggatagatgcagaaggccatgtgcttcaggaaaacatgagagaatcttccttggtagaggtgatgtgtgtaagaagcaaatcagctcttctgactcccataggccacctgcctggctccatcc

SEQ ID NO: 15574 - DNA, 201 bp, Bos taurus
ttactattagattttaaaactatataatacatgatcactgtaaaaaaaaaaaaaaaaagagccacataattcagcaaaggccctattttgagaagacctccactgccattacggtgatcatctttaaagaagtgactcttaaggattggaagagactggacagggccttggaagagactggtcagggccttccaataagtc

SEQ ID NO: 15575 - DNA, 201 bp, Bos taurus
agatataaggagagaggacctattatggaagggagagatggggttggttcttgaggagtgggaaccagggagcagggccttggtgaaatgatgctaaatggaacattacagtaaacccactagaaaaggcgtcacaaaggcagctttgatgttgatgctggtgaagcgcagtagattgcaaagaatggccctaaagacttc

SEQ ID NO: 15576 - DNA, 201 bp, Bos taurus
atcatgtcctgctccttgaacactataagactcctcaccaccccctccagagggggacacacagttttgaaggcattatcctgctgtggccccatttgcccggcaaagaagtaaagctacacttttctacttcatgtaaaactctgtctccatatttgtatatggcactcgaccagaggttgagtttctgaaacaagaggg

SEQ ID NO: 15577 - DNA, 201 bp, Bos taurus
tcagacggagaagaagaaagattcagacgcttgaggtgggagacaacccatcacagctgtaggtaacaccagtgggccaagggaatatgatgcaggcatcggcagcatctgctgcactcatggtgggcaaaaaaaaaaaaaaaacaacaaaacaaaactggggccactagtggcttacactatctctaagattggcaatcc

SEQ ID NO: 15578 - DNA, 201 bp, Bos taurus
acataagctggccctctgtggtctccagggctgttggcctctgaagctgttgttaactcccccttgcaatgtctctgatagcattacaggacacgggggcactgagctactgagccactctgcagcacagcatctcaggaaggcctctgttataatatgaacattatgttgaagttgaagctcagaaactaaatgatgcaa

SEQ ID NO: 15579 - DNA, 201 bp, Bos taurus
tttttctgtaaggggctggataataaatattttacactttgcagaccataaggtctctgtcacattttccaccttggtttttgtgaaatgaaactggccttaggtgatacgtaagtggatgggtgttgctgtgttccaataaaactttatttgcaaaagcaagtgaagggccagatatggcccattctctgcacttggcca

SEQ ID NO: 15580 - DNA, 201 bp, Bos taurus
ggaggcccacctgccaccaacttagcccttacttcacctcccttgtcccgctgtgtggatgcatgaaatgagtgtatagagtgtaagaatgcgaatgtgccgattcagaggggccatccatttattccctgtaatttattaagtacctattatataccatgctttatgaaagatagatataatacctagtgaacaagacaa

SEQ ID NO: 15581 - DNA, 201 bp, Bos taurus
cctcacgtgcctcaaaagggccaccattgaacccaaaccattgtccccaagtaactcttatcaagtttccctcacagggcccacctctctaaaaatcactcggaaacaacctttgccgaccatctaagaggacactgaatgacctggacaactctcggcctacagctgttcttgacccagttgttacaggacctctggact

SEQ ID NO: 15582 - DNA, 201 bp, Bos taurus
tagagctgaggtgaggggctgtcaggttacacttgcactaagttggctgccaaaccaaagcctcaagtacaagaaggggtgagagacatgagacaggacatgagaaatgcccaatatacctctaaacggatcttcttgttcctatcctaaccattgtcactctaatactttctcaccagtttccataaagatctcaaaagt

SEQ ID NO: 15583 - DNA, 201 bp, Bos taurus
agtccagtctggaattattgtgtatgtattctatgagtatgtataattattatacaaggttctggggttgcagttatggataaaactcagtcccttgctttgagaccacctctcaacaaaggagaggaagagcttgctaggcagggacaatggagagtgataactcttccgcagaggtgagccatgtgccatgggcataca

SEQ ID NO: 15584 - DNA, 201 bp, Bos taurus
cctgtgcagggggaacgaggccaggcccaagggatgtacaaagtcaggagggcagagggaacgtgatctggggtaataattgattctcaggtggactgcagacagggtttggggaataggcctggggctgaagtcttaagggagttacggctccttctagcagacaagacagaaggccagaagggagaaagagatgcaagc

SEQ ID NO: 15585 - DNA, 201 bp, Bos taurus
cttctcctacttttggtaggaggtcatggtcttctagagcaggccctccttaagccctgagcaagacggtgggactgggcctggacttttccacccactatgggactcctctgatgcgcagcattgctttggggctctgctggctggcagacaccttgtgagcctggaaagccctctgaaggctcctggggcctccatcct

SEQ ID NO: 15586 - DNA, 201 bp, Bos taurus
atccattttccctggcatttaacccagacccttacattcctttgccccaaacaccctgggtctgtcccgattccttttataataaccaccccaatcattatgcctccatggccttcactctcagatttgacctccaatccaccttctgtctcagctttgtttcctacgggaccactggtgcttgaatatcagatacttttt

SEQ ID NO: 15587 - DNA, 201 bp, Bos taurus
ggcaactctggcacatgatcggagggcaatgaacggtttctgctagtatctgtcatccttaaagccacagagccataaatttccatcctgaggccacctcattgctctgagtaagacagccccgtggcaaagaacgcaggatccaccgtcaaaacatcctgggtgacggcccagttctgacaaagagtagctgtgccacct

SEQ ID NO: 15588 - DNA, 201 bp, Bos taurus
atctgatggcttagggctcctgaggaggccctaagtggaatctggtgcatcgtcctgacccagagtgacatagcatcaggccctctgcaatcaaagagttaaagtatttgacaagacctgtgcagattcagagtgggaaggagctgcccaagactgtggcttgtgggtcatgggagatgggctccactgggggccatcttt

SEQ ID NO: 15589 - DNA, 201 bp, Bos taurus
caggcccgagagtccgggagtcacaactactgaagcctgcacgcctagagcccgcgctctgcaacaagaaaagccactgcaatgagaagcctgcgcgccccaacgagagagtggccctcgctcagcacagcgagagaaaaacctgaaaagcagcgaagacccagcacagccagaaataaataaataaataaaattatagca

SEQ ID NO: 15590 - DNA, 201 bp, Bos taurus
ccctcctgctggctgcaaccggagaacatctctggcttcacaaggcatcctgaagtctaaacaacaccttacgtgtgcgagtgcccagaatcacacccggcgccccggatcaagggccacctcactaacagcctccaaaacacatctgacgtgctcctggaagactcagactttatccacctggattctacagccaactcc

SEQ ID NO: 15591 - DNA, 201 bp, Bos taurus
tgttcctgccagcctaactcccaagcctcatctcgctgctgatgagcaaggccctcgggtcacacagcctggaggcttccttttgtccccagcaatgaatattaatttcccattaatgaggcctttctccacttctcacttcagacagttctccaagctgtcttgagtgccttctattatcaggagccgttatttgcgtct

SEQ ID NO: 15592 - DNA, 201 bp, Bos taurus
acgtccattgagtcattctgatgcatgggccatattttgaatagtgtcttttaaaaatacaaataccatgaagtctcctctttgttgcaaccttctggaggtttctcattgtacttggaacaggccccaacttcctgcctgtcttttgaaccaccacccacctccaccaagattgtcaagcctccgcctatcctttgacac

SEQ ID NO: 15593 - DNA, 201 bp, Bos taurus
ttttttgctgcacctggaggcatttggcatcttagttccctaaccagggatcgaacctgggtcccctgcagtgaaagtttgtagtcttatccactgggccactagggaattccctgtggatgcccctaaggaggactttactaagggcaaggactctctcccacctcccttcatgtatcaggttagtagggttcaagctga

SEQ ID NO: 15594 - DNA, 201 bp, Bos taurus
gaaccttcccattttaccgatgaggctactgaggcctaaagaggttacactttgcccaggacacaccacaaatgagaagcaaaggccagagtgaagccagtgctctttatcatccagccttcagctttccagcttggctctgagaagagaggtgagtcagcctgcccctggggctctctgcagctaggctgtggtggccac

SEQ ID NO: 15595 - DNA, 201 bp, Bos taurus
caaattccctgttggacctgcaaggtggtagctgctcctcctaggcctgcctcttccagctcatgataaacaagaagttctcaaccaaaggtgattatactctccagggaacatttggccatgtctggagacattcttgattgtcatcaactggagggtgagggacattctattagagcccagtgggtagaggccagagat

SEQ ID NO: 15596 - DNA, 201 bp, Bos taurus
gggaggttctggagggtccttgtcctgattggatccccagtccccctgtgcgtgtaagccagttccaccctcctgcactccccccaggcccatcctataagtccaagaattatctggttcctggaacctcccaagcagaggctgtgccagggaagggtgggaccaggagttgtatgaggggtcgtgtgtggggcctcctgg

SEQ ID NO: 15597 - DNA, 201 bp, Bos taurus
gcctaagaagggcaataagcccgaggaaccggatgtcggcaacgagcgggcggaagtggtggtaggctaagctgattggcaccgggaaggctgatagggacctcaaactcaggcagctggggcaccgccttgtagctttaggttacaagtttttgtttacctgttttaatggacctccccccagtactgatccctcgtggc

SEQ ID NO: 15598 - DNA, 201 bp, Bos taurus
cagacggagccgaaaccagcttgatgtttctagaacacgtacctggggtgggaggagggaagggacaagggtacggggcctcaggccattcccctctgggtgaggggcaggcacttaccttgaacacaagcttttgccccagctggttcttgccgtctggtccgaccgggtcgagaatcacacagtagttgtgggggccca

SEQ ID NO: 15599 - DNA, 201 bp, Bos taurus
actgaagtgagcggagaagtcagtccttcgcggtctcccaggcagtgcgtggcagagccggcctcagcacagtctaacgccaaagtgtcctgttggccgccggacttaaagaaacctcgagggtcccatgaaaccaccttattccgctgcctgggtagcctcctcggctttaggaccggcgggcgtggggcactggagtgg

SEQ ID NO: 15600 - DNA, 201 bp, Bos taurus
gcaggcagccttctttggaaatttcttcctaaaatcaactctagcggatggtccatgcttgtgtacaaaggctgtacagtctgaacaacttctgctgttccatctcacaagctaggctcagaggaggcactggagttctcaggaacaagaggagtagcagtggccccacgaggtaggacctcaataacgcgaggcttgtca

SEQ ID NO: 15601 - DNA, 201 bp, Bos taurus
gcagccaaaactaaaaataaataaatacaattttaaaaagacaacacaaacctattctggagactagaattctgaaatcaaggcatcagcagggccatacgccctttgagatgctaagtagaatctttccttgcctcttcccagcttcagtgtttgctggcaatctctggccttggatttgtagatgcatcactccagtct

SEQ ID NO: 15602 - DNA, 201 bp, Bos taurus
ggcaagttgcctaacctctctgagcctgtttcctcatttttgaaatgataacaatgcctatatcacagaatggctgaaacaagacaggacaagaggccagcgtatgcagaatctatgaatgatgtgtacagatcagagctcggcacacagcaaacactcagtcgatggtagctgttgttcacataagtatcctaacacaca

SEQ ID NO: 15603 - DNA, 201 bp, Bos taurus
gagctctggtctcatgcattgcagggagattctttaatgactgagccactagggaagctcaatcaagggagtgagtatccataaaatatttataccatgtatgatagcactcttgagtaaaacaagttatgtggctatgagaaatagtaactccttattttatggaatgtcaatttcaactgtaaaaacaactgacaaaca

SEQ ID NO: 15604 - DNA, 201 bp, Bos taurus
ttttagagactgcacagagttcatttcaattcaatctgatgacactgttatagacattctatgtgtagagtactgcagaaggtaagactcattcttccttccctggttgttaaaggggagcatttttttttccggccattccaggccacatgtggggtcttcattccccaactagggactgaacacatgccccctgcattg

SEQ ID NO: 15605 - DNA, 201 bp, Bos taurus
tcctgcacttgtgtttgagggtgtgccggaattggccaagcccccaccccctccgcttgtctccctgtatctgcagtgggtgaatggggtccatgtgatcgagcatgaggggggccatctcccctttgaggctgacaggaggcccctgtcctcctgccgcatcaccatcgccatcaacaacacgctgtccccccacaccct

SEQ ID NO: 15606 - DNA, 201 bp, Bos taurus
gttctgttatgtacagtcccataatatgatttctaacctctgacatcacatttatcatgctgcatattaatcatgtatatgtttatctctcttaagggactctgagcttcttgagaggagggccataacctcatgtttgcatccttaatatctaacacttgacacataatgggctcaaaaaatatttaatttggattttat

SEQ ID NO: 15607 - DNA, 201 bp, Bos taurus
cagccagctatggagttctgcctttgagacaaagcagccagagacaatatgtaaatgagtgagtgtaacagtgttcgagtgaaattttatttacaaaagcaggcagcaagcaggattgggcctgtgggctatagcttgccagtcctttcttagtggagaaacttttggccgtacacgtccattttctttttccctaagaac

SEQ ID NO: 15608 - DNA, 201 bp, Bos taurus
tgcagtacgtagcaaccctagaatatgtttaaatatgaaattagttttcctgaatttctagaacaaaattacctacccagtaaggaactcaaccccaaagcgtccaaatttgatgtcttttcctgcaaaccttcgccccttcttaagtctccttattcttttcgacctaaagtactgcttcttctccattggcctgctgtc

SEQ ID NO: 15609 - DNA, 201 bp, Bos taurus
ctgggtgggtaagagagtccatgggctcccctcggcttctggctctgtgagtgagcacacctgggtcagggtgggggtcagttttgagaagtatctgggtgtgtgaggccagcctgggatccttgatcctccatgaagctggtgggggtgagaggagaccaaaccagtcaattctaaaggaaatcaaccctgaagttggtg

SEQ ID NO: 15610 - DNA, 201 bp, Bos taurus
ctcttggctcttgccttttgaacactttcttatttcctggcatgacaggatgctccaagctcatcttgtgtacttcctgacccagtttcctggcctggtttcttttcttagagaatggtgttagaaaccaagatctgagccctaggcatgcttgttgctgttgaagcattgttgcttctaggccctgtcacctgacagaac

SEQ ID NO: 15611 - DNA, 201 bp, Bos taurus
ccttgcatcccaggagaaaatcttacttgattatggtgtatgagacttttagtatatttttgaacttagtttactgatattttattggggctttttgcatctgtgttcatcagggatatgaagttgtagttttcttttcctgtagtgtacttgtctggttttgttatcagggttaatactggacttgtaaaatgagtttgg

SEQ ID NO: 15612 - DNA, 201 bp, Bos taurus
tgtaaaacaccattccaacacagggtggtttctttaatttcttgatgtgttttttcccttaaccaacgatatttctctcatctagttaaggattgcagtcggcagtgtacctctagtcttaatctatcatcttgcatataaccaacaagtacttagtaagaacttgttacttatcccgtagtctaacaatcactatgggtt

SEQ ID NO: 15613 - DNA, 201 bp, Bos taurus
tttctgtttctctctcagaaaacaatccacttctgagcatcgttggaggccggttactgcgtctgcatgctgatgatggccgcgatgtgcccccatcccatgtggtcctctgccctgcatggggtcactttcatgttaggcaaatggctgaaatgtttggccagcagcagcacagataaagggaaatagtctttaaaattt

SEQ ID NO: 15614 - DNA, 201 bp, Bos taurus
caagagagcaggtgttgctcagagacagtcagggttctcaggaacccctggatgaactggatgtgaaggaaaataaagaggtggagacacatgttcaaaatctgtgtggccactggtcaggggaaatattttttaagctgctctacaaggcatgtggggtcttagttccctgactagggattgaacccatgccccctgcag

SEQ ID NO: 15615 - DNA, 201 bp, Bos taurus
aaagtgattatgcatatatatatgtaatatatatattcctttttcaattctttttcattatagtttatcagaaagcttttagtccatgtcaatttctcttcgcagaactgtcccagatggtttttctctttagaaaaatgataactaatacctttcaggaaagaagaacaacccaagggagatggcccgtgagttcatcat

SEQ ID NO: 15616 - DNA, 201 bp, Bos taurus
aataaaggtcagcacatgtgggatgtgggtctgtagaccctagggccatctctgcccctgtcactgatggccttagacaaatctctgccgcaaagcacacgcatgtaaaacagggacgtgactgaagggtgtctgggccccttggagctctcaaatttcaagctcctctccctgcagctccagtgtgaaaacatacatacc

SEQ ID NO: 15617 - DNA, 201 bp, Bos taurus
agccagcatagcaaatggagagaagtcaccctaaattgacagccatgctacaaaggtacccgacatggacaatattgaattgtgaagctaaaactcatttcctaaagtatcacctctttaaaacaaaagtatcagtcaaccatcctgaaagaaagaccaaattgcctctcaattctctcaacagaaaaggatattccagat

SEQ ID NO: 15618 - DNA, 201 bp, Bos taurus
ctggctgtggggtgagggtgtgaagaagaggccaagagactgggtcttcgtgtcatggaccacacagatgttgtgtgatgttgacatggatcagcaggacattggcctgagtgggccaggcagctcagaaagaacaagaatgaccaagggctggaaccatccatgagactgtgtttgtgctcactcagtcatgtccaactc

SEQ ID NO: 15619 - DNA, 201 bp, Bos taurus
gactaaacagacacaaccaaatacaatatttggcactagatttgattctgaaccagaagggaaaaatcaagttgacatcaatgtgtgtgtgtgtatgtgtgtatccagcatcttaacagatgatacccaggtgcttgtgctcaggtgcttggttgtatccaactcttttgtgaccccatggactgcagccccccaggctcc

SEQ ID NO: 15620 - DNA, 201 bp, Bos taurus
atttacccactacaaggtcattattgtagcaaatatgaatgagccttaaaggcctcacgaaaatctgtgggacagtggccaccaggcagtgcccctacccatccatccacctgtatcttcctgaatgtttgatccccacatcaggactgcacacggcccacttttaaattattctattctaccttctagttagcttttcta

SEQ ID NO: 15621 - DNA, 201 bp, Bos taurus
aatgctacttcttccaactcaattatcttggtaacagcacacagaggacactgggcaaacagatcagaggtgactgagacgctccacttgaggccacagtctccaccttctccttctgctattactaaacccccagcgtttaggaatcatgagagacctgcctcttggagaggccaaggagcaggagaaaggctttttgct

SEQ ID NO: 15622 - DNA, 201 bp, Bos taurus
tcccccggtgagcttaaccttgaagaagacactcaaagttagtttcctcccgagtcgtggaggaaggctggaaaagtgacttcagggtgtgactttcactccacaagaccttcctgtcatttcttctccctccctggggacaggtagacacatttgtatgtctgtctgtctttcagcgggaagatgagatcttagaactca

SEQ ID NO: 15623 - DNA, 201 bp, Bos taurus
attgtcttttttcttcattgtaggatctctcctcctggtgggggaaatataatgacagaaggattaggggggctgagggggagaagagatccaacactttcataaagggctcggcctgttttgtcttacagaaaaattatatagaaagccacctttaaggttcaaatgtaagaaaggacagcagagatgaagagagggcta

SEQ ID NO: 15624 - DNA, 201 bp, Bos taurus
taaaactcaagcagcctagtgacgttctggaaaatatccatgaacataataagcacaggcccatagatgagagcagagctcaaaggaaagaaggctgaagcgtaatgaaaaatgaacattgggccaaaaaacacaagctgaataggttgtcgtttcatcatttcctggcttgattttctggaatctatttgtatgaggggc

SEQ ID NO: 15625 - DNA, 201 bp, Bos taurus
tttcagtggagtaagtgcaattactgccagtgaatgcattacaaagtacattattataccttaggtgagcccccaagtcttgcaaaaacttgtttatatatgtaaaaccaaacagaagctgaaagtgggaggagagaaaagcaattttcattgaggagacaaaatatacttgctgaagtagaggaaacagttctactctga

SEQ ID NO: 15626 - DNA, 201 bp, Bos taurus
tttcccaaattgagtatgctaatcacaaaaggtaaaatggtgttatttctgggaatgctcttcaatggttacccaaattatttttttagtgacagtagaattattttcttcctctagtaaaagttttttgcaaataaatcaaacaggttgggaggaaaaaaacaatactgtctcaacctgttaatgttccttttttgctat

SEQ ID NO: 15627 - DNA, 201 bp, Bos taurus
ctatacttgcagtttaggctggtcctcttctacaaggaccaaactacacagtacagccactaaagctttctactccctgtggtcaagtctgtgggaataacgcagtgaaacgagatctgttaagctccactcttaaagttccatccataaggctgtgaagccaacccctaccgcacaaatcttaaggcacaaagataatct

SEQ ID NO: 15628 - DNA, 201 bp, Bos taurus
ccgaagtagtggccaccaaaatgctggtcattcgtggctacacaaagaacacactgaaactgctaatgccgaagaagatgcagcctctgtatttggatttcagagattattattattcacttcttatatgtagactacatcatgagaaatgctggattggatgaagcgcaagctggaaatcaagattgacaggagaaagat

SEQ ID NO: 15629 - DNA, 201 bp, Bos taurus
tttttgaaggttaatttgtttccttgtgatttttccccctttactgtaaatccaagcactcaaaggaacagggaaaaagtaacataatgaaggattccaaaaagttatttgcataatcaagtcataagactcctggccttagtgaatattcattctttttggcaaaggactttaaaagttcataaaaacaaatactgtcta

SEQ ID NO: 15630 - DNA, 201 bp, Bos taurus
ttataattttaattgtggctaaaaaaaaaatttaatctgaagctcatgtccctaactaaagctaggattttaaaagtctgccccatgtgggtttctgagacgccacaggaagggctaaataaatggaacacacggttaatgccttctccaaccccactttacccacaacagctgggtttctgcttttatatttggttatgc

SEQ ID NO: 15631 - DNA, 201 bp, Bos taurus
tgtggaaaggggaggaaagggtgagaaggcagcaacagcgccaaggaaagtttccttgatttggatcaaattttttatttctacttaaaaaggaaaacccatcattattacttggatttatttgatgtggtgccttagtcctttcctttcaaaagtcatttctattaaaagtgcccttgctgggtcccccataccattttt

SEQ ID NO: 15632 - DNA, 201 bp, Bos taurus
agaagaaaactatctttcagtccctgagtgcataccaaataggtagcctgggaatataacctggagacccactggggaaaggtctctgggatggaaaacatttacaagacaagtaattgagaactgattatgctacaaataaattccctaaggcctgaaatccatcttcttctggaggaacctgaaaaaccatgagcactg

SEQ ID NO: 15633 - DNA, 201 bp, Bos taurus
tccatctggtttttcttacattctctatttgtcatttttctttgatagcaaaattgaaaatgagttctctgtgttagaaatgataatgatgccatgtgccgtgcttcattaaaaactgctctttgtaaaaatcttccctcgtgaaataaacacttaagtactctcttctggctgttacagggccaggagtaaaaggaaaga

SEQ ID NO: 15634 - DNA, 201 bp, Bos taurus
aaatagtaaacagagggcacccactgccctattggtcctaatagaaaacatcagaacagggctattacaaaccacctgacaggcaaggaacaacacaaggaaaagtctaaaacacacagatcctacctagtattcaaaatctgggacaggcccgagagtaaaaagagtaatacagaactcatatggtataaatatataaaa

SEQ ID NO: 15635 - DNA, 201 bp, Bos taurus
ggaataaaagcacctccttcctattcgatgctgctgtatgctgtcctcacacattcttcatcttctagtctaaacaccccaggtcactccctcatcctggaagctctgggtacttttgggttctttccttggctccttgatgagaaggggaaccaggctgctaggtgcaaattcccatcaggttttacaactgcttctgct

SEQ ID NO: 15636 - DNA, 201 bp, Bos taurus
atttgatagatgtagcatacggttggggttacttcagatccttctaacaatacaggtagattgactctcattgaatagagaatcgtttatggaaacattgcggcacataagccaagttatttaagacagcataataaatttgatgtttcctttcacctgactgcatttctgaagaatattcactgttcgacacccacacat

SEQ ID NO: 15637 - DNA, 201 bp, Bos taurus
cacatcgggatccttaactgtcctgtctgatagctaggcctctgcatgaaaagttgaaagcagtggttaaggattttttttccgaatggaattcagaatgcgaaagggcctttcaaggatcggaaaagcaagacagttccctggtggcctgattgttaggcgtctgggttttcaccgcaatgttccgggttcaagccctgg

SEQ ID NO: 15638 - DNA, 201 bp, Bos taurus
gggaaggttcaggaaaatgtggctggctgtgctttggcagcccaaacagagctaggccaggcctgagcacagggaagaaagtctctgagaggtctgtggacatgtagggcccccttcttggggaattgaggtcttggtgtgcgtgctgcattttaagtcgcttcagtagcgcctgactctgtgtgaccctatggtctatag

SEQ ID NO: 15639 - DNA, 201 bp, Bos taurus
tttgcaaactgggcacaggctgtcttattctgcattgtgttcccgtcagcacttaactcattaccttggcactcagtaaagactcagtgatggctgcttttctggggtgaccagtggggacaaatattctcagccctatttcctctaaggcaggaggaatggctgcagcctgcctagacattagaatcattgggaaagagc

SEQ ID NO: 15640 - DNA, 201 bp, Bos taurus
gggaccttagtttctagacctgcaggcagaatcttcattctccgaccagggatcaaagcagcaccccctgcagtggaagtgtggaccaccagggagtcccccatcttaaccagttttataagtgaaaatgatagttggtcagtcatgttcgattctttgcaaccccatggactgtagcccaccaggctcctctgtccattc

SEQ ID NO: 15641 - DNA, 201 bp, Bos taurus
tgtcgtatgtgtgtgtgtgagtacacacgcacatgcgtgaaccaggtgcttcctgctctcttcaatgcaagcttcagtgagtttctgttctgacagtccaaagccacctgttcttgactcttccaggtttcctaggaaaaaagcaaatagctgagggaagggaccgtgagatgggaattgcagttcaccgtgaaagccctg

SEQ ID NO: 15642 - DNA, 201 bp, Bos taurus
gctctatctgttttgattcacacactttgagactatgttgtttggtgtgtccatgtttagggttgttgtgacttttggtggattggtctctttatcattacgtaatcatgtgtgtatctctcagcggataatggagcatgattgtcttattactggtttctgtgtgacttgttaattttgaccctgatctggtcctcaagt

SEQ ID NO: 15643 - DNA, 201 bp, Bos taurus
taatatgctgtctaggtttgtcatagctattcttccatggagcaggtgtctttaaatctcatggctgcatcaccgcccacggtcttgaacctaatctgattgagaccaaaagcactcagatgctccatctctccatccaaggacttgcctttgacttattctttgggcagctctgatccttacatggatgtccaagggctg

SEQ ID NO: 15644 - DNA, 201 bp, Bos taurus
ctccatcttcacacaccatcacttttccttccccaaacccatgcttccttcctttgtgcttcatgcttccttcctgttgcaccattctggctccccaggacgctggctttttcatgctacccaacccttgcatgtgctggtccctcagtctagtctgcatttctccatttgacatccctcagccaggagaacttttgtgct

SEQ ID NO: 15645 - DNA, 201 bp, Bos taurus
tgtagctttccccaagcctcggtgcttagcgcccatcccttctctcataacgcacactttagaacttagcctgtctcctgacttcattctgttcagctgatgttccactctgggctttcagcccagttcctcttctgatttcagatccacacaccccgcctggtccccccaaagtcgtcgacactcagtgtctggcaaacc

SEQ ID NO: 15646 - DNA, 201 bp, Bos taurus
ggcccctccagagttctcctggttaattttctttttaatttatttgttgggctgccccaggtcttagttggcagcatgcagggtgtttagctgggacatgtgaactgatagttgtggcctgtgggatctagttccctgacaaaggattgagtccaggcacccttgcattgggagagcaaggtcttagccactggaccacca

SEQ ID NO: 15647 - DNA, 201 bp, Bos taurus
gaaaaaaaggaaacattaaaaaaaaaaggtgtgtgacaagcccaaagtcatacagggagaatcatttcccagaggctgtgcactgaactggaccataatctgctttcctgtcccatttcattccctgtcacagtggcaaggttccatggcaaccacaaaagctggtaaatctaatcaggaccagcaaggcgagtgttctgg

SEQ ID NO: 15648 - DNA, 201 bp, Bos taurus
ctgaggacaaatggaaattgtgtgtgagaaacaattgtgagagtgagaaatatagaggcctagtgcctgctcaggaccaatggcaagcaagggcctgaaggaccatcactgagccaaaaaaggtcagaagacaaatacaagctgcgatgggagagggatgcaaaggacggtgggggaatgttgccatctgagggctgatgt

SEQ ID NO: 15649 - DNA, 201 bp, Bos taurus
tcacagcatccagcatattgtctaatcaaggcttaattcttgagctatgtggacacatacatgacaatagcagttactaccatatcagggacaggagagaaacttttcatataatagagcaggatgggatgtacagatgaatatttaggtccttcagtgtagtgtcagttttatcttttgtatgtcacaggctgtccattg

SEQ ID NO: 15650 - DNA, 201 bp, Bos taurus
agcctcagaaggtaagatccaaagaagatccagagagacagtctacgggaaatacaaatgtgtagggggtcgactcatgtaccaccacccccaaacagtacatccaagttataaccactggtacctgattgtgccctttgcacaggtctttgcagatgttgtgaagttaggatgaggtgatcatgccataaatccagggac

SEQ ID NO: 15651 - DNA, 201 bp, Bos taurus
gagatggtaatgtggctcttacagctctgagaggggattttcttttccttcctgtaggattaagtggattcagcatgacatggccaatctgacagagtgagtaaaaaaaaaaaaaatcagctaacataggtgggtccagaaagaggcatcaggtccagtcaggagcatttgaggtcagcaaggaagtggaagacatgcaaa

SEQ ID NO: 15652 - DNA, 201 bp, Bos taurus
ccctgtgccctctgccccttgggccctggttcttgcagagcctcagcccctgtgacaccctgcattctcccctccgtctttcccatcacagcatctggtcacggtggccatcttcttccatcttcctagatggcaatagctttggttcttctgtggggtgataacgaggaaagagtatgggatttttctttgaagactgtg

SEQ ID NO: 15653 - DNA, 201 bp, Bos taurus
agttgcaaactttcatagacatgaacacgtagcttactaatgaagacctgatggaatcagagacccagagaaaggacagagagacaagagggagaagtaacggaaaaaccaaagagattcatgctacaggaaatggcgaggggattttcttcatttgaggagacactgtcagtttctgagacacaagatccaaacacagaa

SEQ ID NO: 15654 - DNA, 201 bp, Bos taurus
gtggttcagagctccgccaatcgcagatatgaaagttgagctcagatggcatactgatagcatatcaatagcataatattctacggcctcctattggccacaggcaagtgtcatttcacccgagaggaaatgaacaagagcctgactcacagaaggtgtgttcactggggccatcttcggagacgggctgccagagtttct

SEQ ID NO: 15655 - DNA, 201 bp, Bos taurus
tactgtagtgggttgccattaccttctccaggggatcttcctgacccagggattgaacccacatctcctgcattggcaggtgggttatttactgctgaggtacctggaaagccccaaaactgttttcagctaatacaaaacaaactgtggaatggacttggtcctacaggctgtgctttgtgtttggtgcacagtgttcct

SEQ ID NO: 15656 - DNA, 201 bp, Bos taurus
ttacaattcgcagtcaggcttatcagtggaggataaggagctcatgcaattgctctttaaatccttcgcaagaccccctttaggccacagaataaatttcgcaacagccttctttgaatgcctttccttctcatgcttggatgtgtaatctcatgggactgttcagttcagggccccacgcaagggaatcacagcaacaga

SEQ ID NO: 15657 - DNA, 201 bp, Bos taurus
aacccaatatatatggcatataacattatatatttgtattaatgtattatatcattattatattagcaagcacatcccctagtaaccgactacagagtggcaagtaaatgtacattcctccaaaagtcccaagtgataaacagtctcctttacctcccagggccttccctttataagcaccttaaataagacccccaagaa

SEQ ID NO: 15658 - DNA, 201 bp, Bos taurus
ataaaaggagaatattatagagcagaggtcatcaaaactacagcctgtgacaccagcccactgcctgttttcatcaataacattttattagaatacatccgggcctgttgtttacatattgtctaaggaggcttctgtgctgcactggccaagctgagtagttactctagagactgtatggcctgtcaagcccagaatagt

SEQ ID NO: 15659 - DNA, 201 bp, Bos taurus
cagtgatctcgggcatcactgagatcccctagctgggattcaggatccatctgtgaaaacaggaactgcaagggatggcccaacagtcccatccagccccgatgctcataatcctggtgcctgttttgagagcgtgtcctggtaacagcaccgtgcacccttatctcaggaaagttcccattaagattactagttagaaaa

SEQ ID NO: 15660 - DNA, 201 bp, Bos taurus
atcctgaacgggctacccttggtgggaaacaggcatgggtgtccaggtgctgaaattcaaaatgagcgttcagaggccctacttgagcaaaggaattacgggtacctgggacatgctggaagcctgttctcagtccggtttgcagggcctatctgcagggcctgtcatgtcgtagcccagctgttgttcaatcaccaagtc

SEQ ID NO: 15661 - DNA, 201 bp, Bos taurus
cgtctgtgtgtggaccaggctgtcctctgggctgggctggccgtcctccggggtcgcggcctcaggcagcagagctgagtctctctcctctgagcctcacgtcctccaggttcattcacctggcagctctgctccaaaaacaacagaagcggagccccaggcacatttcaagcctctgtctacatcccattggccgaagca

SEQ ID NO: 15662 - DNA, 201 bp, Bos taurus
agaccactgggcttccccctgggatgctcaggacagacctacagaagaacttcccaagacagttcccaaaagggacgtgagaaatgggggccactgcagaaagaaggtagaggctggactgggaggaaggggctttgaagaaagaaggagctgctcagagcctgagggggttgcccagcttcctgcagacccaaaggagaa

SEQ ID NO: 15663 - DNA, 201 bp, Bos taurus
agagcaaatcatgactctatttccttcaaaacacatttaaccaacaagtgatgatgctcatggctttctgtgctaagactttacgttgtgggtatcaggattgatcatcattcaactgattatctagactagcataataaacgttgaacacattacgccagataaatttttcatctcaatggagaacagacatcgtccttt

SEQ ID NO: 15664 - DNA, 201 bp, Bos taurus
aaggagataatttttttaattcttatgtagtagaaagaagggggaaaatgccctaatggaaaaataggagattccactagtattctgctatatatataatgtaaattatatatatatataatatatatatataaaatattatatatatataatacttaaagacagtaaatacactacctcctcctgcttagaatatataat

SEQ ID NO: 15665 - DNA, 201 bp, Bos taurus
cagagggctggcaggagctcctggcctgtttggattgtgtacttagctgactcaggactcagttcctccgcatcgtaggcttcctgctggaccctggccggacgctgcagtccaccctgacccctccatgccccagcactggcgtctaattgacctccaagtcctgttggctgacctccttgttattcttcacctggccca

SEQ ID NO: 15666 - DNA, 201 bp, Bos taurus
cacggaggctgtccctgctccgtgtgacctcaaggccgagagatagcaaggttactttcccaggtcagagacagtacgttaattcatccaaggtcacctagctcctgagtggggccagcaggggacttttccctgttcctattcagtcccttccccaatgccctctgctgaggtcaacgtcagccccttttccggaaagcc

SEQ ID NO: 15667 - DNA, 201 bp, Bos taurus
acctgtcggctgcgtttcacacctcccccggcccgcggttatgctcactgcatctcatgttctcatctgtatatcggggacgactgtcccctgggcctgctgggaacagcaaagagcgccagcgcccagccctcttcatcacttcatccctaactgctcccgtttctagagcgttccctacgtgctggacgagtcctcagt

SEQ ID NO: 15668 - DNA, 201 bp, Bos taurus
gcagcaatacccgcagttcattcagactcctgtagggggcgggggtggacagaacagcagtcagtctgggtccctcagctctcatcctccacaattagtccggtgcctgagactggccatcccgagggggggatactggctaccaagacacagcgtctgtgccaggaggggccacagaggaagcacgaggcttgaagccat

SEQ ID NO: 15669 - DNA, 201 bp, Bos taurus
ttcctcaccctggtgggctcaggccctctgctgttaatctgagaccacccatggccccatgtaggactcagatcttgtcggggggatctctatgctccccactttcctccccagacagttctgggctcccaactgttcctggacagctagccacagacatctcaggacaaggaaagagccagtaaaccctcttactccact

SEQ ID NO: 15670 - DNA, 201 bp, Bos taurus
ccaaaggctggggaccgcaacagtgccatggtggtgtgggggaggggaggaagagtgctctaccgggagcacggggtgggggctgggagcacagaccccatcctgccaagtcgaccaaacagctgaggatttagagtgcttaaagtggggcgggggttggggggggtatccagagactgaaagggacacttggctggcggg

SEQ ID NO: 15671 - DNA, 201 bp, Bos taurus
caagcttcgctgctgctttagccgctgctgctgcagcctgggggccaacccctgggggaagaggaaggggagagcctggaaagtgtgccccgggatctccggagcccgtctcttccaggcccaagaaaaccaactggttcatatctgggtgtggatgtggggcatatagcaagcagaggctgggagagctgccccagcttc

SEQ ID NO: 15672 - DNA, 201 bp, Bos taurus
ctgatgccttagctaagacacagagcagccaaataaataaaattttaaaaggccatgtgatgatgtgggggtgcagacacacagggagaagatggccatgcgaagatggaggtagacaagccaaggaacaccaaggatggctgtcaaccatcagaaactagaaagaggcatggaagcgttcttccttagagcctttgaaag

SEQ ID NO: 15673 - DNA, 201 bp, Bos taurus
ggagacccttggggcggcagtcagactcaccaggccaggcggaacggggagggggcagaaagcagaaaagtcattcatccaatttgtcacccacctctcagaaggacactggcctaagggaagggaagtgtacgctgcagtggatggagcagccagctgcaggccaagtgaccggagatggccggggcgggggacgcgccc

SEQ ID NO: 15674 - DNA, 201 bp, Bos taurus
tacactgggaatcaattccctgagggtccagtgattaggactcagcacttccactgccatggcccaggttcaaactctggttggcaaactaagattcctgtgcgtgatcaacaacaacaacaacaaaatcatgccaaatgaaagataaaattctagaacaggcagacccaactcatggtgatagaagacagtgaagagtat

SEQ ID NO: 15675 - DNA, 201 bp, Bos taurus
ctcagaagatcagagttagtcttagcattccgggagaatccagaaccttgaccacagcctttcctacaatgctttcctgtctgggtcccagcaggtgccctgagatgctccaaggatgaggctctcaagccatttataaatttttttaaaagcgcgccctctggtggcccgtgagtgcagggcacagttgcagtctcactc

SEQ ID NO: 15676 - DNA, 201 bp, Bos taurus
caaaaggccgacctggctgaagttgaaaatttgtatggaagtcagtaagagaaaagattgaatagggacatggagtgacaattccagccaaatttctctggctggtattgtatcccaggcccttcactgcctccttcccagacccaacaatggagcccctggagttgttccagcccccacattttttccttttattgaagt

SEQ ID NO: 15677 - DNA, 201 bp, Bos taurus
tctcctgcctccatcacccccttgctgtggctgccagccccactctcccattagacctgtattattcctggctgagtgcccagcaccccccccccagcactccccacctcagggtaaacccctggaggtttcaaaggaagaagatggtccctcatgtcgaatatggtgtctataaacacttcccctgccaggcttgcggtt

SEQ ID NO: 15678 - DNA, 201 bp, Bos taurus
tccaagccaggtgggtctggtccttgccaagggggatgatgttggaggctcagctgaatcaggtggcagacggggccaaggatctagcccctgcctctatcttacccagatcctctcaacacctgctcagatcctcagaagagggggctgggactctcaggtctgggaacctgagcagtgggctcaggcccaccctaggga

SEQ ID NO: 15679 - DNA, 201 bp, Bos taurus
ttgtcactcccacctgctcccccacaggtggggccccagcctgtgtttctaatcagggaaacaaaggaagttccttctctgtgctcctccgctggtagggaaagaggccacagggtgatgtccccggatgaagccaggaaagtctgatcccaggagagagtgggcaggggggtgaccaaaccagggcaggtatctggtgtg

SEQ ID NO: 15680 - DNA, 201 bp, Bos taurus
cgcactgcactggaacgttttgtcttctgtcgggttgactgaggctggcagctccttcttacaagtcactgactgtggccgtgctcccgatgtgctgtacatgttatctccttgcaggtgaggatgacaagctgatcttatgtgacgagtgtaataaagccttccacctgttctgtctgaggccggccctctatgaagtac

SEQ ID NO: 15681 - DNA, 201 bp, Bos taurus
agacctcagtgcagagtaaagtctgcccaaccagaaccccgaaccctggggccctgtctcctttgaacccatttctgggaggatagtccgtgctggctacccctgaccacggtgatttccggccagctctgggcagggacccctggagaagcaccccaccccctgcccactgtccttgcctccaaacagcccattttcttt

SEQ ID NO: 15682 - DNA, 201 bp, Bos taurus
agtgcccctgccctctgtgcccctctgcccagggccaaccacctcccctttcctgcagagcccagctccgatttgtcctttacaggaacccacgccttccctataaggccagaatttcaaagcattccaggcggggtgggaaaaagcacacaggctcctgggggaattcaccacagttgtcagggctgtctccaagttggc

SEQ ID NO: 15683 - DNA, 201 bp, Bos taurus
aagaaggtctgggttgtatactggagttaacttttagccttaaacttaagttttaagttttagcctaaaacttaagttttagctgctgcagtatgggaccatgagacataatacacaaaactggtaggatttttcatcacacaggaacaagtgtattgttattaaaatgagaagttatgctctaaaacttaccaagaaacc

SEQ ID NO: 15684 - DNA, 201 bp, Bos taurus
caccctcatgcccaccccagtgacatctcctcactctcgatctccgtcaggctccgctgagccttctccgtgtcctcgcgcttcttcttgagctcgtccagctcggcccggaggaactcgctctcgtcggccgcctgctgccgcaggtgctgctgctcggccaactcggcctccagctcgctggtgcggcccttgagctgc

SEQ ID NO: 15685 - DNA, 201 bp, Bos taurus
ggctgaaatgaggggtacaggagactaggaagtgtggcacttcccttcacacttctacactggggattctggaattttccatcccttggccaaaggttcaacctaagtggggacctctgaacccattgactctgatagatttttgtttttttggctgggtcttagttgtggcatgcagaatctagttccctgatcagggat

SEQ ID NO: 15686 - DNA, 201 bp, Bos taurus
cacccattcattcactcgctcacccaatgatttgtacatttccctataggcaaatcctatggtttgcacaagctctaagtcatggggccaacaagacatacgaaccatgagactcagaagggcatccctagagagggtccttagggacacaaagcaactggttcgggggccctgcagggtgatgggctcttccgtgggggc

SEQ ID NO: 15687 - DNA, 201 bp, Bos taurus
caggtggaagacactcaggttgtgtctagagaggagtgagattgggagaggatttctgtggggctttcaggttcagtcaagattcaaaaggcaagaggatctgagctcaggccaggctgagtaggacagttagaggaagggtttcaaaggtgtccctttgacaattttctgtcttgatgggcaggtcctttggtttaccct

SEQ ID NO: 15688 - DNA, 201 bp, Bos taurus
ctgaatgcttatacatttggtggcccccccccgcttttttttttaatagatgcaaagctaccaaatgaggttcagggcttggaagggaccctgaaagtgacgggcctcgtggtgaattccctccgactcggctctgttgtcttctatgtagaccatgggtcaagcattttcttcttttttttctggctgcaccacatgact

SEQ ID NO: 15689 - DNA, 201 bp, Bos taurus
ctaactggaggctcaccaaaaacaggtgggtgcaggaggaagggaaggcctctgagcatgcgcacagggtccctcggatgggccacggctaaggatgccacgcctaagaaggcaaggcttccccaggcttgcggacaggaagccatagccacccggttttcctgtcttgcccaaggccaggtcccatccttctcttgtaga

SEQ ID NO: 15690 - DNA, 201 bp, Bos taurus
aaacatcaggagtaggcaagaaacacttatgaagttaagtacctttcagatgaggaaacaagttggtgaaaagcagtaacttactcaagttccaagtgggcagctgagtatgactcaactttggggagggaggaactgatttctacctaagagaccggaggcttccctggtagaacagtggttaagaatccgcctggggcc

SEQ ID NO: 15691 - DNA, 201 bp, Bos taurus
gaactgaatgttaatacaaaccaagcaggctcctcctcagaggctctttttcaatggccggcactgggttctggttgccatggtgacagctggagcagaaaccaggagataatgtaaacacctggctttttgcagtattgaggagagcaggcaaaggtcttgtcccagctgcatgtggaaaaaaacgtggagggaggcagg

SEQ ID NO: 15692 - DNA, 201 bp, Bos taurus
acgtccggaaagaaacagggctttggggtggtaggaataccttcgcctcttcgtttgggaccactgcagtaaaagaggccaggggccgcagtctgcagttgttacgtgtgaatccttttaatgctgagtccgtcttcagagtcctctctctctgcctctttctagaacaatgctaaagtagccgtgctgggggcctctgga

SEQ ID NO: 15693 - DNA, 201 bp, Bos taurus
cttgcctggagaatctcatggacagaggagcctggcaggctatggtccatagggtctcaaagagttggacataactgaagcgacttggcccacgcacccacatccctccaaattacaaacctggggtcttaattcagaagaggaaaatgtggctggaagaggcccagtggttcatcgggagatcgtggttctgtggctgag

SEQ ID NO: 15694 - DNA, 201 bp, Bos taurus
ttttaatatttatttttatttatttggctgctccggattttagttgtggcatgtgggatctaagttccctgaccagggatggaactcgggcccccagcatggggagcacggagtgtcatccactttaccatcagggaagacccgccctgtgggctttgaacacccctgtttccccgaccccccaacacctggcctcacttc

SEQ ID NO: 15695 - DNA, 201 bp, Bos taurus
tgtggcccatgggcttggtttccccacggcatatggaatcttcccagaccagggattgaacctgtgccccctgcaggtgggacgggtggactcttgatcactggcccacttgggaagtcctatatataattctttttcagattcttttctcctacaggctattacaaaatattgagtaagtttcctcagaggtgtctgact

SEQ ID NO: 15696 - DNA, 201 bp, Bos taurus
gcctgccgtcatcctcccccggctgtgtgctgggctccggggacgggaacagcttggccacagcccgtcctatggaaacaaagtggccaagacagagggatacaccccaagtagatggtcccagagtgccatgggaagcgctcccggtgcaggaagaaagttctgtgctctcatgggggaaagggctctcggcttgctgac

SEQ ID NO: 15697 - DNA, 201 bp, Bos taurus
cccctgagagggcctgccagagggtcacgggtcctgctccatgtaggctcctgtaagtgaccgcactgtcagcctccctgctcccaagaggggccctgaagggggtggggtgggttgggggtctctggttctgcaccagccctgcccaactcgggttccctctccaccctccagccgggatgatgtcattgggaaggtctg

SEQ ID NO: 15698 - DNA, 201 bp, Bos taurus
attgggactctccagtatgtaaggaggtaagacactgattccctggcttgactgtgtcctagatgagatccggggcctaaattttaacagtgtgcggtgttcccctcagagctggtctttgtctgccgttttgattatcagtcttgggcccgtgacagttggtacagaggtggttatctgtttattgggatcaaagtgctc

SEQ ID NO: 15699 - DNA, 201 bp, Bos taurus
agactggtctctgtgtccctgaggaagattatcttttggtctagaaagaccaggtcccagaagcaaatctggttttcagacaagtcatgcaaggctgacagaatgctgtggcttttagggcttggaagagcttctgctgggtggacctgttctccaggagggcaggtgtcctgcctgggctatgttgttctggtgttcctg

SEQ ID NO: 15700 - DNA, 201 bp, Bos taurus
attttccatgcaaacgtccgggaaactcttagcacaaacaactgtgtccattatttccctaatgtgtcttgaatttgagccagggctgtgttaaggtctctagcacttgctaattagattggccaacccagaaaggcagggaggaggaagtacacctgatccttctcagagggccaaccgctcctttcagaggtgcagcga

SEQ ID NO: 15701 - DNA, 201 bp, Bos taurus
ttctccctcagaaacaaggctggaacatgagggaatcctccccacctcccctgttggccaggctttcccatttacccgcttaaggtgtggccttgaggtccctggttttatatggttgatggtggtgctggaggtggtgtgtctctgatctagcctcctgctcaaactggccccaggcttagggacaccagagctgagcaa

SEQ ID NO: 15702 - DNA, 201 bp, Bos taurus
attactacctctatactcataagcatgtttacacacacacattccagacagctctacgtacacgtgcgtggcacgtgtttttatgtacagagtgtgtgatccgtgtctgtgtgcatatcacacccgtaactccccttgccctctttactctgtagttctagcacctgacacattgcctgcgtttcaacacagtgttttaag

SEQ ID NO: 15703 - DNA, 201 bp, Bos taurus
ggggacacagatgaggccaacacaggtgggaaatctagagagtggcgaagtgaaaactcacacgcaccgagcgaggaaccctgaacagaagaacaatgcgcgacaagaggacagcaagggggccttggtttggaccgactgtcagaggagaccactgtgagggctggcacctgaagtgagccttacaggatggatagcaga

SEQ ID NO: 15704 - DNA, 201 bp, Bos taurus
ggcctaaatcgctgtcacgtgtgcccccatgggacacctacttacttcatttaccaacatggacggtccctttactgggcactggacctgggcaggacgccgcctggccttcggggaccccggcagctaggagtagcctctgaggcgcggtgatagccgaggcccagctcacgggctggtcacctcccttcttcagacctg

SEQ ID NO: 15705 - DNA, 201 bp, Bos taurus
cccccagagtccccagttcatcaggtctggagtaggcccaggtgatgggatgttgcgggtctgggaccacactgaggacctgtaagagcaaggcttagcatacccaatctggctcatggcctgctttacttttctacataaaatattactggaccttcattcatgtattacttacggcgactttacatcagagctgagtag

SEQ ID NO: 15706 - DNA, 201 bp, Bos taurus
taacccattttagatacgggacctgagctgacactgagggactacaacactcagaatttgccaaaggaaaggtaagcttaaaaaaggaaaagaaactaaatgctctaacagaagttcagagtaagtacaaaagggctcaaaggaagagagcttacttctacttagagaaaatcagaaacagcttcataaaaataatagcac

SEQ ID NO: 15707 - DNA, 201 bp, Bos taurus
gtgtctctgggagtgagcagaagtgctctgggcttggatagggagggagcctcgggcaacaagacaaagttgcagaaacaaggtcatgctcactaagtcccttggctgggccagccagttacctgtgggcacaatgaccttcttgtcacttgctctcttttattcaccttgactatagaaaggacctttgtctctgaaacc

SEQ ID NO: 15708 - DNA, 201 bp, Bos taurus
atcccccaggggagggagccatgtgggcaaagatagggcttggaagctgtgattcggggctgggagtggacaggggctggagccacagtgatggcgtcctagttctttttcctctctccctctatgccattcatacctaggtgtgatgccttagcccacagcatctatagcagtgggtctcacactggaaagagttatcag

SEQ ID NO: 15709 - DNA, 201 bp, Bos taurus
tggttgagacagagtctgtgaaaaatccccggcgtgcagagctggaaactgtgactgtcctgtagtaacataaataatggaaaatgtgcgtcggtcctcaggggggccaaggctgtggcatcgcggggcacgcggatcctcacgtcccaggtcagccctctggccccgcccctgcgcactgcggccccgcccaccacgccc

SEQ ID NO: 15710 - DNA, 201 bp, Bos taurus
cgggcaggtgatttatcctctcccagcctctgcccccatgtaaagtggggggaacaagcctacgtcctaagggttaaatgagacaatgtagggaagttccccggatgggcccagacgactcagggacccagtaaatgacgagtattatgacgattcctgcgccccgcccagccaccagaccccgtctccagcagggagtgg

SEQ ID NO: 15711 - DNA, 201 bp, Bos taurus
tccactcctttcctgagtgctctggagagaagcccactggcatcttgcaggtcgcttaggggatgaacatgttctccctggagcctcagacactaattgaaggccccggtcctccccccatcccccgccaaaggctgctctcggctggtggaacgcacatctgctgtcctttgctcggcccctcctcctcgcgcatgcaca

SEQ ID NO: 15712 - DNA, 201 bp, Bos taurus
acaatgaataggactcagttcatactacctagggcccaggttcaattcctggttggggaactaaaatcccacaaagccaagtatggccaaataacaacacgaagaaaggggacttccagtaacctggaaaaaatgctggctcactgcctctggtcaggcttgaacaagattctggtcaaggtgaacactggcccccgacca

SEQ ID NO: 15713 - DNA, 201 bp, Bos taurus
aaaaaggtgtcagtccctgacctggaaaaagtggttgctccgcagcctctaggcatgttgaacagggccatggtcacagtgaggactggccaggcccacatggatggagtgctcacagcccagggggctctcacttgcaggggctccccaaccattagcctttcccataaaacccttccctccagaggtctccccacagag

SEQ ID NO: 15714 - DNA, 201 bp, Bos taurus
tgaaccacaaggaaagcccactcactcaaaggtgggtttatctaaactctttcaagcatttcgaaggcaagcgcctttaagtcgactggccactctgagatcaagccaggacctcccattcagggggacttcagagccagtggggagggaaaggggtcctggggaaagcaggcccattttctagtgggatcaggtaatggt

SEQ ID NO: 15715 - DNA, 201 bp, Bos taurus
atcctgacctgtaaagagaggtactggggtgagagtgagcctgggggaagcagaagagacacacaggatggattgtttgcagtaaaaaggatgggcttggggagttggccccacagctgcgctaaactcctttcccactgcccatccatcctccccccagcccagcttatcagggatgcggaagaggggctggggaggtgg

SEQ ID NO: 15716 - DNA, 201 bp, Bos taurus
ctatctttgtgcatctatctacattccagaccctgctctcacattaacaacgtgtcaactctggatgttttcccacccataaaaggagaagattggcctgggttttggaaatcctttccagctttaatgttaaatggttttacaattccagtgccttccaaatactgctttcccctagttggcctctccctggtccttctt

SEQ ID NO: 15717 - DNA, 201 bp, Bos taurus
cgtgccccagcccattatgtacccagaggtgaccatcagggcacccagggtgcttcctgccattggcacttgctgcaagagtttaggggtgcttctcagggtcccatcaggagggcttcaaggaggaggcagcatttcaacaggatctcaaaggaggagaaggtggctaactcaggtggtgcctgggaggccgagcagggg

SEQ ID NO: 15718 - DNA, 201 bp, Bos taurus
gcccacggagggtcctccgtgtcctcatctggattctccccactgggtccagcccagctgtgatctggaggtggaggcagaatgggcttagaaaggttccggtggcagggcccacggagaaatatgcctcccacccgagctccttccctaaagccaagtccagccctgattcctctcacctgggtcagtgttgaatcccca

SEQ ID NO: 15719 - DNA, 201 bp, Bos taurus
gcggggatgacgtcatggtggtcagcgaggacgtaaatgatgagctgagcccagactctcaccagggcacgttgtactggagtgacctccaggccatgtttctgcggttcctgggggagggtcgtctggaagacaccatcaggtgaggatcagcttgtcccgttgggccctcaaaaaccatcatccgctcatctcgagtcc

SEQ ID NO: 15720 - DNA, 201 bp, Bos taurus
gggaggaactgactggacccgctcccttcttgcccctccccctgacccgaggccacatcgctcctcttcccctgggagatcccatctccccggcccggcagaaaagtccccatcacggctggaagtccccttgctgtgagggtgccctcaaattggggcacagccccgaggcccctctggggaagtccccgccttaaagat

SEQ ID NO: 15721 - DNA, 201 bp, Bos taurus
ggaagggcctaggattactcactgtggggatctttcctcctggattcctatttctttcttcactgctgtgcctgaagttccccagagaccccttaggtggcggccactggcctgcagcctctcccctccccgtccccactgaactaaatgctatttctgcccccttcttggggctcgtgtaagcgggagaaatggcggtgg

SEQ ID NO: 15722 - DNA, 201 bp, Bos taurus
tccacagccctgagctacctacagtccctagaatgccttccttcccctggaaagacagtgacctctataccaccctcaccacctggctaattcttcattctttgatagttttgcgcttcctctttgacgtcttccttgattacccttccttcctcccaaactaccacagctctttccacacgaggccgttagcctttgagg

SEQ ID NO: 15723 - DNA, 201 bp, Bos taurus
tagcttcctgtgttctcactgattgtttcgctcctgaacaatggcttacagtcctgtcccctccgcaaccctgccaccctggaatcccagccccgaggccctctggattctaccaccaaaacatgtggcactcactgtcctgctccagccgctccttctccaccgccgacagcatcctgcgctgcctggctggccgcgtcg

SEQ ID NO: 15724 - DNA, 201 bp, Bos taurus
gagcctctggcttaccaaggcttacatctttttactctattttctttattttcttttagataaaagctatatggaagtttaaatgttttcttttccaccttgatggactgccttgggaatcctctctgtgattcaaggcatttcagagtccacagactcaagaaaaattaatagtaggtcttttgagaacttgctgggagt

SEQ ID NO: 15725 - DNA, 201 bp, Bos taurus
actgcaagttctagcctcgttcagccaaatggaaaagggcattagcagggaaggtatttcagccctatatccagctggtgtctcctgcctaactcggagcatgccatcccttcactccagcgggtgagctagccccagaagagtcctccagagaggggtgaagtggtacttagggactgaggaactgctgagaaggagata

SEQ ID NO: 15726 - DNA, 201 bp, Bos taurus
caataatgccttacaacaatatacaagctactttagcatcgtgtatttttgatttttttttaaactaccaattcaatgtgttcaacagctatagggaggggcaggctgccaatatttccttgattcaattttaatagattatgactttcagaaaattggtctatttaacgtgttataagatatatgggcacaaaatcattt

SEQ ID NO: 15727 - DNA, 201 bp, Bos taurus
gcttccccttttgtttgtcttcctttcctgtttctcttcacaaacagggcaagtcagtttctgcttctgaaccttcagtgtgctacatgaactcaaaaagtgaggccaagcaattgagtaaccatgttggcaacacaggtcccacagagagctctggtatagtgtctgaactcacatggttccaccaaggcagcaggtgga

SEQ ID NO: 15728 - DNA, 201 bp, Bos taurus
gggagacaggtaggggcacccaccctacaccagctctctcagtccttacttcctcagtcgaactcggggctttggcctgttctatcccctgaccccacagtccccaggttctcacgcctgtctgacctgcaggtgtacattgtgtgcacaagtggcccatatagccaccagctgggcctttggtagacatcgtaagcagag

SEQ ID NO: 15729 - DNA, 201 bp, Bos taurus
tctaagccaaaggcaggtacgaggattcggcaacaccacgtgtctgctgtgggtgagagcatgctctgggtacccagtgtacagcagtgaacaagacagatcatagagccaaggtctggggaggaggaggcagaccagcccctggtggtgcagggtaacggccacggagaagaaagaaacatggaagggggtggtgagtct

SEQ ID NO: 15730 - DNA, 201 bp, Bos taurus
agggttgccgggtgaggcctccgcaggtgcagtacaatcacagtgtgcgccttggaggccaaacacccgtacggagtctcggcccagaagtagctcctcgctccagagacccctggaatcctgcagtgtcatctcaggaggggagagcctgagcaggctactgctggaactgtccttgcaggctctgaaatggaagatgag

SEQ ID NO: 15731 - DNA, 201 bp, Bos taurus
acaaggccaggtattagtgtctagcgatcatcaatataaaatctttgaactcttctgtacgcaaaattccagtttctcttatgttcctgttggcccactcgaagcctgagcactgcgggagaggggcatctgctcgcctccccgggaggaggcagcctgggaatgggggtccagtctcccaccctcgcacagggactcggt

SEQ ID NO: 15732 - DNA, 201 bp, Bos taurus
actcccttttgccccctccacactaccataggatttaaccccaaaagcctctccagagctgatctggggtgacttatcagatcaggggcccccacttcccgcagttacatttccagcgaaggacaatgaggatttgtggtaggaagatgaacactatggctgctgcccttctgttaccaaagggaagtctaattatactat

SEQ ID NO: 15733 - DNA, 201 bp, Bos taurus
tcaggggcatgtctgtggcctgtgatggttccagaactttctctgaaatccctgagaatgaggtggtcttcttcactgcaaggctggtcacttaggttgaaggcctgcacagcattgatcctggaggtctttctcaggccttcttataccttctgtcttaatacatattcttttctgattataaaaaataatatatattct

SEQ ID NO: 15734 - DNA, 201 bp, Bos taurus
tgtcaagacccctccctctagggcctctcttccactcccaggtgatggtcactctatacccaagaagcctgccaaacggtgtcccccagcctgctcactccccactacaccccagtggggtcttcttagatgtgcaggagggatggcccaccgggggttcactcatggggaactccttggtccgcacaactggtcacagtt

SEQ ID NO: 15735 - DNA, 201 bp, Bos taurus
tgctgctcatattcttaggcattcagggcaagtctaatgtgtggtcagggctgataacccttcatttatacttcaccaaatatcaggttaaaaacaggccgcagtccagctctcagaaacttgaatatttggatcttgctggctttgtgtagatccagcttgaatctgagacaacacctgggagttttgactgtttctttg

SEQ ID NO: 15736 - DNA, 201 bp, Bos taurus
ggtgccctgggtgccatccggtgggggggtcctccacctggcagagctctcgagcaccacccctgccctctcagccatactcgccttggccacaagggacgcaggtgtttggaaggaaacctgtatcgcttcctcctttctgtgtgtaagtgactattctgtgtgccaccttccctctctagctatgatcctggcaggaag

SEQ ID NO: 15737 - DNA, 201 bp, Bos taurus
cttgttgctgttcttgctgacacaactgctttattcgtttggctaaagaactcatggaaaaatcaaggggcactattttcttgttaattttcacagctacatccactgtagctgacgcactctgggctttcaccgactctgcaaggacactgggatttaaaggaatcccttcttttgtaaaacgctttgcatttggggatg

SEQ ID NO: 15738 - DNA, 201 bp, Bos taurus
cagcccctggcccagcctgtggttatcctcccaggagcttcttgtgcttgaacagcctgggttcttctcacaccggaagctttctagcgttttccgcacacgcaggtctaacacggcctttcgcggttgcagtagcgctccgtccagtcaccagggagctttgggtggtttctgaccgtcgttgttgtcaccacgagtgct

SEQ ID NO: 15739 - DNA, 201 bp, Bos taurus
cctaaaactggtgttttttttttttttttaatttacaaataggtataaatgtcaaaagggcacaacccaacagaaatgtaggcttacctggaagggcccgggggagtgggtgactacctcggtgggctccggggggctccgtgcatggtcctgctgctgatggagaagggcgaggccggccgcaatgtcgctgggcaccag

SEQ ID NO: 15740 - DNA, 201 bp, Bos taurus
ccggaacatccactcgcatgggctttggagcaaccttcgggagatctttctacctgctactgcatgttacgagagaaaggagaaatagggctgggaagagtgctgctgcctttcaaatacagtcacatttatttatacacgtgggtacgctgtaagcgttggtctatttgtttttctggtttctgctgtgtttatgagttg

SEQ ID NO: 15741 - DNA, 201 bp, Bos taurus
aggccccaactcccccagtgactttcagggaagagtttttaaagatggggtgtggctgttggtaggaatataaggtgcagccaccatggaggatagcatggaaggcccttaaaaaactgaaaatagagctactctgtgatccagcaatcccactcctgggcatatatcaggagaaacccacaactcaaaaagatccatgca

SEQ ID NO: 15742 - DNA, 201 bp, Bos taurus
ctgctgtttgatcctggccttgaatgagtagatttccaggtggggaaaggatattctgacacggagaaggatgcatgaggtcagggaggtcggagtggccggggcacgtgaaggtggctgggggggagcttgtgaataaggggcagggacaaaggatggtggagaggaggccagaaagttgtgctgggtccacgttgtgat

SEQ ID NO: 15743 - DNA, 201 bp, Bos taurus
gcacataaacagacagcttcttgcattcaaggcctgctcaggcctggttgtatgtattctgcttgcacttggtgatggagttttgcccagctcaataaattggttcttgatggccccctgatcgggcatttgaactactccaagactcagtcacagacccagagatgtttcttagagttggttactttttgtttggtccca

SEQ ID NO: 15744 - DNA, 201 bp, Bos taurus
cagggactccctggtaccagtgctttgatgagacgtcatctggagccctggaggggtgggaggcttttacatacagccctcatatcggccagtggcgttttggggaacaaggaaacccagcaggcaggagccccctgggcagacccctgcactcccggtgagcacagactccccagggcacactgcaccctgctcctcacc

SEQ ID NO: 15745 - DNA, 201 bp, Bos taurus
ctgactccagcagctgtaggtagagggctgcttttgtaaacggaagaaaacttttcccaggccctcccacagaccctccttcatttctcttagccaagctaacatttctctccaaatccacgcccattgagagagaaagaccattcagtgcagcaattcgacttctgggtaaaagcccggaagaactgaaggcagggctct

SEQ ID NO: 15746 - DNA, 201 bp, Bos taurus
tggaaggacttgcctctggtcagcaaggctggccctgtgcagttgcctttggtgggacagaggtgtatgctgcagatcccagaggactccctcaagggagaggccttctgggatgggccttgaaggatgcataggagaccaccaggctgctgcagacagaggtggccaggagttcttcagcccgaggtgggtgggtggggc

SEQ ID NO: 15747 - DNA, 201 bp, Bos taurus
ccctgcagggcggctgaggagagagggtggtgggcaggtgggtgttgacggggacacagttgtcgcacagggccagaggggcccccactgacctgcgtatcctctgcagatatcccagcccggtacccgtttcaagctctgccaccgcactatggcaggccctacccattcctgctgcagcccacggcggctgctgacgcc

SEQ ID NO: 15748 - DNA, 201 bp, Bos taurus
gggcctcattccagctcagccaatatgctcagaatttggggacagctcatagcattccttgggggtcatggcaacagcttgagaggggccagtcttatcattgcagctaagaaagtaagtaaatgagtgaaagtcgctcagttgtgtccgaccttgttaccccatgaacttatacagtccacggaattctccaggccagaa

SEQ ID NO: 15749 - DNA, 201 bp, Bos taurus
gggtgagccaggactcctgactggtggcccacagggtcagcggagctgcgaggggtcagcctagaccagcgaaggctgtgaccagcccgtggctgtgagcatctggaggccaacaccctgcaggaagataaagctggtgatccaggaggactagtgcagggggacgcagtggagtggcacgcacacattcacccacacaca

SEQ ID NO: 15750 - DNA, 201 bp, Bos taurus
gtcatgcgcggttcggtcaacgttgtgcttggaaatgtcccgtctacgtgatggcgagtttgatgtgttcacctgcaggcctgcaagacccaggcatctacgcagacacagatccagctgtagctccagagctctgggaggaagtggggacattgcacggtccgctgacttctgtaaaggccatgatcctctctatcagct

SEQ ID NO: 15751 - DNA, 201 bp, Bos taurus
tcggaaaacgggctggttgatcagaaggtctgtgcttctgaatgaagggtctgaaaatggttccacttcacggcaaagccaggcctctaacaccatctgtgagcgtcacagcaatcggcaacaagcacgcggaacttcagcttcctcgggacgtccgcagaggcctcgtcaccacctcagaactgccttttcttggtgctg

SEQ ID NO: 15752 - DNA, 201 bp, Bos taurus
ttggcggctgcccagggtgctggctgtccagctcagacagccagcaggccgtcatccacagccatgtgtgggtcccggactctggccggacctgactggatacccccgtttagtcccagaatgctccactctcagagcagaaacaggcaggctgggggcccgccacgctccccgggagcaccgccaggcgcaggcaccctg

SEQ ID NO: 15753 - DNA, 201 bp, Bos taurus
ttcttagaatttctaaaaattctttctagaactgcaacagttatgtgctcctgcatcaaagttcagacaacgcaggatgagacacaggcctcattcaggcgaagcgagagggacaccaggacacagctctgctccccacaaagagcagagcctttgggcaacattcactccacacacctgcctttcttctacacatatggc

SEQ ID NO: 15754 - DNA, 201 bp, Bos taurus
tctccaggccggctcctctgacctgcacactgtgcctctcagagggcactgggactctccgtctctcgctttaggactagtttcatttcccctctcgaagtgtacaggctcaagggccagagaatggctgtgtctcattcatttctgtatcttgaggagaccccctgggtggagggccttgcacagaacagtgactcagtg

SEQ ID NO: 15755 - DNA, 201 bp, Bos taurus
ggtccactctctgtgtcgggggcctagtggcaggtgggaaggagcctcgggctgtggcccagacgtggcttccagtcatgactgcccacctgtgccggcccgccatcacttcagcaatctgggagtcatttcttcccgatgaaatcagggtattaatgggattattttcaggcctgtcagctacattaaccataaaacgag

SEQ ID NO: 15756 - DNA, 201 bp, Bos taurus
tgaggccagaacggcagagtcctgatttagaaagtcaggcagcgacgcaaacccgcaaacccttctctacagagcagagtggcgaggcctcccagcccgcgctggagagacagcaacagccttgctcttgtgggaagaaagaagaaaggagcccacactcctctatgcgtgtgtgctcagtcgagccccactctgtgcgac

SEQ ID NO: 15757 - DNA, 201 bp, Bos taurus
cgaggcctgttctcccgcgcttcggtggtgccccaaaaacccagcccaaggctacggagattaaagtcacctttgttcagagaggagcgcttggaagcgtaggggtgtgagggtgccgggcctcctgtctcgccacatcagagcagtcaggagaggaggggatgggcctcacccacagctccgagcctcagtttccgccct

SEQ ID NO: 15758 - DNA, 201 bp, Bos taurus
gctgctgcaccgcgtcacgcgtcccaccggccagtgcctccacgccctcgccccggtttttgcttctttcgacaatagctatctcaaccattcattctgcgcctgagcgcggccgagcccgagggtaaccctgatgctcactctggaggcttctgctgtcactgagccgtgtcccgctggacctcagcccaggagggcaga

SEQ ID NO: 15759 - DNA, 201 bp, Bos taurus
ctcccatttggcctgggatgtgggattcttcatgcttgaactagggtggtccaggacaaaacagagctgtcggttatccggcaggaagctgccacgtgctatgagtgagtgggtgggccacgttctaggagagctttcttgtttaaaagagatggcggtggggtctgacctgaaggccacagtgtgctgctgctgctgcta

SEQ ID NO: 15760 - DNA, 201 bp, Bos taurus
ggtgggtgagagagcggctggcgtcgcggccctgagtcggaggccgcgggaggctgcagggtccatgcgtgctgccagccagagtgaaggtgggcctgtcggtgaccgtggtcgccacgtaaggacgaaaggagcagggcggtgtggttcacctgcgagttcagagggtgcgcctggaggaccgagcgtggccgcggttcc

SEQ ID NO: 15761 - DNA, 201 bp, Bos taurus
tctgggagcagagatgggacctgtgtctccccgctggcaggcaagttcttcaccactgagccacccacgaagcccctgacattggtagactttgtaatgatggcctctctggccggtgaacctcagcccttcttactcaaacgtattctggccattcctccgcccggatctcgccaacatcctgtccgctctcccatctct

SEQ ID NO: 15762 - DNA, 201 bp, Bos taurus
cccccctcctcccctccagccacagggacctttagacacggaagccaactgcatccctcaccgtctcaaagtccccaagagcgtcccaaggcaaacagaacgagactcacgtattccccagaagccccagccctctcagccggcacggggggccctgtgcccactgacccaccacctctggcccggcccctccagtgcacc

SEQ ID NO: 15763 - DNA, 201 bp, Bos taurus
tttattcaatgccacggcctagtctggaaggtgtgttctgaagagtttctgaagcggtctccgttttccaggtttgaagctgcacagcgaggactgtggacgtgggcccagccctgcagctgtcctgagacgggggtgtcgcaaaggcggcgggagggagatgagtctgaccttcccacttggttgagtgtgaacgtctga

SEQ ID NO: 15764 - DNA, 201 bp, Bos taurus
cctctcctgcgagtgctttgtcaccgcgctgccctttggcctccgccagctcagattctactgccgtggccggctgtgtgttctgacgggcctcagcaatcgggggtgtaaccttgagcccagcgcttgtcccaccagcctgctggcgtgggggagcacccggcggcctagccctttgctcttggctggccccttgcccct

SEQ ID NO: 15765 - DNA, 201 bp, Bos taurus
cacgggatcagggtgcaggagggccacagagaagggaccctgacccagctagcagacccctctgccctcctggatctgtgctgggcctgccagcctccttgtggctgaagactctgctccccaaggtggagggaagggaagaatggctggaagaagcctatttgtaaccaggacccttggccacctgagtgtgggcagcgt

SEQ ID NO: 15766 - DNA, 201 bp, Bos taurus
tcttctgacccctgaggccttagactgctgttcagtcacccccagaatgctccccccaggtctgaacccttctttaaatcacttgattggagcgccttcccgggccctccagggacgccctgctgctgcctggaggatttgaagccttttgcagggcagagggcagacaggtatgcacccggccagcggctgacttgagtg

SEQ ID NO: 15767 - DNA, 201 bp, Bos taurus
ccgccctcccgaccctgcctgccactgggccgaggggccgcagagggacctggggaggtacagcagcggtcatctgggcctgggtccctgaatgagcatgcgggctgctgcccagtgaccagaacatcggagctgggctcaggagagtgagcccaggccagcccctgggcgcagcctggagagaacccatcttctcccaga

SEQ ID NO: 15768 - DNA, 201 bp, Bos taurus
cccgtcaacagtgcgcaaggttccagtctctcctcattcttgtccaacatgcttacttgccctcacccgctttttgaccatggccgtcctaacctcacaggttttgatgtgcatctctgtgagggttagtgatgctgcccatctttccatgtgcttctgggccatttgcctatcatcttcggagaaacaaacatctattca

SEQ ID NO: 15769 - DNA, 201 bp, Bos taurus
tcccttcccgcagcacttctttcagaaacgccagtcagactatggcgttcccagtggcccaccagctgtgcgtctgtgcgcctggccatatttactgggagtcctgagttttgcatcaaggttacagggcagctaaggggagactgtccctgctctcaggagattcaggagccggggggtgggggggccacagccacaaaa

SEQ ID NO: 15770 - DNA, 201 bp, Bos taurus
tttagaggagcctctgctcaaacaggaccctgcgacgtccgcactttttctgtggctgttgttcaaccgactaataacatatctgagggcccgtaattcttacttaccctcgagagacgccgcagacagctataactaaaggagaccaaacccagactgtcagggcctggccccgccgggtctgtcctggggtctctgaaa

SEQ ID NO: 15771 - DNA, 201 bp, Bos taurus
cctgcaccaaactggaactctcactggtcacgtagcaagtaacagttagaactggcattttaatgtgaatacttacgtattaaaaccactaataacagcatatttttctgcaatccatccaaaaatatcttgagaaaagatgtcagcaccttgctgaagaagaagtctgacaacatttgttgattcatacttgacagcaag

SEQ ID NO: 15772 - DNA, 201 bp, Bos taurus
tttgaagtttatggcccaaagcaagattcagctggacaaagtgcacttctgccaggatagcctcaaatgttcattgtcaatgtgatgaactgggaataaagagagaaagagagcatcatctttccactcccttaccagccccagtttgtttgttccacaggaactctgacttctgattattttgctacaaacatggacttt

SEQ ID NO: 15773 - DNA, 201 bp, Bos taurus
gcttataagtataattaggattcagaaaataagcagagttctgtgggctgcaaagaagggacacctaatcctaacagagagagtagggatggttcccagaggaggcattaactctctgatttgattgattcttattaaaaaaaaaaaattgtggggaggcattccaagaagagaaagcagagtggtatgagatctaaatta

SEQ ID NO: 15774 - DNA, 201 bp, Bos taurus
tcatttataactcatttcttaacttttctttactgtgggaatcatttgctttaacccaagacagaaatctcaccctgcttcttttcctttagccccttttaggccccaaactgttctctcctaaccagtgtcaactgccatggaatcagaatgtaccctccacctcaggagagggggaggggagctgtgcttaagtctctg

SEQ ID NO: 15775 - DNA, 201 bp, Bos taurus
tattttaatgtcacacccaaaattaagcatgaatgaaaatgaacttatcagaagcaacatctatgctgacacccaatataaaaatgtttttttgatgaactcttaatatcaatgtgaaatgagcaacaatttttctttgtaatatttgttaaaaaacaaagatcaatagtattgatagggcagttaatgcctcgtatgctt

SEQ ID NO: 15776 - DNA, 201 bp, Bos taurus
aaattctccagggagaaaggaaggactcctctctctagattgactgccttcagattcaagactgcaaaatcaactcttccttggttctccaagctgtcttggactgcctgcaagggtttgaattttctggccccttacatttatgggagccagttttaaaaattaatgaatctctctctgtaggtctacttctgggttttc

SEQ ID NO: 15777 - DNA, 201 bp, Bos taurus
tgggttttactctaattcaggttcccacagaggacttaatgaacctttatggtaatgaacacccagtaaagttaaggtgtaatctatatgtgaaaagggcgtgagaaagaaactatccccagagataagactggcttttcattgagtacttcagaactaacagatctgtctcagcagttctattaaactggttggctacaa

SEQ ID NO: 15778 - DNA, 201 bp, Bos taurus
gctactgaatatagctcctgaatgtaatagtctatggttgaatgctggtcactgtgtctttgagttaatacttctagaaaatttcctttattttcatgtcggagaagaataaaatggtaatatgtgataaggcctgatgttgcaatctgagtcaatgaaaaatttaagtcatctctagtcttttctctttctattggctat

SEQ ID NO: 15779 - DNA, 201 bp, Bos taurus
atgagtttgaggtgttcaagcaaaaaagaaattattaattttaaatattttgatgtactggagttagggtggtgtttacggcctgctatagaagatgaatcagcagctcaggtgaggaaagggaattttgacctagcatttcctctgatacttcttgtaagtaaaggctggacctactgtcagagtgtagacgccttgtgg

SEQ ID NO: 15780 - DNA, 201 bp, Bos taurus
tcccatttttccttatctccaataatattttaaaaaacttatgttttcacttatgtgtacgttttggtcagttgctattatattttactttttactaaagagcaccatggaaaattcaatttcaagactattctttattccttaatagttacaagttagattttatttcatgtgtattataaagcacattcaaagattatt

SEQ ID NO: 15781 - DNA, 201 bp, Bos taurus
tcctctaaaagcacatatagtctcatctccctctgaaccagtaggtttcattcattcatttactactattagacaaatgcctgcaaaacccatggtgataacacctttacagcagtaggaaaatttataaggacttttgaaaaaaatgagggaccagtgaagataattccccgtcattcgtcagatatcactattagtgat

SEQ ID NO: 15782 - DNA, 201 bp, Bos taurus
gcaaaacgtgattatggacttagaaatttatgggaaaaagttcatacaaagtatataaaaaacaaaaaacagaaagcactccattaaactctaaaatcagcgaggaactagaaacgataaagcttaatgcctgtggtttgaacaccatatatttaaatgactaatgatgaacagcacaggagaacaaatgagtctcagagt

SEQ ID NO: 15783 - DNA, 201 bp, Bos taurus
gggttgaggatgaagtaaatacacagcaaaagtttgactatgtaagagagtcccttcattaaaaaaaaaaatagtgacaggagataatagtaaacaactcggcacatggagttagtagaaaagtgttgacttcaaaaaaatcaacattatccattacactaagtttgtgagtgtgtgtgtgtgaataacgaggtggtatct

SEQ ID NO: 15784 - DNA, 201 bp, Bos taurus
caaagaaaatatatttctaattatccaatgtttatacacaaaactaatttgtcaaaatggacaaatcaatcataagtttaataaaattaatgttctattggtcttgttatgtaggttggtgatcatgattagggatcatattaataaatttcaatagtaatgctttcacattaaacttaattatgcatgacgttttatatt

SEQ ID NO: 15785 - DNA, 201 bp, Bos taurus
ctaatcaaatcttaactggtgtccttgtaagaagaaatgaggtcatacagagacaccaggcacacacagactaaaagtcaagatcatatggaggcagagtgagccaaggagagaggcctcagaaaaagtcaaacctgacaattccttgatctggaagttccagcctcctttggctttaccacctacttgtgattatgggga

SEQ ID NO: 15786 - DNA, 201 bp, Bos taurus
gaatagcttaaaaaaaaaaagtataatacttttcagctttctacatgagaaatacttttctaagtgtcaatataaaagtagcataagagtgttttcaaaaaccagtaggtaaaaccagatattatgtgagagtattaacattagtgatgaccattcaataaattaattataatcaattggtgagctcaatatagtctttaa

SEQ ID NO: 15787 - DNA, 201 bp, Bos taurus
atccatggggacgtgcttttaagatttgttaggtggccctagacaagtgaaggcttccccagtggctcagtagtaaagaatcatcctgccaatgcaggaggcaaaagagaggccagttcgatccctgtgtaggtaagatcccctagaggaaacagcaatccattccagtattacctgagaaatcgcgtgtacagaggagct

SEQ ID NO: 15788 - DNA, 201 bp, Bos taurus
ctggagaaggtgtgccatctaaaaataaaatcataggcacacacatgtgcatgcacatatacagagacacacaaacatatatataagcatatgcattaatgaaatacagaataaacattctgaaacaattttacagctaaaacagaactaattcttcttctttataaaagtatgtgatatatgtctgtaaaagctataaga

SEQ ID NO: 15789 - DNA, 201 bp, Bos taurus
tgtgaaaatagcacagagtctaagtctataacagagttatagcttaaagaacaactgaagtaataccttttggttcatcaagacagtctcattatggaagcggattgggaagaaagcgggccaggggcttcagtaagcagggagtaagttgccccagtacctaaaggaaatcgatggattggccccctacagttactaata

SEQ ID NO: 15790 - DNA, 201 bp, Bos taurus
aaaataagtcattcaatcaaaatcttgcagactagcaattatcttaccatggacctattttttagactagtaggttgaaattcatattataatggatttgtaaatgaaatatgaagagctaaagtaaagagtgggtttttagatggtgctagtgcattggagaaggaaatggcaacccactccagtgttcttgcctggaga

SEQ ID NO: 15791 - DNA, 201 bp, Bos taurus
gaacaaagaaaatatgccactctgtagtaccaaactattgcttcagcttttgaacatgacttggcagaggtctgatgccactagttttgaaagaaagaagagttgttagaattgtctgagagttttcagaaacatatttctgaatgtgatttaccttatgaaataacttacagaacttttttttaggtgagtatacataac

SEQ ID NO: 15792 - DNA, 201 bp, Bos taurus
tatattaacatccatcaataaactgattgccaaaataccacattaaaataatatatatcataaaggttccttattctaaggtggacatcaatgagatattagatatctgaagagggcttccctggtggctcagatggttaagaatctgcctgcaatgcaataaactggaattctatctcttgatacagaagattccctgga

SEQ ID NO: 15793 - DNA, 201 bp, Bos taurus
ttgtaagaaaccaccttatgtgcagaattttgtttgaagggccattggttacacaaaattagtttcatagatccttaccaaaatgtgttttctcaagtcagtagtatttgagggccaccatttcctgcagtctatcaatattattgagtattatcaataatataaaatcaagaatataatcaagaatcaagaatataattg

SEQ ID NO: 15794 - DNA, 201 bp, Bos taurus
ttgtcttggtcagtgactttgtgatggaaaacaataggacttaatgttagaaaggtagacaggagagtaattttgtggggttctaaatgtccctataaagagtgtaaattgtctgtcatttgagaaggaccattttaaggttttgaggagaaaagtaacaccaaaagttataattcagtaagatgaatttagtagaaaagt

SEQ ID NO: 15795 - DNA, 201 bp, Bos taurus
ttcctttcttatgtggcatacttcacagaacttgctgtcaactttcttctccccttttatacaggacacgaggagatggtagggagttgtagacatgtttagtaggagatgaacctttttataatttatagtcaaatttgtcctccagaagatttttatatatataccaaaacatcatcttcttacctgaaatcagtccag

SEQ ID NO: 15796 - DNA, 201 bp, Bos taurus
tcacaagacccacatctgtggaggtcctcttctgtctcatggacccctttattccctacaatttgaaagtttttgttctcacacatatttaatcattaatgtctaaaacagtctggatccacaaaacttggttgacaaagtaaatggattaaaatgaaaaagtggataaatttcataattaactttttacaattatgtgtg

SEQ ID NO: 15797 - DNA, 201 bp, Bos taurus
gagcaaagaaaggaagtttcatttattattctacaatgtgttggtgtattcagtaattgactttgaggaccagggtattattgctaaatagaaatattgaaacgcacatatcaagatggacattgtaaattgataggaaacttgcttggagttcataataggtttttatgctgtataaattaatactttatagttcatctc

SEQ ID NO: 15798 - DNA, 201 bp, Bos taurus
gaaaatatttatatattataaaatgttaattgtagaaatgcaatcaaataaagacaaaaaaaaaaaaaaaaccacatttaaggcctgaaacaaacagaatatgtaatttttatcaatgaaacaaaatgatctggtgggaaagactactttagttaagcaaggacatctggcctaaaaatggtcagattaaatcagagccat

SEQ ID NO: 15799 - DNA, 201 bp, Bos taurus
tgttgtgggccctagaacctttgcaacagtgcgagaacttctttggtataattgttctccagattgtgggtcatctgctcagcagctcagtagtggagctaatggccaacttcttcaagaggacttatgccacacgcagcacatcccaggtctgctgcagccagaacccctgtccctgcatcagacactgctgacaagtgc

SEQ ID NO: 15800 - DNA, 201 bp, Bos taurus
agagaacagcaaatcatgccaaataagtctgttgtttatttattttttaaatactcctatctctaactgactactgtactcagtggctcccggaggcctagtattatcaaaaatccatatattttctgccattaaaaagtcaaactactcatctgtggtagatattatgtctatatttcattttacaaaaacacatgacca

SEQ ID NO: 15801 - DNA, 201 bp, Bos taurus
gcacatgatattgggccgttgatatagcaaatgtatggctgtcacaaaacaaaccagaaacagtgtgcactcacttgggataaatgaaagtatacatctatggtcatttcccaggcctttgttacttttccactctctatgataatagagactaacagaacatatgctatttggccatgcaacataatatcataattggtt

SEQ ID NO: 15802 - DNA, 201 bp, Bos taurus
caccacggccgactggactatgccgcaccatggggatgagtgctctgtgttctatgtggaaccagacctgccccaggcaactggggcggaccatgcccaccggaagtggggtggggaggcccaaagcagtagagaactcacatgcctttaccctgacattgaactttctttctttcttaaacttcttgctgctgctgctcc

SEQ ID NO: 15803 - DNA, 201 bp, Bos taurus
tatgtaatgcacttacggccatagaactagtaagtggcagaaaccgaattcaaattcaggcagtttggaatgaacacctgggttcttaaccaccatgccatgccacgttactatattgaaaagcaattataaggaaacaacatgaagtgctcaataatttacagtctggatgtatgtctaccctctttaaaaaactcccca

SEQ ID NO: 15804 - DNA, 201 bp, Bos taurus
ttcacaggtacatttggatcatctcagtggaacctaaaatagaacgtgagttctctgctaagtctgtactgtgttgcacggctatttttggttcctaatgtcccactctcttctcaagctgtttttcttttaaaaagaaagtatccttatcctctcaaaatttctaaaaggttgaaattagcagcatccgcacctctttca

SEQ ID NO: 15805 - DNA, 201 bp, Bos taurus
tatccatttttaacagaaacaatctaggtgtctttgtaagatttaggatttcgatgaaatttttagaagaagcagaaaaatggactaagacttagtaaggaaaaaaaacaatcttatatgtgagccaactgtttctttaatgaaaagattgcaactataagaagttaggaaaaaatacagaaaataactgtgtgaacttca

SEQ ID NO: 15806 - DNA, 201 bp, Bos taurus
ataaacacaccttttcacctacatattgtctctggttggtttcaagcttcagatgtagagttgaattattgttacagagatcttatggcctgaaaagcctgaattattgatagactctctaaccttttacagacagtttttaacctttgtactaaagtgatggccagtgtgaccaaaggcacgtgaaatagcagtaagaaa

SEQ ID NO: 15807 - DNA, 201 bp, Bos taurus
ccaactaattttcacaaaattaaccacccctggatggtgtcctgtggacctttccttcttccaaccaggccaggtaaatcaagaatccacctgggagctatggattgatcattcaggcctcctttattgtttttacacaggtgctgcaattgcagcagcactctacccaaatcattagggctggtggccaatcaggacatt

SEQ ID NO: 15808 - DNA, 201 bp, Bos taurus
gcccctatatctgttcttcaagcccacacttccagataatctttgccatagactacatttggaaaccttgccttactagacatctcaacctgtgggcccccgttacacagagtctgaatctagagatacatgactctgacagcattctaccatgagtcctaagacattctcttcctccatctcccattctttgatcctatg

SEQ ID NO: 15809 - DNA, 201 bp, Bos taurus
acgcaatcctctgtattccaaatgtgtgtgcagttttcccacactaagctattctgcaactccagctgggagtcctacaatcagtcagacactgaaaatcaaggtcgttacctgtacttctgactgatggatgtgaatcacagattttccatgaccaactccttgggtggattacttttctagggtggctcacagaactca

SEQ ID NO: 15810 - DNA, 201 bp, Bos taurus
aagtatgtggagcataaatgaaaccatattggccaggaattgaaagctgttgaaactggtagctgaactgttgtctaaacccaacaaaaaaccacagggcggggaatgttgtgatgtggcccatttggattggactcttggagacagagcatggtggagtcatacacagaaggtaagaataacagactatcctaactcatc

SEQ ID NO: 15811 - DNA, 201 bp, Bos taurus
acagttctctcttcacccttctctccccttttatgatgagccctaaagttcatgtatctgagggttgggcatgcattgtgaaatttagtgtatcaatgtctctgctcaaattactagaaatgctagaccaaggtcctgattactagtccttaataaacttggaatttattgcatacaatttctttgctataaagaaaagat

SEQ ID NO: 15812 - DNA, 201 bp, Bos taurus
gtcacccagggagaaagtgcagtatgagagatctgagattggccttaaccaggggaaatgagctgctgttctgtgaaaaagaagggatacaaggagactttccactgtttctccaggaaggcccggacacacacagacatttttattaaggactgtaattatgatacagattagtttgtaagaagggactgatttggagag

SEQ ID NO: 15813 - DNA, 201 bp, Bos taurus
tctggacatcgctttacaggttcatctggaaatcacgaggatgtgatttattgtgaccagtacaaagttgatttttaagaatggccagtgccagaaatcatacagcttcttagctagtgtctaggaagtatgcctattttaactaatccttcagagaaagctttcagccacttccaggggccatagtgcaggatctggaat

SEQ ID NO: 15814 - DNA, 201 bp, Bos taurus
agccaaataatcacaaataaaagtaaatgtcaaggggttctccagtggctgagtggtagagaatctgcccaccaatgcaggtgacaaccggttcaatctccgatctgggaacagcccacatgccatggaacaactaaccccatgtgctacaactactgagcctgtgcttcagagcctgggagccacagctactgggcccct

SEQ ID NO: 15815 - DNA, 201 bp, Bos taurus
tcaaggctttcagtatatgccaggctgatttgcacatccctctgaaagttgaaagctccataataatatacatgtcatacttcatctgattagataaagtgccaaattccagatctgctgtacagaaaataataataaaaaaactttcccccgctaaaattatcatctttattatcttaatcaagcttatttataaagtac

SEQ ID NO: 15816 - DNA, 201 bp, Bos taurus
tcttaaggcaggtccttactattttaaaggtaaaagatctgagactcagaaacattaaatgattttcccaaaggcacacaactagtaactgctaaagaatctgaatccaatggattaaagacctaaatgtgagaccagacactataaaactcttagaggaaaacataggcagaacacttgatgacataaatcaaagcaaga

SEQ ID NO: 15817 - DNA, 201 bp, Bos taurus
agctaagagcctccctagtgattctaccaagtcagtttggatataaaaccacatcctatggtccactggaattcacagggacttttgtacttggaacatactccacaagattctgccttgaatgctggacaaatgattatggagttctgaaacattttaattccacaaaatcaaaagaacgccttgaccacaaatatccct

SEQ ID NO: 15818 - DNA, 201 bp, Bos taurus
tagggacgtgggcctttggcagctacctcactgccaatctgaacaggaaaccagcacttggcagaatcaaatcaaaatcggagagcttcaggggcactgtcacatcacacacatcatttcacacacctcagaaattttttctgtgagataataaacattgttgtataaaccagttggagacagtttgaggcagtcttttct

SEQ ID NO: 15819 - DNA, 201 bp, Bos taurus
cagctaagtaacaacggcagtgtggcatgtgcacgccaaccctaatcccccagttcacccccacgccccctgccctgctgcgtccacgtgcctcttctccgcacctacgtctgccctgctgataggttcatcggtaccatttgtctagatcccacacaaagaagacgtagtacatatacacaacgcagtagtattcagcca

SEQ ID NO: 15820 - DNA, 201 bp, Bos taurus
tactgctcctgagagccctattcacatagaacaaaatgtggctagagttttccagagaaagagaacaggtagccctttcatccaaactaggaaagtcgacacaaatgagtaagcccaggccaggtgaaagggaatacagattggtgaggatttgggctgcttggctatcaaaaggaattaaattttatatgttcaaaatgc

SEQ ID NO: 15821 - DNA, 201 bp, Bos taurus
agcttgtagaaatgattcatgtttctttttattttactatttgtgaaaatgaaaaaaatcaaacctaaataaatgattaaatagttggtaatacagtcaagtcataaaatgctatgtaaccatcaaaagagaatgagatagatctgtaggaagatcttcaagatatgaggaaagacgcaaacaaaaaatgttgtgctttca

SEQ ID NO: 15822 - DNA, 201 bp, Bos taurus
gtcaggactattttgcagtaataatgatctgtgggccagattaatgtgcttaactttcccaagagtctggctagtcttatctttccaaaagagattgtgtatggttcctgatttttaattattaaaacaaaagttgaagatacatgccttctcatcacccaaatgttcataatgctctaatttagtccaggtgtaagtata

SEQ ID NO: 15823 - DNA, 201 bp, Bos taurus
tcaaagacagatttaagtccctcgctggggaccccccaaagtagccagttccaatgctaaccttcatgatgtttctaattaggggttcacattgccttgctcatgaaaccacctcaatctaagcaggcaagaagagggttagtaactattgaatatatatcacatgccaagacctgtgccatgcacatttgatgcattagc

SEQ ID NO: 15824 - DNA, 201 bp, Bos taurus
gtaagagagatttttaaaatgaaatattttaaaaatgctttgccttttggttctggattcttttcagatactgagaataaatatttaatggaaattaaaggaactcaaaactgtgagaattctctattaacaacttcctttttaaatactttgaagtaacattagagcttcaaaagaaaatgcagcatgaattgtcaaacc

SEQ ID NO: 15825 - DNA, 201 bp, Bos taurus
aggagcagacctggtaaatgtaatcttcctggataaggagctgcaaccaaggcaattctgattagaggaaatgactctcccaggcctccctgaagcttctgatctggcaaggaagacccttttctgtcacttccaacggctcggagagtgtttccgtgccctttgttttctgtgcttctcccaccctggcccacgttgcct

SEQ ID NO: 15826 - DNA, 201 bp, Bos taurus
ctgcagatgagacccaatttctttcaacagaagcacagccagttcatcctcatcatggacccaacagtaaatctctcaaacaagtttataaccgtggcctccacaaaaggcatcaaatctgggtctcgcatgaaaagccagcaacctcggaaacccctcaccaagtacctgatctcagagcctctttagacacccttgact

SEQ ID NO: 15827 - DNA, 201 bp, Bos taurus
tgaccgcagcagcctgtctcaggctaaaggccacggattttccctcaggacaaaatgtttctctcaggataccgagcaggccggccggaggctctcctctcctcttccactcacccagcctgcccatccctcctggtttccctcagagcaatagtctctgcccttctggcctcaagcccccttttcagactaagtcgcttc

SEQ ID NO: 15828 - DNA, 201 bp, Bos taurus
caataagtagtagacaccctacagctatcaaaaaaattctgattggcaactgggtgacagacattcatgtttaggtaagaaaactgttaaaatgtattcacgatgccacttccctttacttggtgcagtttgcccaggtactaggatttacctctcagatgctatggttagatcaagaagcctattctatatgtaatataa

SEQ ID NO: 15829 - DNA, 201 bp, Bos taurus
cagaagaacaggaaataccataagggcccaagatggctgcggttatgctaacagtcatacacttcatatagtagagaaatatacatgtctcagaccacccctcctcctctgatgggcccaggtacatgaatttttttgtctgtgtctgtgtgcatgctaagtctcatcagtcatggctgactcttcgaccctatggactgt

SEQ ID NO: 15830 - DNA, 201 bp, Bos taurus
tgccttgatcgcagtctggaaggccaggctcaattttagccttcttggctctgcatcaggataaggtagtgtgtgggtagttggctcttcgtttgcagccaccccctcctcttcctatgcttggccttgctgcatgccctgagaacctctgggtctgcttgtgggcaccccaggcggaatgtcccaggtacacagatcatg

SEQ ID NO: 15831 - DNA, 201 bp, Bos taurus
agaacaggcattcaaatattgttgggttgactttggtacctcttaggaaggtcccacgttctatagaaaaggggcacttttctataaaaagtcaacatacgtggcgaacagcccggatcattaagtcctgagtccattacgaaaatcatattccactgacacactctaaccctcatttgaactgtcatgctgtggtattct

SEQ ID NO: 15832 - DNA, 201 bp, Bos taurus
ccaaaccagagggttcagtgaactctaaattgaattgttgctcatgggtctcctttggaccaatgcatacggcttacgtgcaaaatgatcaagccacttagttcccgaatctataggctgacgattctggtttgacacaggggaggacctgataagtgacatttcccatttttgcacacagcggcctgaggctgtggtcat

SEQ ID NO: 15833 - DNA, 201 bp, Bos taurus
tctgagaggcaaagaaaatgctggaagactttctgtcaaattttcctttggtttaaaaatctgaaactcattttctcctctgacccgtccccagctgcctggggaaggaaaacacctggatacacaatgccaggagccactgtctgagcactcttacttttatacaattaaaaaaatttttattttatttatttttgcctg

SEQ ID NO: 15834 - DNA, 201 bp, Bos taurus
attattcatagtaaagaatttgctgcacccagagcaacaaagatctgcttgtgtgtagactgcaagggcagcaacagtgtcacactgaacagcataagcagagcactgagaaatgagcttctccttgggcccatggagtggtcctcagtaacaatgtctcatagatagagtttctgcatccttcttagcccttcctctgct

SEQ ID NO: 15835 - DNA, 201 bp, Bos taurus
ctccaagaaggaagagttttgcagtcatggtgagctaggtggggttcttgtgggacaaggaaaagagacaactccttgacctccaatgggagtcctggcccgttagtcatattctgcatttctctcacttgtgaagtgtggctacaactattaacaggggttttctcatatttgggagatatttgaggagagctgggccta

SEQ ID NO: 15836 - DNA, 201 bp, Bos taurus
aaaataattttgcactcaacgcctggagaaacttgggtggaggcctccaccgagcttcttaaagattttgactcctgatattgagcagaggtcatgaacttgagggctggaaaggcctggtgtgtgtatgaaagtcaggcagttataggggagaggaggggttagggggctttggacagcatttttctgtctaaagaggct

SEQ ID NO: 15837 - DNA, 201 bp, Bos taurus
aattcattcttaatctttgaccatctaattctgtaggtacatgaaaccaacagtattttagctgaatagctggctgttctttactcaaagtggatgtagaaatagcgctgaaagatccattttccatatataattctcctagcaggccagtagagtctaaacttctaccaatcatgggtcattccttttgtgtaaaagcat

SEQ ID NO: 15838 - DNA, 201 bp, Bos taurus
cgctaactccactggagacagtaagtggggccatatgcctcacttgcaacactgtgattaagaagattatacaacttattccagcagttatgtcacacaatgtttcagagctgaatgaactcatctgctcttgggaggtctgtatttccttagaagtacattttttttgaaataactttgggcataactgtttagaaattc

SEQ ID NO: 15839 - DNA, 201 bp, Bos taurus
aagtagatttagacaagattactgttttgtttcctcagaacttagcttggtaagcaccaggttgggagcccccagatatggccagacagaaatatgagtttaccttgattgcagctaagatcctactgaattacaggcagtcctcagggaaattaccatggccataatgagaaacattctaattaaataagatcatttaaa

SEQ ID NO: 15840 - DNA, 201 bp, Bos taurus
ataactgtaaaggtttctgctccttatacaacagagttcagggtacatgaagcaaaaactgatagaactaaaatgagaaatatacacattcacaattataagcagaaacttcaaaaactcactttcgaaaattgacagaacaagtagaaagaaaataaatatacaggggacttgaataacactttaatcaacttgatgcag

SEQ ID NO: 15841 - DNA, 201 bp, Bos taurus
tgaaaaatgtccattaggggtgagggtaaaaatgctcatgcagaccagcagacgttgatggcagggcatacaaagaaaaccactggctaaacagagatgtggttgaggagaaaagcaggggcctgaatggatacttagcagtgaacatctgaggacttttgaaggttttaggacattacttcagaggtaagtgtgtgctct

SEQ ID NO: 15842 - DNA, 201 bp, Bos taurus
acgaattccaaagacatctcactcccctgcaaagagaggttggctctctaattaatttatcttggcatctgcttattgcctgaacatttattagaatacaatttattcagaaatttttatttgtgtagaactttctaaccagttcaggatgacatggcagatgagctgggtgggagggattaagcaggaagggtttagatt

SEQ ID NO: 15843 - DNA, 201 bp, Bos taurus
gcatctagcaaaagtttaaatgaacttaaattctgacccagtacttctacatttatttaggaatctgtcatatagtaacactcccctaaatgctctagtatatttggataaaggtgcattagcacaacttgtaactacaaacacactggaagtagtttctatttgcagggaatcagctggataaattgtggtacattcaga

SEQ ID NO: 15844 - DNA, 201 bp, Bos taurus
aatattattttataagttctttgtggaggaccggcctttctcccttagtctcatcatccccatatttgtgtagatcttcatggaacatctataatgaactggagattgttgattcaggcctaaatctttttctcttttcccattatgtgcgagagctgtccttaggactgaggggtttataaaactatgtaaagcacagtt

SEQ ID NO: 15845 - DNA, 201 bp, Bos taurus
aaaaattgatttgaagaaattatgtctgaaaatttcccacacccaaagaagaatacagtatcctggtatagccaccacagagggtccgaaacaagatgaatccaaacagacccacatcaagacatattagaccatctctacatttgaacattcaagttgtcaaccttcaaagatgtcaacatgtgttttatcaacgtggga

SEQ ID NO: 15846 - DNA, 201 bp, Bos taurus
aatatcgttctcttactacacaatagatccttgttgtttatccatcacatatacaataattgcatctgttagttctaaactcccagtcctttctctcccacctcttccccacgatggcaaccacaagcctgctctttatatctgtgagtctgtttttgtttcatgtgctatgtggtattagatgctcagtcatgtcagact

SEQ ID NO: 15847 - DNA, 201 bp, Bos taurus
agatggcctgaaagtaatgggtctcttacagatgtgggggatggctgtggctcactgcagaggcaaagacactggtggaaacagttctgggaggtcctcattggcctcttgaaggttaccactttcttaccaacacttggcaccagtgttggtgcctgtacactgaaactgttggtttcagcctgtagtttccagtgctgg

SEQ ID NO: 15848 - DNA, 201 bp, Bos taurus
tccatccaacagaaactagcccactggtcttggtgctatgtttccttccaacccactgatgagccttccctctctagggaagtgagggcaaagtttggagctgcacttaaccttgtgcccacatgaggtcaacagtggcctgcctctgccactcacagctagtggtcttcaggatccccatcaagttaactcagaattctg

SEQ ID NO: 15849 - DNA, 201 bp, Bos taurus
gaaaagccacatgtgtgccatttaacaaatatgaaattgaactattaatatttataaaaattcaaaagtaggatctggagtactgcttctaaacagtagtgcagattatatattccatactgggtccaactaaactgtatttagacatgtctgaaggtgaaacactcttgacaatgtcaagcaaaatggaagaaagtgggt

SEQ ID NO: 15850 - DNA, 201 bp, Bos taurus
gcaactagtcaaacaataaactgtcaatttacttatccaggacagtctctcagtacacttccagtcattttgccagtatatgtgatctagaatagcagatgtcaactgtgcatgtttacttatacacgatttttttttcaacaacaaataccctggttgcaatggaacacacaggtgctcgtggcagtggggcagccacag

SEQ ID NO: 15851 - DNA, 201 bp, Bos taurus
caatgaatgtgagctgtattaatagctgctataatcacacacacaaacacacacacacacaatggccaaagtgtggaccttggccaaggtcagcatctcacgctcaatgagtgcgataacatatttgacaaagatcaactctttgttttgttgacaaacattctgatcagctacttggccatggggacagaaatctgatgc

SEQ ID NO: 15852 - DNA, 201 bp, Bos taurus
ccctgccctattttacctcctcagtacctctaaaacctatccacttctgtctgtctccactgcccccactcttgaatcactctctctccactgattactgcaacgacctctaaatttgccctccacatctcttctccttcctaatccattctcttcatgcatccagggcaatcttttctttttaaaatttttaatgttaat

SEQ ID NO: 15853 - DNA, 201 bp, Bos taurus
ttttccatgggagtgtggcatgaataaagatgtaagtgtagcatcttctgggaagacttttccccaacttgggcagagatatgcatgtttgagactatggggagatacattcatgtgtgttggtgagagaggcccaagtgtgctgtgccttgaaggttgtgctaaggagtttggattccagctgaaattagcagcatgtat

SEQ ID NO: 15854 - DNA, 201 bp, Bos taurus
aggtaaaagggcccatcaacttaagtttcttgagtttcacaggaaggaacctgaagacttggatctctctctaggatgaggtccttcccctgattctctcacattgactcagctcactggccctcagactttagcccctccttgctgactctttgtcttagctaacgtttacccacctcctctagagaaagccccgcatta

SEQ ID NO: 15855 - DNA, 201 bp, Bos taurus
ggagagtgttttcagtcactcctaagatacaacacaaacttgctgctagggtggctcctagaagcctggagaacgtgtggcccttgctggatggtggacatgcagacacaggggaagcgtgtaaggcagaaggaatgggcttgcagggatgggcgtatcagtgaggccagaagacacgtcagaagacacagtatctatcaa

SEQ ID NO: 15856 - DNA, 201 bp, Bos taurus
agaatttaaccgtacagccaaattcggcaagacgggccccagatgaagagcatgcacgtcaggttaagccctgacctcacaccgatattttgggcagcccatgctgtgggccacctcaagtaaagcccacacgaatgaagtcttcctgacaggcccctaggtaaacctcctgggctagagtaaagatggatgtactcatta

SEQ ID NO: 15857 - DNA, 201 bp, Bos taurus
gtatagggccaccatgctgacttcaccccatacaacatccccatgactaatctccaacaattagtccaaacttacaaatactctctccagccaaggcaacggtaggaaacctttccatatggccaaattttccccagtcaggagggcttgcaggatttgtaaattagacctttcagttgcacaaaaggaaagaagtgcacg

SEQ ID NO: 15858 - DNA, 201 bp, Bos taurus
aacagactgaaaactgcttctgcctggtgttagtcctttagttgctggatttggggaagttgtggaggaaccagagcctgtgagaaaaagagcacttggggttggggccagcagctagttacccgtgggtacagaaggatgctgagagcaactagtagagttccactggtggtggagaatgtctcttgcttcattgagaaa

SEQ ID NO: 15859 - DNA, 201 bp, Bos taurus
ttgccacatctatgacataaagttaagaaacacatgagcttttcctggcaactggaagaatagggaagaaggaagaagagagtgaaattatggtacagctgtaacagcagaatagcataaatctgtcaaagaagaatgtaatcagtttgtttatagtgaaacttatagactttagtcctcttctgaggctgagactgtggg

SEQ ID NO: 15860 - DNA, 201 bp, Bos taurus
gtaagtcacttgattttgttgcacaactttctcacacattaaatgaggcgcttgggccaagaaaacctgggatactagccattcctaatattctgtgattacaaacattttaaggtcttgggcacagatttttaaaaaacctgcaatcctaattcagtagtagtcaagtacctaaactgctaagtcacttcagtcatctct

SEQ ID NO: 15861 - DNA, 201 bp, Bos taurus
ttaaaatattctaaaggaaaaaaggaaggggaatataagaaataagataggcaaaaatgttgataatcattgaagctaagtgatgaatgcatagttcattcaacaattctatttttgtgtatgtggaaatttccaaaataaaatatttatttaaagataaataaatgtttccagactttccatcttgtctttccatcctta

SEQ ID NO: 15862 - DNA, 201 bp, Bos taurus
tcacaccttcttgcctcctgagattgcaggaaggcccttggaattacctgtaaattttaattcctgaaaaaatttgtcctgggttctgaagcagatgggtgtgcattggcctggaagcttaaggatttcagtgggagatgtagttcttggcctcagtttcttcatctgttgaatgaagatggtctagttgacctacatgac

SEQ ID NO: 15863 - DNA, 201 bp, Bos taurus
atccagaatttccttgtcatattgaaaaagtccatttaattaatataaacactactcatgtttatattcgtcattcccactgaagtcttctgttcataccagaccatcatacaccttgctagacgctcggaatataaagaaccataaagcacattccttgctctggtgtagcttatagtccaataaggttgataagtgttt

SEQ ID NO: 15864 - DNA, 201 bp, Bos taurus
gtttgtcatggccttgcctggtggctcagtggaaaaactccacctgccaagcaagagatgtgggtttgaatctgggaaatcccatggatagagggacctcacaggccacagtctatgggaacatgaagagctggacacgacttggcgactaaacaaaaacatagatgtgccatagctttccttccgaggagcaagcgtctt

SEQ ID NO: 15865 - DNA, 201 bp, Bos taurus
gtgcttgttggtggactggagatgtctaatagctgttggaattaaatatttagaatttatagaggtctagctagagatacagattgagaatagtcagtgaacgtgtgtttgaagtcaattgacttgaaattgccctagagagctagaagaaaaaattgaaggatggagatagaaggaaaaagaatccagaaggatttctca

SEQ ID NO: 15866 - DNA, 201 bp, Bos taurus
gactcttaccaggccattgttgtcctggggctggagctctaagcctcgaacaatgtaaatcctaaccgtgcattcctgcgggacgctgtcaggtaactcccgaaactgccggggaggggccggcacgctggggtcatccggcagtgggtagattcggaaggagccctataggagagacacacacagatggagcccagggcc

SEQ ID NO: 15867 - DNA, 201 bp, Bos taurus
cagagcctgcaggctggaccctcagggctccatttatcaaagaaacaatgtggttagggcgctgccaaaatttcttctgaggctcttggcttccaggaccccaggttgttggcctgtgactggccaaagggaacagagggccttgacttgccaaagaccctttcgacagagaaactgtgtgaaataccccctttacctctc

SEQ ID NO: 15868 - DNA, 201 bp, Bos taurus
tggccaccacgtagcaggttcttcaggcaaaaaagaagggggagaagagaaaggagggtgagacaaggaggtagggtgtttgtcactctggcattggcgggtggggtgggttagggggccaaaggggtggcaagagggactgtcacttctccgttctctcccatccctggtcgtctagtggtctgggacagcacaggtgct

SEQ ID NO: 15869 - DNA, 201 bp, Bos taurus
gcaggagacggagaaaggcagactcaagagcccacagagccagagaaaaatgttgtatcatagcaactgagggaagtgtttaaagaaaggaagtggccaagtatgtcaatacagagggactgcatctcaaaatgtatctgtcactcggaacacccacctcagaaccatgtggggtggcggggtgggggtgtgttattacaa

SEQ ID NO: 15870 - DNA, 201 bp, Bos taurus
tgctcccttggaaaactttttcagcttcagtgctttctcccatggggttttcaaaatctgtatgtgctgtagtgaaacatatggttcttcaacatgcagtggaatataatacatcttaaaaaaccatacatggccgttcaaaatcacggagtgtttagagaacctataggttcagcatattgagtagctgggtcttgagct

SEQ ID NO: 15871 - DNA, 201 bp, Bos taurus
cattgggagtgcagagttttagccataggaccaccacagaatttccaccacagtcaattttagaacatgctcattgcccacaaaagaaaccccctacccactggcaatcactccctattcctctctaaccctagttcctggaaaccactcatctatctcctctttgtctctatgaatttgcatatttgggacatttcacac

SEQ ID NO: 15872 - DNA, 201 bp, Bos taurus
atcactctttatgtctttaactccatcgtatcctgattgctgaagccatctccccttcgaaacccctggatcctgctgggtctggcccccagtatggcagccttttccacagtgactacagtagtcatgttcccacgagcaatgtacaggggtcctgttgacccacatagtggccaatatgtattttataattttttgtaa

SEQ ID NO: 15873 - DNA, 201 bp, Bos taurus
aagaaaattgagaaggtgagaggtgtcagccgcttggtgacttaaaacgttcctcctttctcttccctctttaacaacaaccaatgagagatctttgccagcaaaggtccatttgtgcatgtatgtgtgctaagtcgcttcagtcatgtcagactctgtgagaccctgtgaaccctagctcgccaggctcctgtgtccatg

SEQ ID NO: 15874 - DNA, 201 bp, Bos taurus
cttacttggcctgattcttgcttcctacacattatatatatgtctgcacctggcttctgccccaacataagacctgtagctgactcatgctgctgagtttatgtccaccactttctctggccaccaccaatgcctgtcctgttccctagccactgggcctttagacaccactgaagatgcctattatccttacagccactg

SEQ ID NO: 15875 - DNA, 201 bp, Bos taurus
ggaacatccaaaataatgaactactattctattttgttaataatattcgtgataaacattttaaaattaagcatgtgaaaatatttatttaatatgctaagtttgaacaaaagggtagagaataatctatgcaggatgagccttgttttcttcttctgccagatcttccacccattcctagataatatgcaccaaaagtcc

SEQ ID NO: 15876 - DNA, 201 bp, Bos taurus
ttgcagtgcacatgtctaggggaaaagtttgcagctgtgggagagcatactaatagccaggacccctgcaactgccagtgagccctcagttggcccaatctttgctgcctactccagccctatacactgtatgtgtgcctgcaccctgtctttgccccaacaaagaccacaactggcccctgcagctgaatctgtgcccac

SEQ ID NO: 15877 - DNA, 201 bp, Bos taurus
ataaaagatgtggctctgctcccctctccaagcacattgcttggtacccactgctcactccaggcagaaaagccttcatggggtttctaggacacaccagactcggggcctttgcacatcctgctccctctgcctggaatattcgctccccacacagccccatggcctccatgcttcactcatgtctctgctcggatgtcc

SEQ ID NO: 15878 - DNA, 201 bp, Bos taurus
gtctctgcctggcttagttgtgttcaaaataagtacaagcaccttgaaggcaatgataacattgtcatctcctgctcaccgagggccaactaggtgtcacgtgtcacactgggggcttccctgaggctgtttcatttaatctgcccgtggcggctcagggagagggccatttatcttcactttacataggaggaaatcaca

SEQ ID NO: 15879 - DNA, 201 bp, Bos taurus
cttggctggtatgacagcccttaccctgacatggtcagacgggttctcactggccatggaccacatggtaacactccagttacttggttttgcttatcagaaggcatcatttgaaaatatctcccatcttcttgacgtgaagcatgtcaagaaagccaacatcatctggctacgttcagagcagacaggctagttcttttc

SEQ ID NO: 15880 - DNA, 201 bp, Bos taurus
tcatccctctttgtttcatcactactgcaagtctgtgggaagtttctctcttataagaaacacttataacccagtctctcctgatgcatcccagaattcagcaagtgctacatggggaaaactggccatgtgtttagagctcctctagattccagcgttaggccagatcacactgatcatcaaaagctctatgagcttttt

SEQ ID NO: 15881 - DNA, 201 bp, Bos taurus
attaacctgccatgggtgtggggcagggaactaaataggttttttcctaacttgctgagtatgtagtgggggacttatgggatcctgtaggtttggcccattttagatacctctaccatattctctatggatcaaaatgggagcaggctaagaaagtgaacagagtgaatgggaagccaagttggagctgggagggcccct

SEQ ID NO: 15882 - DNA, 201 bp, Bos taurus
atgtgatgggggattctcagagaaaagggagtaggctaggccagcagacatgttatacgagctggcaatgttaggacaaacacttaaaccagtttcggccagactatggaatatcctttgtagtttcacaaaccaggctgaacatcagaagcaccagaaagccttttaaaaagatacagattcttctagcaggtgaattag

SEQ ID NO: 15883 - DNA, 201 bp, Bos taurus
agcgagactagtggtgtcaggattctgtcaatatttttgtccagaggcataaagccattcaggaagaacccttctctgggcccattttcttgcttttcccattttctgctgagaacaaacctccattaaactgcagagtgagctcctgtcctactgcttagtatcctggccaagtaatgccgattttggagaacagttcta

SEQ ID NO: 15884 - DNA, 201 bp, Bos taurus
agttatcacatgctaggtacccaagtagtagctaacattgatatagtgttgagtttcaaagtatttttatttgtttgatctcatttgatcttcctaaaagatacatgaagtaggcaatatatgaacactaagaactaactactggattttatcattaaaatgtccttttaaatattacagagagcaatttcttaatttaaa

SEQ ID NO: 15885 - DNA, 201 bp, Bos taurus
gatagtttcacacacaagttgaaggatactgactctaattataggtgctggaattgtggtttgacattggaggcctcatagggccatgggtgtttaaatctgattgtgagttatgtgggttaaactccctactatgttactggggtcagtggtacctgaggccagggttggagcagtaaagtcccagcagtctcgtggatt

SEQ ID NO: 15886 - DNA, 201 bp, Bos taurus
atccctccccccaaaatctggcagtcctaattagattgcctaactttttccatttcaccttaaattatatttagttgattatacactggccctgtactcaaacactatacatatacatcccaagtttaatctccttgaatgaaaaggcaaatttgcacttatctagaatgtttagaggctggatttgaggccgaaaaggat

SEQ ID NO: 15887 - DNA, 201 bp, Bos taurus
cccgggttcgcgcctagggaactcgggccccagttggtccccttttgcctggcacccggtccggcagttcatcaaacaagctggctcctcctgaccgggtagcttgggccttccgtgaggcgtcagggagttggtttggtcggtgctggttttcggacgagtcaggtgaagatgaacagtcaccctgggtggcctgaggtc

SEQ ID NO: 15888 - DNA, 201 bp, Bos taurus
ccctgggtggagacgtgaagagccaactcacacaatacttgatactgctcttcatgccttcattgtacttacttggcagaggtatgggtttttgatgaaccgccctgaaaggaagaaattcagcttaattaaagggcaatgcacaagatgaataagtttgactttttgtttgcactgaagatactctgaacaggtgcatca

SEQ ID NO: 15889 - DNA, 201 bp, Bos taurus
acatattaaacagacattcaatatgcacccattagtgcaagttaacccctttaattttcagggtaaactgaatatttattatgcatgttttatgtgtgagaatactggctcagagaggttaagtttcttacccaaggacaaaagttgctagatgacaaagccagactcaaacccagggccagcctctttccttatggcctc

SEQ ID NO: 15890 - DNA, 201 bp, Bos taurus
tcccagggacgggggagcctggtgggatttgaagaagaagaagaaagaaacaagaaatctagaccaggctttactgggggccctgcagcagcacaggggatcaggaacaaacaacaaattcccttacttgctcactccctgagtggggggtggggggggcgtgagcttgttccttctgtggtgtgagggtcggggtgtgtc

SEQ ID NO: 15891 - DNA, 201 bp, Bos taurus
aaacagaaagagactcacagacttaggaaacaaacttatagttgcccgggggaagagacagctaaggacttcgggaaggtcatgtacacactgctctatttaaaatggatgactaataaagacccactgtatggcacatggaagtcttgctcagtgttacgtgccagcctggatgggaggggtgtttgggagagaagagat

SEQ ID NO: 15892 - DNA, 201 bp, Bos taurus
gcattcccaatgcaaggggctccctggtcagggaactaggtccctcatgccacaattaaagatcctgcatgccacaatgaaggccaaagatcccacatgccgcaactaggatctggtacaagcaagaaacaaacattaaaataataataatagttgggcccagccacaggattgtggtgcccatgtgtatatgtgtgtgtg

SEQ ID NO: 15893 - DNA, 201 bp, Bos taurus
gagtagggactgcctcaggaaggcacaggggaattcttggggtgctagctgtgttctagtttttgccttaggtatttatacatgtgctagttttatgactgtttgttaaactatatgtttatgtttttcgcagttttccatatatatgctgcatttcacaataaaaagaatgtttctgaaaagtctttttggctggcaggc

SEQ ID NO: 15894 - DNA, 201 bp, Bos taurus
ggccggagaggaggcccttgcaggacccccggtggaagatggaggtacaggctctggagtctgtctcgcctcaaaccaaggctttaggcccaattcaatggcttttcaaagtagcacaatgagggaagggagaggcgggaataggagggggcaaggaatggaggaagtgaggggtgggagttgacgggctggaggggaggg

SEQ ID NO: 15895 - DNA, 201 bp, Bos taurus
caatcgctaactcttaatgctttaagtagggtggtgggggtaggtcgcctgcgccatctagtggccgagatggtgattatcagcacttgtacctggactttctcgtcaatggaatagggtagtgagatgtggaggctattgagttcttgaaatgtggtttatctgaattgagatgtgccgtagtgttcttgcctggagaat

SEQ ID NO: 15896 - DNA, 201 bp, Bos taurus
tagagcccacaggccaggaggtagagcccggctcagctctcaggcaccttcacattcttccctacccaggtcgttccctctcagttttaccactgtctgtttggttcccagttccagtcagggcctttcttatttagccatctttacagccctctcaggatcccaccttgctccatctctttatcttctcactatccaaat

SEQ ID NO: 15897 - DNA, 201 bp, Bos taurus
tgtgagaaagtgggtgagctggaaaaaggtggatttccagatctcaggggtgtccagcatctgtgtgcacctcacacttgacccaggcacttctcaccgaagctccccagggcctctcagcatctctgaggtgcacagaatcgggcaggtgtgcgcagagagtgaagggctggcacaggccagtgtggaaacagacctagg

SEQ ID NO: 15898 - DNA, 201 bp, Bos taurus
tcaaggccagggggggttgtcaaaggtgctttctcccttttttgaagattcacaatgctcattagcatatcaaaggctctgagaagtcctgcactgaaagcggcccctgagtaatggaatttacagtgttaagtgcctctggactgggatcagtttctcccaccttatattccaagtagtcctgactctcatttatcagca

SEQ ID NO: 15899 - DNA, 201 bp, Bos taurus
cctgttgagatatgagttaagtgctcatgctttatttacactggagaggaactacaaggatgtctttgtatatggagaattgtcaataaaaaggcctcaaacttcctatgttttcgttctggtccttgcctgccccctctccctgaggctagagagccaggtgccccccagtgctggccaggtttgcaggcctgggctgtg

SEQ ID NO: 15900 - DNA, 201 bp, Bos taurus
gagaaccacctgcccctgggcagacagagatggagacacaggcctgtatgcagccttagggtgtcacctgcagcctcatctcagaatctgtgctgggagtcggagccacccaggccactggcagggaagggctcatgaagggctcctatgagttgccagcaactcagggccccagttgcttgttgcaggggaaggtgtggg

SEQ ID NO: 15901 - DNA, 201 bp, Bos taurus
taacttgagtgcctcctccctcaggagctgcccccaacccgggagatgacctgacttgagtctgacaatggtggcaaagagaagcgtgggccagtgcatacggtagggctgggggctcagcctccagctacattcttaaggcaaagagattactgccaagcagcagggtcaggagctagccagcaacatcccgggcctggg

SEQ ID NO: 15902 - DNA, 201 bp, Bos taurus
agagcaaatagacttttgccccgtgggtacccgtgatccccagtcctctccacaaggagtgttgggaactctgtgccctgctgcctcatgccaccaccctattttgagggcatctgagtcacgtggtgatggccccggctccacacttgtctctgcatctcggtccctgccaccctttcagtgtagaaataagttgcaggt

SEQ ID NO: 15903 - DNA, 201 bp, Bos taurus
agtgtgctgtgcatggggcctgaggagtgggctggtaccaacaggggtacacgctgggtgggtaggcatgcccacagcctcatacgcgggcctgagagcacggagactctcagcctgagggagaatcagatcagtgcaggggaccaaaaggaggtaagtctagaaagggggtccagggctgggctgaacgagaccagcctg

SEQ ID NO: 15904 - DNA, 201 bp, Bos taurus
ctttttcttggatcctctgggcatttcactgtgtagtcgtgataatttcctcttccttagaatcacccacttgttctggtacctcattggcaatgcagaaggcatcaggctcaggtctttgcagcagagatcagggtgcagaccttggacacagttggaagggctaggctgcagagttgccccgcagggcagggctgatga

SEQ ID NO: 15905 - DNA, 201 bp, Bos taurus
caaactctctcggccccatctctctcagcctcccccagccatggctatggtgccgagctccatgcaggctccagccagctgcacgcagtgcaacctgaccacatctcacctcaggcctgtaagatgcacttcttcttcatgtcttccctggggcctccctgacaccaggacagggtacccatgggactcacttggcaccca

SEQ ID NO: 15906 - DNA, 201 bp, Bos taurus
agtcaaaaatgcatgtctaacaacatggctggcctgccttatatgctgtttgtccatgtgtgattctgcatccgcagatttaaccaactttgtatcatgcgtgtagtactgttgtacttgggcttccctgatggctcagtggaaaagaatccacctgccaatgtaggagatgtaggttcgatccttgggtcaggtcgggaa

SEQ ID NO: 15907 - DNA, 201 bp, Bos taurus
ctggaaaatgagggaagagagtggtattctaaagaaaatgatacaaaaccaaaaggtgcaaaggtgaaaaagtatggcctcttctaagatggacatatatctttttgatgtactgagggcaggttgtgcaagggtatgtagctgctgactagctgcaaagaaggcaggcactggaccctaaaggccaggggtgcatgtgaa

SEQ ID NO: 15908 - DNA, 201 bp, Bos taurus
ccaaaacaaccaagaggatgggaacacagccccacccagcagtccataggctgcctaaagtcttcctgaaagtagagctgcctctaagcacaccccttggtatggccctgatcaccagagggacaaatccagctctagccaccagtgggcaggcaccagtccctcccaccataaagcctccacaagcctctagactatcct

SEQ ID NO: 15909 - DNA, 201 bp, Bos taurus
aaataactgttggagtagaaaaactaggacaactgacatgaatccactcacacagatggttctttacatttgaaaaccagcttttggcaacttggtgtttagtgtctgtatgtttgccttttattttgcataaatgtatttttactcgagacatactactttcacgtaattgacatgcagagttcaaagaactagactatt

SEQ ID NO: 15910 - DNA, 201 bp, Bos taurus
gatgtgaagggttactctgcagagggaaaaacacaggtgaaaacggagtcatggttgtgactgcagggaaaccctttgcttggtcgctgcttccagtcctgaaactcccatctttgatgctttacaaataagtaaacgaggtctggattatggaatcttgtgatttgaatggagttctggaacactgtctccatcggctgc

SEQ ID NO: 15911 - DNA, 201 bp, Bos taurus
ttttgttgtctctctcttttccccactctgtattttttaggatagcactcgcactgatctttctaagagacaaacttgtttctgaatttaaatataactcaaactatagggaacagaccaacacaaatgggaagcttcaggggaaggagaaagggtgacacctgctggcagaaccactggtggttttcactccaaacagaa

SEQ ID NO: 15912 - DNA, 201 bp, Bos taurus
tgttttctttcattatgatttatcacatgatagtgaatatagttccctgtgctgtacagtggggtcatgctgcttatccatcctttatgtaacagtttgcacctgctaattccaaactcccgatccaccctcccccaaggcaaccataaatctgttgtttcataatttgtgtcatattttagatttcacatgtaattggta

SEQ ID NO: 15913 - DNA, 201 bp, Bos taurus
aggttgtggcagggcctgggctcaccccatcaggaccccgcagtagctccaagctcctgttaaggaccatcactttctccatcaggtcctgaagggacaaagaaaagggcagtcagtcctcatcaacccacaccctgctctcttagctcaggcagctcaaccaaggacttccctgctacagataccaggtgatgatacatg

SEQ ID NO: 15914 - DNA, 201 bp, Bos taurus
gctgtatttgcctttaaatgtgtatttgagaacctgtgtctacacaatgggagcacccatcatggtgtgtaagcctgtgtaagtgtggctgtgtatggccatgtctgcacatagactgtaagccccacaggggcaagaccaagtgtcctctctatagctccatcacctaagaaagggcctggcacatagtaggtgctcaat

SEQ ID NO: 15915 - DNA, 201 bp, Bos taurus
ttgtgtgtgtgcacgcatatgtgtgtgcaggagtgttttggggtatgtggagtgggtgggactgtgccaggtgagtactggggcctaggtgggcatgtgggcagagggtctgtggtgtggttagggtggagggttaggatacatttggggggatgaggaggctggtgagttttgagaatggaggccgtcatgaagggctga

SEQ ID NO: 15916 - DNA, 201 bp, Bos taurus
attggcacctcactcattgctatgccccctgtgttgagtgcagagactggtgaacagaaggcacataggaagcttctttttcttctttcacctttccttcttacacaggaaatacagagaagaaagacaaaaataatgcccatataagttagacaaccccagttgctatttgaatgaccattcaccagacaactctttctg

SEQ ID NO: 15917 - DNA, 201 bp, Bos taurus
cccattaacctaagctctgagacatacattatgaaagagaaagatgctgatatgatcaacgaatgcaataattcaaagcagaaatacagacattgccaccaaacaataatcaaattcctccaactcagtgttacacaaagtgcagtcaccttaatacaataccacaaaacatcaagtaacaaaccttaagccaactgccag

SEQ ID NO: 15918 - DNA, 201 bp, Bos taurus
gaggggatggccatgcctgatagagcccttagttgctttcagaaactgccactcaggacccctgtctgttctctttctatctctctgtctctcttttttttaatttttttggccacacagcttcaagctctgtcttgatttgtctcccagatcagggctgtcttcatgtttgccctgactattaataggggctcttgacca

SEQ ID NO: 15919 - DNA, 201 bp, Bos taurus
ttttgggggccagcggacgtctctctctgaccattgacctcttagcaaaggaaggtttggcgcaaaggagcctgaaggaaggttggggagaaaaaaaccgtgctcgaggaaggcctgggctctccggagagggagtaccgcactggggagacaaggttgggggtagctgggtgtgttctccgaacgggccgccaggtggcg

SEQ ID NO: 15920 - DNA, 201 bp, Bos taurus
cacatgtactttctcgtgggcatgtcccagggtgagcacacggccctctacatgcatggatgcatattgagggtgtgcgatatgcagtgtgtgtctctacgactgtgagtgcaggccggtctacctgtgtctggggcaggaactcttggggcctcctttccctcccccactggttctccatctccacttctctggtcaaag

SEQ ID NO: 15921 - DNA, 201 bp, Bos taurus
gggcagctggctgtttcccattcaatgttgctgttctaaaatgaaaatatgactggcttgctgtcaaagcagcagcacataattacagcctaatatgattgaaagggataattcagaatttagaataaaatataaagaaatgcaaacactcaggtgtgtctggatatctccctccattactcatctagtcctgccctgttc

SEQ ID NO: 15922 - DNA, 201 bp, Bos taurus
atctgcaatcagagctccctggccctgatgagggagcgcctgtcaacctgatcgctgagtgacagcccggccacctttcccggccgtccccacactcctcaaacacaaatacacacacacagagtcactcgcctcctgcaaacacaaacacacacctctcgccaacacaaatagcccctctctgcaaatacaccgttgcaa

SEQ ID NO: 15923 - DNA, 201 bp, Bos taurus
aaagttccatatggaaggtattcggttgattagaatgaagtcttgtgcagatcatcagaaccaaggctggtaagaccccagatgtgaacattcaggacagcaatttttaaaaaagataataataataatgaacaattacatagcagtgactatatagcaggtactattctaagtgcttttcaatactgtcatttaatcatc

SEQ ID NO: 15924 - DNA, 201 bp, Bos taurus
aaaataaaaggtacccaatatactcaatcaacagagagtcatgaacacttgagcaagaatacaaattcaaaatgagcactgcacagccttcaagacaataccacggcagttttcagaataatcatcaaagctgatagtcaaagctaacaacacactgaagtacagttgatccttgaacaacttgggtttgaactgtgtggg

SEQ ID NO: 15925 - DNA, 201 bp, Bos taurus
atgaggccctactttgtgaaaaaagggatgcgagggagaccctgggagggcagcttcaaacttttcaccttaggggaaggagctggaggtcagaatgaaccgggcctgagtattacctttaggaaaggggtcaaaggtcaggctcgactgggcaaaaggtacaaaaggggctggaaattgtactggactaaactagcagtc

SEQ ID NO: 15926 - DNA, 201 bp, Bos taurus
tgtgtgtcaggggtggtggtggggagggtagtaagtttgcctatggagataaaacttcttgctggtctttttaattttgaggacctatgaggctcggggtgttgagcataagactgaggtggtcttgaagctcagtataagcacctgtattaactatggaactgttgtcgctgcttggaccttttctttctgagattcact

SEQ ID NO: 15927 - DNA, 201 bp, Bos taurus
gattgagagtattacggagtctccatgaggctccagaggggccaccagatggcactctagaacctactgcaagatcaacttccttcctcttcctctaagtcttcccggcagccgggcccgctccgggcgggaccagagggctgaggcatatcagcttccccctggggttccccgacttcagaggtggccgagcattaggcg

SEQ ID NO: 15928 - DNA, 201 bp, Bos taurus
gagtcctgaagctcagaaatgaggccaggcctttgttcttggctcggccagttgctcatctgtaagtgagaatgtggattcatagcagtttactcagagagatgtggttcactagactctaggcccttaactagcaggttagtataaattggtggcctctaaagatcctttaccttcctactccctcccccattactcagg

SEQ ID NO: 15929 - DNA, 201 bp, Bos taurus
gccgtgggacaggctggagggagcccagcagggaggctgcaggaggcggctctgacatccagcccctctcctttctgagcaccctccatcttctcatgaagatggcctttggcccttccctgggtgggcccagcctgcaccgaggtggggtgcctggggagcctggacccggcaagagcggggctccgcgctgctgctggc

SEQ ID NO: 15930 - DNA, 201 bp, Bos taurus
gaccatttccatgctggtcctgctcccatctccagctgtgataaacctcacatcctcagaagcgatgcaagtccattcctccctgggatgaagagggccccggtgctgcatgggagaagggagatgctggcagcagagacacaggatgaggccgccccccaagcgcagagaccttcagaaagaagggcgtgcctgtgccgg

SEQ ID NO: 15931 - DNA, 201 bp, Bos taurus
ctaatccccaggcactgagagagggtgtagaggcaggcgcctgggccgggtgggcagatgtacttcaaccagcgtggacaggagaggcctcactgtgcaagtgccagagagccgagcccaggagcagggcatgaccttccacaaaaagactagggtaaacctgaggaagaacggaggagtgctgggcggccaaaggctagt

SEQ ID NO: 15932 - DNA, 201 bp, Bos taurus
agtctgtttgtttaaatttttctttccctccgcttctcaccatgactcgactttgggtaaaccgtacctccccatccactgacggcaggcctggacagacaattttctgcagccagtggaaactgggagagtgtgagatcccacagttctgagccaaacctgtaagaaacacggtgtgtctctctggatcacctgcatcca

SEQ ID NO: 15933 - DNA, 201 bp, Bos taurus
gggctcacagcactgacatcctcagccctccttgtgcaacgggcctgtgggtccagaatacacacgtgcaagaaagcctgtgtcttggggtcacccaccctggtgcctcactccttctggggtgggcctgagcccaaacacaggtgccttgaccttcccccaacccagagcaaaggcagcagcatctccagtccggagctc

SEQ ID NO: 15934 - DNA, 201 bp, Bos taurus
gctggagcaggagtctgagcaggcaggcagctccaacaaggggacagctgtccaccccccagtctctgagcaggaaggcagggcccacaggagcacagccgcctgctcgctctgctcctgtccgtccactgtgacttcttctcatccctgggtgtccacggcggggcctgggtcctacagcctcagtgtcaggcccaccga

SEQ ID NO: 15935 - DNA, 201 bp, Bos taurus
agcaccatcttcccgaggacatgctgggccgtcacctcgccacctgtgtgcagcatcgcatcataaaccatgaggaggaggaggcagccgtgcggcacccggacggggctggtgtccaccgagtggccctcacatgcccactgccgcccctgtaactggcctgccaggtcctgccgccaagtgtgcccctaaagatgcata

SEQ ID NO: 15936 - DNA, 201 bp, Bos taurus
tcctggagggctctggtcgagggacagatagacccaggacatgcccatgtcacagtctcactttaagatgaatgcctgtggcctgatggcaggggttccccgtggagagcagtcaccgccgggtgccccacgccctctcagcaccctgccacaggatcctgtggagtgaacgcagcctgggcccaacagccctgcctcggc

SEQ ID NO: 15937 - DNA, 201 bp, Bos taurus
ctgtcggctccagccctaggtgggtccagagctggacttcgtgggtttgcagcacatcctcctcagtattctacagcagctgtctggagttttttctgccgtgcctgaactgatgtcatttcccccttggcagacagcttcagctttgctgcgtctgagatatgtcacgagaaggtgggggtgggtcagagccaggcgggg

SEQ ID NO: 15938 - DNA, 201 bp, Bos taurus
attctcccagtagcttgttattaccaaggcaaatccaggttacttcatgccagtggaggtccaggggaaaggaatgactagatctcaggttactttgatatatgtttgttcattttaaagccaaatacttgagtagctcaaatggtaaagaatctacttgcaatgtgggagacccaggtttgatccctgggttgggaggat

SEQ ID NO: 15939 - DNA, 201 bp, Bos taurus
ttgtaacttttctcgaagttggtgccaataggagctgaaataataaaatcagtacagttaaattaaataggaaatgagagtcttctatgtcccaggccttagattaggtaacaatagttggtcactcttctgggaaatcgtagctaaaattacaatcaaccggcagtcactgattggccccatttactgtattgtgtccca

SEQ ID NO: 15940 - DNA, 201 bp, Bos taurus
ccaggtatttctgagtccactgaactcagaattgagtccctgccactcaggtcttggtttctgaggaggaaccaaggaccaggctgtggtagggcccagtcatcttacaagacataaagcacaaagacaagaatatgctccaaagtcccacaggactctattccccgtcccctttttagaggcctgtctcaggtaatattt

SEQ ID NO: 15941 - DNA, 201 bp, Bos taurus
aggatgtgagtggtctccttggtaacgcctgggaaaactgcctgcagggctggagggaagtggactggccagtggtcaggctgggtggcacaggcagacctgggccaggctgctgagactccaggccggtcgggagagtctggcttatggaatagccggggcagcctgttggccattcctcagcaagccagagtccagggg

SEQ ID NO: 15942 - DNA, 201 bp, Bos taurus
ggcatccgcctctctgacccctcgcttggcacctgcagctctggccctctggggagctctgctggaggtaagtaggctggcctctttggttccatgtgactgtgccagcccttccaccctgagggacctgccctccaccctggctgaggcaggtctgcagacggggctccagaggagctggagatgggcccagtgaaccca

SEQ ID NO: 15943 - DNA, 201 bp, Bos taurus
aggtctggctgaccccactgctccagggcctttttgatccccagggccctgcactccctctagcctaggttttggctggggtggcccaagacacatacaggcatcctcaggctgggaaagaccccaagcctagttggtgccgcacaaggtaactcacgggcaggccaagcccggcagaacatccctggaagctgcaggctt

SEQ ID NO: 15944 - DNA, 201 bp, Bos taurus
ggcccgccctgctaggaagagggctgcaggggactggcccctcctcgcaggccctcctgagtgtttagccagggtggccctcaggcatgaagcagacttacagtcatggtcatctccactctgcttccagaacctcagtgcttagcgacacagggcctagtcccggagcccacagccggggtggggtggtgctcgcccacc

SEQ ID NO: 15945 - DNA, 201 bp, Bos taurus
ccagaattgtggtctccgaccagccatgggatcaaagtcaggtcaaagtctggggcaaagacagcacattcctggcagagatgagaccgagacagacccttggtggtcctgggcccaggctgctgttcaggcagtgagatctcagaacaggtgccgtggtgctgccttaaccctgccttctgggaaagaagccacgtggga

SEQ ID NO: 15946 - DNA, 201 bp, Bos taurus
tcttctggagaagcatggtgctagttgtgccagcttctagataacagtcttcgctcttttcttccctcttatatactggccacttcagggcatgcttctgcagttctttgtcattcactttgaatcttcatttctggatccttttattccttgctttgagttctctgtggtttactttggaacttctgaaagtatgttact

SEQ ID NO: 15947 - DNA, 201 bp, Bos taurus
ggccaatcacgcgtctcggcccttccgtttcttcccgcccccttgcggagtcttgagaacgcgcgcgcgcgcagtcccgcctctccgggcgctgggcgaagaggagctgcgtgtcaatcaatctggccaatcgcgcgtctcttcctcttcccgcgcggcccggcctctgagacgccgccgcggctggcgcgccctcggtgc

SEQ ID NO: 15948 - DNA, 201 bp, Bos taurus
aactgcatattctcagttaccttagaagaagacagatatttcttaaattaaaaattcatcaagttctcctcctaccctacttcatttcattgcttgaatccctctgcacttgttgcattaaaaaaaatactaataagcattttgcctgctcaagatgtaatgcttaattttattccttccaatctgtccttatatcagcca

SEQ ID NO: 15949 - DNA, 201 bp, Bos taurus
tcctggattttctcctatttctgtgactgtgcctcttcagactctacttcttcctcctgtcttttgcagacattttcctctctggctctcttccctgacatcctctctttcctttccctcaccccctacccattcccccacctcatgctccatgctcccactatcctctctgcagtagtaactctaacttatttcgtcttc

SEQ ID NO: 15950 - DNA, 201 bp, Bos taurus
tgttgtttcaagccaccacgtttgtgatctttagttacaacagcccttaggtggccgatgcaatctcacagcgcatcccagcttggccacccagcttcccatttctgctggtcaccagcagcaaaccagccatcacccgggattccaagtgtagggtgccacactactgggcatgccacactctccctcctggccgggtat

SEQ ID NO: 15951 - DNA, 201 bp, Bos taurus
tgtaggtttttctttctttcttccccctaaagccaaagggcagtgactttgtcttactcactgctgtggctcctatggccagccttgggagctgttgttctgtagtagttgcttaaacaaagtgttttctgcactgaactgctgcaaccttggcaggccatctgcttgtgaaactgtcccataggcagttcccaggcagtg

SEQ ID NO: 15952 - DNA, 201 bp, Bos taurus
aagtaacagatccaggaatggataccttatttaggtttcccgtttgttcctaacttaaacatttttagttgctagtggtggtaccttaaaaggccacctgctactcattttcaagggatagatcaaagagacgatggaagaaggagtgaaatgtcttttcatttcagatctacccacatgcctcttctgcaggcctcctct

SEQ ID NO: 15953 - DNA, 201 bp, Bos taurus
ggtcatcattgttggtgtttttaagagtaggacagagggaaggatgtggccataaggtagttgcccactggtaccctttaagagtccagttctggaggtcactgggcttggaagcctggtggcctttaagagtccagttctggaggtcgctggacttggaagcctggccaccaggggctcagaagggaagagatgtgagaa

SEQ ID NO: 15954 - DNA, 201 bp, Bos taurus
gtttccacccagttagtgctgtgaaaagaaggtctttccgtcccttaaccattaccatggctctctgtccaagccagctggacctggcagggccaccctgtagcctgtgctgatgccagtccacctgctggaaactattcctaaattcctaagtcagacaaggcagatctagccctttggggtcccatccccctcttggcc

SEQ ID NO: 15955 - DNA, 201 bp, Bos taurus
tcaggcctgggctggaatgctggccccagtacctaggagctctgtgaccttaggcaagttacataactctctaaaccttagttttctcatttgataagggggtgtgagagggcctataaccccattctttcataaggattaattgagaaaatgttggtaaagttctgaaaaaggggcctgagtataataaatgccccatga

SEQ ID NO: 15956 - DNA, 201 bp, Bos taurus
ggctacagtccacagggttgcagagagtcagacaagactgaagcaactgagcgcatatgcacgcacatgaggagatggatatgcaagtgaagggtctccactcccttccccacgtgcccagcatgtgcccaggggctgagagtctcattccaggcttgagtcacatattcactttggtcccaggaggggctggcaagactt

SEQ ID NO: 15957 - DNA, 201 bp, Bos taurus
tttgtatctgatttttttctgtctctttttcaatcgttatcttaaaaaaatatttatttattttggttatgctgagtcttcattgctgtcctggctttctctagttcgggcgagcagggactatttttcgtggcagtgcactggtttctcatggcggcggctgctcttgttgtggagcacaggctctggggtgcatgggtt

SEQ ID NO: 15958 - DNA, 201 bp, Bos taurus
tgggatatgaatgcagtgatcaggacctcagagtaaacgtattcaacttctggagtcacgaacactagccaatggccagtgtgctcctggtgataagaaatagagacacaatgcagccagaccagctctgcaaacgcaggatgataggcttcagtgcttcctcgggcttgggcgtggcattaggccatctctgtcttggca

SEQ ID NO: 15959 - DNA, 201 bp, Bos taurus
taagagcctgtgtccctagatgggggtgctgtgcccagggccactgcatcagggcagaaggcagtggctcccgggagggctggcctcagttgtcccctccgtgtctgggcgcctccccaaccagcagtcactgcagaagtgttgcctagtggctgggggcagagggaggtggccatgctcagagtcaaggacttggcaccc

SEQ ID NO: 15960 - DNA, 201 bp, Bos taurus
tggtgggtgctgagccttttctgggcacccagaggaaagcccacccaccaggccagaccccaggagagaccaagcattccttgctggcccctcggacccccttcaccactgcaaggtcacaggtcctcacacacgtgcacacgtgctcatattcagcccccaggcctcccctttgttcctaccacccaagggccctggctc

SEQ ID NO: 15961 - DNA, 201 bp, Bos taurus
ggatgggttgataaaagacaattagatttatgggaccccaaggacaattttctgtttgtatcctttgtgctgtggacttttaatttcttagtataggctacgatgcttttacatttctagtggtattgtgcactgggacattaggtaaggaggttagttaataagatgcccctttggtacattagagtcttgaagctccct

SEQ ID NO: 15962 - DNA, 201 bp, Bos taurus
ctagtttacctgtatagagtgcatgtcagtgtgtcttttgtagtatgtctccaggtccaatgtgaactgtcatggttctggggtacacttaaggaagggacattcctttctggcttattggctttcatacatggttctgtacatacttagaatcttcttggaaggtaaagttattagaaaatagaagtaaatgtagttgtt

SEQ ID NO: 15963 - DNA, 201 bp, Bos taurus
gtctgggggggatgagggccttgtttctcacccttgaagaaccccatggtgctgccagccctggaccgtgggcagggacggccacttgtgccctggctccgtcctgtactcatgcagaggggaggtccctgctgggggcaaaaatgatggtgaaaagcaggcctttccaggtcaacatgaccaggccatggcagtggtcat

SEQ ID NO: 15964 - DNA, 201 bp, Bos taurus
ctaatgtggaaaaatgagaatgagaatgagaccctcttcaaagtgttaattaacaatctacttagcttatctgatttccaccaacctcattaataattatgatatcctctctgcattcacacatcatacagctaactctaccccaattgcttctcattgatacctgagcctttgtcagaccatttgcattaagtagattca

SEQ ID NO: 15965 - DNA, 201 bp, Bos taurus
gtgagtgttactacctctaccagagcttctaactttggaaccatcccaaatctatgtagagatggtgtgataaggaagccaagcttcagttagcaatgtccagagtcatagattaaaatttctgatgaaaacagttgaaactcgctcccacagagcatcccaaattgcaaaagctatgcttatgtatatgtgtgtgtgcat

SEQ ID NO: 15966 - DNA, 201 bp, Bos taurus
gtaaatttgttagaatgactgtgaggaaggaaagcaagagttcaaataataacaataataatagtggtaatgatagagttgactatgggaagttactgttctaagagtattatattttaaatcatttaatgcccagaaaaactcactgaaggaggtagtgttttagctttctctcctagaggaggaaacagaagcccagag

SEQ ID NO: 15967 - DNA, 201 bp, Bos taurus
aagggctacacaaatttattagcagttacgcatctctacagacactttgcaagtaaaacgtcttgactgttctctaaaccattattgtattgctagtagtctttggcaactagtcaactacagcaatttcatgaattaatgccccatgtaagcaatatttctatctagcttcagaactgataatgaaaagcatgcctgatc

SEQ ID NO: 15968 - DNA, 201 bp, Bos taurus
tctttgcttttctatggcaggaacaagttttttctctctctctcacacacacatacacacacacattcaattataagtaccatctccaagtgttcgacaaccggctgaaggcttttgcctgttgtcagtacaggtttcaaactctccccagggatgccctttactgagcaaagcatgaggaatgaagaatgactagctgcc

SEQ ID NO: 15969 - DNA, 201 bp, Bos taurus
ttgaatctcaatttacatttccttaagtaactcacatgactacaaaatgtcatgcttttgtgcatcctgttctttcctggcaaactcctattcaccctgtaaaacctgaatcccagaggcacagaggaaactggaagctaaattcctctcccactcatgtggagcattcttgactcaggtgtggatggtaaatgagggcag

SEQ ID NO: 15970 - DNA, 201 bp, Bos taurus
gatactgagaaaaatcctacactgacaatttcaagagatttgagttttatggctcttctgtcaccaattacccttgaaaaaggtcttcaaaacaaggaacaaaaggcccaaggaattaaactttcccccaaatcatgaagtaggtattttggtaatacatagaattaacatggtgacctggaaagaacgcaggtcttaaaa

SEQ ID NO: 15971 - DNA, 201 bp, Bos taurus
atatttatattcttaaaaggttcatatatagctccaggtaaccatacagatttatatacattctttccctaaaattttaaattataccatctgttaaccatattatgactaattagcaagatcactgcatactatatctccaacaacaacaggagatatctagagctattatataggactggctctttaataaatgtactc

SEQ ID NO: 15972 - DNA, 201 bp, Bos taurus
actatttatcatagttaagacatggaagcaacttaagtagccatcaacagacaaatggataacgaaaaagcatatggtatattgcttagccataaaaaaggatggaattatgccacttgcagaaagtggatggacctagaaaatattatgcttagtgaagtaatttagacaaaaaagataaacactatatgatatcactta

SEQ ID NO: 15973 - DNA, 201 bp, Bos taurus
tgtaacgaggatgtaaccacatatttacatctagctataagcatttcttttaaaagaggaagaagtggaaccttactacttttagaagcataaacacttttgtgcatgaaatgaataaaaccattcttctatagtgatttcctcagatccatggcaacgtgaacctacatcagtacttcacacttttatctataatctgga

SEQ ID NO: 15974 - DNA, 201 bp, Bos taurus
aatattgggtagattccttgtattgtacaatacgtcctttagcctatcttatacccaaaatttgtgtctcccactcctaactttattgttcccctgcaactagtaaccactaattcgttctctgtatatgagtcttcttctttttctttttattcactagtttgttgcattttttagatttcacatataagtgatatcata

SEQ ID NO: 15975 - DNA, 201 bp, Bos taurus
atatctacactgtcaaataaatttctttagacataatgcatttggtcctgtgccctaatatagacatataactgagaatactaggccaaaagaagttcccaagaaaggaccaaaagccacatgaaatccatatggggattctccaagggcagcgctgacttctgtaatagaaaagcaaatagatcaaatggccgcaatgag

SEQ ID NO: 15976 - DNA, 201 bp, Bos taurus
taccgactgctcatcagtagatggtgtcttattacttcaacaaccccaatttcagctattctcttccttcttttcttgatactcctctgtcaccctttcctttttactctatcctctttgattttgcttctgcgctgcctgtcagtctttaaaaagatgaaggtcgtagcttttctttgtgagagtaaaattggaaaaagc

SEQ ID NO: 15977 - DNA, 201 bp, Bos taurus
cacaggtaactcaccatggagaccattgctatagactgaggattcctggggcatccttaacatttaaaatgttaaatctttaacactttcctccacaggaagccagagagcagattcttaattaaatttttaatgaatgaatgagttcaacaaatatttattgaatgccaataatgtgccaggggtagttctaggtgatga

SEQ ID NO: 15978 - DNA, 201 bp, Bos taurus
aacagcctattcatgtcactctctgcttttcccctggaggaggagtgggaaggaagagacttccagctagtgggaattatccacagggttggccgaaagtcagcatcttcaggtcagcttctgtcagcctgaatccctggagttctccaggaagtactagctgcagccaaccccacacagaagctgcctcaaagccctctg

SEQ ID NO: 15979 - DNA, 201 bp, Bos taurus
acattttgaaatattaattgagtcactgagaaatgtactaaaatatacacatgtaaaaaacgactgaaaagtattactatctcataatatatacaaaaatattttctaaccaaaatatttttaacatgctgagggatctgcttttcaacttttttaaattgggattttacttattgaagaatgcaaataattattaaatga

SEQ ID NO: 15980 - DNA, 201 bp, Bos taurus
gccatgtcctcttccaggagatcttcccgacccagggatggaacctgggtctcctgcactgcagcagattctttaccactaagtcaccagggaagctccacagattcatggcaacactggcaaatgactgatttattttgtgggtcctgtctaagcacttgtcttcagagtctttcatttatagtattttatactgttctt

SEQ ID NO: 15981 - DNA, 201 bp, Bos taurus
gtccaggtatcctgacagtatgtgagtctctggtagcagtgcagaagtacactgataaggcaggcaagagaagtggccaaagctgggagttattgtgtctctctgtctctggtgcttggagacagtgcagtgtgtggattacaatcctatactttgaagtcaagtttccagttttaaatcccatggaggccactctgtagc

SEQ ID NO: 15982 - DNA, 201 bp, Bos taurus
aaatgaagcaatcatgcaattttgaggatagaacaatagtaagcagtgcccatgaaacccacagtcctatcatatactattggcttaacacaagtttggggtggactttccagtagcagctaaattaacaatttgtagatgatatcttataaggcagagttgtgtctttcaggaagaagtatgtactttaaacagtgtctc

SEQ ID NO: 15983 - DNA, 201 bp, Bos taurus
gaatgtatagaagaaagaaaaccataattggaatgctccttcattcttaatctcccccacttggcatacactaccagttctgggagtctgacaaaatgggggatgtgatggtgctctcacatgaagtggttagctactggacaactggtagctcaaaaccttgtttggcaattgaataaagtcacactagctgggctaatc

SEQ ID NO: 15984 - DNA, 201 bp, Bos taurus
tgcacacaactaataaattctacacacacatatgcatccatagttgtttgacaaattactcaagagcagggcttttcatacgtggcctccactggcattcggtgtacgtatatgagtgcttgattctgatatgtaggttgtgctcctttaccatgttcctcacggtgataatatagaatgagggccactataaatatactt

SEQ ID NO: 15985 - DNA, 201 bp, Bos taurus
gaaatgaaataagctggcaaatgcccaaatggcacataatcatttccagacagattaagaaaacctcagaaggtgttatttttaaaactaagatgctcttctgtggcaacagaccatgctgctctggggatgtcttccaataaagaatatttccatcagaaaaggaatttcaaccaatgtgattttgtccccagaaaaagg

SEQ ID NO: 15986 - DNA, 201 bp, Bos taurus
gccacatactcagggccacagacagaatcaacagggtcagtcaaggggcaaaggagtcgatcttagggataaacacagtctctctcaatctctttctctcgcttatgcacatacaggcccaatttctttctgaaatacttcaaaggaatttggagatatattcatttacctttaaatgcatcagaatatatttcttaaaag

SEQ ID NO: 15987 - DNA, 201 bp, Bos taurus
tttacggggtttaaaatttttttttatcaaatagttcaattaatagcaattatattgtcattcataggctttttttccttgtatattgccactttggtggttttttttgttttttttttcttagtcccaaacatgcccccttattctgaatatagtcttcccctcatttggtctttctggagaatcagttaaatgcttgaa

SEQ ID NO: 15988 - DNA, 201 bp, Bos taurus
ctctgtgaaaattattccacagttggaaagccagattaaaaatcaaaatgtgagcagattcctatacaaatacagagaactggataaagcaaaggagaaagaaaagagggcctaaatgactttgaagggtaaggaataaagtagattttgaagtagtgtccttaatattctacccccagatatttgtcatcctgctagcat

SEQ ID NO: 15989 - DNA, 201 bp, Bos taurus
tgggggtactccaggagttggtgatgtacagggaggcctggcctgctgcggttcatggggttgcaaagagttggacacgactgagtgactgaactgaacttaactgagagagatgttaaggcctaaggaggtaactttccaggtcacataaaggcacatttagaggtcatgacatgagaaataatttagaatgttcaataa

SEQ ID NO: 15990 - DNA, 201 bp, Bos taurus
cagtgctaaggctggattcagcatctgaatgtgtcccatgtatttcatctcttttctttttgacagtgtatatgctgcttttattcacctctgtattcacatggaacatgaattaatactgtccgaagactttgaagcttgaaatagttgtaagagatgatgacccgtggagtagtgaagcctttctttccctctgctctt

SEQ ID NO: 15991 - DNA, 201 bp, Bos taurus
ggcttatggggcagaaatcctgccaagcccttgccatctttgcagatgctgccctctgcagccagagggagactaaataggaagagaacaaggagtgggttgaggtgggagcaccagccccttgggatgctcttggagggagagcaccaggactgtggctccagaacatgacttgggcaaaaccaccagtttccagatgta

SEQ ID NO: 15992 - DNA, 201 bp, Bos taurus
ggatccacaggcatctggaaattcaaaaatatcagggcatactcacaaacagcctccaaaatatcaccagctctgcaaaacaggtgtaaaatgaaaactttctcctgctggataagataatcttctcattagctccaagccaagagcaaaagtgaaacacctcattaaaaattctcacttttgtatgtcttctaacccatg

SEQ ID NO: 15993 - DNA, 201 bp, Bos taurus
aggatgctgcattttcctttgattatcacaaatggtttttaaattttttaggctatattgaaagaagttggattatggcatctataaagcttttggagaatatttttattttattttctttctgtgtgccacaaaatctatcaatgagaattctaaaggtcaaagaatactttttctacatagataggtttatcgtactat

SEQ ID NO: 15994 - DNA, 201 bp, Bos taurus
tcattccctattccaaggccaaatttgcctgtgactccaggtgtttcttgacttactacttttgcattccagtcccctataatgaaaaggacatcttttcctacacaaaaatggccctctgattcccagctagagatgagcagaggtagatgaatctctgctttcatctctgttctgttttatatctttgtcctgtgctta

SEQ ID NO: 15995 - DNA, 201 bp, Bos taurus
atctttttccaaggatgaagataaagattttataatgctagattgcttatgttaatgcttttgtgacctctacacaactggaagcatctattatctaggagagacatagaaagagaggatttgtttgttttttcaagtgtatttgtgacaatgatactttgactcttgtgtcttttgtaaaattcctcaaagaattttatg

SEQ ID NO: 15996 - DNA, 201 bp, Bos taurus
catatgactattcaacaagcgaattaagggatgttcaacatcaaaaatcactagagagaaatacaaatcaaaatctcatacccactaggatggccactaatgaaaacacaagcaaacaaaccaattaacaaacaaccctagaaagtgactagtgttgtggaggatgggagaggaagtagaagcctggtgcattgctagtag

SEQ ID NO: 15997 - DNA, 201 bp, Bos taurus
tttgctgtttcaacacagaacacctgattatgtgccatgcactgttctagttgagaatatactctggaatgattaagagggccaaagtcaccactcttgcaagtttagatcagatcagatcagatcagtcactcagtcatgtccgactctttgcgaccccatgaatcggagcacgccaggcctccctgtccatcaccaact

SEQ ID NO: 15998 - DNA, 201 bp, Bos taurus
aatttaatttgatgggcacttatcatatagatgagaattcttttaaataaactaagaattctggggaccattttggtttatgtaagaaaaactcttctcattctttcaaaaaatgtattgatcaaaatagatctattggaatcataattatcttcctcattatcagtatcttcatattcctcttggatttctttcttgggg

SEQ ID NO: 15999 - DNA, 201 bp, Bos taurus
gggtttctgtcttccaaattgtaattttaacttcaacttctgggataaggacatgaaaatgaaattggagcaagggaaagacaccaggccaggagacatgctgatcccaccatatttcttttctttctttcttaatagctacattatcctttttgcttctctgatctcccaatttacttcacagaattacactaggtggtt

SEQ ID NO: 16000 - DNA, 201 bp, Bos taurus
gtttccttcttctagagtttgggctaggcttagtaacttgcttctaataagtaaagcatggaaagagaaaaattgtaactttacagtgagatacccagcatgtacaccatttgccaaatgacaaagggcaataacactcatgttaagtaatgctgatgtgagatattccctgatgtgatatacgtagggcacttcacttat

SEQ ID NO: 16001 - DNA, 201 bp, Bos taurus
attcttgactagccccatttgcatagggcaggttcaaggtgggggaggagacaaacatataaaaggaagaagccaagactgattgaggcttctcctctggggtcaacctgccgtcatgcctccagggtgtactatcctctgcttgccaaataaaactgagctttaacggatctgtaacactagtctgctgtttcaactctt

SEQ ID NO: 16002 - DNA, 201 bp, Bos taurus
gcttctcttgcttcccagatctgtgtgtgcttcccaggttagaggtgacaaaggacagccctgtggcagatctggcccctaacctgtatttataaataaagctttattggaacacagccatccagatgatagctgcttccaggctacaacagcagagttgaataattgtgacagagaccatctggcccacagagcctaaaa

SEQ ID NO: 16003 - DNA, 201 bp, Bos taurus
tcacataataactgtatgtctctcatcatactttaacttttaattccaggtcaatacatttagctgcttaattcatatttccccatggatactgctcaggcaggtctaacttaatacaaacaaaatagagctcttgatgtcttcctctaaatatatccctccaagatatcaaccctttatttcaaacttgaacgttcaagt

SEQ ID NO: 16004 - DNA, 201 bp, Bos taurus
tccatcttctgccatctgtcttggccacttcagtgcacggtgcagagatggttgctgaacacttgaaaacaatctttctctgcattcaagtcacacatgtggaaatcatcaggcccacatctcctgatatcatttagtcctaatgctgaccgccaactgaataggtctgcatttcaaggcctggcttcttgttgcagatct

SEQ ID NO: 16005 - DNA, 201 bp, Bos taurus
gtggcccagatgagagtgtatagtaaaaaaggaatgtgaatttgatgaggctttccctccttcctatcttgtatatctctagacagcactgctcgaaagagtactttgtcacagatgaggcaataatcctcctggcctttccaaaacaatgtcggctttggaatttcctgaacagatcaccttaaggaaatggcagcatct

SEQ ID NO: 16006 - DNA, 201 bp, Bos taurus
gaatcttatggatagaagagcctgacaggctacggtccatagggttgcaaagagctggacacaactgaagcaatttagcatgcatacacactctgttccattagtgattgctctgggcttaaaacatacacctttaacatcactgtctatcttcaaataatgtataatgtaagaactttggaacagtatgcttccatttct

SEQ ID NO: 16007 - DNA, 201 bp, Bos taurus
gtggattttcatttttagaagctgcacttagtcaacagaagtttaggtaagaactgtaagcaagaaagaagccctgttcaaacctattccccaaaactataaaaatcatccatttacaatcaagtcagaatgtcagcaattgtcacagctttctgttatctgacttgctttccctgtatctttacttttagaaactgcccc

SEQ ID NO: 16008 - DNA, 201 bp, Bos taurus
tctcaacaaagagaagatgagtcttatttaaagggaacattcaagccaaacagggaaatggtgcttttgagttgctcaggaaggatggatatcagaccaaactgtgaaaatggaatgggattgtccatcagatcaggatgaagggaatttgcccacttctgggtatttgcacaaaagaattgaaaataggtgctcaaatca

SEQ ID NO: 16009 - DNA, 201 bp, Bos taurus
gggccatctctgacttacgtttcataactctgggtggcggactgttctgtgaagataactcctgcatagaactcacacacctcttactgcctcagctttggtttgttttttgtctaggccttttttctccccttgacttttgctccttctgttgaatctcttgtactgtttggttgcccctcaacatctgggttttcttta

SEQ ID NO: 16010 - DNA, 201 bp, Bos taurus
aatagctgcataatttagtgttcttcatggtaccgacgtttgtttttaagtgaatgctaattctaactagtatgggagataaactaatttaccactaaaaactgcttagtgaaattctttaacatattagcagtgtatgcccccacccccttgaatcaataaacagttgtcaagaacctaccatatttccttaatacaaag

SEQ ID NO: 16011 - DNA, 201 bp, Bos taurus
tcagagcagagacctgcgaggaggcctggtgagcccagcaactggaagcagttgcggagggaggaccagggagtgactgatgtcaggagaggagtcagggtggcagcaccaggaagaagacccaggactgccccttccttccttcgctgctcagtgttcaaacccaggagctcctagcctgctccgagcgtgagtagagtt

SEQ ID NO: 16012 - DNA, 201 bp, Bos taurus
tcataggtgttttgaatgtttacatgtggatttgttacagggcaagctactggctttttctgcctattgagtattttggggggtacagtcaattcagaacatatcctgggatgactcttagatggtatcatccatttaagtttgatggataaacaaccttgctgatgaatgcagttgctcacctgtcgtagcaatcctgat

SEQ ID NO: 16013 - DNA, 201 bp, Bos taurus
gaaagccagatggagaaggaacaggacttgccgtctggaccagccattgccaaacagatggagcgcttgtccatctgtgttacccttctcctggaggacatgaggaggaggtggcttggtgggaggaagacaggagactcagctggtgggaagaaagagctccaggctgcttccggctgtgcagaagcctccattcctgat

SEQ ID NO: 16014 - DNA, 201 bp, Bos taurus
ccagattccttacagcatggataagggagaatcgtcaggtgcttctcatcgccagcctagcatgatgacatagctgcgccaaaagccactttctggaagcgggagacagaagcatcaccagcagttttcctttaaaaatgtgacctggaggctttgtgctgccaagcagtctgtagcgtcctcatcttttccagtgatcat

SEQ ID NO: 16015 - DNA, 201 bp, Bos taurus
tgtaccattaagagggccaaggaagcaacacctgccaagaattcaacactgcggcagaagcttcttatgacacaccaaatggccttcgtccacccactgccgtcatctgccaccatctcccaccttgctgggctggaatcttgcccttccttctgacttcctgggcaggatgcagctttgctgacagtggccaagtcgcct

SEQ ID NO: 16016 - DNA, 201 bp, Bos taurus
ggctgagcatctgccagagatggagcccaccctcccttttctcccctccacagcttcctctctcacgagactcggtggggagcattgtttgtggtggggggcaacttgtggccaatctaatctcctttgggggcttcttcctgggctgaggtgacttggtttcttcaccttactcaggagaatggtagcagatatggtatc

SEQ ID NO: 16017 - DNA, 201 bp, Bos taurus
gaaagaatgataaaaagtgagtgttttccttcctgcagacctgcatgagaagactgattattctgtagagacttctccagaatcacagtatctcacatgtgggagggaacctgcaatagttgaaagctgtgtgttccagtcactccatcagagaactgtcagggaagtgtcaagtcctcttggccagagactctcatcagg

SEQ ID NO: 16018 - DNA, 201 bp, Bos taurus
ctttccacgtttcacttccctccttttccctccgcagcgccagctccatcgctacgattggccagaagacctcctcggattggccaataaacggcgccctgtcgcccccgtgttactgggtagaacaaaacaaaaacaaacagagcgagaggggccagagacgctcggaggcagcggcagacgctgaggtgcggggtcggg

SEQ ID NO: 16019 - DNA, 201 bp, Bos taurus
tgaaatcagtagaggatgatggtgaccatgacataagtgaaattctcactgcgtctctttgggggagaagccatgagggccagaccaggccccatgaggtgtcagccagcccagtcgtatggaggcaggtgaaggagggctccagaaacactcatggtgcctgagctgtttctctactcctgctcagctccgaggggcctg

SEQ ID NO: 16020 - DNA, 201 bp, Bos taurus
aatatggatatttttctaatgtaggcttgaaagagaatgaaagcgtgtgctgcctaaattaatttgttgtgaaaacaaaatcacttcattctccagattccttcaaacacttgatgtttcctctagttttctggctctcatccttcatgacccatctcttttctgggaactttttcttggcttagaatcctagcgttgctc

SEQ ID NO: 16021 - DNA, 201 bp, Bos taurus
tgcttaaaaaaaggtgaaggattctgacaaggacgaaatcattgctaatttggtgtcattcctcatttcctgtggattgaaaagttggccttttacagaaagaacttgagtgtccccaagctactggataatttctctgttcctgattttatgtctaggagaactgtgattctctgaggggcttggatgaccacctttgct

SEQ ID NO: 16022 - DNA, 201 bp, Bos taurus
tggcctttctttgtgatgagcagccatgctggcctgcagcttctatgtggaccaaggtacaagccctggcagaggtccaaggggccatggattcagagcctggcatccagtagaagcccattgagagatgactttcagcagcagaaagatatgcatttcctctacacagcaatctggcccctgcaaaagcctgaaccaaga

SEQ ID NO: 16023 - DNA, 201 bp, Bos taurus
aacatattattttttatcgttctatatattttacagtaaaaggtattatcaaatgtttcaagtcaaagcagattcaatggggcagtggcctttcagggaagtcaaactgcctcttgcaaacaaaccttctgaagtgaatcttcctgaatcctcagtgagcagaattgcttgcagttggccatgagcaaaactttggtacca

SEQ ID NO: 16024 - DNA, 201 bp, Bos taurus
agcatggtgggctgccgtctatggggtcgcacagagtcggacacaactgaagtgacttagcagcagcagcagcagactttcaaaatagctctggatatccgattcccaactgaggtggaacattactaaatggatatttctctttcactagaagtaaaacaagggacagctcttgggtatttgcaaagtttccaatgttca

SEQ ID NO: 16025 - DNA, 201 bp, Bos taurus
atatttaggtaatttcttttacagtggctgattcttgtgtgccaatccatgcccttgtaacagcagggtgcttatcttccccaggctgctctgggatgctaaatcatcataatagccccacttactgtccttgctctctgtaatgaagacagttaggaaaacctttccctacccccagcaacatcttttctcctgtggcct

SEQ ID NO: 16026 - DNA, 201 bp, Bos taurus
tcaactgggaacatctgctgtcatgttaggagtgactaagtttgatatgacttttctcaatttagatatttaggctgatcagttctcgcttttttatcatttgctgtcaactggtcttacaaaccaaagcaaagaggcaggaaaggagacaaatttctaatactctaatggccaaaggatgacattacccatgaactcaga

SEQ ID NO: 16027 - DNA, 201 bp, Bos taurus
tacatgtgtgtctccggccatatcagcctgaaggcgcccgatctcatctgatctcagaagatactgtttttaaaatgaaggcataatctgtaggggtgatgatgctctgtggtcaagtcaagaacgactgtaccaacaggtatatataatacaccctctcaaagaagagaaagattttatattgtgaagggctgaattaca

SEQ ID NO: 16028 - DNA, 201 bp, Bos taurus
ctaactcatctctggcttgctctatctctctctttctcacaaacacctggaaaagcaaacaggtattttttgtttcttgcaaggccactgaaaaggaaatattacaaagaggagccttgattcagacaacgaagagacactgagaaaggaatggaagtttgagtatttctgagaatggcagcagaaacgaagggccaacca

SEQ ID NO: 16029 - DNA, 201 bp, Bos taurus
gagggtgtttctggatgagattagcatgtgactcagtagactgaataaagctgatggccctctccagggagggtgggcgtcatttaatccactgagggcctgaatcaagctaggaagaagggagaatttgctgttgagttggatcttctcttcgaggactaggacttacaccatcaactcccctgactctcagactgaaag

SEQ ID NO: 16030 - DNA, 201 bp, Bos taurus
cccttggcccttatgttctggctgggctgacatgacacatgggcaaaacaccactcacaggcaagatatccttagacacaacagcatcagatcacacagccgggccaaactctatggttcatgctatttgcaaagagactggaaagcaatctataacactggccccaaacttggcagcccttggtatattttaaaaatact

SEQ ID NO: 16031 - DNA, 201 bp, Bos taurus
tcctctacaccttcgttcaggagccaattccattgtcaagagcatcagtcctgcggcttgtcctgttttatttccttcccttttgcctgtcccacctgccgagtaagacaataaaatccccaagctcaggattcacaaccactgtctcttttcatctcatcctaggacatggaacaatcactcagaatttacttttaaaac

SEQ ID NO: 16032 - DNA, 201 bp, Bos taurus
tggctcccagttactttgggaagagtctttcctaaaatggaggaaacagacagaaaccctgtcagcaaaatgatgcaacaaaaatttgctacttgaaaacgggccgatatttttaagtgaatctttgttgcagctatttctccctgaaggacaggaaaggtctgccttcacccctctagcacccacaaagggaacacattg

SEQ ID NO: 16033 - DNA, 201 bp, Bos taurus
acaaatcttgttagaaagcatcttcacacttcacagactataacatccccactgcatggagaatgcctgttcctgcaacactgagaacctagttggccacagtcgctttatttcttcagtcatgtccaactctctgtgatcccatggactctagcccaccaggctctctgtccttggggattccccaggcaagaatactgg

SEQ ID NO: 16034 - DNA, 201 bp, Bos taurus
tccagcctatctttgtacaggctcttatcaactccggtggatggtactggctctgctgacctccatgctctcataattcacttgatcagcaataagcttgcgaggcctttggaaatgtttactgaagcaaggctttccttggggttgggctgctggactgtgacttgtttggaagcgcagtagtagatcaaagctgactga

SEQ ID NO: 16035 - DNA, 201 bp, Bos taurus
taaaggagctgaaacccacgtcaagtgcagctttccagtaaatgaaggaagcactgagtagcaacctcccgaactgggaatgaaggcatgaagcctgcacggcagccgtatctcctgggaaggaatcgactgatctttcatcccgactccacttcctgctgtaccttacccgccttcaacacgtattgatatcgtctgaaa

SEQ ID NO: 16036 - DNA, 201 bp, Bos taurus
atggtcctggaaacccaactacctgcagactatcggagttggtcccttaggtcagggttcaaaggatgttgtggaacagcttgaagcttttactgctactacctatactcactcttttaacaggtgactggacaacttgagtatctgagtttatgagtgaagccagtagccgtattcttttttttttttttaagtctaaga

SEQ ID NO: 16037 - DNA, 201 bp, Bos taurus
caaaagtactgtagtggggtgccattgccttctccgaattacctctatacctttacttaaatttaggaataactgttaatactttccttcatttgcttctctgtctctttcgaacatacttgtgtgtatttctgaaggaatcaagcatgaactcccaagtttgtagcttgaataactaagttttccagtggaaaaactgag

SEQ ID NO: 16038 - DNA, 201 bp, Bos taurus
tttagaagtatttctagactagggtaacctcactggctaaaatgcgtgtctgaacaagagccccgttgttcgttcaagccctgctgcactggcgggatgcgggcagcttggcctggggtggggcgggccccgattccctccaggacgccccatgccaagcccaggagagcgcttcccatccgtcgcctcgggtggtgggat

SEQ ID NO: 16039 - DNA, 201 bp, Bos taurus
tcgtgcttcatccaatagggccttaggaagcctgtggtcctccccactttgctttgcagttgagaaaaagggactagagaggataaagcccagtatactttctattacatctcagggcctcccttgaccgtgagattaactgtaaacttgcccagcttgggactgtcttatgggaattggaaattccatagcagcccatgt

SEQ ID NO: 16040 - DNA, 201 bp, Bos taurus
ggtggtgtaggtggccctgggtcgggcacaggtgactgcctcagagtgaagggatccagccttgacttcctccccagcccaatcccctcatgtccttacaggagtgcgtcatcccactgggcctgagcttcctcctttgcatgtaaagggtctgggccagctccccttcacctcctggctcatcactgtggtcctataaac

SEQ ID NO: 16041 - DNA, 201 bp, Bos taurus
ggaaaaaaaacaaacaagaaggtaaatgctgtgcatttctgcaggactggaggtccctcctttgcaactgggaaataaatacatttgtaaaaggccattcactatgtcatggacacaccctcagcttggggaagatatttctttcaataaaggtaatctttcatgggatttccctggagggccagtgtttaagactttgcc

SEQ ID NO: 16042 - DNA, 201 bp, Bos taurus
cggaatcctaaccactgggccagcagggaagtccccggcgtccacactcttgaaaacatcccatgtggttctgatgtgcaggtgaagctgagaatcattgagtacagagaatctgaccctagaacaaatgatcgcatggtctatggcctggaaggtgccattgcagatccaccaccagtaggtagcactagagggaaatca

SEQ ID NO: 16043 - DNA, 201 bp, Bos taurus
aacaaaatggccttcgtttctatttacattttgttcatcaaaaatctgggttaaccatttgcccccctgacagtttccttcctgatacagctctcaaaagggaatctagtctgggcccttgtcctaggctcaggactttgcctttcttctggagtcctgagaaaggtcacacagggagtggagtgggaacatgctgatgat

SEQ ID NO: 16044 - DNA, 201 bp, Bos taurus
tagatgagaataaataattggatccagtgtcctgtggaacaaatgaaatgggaaaatgctcacggtcaagttctggttcaaagtgactggctcttagatacgcaagaaatttggcctcccttaaaatacgcaatgaggatggagcctccaggattgagtcttaaaagtgagtctttcacaggtttcaggaagcattcagtg

SEQ ID NO: 16045 - DNA, 201 bp, Bos taurus
aaaaataaaaaagttataaaaattaaatcacaataaaagagacatcaaaaggcaacatacttttaattgacacatgaaatgcaattagcaaagtaactacgataagtagaggaaggagagatcatttctagaaacagtgggcagggatgactgtcatgaaaaaatatatcagccagatcttgaaagctgaatccaataaga

SEQ ID NO: 16046 - DNA, 201 bp, Bos taurus
tggtcttttggccaagaaagagagcgagcaggctttttgctggggcttttattgtctgtgcctttgggtgtttctggcttctccagtaccccatttgggtacttctttgggccccagggtagctcttctgtcttctgccttccttcagagttgctgtgtgtttttccatttaagcccaaggtgttcagttataattaatgg

SEQ ID NO: 16047 - DNA, 201 bp, Bos taurus
agcagaggaataaggatgaagacagactcacacaaaagttatatgggtgtggtgcgtggaacccagcaatttgaggcccacctctgttccagccacaagcccaagttcacaactcagacagaggctgggcaatggggctgtctgacgaactctacatcctctccagaaactcctaacaattcatgttttacaaggccaatg

SEQ ID NO: 16048 - DNA, 201 bp, Bos taurus
ctgagctttgggcactagtcctctgaccatcctgggctttctcaaaagctgttagcacaagtttccacccttcccagggctttccggccaacaatgggccgtgtccagcagggcagggctcgtgacacacccaggcaagcctgtttgatcctgaagggaggtggagcgaggcccccttccagcaacggggttgagggtgag

SEQ ID NO: 16049 - DNA, 201 bp, Bos taurus
gctacttgcctgggttccctgccttttataaggcaggacagccccaagagggggtgggacatgattcaacatggaaactttgactttttgaagagttagctaataaagtagttccttcctgttcgtgggcctccaaatttgacttctgttagctgaaccagagatactctggcagtttatcagaatgcagacacctattgc

SEQ ID NO: 16050 - DNA, 201 bp, Bos taurus
ggaggatctacacagcattaagtgaaaggattaacatgcaattatttggtcaatttggatttcgcagacaattaaactggttaattcagatcaaaatttcttcttcagattctgacttatcaggattggcacctacattaatttaattagtggaccaatggttaggcatattttttatttgagcttcagatttcaagctca

SEQ ID NO: 16051 - DNA, 201 bp, Bos taurus
atgcagtgaatgatacagtcgggaaatatttattcctctaccctaagctgcctttcagctttcgggttctataaaagaaacaagatgacataaagcttattctaatttgtggtagcattgtttatttgtttcctttttaaggaggaggtggaattggattgtttgtttggtttcttcttcaataaacaacatcttaatata

SEQ ID NO: 16052 - DNA, 201 bp, Bos taurus
catgtataccttgattttacttgagaatgttttaaaaatttctaatttactcttctttctcttgaatatttaccaaggcaaagtgattagttaaatatatttaaaaatattctacatattcttttattatttcatgatatattacaagtgtttaaagcaaaatttatttgtgttttattttctagttgttttttatcttta

SEQ ID NO: 16053 - DNA, 201 bp, Bos taurus
aatttgtatgttgaaacttaatacctaatgtgatgcgttaggagattggggaagtacttaggccatgaaggtggaactcttacaaaagaggccccaaggagcttccttgcctctttcccatgggaggttacagggcaaagacattcatctaagaagcagacgtttatctaggaagcaggccttcacagtactccaaacctg

SEQ ID NO: 16054 - DNA, 201 bp, Bos taurus
gctgaagtccaggatctatctgatgtaattttttgacaatcagccagtcctttgctcagtaatttcagtttctgtcaataagaaccagaacatggaattgctgaagctttaaggagttggagtctatgcagtctatgaaggcacatcataagctggtcaaactcttcctaaactgtttctggttaggcagcattgcttttt

SEQ ID NO: 16055 - DNA, 201 bp, Bos taurus
gccccatcctgtgtttctcccccttactgcttatttgagccacctatcatttgagtaacttgttccatgcccagttggaaagtttgaaatctggaaggtcataatttgtgattcacttcctatgtctgcataccttaaaagagccccatatgatgtgtctcctttatgcagtttttcttgccaccacaccatgtgctaaca

SEQ ID NO: 16056 - DNA, 201 bp, Bos taurus
tatcactcagaggggctgaggcctcagaggaggtccgaaggccgcagtcacctgcgggtccctgaatgatgagaagcaggtcaaatacttctgttaacaccgcttaggactctatcacgggcctcactctgaggcgagtgtggccttgggggagttaagcgtcacaaattgggcatgtggtggtcacaagagccccttttc

SEQ ID NO: 16057 - DNA, 201 bp, Bos taurus
gggctgggtctcattccctgacctttactcactttgtacccattcctgcactggtgcttctctccactaagaagttctgcctgcaaattcaaaacacaggatgaactccagggcctttgtcagattcacccagtgccccatgtgggcattaagattctccttgacttgagtattatagttcattctttgcctttcaaaggc

SEQ ID NO: 16058 - DNA, 201 bp, Bos taurus
tgtccactgataagacactgagatgacacatcctgtctgttttagggttggatccagcggagccttgctttgagggcacacctgaattggtccgattggatcccagcgatgcccagtttgtggatgtaattcacacagatgctgccccaatgatccccaacctgggtgagtccctcaattcatcctcctggagtgtttttt

SEQ ID NO: 16059 - DNA, 201 bp, Bos taurus
agaaattggaggacttctctggccatcctgtgttaagactgcttttccaatgcaggggtgagaattaatcccctggttggggaactaagatcccagatgctatggggcagggccagaagaaaaaagaaaattggattgtgctattgcaggaagatacttcacccaatttatccctctccctgagagaaaaccagaaagtca

SEQ ID NO: 16060 - DNA, 201 bp, Bos taurus
cacagaaatacaaacaacctttattattatttttttttacaaacaacctttattgagtcttgctaaaggccaagatatttcaaatgtatgtcagctcctttagtgaaattgagaatgtgaaagattgtttcacataatattttggccacttgatgcaaagatctaactcatttgaaaagaccctgatgctgggaaagattg

SEQ ID NO: 16061 - DNA, 201 bp, Bos taurus
gactgtctggccctgacttcccgctcaggccatctgctcatctcaggggcattttcagaataaccaaggagaacttggggagccacgtggtccttttcattgggcaattaaactcaggccttcttggcctctgttgggttggccaaaaacttcattcggactttttgtgacatctcacggagaaacccaaacaaacttttt

SEQ ID NO: 16062 - DNA, 201 bp, Bos taurus
tgagcaggacttgctcttccaggtcatctcgttggcccaccctgctctcctggcgaggcccagacccgggtgggaggcgagtgctcccggccacatgctgctcattcattaaagctctggttcctccctgccattctaattatgcgccgcgataagaaagacgctttctccctcaccaaagaggcctatttgtgtgagaag

SEQ ID NO: 16063 - DNA, 201 bp, Bos taurus
taggtttcctcggtaaaagattcaaaaggacatcaagcaaaacgtgaaagtccccttgaccatacacctccaccctctccctggtgactcacacacttgcacaacctcttgtgccttcactcccgaaaagagagacatgagccttcatccatgcttggttttcttccctcccgcttccctcttttccttcctcttccccgc

SEQ ID NO: 16064 - DNA, 201 bp, Bos taurus
ttcttaatgactctcagaattcagaagtataacctgaaagagtatcaactgctgcttctatcagtctagtcgaattagcaaagtctgtctctcctgttctgtgaccccaaaacatgctcatacacttgccatcatagaatgtatcacactgtaggggcactggggttcttttaatttgctttgtcttccactgagtgagca

SEQ ID NO: 16065 - DNA, 201 bp, Bos taurus
gtgacggtggcggccgcgacccctcccgcccagcttccacccgctccgcacccggtgccccagccgtccccgcccacgggccgcggccgcccgcacctggaggctacgcgcccgcctaccttgttccttcaggctggagatgagctgcagctgcttctcctcttccgagctgttcattttggcaggtggggccgggaataa

SEQ ID NO: 16066 - DNA, 201 bp, Bos taurus
ttttatattgaatataagtttctgagctgtttgcaagggaaacttcgaagtacaacatacttggcacagagtgtctgagaggtgtaactttctggtcattcgcttgaataccagatatcagatcaatctgtttatggctacagggcacagaatacagccaggcttgggaccaacagtttactgtccatctcaactagaagc

SEQ ID NO: 16067 - DNA, 201 bp, Bos taurus
atccagtgtgtttttcaaggccctgtggctctttaacattttaactttgtatggtcttactgcattgccagtgatggccccattttctccctatgacactagggtcggcgttcagataacccctgcgcatcttgtaacctggcaaggctttggcctgagttgcttggcctctggttacagatcacaccattttccaagtta

SEQ ID NO: 16068 - DNA, 201 bp, Bos taurus
ataaagatttttcaatttgtctccttgatggtatttgattatagctttgaaattatcttttaaaagccctctaaggtaacccagcagaaagagtaagtctattcactcaagaaaactgaatgccttcagttccttcaaagaaatttgagacagatgtgcttttttcttcttcttcaacaaatccagaggacggaaaatgta

SEQ ID NO: 16069 - DNA, 201 bp, Bos taurus
tgagccacctggggaagcccaaatgtaagactgtgactggggaaatgcctccaggaagaggcaggttcacagtgctatgtgaaggggcccttatcgagtccggagcaatgagagagggaatcagagaaggcttccttcagaaatgatcactgcattgagctaagaagaatgaatagacatttcagataatgagaccagcat

SEQ ID NO: 16070 - DNA, 201 bp, Bos taurus
atatgttttacacacacacacacacacacacacacacacacacacaggaatataccggtaaaaagggagacatgaagtggggtggccaagacagcagagtagaaaaatcctgaattcatcccttctgccatggaaacaccaaaattacagctccttacagagaagctatctaggagaacggcccaaaaactagcagaaaag

SEQ ID NO: 16071 - DNA, 201 bp, Bos taurus
gtccaggcctcggataagactctggcacaggcaaggcaagcactaccaatgagactaactagttagcagggaaaatccttcagactagaatgaggtggaatatttactgtcacttaaagggccataaaccatgatgcgacaacagtctaggtcctcccatgctgatgtgccagaagtggaggggggcctactctgggtagg

SEQ ID NO: 16072 - DNA, 201 bp, Bos taurus
cacatggagtgggagaagccctctatcaaattgaggccctctaacaatctagaaagcctaatacacacagaccaaaaatataaataaataaacacaaaaagctccaacaaaagcctggccaaagggccaggaaagaacactgttagcccatgacctctctactccagtcaaacaccacttaaaactgtggttccatctcta

SEQ ID NO: 16073 - DNA, 201 bp, Bos taurus
ggtctagggcatggcactggacactaaataaatctgaacttttccctgggagtcgaagctgtgcacggtcaatatccttggcagggaatcagcttccacccatttcaaatggacccctgtctggaccgtgacccactccctgcctgtgacttcccagccagctcctggccaccttccgaggggccaaggtgcattggtgcc

SEQ ID NO: 16074 - DNA, 201 bp, Bos taurus
actgtacatcagaaaaacggacacaatgtaaagcaattacattccaataaaaaagaaaatacaacgtaaaaccgtaacagggatggctacatgataacatcaccaaagcttacctttgtgactctctcacagagttttagtgggttaaattcgacttccagccaattgtaaaggtcttttacttctgggacaacatattgt

SEQ ID NO: 16075 - DNA, 201 bp, Bos taurus
cctgttaaaactcctaagtagcttcatgcttgggaaagcgatactttgtctctgtttgtcgccccagcctaaaaagatccaatccagggtggcaagatatttccatatttgctactgacttaagaactgactcatttgaaaagaccccgatgctgggaaagattgaaggcaggaggagaaggggacgacggaggatgagat

SEQ ID NO: 16076 - DNA, 201 bp, Bos taurus
catatggtatggcccaggggcctgggggaggtggcccaagtggtctgggggttgactgttttcctataataaattttgcgctgccggccaggtccttcctgcagtcactctcgcaggagcctgtgttccttctcggggctgcagatgccccagcagctgggagaggagccatgtggctgaagccccagctctgaggcctcc

SEQ ID NO: 16077 - DNA, 201 bp, Bos taurus
tattttgtcttctaagaacaggaactgtaggaattaacacattaaaaatgcaaaatggtgtctttatccctaacatcagggttaaaatcaaatttgagactagaatttggcagtttcacagtaggcaaaagtccacattgccaaactacttcctatgtcaaactgcgcagaattttaagaacaccatgcctttcagaagac

SEQ ID NO: 16078 - DNA, 201 bp, Bos taurus
aagcctcttctgcccatgccgttctcagagccttgattcactttggcctctcttgctctgtgtgggtagcggtgaggaagaggagacacactgtctagaaaccagcaggctgaggacaggccgccccatcgcaaaatcagagcaggcaagtcatttaggggctgttcgttcagtcctctttcctgtccacatacaatacaa

SEQ ID NO: 16079 - DNA, 201 bp, Bos taurus
agcagcagggctaatccttacattgcaccaccgcagctgcagcagtgccagacaccagctcatccttcccatcctccgccctccgcaccccccgttcagatgtaccaggtgcctccaggatctttgccgccggtatgaagacatgctttatatctttatatcattcactgtaattctaatccctctcatttttacctgtgc

SEQ ID NO: 16080 - DNA, 201 bp, Bos taurus
cacgtctttgtgccacttgcagtcctccctgggctgtacccggccaggtttcttgtctctgagggatgcgggaggtctgaacgtcctccagatgccaggtgtctgcaggtgtgcaggcctagaggtggaggtgacgggaggacgcaggagatgtggagccagttggggtggggctagcggcgggggtggtagtgctcatga

SEQ ID NO: 16081 - DNA, 201 bp, Bos taurus
agatcactgctcacagcaggctgtttgtattcagcgttacctccagcatcatgtattacagtgatggagctttagaaatgatgttcctgatcaggatgggtggaggctgggaagttgtcactgtttctgccagttgcctgaaacaatgaattgtcaggactcttgctcaaagtctgatgtacttgcttctcatatattttt

SEQ ID NO: 16082 - DNA, 201 bp, Bos taurus
ctgttggccttggacaggttggtttccctctcggaacctcagtatttagcaatcaggtacttggtgtgcagtcctggtcaggtaatgagggggcagaagatggatatagattggtcagcaagtggccttgggctgcattgtccttccaactttctgtgcttagagttgctgagggcccaatgaaatgctgattcccaggtc

SEQ ID NO: 16083 - DNA, 201 bp, Bos taurus
ggattcaagtagcattatgcagtggatccaagatggctacccagtacaagcctcagtcttcttctctgtaatgtggcaatacctgccctaggaaattcaacgagatgattactaggaataaggcagaggggaaaatctttcccttttacctttctgtgttctcagctggagccttgaaacaaagcacaggttaatagaaga

SEQ ID NO: 16084 - DNA, 201 bp, Bos taurus
ccttcaagttggtccttaacctctctaacttttagttcctcatctttgaggcagagacaagaacagaatttctgctatgcacagtgtggcttcagggccgtgtgatcattcatactaagcgcttggcagacagcccagcactggcagtgcacactcagggttctaggctgatagtagctatttggggggaatgagcatcct

SEQ ID NO: 16085 - DNA, 201 bp, Bos taurus
aattttttcttttcatctttcacacataaataaatccctatgaagaagttcagacacataattgttttgcaaaatttattttatcagtaacataattttctgagttaattgaccctgtctgcacttaataaaactattaaagtgaaaagaattatgaacacacatgtacagaactaatcagtaatatgaagcccataggag

SEQ ID NO: 16086 - DNA, 201 bp, Bos taurus
tgttttcatgtggatgacggagcttcataaatttgtcactgctgggccatgtgcagtctttgatcctttcagtggggccttgtttggagccgggagctgcctgggtgtgacacatgtgtctctgcagccatccctcctgcgtgttgaacttggccgttctcatcagaaggaaagatgggaccagcttttgagaaagggcca

SEQ ID NO: 16087 - DNA, 201 bp, Bos taurus
cccacaaagcgtttagcctggcacctgctaagagctcagtttgctaccaacaccacaatggcttctcttagcatcttctctttttttgcctgcaccccagtggtatatgggaacttagttccctgaccagggaccggacccatgccccctgcattggaaggtgatatcttaaccactggaccgccagggaggtcccttagc

SEQ ID NO: 16088 - DNA, 201 bp, Bos taurus
ggtgcttgttcctggggtcttggctcggcctccacagtttggagggagtaagcttccctctgtgacattataaagtggatccctggagcaaagtgtcccccggggcctctgctcaagcaaaacacaagctttccattttcatttaactattgcatcacgtttgactgacagtcctggctggtcctatggaaactgataagg

SEQ ID NO: 16089 - DNA, 201 bp, Bos taurus
catgttcagctgacatcagagacctgtcacctcttccgcacctttcggtggcctacactagacatctcttgggattgcctcttacagcccttggcctcacctgactcacactacaactgtggcgtgcagtgccatgaaggacaaaaggtctgtctctctcgctttctgcctttcagagacagcagcctgttgggccgcagg

SEQ ID NO: 16090 - DNA, 201 bp, Bos taurus
ggcttactctgctcctttccatctccagggatccctgcccttcatctcccacgactccgaaagaagccaatctcctatcagcccaagcccctgttagttaataattctttatatgacattttccaaccctggctccctgaaaaccttggacaatctactgtatcaaatttctttctttaaatggaaatgcagcaaaaaaca

SEQ ID NO: 16091 - DNA, 201 bp, Bos taurus
cctctgaactctttcagccacccttgccccaggtgtcactgcccttctcagatacctatgaatgatctgtctcagaggccctctctgtgaatggaggaaccggatcagttgcgacctccagaaccacagcacccagcctgagtccggctggcccttgggaaatgttgctgaacttgaaacgggttagaggggagtgatggg

SEQ ID NO: 16092 - DNA, 201 bp, Bos taurus
agagggagcagcccagtggtggcctggtcagcctccctattggtgatttagcattttctgtttaacacgtgaattgctttttggagtggcctggaaactaaggggtccacccttcaaaatattattaaaattttgtagtatttgtttctgccctttaatgagacattaggccattggaaagaccctgatgctgggaaaaat

SEQ ID NO: 16093 - DNA, 201 bp, Bos taurus
gcagccatgggggccatgaccaccccagcccccaacaaagtatggttgagggtaaccttgaccgccagggaagaatggaatgtgctgggcccttttagacgctcagcccttctgaagagacacacaagggagcaaagagcctattacttccagttggtgttgccacatcttcatgtcctgcctggaatgatggtggccctc

SEQ ID NO: 16094 - DNA, 201 bp, Bos taurus
tgagactttcaaaattcttgagacaaactttattcccatttaatcaagaggaaacagaagcttacagaggttaagccacttgctcaaggccacatggtcatgagtggcagagctgagattcaaagacaagatagtgtgatccatagctggaactttctgcatctcctccaggtaccctgtttagccggtgtcgggcaaatg

SEQ ID NO: 16095 - DNA, 201 bp, Bos taurus
tgcagccactgtcggtgggcacttgaagtatcaggcatgaccaatgtggcatccagaagtggacacatcccggcaaggaggccaactggccatgaagcacgaaggataaagaggatggagagggtgctttgagaatggtgatgtcaagagatgggtcgatggcaaagcagatgagtgcactcgtgaccctgacggccccca

SEQ ID NO: 16096 - DNA, 201 bp, Bos taurus
aattacttttggatgtgaacaaaaggtccattttgggcactctgttctgtgatgtctgtgtatatatatataaaacccttttaaaatctaagcctcccactcacatatgagtttccttgtctttagagattagaacactgcagccactatttgttttgagcaaacagagtgctgtgaagtcctgtaatagctcattggggg

SEQ ID NO: 16097 - DNA, 201 bp, Bos taurus
gctggtgcctcgcctgcctgctgggccataacagcaaaggcaccacattgtgtttgggcggcagccaggctttttgcatcatggcccatccatcatctcagtaacaaatgcctaccgggaagtaattaggaaactgcgtttttttcaccacatagatgaaaggtgcagagatgtgcaggaggccttggatacttggcagcc

SEQ ID NO: 16098 - DNA, 201 bp, Bos taurus
acacttctcattatcccaaccttcagaccttgttagtactaaaataaataaatgtgctatttaaaactctgaggtgggcctgccattttgcagtaagtgcgtgcatgcatgtatgcattttaagtcactttacttgtgtccagttctttgcgaccctatgaaccgtagcctgcctgcaggcctcctctgtccatggggatt

SEQ ID NO: 16099 - DNA, 201 bp, Bos taurus
tctcccctttgaagtccccagcattatccgcaacatcttttatctttagctgaagatggaatttaaagagatggttgcagccatcttagtgacttactcaattttcctgggtctcttccatgttattaaacttttttgtgattttctcctcttaactctggctcatgtcaatttcattcttagacctgccaggagaaccta

SEQ ID NO: 16100 - DNA, 201 bp, Bos taurus
acaaatccccacgtgaccctggatagacagatctggacccatcagacttcaagcccatccccatccttataggaggcccaagtcactcataacgtgagggttcttttgcaaaagtataagaaagtgctttccatcccagctggatctggcctctgctcagccaatcccctcccctcctggcctgactgccttcaagtaggt

SEQ ID NO: 16101 - DNA, 201 bp, Bos taurus
tgcctgcatccaggggatattcccgacccacggaagacccacgtctcctgcactgcaggtggagtcttttaccatctgaaccaccagagcagtgaggcccccaggcttaccaagtcctcagagcagcccttcgagtgggcactgctgttttcccattttacagagggacaagctgaggcccagggtcacccagctgtgaag

SEQ ID NO: 16102 - DNA, 201 bp, Bos taurus
ctagcagaagccacaggtgaggcctctccaaggctctggggagcttgatgggtgatcaatcaagcccaaatcttagcttcaccttcattaccagctgagtatcttggcccaacaattctgagcctatttgctcaggattagactggcagcagaaaaaaaaaagggggggggggaggtaaaaggagaacacacataaagcac

SEQ ID NO: 16103 - DNA, 201 bp, Bos taurus
cccctccagctcctgattcacacctgaccaccctcagcagctctccccgacatccagggacccacgatcatccatgacagaaacagatggtttcggactttgactgggccaggggaccagagctgcatacatggggggctgctgggagcacagaagggcatctctgagcagctgggggtgaggtgggttgagtgggagggg

SEQ ID NO: 16104 - DNA, 201 bp, Bos taurus
caaggctcccatacgccgcaggacaactgggcccgcctgccatgactactgagcccgcaccacagcgagagagagtccacgtgcggtaacaaaagatcccgatcgctgcaactaaggcccgatgcaacccaccaagtaaataaattgcaaaacaccctgaggggtgatgggcaaaatgaccagagaagaacattcaagcat

SEQ ID NO: 16105 - DNA, 201 bp, Bos taurus
ccaagaccacgacatctctgattcttcacaggcgtctccaagctacagaatttcagaagaacctaagtgtactggagccaaggccacaggggaatttgagcacaatgtccctccatgcctggttagaccttatcctctccattagctcggcttcctcattcttaagacaactgtacctgggacttctctggagtccagtgg

SEQ ID NO: 16106 - DNA, 201 bp, Bos taurus
tgtgaggctgataattcatagttaatgcagagagattagggatgcagggatcctgcacagggatgcagtttctggcagttgcaagttggccagagctcactgaatggtctcaagacacaggcagagccccgacagtcaatggacagatgtgatgtgactgggtcagcaaaagaagcaaggcatctataaacgatgatttga

SEQ ID NO: 16107 - DNA, 201 bp, Bos taurus
agaggtatgtatgtgatggaaaaacgtccaggcttaatcaaaaagggagaagtgtgactcacctaaactacgagactcagcaagctagacctggcctttcggatgactgtaaggagatccaaccagtccatcctaaaggaaatcagtcctgggtattcactggaaggacggatgttgaagctgaaactccaatattttggc

SEQ ID NO: 16108 - DNA, 201 bp, Bos taurus
actcaacttgagtccgaaaaaacaagctgagattaggggggcaataaattctcaatgcaactctctcttcctacggcccagacccctgaaataacctgataagaacacaagtcctaaggctgggagagcttgggttgtagcagcaagcaggatggctattgtctagtgagcgagggcagggcacgggtgagatgcggccaa

SEQ ID NO: 16109 - DNA, 201 bp, Bos taurus
aagcaacttagcagcagcagcagcagcagtaggtaattgccaaggcatttcccacaatgttgtaccaactgtcactcccacgtataaaaggcccagttgcttcagatccacagtgacacaactgtcactgcttctacctttctgatatcaccctgttttggaaaccacttctgaactgacctgtgttcccctgcagaatta

SEQ ID NO: 16110 - DNA, 201 bp, Bos taurus
gaccttgtttccaaatccagtccgttcagaggttaaggctcgagcacaacttcggagagacacaatctaacccagcacggtgtccccagcaggccgccatcgccgtgagttctcattacactgccctgtaatcagctgggcgtgggtctgtcccctcaagttgatggaggccttcagagggcacctcatcatcaccttccc

SEQ ID NO: 16111 - DNA, 201 bp, Bos taurus
tcaagagtcttctccaacaccacacttcaaaagcgtcaattctttggtgctcagccctctttatggtccaactctcagcatggcccaactgatgcttgaacctatgctattccaaatacactaggatgtccccctgcattttcctgtttgtaacgcttaccttcaacacctgtgcttgggtgaggccatataaatgagaat

SEQ ID NO: 16112 - DNA, 201 bp, Bos taurus
gccttcattggtgatggtctgactaggtcccctttttttccagtagctgagaggagcctttttctagccagtggcaggtttgctatgttaggctgagcaattctttgttcattagtggcctagaatccccaagctgacaaagcagtgtgttttaaaaactgaggttgcgttttgagaaacacagactaacagtgacccccc

SEQ ID NO: 16113 - DNA, 201 bp, Bos taurus
aagataataatgattgaattttcttacgttttctcaattttctttcattcctctggcttctgttcttgcttgttctggcctcctttattaatatctggtcggtttttctcctgaggactgaagtcactttcggaccctctgttccccctggatgcacagaccttgaaggctctgggcctcactgcatgaggagcccatgcg

SEQ ID NO: 16114 - DNA, 201 bp, Bos taurus
ctcatcctgtgactggtgtccttatgagacgtgaaaacaggcccagacaccagctcgcagggcgagtatgtggcagtgaagacagcggttggagtggagcatctcccagggaggccagggtcaccacacattaagacacaggtgtgcagtagagtctcccaggctggcttcttagggagctgaccctctgacaccctatcc

SEQ ID NO: 16115 - DNA, 201 bp, Bos taurus
tgttttaaagctgaggccgtgccttgggtgtgtctgggctctctccccagtgacatttaagtgaggctggaaccaggacttactctctccagcgctggccgggggctgaggaggcaaagaagaggatgatgcgtcagggtcggcaacagctcgggagtctgttggcgctttaagggtcaaaggccagcaggtacttagaca

SEQ ID NO: 16116 - DNA, 201 bp, Bos taurus
taccccattgtggccagatgcagaaaacaacatatatgaccttaaatggtgccaaagaatggcacggctttggctaagctgaggtcatgtctcctggtgacaaatgtgtcagtggccgccacgtgaggcccaccagaaccgaacatcggagcaggcggaggagtcaggaagtggttcccgggcaccactgaggaactccat

SEQ ID NO: 16117 - DNA, 201 bp, Bos taurus
gacccccacccagaaagaggcacggctggccttctgctttagggtgaccacagcctacgagtagccagcatctgggagtccagccagatgagaactccactggctgctccagattgtggcccgaatcccccccgggtagggttgggagggcggccgggtgactgtgactactcagccctgagacgctcttcccgccccgca

SEQ ID NO: 16118 - DNA, 201 bp, Bos taurus
tgccatgtgtggcggggttctggtctgcttccgaccctagactccagccaaggcaacgcgaggtatgtgcttctgtggctccctgacctaggactgtagcatcagtctggccggagtttctctcaccccgtggtcatactgaggtggtataagccggtggaagcatactgacgaagcatgtggtcatacaaagggtcctaa

SEQ ID NO: 16119 - DNA, 201 bp, Bos taurus
tgtcttgagaattgccaccatttcttacgaaggtggatgctgacagcttcacaaaggccgctgtgagggaaggagcgtctgagaatgccagccaggagcatggaggctcccaacaaattgtcaagtcccgacaatcgttcagacagcacgaggcaggggagagagccagcaatctggggcaggaggcctctgctctctccc

SEQ ID NO: 16120 - DNA, 201 bp, Bos taurus
agagtgtgagaggtgaaggccaaacatatgaaaagggagggtgtggttcagttaaacaagtcaatgtacttaagccagaaagtgcaaggctcagattcttcccaggcctgtgagcttcacagacctcattcacttcttttatcaaaacatgaaggcttgagaattatgagaattcaagttgaatatgatcgatgtaagcta

SEQ ID NO: 16121 - DNA, 201 bp, Bos taurus
gtccaagcagacaaggagtcaggaggccaggaaagaagccgctggcaccagcctccatgactggtcagcaaaggtggcagaatgcagccagtgggcaaagcggaggccaagggaccgttctgtgcacacacctaggaccccagcctgttccagggatgagggggagggcacactcagagggacctggctatttgccgtcaa

SEQ ID NO: 16122 - DNA, 201 bp, Bos taurus
atttcggtcagaccagaggctggagctcttcactcctgcctcaaatacactaagagtcctcaagactcttctcatggcctctgggcagctgcaccccagcgaggaagccatcgaggcatcagctcaagggctggaaacgccgtgggatgcccagcttggagctggccttgccgcctgccctccccaacccctgacctggtc

SEQ ID NO: 16123 - DNA, 201 bp, Bos taurus
caccccgccctgggaggtaggggtcctgcgagcctgtggacgcgcccctctctgatgtgacacaagcggtccctgtgggcacagacgaatgagggccgcacgctgggaggcgagctctgctggctgcaaagtcagtgctcatggttcacagaccctggagtgccggagccagcgtggttccctgccctgctccctgaccgg

SEQ ID NO: 16124 - DNA, 201 bp, Bos taurus
tctagcagggtttcatctgtttgttctgttttccttcgctttttactggtggtatcagggcctcagtaacctggtcccggggaagggccattctcctgtcattagctgaaactttttagaaggaaatttggcaatgcacatcaagtttggggcttcccaggtggtggggtggtaaagaacccgcctgccaatgcaggagat

SEQ ID NO: 16125 - DNA, 201 bp, Bos taurus
catctacatttttaagaagaatcttctttacttaagtcaatcactcttctacaacacaccttcacagcaacacctagcctatcatttgacccaataactgggcaccataacctggccgggtggacacacaaagtttaaccatcagccccaacaaggctccaggtttccagatcctggctttattcctcccgttgcctccgg

SEQ ID NO: 16126 - DNA, 201 bp, Bos taurus
ccctgagctctgtcttcaaggtcagcaacagtggatggagtccttctcaagctgtgccactctgaccatctcttctgcctccctcttccacttttactttaaaagtggttatctgggcccacctggataatccaagatgctctccctattttaagatcagctgattagcaaccttaattccatctgcaacattaattcccc

SEQ ID NO: 16127 - DNA, 201 bp, Bos taurus
ctagacttccggcctccagactgttagagaataaattcttgctctgttaagccacccagttcatgataatctgttgtagcaggcacaggaggctcttacggaggccacgatataaacagttttacaaaaaggtagaactcagtgccctgcaggctgttgccaagaatggagagaatgctccaggtctgcccactttgagtt

SEQ ID NO: 16128 - DNA, 201 bp, Bos taurus
tgagccggggagccaggccagagtgctcgcagcctcctcgcaggcaggcgggtgaaagatggccccattcctcacggggagacgtgctgggcgagggcccggtgccctttgctgagcgcccgtttctcacacggggagcctcatttttcaatcacgcccgcgctcaggcttcatctggccacccccccacgtcactccctc

SEQ ID NO: 16129 - DNA, 201 bp, Bos taurus
gccagggcatgttcattcttctaagcagcctcagcgctaagctcaccattagggtggtttttttaattcagatccaaattagcaagtgttattaaagactttcagttatttggctaagaaatggctccctttaggatgaatgctctttattcaacctttcaatgtcagttatcatttttaaagcagcttgacctggaagca

SEQ ID NO: 16130 - DNA, 201 bp, Bos taurus
tcttccaatgaatattcagggtggatctcctatcatctagagagtccattaatctaggagcccagtatacttgagaactagcccatggactccctagtgtgctgtgtcatgctaagtctcttcagtcttgtccaactttttgcaacactatggactgtagcccaccaggctcctctgtccatgggattctccaagtaagaa

SEQ ID NO: 16131 - DNA, 201 bp, Bos taurus
aaggaggggtcgtcctgcagaattaagactttcggccgtgtttccaaatcctgctccagtggctgtggatgcaaagttctcatcttggctctgactctctgggctcctcgcaggaggtctgggcctcggtcctccttgtagcctgcttcctctgatcattggtgcatctggccttctggctcctggtacattcgttattaa

SEQ ID NO: 16132 - DNA, 201 bp, Bos taurus
tgctgtaatgaaaacgttgaataaatttaggattaagttagagtcacttgtttgttcactcacagcacatgagtgcctgctgtgtgacaggcctcgtgccgggggacacacattgggcacagtgcagtaatgaacgagacggctccacctacacggagccctcgcccagcacaggacaggcctggtgggcggtcagctgtg

SEQ ID NO: 16133 - DNA, 201 bp, Bos taurus
gggaatggaagacccacgaaggaaaggccgtttagttttgtgtcttcaaacctgaaacatttctaggtttgaccggagtcctgtcaaactgagcacaatcaggtgtgaggcccgctccttgggctttaacaaactgttatctgcaatctgctgcacaatctgaaaaggcaagaaatgcggctttccctgtttagaaaatct

SEQ ID NO: 16134 - DNA, 201 bp, Bos taurus
cacccctctgagtgccgaggaggctgtgagagacaggaggaagcacgtccttttctgtctcaccctgtttttaatgaagccagaaaagcggagcagccaatgacagtaaattcaggagctcacttgcctggttagtgtaaccaaacaggctccacaggtggtgggacacacggaacgcctgcgtctggaacatcactctgg

SEQ ID NO: 16135 - DNA, 201 bp, Bos taurus
gccgtggcttggcccccagcactgtacaggagggtgtattctttaaggggtgtgtgttctcagcataccctgaattccttgcacaggtaggaagggccagttctgctcacggcgcttgctggatactccagacatcgggtctgtgaggagagagctaaaggcagaagtggccctcgagagagccaaggtcagtgggacgga

SEQ ID NO: 16136 - DNA, 201 bp, Bos taurus
acccggggcctcctgccccctagggagccgtctggccagggtgtgcccactggtccccatctgtcccttctgcaggggctgcactgggcttccctgggcacgcgcaccctggactttgtggccccttcctcggcagaaacatattaaaattatattttaccactatggcaacccattccactgtgcttgcctgggaaattc

SEQ ID NO: 16137 - DNA, 201 bp, Bos taurus
tccttggccagtaagaggaggctgaattcaggcagcgcctcctatcagcgaggtctgtgtgtgcatctgatagtctgtgtatgtaggagcccctgatatccggcctagttaatgtgagacactggccctcgcagagttcttgctgaatggggccatcacggcacccaggccatcccaggctgcggctgcagtcagcaggac

SEQ ID NO: 16138 - DNA, 201 bp, Bos taurus
ctcttcattttccatgagaaaagcgaagccgggcaaaacctaacttcttcggaggagggcttcttttctgtgaaatacccactcagcgtgcagacttggtggtggagactgtttgtggaagttcctagcactaataaaatttaatttaaaacagtgagcccgctgccttcctgtgacatgtatatgggacttacataatta

SEQ ID NO: 16139 - DNA, 201 bp, Bos taurus
aaacaaagtggataagcaacgtgtggacggagtgccaagtcacaggttctccagagtggggctgacttgggggacgacatcgggacaagaggggatgaggctagagaagcagccaggccatgaggctgctgtggaggcaaaccaagcaagtgacagaagcttttttaaaaactgggagatacaccaaacctacccatgcac

SEQ ID NO: 16140 - DNA, 201 bp, Bos taurus
agtttctaagggcaatgcaaaggtgaaggaacgtttttaatcttaatatttgttttttctaccaggactatgtaactgatacttgtgaaacttttaatttttaaaagtgaaagtaggagacatttttaaagtaccacttgatgatcacatgttaatatctctcactgctgttctctgttttaattgttgtactgttgttac

SEQ ID NO: 16141 - DNA, 201 bp, Bos taurus
ttcaccactcccgaactccactctacgccagggtgcagccgccctggtcctgtgtcttccccgcctgtctcacccaggctgtgcctggccagcggcctgggttcaggggcacaggactccccaagtctcctgctgtatgtgggactggagcagccagctttgcaaccaggacgtgctctccagagatctgggtctctgaca

SEQ ID NO: 16142 - DNA, 201 bp, Bos taurus
tgtctggattctctcccttagagttattctgggagcaggaagctcattgttactgaattgtgttaagtacatgaaacaaccgctgatggacgtctgggccgtcctaggtctggggtatcagctgggacacacgctgcttgaactgtgtgagcaacgtgcacgcattctggccgggtcagcgatgacgctgagtccgtgcac

SEQ ID NO: 16143 - DNA, 201 bp, Bos taurus
tcctgcccagcccttctgtgagatgacccaggcatgccccttggccacttacctgggtggcccaactctctggaagttcagctctccgagggccctcgctgggggacatcagacaccatgaccgagccccgagcacacagccagagcccagcctgctgacctgcagaagcccctttccctgtgaccactcagccaccacgg

SEQ ID NO: 16144 - DNA, 201 bp, Bos taurus
agcaggaacaaaggccaggcagggcccacagcctgcggacacatggctgttctgagccgggatgtgtgtgccacagctgatgagatggagagactcagagcagagcagagagggcccaccccccgaggcaaagactgggcctcagttcagttcactcgctcagtcacgtctgactctttgcaacctcatggactgcagcac

SEQ ID NO: 16145 - DNA, 201 bp, Bos taurus
aaatttaaggggaaattaaagggagaaaagcactgattttctgtttcccacagcgagctcctggtgttttcacacttggtaaaggccttgtcattttgagatgttagtcagaatcttgctcaaaaccttcctaccctcagacaggctgcctgcaaacacgacagttccagtgccccgggatgagggccactgggttggggg

SEQ ID NO: 16146 - DNA, 201 bp, Bos taurus
atttccttttatacaagataacagatttcagatttactatcggactgaatcaactttgagaagctcaggggtttgcagggagagaggctgcgttgggcagtcttcctggaacccggccccgtggcttctctcgtgacggccgtggtgactggtgacggatttcatcagcttgtctcatcgtgtaattctatcattaaaacc

SEQ ID NO: 16147 - DNA, 201 bp, Bos taurus
ggtgggtgggtgggatggcctttgctttgggaaggagtggaggccaagaccccaggatgctgctgtgcatggacgacagtgcggggctggcgggacgccccgctctgtcagggctatggccatttcgatgcctttggtcatctgtgggcacgtgccttagaagtgacaacacgctggttctgcctagaggtctgtgtttaa

SEQ ID NO: 16148 - DNA, 201 bp, Bos taurus
atatttgagacacacagctttcctttttttggccacatgggaaggcccgcagcactgagtccagcctgaccactggccaccggggcccgccggcacacgcttttctccaccccgtgtgatgctggcaactggagagactgcccttccactcaggtcttcaggtgagaagacgaaaagttcttgcttttaattccgtcaaac

SEQ ID NO: 16149 - DNA, 201 bp, Bos taurus
gtgggggagtcctcatccccagctctgcctgcagggctcccaggcagcttgcctggggactcagatctccctaatgagaggatcggcctttgcaggcagacggcagctgagagagaatttacaatgacacttggtaattgaacccccaggggttgattccactcctgttagaagcccggggagcctcctctgttggtaaca

SEQ ID NO: 16150 - DNA, 201 bp, Bos taurus
gaagccgaggagcgtgaagggagatccgggcctccatgtccacgtgcggtcagcaccctgagcacaggggctctgcccagcatgatgctggtgtgtttgcgtttggccaacctggggctgaattcctgcatgtgggagcagggagcccgcctggacagctgtgcaggcagctggcccggcagggaggggtccagagagagt

SEQ ID NO: 16151 - DNA, 201 bp, Bos taurus
gggctctgcgggtgctgggggcggggcctcgcccccacgtggtcctgagggggtggggcgggctctgcgggtgctgggggcggggcctcgctcccacgcggtccgcctgcgtctccccagatttatgagatcttcagtgtcatccgggacctgggggccgtggcccaagtgcacgcggagaatggggacatcgtggacgag

SEQ ID NO: 16152 - DNA, 201 bp, Bos taurus
gaggcccaggtgataacggggaggtggggctgaggaatctgatcagatatccagcgtgggggatttgtgctaaagctgaaccaaaggtgcaaagacagactcgaggtcgggccttgaggatggagggcagcctggctcgagctggggggaccccgatcgccagcatagccagaatccagagtctgtgcttgtttctgacct

SEQ ID NO: 16153 - DNA, 201 bp, Bos taurus
gaaacagatagccaaagggaatttgcttatgtcttaggaaactcaaatagggctctgtatcaacctagaggtgggatgggaagggagataaagaaaagcgccagctctggttacttgtaagcaagagacactattttaagtgctttatatgtattgtccctttccttcttgcatcaatcttgtgacttaagtaatcgtatt

SEQ ID NO: 16154 - DNA, 201 bp, Bos taurus
cggactcaggcctcatggaagtggcctcagtctgatgtgagcagagaaacaggcgacccaagacacaccacagcggggccctgagggtgctcggcaccccgtgccctctgtggtcaggttcaatggtcaccaagtagacatcccccggcagctgcgttcctggcctggcttattgggagagctgctttttcttctttcccc

SEQ ID NO: 16155 - DNA, 201 bp, Bos taurus
gggggtgagctggcaggtgttgaacagccgccgccccccggggaggatcacaggaggacgggtagggaggcaccgtagacggactaaaggggtttgtgtcgtaagaggccatctggattttctctaaacaatcaatcacttggtgccggatggccagtaccatcaaggttagcttctaaagggcaagaaaagtggataaaa

SEQ ID NO: 16156 - DNA, 201 bp, Bos taurus
gaggtttggagtacaggcccctgcggagcccctacgagtaacccgattaccgaggctgctgctccaggggattgggggactggagtccggccccctcccctgctccagccccgtctgccccacagctgctgcgccttacagcccagcgtgtctgcccttcagatgagctgtgactctgcggtgactcacacacggctgtgg

SEQ ID NO: 16157 - DNA, 201 bp, Bos taurus
ctggtccagcctcctcccggtgagaccagagtagctgggtctctccatgtgagtcctggtgaccctgtagcttccagaggctataccagggcctgaccaaccttggctacatttttttcttggaatgacgtatcctgaatttctagcaagttccaggggaccttggcccatgctctgttgcaggttgagggttgcccaggt

SEQ ID NO: 16158 - DNA, 201 bp, Bos taurus
gtggccccagctcgcagctgtcctgcgggctgactggggtgtgcgccgcgtgctcagcatggggggacggataacctgggcagacagcgtgctgactgacacgcacggagggccccctgggctgcggggaagctggactagggggccggtagaagatggtcaggcagacgtgcagccctgagcctccgagtgccttcggcc

SEQ ID NO: 16159 - DNA, 201 bp, Bos taurus
gttggagtttcaatatcaagctctcaaaaataatagaatgaatagacagaaaagtagaagaatatagtagatctgggaagcactaaagctgcactgactctggtataacagtagaaggacactgggcttcagaaagcaaatgctacttcagtgatttgagaaagttagaacagcttccaagaagtgcctaaccttccttcc

SEQ ID NO: 16160 - DNA, 201 bp, Bos taurus
ctcatcctgtcacccacttctcctgccctcaatctttgccaggttcaaggtcttttccaatgggttggttcttcacatcaggtgggcaaattattggagcttgcttcagtatcagcctttaaatgaatattcagggctgatttcctttaggattgactggcttgatctccttactgtccaagggactctccacagtattct

SEQ ID NO: 16161 - DNA, 201 bp, Bos taurus
gcagtggcctttgttcagaaggagagagatgcttattacacttgcgtgtgcaaatgttgggtgggcaggtggacgcaccagtgtggaaatggagagagaggtctagggccattaatcagagatgcttcattctgctccagcagtggatcacactgaaactgctttccagtgtgactattattgggatgctttgcctttcct

SEQ ID NO: 16162 - DNA, 201 bp, Bos taurus
ttaatatcaggaggactgctttaatcagggaggtgaaaagggcatgacaatttaaaccacacacacacacaaaaaaagcaaaagaccataggttttacactgactggcctgtatttggagctgcaagtgcatacaagcatgacaccaaatcagagtaggtaaggacctcggataacctgtgtcagataccccacttctgtg

SEQ ID NO: 16163 - DNA, 201 bp, Bos taurus
aggtttatggctctaagggagatgaaagggaaaactttgtaacaggaaaaagtgaatgtttggatttctagtggtgaactggtaagggactctttgggaagaaaccttgctcggtagcatttgctggtttcctgtgtcaccctggggggatggcaagcggggtgagaggaacacaggtcttgggagatgcacacaactggc

SEQ ID NO: 16164 - DNA, 201 bp, Bos taurus
ttttcacaagccaagtgtcttcttactgcagagaaaactagttcctatctgaacggggtattttttagatccatcttgcattgggggccggctgtgttagtgtgtgccaatgctgcccacctctcctgctgacggaggttaatagcccagtttattaaacaagctgcacgcctgggattggggcatgggcaggaagcaggc

SEQ ID NO: 16165 - DNA, 201 bp, Bos taurus
cactgggttggaggcaggggaagccggggggaccaaggcatcgggagggctgtggaaatgttaggcctgcgagcgtggctggtgggggcaggccacagagcccccaccacccacacgaggaatatgtgacgctaaggactgtgcatcttatcctgtaagccaagggccacgggtgccagcaattctcaagagagaagtaac

SEQ ID NO: 16166 - DNA, 201 bp, Bos taurus
tgcagccaggccctgccctcactgaaccccacagggaggcctcaccacacatgcctttacaactcatttaatccatttccagccccacaggcttggcagtggttgctgctggccaagaccgtgtgtctggtctaccacaggccttttgcagatcagagttccagcttcctacttctcctgactgtcattaatcttgggaag

SEQ ID NO: 16167 - DNA, 201 bp, Bos taurus
gtatttgggccacatttttatgccttttagtgagagttcattctttgtcccagtttaggagaggctgaagtcaaagttgaagatgttcgtagcaagatcacgtcatgcagtcctcaggcccacacgtttatccaggtctgcacactgcagggaacagttaagagccggaaagctgtgtcatgaaggacagctggaggggcg

SEQ ID NO: 16168 - DNA, 201 bp, Bos taurus
tccatgacacgctggacttctcactgtcttctcagagaacatgggacagcacccgttctcacccctgtggagattccatgctggaacatgaggccagctctgacggagagcatgtggatctgagcggagccctggcggggctctctcatgcacatcccatgagccacatggaatgttcttggccttccttatgctccggcc

SEQ ID NO: 16169 - DNA, 201 bp, Bos taurus
aagtgactgaggccctccgtgtcaggaaaggcaaacctacatccaaaacacgctgcttctctgttgagatcaagctctacctttcccagggaggaaggagtccagtgtggccaactttcccccaagagatggctggctctgcaataaacagtgtcaagtgaaggctcggtgttggcctctattttaggcagtttgggtttt

SEQ ID NO: 16170 - DNA, 201 bp, Bos taurus
caagcaatggggccagaataactgccaatactaaaatatcttacatgccaggcaaattcttagcatttttaaaatcacaacatagaaaatacttctaaaactcaatacaaaaaaattaacatggatggaaaaaaattggcaaaacaaatgaacaagcatttctcagaaagagaatcatgtccattgaacatgacagaagga

SEQ ID NO: 16171 - DNA, 201 bp, Bos taurus
taatcctctaccatttcatgtttgtcatggaatgtaagaacgaaataaaaccttgttgttagaagcactggaattgtttactaggcctaataaaccagtccgtaatgacttacacaaccaactttgaagtgacattgtgagataaagtaactcggttatgctggtgagaaccaacgtgaggactcaaccccggctccctga

SEQ ID NO: 16172 - DNA, 201 bp, Bos taurus
caaaaaatgaatgcttgacagatgtacaaaagcatgggcatttccccccaaaacatctcctgtaccttgaaactgcctggacaggaaactatatttctaacgggataggctttgcaaagcaagtggagttttccagttctcacagtgcgacagagacaaaaactggagttcaagagacagcctgcaaacagaagaggcttt

SEQ ID NO: 16173 - DNA, 201 bp, Bos taurus
tgtggtaatttgcttatcgcccatgaatggcacttaaacaaaagcaacaatgcacatttcattgaaaagcatttggtttaggcaggttggcaggtgcttcagaaagccctcaggcttcattcccaaaacataaatctcaatcctgcagtgaggagcttcaggcaaaggcagggggagaagagctgtttccttaacgtgtgt

SEQ ID NO: 16174 - DNA, 201 bp, Bos taurus
tatccacttaattctcaaatgcccgaacataattaccgttgggcagtctccctaggggctgaggaacctaccaggtcctagagaagtggccttccaaggcaggcattgcagtctgtgcatctgatgactcttctcttggagaacaatcctccactccacaaggtcctgggatggaggtgggagtggggaagttgtatcagg

SEQ ID NO: 16175 - DNA, 201 bp, Bos taurus
tccgtcagctccagaagtctccctctctgccctcctcgggttccggcagactggacatcagggaggcagggtcctgcagcacaggccttctgggtggttggtaaacaaacctgctcgcagccaccagaataaccatgtggacccacgccacggaggatcattcgggcacttcctacctataactcatttgttctggcctat

SEQ ID NO: 16176 - DNA, 201 bp, Bos taurus
tgtcagacagcccccttcaatgcgtggaggccacctgcccatgggaaatggatgttatgtctatactgtatgtaatgcaaactacccatacagtgagcgcatgtttttttgtaatacataacgggtaagcacacattgtactctgcatcacacagtaaacacgatactaggcttgccttttcctgccttaaatctgttgta

SEQ ID NO: 16177 - DNA, 201 bp, Bos taurus
ccctcgtgtccccatgtcgtcttcttctgaggacaccagtaactggatcagggcccattctcatgacctcattttaatttagtgatctcttcaaaggccctttttcaaaacacagtcccattcagaggtcctggaggttcgggcttcgacctgtgggctttgtggaggttcaacccctgacactggattacccatttcagc

SEQ ID NO: 16178 - DNA, 201 bp, Bos taurus
aacgtaaattgtccttaatatacacagagcttctataaagcaataaggaaagtataatcaaaggatttaaatggataataccatgaaaagaaaaatcaagtggctctttcacttatggaaatagactcaacctccatcattcagttcatttcagtcactcagtcatgtccaactttttgcgaccccatgaactgcagcacg

SEQ ID NO: 16179 - DNA, 201 bp, Bos taurus
tgttctgctcttgtttttacccagagggacggaagcgggttatgagccaggccgggcagagcgggaggcaggttccccgggcccctgggttgcgccccgcccctctctggggctccacaggcacagagcagcgcgactcggttccttcggagactcggccttgtggcctgtctagagccctggaagatttcctgtgtggcc

SEQ ID NO: 16180 - DNA, 201 bp, Bos taurus
aaaactctatgctttcaatgcaggagacgcaggtctgatccctggtccaggaactaagatctcacatgcagtgcaacatggccagaagaattttaaaaagtagcatttactggtgagcactcacgcagcatgaaggcaggtgctagggacaaccctagtggcctggagacagtgctcaggatgggaaggtgggggaaagac

SEQ ID NO: 16181 - DNA, 201 bp, Bos taurus
aaccccttgcaacccttagactgtagcctgccaggctcctgtgtccctgggacttttcaggcaagaatactggggtgggttgctgtcttcttttccattacactattttaaaatggagcaaaccgtatgaggtgctgtatttacagccagggatacacctaccaaactgacgaaggtccaggcagagattcgctccctcca

SEQ ID NO: 16182 - DNA, 201 bp, Bos taurus
ggctagtactcagagactcaattttaaatttacgatcttgctaggctctccctactgataactgagaaaaacacggggcccaaccgcacgcatttccccgctctgcgactacagcgcagccccgtaaagccggtctgcagcgtcagtgcagagtgcttcggccgtatatttaacgtcggaggagaaactttatgggaagtg

SEQ ID NO: 16183 - DNA, 201 bp, Bos taurus
caccaactagagctaatggccagctgccagcacaagaatgaaaagtcccctgttggtagaacctgtggcttggaatgattgcagtggagttgataggcaaaaggacagtccctcttggggccactcctggtaacagttgccttcacagcaggagcgaatgcccagagatctttggagagctgtttagatcagcaacggcca

SEQ ID NO: 16184 - DNA, 201 bp, Bos taurus
ctatgctttcaacaaccttgattgagacttctgttgttcatcttttagaagaggtacttaggatttctatagatctctataaatttattttcttttgagggaagaaaaagtaaaaaaaaaaaaattccaatatgctagaaatggatgagaactcccaatatagttatttctgagttttggtatttttttctccaacaactg

SEQ ID NO: 16185 - DNA, 201 bp, Bos taurus
attttgactttacaaaatggagagtggagagtggaatactgtatgaagaataaagggaaagggtaaagcatcaggccataatccaaatgaggggtgatggtggttttgactacacggctaatgtggtagggaaacaacttgtccgagtgagtatatattttctaggagaagtgtagtggaacagcaaggcccttggtctga

SEQ ID NO: 16186 - DNA, 201 bp, Bos taurus
ccagtaaattagcatgttgaatgtctcatccaaatacaaatcaaattcaagcaagatgtccttacaaggagaaagcaacaaagcacggatccttaactaactttgtaggacaagagattgaatgaggtcccagtttttagacacagtgtaattcacctttcaaataacttttttgttgttgttatttcctggtagaattta

SEQ ID NO: 16187 - DNA, 201 bp, Bos taurus
accgccagccctttgaggatgctcaggggccggccctggtccccgggtttccctgagcatctaggaccgtgtgtcccaccaccttccggccctgtagctttagagggatagggagtctctctgcggttaaactggcagaataacaatcttgtcacctctaactgctcgtgtgttaaatgtgtcctgttggttacaagggtc

SEQ ID NO: 16188 - DNA, 201 bp, Bos taurus
taagaaataatctgtagtggaggattttttggtcattatttctattttaattttgtccttccaattcttgtttaggggaaacttttaaattccctgctgtatagagtttcttttctttacttttcctacttaaaaaaatcatctttatatcatgatcaaagaaaatggtacttataacacaatacttgtaattttgatctt

SEQ ID NO: 16189 - DNA, 201 bp, Bos taurus
agaatatatgtgtcatatagagtattatttccctaaaatgccataaacatatacttccctgaaatatttttcttccaaattttttccatggtgactttttaaaataaaaataaagatcatgtataaaatcaagtggttcagttagacatacaccaaacatacacctttgtggtatttataattatgtgaatacaactgttt

SEQ ID NO: 16190 - DNA, 201 bp, Bos taurus
ataaacatcatgatggtggttgcctaagggttaaaagagtgtaggtaattgggaaaggttgttcaagtgactctggcatgttgacaatgtattatttcttgactataatgatggtttcaaggatgtttgttttttaatttattacactgttcatttacagtaagcgtatgacactgtatatatcatatttcacaattaaaa

SEQ ID NO: 16191 - DNA, 201 bp, Bos taurus
aatcctatggacagaggagcctggtgggcttcagtccatggggtcacaaagagttggataggaccgaatcaactgagagcaggcaattgacactttaaacgaaaagcaatctgcttggaggtggttaacctgtccattatatgtggccacacatgcactctcaatttagtgttagtttttacacaacaaattcatgtaata

SEQ ID NO: 16192 - DNA, 201 bp, Bos taurus
tacagtccactgggttgcaaagagtcagacatgactgaagtgacttagcacacacacacacacacacacacacattaggccactttcacgttttgtctggttttacacaagactacagaatgactttgtttgcctcgattcttcagtcacaaagtggccttgtctgaggtttgggtcctgtgaaataatttatgttgaata

SEQ ID NO: 16193 - DNA, 201 bp, Bos taurus
ataactttaaactattttgtaacaaccattgtgatagacattaatttccattagccgaccttcaaaacttgccatttttaccatgacaacctgctcaatccgtcattcttctttagtatttatacatatcctcatcattaatcattcttctttaatgaccaaattacatatactataagaacattttacaatttctatgtg

SEQ ID NO: 16194 - DNA, 201 bp, Bos taurus
gtacgactccctcttttggatgtcagatttacacagaggaaacaatgtaatctcaaacagaatattaaaagagcattagttttggtgatgttttactcaatagacatgatgtttattataaacatagttctaaatcctttggaaaattgactcatcaaaattaggaaagggccttagcacagatatatagaaaaaattccc

SEQ ID NO: 16195 - DNA, 201 bp, Bos taurus
ggtccacatcctcaataaccttgtcatctctagcctttttgttggtaaccattccaacagatataaggtgacatctcttatggttttgatttgcatttccatgataaagaatgatgttgaacgtattttcatggactagcttatttgtatttctttttttttttttaagtctcagatctttatgcacattctttcattgca

SEQ ID NO: 16196 - DNA, 201 bp, Bos taurus
atcctggtgaaggccaccctgaactaactagcccccacgtgacagcagaagagaaatcaagcccagcagagactgactgacctaggcctatagatgcctgtgaaataatgtttttagactactaaattttagagttgaccctttgttcagcaatgccaaacagatacacctgtgtagctttccaatttcatttcttaccaa

SEQ ID NO: 16197 - DNA, 201 bp, Bos taurus
aaataagggcttttaaaatatgtttcccttttcaactggtaccaaaggtttctcagtggagactgctagagaaaccctgtgggaagaacatgttatgctaacttggtagatgccttcaatgtgtgtggcttccccaggtacagctcctgcactgggaataacttatcccacattaggctcttgaaggatgacatttcccca

SEQ ID NO: 16198 - DNA, 201 bp, Bos taurus
gactaaaacattgccactcactctcagggcagagttactgaggctaggaacctttgtcttttgcaagtgctgcatcagtgttcatgaagaaatgcaataatatgcagagttttcaggtgtgatcacagactgtcagtatctctctctgatgatacagagaaacagtactgatttaataaatctgtaaccagtattgggtac

SEQ ID NO: 16199 - DNA, 201 bp, Bos taurus
atataacccccacagcaatcaatcagtcaaactggtgaacctcctagtgccctttcacagggagtccttcactctggccacacagatgtgtattctgtccatgttatctggatatcttcaaaattacatggttgaaaggaaagtgaaaatgttagtcactcgagtcatggccaactctttgcaaccccatggactgtagcc

SEQ ID NO: 16200 - DNA, 201 bp, Bos taurus
tgcattttggtattttctattatctgttgaagtgtttcttttcaaagaatatctatttttatatactgtccccaaatgtgatcttttcagaaggcgtgttgtcatcaaatgcattttcacaaagcataacacattacgggatttgaatggggagggaaaatacatttataaaagcaatacatagttgctgggaatacaaat

SEQ ID NO: 16201 - DNA, 201 bp, Bos taurus
gaatgaaatggttcagaagtgacaatgtgctgtttcagccattgcttgctagggctccctgaacggccatgtgttttattggaggggccacttggagtcgcgtgtgtggacttaccacttggagagggatgagagagcaagagttaggtcctggatgctaatggacttaccacctacaggtggctgtgtgaatgaagccct

SEQ ID NO: 16202 - DNA, 201 bp, Bos taurus
ccttgggatttctaatcaggaaatgaggatgataattattacttgggcaaagaaatgagctaatgtgctaagaacacagtaatccacggtcagcactgtacgtgttgcctgtcattttctttatcctctactagtggagaaaagctgtctttagtttaactttcaggttgaacttaacaatgtatttcgacatactttaaa

SEQ ID NO: 16203 - DNA, 201 bp, Bos taurus
ttttaaatttattatagtaagcattatttatggacaagagcaggttatagcacttcatagtgtgtagtgggagcatttttaatagtagaaatggttttgcttgggcaactttacattcttggtgtgtaattttaatctccataaaaatatgtcactgttgtgtaataccaaatgtaggattccagttgaaagcaactttca

SEQ ID NO: 16204 - DNA, 201 bp, Bos taurus
cataaaacaggaaagacaaatgttgccagaaaaaaaaaaaaatctataacaaatgtggagtaaactctgtgaatgaaaatctgctgtatgctggtgtgatcgttaaatagaaacccagggtatttgtgtatttgttttgttaatgagcaaatcctgcccatgtacataaaggcaagtttattcccaaagatatggtacaga

SEQ ID NO: 16205 - DNA, 201 bp, Bos taurus
tatcattataatatacataatatataatatacatacatttatttatgaatgagttggtgatgttattctagaataaatgtccactgttaatgagttggttatctgacttagatggcccctacttttgtttctttctgccaaaattaataagttcccaaaatttggggtttaaaagttaaataagaggtttatgcaaatatt

SEQ ID NO: 16206 - DNA, 201 bp, Bos taurus
ggggggaatcaaccacccaccaacattcataaaattagaaggaaaaagcagaaagattacttaaagtaaaattattgaatatgttgcatataattcagatctaatttcacaaggacaaaactggattcagagactagggtttagacttttctagcagaaatgatgagaacaggtgttggccaagcttatgatcatagcaaa

SEQ ID NO: 16207 - DNA, 201 bp, Bos taurus
agtgggagggtgtggctggtatatttcttccccaggccctcccaggtgggctaggcggtggccctgtccctctgctaaggccaccatgccctctagatgatctgttctttactgcggtcacttcttacttcctctaggtgtcaacttagacaccagttttcaggcccagggatggttcctcttagcctagctcataacttg

SEQ ID NO: 16208 - DNA, 201 bp, Bos taurus
acatttagaagagttctctgtgttttccaaatttcttgcttttgttaatgtatgattaccagaaaccatattgaaatttacaataggggctcgttacatgtgttgcatagtcatcaaatttccccaaattaccattgcatattttttcactcaaaaactgaattaagaacagattctgtatctttaacactgccccataaa

SEQ ID NO: 16209 - DNA, 201 bp, Bos taurus
gctgcgcgggtgcaggagggcctagatactgtgtatgttatcctgttaaacatctttctgcactcaagacattgtttcactatgacacgttcagaagtacgtgggccaagctacagaaatcaacactgtttagtgacctaaatgcaaaaaaacaacattcagtacaatttgaacaatgagcccttgtcttggtacatcgca

SEQ ID NO: 16210 - DNA, 201 bp, Bos taurus
tatatcaccataatatgcacacatttgttaatgtatctgtctgtaactgtctgatctcagttgaatgtaagctacatgagggagcatcatctgggtttccattattgactcagcactcccaacaatgccccaaacacaattgacactcaacagaaatttcttgaggaaataaagctgtatgttgtcgtgttaattaagaag

SEQ ID NO: 16211 - DNA, 201 bp, Bos taurus
cttttaaagtctacattttaaagttatttcaggggcccacttaatcagagtcacagaggccctgtgggttgcctttatctgctccccacttgcattttgtctcagcatttctaggccttgtgtgctgctggcagctcaaatcatggtttgccagcatgcctctgaccaaaagaataactctgggtttgctccatgccatgg

SEQ ID NO: 16212 - DNA, 201 bp, Bos taurus
ataaagaatggaactatgatccttaaatgaattcaagatatgttattgcctgcaaaattttgttatcttttgttttcactaatatttctatgttacccagtcatttcagattcctaatataaattttttcagtgccaggagttttatctatgtaaacattgagtattgtgtgatatttcattatataagtttaggaaattt

SEQ ID NO: 16213 - DNA, 201 bp, Bos taurus
accttaagcaattgtaaagttaattgcctgcaagttcctcgtttatatatgtgaattaagtagcttagtagttacctattagatgttaaccaaggggttcatgtgtagctatttaataaaagatttattaaagtcttgttttattatgaagtctactttggcatggatagctcattagttatgttcccatagctttttact

SEQ ID NO: 16214 - DNA, 201 bp, Bos taurus
agtggcccatggccaagcaggtgcaatgtgatatgcaagctcagtgctataagtgatctcagctattacataaccatacaaagtcattctttacagaatgcggggcgagagggcctgagagcttgactttcaccatcttggccacgtgctctttccccacagcaacccactccagtcctcttgcctagagaatcccatgga

SEQ ID NO: 16215 - DNA, 201 bp, Bos taurus
gttttaaaccatgtttgcactattcatttttgtctgctgaaatatcaggggattgttttccttcctgtatgtttccaattagaaataactttcagatcttcaaggcaggacattaagtacagcgataatggacttcatatgtaaacagctgagtaaaaacatgtggtctttaaaatacaacagcactgaacagcttggccg

SEQ ID NO: 16216 - DNA, 201 bp, Bos taurus
tgtaatgtgccactcacttttgcaggctcattttccttctagattaggtttgattaaattattatcctgacggtctctgaacatttattataagtggtcagaggtgactccagcgtggcacccaggctgctgtactcttccctcccatccctgcgctggccatgctgcctaaggatccttctcgaaaatgtgttctgggag

SEQ ID NO: 16217 - DNA, 201 bp, Bos taurus
ttcagccaggatgcaggctccaaggcctccttccgctcccggagtgggctcttgaggctcgatcgggacctcaagggctgaggcctcagtgggctccgctgtccgctctgcattctcttcagccttttccgcaccccagcttctgggcactgggccctccggagaggtgcctggctcctgggagatgctgagcaccaggcc

SEQ ID NO: 16218 - DNA, 201 bp, Bos taurus
agacaaaggagcccatactgacagtcggaggctgtagcttttcttggagtgatgactcatttcggctcacaaaggattctgggcagggtagtgaggagtcgggttggctgatccacgcctgtgacttcactttgcagaggacaggcagcagaggagacactgccgattcccaaggcactgcagtgggctgtcggctcaggg

SEQ ID NO: 16219 - DNA, 201 bp, Bos taurus
aaatgccttttcctgagccttccaggggaagctcacactcgaaagtgcaccgaagccacagccatacccaggaccgaagatccaggaatgagagatccaacaaggccaaggagaggtccagatcgatggataactctaaaggccctctgggtgcttcttctctggggacgcctgaagacctggccgaaggctgtagccaag

SEQ ID NO: 16220 - DNA, 201 bp, Bos taurus
cctgttaggggctgggcccttggcacgctgagcactgcacatccttcatctcgcttcagagccactaatgttctgagctcatctcagacaagggaagacacgggaagatgaactgctggacagaggtcacccagcaagggaggggccgggtgggtcatctgtctccagagtcctggcatcccaaggttgcccggtgttgcc

SEQ ID NO: 16221 - DNA, 201 bp, Bos taurus
agggaactgcttatagctgccccgagagcagggtcttcctaataatcccccagcaaacctcccctggagtgtgtattcaatcctgatgagcgtccttcactattgttcctgctcctggggttcagttaaaaagaggcagaggtcacactgcctatgtcacatgcagacattactgcattttttattgtgatgttttactgt

SEQ ID NO: 16222 - DNA, 201 bp, Bos taurus
ttttacaggtgaggaaacagaggcaaagaaggttaaagcaacttcctgtgatagacacagagatgttgcacccggaggcctggtcatgttgcccaccttcaaggaacagagaggtcagccttctgccatcagctccttcagggtcagccacaagtgcagcgcacacctggcctgcgagcctgcccttccagggcaacacat

SEQ ID NO: 16223 - DNA, 201 bp, Bos taurus
ccatgcagactcacagccgttcaaggagggtcctcaggacacagcgtgtggtctagaagagagggtgcaagctctggatgggaaggggtgcagctggggggtggccggaggggcaccttctaaagcacaaggtccaggcaggggcctccttgcccaagtcaaacaaaggctcaaccaacgggacctcatgagctcttagac

SEQ ID NO: 16224 - DNA, 201 bp, Bos taurus
tttgaggcctctccattatcctggctgctgacagtgtatattgctaccaatttcggggattcctttcttcttcaggcggcttcttccagcagcatttattgttttcagagttgggaagatggccattgtgccggatgggatgtgatttcccattggccttttgactgacatttcctgtgtcacttagggatgcttaccatc

SEQ ID NO: 16225 - DNA, 201 bp, Bos taurus
agaagggctgccctgaggaagtgacaaccaaacagaaaagtagctgctggtcaaaggggagtacaggtgaagggatttcttgggccttgcacaccttccctgtcagctctctcacaccaccatgccctcctcacacaactcctgaatcactcctgcacgtgggcctccagccagcgtgagtcatcatccaaggtgcagcaa

SEQ ID NO: 16226 - DNA, 201 bp, Bos taurus
gcagagagatccccaacctcccccatgagggccttcaccaaggaccaccctggcgccctagtctccagactgtgagaaacacgtttgtgttgtttacagccggccagtctgtggtgtttggttatagctgcccaaactaagacactggccaagtgccggcattctagtagtaatggagcatatgctacgacttctttgctg

SEQ ID NO: 16227 - DNA, 201 bp, Bos taurus
aaaagctgaaaaaaagaaaaactgtaggtttcatcagttgctaagtagaaaatgaaagcttattagaattctcctgggtagcgaagtttgctaacctggacgcaaattctggaactcatcgcccctgacttggtgtcaggactcaggttgaatgacatggtgagatttatgttttgtgctgctgtgaagacgtcacgactg

SEQ ID NO: 16228 - DNA, 201 bp, Bos taurus
gcagtacaacacaggccctggtttccatctgggacaataggagggtccttgctcccagcccagaggcagcagctgcagtcgggtagacatggctttgtgataagggggtgagaccaagggcctgagaccgtccccacctccccagcctgctggttcccatggtttatacttggagaggacggtttcgtaacgtcttctttg

SEQ ID NO: 16229 - DNA, 201 bp, Bos taurus
gtgataaagaccatgtagtaaccttgtaacacatttacgatggggtgctaagtgagtcaaaacacactatgatactagttatggcggtgtcacaaagcttgtgcctggacaaacacagtgctgagacttctttcttttcaaatattgttatcctttactattataacattatggaaaacactgtacgattactatgaaaaa

SEQ ID NO: 16230 - DNA, 201 bp, Bos taurus
ctttcaggaggccacattttctggatttcctcctcccttagcagacactgcctttagtctcctgagttggttcctcctcttactatcgggacgcccttgggctcagtccttgggcctgctcctctctttgcagccatgctctggtcatctcattcagtctcatggctgcaaaagcatctataaggcgatggcttatatctc

SEQ ID NO: 16231 - DNA, 201 bp, Bos taurus
cttcaagggcccccttgacatgatgcaggggtccaggtgatgatgttctgatgaccgaggtcctaccatgtggagtatgggaagggtatggcaggactcatgcatcccaagggccccagcctggggagaagctgattttcctccaaccaggaaaagtggctgccagtagtggtagtcaaattcattactcatcaagtccat

SEQ ID NO: 16232 - DNA, 201 bp, Bos taurus
tagatccgcggaggccagattatgcagagccttgagccttacaggttgtggtacagggtttaacacatctgagaataagtgaagaatggccacatggttttcagcaggagcctaaagagataaacttgactgtgaacaaagattgcatttctgtgactccagggcagacaggggtgggaaggtcaccaggcctgagctcag

SEQ ID NO: 16233 - DNA, 201 bp, Bos taurus
tgatgctttgagggaaatataactgtttatctaggtccataatatactgatcacataataaactgatgggaagttttttgttttggaatcatcattgacatacaatattatattaatttcaggtatacaacatgtgattcagtatctttatgcattttgatcacaataagtcaagttataatctgtcaccatgcaaccttg

SEQ ID NO: 16234 - DNA, 201 bp, Bos taurus
agcccttgatggctgttgtttctctcataaggcataacttgcaagtacagataatgtgtttttttgtttctaaaggaacttttaagatgaaatttacagacatgacatgctttcttctcttattgccaatttgtagtctctttggaagaatccctgatttaccagtaataaatgatcagatgtattaatcccttctgaatt

SEQ ID NO: 16235 - DNA, 201 bp, Bos taurus
tcttaatttatgcctctgacatttttatatgtattcgatatgaggaaaatgggattagggttgccacatttttctggaattagaattctagtttcagaaatcctgtttgcctgaaactaaatattattttaaatctacttggtcgtattacaggccagatattagattagtaataatttagtctttatttcacgctttcac

SEQ ID NO: 16236 - DNA, 201 bp, Bos taurus
aagaaaacaaataacccttcttgaagaaaacttctaaagtgatcttgcctctcctccccaaattaaataaatcactcaagcaaatcacattaagtctgtatactcaactactaatttgcaaaaacattgaggacagatgaaaacagacattagaaaacttccaatggtctgcaaaatcactgaaagcgctgcaggaaaaat

SEQ ID NO: 16237 - DNA, 201 bp, Bos taurus
gactccatctccttatgcgctcctacaccgccctgctgctgtggaaaccacgtgttctgaccttggaaaatctggtctccacttgcacagctttgctcagtaggaggatcctgctttggttagggacggtttaagtaactgcacacagatccgctcagatgagtgagtagttgcaggtggaattcacaatgatggtttgaa

SEQ ID NO: 16238 - DNA, 201 bp, Bos taurus
tttaaacccccagaggactcccctcaccacttcaagttttaagattggctccaaccagcaagtccaacaaatgggcacctttgtgagttgcattatcttgggaatgatgctataccaataggtcgtggtcgaatacccagtgcagacagattgacttttttcttggtggaggcgaaggaaaatcctcacagttttctctaa

SEQ ID NO: 16239 - DNA, 201 bp, Bos taurus
gttttcatctccctcaaattcagatgctggaatcctaatccccagggtgatactaggaggtggggcctttgggaggtggttagggcctaatcctggtgagtggaattactgcctctataaaaggtgctgagatcccctcccttctgccacgtgaggttacagtgaacaggccccgcctgtgaataggaaatgggttctcac

SEQ ID NO: 16240 - DNA, 201 bp, Bos taurus
ctggcctcattttggttcacagaactgaggacattcaattagcatttgaccaaaagaaatcattgcaaggctgttttgctgctggctctggtatttcctcgctctgtctcatggagtttcccatttgtgacttctctgggatagctgtgtctgtgttatttctcagtctgtcctatgtaaaccctacctggttttttggag

SEQ ID NO: 16241 - DNA, 201 bp, Bos taurus
cccattaagcccttgcctatcccagaatgggacgtgcccacttggaaattattttaaggctaattgctcttaggggacatgtggctgtggccaagtttctttagccctcccccttcacactgacatcaccctttcctctggtgtccataaagcacccaccccccaccccctgagacagagatagaggtcaggcctggagcc

SEQ ID NO: 16242 - DNA, 201 bp, Bos taurus
tccctcttttatagtgaaagacaaattggcaatagaccttttgatttaaatgtttctcttttgttctctgtctttattatctctcctggcccaagttcaaccatctcctctagcatctacttctgtgattgggtactgttgttgcaagtaagaactctgggtgtctggtcttatgccaaatagtctcaccagatgtagaac

SEQ ID NO: 16243 - DNA, 201 bp, Bos taurus
acttaattctaatctttcactgcttgtgtccatttactagggtgattttagcattacatatctttctctcctaaaaataaaagtttttttccaaagcctatttaaaaggccctcaggattgcatagatatcaaacagcacattagtatttcacattttagtttaaatgagatagaaacttgcaaaccaaatttcctttaag

SEQ ID NO: 16244 - DNA, 201 bp, Bos taurus
taggcttgtggagcaggaaaatgctgatattccggccactgctatttcttgaataacaatattgtttgtcactgacttttgacagaatccctgaaacttcgatgagctacctaatttgcttctagtcaggataaaatctcagacccttcgttgttcttgacaacatcatgaaaaagacaaagaagaatgggacttctttag

SEQ ID NO: 16245 - DNA, 201 bp, Bos taurus
agcagcaataacagtaaggcattattagtgtcgtacttgcaactttttagtattttctcttgtgtgactttttattctgccaacaactgtgtgaattaggcgggcatatgctgaacatcagaatgtttaaatgccttaggtagcacacatatgtagtcattgggaagatggcatttctagatctgatgagaatatgcactt

SEQ ID NO: 16246 - DNA, 201 bp, Bos taurus
tgccaaagacagtaatagaacgggtgccgtcgagttctccggccacttctagtgcagctgtgagaggctcagcttccgtgatggctctcaattttgtcaccgtcagctttggatggccagccactatgctgttcatcttcaaggctcttgtctcctttgcaaaacttcttgaaccaccacagaactgtatgttcgttagca

SEQ ID NO: 16247 - DNA, 201 bp, Bos taurus
tttttttagtgcattaatgaaattctcctttctgagaatattaggaaataggatttttaaattaaaaaataataaacacgttcctttttctcaagaaatatacctggtttagtgttttgcctctatggtatgaaaagacaacttttaataaaagacagctcggaaaatattttacaattcccaatgaaaggctaatagcaa

SEQ ID NO: 16248 - DNA, 201 bp, Bos taurus
agaaggaaggtatccttccaagggtgctaatccctaaattattgcctaaaaattaccctgttggctcatttccatcttagtgtctacttcaggaggaactcaacatgtaacaaacataaaaatgctcctggcaggagacagaatttccacaaagtgataggattatgattctttgctttttctgcctagagaagatttttc

SEQ ID NO: 16249 - DNA, 201 bp, Bos taurus
catgtccattgagttgacgttatactagatacagtctttgaaaggtgctctcagccagcttgaatacaataattttgaggtaagagagcagaccattatacagaattagagctctgtttcagcaggtcttgtgacagagtcattataatttaacaggacattttcatcagttgcagcagtgactaggatggaaggaatgac

SEQ ID NO: 16250 - DNA, 201 bp, Bos taurus
tgtttctatgacttttattaatttaagataggctatatctcactttaaagaaaagctcaaggggcttcttttaatcattactttcacatcttcagaacatgaactgtttagaacttaaagtgaatatattctttttttgtgaactgagatatctataagtaaatttttacttttaaaatagttttagatttacagaaacat

SEQ ID NO: 16251 - DNA, 201 bp, Bos taurus
attcctaaccttagacaactgaaaggccaatagccctgactacacgtggaaggtctgcatttggtacttatctagtattccgttgatcaacatcaactaaaggaatggccttgaaggatcagaatacctgttccccaaacaaataaggtaattaatgaaaagaggaggcagccaaaatggcagggtggtctgggatccgta

SEQ ID NO: 16252 - DNA, 201 bp, Bos taurus
ggtcaggcctttcaggaagggtgttaggaaagctagtttagaagccaaatgagcaaatgacgaacaggagggacacagggacatgtggtggaaggcgacggagtcagaaaatatcccggccaggagctaggtattttgaaggtttagagcagagacatgtaccaaagtccaggtttgaaaaatcaaaatcattgaaaggta

SEQ ID NO: 16253 - DNA, 201 bp, Bos taurus
acttctcatctcctccagcttgttctgcttcagacctgaaccccgtggtaggatgagaaaggcagctcctttccttaatttccccagtgggccttttcacacgcttacactctcacagaattaggaggaggagagaggatggaggagggctaaggagcagggagggtctcactgcttggcctttgcaggacctactggagt

SEQ ID NO: 16254 - DNA, 201 bp, Bos taurus
ctctacccgtcagtgtatttgccctacattgcagctgtttactctgtggattttttttctaaggctgtaattctaccatggggcagagtgtaccaaaacagacagacagggtcacaaccctctgtctaacctttgctatttaaaccaaactcccaaaccttttgaaaatgtaaattgctctggcctgttcactgagaagac

SEQ ID NO: 16255 - DNA, 201 bp, Bos taurus
aacttgagagtaccactgtgctcagcaataaattatatttgttttaattgtccagagacagaacatgcctaaagacatacacggcatcagtgctctagtattgctggtagcccttaggataatgaccacttgaatcatttcaagtaaatagtaatctctgtctatatctttctgtccatctctattgataagatacagata

SEQ ID NO: 16256 - DNA, 201 bp, Bos taurus
tctagaatttcatatacatgcaatcatataatattacttttgtgtgtgtgtcttgcttccttcatttagaaaaatgtttttgagaatcatccctgaagttatgtatattagctgtctgtttctattctttggagagtaccttttaactgcatgaatatacttgttaaaaaatccacttatctattaataaacatctgggct

SEQ ID NO: 16257 - DNA, 201 bp, Bos taurus
attcctggcatatttcacgctggactgtattcattattcccatcaactagggctgtctctgctcacaggcttggagtttgcaaccatgacaaaaaccaaccactttcatctactgaataagacccagaaacttgaccagctactactatatttagcagctcaacctcagggagtctttggtcctgcagatttttgaaaaca

SEQ ID NO: 16258 - DNA, 201 bp, Bos taurus
attcacacaaactcagctttgaagtttcactttctgaaatatactggtaaaatctagttcccgaagaaatgtttaacaccaccttactaatcagggcctcaacataactaactgttatgttgagttagtaactgtttgcagttacttggaatgaagagtagattgtcatccttgaaagctttactctttggttgaacctga

SEQ ID NO: 16259 - DNA, 201 bp, Bos taurus
ccattttgggccaacagttttccacagtcctggctggctctataccatattagtatctaaatgtaatacagtcagaataaaactgctttaattgagcataccagagacaatcaccagattggcccaggagtgtgtcctcgtgtgctgttataagacagaggatccttcctgattttaatcctatgaaacaaatcacttatg

SEQ ID NO: 16260 - DNA, 201 bp, Bos taurus
gtgattgctttctcagacagtttacatttattccaagagctaggaaaagctgatgaaaggttttaaaaagtagatagtatgaattattttattttttataaagataatctaagcaaaaatgaatttggttgtgtaagaatagagaataggagtgtagttaggatgctatgctggtagcctacatggcttttatatggtcat

SEQ ID NO: 16261 - DNA, 201 bp, Bos taurus
acctgataatagtaataacttgtgaaaacctccagagaagaaaatgacagattcaccgatgtgcctttccggacacatgcatgtggcttgtgttctggccatggaatctctgacaagaacctgtgacagtgcctcgactctagagccaggcactgccaccagtacaaaccagagacacggcctgtgctgggctgcacccct

SEQ ID NO: 16262 - DNA, 201 bp, Bos taurus
aaggatacactgggaatgtgcagtcaatgaagaatagtctaaagagaggaagccttggaaactagtcagcagaaatattccagttttggaaaacatgtcagaaaagacaacatacatgagatgggatttctaaaactgccaactcagatttagtcttcttagccatgcttggatgaaatactcctttcataacatcaggat

SEQ ID NO: 16263 - DNA, 201 bp, Bos taurus
aatttagttgaaggacattggttgggatagaaatctattaaacaggattctggcttttctacttataccactctactggcagtacaatacttagataaggaggattagaaaaatcataggtgatctttctgctgaagtaaaattgtatctacagccaaaaaaaaaaaaaaaaccaaactttttgtaatggtcttctcctgt

SEQ ID NO: 16264 - DNA, 201 bp, Bos taurus
tagcctttgtgccctagttgtatgactttgtgttttacattgagaatagaattcctggacacaatagcaaatgccgtcatgggccaagagttctttgcctataagtattataatatttttaataataccagcttctctaacgtggaatcatggctcaggaaatctccaccttttgtaagactttccatcaggccaggcagt

SEQ ID NO: 16265 - DNA, 201 bp, Bos taurus
aggagaaggggacgacagaggatgagatggttcgactcaatggacatgagtttgagcaagctctgggagtcagtgatggacagggaggcctttgcagtccgttggaaggcaaagagtcaggactgagcatctgaacaacaaatccctcattagaaatgtctcttttactgaaaggaagacagttgcagcacagctcaatgg

SEQ ID NO: 16266 - DNA, 201 bp, Bos taurus
tctattaagtacaacgataacagaagaaaacaatgaaacaaatggataccaaagatgaagcagagcctgttaaccaggcacgggccagagaaacctgccacgctggcaatacaaggttctttaccaacggagccgtggcgcgtgtgctttcccccgcaaggatgatggtgctggcacagaaagtgcaggggccagggccta

SEQ ID NO: 16267 - DNA, 201 bp, Bos taurus
tctcctccaaatatgactatgtacccttgtaatacagattaaaaagccaaagagaggaaagcagtaactctgaacaccatgaagctccatagagactgaagtaggagccccgcccgcctctcatctacctcttcagacacatccgcacacggcacgcagttcatgttcagcgcttactccaagggctgagactcactaaaa

SEQ ID NO: 16268 - DNA, 201 bp, Bos taurus
ccacaccatgacagacttcaaattgcagtttggggcactcaggcttataatcccaggctgaaagctggtatcgtcatcagtttgtaagcaaaaatgcaggtttttttttaacttttacaatgctgtttgtttcaccttgtgagttgcaggattttattagcccctgggagactggacagacctctaggagctcaagaattc

SEQ ID NO: 16269 - DNA, 201 bp, Bos taurus
atcatgactctacaatcaacaaaggaacttttttagagtaaaggaacataaaaagaaggaagaccctggcatgaggtttctattctttaagagcacaagattagtttacttgctttccctaaaaataaatctgagctgtccttcaatttaaacatatatgaattatgatcagacttacctgtcagatgatctctattccaa

SEQ ID NO: 16270 - DNA, 201 bp, Bos taurus
taataattaactgccctgaaatgacggactacaagttatgatgtgtgtcatctgcacttcactcggtaatattagcaaatctccaaatgttagccacatttgtttgtttcccttgtatgttgtttattcatgatacttcaatgctgtaactgggtggtcctttttaaacatttgcgaaacagagggattatttgtttttaa

SEQ ID NO: 16271 - DNA, 201 bp, Bos taurus
ctgaagtggttcattcatgtgtccttccagattctcagtgtttgagattcagaagaacgtctaggcaaaatgacaaattccacgcctccttggccttttacagtcaataggaaatagatgaaactatgaatgtaaaatccaaggacctaaagggtcttggatatttttggatattcagttcatacacacatctgtctcaga

SEQ ID NO: 16272 - DNA, 201 bp, Bos taurus
ggaagttttcaagctggtggtcttttgtagggattttactgactctaactgaacccttgccgcctctttacattctctgcacataaatactaattcagtggacttgcctgtggcttactattgtttgcttgccctgagttgcaattcctctgctattcctgactaaactcccttttttctttttgcttgtctgtttacctt

SEQ ID NO: 16273 - DNA, 201 bp, Bos taurus
tgaaatgtacatagaacagaagttcattactcctttagagttctctatttagagttctctaaaatatagaatgtctttatttttccctttgaattttgcacatagtgtgaatgtcacagaaatatttcagtttatagctgatatagtcttatcaaaatacatctgatttagttgaagaaaattataaacaacttgaaagga

SEQ ID NO: 16274 - DNA, 201 bp, Bos taurus
gatggacagggaggcctggcgtgctgcgattcatggggtcacagagtcggacacgactgagcaactgaactgaactgaactgaatcctgttatcttaaaacgtacattacgagggtggccttcccctgtagctcagtcagtaaacagtgtgactgcaatacaggagacctgggttcaatccctgggttgggaagatacccc

SEQ ID NO: 16275 - DNA, 201 bp, Bos taurus
gtggagacaactcaacatcaacaaggcatcgggcccaggaactgctaacaaacgtccagtgcagtggtggttcaacaagttttgcaatggagacaagagcgctgaaaatgagtggctggccatcaggagttgaccatgaccaacaggggatcactgaagctgatctcttacaatgaaaacacaagttgcctaagaactcaa

SEQ ID NO: 16276 - DNA, 201 bp, Bos taurus
agcacccccaaaaacagccatcgcccacgcccggcggcccatctgcctagcaacgcggctcgcccgctcggacccgccccggccctcccaggaatgcccacgggattcgtcctacctcctttttcttctgtcctccgccgagctggatacacaggagcagcaggaggaggaggaaggggaagctcccggtggggagatacc

SEQ ID NO: 16277 - DNA, 201 bp, Bos taurus
tatatatatgtttgagtttttaaaaaaacactctcagagaaacacttcgaataatgtttgatccaatatctaggcacccaatggcccactcaagttgacaaataaagctaaccatcacagaaagaagccaccagcagatgaaggtctggatcaattcagtagacaagtgcgagaccagctcaactggcctagagttaggga

SEQ ID NO: 16278 - DNA, 201 bp, Bos taurus
tgtgttctggccagttgaagctgaaagaccaatttctggtccagtgttctaatgatggagccctgaaagggtgatcaggggtggcaaggtttctaggcttggagctattgcggttcttccggccactaaaggggggcccttgtttcaatctatggtctcttcaaagtgggagggcaattcagatagaggatcagtaggatg

SEQ ID NO: 16279 - DNA, 201 bp, Bos taurus
actattacacagagtaaaagcctaagactgaacaacagccccaagtgcctatcagttctctgatctcaccttcttgcttctctttccatcatatctgcttctgtctatggctttcttaatgcttcttgaacatattatgtgtgttctcatcttaggacttttagtcctaagatgggctgttccttcttcatgaactttttt

SEQ ID NO: 16280 - DNA, 201 bp, Bos taurus
aaaaatctagaatggtctgtctttctgtgtcactggtttggcctactctgccattaaggatggacttctggcaaccttcttctgatttcttgagtccaactactttactattactaatagggccatggtgagacatctgaccccagagggcccaattaaattcttcctccagggtatatggatgaaataactggacttcaa

SEQ ID NO: 16281 - DNA, 201 bp, Bos taurus
tttggggttttgcagtgtacattgaagcttggaaattttgttgagtttggtgctgagctcatctgaatctaaccgattctgtgactaacttttctaagacgtgaatctgagttaggtggtaaattatctttgcccatcagttctgtggctttggctcccaggattcccattagcaaaagatttttttttttctttcaggag

SEQ ID NO: 16282 - DNA, 201 bp, Bos taurus
actgcttccattataaccctctgtttgtacctcctcataattttctgacaaattgtccctctcagatgaagtctttcatgcttagtcttatcctagtggtacattttctttccttgcctttataaagaaaaatgtaacctttttttttttttttaatccaagttcaaacaagtaccaagcagccattccttttagtgaatt

SEQ ID NO: 16283 - DNA, 201 bp, Bos taurus
caggccaatgttctgatggtgagaagacgtgtgtgcgtataatctcaagacccactgacttattttgcttgtttctttatttgttgcaatattggaagtgtatcacctattcattctgggccggtcaactcaggaattgtgtacagttacctcctctgatgcaagtaaacgaagaaaaaagtaaataaccccaccatctaa

SEQ ID NO: 16284 - DNA, 201 bp, Bos taurus
cacacataactatatgcaagatagtgttgaacattttatgtaatactgaataatgtttaatccagtgtaataaaactaatttagtaagtctttcagaagcatttaagtgaaaagtatgtatgatcccaataaggaggagtaaaatgaaaaataaatgtaggaaatgaattctatattaaattttggaacataaaaaaataa

SEQ ID NO: 16285 - DNA, 201 bp, Bos taurus
aaattatagaatgggtaatatgtttaatgagtttatttagttgtaaacgaagctgtaaaaataatttgttaaactctcctccctttggccttggcaggcacttaacattttgcttaaacagtaaaagaagtctattgaagagcaaaggaaacctcaagttgcttaaggccagcagcactctttgggcccatgtttctccac

SEQ ID NO: 16286 - DNA, 201 bp, Bos taurus
tccacctggggcacgaaactgtccctccatttgttggcggttctatttgtccactcagatccaccctcccttcttctccctcggccaatatggacaccatcaaaagattgcttaccctctgacttcttatgaatggggaacgttagcaagagaagaaaaggagggaggagaatgggaacacggcctcctcggaggagcact

SEQ ID NO: 16287 - DNA, 201 bp, Bos taurus
tctgttcccacttgccagcatttgagactgtagttaataacgctgtattgcatatttgaaagttgttgactaagtaaatcttgaaagttcttatcacacaaaagtttgttttaattatgtgtggtgacagatgttaactaattatggtgatcatttcacaatttatacaaatatgaaatcattctgttgtgcaacggaaac

SEQ ID NO: 16288 - DNA, 201 bp, Bos taurus
ggattctagatactgctggctaaacttaccccttaaataagaatatcaaatcctgggtaaaagggatagccaaacatttgcctagtttaagaaacagaggcactcgttagcaaagacgtgttctagaaatgcgatacaacagttgccttttggaactgcataaagctcctcatcacaggaaggctgagagaagtattacag

SEQ ID NO: 16289 - DNA, 201 bp, Bos taurus
ttaaagaatttaggtttgagtcagcttgccctttggcctcttgggacagaggttaagttgaagcttggatgtgaagtgctcactgtgggggatctaaatccgtaacaatacatggccattaacgtagtatttctattccgttgagacctagttcaagaggcaaaattttaaatattaaaaagtagagatagttctttcatt

SEQ ID NO: 16290 - DNA, 201 bp, Bos taurus
ctcctcaggcacctttgtaggcaatgatgattccttctgcagcctgccctctcccaaggaactgtccagcttcagcttcagcatgaagggccacgagaagactgccaagtccaagacgcacagcctgctgaagcgcatggagagcttaaagctcaagggctcccaccacagcaagcacaaggcgccttccaagctgggtct

SEQ ID NO: 16291 - DNA, 201 bp, Bos taurus
gaaggccactaaagacagagacagaggctggagctatgcttctaagcagaggagcccctggagccaccagcagctggaggaggcacctccttggagcctcgagtgggagcttggcccgtctttctcacagccttggtttgtgcccatattccaacctagactcttgattctgtgcagtccctagtgtattccagaaatttt

SEQ ID NO: 16292 - DNA, 201 bp, Bos taurus
gctttccagcctgcagagtttctcacccacccccacccgggacccagtctgtgtcccttgaagacacccctcgctgacaatgagtgaggcctggaagcaatgtctgccactcgattgtacccttattctgaatatcctttgtgcatttacaagccctcaaacctgagcgggagctctgagttctggccgagcacactgtcg

SEQ ID NO: 16293 - DNA, 201 bp, Bos taurus
gggggttggctgccgggggagagcctgaaggggctggggtgtggtgctccctgctgggggagcacggaaagaagcctgggccgccagagaggcaggacgccgttgttgggggcgcaggaccaccataggagcttctctcaggcagcagggggctgactacacgagctccgggggtgttagccgtgaccgccgtcccggact

SEQ ID NO: 16294 - DNA, 201 bp, Bos taurus
ggtgatggacagggaagcctggtgtgctgtggttcatgggatcacaaagagtcggacacgactgagcgactgaactgaactttcaaaatatttccagaatcgtccttttctcaccatatctactactgccactctgttccagccaccctcatctctcaccagcattattgctgcagccccctactaggtctccatttcgat

SEQ ID NO: 16295 - DNA, 201 bp, Bos taurus
ttactatgattgtttaaatgatgtgtgttgtatcttcctttttctgggtaggattttacaaaatttatttcactatttaactaaaaatatttattgagtacctcctatgagctaggtaccattccagctgctgagatatagccagcagggtaccaagcacttatttgtaacttaacaatgcaatggtataaaaagaatata

SEQ ID NO: 16296 - DNA, 201 bp, Bos taurus
ttgtatttgtttagaaagtggtacagaaaatgtaaactcagacctaaaagccatttgaagttacagctgaagactacaaaccatcactatttctctggccgaggtccctcaccctcacacttagggtggagaagataactgctcaccaggatcagcccagtacagacgagtccctgcatctgaaaagctcaggcccacagg

SEQ ID NO: 16297 - DNA, 201 bp, Bos taurus
ctaataaatactgtgacttgtgaatgctgagtgctgacagaagttggaaaatgtgcaattaataataataaaatgatatggtaaattgcgatgacgcataatgctttaaaaattgatactaaaatgatttatttggtggtgtgtgtgtgcatgctccgttatgtctaactctgtgaccccatggtctatagcctaccaggc

SEQ ID NO: 16298 - DNA, 201 bp, Bos taurus
aatccattcatccctgctttgtgacagttgttcaagctgagtggctacattggcagttagagatctgctggcccctccggctttgtcacaacctggggcacggggctgcagtgggtgaaagagttgtcacaatggggtctgtggttcgtggttgggagaggaggctcctggttattgaccctcatcctctcagctctgggc

SEQ ID NO: 16299 - DNA, 201 bp, Bos taurus
taagaactttcctacttttccaacttactattttagtctttaaatgaccttgtcccaattacacagatcaagaaatagaaggtcattgaactcaaaggccggggtcactcagacgtggagcccagggttctgcccagctctgcccaccttcactctcaggctctttctggatgtcagcttccaccccgctgaggtcccctg

SEQ ID NO: 16300 - DNA, 201 bp, Bos taurus
acctctgtgctgaaggtgaccaggtaggcgctcacgctggaagctccacacacttccatcacctgtcagctccatgcagacagaaggggctggtcccatccaagatggcagacgtctcacagtggcagcctgaaggctgaacatagccctcaaatgtattttgtctggtttttacagtgttttaaaaagtggagccaacct

SEQ ID NO: 16301 - DNA, 201 bp, Bos taurus
ttgggtctgggctatttaacttttctgtcccattttgtcctctgtaacatgaagataccaatagtaccaaactccacaggaccattgaggagcgtcaatgaattaatatgcaaaggcctcagagcagagtctggcaaacgacaagctctcaggacctgttatttattaatatatttacatcaactggaggctcatgtgggt

SEQ ID NO: 16302 - DNA, 201 bp, Bos taurus
gggacttggtgatggacagggaggcctggtgtgctgcgattcatggggtcacaaagagtcggacatgactaagcgactgatctgatctgatctgattcttttccagccaggccaactttaaatgtgttcctgaattgctccttttaactgcagccatcctggtttaagtggactggagggaatatattaagctgatttgca

SEQ ID NO: 16303 - DNA, 201 bp, Bos taurus
tggagtgggttgctgttcccttttccaggggatcttccctacccagggattgaactcacattgcaggcggattctttactatctgagccaccagagaagcatacttatagcctacttttataatgatctactccccatcccagatccttaacccttagcaaccaataacatgttcatctgtataattttgtcattttgaga

SEQ ID NO: 16304 - DNA, 201 bp, Bos taurus
gaagcagctgcacaaccaagggtgtgtcagagagccatggctttaaataaatactgaaacttcctttagattgatgtacttctttctgaaaaactttaacgtgtgtctgttttagttgcgggtcttgacatgaatattagccagttcctaaaaagccttggtcttgaacatcttcgggacatctttgaaacagaacaggta

SEQ ID NO: 16305 - DNA, 201 bp, Bos taurus
atacgaggtatcaggcagggcggccggtggggagaactccagagaggacgttgtgcttcctgtctacctgcgggagcgcaccccagcccgggactacaagggttcctactatggcctgatgctcttcgggcacccgcttctggtgtcggtgccccgggaccggctctcgtgggacgccctgtatcacatcctgctgtaccg

SEQ ID NO: 16306 - DNA, 201 bp, Bos taurus
tagagtggggtgtgaagctcagtgatgctcttccaaacccgaagagtcaacacgaccaaccttcgctaatgaagtcatcgtgagacctacccaagtgagatagaaggactgggaaatctcagatgaccttgttagataaagtcctttagcattttatagtgccagggcccaaagagaacaaccagagagaggtaaactgtg

SEQ ID NO: 16307 - DNA, 201 bp, Bos taurus
tatttgtccaaagccccattgctgagaagtggcaaacccagagtttcatcaaacccagagtctctgacccagatccccagctcgtaacctttactggccaggatggtgggggtcctggatttcctagactgcagtgagaattcttagcaacattttgcatttagaattctggtaccaagtgggccactgccagggccattt

SEQ ID NO: 16308 - DNA, 201 bp, Bos taurus
atgagtaagagacatgaggggagaagagaagcaggctgtggtccagggctgtgcaggacacagagcatccgccctggcccccagcagcccttccagtcctgccatcagcatcatggttgctgggaataacttttaatcaggaaaccaaagatgtgttctctggggtcgagtctcaaagtctaagccaaacagcagagaggc

SEQ ID NO: 16309 - DNA, 201 bp, Bos taurus
atatctaaatgttgcgtttcatccaaaatttcttctaaagtaagaggatgtgtatctcctcgctgatgccgtgtctattgaaggaagaaattgctatttaaagacagttttaaaatgctagatgtattaaataataggctaaatgaatcttttcaggaatgcagaatgtgtaattatttgaggcagtacaattatagtgat

SEQ ID NO: 16310 - DNA, 201 bp, Bos taurus
cttgtcccttgtggacagtctgcggctccaggtgaatcaaggtaaaggagcgagcagggattatgagtcacccaccaggaaggcctttaagtaaaagctcaggattaagacctcacagtggactggcagcgcccaccgagggagcaacagagttgagcaacaataacaatgactccgggagtgagtaagcgctactcacag

SEQ ID NO: 16311 - DNA, 201 bp, Bos taurus
cccggagcggagaaggggtggcgggtctccaggattaggcgccaggtctcacttttgaatcacctttccacaggaaccagagaccacgaaatgggccggagaccgttgaggcgaagaagaaggtgctgcggcagagtggcgctcagttgctcggacccaaaagtccaaaagcaccctctacggacacaaggctaaagggcc

SEQ ID NO: 16312 - DNA, 201 bp, Bos taurus
acttcagccatttactcaatggaaatcagggtgattaacaatttttggctactacaaataaagctactataaacatttccatataggttttagtgtggccgtaagcatccatttctctgggataaatgcctcgtagtacaacagcagggtcatatggtagttgcatgtttagtttttcaagaaaccatcaaactttttcca

SEQ ID NO: 16313 - DNA, 201 bp, Bos taurus
ttctcatttctttccactcatcatatttactttgtcactgccaaatctcaatctttcagaaagggcaccatgtggagatcatcaaatccttttggagaacaggggccatctgttgagtcctatttccccagagggcattattctaaagctagacaagcttaaaacaactacacagtaattccagtagctacctgtactcac

SEQ ID NO: 16314 - DNA, 201 bp, Bos taurus
atcaatagttatattaactgtaaatggtctaaaaactccatttaaagaaattgttagaattggtttaaaaatatgacccaaccatatgcagtccacaatacattcactacagatataattatataagttaattaaaaataaaaggatacagacattgtaaagcagttaaattccaagtaaaaaataaataagaattgaaaa

SEQ ID NO: 16315 - DNA, 201 bp, Bos taurus
agatgtgtctctgataagctatttgattgtatacaatatcatctgaaagagcttgtgcagttttccccccctttttcctattttctttactactacatattgagtatagcaaattttcattcagagttaaatattaaaatgaaattaatatttcagttgaattaataaagatattagcataaattgaaattccaaagaaca

SEQ ID NO: 16316 - DNA, 201 bp, Bos taurus
tctcctgactttggggcagggcctagcctcctctgttaattgtcctgctattttcgtctcggagttttggtcaatatggaatgaatctccaattgctttaccccgaggggccatctacctcttgtctcaattctgtcttggtggtggaataggatctgattagcaaatcagactacttgtagttagtgattagattaattg

SEQ ID NO: 16317 - DNA, 201 bp, Bos taurus
tgcctcactgtctgcctctgtactcacatggccatggctgtcatgcctgtgtctctgcctccagatttcccactttctataaggacatcagtcataggactggggcccaccctaatctgatataatctcccacctaaacttgattacatcttcaaggagtcatttccaaataaggtcatattctgagatagtggggattag

SEQ ID NO: 16318 - DNA, 201 bp, Bos taurus
aagcttgaaaacaaataacataatttgcataatgaaaccattgagagtaaatcgctgtcattcgtcagggtatctgtaccattttgacttacagtttaaactcattcaagtttatttttctccttaccccaactaaacatgcttttgatttatccttgccatttaatgtcacataaaataaagtgttccaccagaaggagg

SEQ ID NO: 16319 - DNA, 201 bp, Bos taurus
attccaacatatagcttccggctaatcacctcgcatcacccccaagaagacactttatagctgagacactggacgcggagaagcttgcttgcaaaaggccatctagctggtgtttgagcatgaattcagacccacaatctcatcactgtgctgtctccaattacacttcacccattcaattctagcaactcttacttggct

SEQ ID NO: 16320 - DNA, 201 bp, Bos taurus
aggacaaataaagagaaaagagtacaaaagttgagacatacaggatgtaaggatgtgattccatcactttactaataagacattaaaaagtacagagcagactggatgagagacagtagtcaaacaagagaataggtgtattttagagctgaagggaatcatgtatctttagattgaaaactccctttggctacagaagaa

SEQ ID NO: 16321 - DNA, 201 bp, Bos taurus
cttttaccccataaagttgctgtagagaggaagtggtccctgttcctaccatagatatgagaggatgttctatcagtggagtctgaggttagcctgagtcctgtcatctgctcagttactttagtaaaagcttagatcgtcactgtactaattcctttatcgctctgagtggccacgcaccatcagtgtgtcatgtgaatg

SEQ ID NO: 16322 - DNA, 201 bp, Bos taurus
ctagtagtaagaataaacaatttataaaaattgccaatgtctgttaatttcatcctaactgtaagcttcttcatctcgcatgaccacaggacagcactctctcttctctctgaggaggggtcctccatcgcataaatctagaggaatgcttagaaccctctatgtaagatgagatcctagagcatttacccttttcatcct

SEQ ID NO: 16323 - DNA, 201 bp, Bos taurus
caaaggcctgtttgcggttagaaaaacataaaggtggatgaacatcagtttacctttagttagtgaagacgtcgggtttctctaacaggatggaaggttgttgaatgacatctggcactgggcctggcacacagctggggctcattaaaagtctgataaggttgcttaggttctaatcctggatgtaagaatatttaccat

SEQ ID NO: 16324 - DNA, 201 bp, Bos taurus
taacttcatgggtccctcacttttttttttaattggaataccattgctttacaatgttgtcttggtttctgctgtacaatacagtgaagcatctatatgtacacgtatatcccctcggccttggaccttcctcatcccatccctctaggcgatcacagagcaccgagcggtgctccccgggcctgagagcagcctctcact

SEQ ID NO: 16325 - DNA, 201 bp, Bos taurus
gatgtatctttgacttgggaccatgaaggagttccatggaggggctgagatgtgagctgggggaagattttcaaatggatggggagaagctaacagatccgcttgagtacttggtcctcttataagaagcagcaagttttagggatccttttaagtcctgaagctttcttgtgaaaattgtgattaattcattagcaatga

SEQ ID NO: 16326 - DNA, 201 bp, Bos taurus
tgcaatcaacttgccttagaatttctctccactttgtttattactctgagaacacaggcctgcagttcattttcttccaacctaagtttcttcatctgtagaaaggatagcgctggtttagttgctaagtcgtgtctgactctttgtgacctggtggactgcaccctgtcaggctcctctgtccatgggattttccaggga

SEQ ID NO: 16327 - DNA, 201 bp, Bos taurus
tcgtttcccatcgctgagctccttcctttcttctcccgtctctgtattcagctgagggttcgtgagccttcattactgttcgtcccttgtccacctctttctccactgcacctacttctaaaactgcccactgctaataaatgcacccactagtcctcagagctcagaaaacctttacagaagtaaagaaagctgagataa

SEQ ID NO: 16328 - DNA, 201 bp, Bos taurus
attttttattgaaataatactggtttataacactatacaagtttcaactgcacaatgttatttttctacttctgtgtacaaaaacagcgtactcctcaccgaaaatttcatttccatctgttggttacagttttgaatattttcccagcattgttctttcctgcttgtctgtcttattatgttcaggtcatggcaggagaa

SEQ ID NO: 16329 - DNA, 201 bp, Bos taurus
gccatctatcaagcccaggagtgcatactagcagcccagtttgatcttggaaggataaagcagagaactgcccagtgcaaggtctggaagtgggctccactttggccttgggggcaaggaactctgggattctggtgtgtgcagtgtgatgcctcagccaggaagcatgggctctgtgggcacaggtgagcaagtgacctt

SEQ ID NO: 16330 - DNA, 201 bp, Bos taurus
caagtacccttcggagtcaaagctgcaacaaacttaagtggcctacaacagcaaaaatttattatcttaaaattctatagcttagatgcccaacatgggtactgatgcagaaaatgtggcctccgtgcactggtgctaaatcgaatcttggagacaagagttttggatgaagtagaaatgaacagaggagcctggcaagcc

SEQ ID NO: 16331 - DNA, 201 bp, Bos taurus
taaggagaggagaccaataacatgattatatagaagttatattgcatattagaaagtggtaagtaaatgcagaaaaataaagcagggaagaacaataggaggtaggtgaggatatgaagacaatttttaacatagtggtcagggaaggtctcactgaagcatctcatctgaaagaagacctctatgtagagtgttccagaa

SEQ ID NO: 16332 - DNA, 201 bp, Bos taurus
caaagtaactcagtattctacagtttacaaaatgatcaccactgtagacaagtatttaaagtgacagtttattcaaatgaaactggtagagagagcagaaataagaaaagagttaaattcaaaagtgtttactactttgcatgattaaaatattcaactatgttaatattcatgctataaacttaatgttcttattattat

SEQ ID NO: 16333 - DNA, 201 bp, Bos taurus
gaatcctaggcgattgggtatgggggtctcttttacttcctctgctcagtcctaagttggaatcaaagacaaaaattagagaagcagtcagttatcaaccggttcttggccattaacagataatcattacagaagttattggtcacctttctggattgttcctagagacagcaatctgacttcgtaccagtctgtctgaca

SEQ ID NO: 16334 - DNA, 201 bp, Bos taurus
cctgttcatttccaccaaaccactctgtcttctgcttagcccatgtaaactgaaggtgtttccatccttccagtggccgacatcaaagtctttgagttctgtgctgtctttcttttgctacacatatctgggctgccaaaatttccattgactctactttcaaaataggttgagaatttcaaatcccccattagtctcatc

SEQ ID NO: 16335 - DNA, 201 bp, Bos taurus
gagagcagttgacctgtcagattacgaaacaaataacagagctaccagccaggcccattatcttagcgctgcaccacacctgcgcacggcagacacctccagagtggtccatcattcaaaagggccgtattttacccaatgaggtgcttactacgaactgctatagaaatgatctactaactccagcttcgttggcagtcc

SEQ ID NO: 16336 - DNA, 201 bp, Bos taurus
ttttaattttctgaattaagagcctttaaaaaatatctcttttgtgtattacatcctctaatcatcactagctcccatacaaaaggtatgctttctctcttgtacaggaaattggactcagagtgcttaagtaatttgctccaagtcagagccagaatttgattttggaattgttcacttcccgcttcctatgtttttatt

SEQ ID NO: 16337 - DNA, 201 bp, Bos taurus
gttccttcctgtctgtcatgcacaactagttagatgtttgttctaactcccagatctagtcatctagaaatagaacctgactctgactacactgagagccacagaaaactctttggagaggaaggcaagtatgcagtctacagagatagttttacagctcacgtgcgggtcttgctggatttcttttcagcatagaaaatg

SEQ ID NO: 16338 - DNA, 201 bp, Bos taurus
ctcagtacactttccactcccccttgatgtattaataatcttttatttttaagcacatagacatcattagaaataaatttcagagccaggctggctgaaagagggccatttcaaggaacagctgtgactgtaggatggtttaaaacagaaattctgagctgaagaggggaagctttgtttcccgccttttgtattatggat

SEQ ID NO: 16339 - DNA, 201 bp, Bos taurus
gggttatgaaggctaagcgtcgtttgacttcagatccatctggttgtcctctggtccaggtgaccattatctgaggagatcagagaaccagctggccgtcgtggtctctgtctgctctggctgtcacattcagagacaggaggagacgtgaaattcttctctgaaggtcacatccctgaagccagggcctcctcctatttg

SEQ ID NO: 16340 - DNA, 201 bp, Bos taurus
tttcgtatcccggaagcacacctgaatattgctgcctgtctcattaaatcaacataaacggctcagtgagacacacagcacaagtttctcctggccacagctcccagccctggatgactagcaacccccaatgtgaaatgatggaatagaggaggtagaaaaaccaccggccacaggcttcaggtacattttatatacaag

SEQ ID NO: 16341 - DNA, 201 bp, Bos taurus
gctatagaacatattctgagccatgtcctgtgagctgtcttgtagatactgaaacccctcaccaggtggaagaagttaactatatgatggccagattgtaaccatgcatgagtccatttttttttcctttaataagcacaggtgtgtgtacaggaggtaagaactggctaagaatgtatagctttcacagtgggccttagg

SEQ ID NO: 16342 - DNA, 201 bp, Bos taurus
tgcatcctgggatgaacacatctccttcagttgtcttttctgtcttcaataagtatatccctgtgcttctgttggaacttttccttctgaactttgctcctgatagtgtcgctagttaacttccatatggtacatctgttatgtgccagaagcatctagaagctaggagacagagggaagcaggctgtggctggattctca

SEQ ID NO: 16343 - DNA, 201 bp, Bos taurus
acctcctccccagtcggctctgccgtgggccaccagtcgtctttcttgtcaacctggagatccctgaaccgtgaaccttggcggcctcatctggccgggcgcagcctagaagccacatcacggtactgcgcatgcccagctcagtcccactgcgcctgcgcagcctgcacctggccagtcatctgggctgagtgcttttca

SEQ ID NO: 16344 - DNA, 201 bp, Bos taurus
ctgtaggatttcatatcaccttctagaaatccacacctgcttagtactgagtagccagcattttatctcccagaattacctttcttcagaggccaggtagctcttatgttcccagtgctcttgtttccagccttatgttttagaacctctaaagatgccttcctcatttcaattgatattcaattgatacataggaatcac

SEQ ID NO: 16345 - DNA, 201 bp, Bos taurus
caatgtcacccgggagggtgggctccaggcaggctggccacagggcagcagtgtgagggcgactcagcccaagagcaagggctgtgctttctgtagcctcctggtcttctgtgcatagtgggcctccacagctgcacaggaggttgtcagcatccactccactgcatcttctgcttacagagcccaagcatctcgtcaatt

SEQ ID NO: 16346 - DNA, 201 bp, Bos taurus
tgccttcctttatagtctgtttcagggatacataagagcatgagggtgggattggaagttacctcggctgaagtacagttagtccagtgtttgcagatttgggggaaacatcagtccagtagctgtgtatcatctgggacagaaatctaaaattgaaagacacactttacaatacataatgaattaacagacaagaaattc

SEQ ID NO: 16347 - DNA, 201 bp, Bos taurus
aactggtcttcaggcctggcttcgccagaagcgtttgcctcgtacttgatagggactttgggagcaaaaagctgccctttctgctcatacatcagaaagcggtgcttgcattctggccacccctgaagacccttgtgctcaatctaaccatcccagcatgtgggtgaagagaccaggagccctggtcagtgtcttgactca

SEQ ID NO: 16348 - DNA, 201 bp, Bos taurus
ccgagccctccacaagccccgtcgtgttccaagccaaatgctgggaggacgcgccgtgaaggatgtaccctgtcatcgggaaagcagcgaggggcggcccaccacaggtcttcgttgagacattcactctcctgcctttacctgtttcttgaaggctctgcacagccaaggggaccacagtgatgcctcaggtcagacaga

SEQ ID NO: 16349 - DNA, 201 bp, Bos taurus
tttctgtgtgtgcatgtatgagtacactgtgtgcatatgtgtgatgtgtgtgtgcaccaacatacctgtgagtcttcctctgtcctggtccctcccctaccccccatcctatcacacaggtgacgtccccaggcatctcctgggaggtctggccacactggctgccttcttatcaggattatttttaccatcattcacagc

SEQ ID NO: 16350 - DNA, 201 bp, Bos taurus
ccgggttcttcattaggggaggggtcagctccagggactgccatcaagcaggtttcagtgacctctccctgacccccagggtgcctctgatctgctcaaggcagggaggcctgttaacttttaccagactcctttgacgtggagcgctaagaagaacccgggagggggcttcacgcaagtgttggaggctcagcgctgccc

SEQ ID NO: 16351 - DNA, 201 bp, Bos taurus
agggtcgagctgagaggaagaaaaggatccgtggacatggctctgacacctgtccttctttcttaaatgcttatggggctgcagagaaagtgggcccaacccatattgatgtaacagacatgtctttgctaaactgagcctgcctctctcttcctccactgcagaggtggtgccctgctgacttccaccagcggccctggc

SEQ ID NO: 16352 - DNA, 201 bp, Bos taurus
ggtggcagactttttccccttaggatatggtggagcgcgggacagatggcaggcctgaacacccgatgcagtaggtcacagaaggagctcgcggggccgttaaataagctgtcgtgtgtagggtctcggtggcacaaggacctccaaaccagtccacgtctaattctttaatgcgttcttagtttctgaagaggccagcaa

SEQ ID NO: 16353 - DNA, 201 bp, Bos taurus
gaaaatatacaattcttgtattcggtgcatacctggagtgtaaagtcccagatgacactggttaccgaacaagccacagctcatggtgctgcttgaagcctgtttctttgtggatgaaaacaggagggagaatgcccttaccctcccccccaaccccacccccttctctccaagtctcttttcagggttcttacctcccct

SEQ ID NO: 16354 - DNA, 201 bp, Bos taurus
ccatgggatcgcaaagagtcggagacgactaagtgacgtcactttatttctttctttcactgagtgtccaccatgaagttctacagttttaggggaaagtgaacggtgtggccccatatggggagcggtagggcagaggaggaggggtgctcctggggggagtcccatttgaactgagtgtggagagtcaggtcaggaagg

SEQ ID NO: 16355 - DNA, 201 bp, Bos taurus
tgacagcagcttcgcagagatctttttgagaagagggaagagttttgtttctaaaggggtgaccatttattatttttggtggatgttatcttcatttggtgctgctcgacactgagacagattcaggaaatatctctcatgtgaatggaacttgaaattgctaattggtaatacagaagaatctttgaataaaggttatat

SEQ ID NO: 16356 - DNA, 201 bp, Bos taurus
gtttccaggtgaatcaggcctggggaagccagctccaggcacacaggtagcatggtcctccttccttccaaactcaacgttggctcctaagccacaagagacctcctggtccaaatagctgtggtgggcgaggaagagcttgggctgacagatggcaaccctgggttcaagtctctgtgcttttactgagagtgagaattg

SEQ ID NO: 16357 - DNA, 201 bp, Bos taurus
acctggagaacaaggggcagcactgtcttagaatcaggagtggcggcccgccgaggtggctttggaaccagctgcccgctgggctggctctggccacagggtctaccctgcccggcaccgccttctctccatgtgtctcatttctgaccagctttccatctctttcttgtctccatcacacatgcagtcagatgggccgaa

SEQ ID NO: 16358 - DNA, 201 bp, Bos taurus
agtggtgccattgtgaagaaagccctgagggacttccctggtggtccagtggttaagactctgcacttccactgcaggggtcacaggttcaatccctgaccgggaaaccaccatcccacgtgccacgtagtacagcctgaaaagaaagaaagaaggaaccccatctcatagcagagtgtttggtttatttctattgttgat

SEQ ID NO: 16359 - DNA, 201 bp, Bos taurus
ttagaaaggcatttgtcacggtaagaggacagagcataccttatgttagagtttccgtggtgtgtgggggcctccatttgtagtctcttcctgggcctctggaatgttagacgtgagcctgtgggcaaggaggcagtaacacagtcaaaggtcctgaaacagcaaagcgtttggtgtattggtgcggcccagcctcggtag

SEQ ID NO: 16360 - DNA, 201 bp, Bos taurus
gcagtatgcaacatggcagagcatctcctggtccagccttaggcgagaacatgctcggcgggtcagcccagttctctgccgccccacacatgcccctgaatggccgggaacccaccgcacgtcttgacttggaggcgacatgggaattacagtgagcaggcaaattcacaaatacagaatctgcaaatactgaggatccat

SEQ ID NO: 16361 - DNA, 201 bp, Bos taurus
tttggatagcagttctcaggcctatttcctgagaactgcttccaactccttccaggacctcctcccaagtgaaccagtgcatgcggtggtactttctcaccgtgtgccattttcatggcccttccaggagcaatacaaggctgcctcagcctctgagtgacacttgcatcctttcagcgagctttgcctcccaggcatcca

SEQ ID NO: 16362 - DNA, 201 bp, Bos taurus
agacctacctgctagtgttggagggtcttcctgtggaggtgtgggtcaacagtggcttccgcagggatgatggcactggcagcagtcctggaaaactcctcttggcgtaagtccttttggaggttgccattaaccccacacagagttcatagaccccagggctgggttgccacaagccaggcaactaacagagagggagca

SEQ ID NO: 16363 - DNA, 201 bp, Bos taurus
aaaaaaaagaaaactcaataaatttaggctctgatatagtaatttctcttaaggttaaaccttgtcaagaagaacagagtattctggtatgtttcaaaacttcttccattcccctccccctgctgaaaatgcaagggaatttttctctgttatttactgtgagaatctggtctagctcctagaggtaaaattcacaaaagc

SEQ ID NO: 16364 - DNA, 201 bp, Bos taurus
aaacaaaataacacgttaaactccttaggttttgctatttaattagccacattttaaggttaagactgagtacaactgcctcagaaaggcatgtgttcaatcaggataggactcagttctatgtaaatcactgaatgtgattttgccaaaagtcattaaacaccagtaattctaggacatgtttcccatcaatttaaagac

SEQ ID NO: 16365 - DNA, 201 bp, Bos taurus
ccaagacttatgactcaaaatgacaagcgctcaatttagctcagaatcctatggggcagcctggggattctcctggcctgagatgacctagccatccttgactgggttctctcctttgtctgtggtcagctggcagatcagctggtggctgaacaatgtgggatggcctcattcacacgcctgttgatgggcaggctgttg

SEQ ID NO: 16366 - DNA, 201 bp, Bos taurus
ctcctccttttctcctagggcctcgaactctctttcatctaggttcccactttttgccttataaaaactcaagtttggtggagacctagaaagaaaggagaggcctgggaacgagaaagaaccagaggaggcaaaccctgaactgactttggatgaaatggagggtgactggaaggctaagtgatggcaaacatcttatct

SEQ ID NO: 16367 - DNA, 201 bp, Bos taurus
tctaatatggcccttcatccctctcagcctctcatctggcccctgtcttccaatgttctagtctagtggttctcagaatatgctctgaagactcctacaccacccaagatcctctcaaggccatcctctcaagggcatccatatttttacagtatgactgagatctttttcgctttttttcactttgttaaaattctcact

SEQ ID NO: 16368 - DNA, 201 bp, Bos taurus
ccatctgagacccacaatcctgagagcaccagagaaaagtgggattgcttaacaagtgtaaggccactcaagtgcgtggccaccactcaggaccttccatcaaggatacattgttctggatactgtaggtgatgcaaagaataataagtccatgaatgggttaaaagtgaggtaggagacagacgggcccctggactggac

SEQ ID NO: 16369 - DNA, 201 bp, Bos taurus
gtgtctaggtggaaagaaacagagccttggcaaacaccacctgaccctggactgatggcggatggggtctggtactggctcatcactcagctgcatccctcgtgcctggtcctctctttccctcctgttgcttttcccaggccacttggcctggagccaacacctccctatgctgacttcagcgggaaagtcaaaacccca

SEQ ID NO: 16370 - DNA, 201 bp, Bos taurus
aaatgtgacagactggcccctccttttgtgattcttgatagaagcatgcacttgtgtattttctgcccagatctgtacattcctgaaggccttccatccatggaaaacaaagcatgtttatttctccccattctcctgtattctcattcggttgaactgaatggcccatttcacagaaaagaaatcccttggaattagtta

SEQ ID NO: 16371 - DNA, 201 bp, Bos taurus
tggccttttgtgaatttctattgattaagaagaccaggaaccctggtgagtaacagagtgacttagattaaataaggttcttcaggcagagaccggtgcccgggagcaggccagacctctacccaacttgaggaagagcctgttgacaacctgcagaaaagtcagctgttttctcagcagagatttccaggctcaggtggg

SEQ ID NO: 16372 - DNA, 201 bp, Bos taurus
aggaccacctgggatcactggcccctaccagcagctgggagagaggcatcggagggtttctccctcagcgcctctagcagccccagtcctgagacacctcgatttcaggcccagcatcctgaaccgtgagaataaagttccatcattttaaagccactccatttgtgttgaacttattccaagagctccccgtaagcaccc

SEQ ID NO: 16373 - DNA, 201 bp, Bos taurus
agtctacaaacagtaagccaagtataatgacacttacaccttgtcatgtgggttaaattttttgagattgtaaataggccttttaaaacccactagaacaatcatgctttttttttttctataatgtgctatttattgatttacaatgaagataaaggcttcagtgttattcctctccattgcttaatcagggaacaaatg

SEQ ID NO: 16374 - DNA, 201 bp, Bos taurus
cctgggggtaactcctgaggtcggctcagccagcgggggccctggcacgtagactccagtccacacctcatctttgccagctccctgtctccgtgcaggacctcccagggggcctggagtccaggcccacaaactgaggctaggacagcccaccttgaatgttcccccccaattacgtctctccctgacccagtctggggg

SEQ ID NO: 16375 - DNA, 201 bp, Bos taurus
ccagccacagacgctcacaccccgaggtggggtctttctgcctccctgagctggttgtggacagaagcagaaggagggccagcctcctgagtcccagagcggatccttctcagccatcgtgagggacgagaggtggggagggcgggaaagtgccgcccagctccggcctgcacatccccagcgcctcccagccaggccgcc

SEQ ID NO: 16376 - DNA, 201 bp, Bos taurus
ctgacaggcgacagagcggccaggaagcacggaagcgttcagagtgtgtctgcaatcaaagtggggaggacccctggtcaacttgtcagctctcgggactcttctgctccagaccggccatggctctccatcgccttcccagtaaaaccagcgtccccactgcagcctggaggagccggcctcctgcagcccctgccctct

SEQ ID NO: 16377 - DNA, 201 bp, Bos taurus
ccctccattgattcctgccgtctcccgtctgcaacgttaggggccgtgtgatgagagcaagaacgcctgatgaccagccctgcgctatgagcacagctcacgtgccggacgccgtgccaggccctttactgacaacattgtcgcagcagtgcaggcgggctcctgtctccccatccccccgagggtggttttagggggctg

SEQ ID NO: 16378 - DNA, 201 bp, Bos taurus
cctagagcccacagtccacagcaaaagccctgcagtgagaagcccgcacaccacaaccagcgaaaagcccaccatgtagcaacgaagatccggtccggccgaaaataaagttaaaaaaagaaagagtgacaggggaattccctggtggtccaggcgttaggattccacactctcattgccaaaggcctggattcaaggcct

SEQ ID NO: 16379 - DNA, 201 bp, Bos taurus
ggactgcagcccaccaggctcctctgtccatgagattttccagacaagagtactgtacaagtacaagtacaagtacaagtgggttgccattgcctcctccgactctctctgctcatttccccttattcttcccaagtctaaatttttacttatttaactgcaccagtcttagtttggcattgggatctttttattttagtt

SEQ ID NO: 16380 - DNA, 201 bp, Bos taurus
cccccatttcacagattgggacaccgaggctttggaaaattcagtgactgatccggatgcctggccagactctatgcactcctacacattctggcctgcacgcccagctgacctgagctctccatgctcttgctagtgattctttccggaaaacccaccaggcacactcctgccttggccttgcagtgctttcccctcttc

SEQ ID NO: 16381 - DNA, 201 bp, Bos taurus
caaacctaaggctcacttgttcctattctgtgccctgaagtgttgggctgcttggccaagtcccaggagctatattagggaaatactttcccttcagccatggttgaaaatggaactatgtgtataaatagacatcttgcttcttacatatttatttgccaattttactccgagtataatgcaagttcaataaaaatgtga

SEQ ID NO: 16382 - DNA, 201 bp, Bos taurus
aactttggccctgggagggctggctggctgggctattggccagagatctaaatgactgcacagtgaacatgctgaagggttcattgaggtccaccaccctgaagatgaagctccctgctaggcctttgtctctaaaggagagcctggattctgatcaactctaaattcccttcaggtttcaagaaataccacctgatgagg

SEQ ID NO: 16383 - DNA, 201 bp, Bos taurus
ctatttttaaacaatagtcttcacatggttgactaagccagaaatcgacctgcttcactgtccccaaacgcacacgccttcaccttgtctgggagggcccgtgctctcgggtaaggacaggctgtctgcagcagggcaccctgctcatctccgaggtctggacatgccggacacggtgcccttcctccccttgtgagcgct

SEQ ID NO: 16384 - DNA, 201 bp, Bos taurus
aagaaatgtattcagcaactgtaggatgacagtgtggacttagttctttttaaactagtcaatacattgttaccaccacattatcattgagaaggcggccggcgagggtgtggagtaaaattcagtgtcatttcctacaggtgatgtttatcaggtccatttattcatttactaacaatatattgagcctctgccacccat

SEQ ID NO: 16385 - DNA, 201 bp, Bos taurus
cagtgtgtgtcctgggccctaaccccagagtctctgattcagtaaatctgagccggggacccaagaatgtgcatttctggcaagttcttaggatgctggtggtgttggtgtggggccctcacttggagaaccactgatacagagaagaaggtgcagctgagcggagcagctctgtaaagagtgggataaaggctgaagtga

SEQ ID NO: 16386 - DNA, 201 bp, Bos taurus
ctcatgcccctgtgtccatgtccacgcgcagcccctcagcagggtgcaatgtctctgcatgtgggagagagctaagagttggcctttccgaggcttctgccttgtcccctcctgagccagggctccgtgcctggtgcctgcctgtctccgtatcctccagatggggctctctgcctctgccgtggcccacttcagctgctc

SEQ ID NO: 16387 - DNA, 201 bp, Bos taurus
gttgctgttaatacatcaatggatactttatagaagctccataaaaagaatccaaattatatgaaagagtttaagtgggcaagcgaatcagaggatggcccgaaagtgaacagatggtccagagccttgctctgcccgatgaggtgcctcgcagagcacagtggtgagtgcagccagagagagagaaacgaggaccagtgg

SEQ ID NO: 16388 - DNA, 201 bp, Bos taurus
gacaggagtccttgcttataaaacagatgggctgtgtgtttcccagttaagggggcgatgcagacatgctcaggctggttgactgggacacagctcgtccaactcggcctgtgtacacagagctcaaacagctgaaccgtaattgtcttttctctccatctgctgtgtgcacagctgcctctggaacttcattctaaggct

SEQ ID NO: 16389 - DNA, 201 bp, Bos taurus
gcccccgtgactcaggagtgggaggtggcaggggtccgccttgtttacctgtgagccggtagtgccattcgatttgggaattacatgtgtgcacttccacggacagaggagcctacaggccatggggtcgcacagagtcgaacacgactgagcaacggagcactgaacacgttattttgataaaagtaaaataatccgtag

SEQ ID NO: 16390 - DNA, 201 bp, Bos taurus
gacagttttcattgccggtaactttctttctaggagtgatatctggaaatgcttttagctagtcccctagtgatcagttggccacctcagcagaaatagtggaggcaggagaggcttggtgtccgggttcaagccaagggatgccggggcataccagcggaggggcttatggtatggtgggccgcagctggactttaaata

SEQ ID NO: 16391 - DNA, 201 bp, Bos taurus
acaagatatgcacaaaaagcttatttctttcaactcttcaggatcacctgtgttctaagaaacggactaacaattccaccatctggccacgccctctcaaatatcttctttctccaaactaagttcaaaggctcttaagcttcagaccagtcactcagccacacggcggccctcccaggcccatggccggtcagccccggc

SEQ ID NO: 16392 - DNA, 201 bp, Bos taurus
cacgtggcctgtggccattagtttagacagggcagatcaagggcggttccatcagcagagaaggctctgacgttcagcgctgatctggaaaggcctccgtgaaccggtcccagagctggtcggctggcggacctgcaggcagtggagtctcaagttaaatgctggccacgaggttgcgtttctctgggtcctgggagaagt

SEQ ID NO: 16393 - DNA, 201 bp, Bos taurus
ccctgggaagaggactgcagtgggtggaaaagatttttttttttatcagtttgagcttgactggaagggaattaggaagccatcctccgagacaaactggcaggggcctggagagctggtagtggccaggcctgagccacagccccctgaccctcggcctgacatcacatgggcggcatgcctgcagtggccaggggcccc

SEQ ID NO: 16394 - DNA, 201 bp, Bos taurus
gcagcccttgtttggagttggggctggtgttgaagaccgccagctgagtgaccctgggcagatgacttcgctttcctggccttactttctctgtgccctctgttgttgtgaattttcttttttggtgtcttcttatagtggatattagcagttagcatggttcctgcccaaaggagatacaggcctagattacaggtatta

SEQ ID NO: 16395 - DNA, 201 bp, Bos taurus
gaccgcacacatcacacctcccgccaccacctgtcactcacacagcagttggctcactgacattgttgcggtggtctctgcactggcagtttaccccccacctacaaggctggcacgctggcccccttgtcctcactgagacttccctttctcagcatggatagcttccccaaacaccgtttgcaaccatccactccccac

SEQ ID NO: 16396 - DNA, 201 bp, Bos taurus
gtatatgtacatgactgcatattttcaaagctatgcctatattcttaatttggttgtgacctcagttacttgatgattataaagtcttgttttgttttcccatgcttgcaccagtgcctgtgggtctttgtagtgctggagctctaagcctgatcatcctgatttaactgtgttgaggtggtggctcagacaacaaagaat

SEQ ID NO: 16397 - DNA, 201 bp, Bos taurus
caggccagcaccctttctgttgtgctgtgtcctcagacacagggggagggaaagacagaaaagaaagaaggaaagaaaggtgcatgctaacatgctgtcccgagggccattggtcttgaagcccagcggcctagaggcttggcttctttcctatttatgcccttcttttggtgttgtggaaattagtcacactttaggttt

SEQ ID NO: 16398 - DNA, 201 bp, Bos taurus
taaagtaggtaaaaaattccaaaatctttccaaaatctaatacacatgatgtggctaccatacacttattctaactatctccttcttatcattatagatacagattttctaatcctatttcctatgacactaattataccaggatattgatagataagctttgaggagtctggtacttgtatgtaatgaagtccacagaaa

SEQ ID NO: 16399 - DNA, 201 bp, Bos taurus
atccaggcacacacgcggagcggggccgtctgtggaggagggacaggtgtgtgtgggcaacatgtgtgcttcaccctggaagacggaaggaggcccatgtgacaggactgtccgctgacgtgtgatgctggggtccaggtggaatggactatgtctgtgtctagaacggcctttgcagagggtgaagtggcagctgcctgc

SEQ ID NO: 16400 - DNA, 201 bp, Bos taurus
gggtggatttttttttcaacagaaagtattacattactaccagtccaaagttggttgaatctgcagatgtagaattgtgtatatggaggaatcaagtatacggaggaccaattataagctattcgaggattttcaactttgtagagggtcgggctcctaactcctgcattgttcacgtataaactatatatggctgtgaga

SEQ ID NO: 16401 - DNA, 201 bp, Bos taurus
tactctgatgtccaatctggcctctgtaacctgacaccaaattaaatctcagggacagagttttgggtgaagtataaaagaatatctttgttgctttgccaagaaaagggggccacagccaactaacgtcctcaaaactgtgtcccaacccagagtaggtagtgaggagttttacaatgatggttcaaagaggagggcgtg

SEQ ID NO: 16402 - DNA, 201 bp, Bos taurus
gagcataaattcccagtgtagccacagaaaggatcctgcttagtcactgctacccgggtgagccctctgtatgcaggcctatacaagcactgcttttctcgatcaggacggagggcagactcgagaagtcagtgtgacttaagatctttgtgctttagctctggacaaatatacaagggccctgtgccttctccctcctcc

SEQ ID NO: 16403 - DNA, 201 bp, Bos taurus
ctttcgtgcactgtcaaggagagcaggtcacttgaattccgtctaagagttctgaattcagtacgtgaaacccattgcatctataaataccaccaccccgctgataggtacacttcagttttgtgatcgcttctactctagccagtattgctttatgtcctgttgacgaatcctgcagaaacaatcagaacgtcagcctca

SEQ ID NO: 16404 - DNA, 201 bp, Bos taurus
cagtgacttttctttcaagaaactgtcacagccatgcatatcaaaagattctttgggagatttctctggcagtctagtggttaggcctctacttctactgtagggggcacaggtgggatccctggtctgggaactaagatcccagcctcatggcatggccccacaaaaaaaaaaaaaaaattgccaaaaaaactgcaaaaa

SEQ ID NO: 16405 - DNA, 201 bp, Bos taurus
caatgccattttagctataccagccttatcaaaaaatgaacagtctacaaaagaatgtctattaagccctttgaggtaatacatcacatacaccctacctcaatcccttgctcaatatatctttgtttgatgacatatatttgttggagccatggggtcaggaccctgcggcttttagcgcagggcattagagcttcaaac

SEQ ID NO: 16406 - DNA, 201 bp, Bos taurus
gcccagcctggcctctgtgcccccactcctgtgcctaatatatccacagctccgaagtccctgaggcaagcacaagaccatgtgacctgtggctcacaaccctgacacccgtggcctcctctggctggtttttggccctgtaccacattttcaccctggttctctcagagggcttccctagtagctcagttggtaaaagat

SEQ ID NO: 16407 - DNA, 201 bp, Bos taurus
actcaaacccacagcttttaaaggtttttaacccatctccttcctctgctaggaacatcgctaggtgtgatgtgctagggcctatttactggcattggagaactgcaggttgggtacctccttttcttttaatcgatgtttataattttccaaacactgacttgaatcaagacatggttaaatttgacaagatagtctagg

SEQ ID NO: 16408 - DNA, 201 bp, Bos taurus
ctccacacctctgaacaggtcccttcctacctcatcagtgcgggagcctctcacccagcccacagctgcaaagccgctccctcccctgagggccactgccgattgtttaaagcactcaatcgcggtccaggtttacatgtctctctcaagccaggtactgagtaaagatcagggaccatctgcgcagttgtatggccaggc

SEQ ID NO: 16409 - DNA, 201 bp, Bos taurus
tctcaaatttgcttcaagtgcggaatggccgtagaatggctgacactgaattcttcagcaacttctcatgtagttgtaagaggatcagctttgatgattgctctcaattggccatggtcaccttccgatgggtggccactacactcctcatcttcaaggctcccgtctgctttgcaaaacttcttgaagcacatcagcaat

SEQ ID NO: 16410 - DNA, 201 bp, Bos taurus
gcgtggtagggacctggaggctgtggaatcacatctgggagctgagctgagggtggcttggcagcgtcctcatgacagtgtcgcctgggaggacaatgagcgatgactagctcacactggccagagaagcagggcaacccaccagaggcagtgacatagccagtctgcccttcctccttgcctccccgcccagcacctaag

SEQ ID NO: 16411 - DNA, 201 bp, Bos taurus
atccctatggtaagggaagcctggcatactgcagtccatggggttgcagagtcaggcaggacttagttactgaacaacaacaataaaaacaaatcatgtatgtacatttattattatcttttgcttcatttgttcaatatttctcacccctatctgccccatgcatagtaatgtagctatgtgataatttcccaccattta

SEQ ID NO: 16412 - DNA, 201 bp, Bos taurus
ccatcagccgtcacctgttcctgggaatggctaacggcagtggtatggcatgctgaattttaatgtgcgagtggccctctctggttcagaaatgggtcccgcaaatatgaacccattaaaacctttgggagcagttttggagtcaggaaaattcatcatacctggtatagacagcgttcaccatgctgctactgacacacg

SEQ ID NO: 16413 - DNA, 201 bp, Bos taurus
attcttatgcctaactccagaagttctcggagttgttacagtttccaacacataagaatgcagagtttgatcagtgatcaaacaaaatcatccctcttttcgaatgattcagaaaagctgaaaacaacacagaatggtctgttttctttctgctctgttagggctccttccatagggttgttctgtgattgtgttgtaagt

SEQ ID NO: 16414 - DNA, 201 bp, Bos taurus
tcagggcctcctgataccacgatgtatgtcttcaaggcccggcttagagccctattccatgcagcttcggagctacagctttcggaaaagctgcaagcgtagagcaaggccaggagccggacacagtcaatcctatgcttggcggttttcagtagttctccccttggtctttggctactgacatcttcgtctcaagctcgc

SEQ ID NO: 16415 - DNA, 201 bp, Bos taurus
ctgcggtgaggggtgggactttgctggaccggctcccggagcccgtacctcctgacctgtctgccctcttcccgcctcccagcctggccgcctcgcccctgcatgtccaccgtgactctgggcaaaggacaccaccgtcaggcagtgtcggctcctctgaccccaggcacggcctcctggaagagcagggactagtcctgg

SEQ ID NO: 16416 - DNA, 201 bp, Bos taurus
ctccccccggcgggccccctggggcctccccacagtggagggttcttaggtgacttagagactgtctgcctacatgtggaaacaaacctcaccctaaacgcctctttaaagaggcatctggcctagtttttaaaccgctggagacccttgacaaatctttactctgcttttatttacatgtgaactcacaaataggaactt

SEQ ID NO: 16417 - DNA, 201 bp, Bos taurus
aagatagatgagtcacaggtatgagacgcacagagcgggaaatacagccagtaatcgcagaatagtttcgtacggtgacagatgaaacgacgccaaaaaggcatgcaccttaaccaatttgggattattctggaaatgcaaggacagtttaataacagcagattattaatgtaatgtacttaacaacacattaaagtagaa

SEQ ID NO: 16418 - DNA, 201 bp, Bos taurus
ccctcgcctcctgtccgaacaatttctgttaaacctgctgaaaggaggctccttttctgaatgttgaagatgaaaaagacgagggtctggccaattctcccggcagacagacggacaccgagagaccgagcacgagctgaggtcccactgctgctgctgtactcgcgtgtcgcggccgtggccgggggctcctcttcgggg

SEQ ID NO: 16419 - DNA, 201 bp, Bos taurus
tatgctgtgtaacaaatgatatcccaacttcagtgtttaaacagcaaaggtttacttctccctccacacagcaacggtgcacctgagtgactcccctgggctctgactccaacgtcagcagcgtagtcacccaggctgctcagagcctcctgccagcagcagaaacggagagagtggtccgtctcaaatgggccattaaac

SEQ ID NO: 16420 - DNA, 201 bp, Bos taurus
cctcactcccaccccgggcgtaactcggcagggcctcacttccgtcctttctctgggtaacagtcggcatctgctaatccagggcttccgctccatcccctacccccacggcctctggcaaccaaagtctgctctctctgtgagtctgtctctatttatagacagcttcatctgtgtcatttcagattccgcatataaatg

SEQ ID NO: 16421 - DNA, 201 bp, Bos taurus
aaacatacgacgaatatgtggactttgaaaaccattttcttaatgaatataggcatttcctcaacaatatgagtctttataacttaaaaggctaccacaagagactagttttttacattccaaactgcagttgatgttaaacacgagccaagaccagaaattagcgctacatgtagaagaaaaaatacagcaacctagcaa

SEQ ID NO: 16422 - DNA, 201 bp, Bos taurus
gcaaaggacacctcagctctgtggaccgctcatgagataccggacaagacaaggcaagagcaagctgccaccctggcctcccctgagggacagagctctgtgcacagactactcatctgcagctgcgctgtattcgtgggagatgacacccaataaactaaaacaatgctaaaggccatcagacttggggagcagagtgat

SEQ ID NO: 16423 - DNA, 201 bp, Bos taurus
tattgtctgtaaatggtacaggtgctttgctcagtctcagtttgtgcgatgagaacataattggcccgcggaatttgaagggctctctccgaggcctctgcaggtgcccacgtgttggtcccaccctgagttgggggtgctggctggcggctgcagttgctcactgcctcagtggcctgcacaccagcttagcctgtagat

SEQ ID NO: 16424 - DNA, 201 bp, Bos taurus
tcaccacggaccaaaacgtgggtgtgctcttgtataccaactctgtgtgtcactcaaggatatcaacaaacctgattacccttaaactctaaaatgtgtactgggggattagaaatcaccatatcctgggcttatcatcaattatgtagccatctatctctctcaaatgctgcagtatattaataggaaaagatgacataa

SEQ ID NO: 16425 - DNA, 201 bp, Bos taurus
aaagcttacttttgctccatgtggtgtcggccagggtagcttgctgaaatgaggatctatatccacgtggttcacttaggtgggcttgcagggagccctgcggggctgctgggtggcccctcagtggtgctctgtgtgggtctgcccctgtggccgcttgagactccttctaacagggtggccggattctaagtgggaggg

SEQ ID NO: 16426 - DNA, 201 bp, Bos taurus
cagtccatggaatcgcaaagagctggacctgactaagtgagtttcacttcagttcatcccttttctgcttcctaaatggcagtgacggtggcctctgatcatcattctaaaaatctggttgctttatgtcactgctttatgctggcttgaaaaacaccgcggcccttgagtcaaagcatttttgtgatttccttttttaaa

SEQ ID NO: 16427 - DNA, 201 bp, Bos taurus
cctgcaagagcaaaagccacctagggagcttgttagaatgcagtctgcggggcctccgcgccacagatgctgagcttccgtgtgtggccgtggacctcccaccggtgtctgtcccgtgtaggctgcccctctgaaggcaggactgatcttccttgtatgtctggctgcttatcccccactcccattatctactcaaggaaa

SEQ ID NO: 16428 - DNA, 201 bp, Bos taurus
gactcaatgtgtagaatccatggtaaatcattagaacacaatggaggtgacctactaaatattacagactatattctagtttataatgttccttgtaagaaatggcacatatttttgtaagtcagaaattcgaaagagtctaaaatgcccctgttcccttttttggcaaagatgagatgtctaagtgaattgtagcaattg

SEQ ID NO: 16429 - DNA, 201 bp, Bos taurus
ttccagaatgacatttcttagctttcagaccttcgtttttaaagtgaaatttagatggttgacctctgagcaaatgatagccggcccactgcctgttttcgtatgaccaagaactcagcataagttttacattttgatgaaatggaaactgaattcggatgcaagttaagtgacatgttctcttgggccatgaagcctaag

SEQ ID NO: 16430 - DNA, 201 bp, Bos taurus
tctctaagtggcccctgaatcattaagggctccaggcttgatcgattagcccaggaggctacagtggtgggtcttgataccagttcttgctgcctgcttctatgctaataaacatttatgttcaaagcaggttatgggttttccttgtggcatttaaagcttactgagagcagatgctgttagtgaagagattagctagaa

SEQ ID NO: 16431 - DNA, 201 bp, Bos taurus
ctgcaggtagagactgtgatgtccaccatcctcaggaggattgccccacaggtcccatccgagaagaaagtccattaaggtgctccagtgatgagaaggccagacagggctgctggaggaggcaggtgacaacctgattaaaaggaatcaaaagtgcttctgtgaagactgtctggaacttaaagaatattttcaagctta

SEQ ID NO: 16432 - DNA, 201 bp, Bos taurus
aagcgactgagcacacagcacgttttaaaacaagtagtatatgagctgttacaaagtttcctgagggcatactgaaacagtcatatcacatttggccccaaaatttggttttaaaaaaatgtgtgctaaggattgaatcatagacatttacagaaggactgctcagggatactcaaacatgtttcgttaggagggtcaaat

SEQ ID NO: 16433 - DNA, 201 bp, Bos taurus
gtttcactcgttgagttttctggttcacttctgggatattgctattgactgtgtgcaaaattatctccttgggccagaaaattcatctgaacatagaaacgcttgactgcatcccaggagagagcctgtaacgtctgacgaaaagagaagtgaattaaaacaaaatgtgtttatatgctacatacgcatagtgtgtgcatt

SEQ ID NO: 16434 - DNA, 201 bp, Bos taurus
aggaactgagatcctgcgtgttgtgcggcatggccaaaaaacacataaataaaaacagattgaaaacagaatcacgcggtgcagttttggaggctgacttccacacatgaagaaggaggccacgtgacttgtatttcttcatcagagccaccacggaggaaaatcactggtgatttccttttctagttctccatgcctatc

SEQ ID NO: 16435 - DNA, 201 bp, Bos taurus
gcgagctctgggcacagggctctgggcgcccgctctgttaccggcttttcctggtgttggggtgaggggtgaagctcctttgctgctctctccttcccccaaaagcccgtggtcttccagtcaccttgccacccaacctgagttttattatttacagaccaacgctaagtttttgtcttctcttcctctctgccgcctgcc

SEQ ID NO: 16436 - DNA, 201 bp, Bos taurus
gtcttccacttctgccagtgtgtttctgttttgtaaataagtcacttgtatcattatttcagattccacgtacagttcaatgtcgtcccaatagagcacattccctgcccgcggatgcatctacacacgcacctttctgaaatgtgccacatttccctgagcacacggaacgctagagtcctcaccatcagttccccagat

SEQ ID NO: 16437 - DNA, 201 bp, Bos taurus
gcattcgctttgctttggctgtggctcagtctgtagacagccttgccagtagcttacacttacgtgattgctccagtcagtcacccccagattataccatttggagcctggccgaactccagcgtgaaggtcaagatgccgcatgtgtagccgtcaggatactgacccctttggaccttatcttactttttgcccagcttt

SEQ ID NO: 16438 - DNA, 201 bp, Bos taurus
ggtagaaacagctttttgattcattttagttgccactatcaaacaccagctcaaacaggagacattaaccatagtgagttgaggggccttcaggaaagtcgggatgagaattcttttaatacttacttatttggctgtgccaagtcttggttgcagcacacaggagcctcactgcatcatgagggatctttcgttgtggcc

SEQ ID NO: 16439 - DNA, 201 bp, Bos taurus
gaaagagaaatcagctgagatcacaacattcaaagtttgaaggaaaatttcaaaggaaaaccagatacaagtgttatcatggattcagaaaggagcagaaacatttccaaaggtgtggacagcaaaaccataccccatccttccatgcgggtcgagggccgcaaagctaggcgggcagcagttcccttgggaagagtggtt

SEQ ID NO: 16440 - DNA, 201 bp, Bos taurus
taaaggtctatgttcaccattcaaaacctacctggcctgaaaggatgatagactctagtgcttttccagaagagggcaatttgttttctgtttgtagtctgttgtgctgttggtaaatcctaggtttttctcttatgcacataagtcaaaggaggaggaatttgcttctggttcaataagtatttctcctggaaggtagga

SEQ ID NO: 16441 - DNA, 201 bp, Bos taurus
gcttgcatctttaatatgccagcaccttctgtcttagaggcatatcgtgccagatggaacatttcataaacactataagaaacaaattacattaggtaccctggctagcacagtgacacacagcaccttgatataactcaattttgtctttgcctacgtctgaaccatcgcgttttaaaccagcactgggatagtataaac

SEQ ID NO: 16442 - DNA, 201 bp, Bos taurus
tccagttgattacaaaagagacaccaatggtttgatggtgggcccctaagagggttcaaaagtggagacacaaaatttttaggtttaaggctctgaagctgttacagttgtaaggccactcactaccttggcagaattttgtttatggtcttgtagtctcttcagagtggaaaggcattttaaatagaggttgagtaaact

SEQ ID NO: 16443 - DNA, 201 bp, Bos taurus
caaggattattagtgcacacggaagaggattttgtttcctttttaaaacaggtggtgagtgatgctaaagatgtatatggcactggagtgtgacggggccttctgcatttcctactttttggctcctgagcaccatgtgttgaaagcaaattggacaactgatacaaggacactcgacagtcagagcctcaatctgtggga

SEQ ID NO: 16444 - DNA, 201 bp, Bos taurus
gcatctcaaggtctggatatgttcaaatttgtgtttgcaaaggccccactgccagacacaaagcgattgctgggacaggcttcctgctgaggcaaatcagcgagcgttcacacggccttggcactctatgtttgcttttagggatgcttaatttttttctgggggttgttcaaaaccataggaaatagaaaacacataaag

SEQ ID NO: 16445 - DNA, 201 bp, Bos taurus
tgcacatgcaaaagtcacaagcagaaaagagctctattttcagtgcggtgagaaggaaaaattgagagcttagcatgggaggtctggccactggaagccttgggacgatgaggaaacttggattttgtcctgagggtaatgaagaattattttgtgacctgggaaaagtgatcagctttgcagtgtaggatgcctggtcag

SEQ ID NO: 16446 - DNA, 201 bp, Bos taurus
tgacccaaactggccaggccacagagccccggcttccggatcacagcactgagatgaaggtgaaatctgagtgaagcagggttcagggtgagttcctccaaggtggcacttctccacgcagacgagaagtttgtggtgcctggggatgaagcccacctccaaggaggggcagcgcaatgttcggcttccaaatcatgagca

SEQ ID NO: 16447 - DNA, 201 bp, Bos taurus
gcaaggagggaaaagaccagcgcaaacggccagggcccaaagtcacctcagttgttaagatctctaccagccacccagtgattccaagagcgccacccctacaccccttcagggccaccttcctggtacctcaggtgggtagaaaccaaggaagcagaaccaagaaacctcaccacggggccgtctgattgcaaagctctc

SEQ ID NO: 16448 - DNA, 201 bp, Bos taurus
ggtacagttgggagttgtccccagccctgactcctgacacacgcagacacacgctgcttcagtatgtctctgtcctggcctttcttttgctattggtcacgttgattcatgtattgtctttgtcttctctgctgggctgagatgtcctttgaaaagggtgccttctgtgtgcccagggcctggcacatagaagggactgaa

SEQ ID NO: 16449 - DNA, 201 bp, Bos taurus
caacattggagaaatacaagaccacaagcataaaggaaaaaggccccatgagaaggcagtacgtcttttttgggaccagtgtggttaaaaatgacagtcactaaccttgtttacaaataactaggcccatttaaaagcactgtggatagggataattccaaaacaagcatccagcccaaggatctgagtggtacacatgca

SEQ ID NO: 16450 - DNA, 201 bp, Bos taurus
ctggtcacagggccattcattcacctctgcccttgggcaggggtatctctccttagcctgaagttagagatgtcagggccctgggtgagcagcagacccaggagcacactccccattctgaacccccataatgcccattcccaccgtaaccagacaacctaccaggtgaccttccttccccctgctggcctggactcagcg

SEQ ID NO: 16451 - DNA, 201 bp, Bos taurus
tgtggtgaaggaaaatgcatttattgcaggtgccaaacaagaaatgttggcagctaatgcttaaaaaaccttaattccccagtgggtttcagggaagggtctttacaggccaggtgagggaggggcttcagggtgtgtaatcagctcatgcacgatcttttggttgttggaggggtgacaaggtggtgtcacaaacacctt

SEQ ID NO: 16452 - DNA, 201 bp, Bos taurus
aggctcaccactcaattagtggctcctttgtagagtggtctccacacacatcaccatttaatgagaagtcccgctgggccctgtgcacctgctcctgtacggagtttccactgggatatagtctctgtgagttgctgtgggtggggaggcttgtggttttctcatctgcaggaaataggaggttaggggcctgcctgtccc

SEQ ID NO: 16453 - DNA, 201 bp, Bos taurus
gcagtgtgaagctgaccccttgttcaggatgtgttgaagtcaaaattcctgggattgaggctctaaggtctctccctgccctggggctggagggagggccggtctgagttcagggtgccttgctgtgaatccaggttccagctgtggctcccaccgtcttccgcagggcccagggccatgaggccttaggcctggctctct

SEQ ID NO: 16454 - DNA, 201 bp, Bos taurus
cctcccgcagcagctgtttgtggtggagcagatgtggatggtgaggtgacctgcatgggtgcagccccatgctgccccagggctgggccaggtgcattccgagaggatttggtgaaatcccacgccatgcggctcagctgcaaccagcagagactgaagggacccaatttgcggcccaggaacccgtactcttatcctctc

SEQ ID NO: 16455 - DNA, 201 bp, Bos taurus
aggatttctgccagcctttaattgctaccttgaaaaattctgcatccctctcagcattagaccaaagtgcagtgtggtttcttgggcatagtgaactaaaagtgcatgtttgtcagatgaaaggcatttcatggaagcagtgaaagaagaactccaaactgctcctggctctatagcctgcaattggaactctaacttctc

SEQ ID NO: 16456 - DNA, 201 bp, Bos taurus
ctaaggaaatggtagaggatcagatcacttctgagaacatccagatcaaagaaagatatgaaccatcttgttacatgcttgaaaacatgtaacaagtgctatgtaatataaatcaatcaacttgcacctagagaagtcaaagcaaacctccaaccgagcaaagacaaaatttcaaaactcagaaagaacatgccatctact

SEQ ID NO: 16457 - DNA, 201 bp, Bos taurus
acagaagaagttaaaaccgagggaaccactttggaagtgacaggtgcaagagattaaaaccctgttgttagtactgacagcataggaagaggcttatagaccttgagaaatataagctggaccaaggaactatccaaaaatgaactgaccccacactgcccacaacaacatcagagaaagtcctagatatatttttactat

SEQ ID NO: 16458 - DNA, 201 bp, Bos taurus
gtttgatccccttgtagtccaagggactctctagagtcttgtccaacaccacagtccaaaagcatccattctttagcagtcagtcttctttaagggccaactttcacatccatacatagctactggaaacccatagatttgactagacagactttgtcagcaaagtaatgtctctgttttttaatatgctgtctatttagg

SEQ ID NO: 16459 - DNA, 201 bp, Bos taurus
cacacacaaaacaaggttatatattgatcagttgataaaaatattgtgacctaaccctattttccccctggaaacagtggttcagtatttgctaactgagatttcccagtgattctatggaacttaacgaccacatatgagactcgactgtgtattttatactgtttagaaatagccattcagggacgttaccaggggttg

SEQ ID NO: 16460 - DNA, 201 bp, Bos taurus
cttcctgggcaagatgaggagctggcttaacctcggcagggtccaggtgtttatggcagtcgggctagagcacactcccccaaggagaaaataagttacttatgccagtgtttgtataggagaatgagtgacactcaaattcatacttaaaaaataaaagaaaaggtggttctctcctagttgttacttgcatgtattttg

SEQ ID NO: 16461 - DNA, 201 bp, Bos taurus
actccaaggggccttcctgacctagggatcaaacccgcatctcttgcgtctcttgcactggcaggctgattcttcaccactagtgccatcttccttactgtttgtttgattacttggcctttccattactggggaaagtgtatgaaaatcttctcctgtaatgatagatatatcactttttcatttttgcacttttgacaa

SEQ ID NO: 16462 - DNA, 201 bp, Bos taurus
aatgagtgccatggagactctgagaaaacccagttggtagaaaagtagaccagggcacagcaagattctgcttgcctgaagaaaggccagagactaaagaaatcatgttccagtggtagcatatcagcctgggataggatggtgggtgcacaaacccctgggtcagaattctgactttgtctttgtacaaaggccattgca

SEQ ID NO: 16463 - DNA, 201 bp, Bos taurus
gcctagaaacagtgagtgaagaataaagcagaaatacagagacagcaaagagagagggggcctctgagggtcccacagtctggcatgtttctgagacccagctatattcctgtccttgggttccataaaacatccctctaatctaatgatattatgacactctattttcctttcagaaaggataggggctcaaacatgtac

SEQ ID NO: 16464 - DNA, 201 bp, Bos taurus
gtaaagaaatgaaattggtaattgggccaacggctgcacgtgaagcctctgtctaaggttgaggagcaagctgtttttaagacagaagactaaactagggggcagaaggccatccatgctaccattaataaaaagctcaggctgccctgggagtgttacatctgttatcttcatctaaacattgaaaatatgcctggaaag

SEQ ID NO: 16465 - DNA, 201 bp, Bos taurus
ggagactgttggctttggttagtatactgatgacacagagcatggttttgcctgcttcaaagtggggtaggtgagagccagcccagaaaactgcaggcctcttgtgagagcagccggcatccaggttggtttactaaaaatccttacttgggaatggtgagagccatgtagcagtattgattgaggccacctctacaggtg

SEQ ID NO: 16466 - DNA, 201 bp, Bos taurus
gcgttggcaggcatattctttactagggccacctttggaagcctaaaacaaaggataagctagtccaaaatgtcagtactgctgaggctgagaaagcctaagatagaggaactgtacagacatttgtcaagaataatctggtactattccaccaaaccgagtgtcccctattctgggactctgctgttcccctccagaaca

SEQ ID NO: 16467 - DNA, 201 bp, Bos taurus
gggtgggtgttttgttccattcagacttggccaaagaaatcagccttgaagtggctctgggcacaagctcctcagagcccatatcattccacatccagccagagagctgggccacaactgctggctccactaggaaacagtggccattcaggtgtcgtgtggaaatgtgtctggttgaactaataatcatatggatatgat

SEQ ID NO: 16468 - DNA, 201 bp, Bos taurus
agtacttaacacgcatcgttttaagttttttattatttttttaatgttggctgtgctgagtctttattgctttgcatgggcttttctaattgcagcaggcaggggctactctctagtttcagtgctctggccccattgcagtagcttcccttgttgcagagtacaggctccagggtgcgtgggcttcagtcgttgtggctc

SEQ ID NO: 16469 - DNA, 201 bp, Bos taurus
cctcctctctgagaagagagataccttgaggggtatcacgggtggtgacagagagctggacgctcatctggtccaagtgtgtcacccacaacatccacacgtcatgtggccgttgatcattagtgtgaggcagatcagggttagtgaagaccagtaaagaatacaataatagtatggaaaacagtaacatgtctgagtttg

SEQ ID NO: 16470 - DNA, 201 bp, Bos taurus
ccaggatatttgcctccatccttttgcatttccaacacgcagtggattcagtaggaccaccagcaggaatccaggcctcccctgagctaggaatggctacggcctgcatttcccagttggccgtcagagggcgacagtcccacctctcttaccagtgcaggggctccggattctgcccccagacttggccctgtgcacagc

SEQ ID NO: 16471 - DNA, 201 bp, Bos taurus
acccttaaagggagactggcatcaggagtgtgtgaaggtcagagcaaggtcaacaatgtgcctgggagcacgtgtctggtgaggtctgagtctgataaggcccctgactttccatagagtaagacttgcctcttctacagcttctgtacattttaatacctacatttaaacacatacatttagtacttgttgctgaaaata

SEQ ID NO: 16472 - DNA, 201 bp, Bos taurus
gcttcatttccattccatttacctgtctgcagaccagagggctaagtgatggatatgatgctacacttctgcacaccctagaatggacacaccctgcttgtctgaccttcccatagtgagacgaggatattagctatgactatgtcctcatgcataaagaatgatgctgctacgactgttatttcattctttctgggtaat

SEQ ID NO: 16473 - DNA, 201 bp, Bos taurus
gagtataaaatagcttcaaattaaatgttgttcctacagattcaataagttactgtacccacaaaatgagggggagaaggatttcaaaaaattagagggcctaacaaaaattgattgctaaaataagagaaattcagtacacagtttgggagataaagtcaaagtaatctcccagaatgtagatgcgaatatcaagagatg

SEQ ID NO: 16474 - DNA, 201 bp, Bos taurus
catgttagaaaggaccctgccacacacacaagggacgatggggagcatacagaatgatgaaatttggggttccattaaataaacactacaggagacatttggggccagcctttccagctctctggacatatagtcaggcaggccacaaaagacccccacaccacccaacattcaaagtaggcttttgcttccaggaagagt

SEQ ID NO: 16475 - DNA, 201 bp, Bos taurus
tgctcagtgccgatgccagcccctaagagcctcttctcctctttcgctccctggaccactcctggtcacaactgagaccctgggcggtgggcctcagctctgagctgaccacacaagcagacgaggacagtgcacagctgacgacactcatcaccacggagaatgggtgccccaggctgggccccagcatttctggatctg

SEQ ID NO: 16476 - DNA, 201 bp, Bos taurus
tggccattacataccacacactttactagtgataaccatggtgaatgcttctgtgcaattttagaagtcaactactcaggtttagttgttggtttgaatatgtcaggcctcaatgttgagaaaggcagatctcaggattatccattccgaatatcatggtgtctgcttcctctggctgagaatgcagtgttaatttgctag

SEQ ID NO: 16477 - DNA, 201 bp, Bos taurus
ggactcctgctggtgccagaacaggaggcccagggtcacatcaggaaggaacagaagcctcaggacacgccacagccctgcagccagccagagggaacacgatcatcctcccaggcctctcaggctggttatgtaatgttccacagaatcgtgtaggcctctataaaaacagttgttttcaacgacaaaaatacttccatt

SEQ ID NO: 16478 - DNA, 201 bp, Bos taurus
ccaaaagcaagggtcagacggaacttaagctggctttgtggctctcatttactgccccctaatgaaagacatccttctgggatcctacccggccatgtgtgctcagcctggtgtctcccacggcttttgatgttttgacatgacacacagagagtcgatgtgcactaaaatcatcctattggtatataggctgttgtttaa

SEQ ID NO: 16479 - DNA, 201 bp, Bos taurus
ttagtcacaaacatgaacagttgagcattctggtcactaacatccatctttatggctagaatacaagggacatgcatcaagctgtcttatttatctctggcggcatttttcatctggtgcacagggctttgtccatgttgtcatattttatttgtctatccatcttgtaaatggttgttccttgttgtcaagcattgccat

SEQ ID NO: 16480 - DNA, 201 bp, Bos taurus
aaggccagggggtccctatagggtatgtctactgtgtgccactagtcagagaacaaagtcagaagaaactgagggatgttgggctgtttgtttgaacatcgatgcatcttagaggccagagcttccacaaactgacagagcccttttcaggtgctccacgccctagaagctgtctctttgtatcagaaacgcaaagcagcc

SEQ ID NO: 16481 - DNA, 201 bp, Bos taurus
cagacgacggggagcccaggatttaggtcatccccaggcggaagtagagaaggaagtgtctcgtctttaaagtcagagtggaagaggtgaatgaaaacgccgcccaaacctcgtggcattagtaggacgactggaaaattccacctgaagttgctgaaatgaatttgtcttttttcccagaagtgaaaaataaacaaattc

SEQ ID NO: 16482 - DNA, 201 bp, Bos taurus
cagccttgctcccctaactgagcccctcagcataccagtgacactcgaaaacgcaaatcagaagcccctcgcctcagtggccgactccttttccttatagcgtcctctgttccacattcagcctcctctgtccccagccagcctgaactcttccatttcctctagggccgctctcctgccttttggcctttgtgtatattg

SEQ ID NO: 16483 - DNA, 201 bp, Bos taurus
aagtcgaagtcatcatccccatagttcaacgtgtatgtttagaggtagggcctttaaagaggtaatgaagttaaaatgaggagccagtgagaaggtggctatctataagccaagggaagtggcctcagaagaaaccaactttgtagaccctttgatcttggacttccagcccccagaactgggagcaaatacatttcttgg

SEQ ID NO: 16484 - DNA, 201 bp, Bos taurus
atccaagggacagcagcattcaaggcagcagtcttcaaacttaatggtgcacaaaaattacttcaggtattgtttcccaaactctctcacctcttggcatccagagaaatgatcctattgataagaaacctgggatcaatgaatgaagccattcttgtaggaggataaccagcccagagcctgtgactttctttgccacta

SEQ ID NO: 16485 - DNA, 201 bp, Bos taurus
cttgtgtgctctgttctcttcctcacagctctgccagctgccgtgtgagccagtttcggcaggctggaagataatggaggatgagagcacgtggaccatcgaggagcctttccaaatgaggcctccttgaccagtctcccctagatgagccaccagctgaccagagatacaggagcaagatgaaagagatgctagtttgat

SEQ ID NO: 16486 - DNA, 201 bp, Bos taurus
tttgcttgagcagtaacaacaagcagatgacttctcctttgtggcttaagaagcatagaaggaagatactatcagagacatatggcaacatttaattgtaagtctcctgatggaaacattgaccctacagcataaaagataatatccacttcaaggtgaacttgccagagttgaatgaaacaatgtatatgagtgtgtctt

SEQ ID NO: 16487 - DNA, 201 bp, Bos taurus
tgacagcaagatatttcaaaatacttaaggacttttgcctgcagctaaaaagaaaaaaaaaaaaaacgcaataagtacacataatggaaatctctccccagtggccttttcatttcctctcagcccaggggaaagtatttgactggggagcagaaatagggagggtttgcagccagcagtattaaagggcaagaaaagata

SEQ ID NO: 16488 - DNA, 201 bp, Bos taurus
atgaggaggcctgttgtgatggagatggcccgcatggctgtagtagaaggagggaaggggagaagtgggcactgagatcagagagggaggctgaggcgccaggagagggggcctgttgccctgagtgagatgggagctgctgttggtatggactggcctttgtgtatggggctgtcctcttgtgtgtcaggcttgctttga

SEQ ID NO: 16489 - DNA, 201 bp, Bos taurus
gggtagggccacaaagatcctacactttccctgtctgttttgcagaaccgaacccaaaggggtagctgatcagcgatttgtaaccaggagtctatgtatgaaaactggtctgggtgcctgggggcccctgtccccactctgtatacagcgtaactacaagaaggtctttggctggccaccccaccctgaaggtgggccatt

SEQ ID NO: 16490 - DNA, 201 bp, Bos taurus
agaaagcactcataaccatgaagacccagcacagacaaagataaataaacatgcttaattatttaaaaaaaaaaaatccagtggaagtccctacaggactgctaggccccccaaccccacttctttagtgtatgtcaacctgaccttgtatcagtggattaacaaatgggcagttggaggaattccctggttgtccagtga

SEQ ID NO: 16491 - DNA, 201 bp, Bos taurus
agccagcccaggggcgctaacagctggtggaaaactgggccgtgtggacatcagagtctgaggatcacagtgagcagtgtagagtcagtgttttagttggttcaccatccctttactgatatgtactcacaccattctctgatggctcagagggtaaagaatctgcccacgatgcgggagactggagttcgaaccctggat

SEQ ID NO: 16492 - DNA, 201 bp, Bos taurus
cagctggggagacaggggacgcgtcacatttagacaagatgagagtggggccttggcagtgcctttgagtgcaggtgtttgcgtgtaggaggcaagaacccgggagaaagaggtggtgaaggccgagtgacaaatcaggttggagatggcactgtggggatgaacgggctggcccagaagcctgctggccacagacattgg

SEQ ID NO: 16493 - DNA, 201 bp, Bos taurus
gtcatcctctactttaccaaagtggaatactggagctcttttgatgacattccatggggaaacctttgtggattttcagtcctcttattgagtaagtggcgactaccctgccagaatccccagaaagcagggactgacagtgggatccagaaacccatgccctgaaggagaaaagcaagtctattattatcctcaagttct

SEQ ID NO: 16494 - DNA, 201 bp, Bos taurus
aaaggcagactggtcctagaatcccatctggggctgctacatgggcgctgtgctcataaaagtagctaatggacttgagagtggccgctttcaacacagaaatgtgactagatcaatcgagcaagcaaagaatcaataaggaaggcagctccctggccaaagtctggcagagagagttccgtgaggacttctgatggaaag

SEQ ID NO: 16495 - DNA, 201 bp, Bos taurus
ctttccaccttaatttctgttcacctcatccagcgacctctcctgatcccccacaggtctacaagttctgatcaggagccccgaccctggggccccatcccagtgcttatggctttcaaggcatcgtgttaagattagctgtttacttatcaattcccttgttggccaatgttctctgagggtagaggacatatcttttat

SEQ ID NO: 16496 - DNA, 201 bp, Bos taurus
ttgcccaccccccgccttccccgccccccgccccaaccctgctctgcttcctgccgcagccactgggcaccttgtcctttcctcaagcagcctgattttccagccaccaaaaataccaacatttgataccaggcctctgaaagctttggctggggtcatgtttccaaattcttgactcgagaattgttaaatgagaactcc

SEQ ID NO: 16497 - DNA, 201 bp, Bos taurus
cagcgggggccaacctgagccttaggtggcacatcagagcttatttgcatcagatgattgtgtgctgatcaccgttggccccagaaaggctccccagggtgtaaggacgtgcagggaccagtttctccaatggcaccccaatccattgaacctgggactctgtgttaggagtttttgtgacttcgttatacagatatatca

SEQ ID NO: 16498 - DNA, 201 bp, Bos taurus
agatattcacaaacacaaccgaaggaggggatcactcctgcccgggctgcagcccatcccccagatgggaccaagagaccagggagtaatgcagggaaacacatgatacttccaaagccagaatgtccacatggtcaactgattgaaaaccgcagcgccccagatgcccaaatacgcattcttgaatttctgcatttatcc

SEQ ID NO: 16499 - DNA, 201 bp, Bos taurus
taaatcttaacaatgttactgggtagaaactacccacaaataatacctaacaagtatcattacaagccttattctgctttatcctttttctgaaggataacagcctagagtgctttcctacaaagagtgctgtacatacactttggccacgttactggaaaaaacttttggaggagcacaaagatttctataatttcagca

SEQ ID NO: 16500 - DNA, 201 bp, Bos taurus
ttctccactgactgccactctgctggcagcaagccctggagcgtgaacgagcaccgttctgctccgtgtttcatcatcagggcctaagaatcctgcccccagagttctgagtgttattcccaagccttcgtgcagtctgtcctttcagatctccttaggtcaggagctggcaagctgtcccctaaggagccagggaataaa

SEQ ID NO: 16501 - DNA, 201 bp, Bos taurus
aagccaagggctctcccctgactgcctgggttgcagtcccctcctctctactccaggcgtctccttcagcccacagaggcaaggggtcttctccatggccgctgtgttaggatgaccacagaattcacccaacagttcctcccacaaccactgtgaaccggtcttcaccactgcccaggccagcacgcgcaagaaggtggc

SEQ ID NO: 16502 - DNA, 201 bp, Bos taurus
ctttgtcatagcaagtagctggccaaggatgctagcctgagtaacatctctgttcctaggtggggaaggacacagcttgatttccaagccaaggccagcagcccatggagatggcttgtatctcctgctgctcccccatcacccactcacacgagggataatgtgaaatgaggggtgaaacagcctccataagggccttac

SEQ ID NO: 16503 - DNA, 201 bp, Bos taurus
cctccaccagctaaaacaccacaaaaccccacaggtcaccagggtgtggatgttgcagagccccccacactgggccccagaggggaatccctgagggccttgcttgtctgtctgatgaagttcataggcaactcgtgactgaagagtgtataagtgaaactactacataaggcacacggagttggcctatttatctagaga

SEQ ID NO: 16504 - DNA, 201 bp, Bos taurus
aatagaataactggaactaggaataaattgtttatagggttcctgatatattatgtcaaagtatacaatgccaccaaacctctgatcaagagctaagatacattcttcctactgtggagatgagttcctaaaaaaactttttattttaacataaaaggtaaaatatagtatctaaaaatttttaaaaactaaattagcctc

SEQ ID NO: 16505 - DNA, 201 bp, Bos taurus
tctctctgttttcaaaccttttcatcaccccgaggaccccacagggaggaaggagtcattcttgtttccatttctccaaggccctggcagcagcaactaacatgctttctatctttatagattcacttattctggacatttcatataaaaggaagcatgcaatattgcaggggcccccgaactctgagatctaatgcttga

SEQ ID NO: 16506 - DNA, 201 bp, Bos taurus
aaatgggtccaggttggggaccagctgactcaccgcctggtggtcaaagaggatggttacatctgtgccattcacaaagtactcaggttggccaaaaagttcaatcagctttttctgtacgatcttatggaaaatctgaatgaactttctgaccaacctcatatgtatcacagggcttcccaggtggcccagtggtaaaga

SEQ ID NO: 16507 - DNA, 201 bp, Bos taurus
acccccccttctcagttagggtggtgggtgctctccctaaattcacgtttcttggaaggaagcctttcaaagccagcagccaggtctgctgtgttgacactgcacagcccgtaactgaccaccattgagactttgctcctgacttcctctctcagtttgtctagtatctctcattccattaagtcatcatctcttctctga

SEQ ID NO: 16508 - DNA, 201 bp, Bos taurus
attctctctaaccctttcagatggctctttccttgaacacgggtggcttcctcccaagcatgttctgatcagtatgcactcagatgggaaactcagaagttcagaagatgtccagagccctctccctgtgtgtggtcctctcctctctgatactttatcctatgaatacttgctgccttcttctccctggactctcagctt

SEQ ID NO: 16509 - DNA, 201 bp, Bos taurus
ggacagaggagcctggctgttcataggatcacaatgctttggacatgacttaagtgacttagcgtgcatgcatgcacaagggagtataaagtcctcatatgtaagaataaattagtgctgctaagaccaatgctaataaagaaacaacatttactgggaaatgacttactggcgtcctatggttgaggtcctggaatgtaa

SEQ ID NO: 16510 - DNA, 201 bp, Bos taurus
gggtgactgacttggccagaaagactgtcaggaggatacaaggacatctgagggtcactgacggtttctcactgctgggcttttcataatattccacccctaaacctctgcctacaaaggcctcatcaccaattacaatgagtgataggtgactccccacctgtcctgggtccccagcacactcactcctcagagcacctt

SEQ ID NO: 16511 - DNA, 201 bp, Bos taurus
ttttttttttttttttttaaacagtcagtattcatttagatttaccagtaagttacactggttagtacctttcattccttcctgcattaccatgcttacatgtgagatcatttttctcctgtctgaagaactttcgtaagatttcttttatcctgagtctactaacgataaatctgctcagtttttgtgtgaaaacatcta

SEQ ID NO: 16512 - DNA, 201 bp, Bos taurus
catgggcagaggagactggtggactacagtccctggggtcatgaagagtcagacacgactgagcgactaaatgccataagggattaagaagataaataccatgacgtcttaaagatgagtagtgacctcgtggaaatcacttcagcacaaggtccccatggaaatttcctacagaaaatgacttcctttcattgaaaaagc

SEQ ID NO: 16513 - DNA, 201 bp, Bos taurus
tctcctcctgcctgcacctgttaaattgagatattttgtttaaaaatgataatgccatctcccatttcttattgatgtagggccttttgtatgtcagtcacggtggaagtttatctcacttctcttctcactttgtcgatggcagaactggaataggggcccagctattgcaaattctaaagcccatgcttctcgctgtgc

SEQ ID NO: 16514 - DNA, 201 bp, Bos taurus
gcaaagcaaacagcaattgcctgagggctccagagagtttaacaaaagcaggaagattctggagagaagccagccttgggaaatagaattggggccgatcggttttacatttttaaggtttttagcctgaagattgtggtcgctaaacctttgaaagaacaagcacagtctctccgaagacaaaattcagggccttttgaa

SEQ ID NO: 16515 - DNA, 201 bp, Bos taurus
aagagaagctaaactatatcaaagaaaatcctctactgttttgaactgaatgtggcatgtatgtggtggagaagacccctttttcttgatcagctttagaacccaaatggatgagcgtagtttttgtagagttttaattctcattttcaaatgagaatattcagcatcccagatttcctggactaagctcactggcagtga

SEQ ID NO: 16516 - DNA, 201 bp, Bos taurus
gatgaaacactcattttttaccttcccctgcaattatttacctttcactagcctccattcaccaggtagtaagcaatggttttataccatctgcttatttttagcctcatttggttttgtgttatcgattcatcccagtctgtgcctctcctggcaggaagagctcctagtgcagagtgacgtaaggtttggaatcaggac

SEQ ID NO: 16517 - DNA, 201 bp, Bos taurus
agacctgtttcttgagggcaggcatctcacttgattttagtcaccatcatctgaactttacacagagctcagtaatatttgtcaaatgaatgaagcaacaaataagcaataaactcagtctctaggcaggcttgtacatagcaaatgcttatcatagaaacagggtgccttctgttctctctgtggctttgtgccagtctg

SEQ ID NO: 16518 - DNA, 201 bp, Bos taurus
gaggttgaaaataaaggagaggaacttgatgaagcatgatctgaggatgattaggggtggggaaatgaaatttacaacacaggtcaaaggccttatataaaaagaatacatacaccactaagcttgatgggggagcagtaaggatttaaaaaatgcagtaaactctgttatggaaaatcaagaagctgggggaactgttac

SEQ ID NO: 16519 - DNA, 201 bp, Bos taurus
ggcttactttgtttacaccaactgtgttaccggaagaaaagagaaggaagaactattttccaagatacaaatttcatcccttgcccacttgggcctggccttctttccgtcttctctgggagagagggggacccttcccgcctcggttcatacatgcactcatccacatcgctggccccgtgtccccctgtgggcagttgc

SEQ ID NO: 16520 - DNA, 201 bp, Bos taurus
gcaaaaagtggggccaccactgcgatctctctctccttatgtgccagcaagggcactgagggagggagtctccttttggagctggctagcatgcccctattatcacctcttggcccctcccctcctacctggtgacctgcttcacgatcgctgctttggctccctctagactgacaggctcatgggttccaattactactg

SEQ ID NO: 16521 - DNA, 201 bp, Bos taurus
tggcctggagaattccatggactgtacagtccatggagttgcaatgagtcggactcaactgagaaactttcactttcacttcagttagtgactgagtcaagaaccacggccccagaaagcttctagactgtcttctccttatcatgacaacttctgaatgaaatggaaatcagagaagcaacagaatcaatcactcagaaa

SEQ ID NO: 16522 - DNA, 201 bp, Bos taurus
ctgtgtaacagtatgtataatggcttcccaagtcaattgcttcatcccaaacatttgtatatgtttttaactacctcttcactaacgtcactgcacatataaatttgccttttttggctgtaaaattgccatccaattgtgaccgtgtttcacaatgcatatacctgtccttaactggcttttcctatcacctctatcaga

SEQ ID NO: 16523 - DNA, 201 bp, Bos taurus
tataaaggcagaatttgaagtgatgaggctggaagtaaaggcatgcaaacagtcaccagaagccggtagagacaaagtatggattttttcctgaaacttccgaaaggagtgtcgtgtttctaataccttgattttgaacctaagttattcagaatggtgagagaattcatttctgttgttttaaaccatccagtctgtggc

SEQ ID NO: 16524 - DNA, 201 bp, Bos taurus
aacagtgatgggcaattgtcatgcagaggtgcaaaacgttcctctccaaaatgtctccgtgccatgtggattgtttgttttcaaaaacaatcaaggcccagtatactcaagaagaaactttgatctttcccttaaatacctaaaagaatttggatagaggacctattcccagaatagagctatcaccagaggaatctgcat

SEQ ID NO: 16525 - DNA, 201 bp, Bos taurus
taccattttatggtaatgtcattgtcattgggttttgatgatagaacttgagacatttaggaaattatgctgaaagtgtaacctgtaaagtataccttacatgataaggcctatgactagctaaccatatcatatgatgtgccctgatataatggatgcatactttagttcaaatttttgtttttatctatgctttaatca

SEQ ID NO: 16526 - DNA, 201 bp, Bos taurus
tgctaaagcaatatgaattttatgatttttaaaatcctagaaaatagtttttgttgtatgattttatgagtgaaattatagattcatgtttctattttcaatgtggaaacattatttaagaaatagtgacaggcttctctggtggttcattggtaaagaatctgcctgccaatatgggagacacagattcaatccctgtct

SEQ ID NO: 16527 - DNA, 201 bp, Bos taurus
tgaaaattcaccaaaacttgaagcttcatatataggggacctactgtgttgttcacctcacatcctgcatggggtttccttgcattcatgccaaggccatgcttctcccagtttctcccatcaaataaaagaataacagaataacagataaagaataaagataacagataaagaataatagaaatactgtgttggcctatt

SEQ ID NO: 16528 - DNA, 201 bp, Bos taurus
gcattacacaaaggtcctttcttcatgaagaaacccaaacctcccctctattgcttgcaacatcggcagacaggctctagagaaaacaccatgctccaggcggagagggactttgtctgtctgcttccaccatcttccattgggcagtgtttgcccacagggagttccagtttgcatttgacaggtcagatgatggaactg

SEQ ID NO: 16529 - DNA, 201 bp, Bos taurus
ggcaagtcggtgccatcccgaatccccacgctcctcgtcagttcgcctgggcggcgagggctcttctggaaagacgagtgatgaaccgaagggtggccccgggcttgggcgctcagtcctaggacactctcttccagaacgctgagcgggaggcgaccagcgcacagtggaccgggcgcctcccgcgcttcgggggatcgc

SEQ ID NO: 16530 - DNA, 201 bp, Bos taurus
atgatttctttttacattattttttgactttgttggaattaatactgtctcatagtctccctttcttccctgcatctccctccttcccttcctgtctttcgtctcttcggagtcttcgggccttttgctccagtcaggactggatgctctctggaccttccagatagctttcctctagcattttcccctcagtatacccat

SEQ ID NO: 16531 - DNA, 201 bp, Bos taurus
ccatcaccaatgctttgagatgaaccaaattgagaaacgagctttgagtgatatgtaaatcattgaaaacaactggaataacagagacggcaaccagttagagggatgtggccatggtgctagaccaggaaactcaccatgccactcactagatctcccgtggaaaagtgcttgagtttcttaggttatgaatcaggcctg

SEQ ID NO: 16532 - DNA, 201 bp, Bos taurus
gcatataaaaaggcaatctattcccacactaggcacaggacaaaagaatcataccagaatctgtgatgactaatgctttatttataaggggagctatggtcctggggttaaccctaaccaaaggactgtgagggagaaaaagcatcaaagcccatcaaagcaatgagttatgggctagtcctccagaggcttaaagaggca

SEQ ID NO: 16533 - DNA, 201 bp, Bos taurus
acctggcctagctgtacccaggtgaagcaggatacattagtattttgcccacattgtgccttgaactgcaatgaagtcagtgccacattttgctatacatacaattctggccaaatgaagctggtttaaatgccgtctaggctgaggcagggtcatgaatctcttcagctaaattcaagaacaaatttcacacctctttct

SEQ ID NO: 16534 - DNA, 201 bp, Bos taurus
actggggtggagggggccatctcagggggtcaaatcctagatgatagaggggcagccccagccagcccacctctccaggcacatgtagccctgcatcgagaagggcttgataggagccagcaggccagacatgcaagcaacagcattatcacctccagggccatttcctctcctccctgagcttgggagggcaaacaccca

SEQ ID NO: 16535 - DNA, 201 bp, Bos taurus
gaggggaccatgctgggcacgtcagggtgcttccacagtgggtcactgttgtaatttaagtcatcactttggggcgggggtggggtacttcaaaggccccggcaataaaagtttcctgtctgcacttagaaagtttcatcctctgcgggaaaggggaggcagagcttcaggggacacggtggggtcaggaggagactgcgc

SEQ ID NO: 16536 - DNA, 201 bp, Bos taurus
ttgagggtttggcagaatttgtgccatggatttgcccgctggtgtctctatagttttggggcctggtccttcctttgatgacccacacttttcctgctgcgaaccattcttgccacaacaagctgcccaggaaggctcattttcaatgctccatcagtgcttgtttctggaatctttttcttctcatttgatgtgaggttt

SEQ ID NO: 16537 - DNA, 201 bp, Bos taurus
ttgagcccatttagataatccaagataatctccttatttacaaaattatttttattatttatttaattagctgctccgggtcttaattatggcctgtgagatctttagttgcagaaggtgagctctcagttgcagcatgtaagatctacttccctgaccagggtccaagcccgggccccctgcattgggagtgcagagttg

SEQ ID NO: 16538 - DNA, 201 bp, Bos taurus
agcattttactctctgggtgctggaagcacaggtgtgggaactagagtagaagccaaaaatctaatgattttgaatttccacagaacagggctctgggctataaaaccctgagctgaagacacagtgggaataatgagaagcagttgcgttgttttctatcatttttaggttttagaggggtgcagggaaaagggggtcac

SEQ ID NO: 16539 - DNA, 201 bp, Bos taurus
ctcactgagtgcattaagagcttcctacactcctggcaatccatcttctctttgtatttaggaacctttgatcccactttttgcctgaactggctgggattacaacttgctttcagtataagggggactctggtctatttgtgccagtgatatttcattttctaagttttgatttatagatctgagagtggcagtgagtga

SEQ ID NO: 16540 - DNA, 201 bp, Bos taurus
ttcctcactctgcacgcctcctcaattcccccagggccaagactaagaaagggcagacacaaatagctgcatggtggaggctgacttaattgcttggtcacggtgttacttgggccttctctgaatccctcctccagatgcttacctaattttcctcctccttgctctattttttttccctttgaaagaaaatgtagatgg

SEQ ID NO: 16541 - DNA, 201 bp, Bos taurus
ggggtgtccatcttatgtcctgccccacttcatttctatttgaaaaacaggtcttgaaataaacattaaaaatgttaccaactttctctcttggctagaaggtgtgtacataattatatttcttttttacttttctatttttaaaaaatgttctcaagacaaaaatgataagtaattaaagatctagcacctgagaactaa

SEQ ID NO: 16542 - DNA, 201 bp, Bos taurus
gagcagcagacgaagcttcacgcttgctcactcacctcctgctgtgtggcctgggttcctaacaggccaggaacccaatctgtggcccagaggttttggggactcctgctttatttgggttcattgtcctgaacccactggcagccatttgttatgggtcatgtgattctgtaggactggccacttccccctgggggtgtt

SEQ ID NO: 16543 - DNA, 201 bp, Bos taurus
caaggtgactttcctctggctcttctgcgaggcccctcctatttctctttggttcctcttctgagatttttccaggaagttccttcagctcctcaactgaggattgaatgaaggaggattctttgcattgggacagtgtgagaagcattagagcagtaacatgagggggatgatctttcctgtcttctttaaggtctttat

SEQ ID NO: 16544 - DNA, 201 bp, Bos taurus
gtgggccagtggttaagactctgcacttccactgcaggcagcatgagtttgatctctagtcaggaactaagattctgcacgccacatggcttgggcaaaagtagacaggccaacaaaaccaaaaagtgtgtgacccctcttacaaaaagtcataacagcacagtgctgggctggatcctaaactcaccaagccatttctgc

SEQ ID NO: 16545 - DNA, 201 bp, Bos taurus
aggctattgcctgcagaggtcaaacgattcccacaaagggcagtggctctgaaagtaaccagaggcccaagccccctaagtcagtggcccactttaaacacgagctgacataagagcagagtcaaataatgcggatcatcccttggatgtcaacagctgggaccacccaccctttcttttcctagactcacataagtgaag

SEQ ID NO: 16546 - DNA, 201 bp, Bos taurus
tcttctagcacacaggccattgagcaaagaatgttttttcttttttttcatttttaaagaattggagggggaaaaagtgaacaaagaagaatatgtgatacggacatatgtggccagatctaaaatattctctgatccttgaaagaaaaatgttacacatttctgatctaggcagaagggaaaattttctccaaaagaagg

SEQ ID NO: 16547 - DNA, 201 bp, Bos taurus
tactgtaaagactctatatgataagtaactctatatgataactctatatctaactcctaactatatctaatttcctcttatgcaactataaattatgtgactatatctgaactcagacatcaaaattagtactatatcttgtctctatcgtctcttttttgtaggctgaacatagaattcattgatgttacaatttttcaa

SEQ ID NO: 16548 - DNA, 201 bp, Bos taurus
agcagaaagctctgatgacagtggaatgagaaatggaagctaatgttctccagcattcttgccttgctgatgaatgatacatttcttaagtaccttgtaattcatttagtttccttcttggtaaaaggtgtgacagcattctctgtaaatgagatttttttttttttttttgtaaatgagattttgcaacagagcaagaag

SEQ ID NO: 16549 - DNA, 201 bp, Bos taurus
atggggaggctaactgtctctcccttggaggaaaaaagaagaaaatgaaaatggactaaagcattccccattacctcagagcttaacactagctgtttcctgagtaaaaaaaaatcatagaggcatttaaaaataattggttgaaaagcataatgcttctcttgtggtcatctggtctgtatttctctcatatttgtcaat

SEQ ID NO: 16550 - DNA, 201 bp, Bos taurus
tacttgttctgggaagctgtctcccccttccactgccattctctgtggccaagtatgaaacctgatcactcaattagttaacactctggacacagcattgcgtctaaaaatacccgccttggggaatgtaaaggtttcccctgactcctagtaaggaggcccaaactggtcagaatgtccctaagtattgaaacaaggggt

SEQ ID NO: 16551 - DNA, 201 bp, Bos taurus
cacttaaggttacaatggcatatgttttatacagcttgccacaattttaaaaatgggggcggggtgctcttatttaataatatgggcctggtaaagggagcgggggcatggttaaaaaaacccactaagcactctatgcaaattagtgatacagatggaaagcaagaagggacatttgcaccacctactggcctttgggat

SEQ ID NO: 16552 - DNA, 201 bp, Bos taurus
tgaaggccctggtttctgacccattccctcaaggagcaacatcctttccctgacactgagtctcagggagaaactcttttctcaaaccttaacaaaaactcatgaatgccatgcttcccaggccactttattacactgccaaataataattaaaattagaattaaagtaacacataataataaacataatgtttcacagtt

SEQ ID NO: 16553 - DNA, 201 bp, Bos taurus
ttgtgcttcatccagtctggcaattctcatgatgtactgtacatataagttaaataagcagggtgacaatatacagccttgtcatactcctttcccaattcagctccatagtccacagaatttcaatactctgtagtttccaaaagattttcacttgctaccaagaattaagcatgaattcaaaaatttttaataaaaaaa

SEQ ID NO: 16554 - DNA, 201 bp, Bos taurus
tccattgcagccaagctagcattacctatttcttacggctgccttcccaatcgtcttaagcttagttcaacccaatgtacataagaacgtttcaggccacacaatttgtccttctctgaatctgtgcagcaaaccgtataaaattttgtttcccttagatttcctggcttctttggggccactgacccccatgaacacagc

SEQ ID NO: 16555 - DNA, 201 bp, Bos taurus
ttattttgcctccatatggaagaacatagcacacaacctatgcagaagttctaccaatagaagacaaaaaagagagaaagatctgaatctgacagaacttctaaatccaactgccaatttaataaaagtagtataaaataaaattcaatgataccaccaaatgccatgaaatcaggggatgcaatcagtaaacaagtgact

SEQ ID NO: 16556 - DNA, 201 bp, Bos taurus
tagattctgactccaaattcccttccctgcttaacacctaaggggccctctaccctctgatcaaggcaccctgaattatatgggcagacttcagggctttcctcatacaacttctgcttggaaggcctgcttcaccattccttctccagtgttcctagagaatgtcacatccaatatttcttcaaatgtcacatcctcttt

SEQ ID NO: 16557 - DNA, 201 bp, Bos taurus
ggcgtgctgcagtccatggggtcgcaaacagtaggataggactgagcgactgaactgaatgatactgaacctcctctcatgtgccattatatcttttttgaggaaatatctgttcatctctttggcctactttataaatggattttttaaactactgaattctgagaggttttttttttcccccaaaagtatattctggga

SEQ ID NO: 16558 - DNA, 201 bp, Bos taurus
tctcagttattattagaccactcccatctcagttcttagggcctaacagagaagaaacgaattgtctgagcacttcggctacttgatgttaagggcctgtaggcatctcttgatgttaagggactgtcccctgcttgggctggggtctctggaatgtgccctgaggccaaaggtacagcctcttgtggtacaacttagccc

SEQ ID NO: 16559 - DNA, 201 bp, Bos taurus
agtctgtgttccttcaattctccacctcctgccagatctggtgggcactctcagctagcactggagcccctttaaaatggccctccgtctcatcatatccggtaggtgccctgagctgttatcagagcccctccaatcatccccaaccaaagtggctcaccccaaggggctggccatacagaccagagcacccacaacagt

SEQ ID NO: 16560 - DNA, 201 bp, Bos taurus
tataaattcaatgaggttcccatgacaggcatatccatgtggccatgtcaagttcctctgtctagaagtcacatgatgaagataaagcttgggcacggccgggaaagatgagtaggggaggagaagtcatctggaatatgactgaataacatgaataaggacacagaaatctgaaaaattatggtgtgctcaggaaccagt

SEQ ID NO: 16561 - DNA, 201 bp, Bos taurus
tatatctcacagagggcctggaaaactgtaaggaatcaataaattatgagcaagagcaagagagtgggttggggaagaatgggagaatatcttcaatttagatttctgaatgactctaaggatgaaataacttgtattttttttaactagcttgagcattttctggtttcattcaaattatgatgtatacatagaaaaaac

SEQ ID NO: 16562 - DNA, 201 bp, Bos taurus
atttatatttgctggctgataaggatgttcatcaagtagatggactcaacttgaggccactgataaggccaatgcagttttacagtttgctcagtccttgtacttttccactccatttcccacacctgtaacttactgaatcataatttatctggccagtcaattgtcataataaagaaacataacagcctttccttcaga

SEQ ID NO: 16563 - DNA, 201 bp, Bos taurus
taccacactctcttgattactgtaactttatagtaagtcttgaagacaggtaatgttggtgccagaacaattttgttctcttcaacattatattggttgttctgggtcttttgcctctccatataaactttataatgcatttttcaatgtccattaataatttgtagggatttttattgtgattgcatttaatatatacat

SEQ ID NO: 16564 - DNA, 201 bp, Bos taurus
tgtgttcggccacaataaaagaagcaatcacccctaaatagcttaaataaattaggagtcctaggttctttactgaataagaagcctaaaggaaaggaatccatggccagtctggtgtctcaaatatcacctggaaccgagactcgattcagctctacacactgccatacttaggatgtgttattcacagaaatacctctt

SEQ ID NO: 16565 - DNA, 201 bp, Bos taurus
ttgacccccacccctggcccccaccatgcagcctacagattggttcacactcacccatgccaaccccttcagagccactgtttggctctgctgagggtgataagccaaatggcctcatttcccagggtgctctgcagcttaggttcgacatgtgacctgacttcagccatgcagacactgcctgcaggacatcatgaagct

SEQ ID NO: 16566 - DNA, 201 bp, Bos taurus
ggagcgcacctatctgttctgaagagggggcatttgttttccccgctgcaatgatttcagtctggtttcatcatgttggaatttgatcacaccattttcaaacaatgttaacatagtccagcttttgtttttctcatctcttccgagaggagactcactgtttctgtctgaggaagctcataccctcggcaaaacatcagg

SEQ ID NO: 16567 - DNA, 201 bp, Bos taurus
tgttctatcaaatataacaagtgatactctgtgttttcattcatctaagaataacccctcttaatttgcttttaagccagctagtaactattttcagtttagaactagtcaaagaatcaatcttgacccggttgctaggaaacttgctttggtgaagaagttaagaatcaatttccctatgcattaaagaacatatttaag

SEQ ID NO: 16568 - DNA, 201 bp, Bos taurus
agggaagataatgatagtcacctaaattggaatcttttctagaatcccatgaaaagtttcacatcaacaaggaaagcaaataaaatcatctatggcccaaaccaacagcataactggaaaacagacttcaatttacaactgaaaacaacagagccagctcttggaggccttacccaaatggtcaggtattgcaaaacaatt

SEQ ID NO: 16569 - DNA, 201 bp, Bos taurus
tttataaagaagggccatgtgcaaagtcttttcaatgctctgtgcagcacaactttataacagagatcattcggttgacagagcatattgtatacaaaatagagataggttcaagttcagggccgccgtcttcacgatatcattctctgtatgtttatgtattgtacatatcactaatcctagagtaaaccggttgttcaa

SEQ ID NO: 16570 - DNA, 201 bp, Bos taurus
tagggccttagtgttttgttgattctaagcatcaaatcccagatgtcttcaaacttcagggtgcataattacctgggaacttataaatatgccaagttctgggcccatcctctgagaatgatttcaaggtctggaaatgaaggcccaaactctgcattcttacctcccccactatctcctggcgagtttgatgcccatggt

SEQ ID NO: 16571 - DNA, 201 bp, Bos taurus
atactttaatgatgtcacctcagtctacatgttcatttccagggcagtctggaaaagacctaggtccaaatgcctttttcctagatcgatctagtggaaatgtctgtgctacatctctattctctttcagtagcacagcatctgcctgactttgggattccacatgctgttacggactaaatcaagcgaagaaagaaatct

SEQ ID NO: 16572 - DNA, 201 bp, Bos taurus
ggaaaacataagatcaggtacattcttaatggaattgagtaagctgcattcctcttttggatttgtttctgattgctctttcttcacagaagcctgtgtgcgtcctttctcatttctctgtgtatacccataagcattaaaaacagtcctttccttgtattacttctttctctctgttgggattggttcttctcttcgttc

SEQ ID NO: 16573 - DNA, 201 bp, Bos taurus
gggtgagattagtatttaaagaggtggtctgaatagagatgttctcatcaatgtgtgtgggcatcagccaatccaccaagggccttagtagacaaaaaggtagagagagagggaatttgttttctgtgcttgagctaggacatccatcacctgctctcaaataccagttctcttggttctgaggccttcagatttgaactg

SEQ ID NO: 16574 - DNA, 201 bp, Bos taurus
tatcttagactatatagagaaccctttctctatatagtctctataaaattgtgctaagtgttttttctctccataaagtttcgataagtactaagtggccgtggacttgagatcatacttcctggcaagaaccaggaatgtggctatcatcagacctatataccttaaaagacatcaaagcttaggacagaacaggtgaaa

SEQ ID NO: 16575 - DNA, 201 bp, Bos taurus
acagaaatatcctgtaacagcaagtttgaggcatggaaaatgaaactaaggctaattgcttctttttgcagccttgactttgctttttatttatttctctgtctgcttaaggaatacaaacaacagaataaatacaaagcttttggtgctgtctttctcagtaggtattgcacttagcagagaaataaaaaattaactcta

SEQ ID NO: 16576 - DNA, 201 bp, Bos taurus
cagccattgctgtggactcatgccaactaaacccacagtggtttcccagaggggtctatggatgccctttcttatcagaagacttcagtgactcctttgtccaagcaggaaagagttccctcctcatttcttgtgagtagttctctatcccgaatagaactgtgagggtctttggcatgccacaggagacaccttcccatg

SEQ ID NO: 16577 - DNA, 201 bp, Bos taurus
gcaaatcatctggaatttaagtcatactaggatttttgcaaggcctatagtgctatggggaatacaaagaggccagatgatccaggggatactaccaggctatagcaagtggacagaatccagatcactgaaactggtgaagcaacagggtagtagtcaccacatggacagaagaaactgtcctcaagatcagagaggtca

SEQ ID NO: 16578 - DNA, 201 bp, Bos taurus
tttgccttgttataataatctattttaatgggcttttcagaactccctgtatggctactaatgacttagaatataaaagtcatctcatgtttcatctatccctagttttattttcattaatcattatgaaataattgaagcactgacatttttctacacaaatccacagctgagagcatccataaagaaccatttgtataa

SEQ ID NO: 16579 - DNA, 201 bp, Bos taurus
tgttcttcctctcttttatttgtggaggatggaaagttaatgtgataagaattaaagagacattcttgggtaagcacaaagaatagctctttccccaaaacgtagggaactgttggagtttatttcaaaaataaatgttaacatgtttttactcctttcaataatattgactccataaaatttatattcagtcccagagat

SEQ ID NO: 16580 - DNA, 201 bp, Bos taurus
cctctcccatattatcactttttccttcttcattgatcatcccctaagaatacagacatagtaaaaggaaacatgtatcaagtcatggaggaaagatattgtataatatggtttgtaaattttgtgtaagtccaccaaatgaaggaaaatttgtatgacaaagactatcaagaaaaaataagtcatattatgaaggaattg

SEQ ID NO: 16581 - DNA, 201 bp, Bos taurus
aagccacttatcaattattctcctaagatagctttctacttgaaaagcatatgtagggagtaaagtaaataaatataacatatctgtttcattgcctagaatttaataggccctcaaattataaaccatttttatttataaaaataagaatcacagaaaaatgttcatctacatacattaagtattcaatcacaaaataaa

SEQ ID NO: 16582 - DNA, 201 bp, Bos taurus
acttcaaattctccctgaaaagttcattgtcaatgatgttgacattcatagaaaatgtttatacataaaatcagtggctgttgaagagacttaaacttctttgaataattgtttagcaataattgctcagcaatgtagtacttaaattttggtaatgatttaggtcataagttactactaaatacaatgcatttaagttcc

SEQ ID NO: 16583 - DNA, 201 bp, Bos taurus
actagaattagcttatccagaggatatgatctagtaataattgagagcctgagtagaacatttggtttaagttgtagcctatagacaagacctggctatgctgattaagtcactggtaacatgtttccgaagcacagacttagtaaaatgatataatgccttattaaacagtgaaagatacacaaattgaacaatacacat

SEQ ID NO: 16584 - DNA, 201 bp, Bos taurus
ctttaacaaattcaaaaattcagaacaagaggaaacaactgctgatgtcccaaattgaagtcatattgtattagtatattgatttcagataatcaacactattctaatatgatataaaataccctaaatactaaatccaggcctccatttcaattttgcaatgaaaagtttgatggaatataagataagatagtgttaata

SEQ ID NO: 16585 - DNA, 201 bp, Bos taurus
gggatgtgccagtgggcattctagggtgattttggcaggccagctagagcaccaggtgcatttcaatctgctgcttttccactgcaactcaaaacaagtcagtttgtgtgcaaaccatttaaaagcagattcttggtttcctacaactctcaggctctccctttcataaaacctagtagtttacaaagccaattttggggg

SEQ ID NO: 16586 - DNA, 201 bp, Bos taurus
catgatgagcagctgccgtgtcaggttaaagcaaacttcaccatctgatattcaacttgtattatacatagcactattattaaatggcaaattatagcataggttaattagggttaccaaactcttgcataacttttggaaataaagtgctaaaatattgagataactgtttcaaaccaatatatcaaaaaactttaagat

SEQ ID NO: 16587 - DNA, 201 bp, Bos taurus
gatgtctggccctagatgagtgatcccaccatcgtggttatctgggtcatgaagatcttttttgtatagttcttctgtgtattctctcaacctcttcttattatcttctgcaaaggccaacagagttctgctgagagcaaactttaacagggaaaagactaacagagttttgcttagagaatgaactggtcatagcaaaca

SEQ ID NO: 16588 - DNA, 201 bp, Bos taurus
cattaaaaataaaaggatgagataagtttgaacaaaatcatatcgtgaagttaaagtatagccattcctgagtgtcctggggccctatcagtaatgtatgaaaaagatttttttgtgaaacatgccccaaaaatggcagatcatagcaggcttctctacccctggccagaggtcatggctatatgagtgtttcctggtttc

SEQ ID NO: 16589 - DNA, 201 bp, Bos taurus
gtgtgccccaactactgaagcccacattccctaaatactgtactctgtagtaacagaagcttctgcaaagagaagcccacactctcaagcagcttgagaatagcatctgctcaccacagctagagaaatgcccatgtagcaatcaagaccagcactaacaaacaaaaaaaaattatagtcttggcaatttgctagcaatcc

SEQ ID NO: 16590 - DNA, 201 bp, Bos taurus
tatttaggaaggaaaaatagtaaatgaggaagtcaatggccatgatagttcagttactctgaataaaatccaaatttgcagctctcaagaggaagctcacggaatgtatttctgtggtttagactctggtgctgaataccttttttctcctccctcaatggggaaaaagtgacatttttctcagaggctaaaatcatgaag

SEQ ID NO: 16591 - DNA, 201 bp, Bos taurus
tctgtgggaactggatgtaacaagaaacagcaccagagctcaggctaaactatcacaaggtaaatttatgaagacacagaaacttaagaaacaagtgggtgccactaagtcatccactaagtttggggcaaacacattttttttttctctacttaacagccacttcccatttgttcctgctgataaaatctctaattttgt

SEQ ID NO: 16592 - DNA, 201 bp, Bos taurus
cagtaaataggatccaatgaaagagcgtacacgtgttagtcagaaaagtgatgcttcaccaaacattctttctaaacaaaagaaaagctgggacccaaaaatgatcttctgtatcgaactggtccctaagtaatggttgacagtgcttcacttaaaaccagagactaacctggcaatagatagagtcactccagcagacct

SEQ ID NO: 16593 - DNA, 201 bp, Bos taurus
ttacaaaaatcattcagcttcaaaaactgccattcaaaatgtggtaagttgaccaccatttatacacaacacaaaatgaataagtctagtcatcacaagagacctctacatttgcagatggaaaatgcatgaattttaagaagtgggtaacatatgatgaaaagttatttactgtttacctaaaattcaagtttactgaag

SEQ ID NO: 16594 - DNA, 201 bp, Bos taurus
ttcctactccaggggatcttcctgacccagggatcaaaccctcgtctcttgtgtccccagcactggcaggttgattctttaccactggggccaccatagccgattcaaacttgcctaggttattctcttccgtccctgtgctaatggagggcttagcgaagttgtccacgcaaaaatgtcccacagatttgggccagctag

SEQ ID NO: 16595 - DNA, 201 bp, Bos taurus
aagagatacttgtgctcccgtctcctttcaaaaatgcaaccgagtgagccgtccttaagtgagtgattcttctgcagacaattaaggcacaagagatttcaaggtctttcagtaagctttaattaatgctatcaaacagagcctaggaaacacccacatattttaaaggcaaaactaaatacagtatattcaaaaacaaga

SEQ ID NO: 16596 - DNA, 201 bp, Bos taurus
ctaaactccaatgttttgctttgtttggcctccctgcatcaggcacgtggacttgtatttggtaacatttccttcttttccttctcttttatagaccaggggtccccagcccctgggccacaagtggataccagctgatggcctgttagaaactgggccacacagcaggagatgagccgtggcaagatgtaaaccatcccc

SEQ ID NO: 16597 - DNA, 201 bp, Bos taurus
ggcctccgtacaaacatggcaatagattcagatcagagcagctggaaactctggtgaactaagcaccctggtcaatcatgctcctcataattgaaggactataagttgcattcctaaaactgccaaaaggaacaatttccaactgggccaatgtttgtcaccttgggaaaggtattgaatctttatgagatattttgtaaa

SEQ ID NO: 16598 - DNA, 201 bp, Bos taurus
tttaaaatctcttaggtctccagcaaatttttgtttaattagacattgtttcggaaacaaaaatagaaccaatgaaatatatgctttttttatccaaatccagatttctattatctttctctacctggtggcttggggatttaattcttaatgctgatatatttgtcaggaaggcaaattttaaaatatactagtgtaact

SEQ ID NO: 16599 - DNA, 201 bp, Bos taurus
agacactgcatggtgaacctgtcacatcacagctcagaaacttctaacatctcctcaggactggtctcatttggggctcaacctactctttcagtttctcatgtgtaattacccttatcccactatgctccaacaaaaccacaacttaccattctttcaacatctccctcaaagtctaccactgatttgcttacattttcc

SEQ ID NO: 16600 - DNA, 201 bp, Bos taurus
aatacttagaaaccaaaatagtaattagtcataaaattttcaagattcaagccagcagaaaagatatgttctatcaagtttcctaatattactcagataacaccaatgaaataatatcaaagacacaactttctatttttaccatatttaaagctaccagcctgtacacaaaactcatgtttggtagcacagaaacaaatg

SEQ ID NO: 16601 - DNA, 201 bp, Bos taurus
taaacatttctcactctaaacttcaatgttttggtttgtttggcgtcgttgtgtgttgcacacacaaacttgggttcaacaactgtgctaatgcaacatacccccaccaaaattaggcctgttgagaaaccttctgtacaaggtgattcctgcctgatattacccattcagaaaaatattaaccaaaagagtcaaccagga

SEQ ID NO: 16602 - DNA, 201 bp, Bos taurus
taatcaaagggtacaaagttgtaattctacatgataactaagtcctagatatctacttataacatagtacccaaagttaacaatattatattatacacttaaaattttgctaacaggggaaatcttatattaagtattcatatcaccaaaaataataataattagaataacaataagaaggagggaggaaatttttagagg

SEQ ID NO: 16603 - DNA, 201 bp, Bos taurus
aagccactctctttaagttattagaaagctttttatattaaatctgaatctgcatttctatgtatcactttgttttctatttcagtcttcattctgccccaggagggaagtttatatggtttagatacttcatgctgccatattctccctaagttgtcttttttccacactaaatatgcccagtttttccaaccaccctga

SEQ ID NO: 16604 - DNA, 201 bp, Bos taurus
ctttgggaatatagtggacattggccactggattttgcaacaggtagctctagaagtgttggctcaaggagccagttttatcgttagttgttaaaatacctaacagctattggccacttaccatgtgccaggcactgtgctcattatgttttgtgtttaacatgcattgtgtttacataacctatgaggtattatccatat

SEQ ID NO: 16605 - DNA, 201 bp, Bos taurus
tttgtggctgttttccctgttcttcccagcaatccactggaacagaaataatattcaacatttttaatcattttcaaaaagtagagacagtgtgctagacaccttttcccaatttgtttacttagtgtatgattacccaaattgggtgagacctcttggtttccctcatcccagaataaacactaacgtgatttgaagaaa

SEQ ID NO: 16606 - DNA, 201 bp, Bos taurus
tcggtggctgccagggccgccgccgccgccgccatcaggaccagggccgcgtcgggagctttggtcgtcaatttacaacccaagggccctagccatggacggagcaggcagtgacagggcaccgaccgccgcgcgggcggggcggaataccacgggcagcaccgcgcgacgcgggctgattgcgtataccaggggcggggc

SEQ ID NO: 16607 - DNA, 201 bp, Bos taurus
gcattgtcttggacatttctctatatctttgtgtgatttttccatctcaatagcttttctttttcttttttaaataatttatttggctgggacacgtgggatatttgatctttgtagtagcacagggaatctagttccctgaccagggatcgaaccctagccccctgcaatgggagtcttagccactggaccagcagggaa

SEQ ID NO: 16608 - DNA, 201 bp, Bos taurus
atggtttgagtttctacataaagaacttacattttatttaaaaagtaataaaacatactaaatcaaagtgatgtaatttgcatttagaaagtttagaagacgcagtgcagtggttagaactaatgctttcactgcgaagggcacagtttcaatccctggttccaggaactaagatcctgcaggccatgcagcaaaaaagaa

SEQ ID NO: 16609 - DNA, 201 bp, Bos taurus
ttatactagctcaccattcttgttttttcaaggctttttaaaaaatgtttctgctttcaaatgaacttcataatcaatttgtctagttttaagataaatctaatggtatttttaatgggattagattaaattagaataaactgacattattctgatattgaatcttacaatcccattaaaagatttttcttttcatttgtt

SEQ ID NO: 16610 - DNA, 201 bp, Bos taurus
gtaggctgccgtctcgggtcgcacagagtcggacacgactgaagcgacttagtagtggtagtattgatgatagcttgtttgtaactttaaaatcattttgaatggatttaaaattcttggtttaccttttccttcaatatcttacatatgttttccattggaataaagcatactataaaaagtctgatgccagtctgattt

SEQ ID NO: 16611 - DNA, 201 bp, Bos taurus
cttacccctggaagttttgggagcaggtatcatttacagccccacagcgcttctgagtgttaagctgcaatagctgttgttttcaggtcgttgttgcggtgagtggccacgaacaggatgtgcagctctggttacccagttttgccaacacagccttactgcaagtcctgctttggggttgtaaattagggtggaatgagc

SEQ ID NO: 16612 - DNA, 201 bp, Bos taurus
taattttgaaccccaccatcctgtaagcttctttcctggtatttgaggacacactcaggaagacaaaacattgtctggtccattggattgccctggggccaagagtgctctcaactgctcttagatcaggcagaactctttccctgtttaatgttgagtctcccaccttgcttggggcctgggaaagtgacaagcttactt

SEQ ID NO: 16613 - DNA, 201 bp, Bos taurus
ataatatttaagtttgaaacagtgagagttttatccataaaatggacagttggaggtgagggtttccaagacactacaagatactacttagtgtgatgtactaaaagacagagaacattaatttaacataaactgttcttattttagggaccaaacttgctcaagcaaaaaagtttaatgatcctgatgatccatgcaaaa

SEQ ID NO: 16614 - DNA, 201 bp, Bos taurus
tgactgtggcattgcccatcacagccaccagcaccagggccaggtaggctgcggtccacagtgccagctgccagccgggcatggagaaggctgtgatgcccgtggcattgctgtcaaggccagacgagatgttgatatcggtcatcacgacacaggcccccatggccgcctctgagtctggcacaagaggtaaggctcctt

SEQ ID NO: 16615 - DNA, 201 bp, Bos taurus
gctgactcgcaaggaaaatgtgatcttttgtaacaggagggagatcagaccaaagaaagttttgtttcctgccaggaaggccgttctggagtgggtcccgaggctctggggagcttataaaaatagaagaagccactgactgcttttacaaagagggctagggtcaattctgctcagaatgcaggcctacaacagcttggt

SEQ ID NO: 16616 - DNA, 201 bp, Bos taurus
cttaagaccactcagtggttgttcctatccattcagtggcctgagcagtgggagctgtaaacccattttgagctacaggctgagggctctatcttccattaggaactgaataggcatggcagggccctgtgccttcagacccacctgcaacttcagaatgggctaccctggtggctcaaacagtaaagaatccacctgcaa

SEQ ID NO: 16617 - DNA, 201 bp, Bos taurus
tgagcaggcaaagccaagagctggcctggtgccccagcacacggaggtgtagctgggctctgacccagctcctcaaacaggttccatatggtcctccggccgcccctcatccctcttccccaccttgactgtttccgagattaaaaccctttcctggttgtcagcaaacagccttgctgcttctgcggctgagctggtgtg

SEQ ID NO: 16618 - DNA, 201 bp, Bos taurus
atctttctcgtacttaactttgatgaatacctacatctctcggtggcaaaatgacataaaataggagtgcagtaagtacataagaacaacataacattcttacataagaatgtatgtaatgtatgtagtaaaaatgcctctaacttacatcatttacctctgagataagagggtgctgagcatgggttttgttgctaattc

SEQ ID NO: 16619 - DNA, 201 bp, Bos taurus
gtcacaccggaaggcggagagggaaggaatgaggcttagcttcctgccacaattctatcccaaaccaagtgggcagtgctgggtctccatagcctggcctggagatgctgtgaatggaattctctgcatacaactgcgaccactcgccaggatgtcctgggctgggacatgacagctgaccaagaagaattcttatcaggc

SEQ ID NO: 16620 - DNA, 201 bp, Bos taurus
tcaggaccagggctgttgtacggctgtcctgagctcgccagaagggaagggacagagctgagtctactgtcagggggcagagagagaaagcgcccccaaatggcctgcccggtaagaggtccccagcagctaaagagaagtttggtccagactccagagctgagcaaggtgggtagtgaaggggaggcaactgggctctgg

SEQ ID NO: 16621 - DNA, 201 bp, Bos taurus
ctcaggcagcaccagcaggaaccaacagaaaccctactggccgcagataaaccaagctgaccaaaataacactgcaaagctgctgaaaattaaactgccattgaaaccacagtccacaaaagtaggccaagacccatgtgctaactctaaatagggtgatgcttactaaaaataaaaagatttaaatgggtcctagcatct

SEQ ID NO: 16622 - DNA, 201 bp, Bos taurus
aagcagacactgacatgccctgcaccaagccgctcatcttgcacgtggcgttgtcaaagggccagcctgcaaagacagaggccactacaaagtgagagacgcctcatccacaaagagccagagaccttcatccacaaagagccagagacctccagccacctgggccagtcccctctgtggcttgtatcttccctccagtca

SEQ ID NO: 16623 - DNA, 201 bp, Bos taurus
aggacggggcacagtggagggcctcatccaggtcggtcctcaggaaacaataaatagatggaagttgtcttctgtcactctcagggcagctgctggctcttagcactagaaacaaggcctcaaacccaaaagggcccggaaaatgcgcagcaatgctcatccatgggcccagaaggtactgatgacttgaaggtaacttgg

SEQ ID NO: 16624 - DNA, 201 bp, Bos taurus
ctccagagccccatcccttgtgccctagaagaccctgtgagcctcaatccaggcaagggagctcaggacaggctctgcagacagaggaggggcagggccatgggctgggtccactcacccacaatctcattctcttccagattgatgttctccagcgcaggcagggtggtgagctgctcggggaagtcgtggaactggttc

SEQ ID NO: 16625 - DNA, 201 bp, Bos taurus
ttgcctgtggtccttttgtaccctgagctatccaggtggtttctcctgctcccgagcaggtcccttccatgggacagaagcacattggataaggcctaacggtatactctgcaggatggtacccaagaatgacctcggaagacgctgaaacttttgagtaccctacccaggcccagtagtcattgtttctcagtccagtga

SEQ ID NO: 16626 - DNA, 201 bp, Bos taurus
atttcctgctgaggacagctcagggttagggcagatccccggacctcaaggcccaacttcatggttatcttgccgtgtgaccttgggccaggcactgcctcttggtgcctctggcaacttccaaccctgcccgggggttgggactcagggtttccaggctttcactggcctgacaggtgccctttttcccagggggtctct

SEQ ID NO: 16627 - DNA, 201 bp, Bos taurus
gtggctgagacagatgtttcctgcagctggccactcagcctcctgccctatttttagctccattgttacccgccccaggcatctggctgccagcggtccgtgagaggctgtggccctggaaggggtgctcttccctgggtccagcttgttctctgcctgctgcaggtccctgggttaagcttcccagtgtctttggggaaa

SEQ ID NO: 16628 - DNA, 201 bp, Bos taurus
cagaataaacaggatggaggaaggggctgctggcgaggtgctggaggcctctgactgcagatgctttccaggctgctccgggccccctctgcagttgaaacgcttgctgtttcgttgggaaggctggggttaggtccagcccatcttctggaagagctatgcgctctgggctgtctcagcaggcccgtccccgtgctctgg

SEQ ID NO: 16629 - DNA, 201 bp, Bos taurus
ccttacttctgagttctcgaaagtagtttgcagtggctctcgcctggtgggacagtgggtgaattcctttccttttctctaagaaactgtattgaactaggctcctggcctttggatggagattggggagcagggtaagggatggggtggtggatgcccagtgcttctcagtatgacgtattcatccttagagacaggcag

SEQ ID NO: 16630 - DNA, 201 bp, Bos taurus
atcagaggaggctgggattatgatctctgttttatgagaccaagagaggttctgtaatttactcaaggctcatgtcatatccctaagggatctgggattctggacaccaagattccctcaaacccatgctggtgactctgtgccctctctgtagcctagaggctacttggggttggggactgtgtttgtgcttttctgaat

SEQ ID NO: 16631 - DNA, 201 bp, Bos taurus
ctggaggccttgccaaaaaacatatcctggaggcttgcagagtgtaaatgtgcacggctggctgtggggctcgctggcctcagctgctaggagttataaagagaacagaagtgccggtggcgttggggtgactaatggtgaccactgggggtgtggccgtcagctgtgagatgatgtgtattccgcctcactcagttccca

SEQ ID NO: 16632 - DNA, 201 bp, Bos taurus
tgcagaccctgcctctgctcattctgttcacacctcccacagggctctccccttccctctgctgaggcatctgccatctgggccacccgcttcccagaactcaagaactgtctgatttctctgcatgctgagcacggggctgggctcatgatacaagggaggtcatgacttcaggagcagggcgtaacacaagaaagagaa

SEQ ID NO: 16633 - DNA, 201 bp, Bos taurus
agcaggagtaacttggccaagggcaaacggccagggcagtgccattttcctattgtgcaaaatgtccccagggcagcccaaactggcaccattcaggccacgagtggaaccctctcttggaaaacagaagaaagggaaggtccgttctccagcctcttaaaaagatccaggcagaggagcttaagggatcctagaatttag

SEQ ID NO: 16634 - DNA, 201 bp, Bos taurus
gtacacctggtcctttgctggggtccccctctgcccaggccccagaacattaaagagaggaacccgcaggactcctgccttggcagcctgctctgggtgctgtgacactaggccatgccttgctttcctaccaacttagatacttggacatcttccccatcctgttagggtaaggaaagcaactcctaggcctggggggca

SEQ ID NO: 16635 - DNA, 201 bp, Bos taurus
ctcctctctcagctgggtactttagccaagccattattcacatgacaaacacgtattgagcacctactgtgtgccgggccctgtcccagacattgaaggtacagtcgtgagcatgacagatccagggatgcctccctgaaggatgcaaaccctgaggcccccaccccatagaaccagccttccaagacacatgggctgagg

SEQ ID NO: 16636 - DNA, 201 bp, Bos taurus
gtgaccctgggccattcatgttctctctctggattcattaagttagggatggtgagaggcaggaggaagtcaggtcagggctcccaggctccctcacccctgttttcaccaccagcaatggcctgtatttagattgtatgtgtagaacatttagcccctggctcataacatgcacttagtaaacaatagccatttagtctt

SEQ ID NO: 16637 - DNA, 201 bp, Bos taurus
agttttgctgtgaactgaaaaagtgctctaaaaataaagtcattttaaaaaaatatgaaaaatacttaaatttgacacctgtttcgatcttaaattcatgtaacatgaccctgatcatatttccactgactggtcatttggattctgttcttactgttaagttgcttattactattattactaaaggtcactggggggctt

SEQ ID NO: 16638 - DNA, 201 bp, Bos taurus
gggtccccagatgccactacctactgcagttaaactctgaaagatgggtaatgagtgaaaaaaggcactgggtccagtcctgaactgtaataaggccctgctttctgtctagattctagaacaacaagttctctccaaggtggctcctgggcatcctggagatgcctgcctcagattatgtgtggcatgtttcccaggtat

SEQ ID NO: 16639 - DNA, 201 bp, Bos taurus
gtcaccaggctgacagagccagaatcccataactatgctcttcactgcagtctcagagttctgccactttagggctaagctccaccgctggcctcaacatccccctctggacaatgggtgtggtacgctctgccctgcccccatcaggatggtcatgaggagctcaggaggcagtggtcctaagagcctcacaggcctccc

SEQ ID NO: 16640 - DNA, 201 bp, Bos taurus
tgtagctcagaggaagagtgtctccaaggccgggatgcaggaaggcttccttgaggaagcaggtatgtgggggcaaatgcggtggagcacagctcagagttgaggcagaggccaaagagccaacatctggacttggggctccggggagctttgtgaacgcatccgctgaggatgccctgacaacttgtgcttgtgtggaca

SEQ ID NO: 16641 - DNA, 201 bp, Bos taurus
ggactcccgagatcggggacacccgcagctccatgccagtggccttgcattttccaggcgtaggtcctggctcttgtcctcatcacccgtgcgcttttgatggttccttagaggcctctggggtgacgtgtgctgccctccatgcttttctccccaaggggaggctcctggggccaggccaggcagagtacacagctgaca

SEQ ID NO: 16642 - DNA, 201 bp, Bos taurus
gtatgatgcctgacgatactaaagagtatgatgggctaaaggatggagaggaagagactgcatggccccgcagtggccctgggctggcatcttggaggaacgggcacctctgcttcactgtctctatatccttaaaatgccaaatactccggtggccctctggcactcttcgtgagaaagaacgggaggaaaggggccaag

SEQ ID NO: 16643 - DNA, 201 bp, Bos taurus
gatctcaccatgagcattgccaggacctttaaagcaaccccttcctgtgcctgcttggcttgttccctcttcatcaggagtggggccacccctccttcagaactgtttcaaagtgagaacattctccagaagagtctgagaagaactttaagagaggggccctgggagcatcagggctagtttatgcttgactttgaatga

SEQ ID NO: 16644 - DNA, 201 bp, Bos taurus
ctcagagactaagggcccgggaggcctctgactggatgaatcgacccatgctcacctagagaatcagcccactacctgtaactgcctcccccgctgtggcggcaggcgaaccataagaggactggccccagacgagtaaaaaggcatccctgggacaaggtgggacagaggaatgagctgaatgggaaggcttgctcacgt

SEQ ID NO: 16645 - DNA, 201 bp, Bos taurus
ctcctgacggttggcctcttccaagcaccatgctgcaggctccaggtgtgagagggtagccacttccttcctggggctacttgcagactggagggtctgacgagcaaggtggcctcctgttgccggtgtcagaagctgctttgagagtagagggggacatctaaatgtccccactccaaccctttctttctgagtggtcca

SEQ ID NO: 16646 - DNA, 201 bp, Bos taurus
aaggggtctgagctgttaacaactgctcctagccagcagtgtgagagtcaggggtgaaggagacccctgagtttggagagggtcctgggccagctggagcgagtctggaagagcttccttctgaggagagcagggttttgaagggagaaggctgtagacctggccactggttctggaaagcccctttcccacctctcccac

SEQ ID NO: 16647 - DNA, 201 bp, Bos taurus
ttattagttgccaaaagtttaaaattgagagctcaagtaaaatctggacttctgactttgattgaaaatttagtgattctggcaaccctgggcccctctcctggcgtatgccagttggaactgcatgtacaaactggcagctgggttttcaccagtctctgcttctccgtaccgtctcccccaccagctccctggccctgt

SEQ ID NO: 16648 - DNA, 201 bp, Bos taurus
ataagatggtaaatatcaacagatataatccacatgaagaaaagttctttgggggtctctcaatgtctcctgaatacacaagaatcctgagaccaaaaagctggagaaccactgcattaaaacatgtaggaacaatcaagttctggaaccaaaaggaggggaaataacttccagaaattatcagggccaccaggggtatct

SEQ ID NO: 16649 - DNA, 201 bp, Bos taurus
aaattctaccaagagttttacccatttcagaaaatcacagtggaacagccacatctctcccggaattcaagtccccaaaacagcagccttgcggcccctgcgtttgcagccaggtgcatgtgatgctctaatgtgccatcagcctctttccccttgtgccaccttgggcctgctggtggaatcggtgggcatgtaccagct

SEQ ID NO: 16650 - DNA, 201 bp, Bos taurus
tggctttgaaggcagatgaaggggcccacaagccatggaaaacaggcagccacgagagcgggaaaaggcaaggaagaaggtctccccaagactccagaagaagcacaggcctgttgattttacgccagtgaaactgatcttagacttgacattcagaactgcaagataataaatatgtgcttttaagctaccaagtttgtg

SEQ ID NO: 16651 - DNA, 201 bp, Bos taurus
cgtcaaggatgccctcagcctgtcagccccctctgttacgggtgttggtgagagagcagaggggcagcagtgctcaccgtgcggcctcgttctcactcacgtatgcagattttcaaagaatggggaggtcactgtcccctttcaccttacagggagtagaggccagctcctctcatcctgaactctgaacctcagcaggga

SEQ ID NO: 16652 - DNA, 201 bp, Bos taurus
ggctgaactgagacaagataattcatctagccactcatttatttaacatatacatcctggttatctgccctgtgccaggcccaggactcaaggaaacacatgtgacaagacatgatccacgccctcaaggacctccagcagggaaaacccagggaatcaaggaaatgcagcccagggatcttaggatagaatataggccag

SEQ ID NO: 16653 - DNA, 201 bp, Bos taurus
cacaggcaatcagtaaatgcaatgggaggtaagaaaacgatggagagggcttgctttctagacaagccctttagaagagacagacactgagttgggcctcatagcaagtccaagacttagagaagaggaggagggagggcagcgtgaaagcagaaatgggtctggagggccaaggagatcggtttagatgtatgcagggtt

SEQ ID NO: 16654 - DNA, 201 bp, Bos taurus
atagcaagtgtgcaaaatctgtaagggctgtgaaacaatgcagctcagatggggacttgaacccacggttttgaaacacatcacacacgtggcctcagggttttaacgcagctcaccttcttgatgtctcatcacagaaagaattcagtgagacacaaagtgataggcaagaagtgaattcatgtagaaagaaacatactg

SEQ ID NO: 16655 - DNA, 201 bp, Bos taurus
ccactctagtcaatttgaattcactggccacaaaaaatcccaaatactgggaagccaaacatagataatgcaaaagaggaagaaaaggagcagataggatacctaaaggccacataatctgaagtctgggggaattctgagtcataggagttccaacagtcttcaactatactggagattatataatgcatatgcaaccct

SEQ ID NO: 16656 - DNA, 201 bp, Bos taurus
aaccaatctactgttcttacgtggcccactgcaggacagtgtggtgtggtttctcaagcactggagctggatctgcatccaatcatcccccatcttattctgcacacatttgcaaactggctggccaagatcagggcacaggctgtaagcatgaaacaactttagcacctagaattcatcaggtacacttcactttaggag

SEQ ID NO: 16657 - DNA, 201 bp, Bos taurus
ctatcaccacattcccattccctcagaggggagagggtaatctaggcatgaggacagagtagtagagttgattcgggctggcacatctcggaggacaggaaagggacctgggccccaggagagaaaggcttgaggcctggagaacctgcccccaaccaattctcagcctccaaaaattgtgacttttaccatcattaattc

SEQ ID NO: 16658 - DNA, 201 bp, Bos taurus
ttctaaaccagctgagttacatggaaacaaaacagctctcccagcaaagccagtgaccttggcagttttctgaattaatttagcttactataaggaagaaatgattattggtgttaatgagatttgggtttctgtatttgttgctaaagttgctaaaacttggtattttacttttgcaggtcaccttgtaaattttgccta

SEQ ID NO: 16659 - DNA, 201 bp, Bos taurus
tgggtatttgttactgtggtacatgtttataagacggggttcaagatagccctcagtgatccctgtcctggtgtatttatacccgtgtgtactgtcctatggttggtctgtgtgaccaacagaatatggcagaaatggaggtatgtggcttccaaaattacattataaaagactacaacttctgtcatggaaaggcccatg

SEQ ID NO: 16660 - DNA, 201 bp, Bos taurus
acttctaatagccccatttctcagcgttgtcttgttcctgtggggaatactggggaaggctagggagttcaggggggccattcactacagccataccttaccaggttccagttgcctgttttgcaatttgattagttttgctgttcccttggctcacaaaattgccattcctctgatggcccctacagtgactgctggtca

SEQ ID NO: 16661 - DNA, 201 bp, Bos taurus
ggcccatgcgtgtctcccgcggcttcccatctcacccctggcccctcaggctaattcaccaaaacgaccaactcaaagggcaagaggagggcgcccactgtgtgttctctaggcctttcagaaaacatggagttgttcctttggccacatacatgcgaatctacaagaagggtgatattatagatatcaagggaatgggta

SEQ ID NO: 16662 - DNA, 201 bp, Bos taurus
acagcacactcatgattgcttgtcatgcaaccgtgaaaccagggcagacagaggtaagttctggtgctctccttacgacatatcctttgcctcatccaagctggcccagttacccactaagcacctgccttgtccagcactgtctagattatacaaagatgtgtaaaataggatttatgcctttaaggaatttacaatctt

SEQ ID NO: 16663 - DNA, 201 bp, Bos taurus
ctccaggctgacttagggcctaagtggccctgacaactttcttaccaagtttatatttgaaatgatcttgtacataagtttccttttttctttttcaataacagtacacgaattaggccttcactagcctgaccctggagaaatgcctaacttttctgggcctcagtgtcaccttctgtaaaacagataatataacctgct

SEQ ID NO: 16664 - DNA, 201 bp, Bos taurus
taagacttcttcctagatgtgattctggcagtcacagtagatgaaggcttagttggtcgggaggggagcgtatcgtcaatagctttctatcccagggcccgtgcctgaagagggtgatagggaggaaagcaaaagcccaagaaattgctggatggagcagagttcacacgtgaaacacgcttttaaaagagtcaaggccaa

SEQ ID NO: 16665 - DNA, 201 bp, Bos taurus
gcgtgtgtgtgtgtgtgttggagtgatgactggggaatcctgagttggataggattaacaacagaaagtagatcttttgtcgttcgttggccttagagatggggtaaaagggaattcccactttgacctgggagtacttatccagttcagcctgaggcagggcagagaatagaaatgaatatgagtagggggccgattgtg

SEQ ID NO: 16666 - DNA, 201 bp, Bos taurus
ggctgggagctccacattctctcccaagaaggtctgttggccacggtgttctcataagcctcgttctaggcgcgtatacaaattctgaagaagtccattccgagacctggggcaggcaggccatctcagaggctgcagtcacatcacacagcccccagagctctgtcagagttcttgcctggtcccgagtccatggaggcc

SEQ ID NO: 16667 - DNA, 201 bp, Bos taurus
aaccacccatctaagccatttattctcagacttcagtacacatctgaaccaccaagcttgttaacaatagcctagttaaacaaaactggattggtacctgggcaactgtatttttagcaagcttcctgatattcttcaaagactgagaatcactgatctaaggaattcattttatcagttagctgaatcttctggggaggg

SEQ ID NO: 16668 - DNA, 201 bp, Bos taurus
ttcttttttattcataaattcttcacacatttatcaaaatgaatttgggcaggatttttttttttccccagaaggaaaggataatgcatttttcaataaaggataagattcttacctgagaacttgaacttagggtcaaagattgagatggtgaagtgatagttaaaaagagaagataaagacagagggagggtttaacat

SEQ ID NO: 16669 - DNA, 201 bp, Bos taurus
gttgtcaggtgtgtgtatatacatgtttaaaattgttatattttcttgatacattgaccctttcatcattatacagtatccttattttctttcagtaacaatatttatgttaaaacatttttttctgatagtaatataaccacttcacctttgtctggttattattttcgtggtttatcatcttcctttcttttactttct

SEQ ID NO: 16670 - DNA, 201 bp, Bos taurus
tagggagagccaagctccttctactgggcagctggggagactggggcctctagcaggagggaggtggcttgggcagaggacatacagagatacaggggatttgtcccttttctgcagcctaaggcctgagggcttttgctccagatgcactgaacacgcaacaggaggaggcagaaggtaaatggatagacttcaggaagg

SEQ ID NO: 16671 - DNA, 201 bp, Bos taurus
tgtctgacggcattaaaaggcctgcagaggtgacttgcacagaggcatgaagaaaatgaggaaggaccatatggatatataggagggagggaacagcaacggcgccggcctctggggcaggcttggcatgttctccaagcaataagggcagtttggcttaagagtgagaagtgaaagggtgattggaaatgaacttagaga

SEQ ID NO: 16672 - DNA, 201 bp, Bos taurus
agtgagtaagtgatgaagagaaatgaagggatggtgctgaaggttgtatatacacaccatacccctttgggctactgctatggaaatgatccaggccctcgttaggtgggatgggactgggtatagggaagtggaatagggagtagacagtgtcagtacccagacagtctgtatgggccccagtgagaggtctaactcatt

SEQ ID NO: 16673 - DNA, 201 bp, Bos taurus
tctgacaagaagtgatgggaccagatgccatgattccagttttctgctatgttgagttttaagcccaaatcctccccatgtctgtagcgtggcctgaacacccatgttcctggggcttgtgggttctactgcatcactgtgttgaaaccaacctccccccattccctcctgccccaacaaggctttggcccctcagcttgc

SEQ ID NO: 16674 - DNA, 201 bp, Bos taurus
ctttcttgacctttcttgttcagtcttagttcccaggtcccgctcgctttgtgtttcatgagcttagcaaagcgtggcctccaattccctagttctagtgttttcacttaagatgaggagtgatgagccaaaggtttcaggctcaatccttgagcaaagggccgctctgacagggattattatttatttgtcatcttggat

SEQ ID NO: 16675 - DNA, 201 bp, Bos taurus
tgaaagctctttcgatctgaattactcctaaatgtttttaacggtttgttataaccacacaaatgtgatcttggggccatttggaggttattgagtttccttggagatgagacttggcattttccaaaccagagtttgcttttgtggcctagaagttgtgaggcgcatatatttggagggctaaagattattccccaccaa

SEQ ID NO: 16676 - DNA, 201 bp, Bos taurus
tctctccagtccagcccctatctcaagagtgatggccaggctgcttgcctgcctgcttgtttgcctccctcttgatctcaaacattttagtgggggatgcttgtcaagttgcaggccctgggttaaatacacaggtaccaagatgtgtgaagttcagccctgatgctcaaagcgtgtctgggattaaagctgaaatgcaga

SEQ ID NO: 16677 - DNA, 201 bp, Bos taurus
tgtgtttggcaacccgcattcacctaatgaaataacacttcagaagtgtgcctgcaacctctaagaaaattgagttagcttagcactccattgtgggccaggtgtagatttgtgtgctcgttttcaagctgtcttcaagctcctccaaggaggaggagtggatggaggaataggctttatctgtatttgtaaggagcttcc

SEQ ID NO: 16678 - DNA, 201 bp, Bos taurus
aactatggcaaggctggaaagtccaagggcttggccccaattcctctccccgagctcctttttttttttgtttttttgcagaatttccactcaagctcctctttctggcccctcaataggcgatacacatgggatgaatggggaacatatataggctgaggatacagagacgagaatgactgcctagccatggatctcagc

SEQ ID NO: 16679 - DNA, 201 bp, Bos taurus
aagcctatcattctgaaaggacttcttcctgctgctgaagtttatggggtgctttggttaccaccaggatcttgtggggccccagctgtccagagcagaggagagagaccccccgcccccaccagcaggtggattggtaacaggattcagtgtgatgacaggccagccttgtaatttacttcttcaagggcaaagcgacac

SEQ ID NO: 16680 - DNA, 201 bp, Bos taurus
aacttgtctagagtctcagagctgctcaggccttgttatggaatgttgtcatgctacaaaagagaacggtgtttttagtgaagaaggcaagagacagagtggataaggacaaggccaggtgtgtgctggactgccaagtcaatgttgtttccgggggacagtggaggcctggcttaggactcacagagtgagcgtgcctct

SEQ ID NO: 16681 - DNA, 201 bp, Bos taurus
agtcttagtttccaggaaattgttgataaaactgttttcctttgttgctgagatgatgataaaatagtcagactcgtgctggccttggctcaagagatgagctttgaattctagactcatcaatgggatcccacaggacattactacatcagaaggtagaaaatgacagcccaaagccaggggctagcaaacgatgactca

SEQ ID NO: 16682 - DNA, 201 bp, Bos taurus
acatctgtatacctgtatctgtacagatgtacatactatattgtaagcggcttagaaagttttaggaaacttcacagatctggggccatctggtttctggtagaccttctattcctttagctgatggctgagaatccttcattcattcattcatcaaatatttactgaactggaacccttcaggccatctcctattcaggt

SEQ ID NO: 16683 - DNA, 201 bp, Bos taurus
tagcatttaaacttccgcattgagacagggtgagaaatctcagtaaacagtcaaatgattctggattgctcagggtctgggcccggggacaggcagggtgtacctgctgtgctcactgatggaagccactgacaggtaaacagcaagttaccgggtgctctggcccctctctgctgctcagagaacagaaaactgtgagga

SEQ ID NO: 16684 - DNA, 201 bp, Bos taurus
gggtgatttttttttttaattttaatgatcctgtctaatgatggagagctcaaaggaagggcttctttataggatgtgatgcccaactagagagaaaaaccaatggccccctcctcccatcccacctcccactaccaacataacccaaatactcaaatcctctgctaatcctatgcataggactgaggcagagaagaaaca

SEQ ID NO: 16685 - DNA, 201 bp, Bos taurus
tgaatgacacatgaactctgcccaaggcgacgcggcccacaccaatccattccacagatcactgctgacagagaacagggagtagaccttgaggtttcagtcaaggtctgctcaaggtcttcagcataaagggtggccaggctgaacacacaccagcagagaagaggatgacatgggcttcataaactggcccatgagagc

SEQ ID NO: 16686 - DNA, 201 bp, Bos taurus
cacacatcagcttggagggctgacaggtccccgatcactcaacgggcaggcagcaaactctgagggcggagggagttaactcggccttatcttgagctccactatcaacaaacttgtcatcacttaaccaagttgttagtcactggaacaatttgatggaaagaaatttgtgtcccagggagaaacaagttgacccagatg

SEQ ID NO: 16687 - DNA, 201 bp, Bos taurus
caggccctaaagtttcccctcctgctcttctgtgagaaggtagaagtgacctatacaaggtcacacagtcagtgcaatatagaacacagtgaaggacataatgtggccagaggagtggtggagaccatgggaaaggactcggcctgtgcaatcaactggcctgggttccaataccagccttgccatagatcagctctgtga

SEQ ID NO: 16688 - DNA, 201 bp, Bos taurus
cagaaccatgcaatgtggctaccggtgttgccagggaggaaattatgtcttacacaaccctgcatccctggaaaaagaacggccacactgataaagattcgtggactaacccattcgtatctgctaccaaatattctgtgcatcgggtttggcaggcacaaggccacaatgtccaatggttagaaagaaatccataatgtg

SEQ ID NO: 16689 - DNA, 201 bp, Bos taurus
gcagcaacctgaaaacgtagccaggaacgcacccagggtgagtcagacagtactggggacccgcggcctagccaactctcgggtcagccagcgcctggccaggggtctcagtattgtgctgcactgtgaaacaggtatggtggtcaggaagctcttccccacactgagaagtctcctttggggaacttctctcttgggcca

SEQ ID NO: 16690 - DNA, 201 bp, Bos taurus
ggccatttaagagcaggcagtgaaccagatccagcccatagactctggtttgccaacccctgacctgactatcatgtccgtgggccatgaacaagggcggaactcattcaactcactgtgtcgaagacctgaaataacaggtgaggaagcaggggaggaggaagccagctgtcctgccttctgaggcccactgccccctca

SEQ ID NO: 16691 - DNA, 201 bp, Bos taurus
gtcccaggaaactagtgcagtctcatcacagtggccaaaggtgggtgtccccattttacacatcacctggccacctcagtcttcttctgcctaagaatttttctacagatttgcagacctttcctccttctgaccttagaggcagagggcctctcctccttgacgacagccctccagactcgggagagaatctttgcaccc

SEQ ID NO: 16692 - DNA, 201 bp, Bos taurus
tttgcctccagctgccactgtagacattgggtacctaaagtgaaggaatggtgggtgggtcctgtcgtgccctgttgggccactcccaggggttacgttattttagaagccatgcagtgcatggctttaagaagagagtaaggaaagagtatcaagatggtggcctgccttcggataatggcctgtgaagtaaaggttgga

SEQ ID NO: 16693 - DNA, 201 bp, Bos taurus
cagtggataacacgttatttcagccaaaaagaggggtcaaagaagtctcaaaacccagggagcacccttttaaaaagaaggggtgatggccgacttcacagggttcagaggaggtcagtctgtgcagggctcggggaggtggctggcacaggcagttaggaggccacgtagcctggattgatggctctccgggcatgatgg

SEQ ID NO: 16694 - DNA, 201 bp, Bos taurus
tgttgtctacgggtccctgggagtggcaggccctcctgactcaacctgtatctccagctctccgaggtggcagtggcagcagggggcagtcttcctcccctgagtccagtggattccgcctcatcaccactcacaggtggggtgtggctcccctcagtgccctgtgtgtagccatagcaactacgacgctctccttttgat

SEQ ID NO: 16695 - DNA, 201 bp, Bos taurus
ggcaggacagagtggaggcccagaaagatgcacccagatggagctcatccccagcccaccacctctggcctccaccaccctatcaggcctcactgctcctcctgtccctgtgacctgtcttcctcgttgtccctggaatcagtgactcacaggtcagcgctgactgcctttctcttgggcttacttgagtgcatgtctggc

SEQ ID NO: 16696 - DNA, 201 bp, Bos taurus
tccctggggaagtcctgttgtgaagagctcctcacctctgaggagcagcaggggtgcttcctggcacttgtggggcaggtcttggctcacagagacaggtggtggccaaagatggtgactttccacgcccggagggtgggagcctgggactggaaggttgggggttagattaggaggtgaccctgttggcatgaggagggg

SEQ ID NO: 16697 - DNA, 201 bp, Bos taurus
caaaatgacatgcttctcctgggcttgcagacgtgcggctcacgcctttcttaaacaaagactttcattcattgcctctctcctgactctctggcctgccactggctacccacccctcccaagtcccaatctcctttacataaaatgtgaagctggagaccaggagctgcgtggagaggagggctcagctggccagggtgg

SEQ ID NO: 16698 - DNA, 201 bp, Bos taurus
gccattttccttacatccctggcatcatgtgctgagctgggcacagtaggtgttcagtgagtgctcgtcgagaagaactgtgggctggaccccagtcaccaggtttgcggccatcgcaaacgcaacacgcttcacagcacggggttcatcctgcagacctcatcaaccatgcagtcatggggagatcaattggtccggctc

SEQ ID NO: 16699 - DNA, 201 bp, Bos taurus
atcaggttagtgaaagttccaggagtgaagcagccagcagtaggaggggctcgaggggcagcagcaaatttgttggccagtattcccagaggatatgacacggggtcatcagttgagttttcagtcgcatcttgataactcaactctcagttgagttatcagtggcataagccatgtgcataagcttcggccaggtctcct

SEQ ID NO: 16700 - DNA, 201 bp, Bos taurus
cagggaattaagatctcacattctgcatggtgaggccaaaaataaacaaacaaggacagctgagtggtttacaagatccaatcatttatgtggcgcctaccatgtgccaagaagtgtttggccccatgggtaagggtgaaaaacatgatccctagtttctgagtgctcagagcttaggaggggagtggaaatgagtgcttg

SEQ ID NO: 16701 - DNA, 201 bp, Bos taurus
ggaacaagtctaaactttactaaggcccttctaaatacatcaactgtgccttttcatgactccccgtaggcaggtatatacccacttaatgcctaaggtcgtatggccaggaagtgccaggtaagagaccctcaaaaggaatccacttttcagtgggaacaaattctctccttgggtctcaggtgcgatgaagctctcttg

SEQ ID NO: 16702 - DNA, 201 bp, Bos taurus
gcagggcatagggctgtgccgttccccagaggggcaggtagcctgggccacttctctagttggtaggtgctaacccaggccccaggcccctttccattgctcctggcatcctccctggtccccagaccatggtggaaactcttcaggctgtcctctccgaggggagtagggattccccactggccctgtgtggggcaggga

SEQ ID NO: 16703 - DNA, 201 bp, Bos taurus
ctagggaggttcccctgcatttcccgtccctgtccagcaacctagagaaccctcttctggatactgtcatgccctgagcccagccagtgtccatctactgcgcacctggaggccacctggatgcccacctttcagcccccatgttgactgaccagggctcaggccttgtatttgttgttgttgttgttgtttagttgctcc

SEQ ID NO: 16704 - DNA, 201 bp, Bos taurus
cctcagctgacctcctcagctcctggaccacaatgcacccttcttcccccagctcttaattaaactagccagtggcagtcttcacagcagaggcccagccgagcaagcgcctgcatcctgagccgccattgtctccccagcccgcggatccagcctcctgcaggcacacattttgccccagggcccagcatctgataggcc

SEQ ID NO: 16705 - DNA, 201 bp, Bos taurus
ccctacacctgtcagggcctgcctggcagaccaccggtgcccagggccaggcggcccaggcggtgggggtggcgggtggccattgttcccatccacccttcggcagccccaagtaatgacaccagggtctgacagcctcggaggaagctttttgtctcacagccacggccaaagtccataattgatatggattgcaggggc

SEQ ID NO: 16706 - DNA, 201 bp, Bos taurus
ctcgtaaaatgcatagggaacacgactctagtgaagacacacagcggtcttacctgatcaggggccgggctccgaactctagcacagaggcctcagcaccccacacgcctcctcccacctccccttctttctcttttctatgtccagcaggcagatcgtcatatcacatgggctgaacctccataaccacgtagctctgca

SEQ ID NO: 16707 - DNA, 201 bp, Bos taurus
acagagaagcctggccttgcagggccacttccaagaacaagcgctgatcacctgactgctgtaacctgggcgctggcctgggccacagtctccaaataccaagaaatgactgtgttcctcctcttgatacaggttcaggacttagctcctgccaggtgaggcggcctgcacacaaccctgcaactagaacgaggaatcctc

SEQ ID NO: 16708 - DNA, 201 bp, Bos taurus
tccaggcgtttggctgagtggcacagggttaccagacggcctcccgcctgggtccagacccttgctctgcccagcagtcttttctctttctggagacttaattctttggccgtgaaattggtagtactctcctcccaggttgctttgagaattaagtgaggcgaggttcacagtggatttatctcttgtccctgccctacg

SEQ ID NO: 16709 - DNA, 201 bp, Bos taurus
tctgatagggctctcccgaggggtgcctgtctatcctggccttgaaaacgcagcaaatcagacttgggctctgggtgaagctttggtggggccctcacggatgtgtctgcaagtgcccttgaatgcagctgtccctgctcctgatttcctctatcattgtctcttcagtctgaggcttttctcctgacaagactatgggcc

SEQ ID NO: 16710 - DNA, 201 bp, Bos taurus
cccaccctcatgccaccaaccccagctgcctctaagacctgccttcctcgggtacccggagaaagagaggaagggcatagccaagggcctcacaaatttctctccaaagacatacattaatagttgttgccacagatcagggttgaaacaggggttcattcacagggtctagtttctatacccagaggcctttttaagaac

SEQ ID NO: 16711 - DNA, 201 bp, Bos taurus
ttccccaccccccacctgtaaagtggaaactttagctccctggcaggtggtgatggggtccagacgagtccatacatgggacacaggtagcaggctctaaagtcctatgccaactcttggttcactgtggccccagcaggcaagatctggccatcctatcctggaagaagggctgtcccaagagtgtgtttatctcacccg

SEQ ID NO: 16712 - DNA, 201 bp, Bos taurus
cagagattctgcccagctgtcctaggtgacctgggcctggagtcgggggtgaggcctgcatgcctatctgtccatcttctgtccaggagctctatgcagccggggagaaccgcctgggaacagatgagtccaagttcaatgcgattctgtgctcccggagccgggcccacctggtggcaggtaaggctgtcctggcttccc

SEQ ID NO: 16713 - DNA, 201 bp, Bos taurus
ggcaacccactccagtgttcttgcctggagaatcccagggacggggcatcctggtgggctgtcatctctggggtcgcacagagtcggacatgactgaagcgatttagcagcagcatagcctcaaagaaaattccagctggaaagttggtgttaggtgattggttgggatgctatagagttagtagcacatatagagtgttt

SEQ ID NO: 16714 - DNA, 201 bp, Bos taurus
gggaacatttggttattggctgtctgagtggcactgggataatttgaattgatggtgaggtagaaatttccaacaaactgtgtaggatgaggctttctccaccatagtgttggctgatttcatcattatttccaagtttctgtgtttaaatgtttttttttttttcctgataatattcatagtaactatttgagagaatgg

SEQ ID NO: 16715 - DNA, 201 bp, Bos taurus
agctttacagtttctctctcagagaggagaaaagcccaacactgggagtgacccatgtcctgcaccctgatctcacttagctcctgagtccctttctgatggtaaccagaagttctattggacatcggctttcctcctctgcagccagtctgcccctggtggcacccgtctcacacatcccctcttccatgaggcccctgt

SEQ ID NO: 16716 - DNA, 201 bp, Bos taurus
gggtctgtgaatgctctggcagaaggcctctatgccagacctcccctgacagttcccagagaccaaaaccaaagcaacctgcccactgctgtcgggatgggtctcacaggcctttgtgccttgcagatgccctgccttaagacttaagtaagagggagagacagcaacaaagacatcaatagttattggacagggcatctt

SEQ ID NO: 16717 - DNA, 201 bp, Bos taurus
cgccctgcttagaaatccacagttctaagcagcatgccaaggccctgagcatgccaaagccctgagaagttctgcaggaaaatacaggacttccattcaccctgcgtttctgtgccactctggcctaggaccccgcccgagagctctgttacatggcaacatgtccacagcagagatgcctggcagtggtcagtggcctct

SEQ ID NO: 16718 - DNA, 201 bp, Bos taurus
aacacacgggatgccgaagtagagtaataatgacaataaatacaagcaccgtgtgttctcaggatgaattagaccctgccaggaggtgggtgagtactgacgctctggggaggactgggtgctctcagggacttgcgccatctcctaccctgcaaataccagcattgcctgttacgcgcattccccatgtcttactctaca

SEQ ID NO: 16719 - DNA, 201 bp, Bos taurus
gcctctggcccagggagattacagctgggcagggccctttgccttttctggtgctggcgggctgtagaaggacagcctggagtatgcactgtagagtgggcagaggggccagagaaaagccagggttccctccagacccagaacttatgcccaggaggcaggcctgcagtgacacagctggagcagctgttcagtgtttgg

SEQ ID NO: 16720 - DNA, 201 bp, Bos taurus
gatttggactttgggtaagatttttcttaaggcttgggccaaggcaatcgctggacctgtgcaatgggaacactgccagctccaagacttctctacaaaacgactggatggggcctgacttgatgcagtcagactacaaaataatcagttttaattctagaccgtgcttcagaggtcttccttgctctgtgcactttccca

SEQ ID NO: 16721 - DNA, 201 bp, Bos taurus
caaccctggaggaggctgatgctgggagcaggaagagagtgatttctcccttaagggcaggcaagtgggctggtgtcctcaatgccttctcactgccttcgttggcccacagggcaatgacggggggatttgccccaaggtgggaagaatgagaggtggaaacatgaggaagagagcaagccaggcttgttaggaaccacc

SEQ ID NO: 16722 - DNA, 201 bp, Bos taurus
acatggacttctaaattattgtgctgattttaaaatagacacacagtatatacttattaaatgtttggaaagttatatttattaaatttatagaaaaagtgattctgtaaattctacaagataaagataggcaaattaggtcattaccaagatcagcctttcttacatatcctccactttggaaatttagagacactctga

SEQ ID NO: 16723 - DNA, 201 bp, Bos taurus
agaacaagtgttctgtataattttagaaatgtaatttggaatatctgatattttcttatgtactgtaataatgggtaaacataaaagaatgttcaaaataggttgatctggtgaatgtgaataattcacttgttactaagttgccttttacctattgaaatatattcttctggaataaaacaactagaccaggaagatttt

SEQ ID NO: 16724 - DNA, 201 bp, Bos taurus
ataattattttgcctgcaatgatctacaccaattctaattttgctttatatttgctgtgcctccatgacatgggatacatagggcctctgagacctggctgtaaagatattgattaaaaattatttaatatggtctccaaaatcattaatctctgccagagccatcctcctaaaagagcacatgctaaaaggcccaggagc

SEQ ID NO: 16725 - DNA, 201 bp, Bos taurus
acttggtctctcaagatcatgtgttcaatctctaccaagacccaactgactaccatgagctaatcaagaaacagagaatattgttaaagaagctaaattttgttctaagattttggctgagttgactgggccccctactgtcgttattgaaggagcatcctgagctgactcagacactttgtttatgtcattagagaggct

SEQ ID NO: 16726 - DNA, 201 bp, Bos taurus
tatattaaaaagtaacagtgaatcctgtcacacaacattcacaaccaatagatacatatattctagagatagtaaatttcacaattaaacatgatataaaatagaaaaaatatggctgagacgattgaaaattcaaagtaggaaaatataaagaattcatcaatacactgagcaataataaatcctctcattccaaatgat

SEQ ID NO: 16727 - DNA, 201 bp, Bos taurus
cttgaagtcctaaaaattcccaccaaataaaacataactctcaactttcaggttgtgactattttttaatttgacacacagcatagccaagttgcctaaattctgtgataaaagaaaatctttaggatatccagagaataaggacacattatacacagaggaacaaagataagcatggtatgatacagaagaaaacaatgg

SEQ ID NO: 16728 - DNA, 201 bp, Bos taurus
aggtaatccaggaaaatcttactattgcaacatccttaattatataaggatccttatcatataaggtaatattcacaggttccaacaataagaacctggatatctttggaggccttattcagcttaccataacctccaatattatgacctgaagcaaatttttactttatactaacaaattcctaggaggataactgaagc

SEQ ID NO: 16729 - DNA, 201 bp, Bos taurus
tagttttggtgtgtgggactgagttctctgaccagggattgaaccaggcccccggcactgggagcacacagtttaagccactgggccaccagggaagtcccggtactccatttttattatcccatatttttatatgaagaaagtgaaccacagagaagctgcccagggccttccatctagtaggtagtgggtctacaattt

SEQ ID NO: 16730 - DNA, 201 bp, Bos taurus
gaacctaccttttgagagattctagcaatacccagttggacccatgggatatggcatggatgttaagaccattactggcaactgatccgtatactgcttgtgttttacttttcaaataaaacaaatgtatttcttacttattgttttttattatattttcctattgttgatgtggggatggaatatgtgctgtactccttg

SEQ ID NO: 16731 - DNA, 201 bp, Bos taurus
tgagactcttcacatagcaccccagatcttttgtatagggatacccacttttgaactcacagtattcaccagtaatcatgcatatacaaacattttgacctctgtttacagagacatcactgatttatttctatgaatgttcttccaagtggctctgtaggatggtggctgcagacttcattagctcagccttcagaactg

SEQ ID NO: 16732 - DNA, 201 bp, Bos taurus
aaccagaatcccaacactcagagagaacaggaccctaaggctataggcacaactttagttttctgactccagcatgcactgtgagctacaaagccgctccctctccttttctaatggtccctgtctcacgctgacagttacaaagggctccaggattctggtattacgttgatgatacagctggattttaatagttgtgag

SEQ ID NO: 16733 - DNA, 201 bp, Bos taurus
tctttcacaggtgtgcgttgctagcagacactgaaatacagtatagtgtgttatgctaggaagaaagcatatttgcatagctcacacatgaacactaattcaaacacagtggcatcatgcatcaaaagataggattagagaggcaacagagatatgtccattgactgatgatgtaaaactttttctcagtctagttaacgt

SEQ ID NO: 16734 - DNA, 201 bp, Bos taurus
tgtggggtcgcatagagtcggacacgactgaagcgacttagcagcagcagaaagtgaatgaaatgacattcactgataggtaacatctcagaaaccacaggaccaagcatctttcactttttcagaacattgcttgaagcttcctctcatcactgagctgagttagaagaagcataattaaaatggagagaatccattcaa

SEQ ID NO: 16735 - DNA, 201 bp, Bos taurus
cgagagtgaccaaaacatgtcagatcatattattcttataaataaaatttcagtgaagcatttcatccagagaaccggtgtttattatgtcttatctctgctctccttctctctccttgctttctctgccccaggcataccatttcactccaactgtgggctccagaagctccccctggtcattttgctctttcctcagat

SEQ ID NO: 16736 - DNA, 201 bp, Bos taurus
ttccatatcagaagaaaaatggtaattcaaaaggaagtcaaggacatacagctacattatagcagctgcaggagatgatgagattatcatgtgtaacatgatgttttcacaaggttgtgggagctgtgtaagcaagtggatatggctacagcctcctctttatggctgctgaccatttccttcaaatggtacaatgccata

SEQ ID NO: 16737 - DNA, 201 bp, Bos taurus
ttttttcagaaacaggtgcaatagggatgaaaccccagagagcttactgcagccacattaaaattttcatactcctacctggcctttcctgatgactcctaataggactcccttgcaaggcactgggctattctggggttggagacagaaagacctggcctgtgttaccaccttcatgactttagttaacaacttcttgat

SEQ ID NO: 16738 - DNA, 201 bp, Bos taurus
tggatctggagagtgggtctttaggaggtaattaagattaaatgcaacaatataggtagggtcctcttctgataggattggtggccttagaagaagaggaagagagagattgatgtgggagaactattgataggtcaatctctccactatgtgaggtagcagaagacagccatctgcaacccaagaaaagagccctcacca

SEQ ID NO: 16739 - DNA, 201 bp, Bos taurus
ttatgctcactttttcctgcccaagatttcctggcccactgtccttaaaagaatcactgaaatatgattgaatctttctgtgctgaggtagtattaagggcatgacagaaattgttcactagccatgaggcatttttgattcagtgtctcactgtgagtctccctaggcctgcagctacccagaaactagaaccctgggaa

SEQ ID NO: 16740 - DNA, 201 bp, Bos taurus
tgtccaaggaggtacgagggctgacacagcaagactttcctgggtagggcactggggtggggagcaacagagtaaggggacccaggagaactcctgtgccgtgtggcttttatgtgaacgtctcaggttttatgtgaacggggttagtttccagtttgtctttggccaatcattctgactcagtccttcctggtggcgcat

SEQ ID NO: 16741 - DNA, 201 bp, Bos taurus
gaaccattcaacttcagcttctccagcattagtgcttgtggcatagacttggattactctgatattgaatcattggccttggacacaaactgaaataattctgtcatttttgacattgtactaaagtactgcatttctgattcttttgctgactatgaggcctgctccttttcttctaagtgattattgcctgaagtagta

SEQ ID NO: 16742 - DNA, 201 bp, Bos taurus
tgtctttatcattctcctgatcaagtgcccagtggaaaagttactggtaagttccagtaactttttgatacccagctatagtgtcagaggccctcctctcataacgtttcctccagctcaactctttgcatgtgatttcccacagtattcaacggcggaaaggcatcctgtgactgcattggagaaaatgatggagtcaag

SEQ ID NO: 16743 - DNA, 201 bp, Bos taurus
tcctttacttgacaattatctttttaacccccttgttgtaccagatattggtttagagatattaatgtgctctcacgtgtattagttggcctcagctacaataacaaaatacaaatccaagagaaagtttccagaaggctttgtttctcataagaccttgcttgtgcacttgtcgatggcaactatgtgccatgttctttc

SEQ ID NO: 16744 - DNA, 201 bp, Bos taurus
actggagtgggttgccattgccttctccaatattggtctgctaggcctgccttaacagagtaccacagactgggcagcttaaacaatagaccttggttgtccacagttctggaggccagaagtttgagaccaaggtgttgaaagggtaatttccttttgagggctgtgaggagaaatctgttcagtgcctctgccctagct

SEQ ID NO: 16745 - DNA, 201 bp, Bos taurus
agacagctctcccagcagctggcagactgagtaccttggtcctgaagggtggccctgggtggtgtaccacagcacagcacccactctcaggctcctatatgtcaaagatgtcaaagatggagaaggcctgtttaacaagctgctccagaaacaagcacttgtgactttatgttgatctgtttcatgctgtagtttgcctct

SEQ ID NO: 16746 - DNA, 201 bp, Bos taurus
gctccttaggttctcctgccacgtggaagaagcccaaaaagacacactgggacaacaatcacactgagccttaagaagtggatgagatgaggagtggccaggaagaaggggagatgaagacatgacctctggggaaaagagaaccactgtgagatggagcaatggctcttccttgctggcttttcagcaggatgctcagcc

SEQ ID NO: 16747 - DNA, 201 bp, Bos taurus
gatcactgacttgtacactttaaatggatgcattaatggtacatgctttttctacctcaataaagttttttaaaggcggtagattaaatgttccagtagggagaaagagtctgggaaaccagaaatttggggaagagctgaccggacatccagtggacccagacctatgctgtgctgggcagcctcctactccatcaatgg

SEQ ID NO: 16748 - DNA, 201 bp, Bos taurus
ccctcattccttttgttggtaaggttactggagaaaacaagcggtaaggaatgaccttagtaattgttgccagaggtcaagttcatgggctgattaccagaagaatatagctgtgactctctaagctccagaggtgtttcctcacttcatttgacccttggccccttattgtaactctgcttaggttctcaactttagact

SEQ ID NO: 16749 - DNA, 201 bp, Bos taurus
atgcactcacctggggagcaggttgtgacttcctcattctgtctgggccctgccacctgcctgctgggtaaccacctgtgatctgcttacctgcttcgccatcactggcagttcacttggcctctgagctttaccttcaacctgtcaattgaaaaactgaactaaatagtcttctggggtgtcattccacatcctatttgt

SEQ ID NO: 16750 - DNA, 201 bp, Bos taurus
tacttagtcagctcacacacaggggagagatcacagtgctaggggagaggactatgtgaggatgagaatatgtggatgtatggcttatagacaggccagtacagagactggctagctaccacaggcactccaaggaagtgaggtgcttcctttgatctaaaccaaggagaaggagagaggcctcagtcagaaagactgtct

SEQ ID NO: 16751 - DNA, 201 bp, Bos taurus
atttgcattactatagttggaagggtttattaaaagttatacattataataacctagttttttaaatgaatatgggtcttaagatattgatgtgccagttgcacagctaattaagagttcagagaatcaaaaataccagatttaaggcttttgatgttttaaatgatttttagaactgagaaggtataggtttggttatga

SEQ ID NO: 16752 - DNA, 201 bp, Bos taurus
catatgaactcatctttaggccctcagttaagcaaagtggtggatagcaagcaaatcaagtccttgcatcttccatgtttacatcaaaacacaagcttatgtggcagcggtgtgttcgtcagccagtgtcgaccccgtcagcatgccacacctcaactgtagggcctcagcccacaacatacttgggtgctgacggagtgc

SEQ ID NO: 16753 - DNA, 201 bp, Bos taurus
cctctccggggtgatggtgatggcggagatggccagatctgctctctgaaaggcaaacccatctggtcagaaggcagtcctcagattactgctgggttctaccttcgcccaaggcctgtccattgccctttgggttgttcagaggaaaaggctgcaagcgttgacgcctcatgactttgaacgttgtaaggaaaatccagc

SEQ ID NO: 16754 - DNA, 201 bp, Bos taurus
ggatagtggaaattgaaagtacactattgtgaggttctttcactatatgtgaacaggtataatattatttgaaggtagaagataataaattaaagatatatatgatacaccctagcacaagcactaaaaaataacttcaaaattaaaaacatatatctaagaaagttagaaccaagattgccaggaggaatatcaacaaac

SEQ ID NO: 16755 - DNA, 201 bp, Bos taurus
agagtccatgttcacacggcagctgactcaggctcaacccttggtcaggggactctatctcacgtgcctcagctcagagctcacacgctgcaacaaaaactgggtgcggccgaataaacgaatgagcatctttaaaaataatgtatctcttggtgttggaaagacctggtcatataacaaaagatgaacacattcacacaa

SEQ ID NO: 16756 - DNA, 201 bp, Bos taurus
cctcagccaggtctggagggcccgccttgcagaagccgtctcgagccctcaattctaaactgcctctgtccctctagtgtgcacggcaacagtgtccacccggcactggccatgctgggggagagagagcaccatatgcttctactggtcaagggttcaagggcagagcttcatcttatttacctgagagtctctccttct

SEQ ID NO: 16757 - DNA, 201 bp, Bos taurus
cagacgggaggacagcagcgacccggggagctcagtttctggatcattaggggagtgtttggggcaagagccccatctgatgctgagcaggccatggaggaacaaggagacttcctccctacttctccatgatcactgagagcctgagggagccaggctgcaggtcagccaagtggaggcctgcatttccagagacacttc

SEQ ID NO: 16758 - DNA, 201 bp, Bos taurus
gggtggccggagggtgcggtgcggccacgcccatgcctgcagccagccccacatgggctctgtccaccccaacactccgtctgtcaacagttttccctccgtggtgaggccgcatcaggacagatgagaagggggctctcctggcggtcagagaccttcacctctgcccctctcaggccaggtgagggcccagggcactcc

SEQ ID NO: 16759 - DNA, 201 bp, Bos taurus
accttgcctggaagagctttggacaaaggacctcctgtctttgagtcagaggatgggagcaggctggggggaggaagcagtgaattcccccatctggcaaggacagaatggcccaaatgaccttcaacacccatatgccaccttctgtgcccattccctacactacactgctgacccctgaccaggcaattggcagaacca

SEQ ID NO: 16760 - DNA, 201 bp, Bos taurus
gtcagctctcaggagtagctgaggctgatagagagcttgtcatgtgaggtgccttcctgatggagagaacagcatgtgtaaaggccctgggtaggaacacactttacctgctgcagacatgggaagaaagtcaatgtggctggagcagggggtcaggaggagtggccgtagagaagcaagtgagctcagtcctctctgggg

SEQ ID NO: 16761 - DNA, 201 bp, Bos taurus
aggatggaagttgctaaaatgatcctggtggggggtgctgaggccaggctcaccacttttcagacacatctcaacagagcaggggcccgaggtggcccccagcagtcagagacgcatcaaccatcatgtcctcagtgggcatcttagggaagcccaagagtcactgatctgcagaggagtgaagcccttgtccccctggcc

SEQ ID NO: 16762 - DNA, 201 bp, Bos taurus
ctggggactctgacacctgcacagcatggacactggccagacttcatgagcacgtgagacagtagaactgtgaatcctttcaggtgtttgggtatgagaccttttcgggtcccctgtcgggccctcctttgcaataactcccaaagggccaggggagcagcaggcatcaaggtttgatggggtgtggggagggctggtcag

SEQ ID NO: 16763 - DNA, 201 bp, Bos taurus
gggtggagtgtgtgctgatgctggttccaggtgagcctgaagacgtgtccagcctggccggatccctcagaagggctgcgcttggccctgtccttgtctgcggagcgcacttaacgttttgaagggaaaagtcttgatgggtagaagctggtgggctgcccagcgcgttggacttgggggccctgagcacctaagccctgc

SEQ ID NO: 16764 - DNA, 201 bp, Bos taurus
tttggaatgcttaatttttatttgatcagtgctggaagtgtttaatatgttctttgatccctgtgcagcaaatttttttattgttctttcccatattttcagccttaacttatctcctttttattaagtaatgataaatgaaaagatacatgagaattaaaagcacattaacttgcatgactttttttgtcacttaagact

SEQ ID NO: 16765 - DNA, 201 bp, Bos taurus
gctgttggattatatgcattatattgagatcattgcttctgattttctgtctgaaagttcaaaacctgctgttgcttctttttaaaatcttgattgccctggttgttgcttatcctgcttataacccccttccttaggtatgtgactcatgatttaaaagacagtgttgtctggtaattagctctgtacctctcatcacat

SEQ ID NO: 16766 - DNA, 201 bp, Bos taurus
ccctgggccttggagaacagatacaagggcggaccgtgtagccacagcccagagaccagagtcagggctccaccctgctcccgtgtgacttccagagatatgcatgacttctctgggccacaagctcccagctgcaacagttggaaacacttcttggggtctcactgatactggtgactagcccagctaggctgctgcgag

SEQ ID NO: 16767 - DNA, 201 bp, Bos taurus
ccctcatggggtctcaggttatggggtgtgggggtctcatgctgccagaggagcacttccccagccacagcagtggggtggccccacccagcttcttccttctgagcctgtgctgactcaccaccagcgtgagcgctcgtgtcctggcgcccggccgggcatcagaggcatctataaaagcagactggtccaggccccagc

SEQ ID NO: 16768 - DNA, 201 bp, Bos taurus
atgaacacaggatattttccacttctttttatcttcaatttccttcaataacatcttaggtcttttatctccttggttaagctaaaaaattgcttaaatattaaaatgtgtttatacaaattaatgaataggcattacttaggcatgttactggggcttccctggtggctcagcagtagtctgtctgcaatgcaggagccc

SEQ ID NO: 16769 - DNA, 201 bp, Bos taurus
gtcagctatttgaaaaaaaagaaaaagatgaagtgtcagtgaaaagctgctaatacacaaagcacacatatctagacttcaagaatgtaggacatttgtggtgaaaggttcaagttaaaatgaatatttatccttaccttcatgtgttttctctaggtcaggtaaaaatgaatttattttttgaataataatctggtatat

SEQ ID NO: 16770 - DNA, 201 bp, Bos taurus
gttagcattaaaaatgattaggaagttataggttgacataaaagagagtagccttacatggattaaaggaaaatacacagttatatcaattttatggttacaactgtgtaaaaatacaggttgtattttttataaaaaaagcaaagccctaaaacacagtggtttggtttttccatgtcactaagcatgtatgtgtagagt

SEQ ID NO: 16771 - DNA, 201 bp, Bos taurus
gtacatctgggttgtttccagttcttggctattataaagtttccataaacattcaagtacaaggcattattcatagtctttcttttctcatgagtgaatacccaagaattgaatcaatagctggattatatggcaggcttacgtttaactgttaaagaaactgccagaaaaatagaaataaagaaactgcctgtttcccaa

SEQ ID NO: 16772 - DNA, 201 bp, Bos taurus
cgcttagaaatcactttaattacatttctctaatcaataacgatgctgagcatttttcaagtgatttgtttttaagaacacgaggtgaatttaggccttgaaattggcttctggagaatcggtcctactttgaattccttttcagttacctttcacagggaattttgtgagaggacgggtcatttacagccccagaggcct

SEQ ID NO: 16773 - DNA, 201 bp, Bos taurus
caccaacaggacacatggtgctggattaggcaccataaatgtccaaaatgttgagaaaaaatgtgagatgagcggggtcagaggcccacagcgtacagttgccagcttgccatgcagcctcagaacttgtgtccagcactgcattcccgacactgcttggctcaggatgtcagcgtttgagcttcaacaggaagcttctcc

SEQ ID NO: 16774 - DNA, 201 bp, Bos taurus
gagaaatgactctgaacaggagagcatggggccagaaccactgaggctcataatgccaagccaaggggcttaggattccggctgtgagcactatggagctctagctgattcttgagttaagtgtctcatatggtacatgatgtcctccaggtagaaaagtctgatagcaatggtcaaaatgatttgtaacaagagccaaga

SEQ ID NO: 16775 - DNA, 201 bp, Bos taurus
ctggaccagcactaaagggagtagtcaagcttctctcttagagtctagggctcttggccttcatctgttcctgaagaaacagaccataagctggaaaagcaacctgagggctgtccatgaaagggagagtagtgactccaggctgccatgacaatgagatgtcatcctctgctaaagcagattgcaggggatgggactggg

SEQ ID NO: 16776 - DNA, 201 bp, Bos taurus
ggacagggtctaacttcctgccaacccaaaagtggccctctaaagcctggtccgtggaggagaacagtaatggagagtggctatccccagcagacagcagggggtagaagactagcctggcctctgactgtatgaccttggacgacctttaactttccaagcatagtgtctgcatctcgtgtaatatttaccttgcctggt

SEQ ID NO: 16777 - DNA, 201 bp, Bos taurus
attctgccctcctccttaccccctatcccctgtggatcatgaaatcaaagaggacctcacgcctggccagctcttatctccattggtaccccaggatgcccggctttgcattttctattttcagaaggcttaggttaatctgaaagtcctgccagagaccacccaccacccttaaacaaacagctcacctttcagcccaga

SEQ ID NO: 16778 - DNA, 201 bp, Bos taurus
agcacctggccctgaacctttcaaaagtctagttctttttttaatcccttgctgccaagcgccgactggctgctgggcccctgtggctggttcctgcacaatctgtgtgtttcattttcatgatgagaggcagattacaggtctgctgcatgcccaggttcggcccggtgggcactgcataggcacactcatagagagtgc

SEQ ID NO: 16779 - DNA, 201 bp, Bos taurus
cacgagtgtgactctggtggaacagtgggggcaaactcctgactggagtgactctaagggaggacagggggcgaggaagggccggtggggagtagagacctcttcctactctttcaaggaattgtgctggcacgtgaaagcccacatgtgcagctgctcctggaacacctcatgaaccatctgaaatcaagctgtggacca

SEQ ID NO: 16780 - DNA, 201 bp, Bos taurus
actggaccctgagacataaaggtcacagacctgactcccactcttggggacccaactcaacaagctctccctagacctccccagagcctcaccagacctagtgagggtctcactagggccatccaggcctcactgcctctttagcttccactcctgatgctcctcagggacagtgcagccattctgcactgcccactcctc

SEQ ID NO: 16781 - DNA, 201 bp, Bos taurus
ccagccatctgtgattgcatttcaactggacctgcagaacagtcagaaagaccccctgagcagcatgtacagcatctctttggagcctccaagaacacttggcagcatgtagcactggcccattacacaaggagggaactgaggccctgggaggaagtcagtgattctccactggcagaggtctgtaagtcccggagctaa

SEQ ID NO: 16782 - DNA, 201 bp, Bos taurus
tacccgggcccagttctcctgtccttggtcacctgatcgtggggaacctgccatgaagccgcaggtgcaggctgggaaagagaaggtcatgcagcagaagcgggggattttggccacttcgtgtaacttatttgtgccttcagagcttttagggggattatttcagtagctactgtgagtagatgggagtagaggcagtga

SEQ ID NO: 16783 - DNA, 201 bp, Bos taurus
gggtccctgctgatcgcacctgtaatcaccctatgatccaaagaccaaagtgtccagtcactgggagcagctttgcactaactgatggtggactcctttcgggtgaagactgggccactgattgccttttaccccatgtcttacccgtgagctgacatacagcagaggaaagaacctgaagaaccaataggcaaaaccctg

SEQ ID NO: 16784 - DNA, 201 bp, Bos taurus
ggacaggctgtgcctggctctgggaaccgacctgactacaagacataagctgggcaggacacaaactgcactgagccctgaaaacatgcactgcagctacgacgagctaaggaggcccacggcaggtcacctggcacatgacgtgcggagccaacgcccctcctcccacccccgcgaggcctgggccctcaccggtaactg

SEQ ID NO: 16785 - DNA, 201 bp, Bos taurus
ggggatgcaggcccccgcaggtctaaggcatgtccatagatgagacttatggtgaaaaaaatagcccttggggagtgctggagggcatcagagggcatccatcagtaaggccgtgcgaggctcactgctgtgttagcttctcagagtagtgtctgttccctggtggcttccctgatagctcagttggtaaagaatctgcct

SEQ ID NO: 16786 - DNA, 201 bp, Bos taurus
gctgggcacagaagctggtgggtgagagtgaaactgctggaagagaacaacaaagccccaaccagagacggcagcatgtccttgggaccaagcgaacagtggcttggcttgcaaagggaagtcggggcaaagagcagagtgagaagagagatggagcccaaagcagagaggcagcggcagagcaaagccaaggacccagag

SEQ ID NO: 16787 - DNA, 201 bp, Bos taurus
catgaggtcttctaaaggctgccctgtgggtgagcccctgcctacctagacgcaccagagtttcctgcaaaacgagcagtgcccatgcctggggccttgatggtctccgagactggtcgcttgtgtgggtaggatgaccatggtcctgctgctagctacttccctgaatgtgtgcccagatccactacatcctacccccgg

SEQ ID NO: 16788 - DNA, 201 bp, Bos taurus
tgagagataaatatcgaccaaattgagactgaggtcaatgctggactattgggaaaataaatcttaatattaaccaaaacctgtagatgctaggcctggtgtttttgactctaaactgctgatcaggcagaggtacactcaaagtcagttctttcctttattgtgtattggtgtaggtgcaaactggccttcaaattgacg

SEQ ID NO: 16789 - DNA, 201 bp, Bos taurus
atgacagctggcttagccctcagggaaggggccatgaagctgcagaggaaacagccacacccagtcaatgaaagtccagggagcttggcaactccgagccgtctgtggccatcattgggccgtactgtgtgccaaggtctgtgtcaggcatttccaccatagttatctttttaaaggctgcttctaacatttgcagaaacc

SEQ ID NO: 16790 - DNA, 201 bp, Bos taurus
cacctttcccagggtggccaccatgcaatgaccgatcgaagccaaagggtgaagacttggccatctctacccaaatcaggacacctctggagggccactccagccccacagctcccagaagtgtcagacaagatcaaagtttgattctccttcttcccatacctgctgctaacacctccttctacagggttggccccagag

SEQ ID NO: 16791 - DNA, 201 bp, Bos taurus
ggacatgctggggcccgtacgggtgacaagtgacaggagcttggaactggtgatagcagtgaagataagatgctacgtgggaaatctttatgctacagcatttatatgcggactgctcaatcctccttcacatactcccacttgactatatcaactgcctgacttgtttttaccccgaatgtctcgttcaaataacaactc

SEQ ID NO: 16792 - DNA, 201 bp, Bos taurus
atcaatttccactcagtttcccacaaacgtaatggttttacatcaaataggaactgcagaaaagaaacactctctttagttaagtttaatctggcctttgatctgggagagcttggagtccagcacagttgacagtgtcgggctggtccccacgttgtggctcttctgaaccgtcgataccttgggaaccaggggcctgag

SEQ ID NO: 16793 - DNA, 201 bp, Bos taurus
accaacctccacatggactgcagcccagtttcaggccatctggatggctaagcaaatctcaaaccctgaaattgtattaagatgatcctgggttgctggtgctaccaggccctggcaagaagtgaaaaataaagtcttccatagaggaaaataacatcatgcttggcctcaaattatttctacaaataagttttctaatac

SEQ ID NO: 16794 - DNA, 201 bp, Bos taurus
tcaatctacagatgaacaaggacagcgtgagcagcagccaagtctgccgggctggagagaaaccaaagacatgggctcctcggtagctggctggctgtctgcagagacgtgaatgacacagacagacaagccacatgaaaccctggagaccagggcagctggagaaacactccacagctacagcccatctatcagacacct

SEQ ID NO: 16795 - DNA, 201 bp, Bos taurus
ctgtagaggagttcgatacaaccacttttctttatcaactttaagctgcatacaggcaaagagatcacaaactgctgggaggccataacggtctgggggaaagctgtgttcctcctgtaggggcgaatcaagcaatactccctgcaacaagacaaagcgtgggtcgctacatggcagctgggaggccggataccaacagtt

SEQ ID NO: 16796 - DNA, 201 bp, Bos taurus
ttctgctgaggtctctctgggtcactggggaggtcacagatggcatgcactgtttggatctgagtcctgcctgccccacactgtctgctgctcactcaccgtcagctttggcctgcccctctcttgctctgtttcctgagattctaaattgcacattgccgcctgcagcactctcctctcctggcccagctgtgtttgctc

SEQ ID NO: 16797 - DNA, 201 bp, Bos taurus
catttcagtctcaacaatcctagcagttaggcagcatcggccttactttatagtcagagaactttaaactcaggaaacttaaaaacttctcccaagatggcgcagctagaatctgaaatggccactgctttccaggctctagataaggtgaccccttgcttgtaaagggtacttagagatgagttaacatttgttataatt

SEQ ID NO: 16798 - DNA, 201 bp, Bos taurus
aaagtacacacgtgtctgtagccttgaatcagcacaggtggtggtgactatgactgcattgcctgcagtggacaccaggtacgccagaaagtgcaccaggtagaggattttgcccaggtgctggacagcagggaagccctccaaggtgaattcttggaaatttgtcccattcctcatttccatggccatggacatcttttc

SEQ ID NO: 16799 - DNA, 201 bp, Bos taurus
tagctgctggcgtgtggccctttgtctctgctgcactgggggcggcttccctgggcactggtgcgtcttccctccgctggtggattccctgtgtaagctcccatgcttgggccacctgagctctcgatccactgcagaattctgacttttgacacgcagggttcagtctctcagccgctagccctccacccctcacttcgc

SEQ ID NO: 16800 - DNA, 201 bp, Bos taurus
tgtatgaatgcgccttagctcctgttggtcgacagcgtccttgtccatcttctgtcttgttgtttgatcatctgtgaaatgggctctgaagtttgcagtcgtagctgctgatttgtttctctccttttaggcctatctcttttttgtttacatatgttgcagcttcattgtttggcacagacacactggggttgccatgcc

SEQ ID NO: 16801 - DNA, 201 bp, Bos taurus
tgtgtaggagaacagaatcgataaaagcttggtaacaacttccagatctcaaaaaaaggcatcctttttcctattgcgctgggaagcctccttccctagagtggggtgtggacactttatcagggacaggtcagagctccatggagtttatatctcactaatggagtgtggtgcccttgggggtcaaaagaaactgatcac

SEQ ID NO: 16802 - DNA, 201 bp, Bos taurus
ttaacaaattctagctcctgttttcatgagtcataaatgtactaagacctggggtttcgaggtcccgctatggagggcctccactgaaccagccacacttgggactgttggtgccatgcagatgtgcaggagttaagagaaagcaccttaccaatccgtcttcccagcagcatctcaactaccgagaaagtcgtctggtgt

SEQ ID NO: 16803 - DNA, 201 bp, Bos taurus
attgtcaagatgctcgtgtgtacctttgagaagtagagcaggtcgcagagcaaacccagcacagagcaggacttaggactcggggcttcccttcctgggcgtatcgacagctttgggcctcccacaccaccccaagctctctaacacgttcatcttgctattctcagcaagtggcaccgagcccagcggctgcgtggcctc

SEQ ID NO: 16804 - DNA, 201 bp, Bos taurus
gcgcttcaggactgcctgagagacgccaggcagtctgcacctctctgctctctgatgctgggggatgtgttggggacttggggaggggggacagaggagaggactgggttcactaatccacagggcagacacagatgccaggtggattggtcactgcccagctgctcccaaaccccagtgtaccctgtgtgctcctgcccg

SEQ ID NO: 16805 - DNA, 201 bp, Bos taurus
atacagcaggatccatatggtatcacacagcatgtgtgtctgtgggagcttcacccccgctctcggtccagttggtcagcatttcaggagaaaatctgaccctccctgtggccattcctctctcctcctccctgcactgaaattttcaccaggcaaatttgcaggatcttttttctatgattgttttcttgataaacagtc

SEQ ID NO: 16806 - DNA, 201 bp, Bos taurus
tcttgtgaataagtacctgtgctgtcgtctatccaattctagttcttgatctcaggcttaatcaatgacagaagggacatttagagacatggggacactttagccaggagaaggcatggttgaggcagagaaagaagccgtcgtcactgccgaacatctcaagtatttcatgcagcaggagtcggatatgttcttgtccca

SEQ ID NO: 16807 - DNA, 201 bp, Bos taurus
aactggaccacttcatctcaggcttcgcctgaggccgcccccgataccttccctcccggggagcccccgaagcactcacatcaccgcgacatctgtgaggcagctcaggctgggcctgctccttggcctcaggttttcattttgtgtatttgtttgtttgtttattgctgaaaaataaagaataaatgaggaataaacagt

SEQ ID NO: 16808 - DNA, 201 bp, Bos taurus
tagaaatttataaaacgatgggggttttaatggcaatttggtttacagtcaataacgaacccaactttcattcataagcagggctcctctgatttacatatggaggtcactctctcagccctgagcccctcgggagaggaggcatctccccttctgtttctagagccactgctagctatttcttccaggtgcttcacttgc

SEQ ID NO: 16809 - DNA, 201 bp, Bos taurus
ctttctggcttggtgggccatgcggcctgtgctgcaactactcagcttcgggctgaagagcaaatgcagccacgacgctgtatggatgaaagagcaggactgtggccaggccgactccgcttacccggcagaaggctaactttcgtccacccggagctgggtggctctgaccctggtgtgggtccgcttgcaggtgacatc

SEQ ID NO: 16810 - DNA, 201 bp, Bos taurus
gaaagcttctccagctctagcagactaaaccgtctcacaatctgaaagcatctgtgagcgccttcccgtctccctgctgttggtgtctagtggcctccccggataaatcacaatctctagagtgtgctttgctgggttgtgtgtttctccccatctccatcagaggcctctacatggagtgggtccccaatggctatttgg

SEQ ID NO: 16811 - DNA, 201 bp, Bos taurus
gtggagagagcaggccagcttctgcattaggctcagatccctcatcccaccttttgcccaaatcatttaatacataaaacacaggaagtaagcttcaacacggaaaaggcctgacattaagtgacagcattgttcagaacgcggaaagccagaggcaaccttcacagccccaaggaagggaggtttctgtaagatgcggca

SEQ ID NO: 16812 - DNA, 201 bp, Bos taurus
cggtcactcagtcgtgggctaagcggtacccgcgggcaaaggaaacttcccgatcgctctacagctcttagaaacatggcccggcttcaccacgcaagcctgcatgctcgtcaagcgggagcagaacgcgcccaggaacgaccactccaagcacggactcaggccggctggccaagccccggagcctagagcgggtgtacc

SEQ ID NO: 16813 - DNA, 201 bp, Bos taurus
gggcgtgtaacagctaattttagtccagcgtcttcacgtcacaaggggtgaaactgagtcaaggcggcagggcttctggtcacttacacatcaacagctgcttctttctggtaagcaagaagggctggaagggggttccctcagttcttctgtgctcagtcgtgctccactctttgcagccccctggactgtagcccaggc

SEQ ID NO: 16814 - DNA, 201 bp, Bos taurus
cactaaatatatatatatgtgtgtgtgtgtgtgtgtgtgtgtgtgtgtgtgtgtatcatgtgaaggctgttttgtgaggccccaggtagcatgccttctagggggtcacacagagttggacatgactgaagcgacttagcagcagcagcaggtagcatggtgatttatttgggcccagcagtaatgggagtagtctggcag

SEQ ID NO: 16815 - DNA, 201 bp, Bos taurus
ggaaccccaagtctgacaagttcctctgaccctattgtatctctgccatttcgagttgaaaaaaaaacaaacaaacaaacatcaaaacttcctctctaagtaagcataaaatgggttcttacactggacaagccctattaataaacactgacaaacaaagtgtaaccgagagatcagggcccagactacaggctccggagg

SEQ ID NO: 16816 - DNA, 201 bp, Bos taurus
agttgtggcggcatccgtgctaccatcagtctcctgcgtgccaggtcctcttgctggagctgctggagttctttcattagtttctcttgattcttccaaggataaagagaaataattaacaactgagtcacacactttggatagtaacattaatagtgaggaaatcatgaaggaaattaaaagtggagaaatcatgaagac

SEQ ID NO: 16817 - DNA, 201 bp, Bos taurus
ttccctttcgacaacatcatcacccaagagccaatgaatgggtgtatcaggctttaccaaagagccagagtaactagagggaaagataatgaaaggagatgcggatcagtgaggggaaggggcctcaagataaccctccacgtgtctgtccttgacatcaatggtgaagcttgagcagaactcagccttcgtaggggaacc

SEQ ID NO: 16818 - DNA, 201 bp, Bos taurus
ccttcgaggcttctctgtcagtggggctctccaggcatgaatgcaggagtgtattggacaatacttgttgccatacccttctagaccaaaggagctgcaccgcctccacacctggccctcactggggcagacccaagtcctccaggacagcctcaggagcaaaccccagtggacgacccacatgcagaggtggaatatatg

SEQ ID NO: 16819 - DNA, 201 bp, Bos taurus
caagcagattcttaaccactggcctgccagggaagtcctgtggattactgtttaattgtctcggttatgcaggggattatatctataccatgtggcaaaatacgttaaggccactttaaactgtgctctctcttttgttgaagttgttttccttcactgactgactctctgcggctgcttccctacttggcccagcctctc

SEQ ID NO: 16820 - DNA, 201 bp, Bos taurus
cctgaccaatgggccaccagggaagtcccttgttttcttttgaaaacactgttttcctaacaggactgaacttattctctgatttgagtgagtcagggtagtgggagattcctcacgaaagtggccaactttaaactccagctcacggctcactccctctgcacagagcctggagttccagaagcaggtgtatgaagtcta

SEQ ID NO: 16821 - DNA, 201 bp, Bos taurus
gttctcagcctcaaaaattatgctaataaggtaagaacaataattcatagtatagtcactaatttctctaaggggaaatatgcagagaccctgggctctatgtttgttttcaactaattatcatgtatttacttttccattagtccaataatttttctttcaattcagaattaagcaataagacactgaattatataaagg

SEQ ID NO: 16822 - DNA, 201 bp, Bos taurus
cccgcctggaggctaaggcgtgcgccttaagaaggtgcttctgctaggagagcattaagcaggctggtcctaccattatgtgcaggatgtgcttgtcttgcgcctcgtggtccagcctctcggccgtgtagaggacgccggtgctggggtctatgcggaacttcctcatgctgatggagtcgatgctgccgtggacagtgt

SEQ ID NO: 16823 - DNA, 201 bp, Bos taurus
agccacatctgggcctgcttaccactttcagcagctgtcctttccactagcttgtctccttcatctgccatcaggcctacacctgaacccctatgctaagaagtgagtaatatctcatgtaaatgggtcagtgttagtttcaaccttgtaggctaggtctggcctttggaattagtatctccagttattaacaaacacaga

SEQ ID NO: 16824 - DNA, 201 bp, Bos taurus
caggtgggcttgcctgaaggacacaggctggaggcatttgctcctcactacgctctcagtgcctgcagtagtgtcgcgaggccaagcaggttttcagtagtttgctgtacggactgaagggagtgaatgtttccatttctaattaaaaaaaaattataaatttttattggctattttccacttacattattgtaaaatatt

SEQ ID NO: 16825 - DNA, 201 bp, Bos taurus
tgtggttgctttttcccgaatgtgattgaaaacttataactacgtttattatgacaagtttataaaagcttatctaggagaaaaacagcctccagaacttttgtcttctttcatcctttcaggttaaatctcactagattgctttttcctttaaccagttttgctgaaactacacagacaatgccatacttaggtaattaa

SEQ ID NO: 16826 - DNA, 201 bp, Bos taurus
cctgggtaagcaacagccatggacaactgtatgacggtcaccgggagtctaatcacccaactcccaggagtcagatcaactcagatcagcacagaaattccggttagttccagcaaggttgcaacaacccacatttacaggtactggttaacctttctgtttccgcttgtgttgccctattatcctggaagggaaaactaa

SEQ ID NO: 16827 - DNA, 201 bp, Bos taurus
atattgcttcccagactgggctcctggtacttgcccacacatttttggatcctggggttcccctgtggaggaagggtatttttccgtggcccatcttcttccctttccccaaatcgttttaaatcatttcggtcgaaatggaggagaggtactctcggtggagtgagggagtgacttggggcttggtgatttgcaaggcca

SEQ ID NO: 16828 - DNA, 201 bp, Bos taurus
ataattatatcatgaattttcaataatggctgcttttaacaatgatctcacaagattcctgagaatttagcaagtgggtttttggaaccaccatgagctggcttcagtgcattattccctaacccatgcttctacacagaggttaaactccagcttctttgaaagaccctctcttccacagctacccgatggaggagaggg

SEQ ID NO: 16829 - DNA, 201 bp, Bos taurus
ctcttgcttctaactgcttgaggcttcaggtctagccgtcagatgggacacatcttggccattcttaggaaatgcaggtcatcctcctgtaccatgttctgggtattgcaaaatgcatgcggttctctaaggccccatctatcagagcttgtctgagtgccatggagtcatttctcatctagagtctttttttgacgaatg

SEQ ID NO: 16830 - DNA, 201 bp, Bos taurus
aaacaaaaccattgaggactatgctgctccctaactaaccccttgtaactttttagtgtcctaaactgaatggattcagtgtggtttcctccatgcccatatggtctccagatcttgcatataagcaggtctgtgttcccgaccttatatatcagcagaacaacctcacagatgctgaacagaggtgctgtcatctcactg

SEQ ID NO: 16831 - DNA, 201 bp, Bos taurus
gacactgaaaaatggtcttgcagaagggttgtaccattctgaatctccagggcaatgtatgagtgctctattgtttcattcctttaccagcacttggtgttcctggtttttatttttttaattttagctattttactagggtaggtggtagtgtctcgtcatggatttattttgtatttagttttaatggggatcaatttg

SEQ ID NO: 16832 - DNA, 201 bp, Bos taurus
ggggcatcagttcaatgctgcttccaaggaacaggtacaatgtgaggtaagggtttacagtgatctatccatttctggccttggcaggtgacagttttagaatcatatgaacggtaaggcagagggttagggttagtacaaagtacttcttgtatttcttggcattagaatagcagtgtaatggccttgatcttgaaaatg

SEQ ID NO: 16833 - DNA, 201 bp, Bos taurus
gaagccaggggcagtgaccctacaagcaactgacccagacttgccggtgagtgtccaggaatctctggaggaggcatggtttggcaatggcctgcagccttattggggagtctgagtgcagcagtgtgtgcatgggaccttttgaaggaagtcctcattatcttcattaccaccactatagtttggtgtcaggtcaaacaa

SEQ ID NO: 16834 - DNA, 201 bp, Bos taurus
gaataagtatagcatatgatgaaggaaatgagatggtgatcagcttgatcagtgtttgaacaccgtctgaatcaaatgcaggttgtgtgaactgtgaaagtttacataatacatttgagaatttttcctaaagtgaattgttataccaatatctgcagcataagactattaaaatgtttaaatgaaattatgcatgaaaag

SEQ ID NO: 16835 - DNA, 201 bp, Bos taurus
caggttttattttccatctttattaatcatctccaggggggaataaattgcctgctaatgaaatttgcagatagcactaaattttgaggtgttgccaacatggttaacaaaggagaaataaatataaatggacttaagcatgctatttatcatttatttggacttaatcataattgttcccaggatacatttataagcaat

SEQ ID NO: 16836 - DNA, 201 bp, Bos taurus
aaaggcatcatcttgttggtctctctgcttttacttgtgcattccttacagtttttcttcacaaaatttatctccattatcactctatggccaaagtaaacctcaattatttcttaaaaaatcatctaattctttagctgaaagtctttcttggttcagattaatattacacattccttgaggttgctattaagactaaat

SEQ ID NO: 16837 - DNA, 201 bp, Bos taurus
cagaagtaagaaagttatactttcctgaataagagcaataaattcctgaatttacatggtcatttcttagcaggatgaaaactaaagctacaccttcatgatatcactaaagtacttgctttgtagctgacgataaatctgcatttttcatcattcatagactcaatgaattgctaaacttttgtgagttgacatactttc

SEQ ID NO: 16838 - DNA, 201 bp, Bos taurus
ttgtcgacaaagtaatgtctctgcttttcaatatgctatctagattggtcataacttttcttccaaggagtaagcatcttttaattttaatttcattttggttggtacttaatcaaaggaagaaaaacaaacaacagggacagcatgaagtaaatttgagataggaaatcttccagaccatctaattactcatcttcttga

SEQ ID NO: 16839 - DNA, 201 bp, Bos taurus
ggggttgattatgacttgagggaacatgttgatgagaagcaggacagccctgggacacagagtggcatggacacatggccatatagataattacttcatgcgcacaatatagagcttagcaataggattggaattatcagtgagtactcactgataatgtacattgatgatttaaaataaaagaagccgaatagctattgg

SEQ ID NO: 16840 - DNA, 201 bp, Bos taurus
aaagttaaaatggcctttttggattttctccagttgagttgtgttgtccagttctgtgtgatcaatcactggattcaagccatcctaggaagggatgttatcttaggttccctgaaaactaaaggccctgacaaaatgagtgctatctaattattgtttttattgtctagttatggtttttatctagaacctagaagaaat

SEQ ID NO: 16841 - DNA, 201 bp, Bos taurus
taagaataaaggattctggtaccaagaagtttgcaaccaacaactgcacccttatccctttttgcataaaaggagcttgaattctaactttggtaagatgattctttgaggcactggtctaccaacttctcagtctgctggatttctgaataaatatctattgccccaacaacttgtctcaagaattactggcctgtcatg

SEQ ID NO: 16842 - DNA, 201 bp, Bos taurus
aggccgcccccgacctgcttttctgcccggccccttcccactccctgagctcacctgaggcatggcatgcacagccgttacccacaggactacagacaccgtgtaggccctcagtgctgtgtggaaacccaacatttttgctgctccctaactctcctgaacatatttcacactttaattctcttttcaagctaccaacat

SEQ ID NO: 16843 - DNA, 201 bp, Bos taurus
ggaactctgatcccccaggtctagtgacacggccaatgtatatatatataaaaattatctaaatagatcattgtaatgaaaggtacaattagaagtggttcaaggagaaaggccctttaggatgaaggtgtgaaatacagcggaatcagtaggaagagaaaataatagatttaactcaacacaaaggaattagagattaga

SEQ ID NO: 16844 - DNA, 201 bp, Bos taurus
tttcttgaattctttctatattactttcagatctgtcttctttccaatcagttccttttgtttctttctgatttgcttacaaatcttttggccttcttttgtaataaaccctttgtagtaattttctccctcctgaagaattagagttaccatctgataatcatgtctccatatccattaacgtcaaacagttgggagagg

SEQ ID NO: 16845 - DNA, 201 bp, Bos taurus
ctgatggaggataagaggcttatggatgcttcctgatggaatagactgactgagggggaaactgggtcttgtcttaaatccctaattttaaacccctataagacctgcactcctgccagcccatctctgttacttgccttccatcaccgctctgccactttgcttcatctcctctgtcctcttggtttacttagaatgtat

SEQ ID NO: 16846 - DNA, 201 bp, Bos taurus
ccctttcctcagcctaggcttctgggaggggggagccccaggcgccaaaagttccagatcaccagggtaagctgatggagggttggttgatggaaattcagaagaaagcaaggccttcagcatccaccaaccctcagatcactgccattccctgtcatttcctcccgatcactccttggttgccgtgtcaggctgggatca

SEQ ID NO: 16847 - DNA, 201 bp, Bos taurus
tctatcagtactatctatatgtgaacactgcatcaagcatttattccctgttgaatttgtagataagtaacttcttttacccacactatgtcaagtagcttccttataaaatgtgggtaaaaatagaaaattagtaaatgttgttgagaaaattgaaatagttaattcatataaaaagagttaatctaatacctagaaata

SEQ ID NO: 16848 - DNA, 201 bp, Bos taurus
tagaattgtttgaattggaaaagagaacacattcaagaaaacactatttgtccatctgggagagagaagacgtggggtacagggatggctatatgtgtccaacaaaacaaggttaaatgaaatctcaagccaattatatttgagtgatctgctgctcagagtgcatgattaagttcctagcaggttttatgtctgctgggt

SEQ ID NO: 16849 - DNA, 201 bp, Bos taurus
ccctgctgtgtgcaaagcacagtagtaggttttggttaaataaagatgatatccttagaatgctcactgggttcaagagacagacaactgaggggccaaagcaattcctgagataatgccacagcagaggacagggctggctgtggtacaaaagtcatcagcattgctcagggccaagtcttcactacggagaaggtaact

SEQ ID NO: 16850 - DNA, 201 bp, Bos taurus
taactaatgtctgctcatttccccctctccctcaggcaaatttcttaatatcttttagcttcagtttcgtcaactcggaagtgaggtggctcttatccacatggagagctatgagaatgaagtgagattttgtacatgaaatacccaggacagtggctgacacagtaagtacatggtgagagctggctccattatttttgt

SEQ ID NO: 16851 - DNA, 201 bp, Bos taurus
gtcagacgtctcctcaggcttcagttgttttcaggtttttgtttgtttttaatagtttgtgcatctgtttgtttgtggttgtgctgggccttcgttgctgctctggcttttctccggttgtaggagcgggggttgtgctccacttgcggtgcgctggctcctcttggtgacgctgtcttcttgccaagcaggggccctgga

SEQ ID NO: 16852 - DNA, 201 bp, Bos taurus
ttggcccgtatctggaaataatagttttatatattctttgttttgtcctattttttaaatggaagagggtaaatctagtccctattactccatcatgggttcaggtagaaatttattttgtggttctttgtttcatttttcaaggttaaaagttttcaataagcctatattttcagtatttattataaatttaggtaccca

SEQ ID NO: 16853 - DNA, 201 bp, Bos taurus
gttcatcccttgaatctgatatttggtgctatttcagcaggcctaagctttggatatctatatgattatggtgagtagcttcctatagtcacactacttctgccttctttggttaaatctcccctgtcatattagatattccattcttacccttccccacaagaccttgaaacactcttccctttactttgcaaaaaagtg

SEQ ID NO: 16854 - DNA, 201 bp, Bos taurus
aaagaggttttgaagtacagttacacaccagtgtattctattactcattcaatgattctaagaaacagtataacaaaggattgagagcatcacagtgagagccagagagaacagatctgaaattgttcttttccttcttgctaattatatgaccttgaatatatgaacttacctttctgggtctcaactttattgcatgta

SEQ ID NO: 16855 - DNA, 201 bp, Bos taurus
ataattattccatcattggagaaggctttttttaggagtgtgagaatatgataggtgttattttccaaaagataatcccaggatatggcttatgaatagacgaagtcagacgcatatggaagaacagtatctctaatgaaaattacactattgaggactatggcagtgtgaatgatgaaaaggcaatagaccatgccctcc

SEQ ID NO: 16856 - DNA, 201 bp, Bos taurus
tacatctctattccaaagtgagtgaacatggttgaccctcctcgtagttttgtctaaactctggtcctgaaatattagacaatgactatataataaaatagagattctaggccttactcagaaatatatgctaatttttatctccataccatgactgacactttgaagtttttaaggatttttaaaaattcatccatatat

SEQ ID NO: 16857 - DNA, 201 bp, Bos taurus
aacaattattcagccacgagaaagaaggaaatcctgccatttgcaacaacatggatgaaacttgagggcactatgctaagtgagatcagtcagaaagacaaatattatatgatggcacttattggaatcaaaaaaagctgaacccttagaaatggagtagaatgggggttactaggggctgggggatgaggaaattgggga

SEQ ID NO: 16858 - DNA, 201 bp, Bos taurus
acacaatgccatggatttactcagcacaggatccatgtcttactctttttctgtgtagttgacacccagcacagtaccagacacatagtcagtgtgcaaatatacttgctaaatgaatggatgaatggctggatggatggacagataacaaaaaatgatgtctgagctacactggcatttgacaatgaaaaaagaaggact

SEQ ID NO: 16859 - DNA, 201 bp, Bos taurus
ggcaacatttatgtagagcagatctctagaatttattcgtcatgcataactgaagcttcttcacaggaaactatctggatttcaccaaaggtaggccaggtagagagtcacggaattcaaacaaaagccctggcagcctcaccatgacatagtctaactaaaatgggctggacaggagacagagtaagcctactggggcct

SEQ ID NO: 16860 - DNA, 201 bp, Bos taurus
agggagagtggattctattacttggagtcacatggcaaggaaggtattaagagtaacaatgtctttccagtgtaaaagtaattaattaattaattaaagatgaaaaatgagtgaggccttctctgctgtattccatgtaccttggaatgttgtagaaaagatatcaccgcaggacgggttcacagaacacatttgtgtgtc

SEQ ID NO: 16861 - DNA, 201 bp, Bos taurus
cactacccagcggtatagtcaactcaaagagacctggttttattctagcctgattcttcaagccttacagaaaaggatgaagttggaaggcctttcaaacgaatgttaattgtcattccacatgcaagcaaagtgcctcctcctgaatacccaagccctcagaggtgaggcctggtatgtgcaagacccttcatgtgcatt

SEQ ID NO: 16862 - DNA, 201 bp, Bos taurus
gatcttcccggcccagggatcaaacccgggtctcctgcattggcaggtgggttctttactgctgaaccagcggggaagccaggatgccttctgcttaaacgtctgggcagcagccctgggcctccctgcttcccttctcctcctgttctctgtttgcccagctagtccttcaagcaggcaaataacccatttggtttactt

SEQ ID NO: 16863 - DNA, 201 bp, Bos taurus
aaaactagaaattataactcacggtgccatcctaagagttcattatttttcttctaacctgtatttgaaataagacactcctaatttacttaaaatgaccgagaagcttaacttatcaaaacctttcttccaacatattatgtctccacttaaatcttctatatttcctatcttcgagtactataaatctatttataaaca

SEQ ID NO: 16864 - DNA, 201 bp, Bos taurus
aatttttatccctgatctatgataactaaagagacaagtaacagtaaagaacatttggccaactatatactcagattgctacagaaaagggtgagttacaaaagtgttcagtacaatagtcttcaactttcaactagaagtaatatgctggaagtgtattttgaactcaacagaggtcagccaaagaataataaaatgtca

SEQ ID NO: 16865 - DNA, 201 bp, Bos taurus
ccagctccgatcagtacacaagacactgcactttacacgtactgttcagaatctggaggtttcaagctggaaggtgtgttggggccatgcagtctggcctcttatgttagagataaagctgaagcccagttagataacatggtttgttcaaatttgcatggtgagctcacagcacacctagatttaacttggccttggggt

SEQ ID NO: 16866 - DNA, 201 bp, Bos taurus
agttcccatggacacctggaacccttagtcagacggaagcctttccaacgagaccctctccgttggaaagcggccaggccgctgcgctgccgccgttgacggctcccaactgctgcagcatatgttcctcctcgcctcgctcccagctgttctcagataggccggccgcgaggttaatcacgtctcacattgtaaaacgga

SEQ ID NO: 16867 - DNA, 201 bp, Bos taurus
tcaacagttgatgagacaggaaaaagcctcaggccaaaggtgacccatcatttgggtgaggatgtgaccagtgccgcctggctcaaaagggaggccagtcggaatcctttccaggaactagaatggacaaacgggaaaggttatatggagagaattttccaggtaggaagggaaatcaaggccaaaggatgctgcgattta

SEQ ID NO: 16868 - DNA, 201 bp, Bos taurus
gtggaaggccattagaagctctatatggagaatgatctgttctggtgaacagttttaaaagatcactttggcttctatgtagagactagattgtaggaaggcaggcctcgagcctaactaggaaagcatcacaaaagttggaccttctagaaatgcggcttgggctagggttggataccattgaaggtgaagagatgctgg

SEQ ID NO: 16869 - DNA, 201 bp, Bos taurus
ctatgctagctagaggaaataagtcactaaagaccacacactacacgattccatttatataaaatattcagaaaaggcaaatccatgatgaaagaaagtagattcatagttgcttacagcactggggatcctggaagctggagattaaccactaatggtcatggagtttctttgggggagatgaaaatgttctaaaattag

SEQ ID NO: 16870 - DNA, 201 bp, Bos taurus
gtacagtatggttcccagcttctccccgatttcctactgctaaaagaaacacaattgcttttctttggggcaaatgcgggaccacagggacatggataaccgtcctattcattttatttaaatggaccaaagacgccaacagaaagagactggtaacaagactgaatagttcgtaaaagaaatgagaacctgtcaacagag

SEQ ID NO: 16871 - DNA, 201 bp, Bos taurus
aaaaataacaaacttttatcattcatttactgtggacatttaatatgtctttaaagaaaaaactaccaaagtctggacttaactcattcacagtaatgacgaagaaggaatccatatcatataggaacttaaaatatttatattacttgtagatttaactaggtatgagttcaaactttcaagggtactagtttttccctc

SEQ ID NO: 16872 - DNA, 201 bp, Bos taurus
ggatggcatcatccaaccagccagggaagcctggagtgctgcagcccatggggtcgcaaagagctggacaggactaagcgactgagcaacaacgaattaggggagaacacagaactcggaaacagggtgcgctgtttgatgtgcaactgcgcaagggactagagtagctaaaatacagagagggtggaagccccgggcaga

SEQ ID NO: 16873 - DNA, 201 bp, Bos taurus
tctcatttccacggcctcagcggcccctgtgcctgtgactgtctgcaggagccccagcgggattgctatcagtagctcgggccagactggctcagctgcatgcaaagtggggcaggggggttggggggatagttgggagagtagggcttcagaaggagaccaagctgggtgtccaggaggccagtagggaaacagaggggc

SEQ ID NO: 16874 - DNA, 201 bp, Bos taurus
tacgatccatggaattctccaagccagaatactggagtgggtagcctttcccttctccaggggatcttcccaacccagggatcaaacccaggtttcccgcatcacaggcagatgaaagccttttcccaataggtatgagcatgtgggcagtgccattcgtctttgtatgcccagcccttcagagcagagtttggtactgca

SEQ ID NO: 16875 - DNA, 201 bp, Bos taurus
ttatacaagtagagtttgtatattccaagttcctatggagtctggcagttggatactagttaacagaagctactgtctcccaaatttccctgataataaagttttcttacagtattggttttaaaaacacaatttttggttacatcccagattggatgaatcagaaactccaagccttgggagccaagaaattgtattttt

SEQ ID NO: 16876 - DNA, 201 bp, Bos taurus
ctgccaaaacccaggttgtaaattagtggaaggtcacttcttaatgagaaattcactatgttttacctgtcagggttttccctgaagtatgtgaactcttgtccagtgcattggatccctccctcgggcttggaacaggcagtgtccttcacctttattgtgaatcctttccaaatcctttccaaagtctaccatttagtt

SEQ ID NO: 16877 - DNA, 201 bp, Bos taurus
ttgccttctccggaatggatgttgaattttatcaaataccttgtctgcatttactgaaatgattatgtgttttttttcttttgttgatgcagtgtatgtagcacatggattgacttgtatatatattgaaccatccttaagaccctgggtccaaggggtgaatggatccaacttcattgtggtatatgatctttttcatgt

SEQ ID NO: 16878 - DNA, 201 bp, Bos taurus
tgctgtccaacggatggagtaacttgggccccagttcccattcgtgtgcttctgctgaggaagggaagattctctttttttagatcagatgttgagcctgcggccaggccatcatcatttcagagaatggaatacaaatggcttcttgggggaatgagactttatttgtgatgctgagcatagatttagtggtggaggtaa

SEQ ID NO: 16879 - DNA, 201 bp, Bos taurus
taacagatgacagtcagtaataagccaatgactgctactgttggggcagaagtcacagggggcactgtgtgccagcctgagccacaggcagaagaaataggaagccagatgaaaggccgtctaagagtgagatgcagagaaaaataagacaaagagaaatagttatggatagtgaggatagagccattaatccataggttg

SEQ ID NO: 16880 - DNA, 201 bp, Bos taurus
tatgatctgtatatacatgcacagatctcatcagatatgctaaatgaatgataaatctgtgcttaaattcttactggccttgcattttttcaaactctttaaaaaaaaatctatttaaattgaatttctgctgataacaatcaaatgtatggccttgggaaggttttaaacttccttcatcaatcatccattttctaccct

SEQ ID NO: 16881 - DNA, 201 bp, Bos taurus
ggccaccgaaaacaagaccaaccagtccacctcgtgttacggtgcaggtttcacactgcagatcacctaggaaacaaattagttccgcagatggatattcaagcaaacatgtaaagaactcaaggtccccttatatgtatcaaagataggcaatttcaagcagaaatacagtaaatgcatttctcaaggcatgttaaaagg

SEQ ID NO: 16882 - DNA, 201 bp, Bos taurus
ttgctaacctatttccatagtgtgctcggctccagaataggacgttgttttcactattcgcatttccctgcacccacgtcttgtcctgctgccaccaatattatttccacccaggaaaccaagttagcacaagttgcttagttagcaaagaattggacaaagagggttagatattcttaaggaatatgtacctcaagctaa

SEQ ID NO: 16883 - DNA, 201 bp, Bos taurus
gacaatgttttctaaataatgttcaatggaacaagcaagatgtcttcaggtttcacttttaaatggaaaagcagtcctaactttttaataagtttgggaatgctcgatgccgtatccccatcttagagatgcacattatatattagtgtattgaagtcaatgcaaaggtctgctgtgtaaaatattaacattttctaaaac

SEQ ID NO: 16884 - DNA, 201 bp, Bos taurus
taggccacaataacatttctgaaagtggtgcacttgcttcttgcatggatttactgattaatagcttttgaccacttattatattccaagtaacgtgctggatgctggcaatgatcatagtttagatggaatgtgatttgctctttgaatctctcataacagagaaaatacgacatatggttgagaaagaccctgcttctt

SEQ ID NO: 16885 - DNA, 201 bp, Bos taurus
cctggctctttcaaaaaatcttcaaaaggggagagttatcttggtgaactcatccaggatcaagttttgttttgtgagccccagaattctaacttggcagaattatagccaatcaaccccagaattcctgattcatattaagaaagctaataagttactgttggagatgaatagatcgttattggagtctgttcatttcaa

SEQ ID NO: 16886 - DNA, 201 bp, Bos taurus
tgcaagaggactttgcaggtcaagcttctctgttgccagaacatcctgctcaggcttgtatcagcatatccttttggccaggaggccctatagattatgaactaaaagtcaaagtggtagtcgctcagtcgtgtccgattttctgcgacccccatgagctgtagcctgccaggctgctctgtccatgggattctccaggcc

SEQ ID NO: 16887 - DNA, 201 bp, Bos taurus
aatcgatccactcagaaagtctttcacttctaagagcttttaaaatactttgttttttctctcttctttttttcatttttttccttattaggccatccaagtaactcatagcatacagaaaagatagatatcaatagcccaaattaaggagataaacaagttgcaaatcctaacacttaagacactgagtttttaatctct

SEQ ID NO: 16888 - DNA, 201 bp, Bos taurus
cagtatcaggggctatacatcagtgagtataaggaatatggttcttctgctctgacagcctatattctacctaagattacctattgctttcacatcaactgtttctcaagtaagtttctcagatgagccatgctatctccccactctgggtgtttgaatgcatgtttccttctgtaaggatggtcactccccactctcttt

SEQ ID NO: 16889 - DNA, 201 bp, Bos taurus
ggcaggacccacaagaagatcatgatatgcccagctttaggaacacagcggtaaatagtggggtctctgcccccaggccctcaggtctaatgggaggtcagagcaaggaggatggaggcaaattcttaaataagactgtattaaggaacataaggaacctagacagtatatagtggaaaggaagaaactcttgggccggaa

SEQ ID NO: 16890 - DNA, 201 bp, Bos taurus
ccagaatgtgcaaacccaaggaaatactgacagccctgaagtgaatgaaagagtgttctgggctttccatcatcaagagcatcatttacaattatgattgggtaatacatttttatcttgtttgcttcggttgcttcaacagctgtataaaaagtagaaatgtgagccatagagaaccagctaaactcattacaatttgat

SEQ ID NO: 16891 - DNA, 201 bp, Bos taurus
ccatgctcatgcaaaatagaatttgcaaatgttaaaaagcacaaagcagaatgagatcagagtatgcgagaaggacacttaactctcagagaaggagcttagggattgatgaggaagatgccccagagtgaccttcaatgagatacataaacatcagccacatgtaaatttaccttatttccccaaagcgtcttaaagaac

SEQ ID NO: 16892 - DNA, 201 bp, Bos taurus
ttctttaagaatctcattgtctcatcattaacttcttggacctctcttgtttgaaacttctcttttttctgtatgaaaacatgatgtgtataataaaaaggaatcactgaaacttacaatagcaactttccaaagggaacacaattattttagaggagagacaagaatgaactaagaggaaagaagcctttataagataaa

SEQ ID NO: 16893 - DNA, 201 bp, Bos taurus
attttcttcttctgagttgctccctcttctacccaggctttttagtgttttagggaggagaaatgagctgaatgggatgttagttttggccctatttcggttatctctgtgaccttgaataactctgcatttctttctccctttgtttaaatcctttgcaaagggataaggatccttgccccttggcctggtgatatggcc

SEQ ID NO: 16894 - DNA, 201 bp, Bos taurus
aaagaagtctagaggttagcagcttgaaaaggctagtcctgtggtttcatggtgttgtcagtgacctgggctctctctcagacaggcctctattttcaaggtcaccttcctgtacaagatggctgctagaggcatagccatcacatcccagtctcagcagcaggaaagaagaaaacaggaaggaggaagaatggcctgatc

SEQ ID NO: 16895 - DNA, 201 bp, Bos taurus
gaagcatactttctcctgtgctttgattttgatcagcatcaccttcctggtcatattcctttagataaattttaacatactaacattctcccttatctctcggtctggctgtggtcagatccagaaaattctcttatctctcatcgttaaggctaaatgtcttctcagtgggttgaagattatttatgttagataagtcat

SEQ ID NO: 16896 - DNA, 201 bp, Bos taurus
atatatatatatatatatacattacttagcttagggtctgtcatatgcagcctctaaaatggtccctgtattaatacattcccctcctcttgaatgtggattgcacctagagacttgattctaatgaatagaatgtggcaaaactgatgggctgtcactgttgagattaggttctaaaaggactatggctttcatttgctt

SEQ ID NO: 16897 - DNA, 201 bp, Bos taurus
aaagggaaattaaggctgcagatggaatcaacattgctaaacagctgattgaacaacagggagactatcccggattatttgggtgggcctaatgtaatcacacatttccttaaagtgtaggagagaggcagaagggaagatcagagtaatattaccagagctgtgagaaggcctcaacctattgttcctggtttttgaaga

SEQ ID NO: 16898 - DNA, 201 bp, Bos taurus
gtgaaaaggactccccacttgttcatagttgatgccacccctcctaaagcctcagtatagtagaaagaacaagaactttggaatcagatggacatggattaaaatcttagtttcgccactggttttctgtggaatcttaggtttactaattaatcctgttgaacctcagattttcttggatacaagataggtataaaaaaa

SEQ ID NO: 16899 - DNA, 201 bp, Bos taurus
tataaaaagagtgataggccttttctaaggccctgcatcaaaattatttggaaaagaacaaattttaaagaaattaaatcaatctatgtttgtcttaattgtaatttgttttcataaggcccaactgacaggtgatacacttgtttgaattacatccatggataataatattttaatgtttgttagttgcataaattattt

SEQ ID NO: 16900 - DNA, 201 bp, Bos taurus
tgtagacgttccttcaagccttgactggttaatgctgagcaaatccaataatttctccattcttcaagcaagatcaccttccaggattagtgaaactgaccagattatatgtgtaagtgaataagaaaagtatcttagagaatacattggacttctaggcttggagaagaattaaacatttaaagtgattggaacaacata

SEQ ID NO: 16901 - DNA, 201 bp, Bos taurus
tgaccttactattgtcacaaatttaccaagaacaacaatttttaaaagggtattaaaaaattagaaagtattttaaagtgtccagttggtaacatgcttcgcattttggattcctatgaacactttcagaaacagtgaaattgggttgaaattgccctgtcattgtatattatttatatatagaaagagaaccccacatat

SEQ ID NO: 16902 - DNA, 201 bp, Bos taurus
gttagaataatatgcagtaaataagcattgaatgcagtttgacaaaagtatttaaaagttatggcatggattttgttacttttacaaattaatatctcaattattaattccatactggatgggtgtaattgttgggttcttgacttgaagttcaggaattgaagcaggaaaattctgtcatcagtaaaaaccttgtagaat

SEQ ID NO: 16903 - DNA, 201 bp, Bos taurus
tattccacatattaaaactttctataaaagtctacttaaatatttcacatactaaaacctagataaggaaggttcaattcatccattgattaaatgtacccattgtagaaaaaccgtgaacaatccatgaagattcttagcccttcagatgtctatagattcttgacagttctgttcatggattttgattacaatcaccag

SEQ ID NO: 16904 - DNA, 201 bp, Bos taurus
agagggatttctttctcttaatccaataagagaattctaattaggagcctttactcagggaagggaaggcgaaaaggcgcaaaaggttctgtatggttccgacctaaggcctgtgtcataggagcagaggatgagtgtgtcagggaagtgtctttcgcttgctttcattttcctgttgctgggttgtgcataatttaaagc

SEQ ID NO: 16905 - DNA, 201 bp, Bos taurus
gtttatatactgtcttcttcatggagttatcctgatctatctggttggtattaatctctgggttctctaaaggtccatgtgggacctcatatttgcagtcatgataatatgtcttgtttactcatctttcttccttaacaggttataagtgatgaagacaagtacaatgtcttattatcatttgtatgcctgcagtgatga

SEQ ID NO: 16906 - DNA, 201 bp, Bos taurus
ataaattatgatatattaataggaaacttttaacctaaatgaagatgtttacttgctatttatcactttctcattcagtcatgtcttcagcaatcacacattcagtgcattctagacaatttcctaggcatttgctaaatatcataaataccatgcagttctgagaagtttctactgttaggaggcttactaccttatagg

SEQ ID NO: 16907 - DNA, 201 bp, Bos taurus
cttactttatatagtgtttctgtacaaaattgatcacagacacattataataagcaagttcaggctaaggaatttgagccatcaggatggaaacaaagccattaccactgggataacatcaaattaaacaaacacaccatgccaaatgctttgagggactgggacatatttaacagggctttagcccttaattccactgct

SEQ ID NO: 16908 - DNA, 201 bp, Bos taurus
ctgctctgtcttaaaaccccatacgcataacttccagaatgaccaccacatattcatgcaacacatgtggtatgcaatactcagagaatctcaaagcatggtgtattcatcatgtatttatagtttgtttatagttcttcccagtccggctgtagtttaatactcagggttatttcttaacattagctgtgttgcctgtca

SEQ ID NO: 16909 - DNA, 201 bp, Bos taurus
agagagattatttaaggggcctggagtttagcaaaaaggtggatttgttcatttatattggagttttgtgggaataacagaaatcagaaatcatcctggagaaaggccaagaagaacaagtcaaagtgcctcgaggaagggtctgtatggagaatgggagaatgagacagagctaaatgaagagtcacttcacaatggcac

SEQ ID NO: 16910 - DNA, 201 bp, Bos taurus
ataaagataagaacatttcagagagaagaacaaaattacaaaggaggaggaaaaaataaaatgtgcccaggaggcccaaagccgaattaaagcagtatttgtaaatggaatcagaaagagagggaaaactatctgagatatatttttcctgatgacaagtctctgtttatggatcaacaaaatagatgaatttgacctata

SEQ ID NO: 16911 - DNA, 201 bp, Bos taurus
tccatctttttcttggactgcactggccttctggaaggaaaacgttttctccagttcatctctgtaatcccatagccctaatacagagggtagagttagcgcttggccacttatgaatcccatcaaactttaagttcatcaagaaattctgtgataacacagactacaagtgaagagggggtgaaatactagcctgtccca

SEQ ID NO: 16912 - DNA, 201 bp, Bos taurus
acaaaatgtaaaggagtaagactttcttgtaacagcctaacattcatctttggtaagggttctatttttgctagtcttgccctttcggcagccacaggctaggcagaatcaattaggcccttcttaagttcctatagaattgtatctgtgccaagcacagtgcttggtaattagaagggatggaaacactgtttcctgagt

SEQ ID NO: 16913 - DNA, 201 bp, Bos taurus
gtgaacccagatatgctgtcaggctcaagggcccacatccctggcctcccagtaggaacagcttgttggtgtcatgcacagaactaggacccatagcacgcagccaggacgtgattcagaccggcctgggtgggagtggcttgcacaccccaggacacagctcagattgccctgagacatatgggggaggcagactgtttc

SEQ ID NO: 16914 - DNA, 201 bp, Bos taurus
cagaagtggaccccagaggcagaggccagagagaggctgtgatgtggggaaggtcagcaggtgtcacagctcccagcagagggggaaccaggtccagctaggggagttaggccatttgatccctgctgtgtgctgagccccctactgtgagctgaacatcacaactctgccaggctgacttagggtgctcggtcaccaact

SEQ ID NO: 16915 - DNA, 201 bp, Bos taurus
ttcaaaggcaggggatttggtgggaaagggaggaaaagagaagaatgagacaaaaatggatgaaaatcatcaggagaccagggcttggggcccgggaggaagcagaggtcatggggatcgtctccatttgttcagcgggctttgtgtggctatagaggtgcaaatcactttcagatgcttcattttatgagctcttcactc

SEQ ID NO: 16916 - DNA, 201 bp, Bos taurus
ccctcccaaaacagcgggagaggcaagtccacggcagggccatcactctgcctgtttgcaagggagacagagcagcctctgttgttgctgctggagcgccacgatgatagatggagggccgtttgtcgagcctgaagccatcattcatggaggacaatggcccactgggacccaacacatttggagaagagcatggaagca

SEQ ID NO: 16917 - DNA, 201 bp, Bos taurus
gcctggagaattttgagcattactttgctaatgtgtgagataagtgcaatcgtgcagtagtttgagcagtctttggcaatgcctttctttgagattggaacgaaaatgggccataagaataaagaagaccctcttccctgccacaaaatgcaacacagactccaaaggccaggacttagagagcctttggtgtccctttcc

SEQ ID NO: 16918 - DNA, 201 bp, Bos taurus
ctacaggaagcaggaagaaatgggttggaggccttggctataggactttgggtgaatcaactgtggatttccacacttaagttcagggctaatgccccccgctggccaatttcagagcccagtgaatcaaaagcatcaatgtgaatacattttataattgtcacaactgccctgggaagagttatcatttctattgcacag

SEQ ID NO: 16919 - DNA, 201 bp, Bos taurus
aattaaatctcatccctcactgcatctaaacccaagaaaggtggtctcctcttcctcccataaatccccccatcccaggcctctctctcactggttccccaaacatcctgcagtgtcacatgtgaatgcagctctgggctctgacagaggggccccttggaggccagagatgggatctctcattcccatgttgatgctgcc

SEQ ID NO: 16920 - DNA, 201 bp, Bos taurus
tgaaagtactttggaaccttataaactgtgacgagttctggttttgtttttaagcttcatattaatttgctagggccactatagcaaaatagcacagactaggtgttttaaacaacagaaatttttttttttcataactgtggagactagaagtccaagattaaagtgccagcaggtttggtttcttctgaggccactctc

SEQ ID NO: 16921 - DNA, 201 bp, Bos taurus
ctccctccctccactgcatggcagaaccagcctctggttccctgagtgttttgcacctcttgcttcctggctagaaggcctcctgggctcaccccctcacggaggagatcactgcctcagatacccataacaatgaggctggttcacgggcaggctggaggaagctcacttcacaggactgccctcgtaacaattaggccc

SEQ ID NO: 16922 - DNA, 201 bp, Bos taurus
attttatgcccaggccccttctccttcacccttcaactttgtaagtcctttctgaactgagatcccgactgcgaagggccctctgggggtgggactgagaaacgtggatgcctgcaggtttggaggagttctgaacccttcagttctcttgggccttctgctcccaccgggcctcctgggtttccaagacagccaaacctc

SEQ ID NO: 16923 - DNA, 201 bp, Bos taurus
ggaattatgtgccttcatacttgttaaactgtcttggcaccagacgtggttctggtaacctgagctttacagcggcaccgccacagttaaagctgggcccgccttatccctgcaccctctctgtcggaggtttatagctaaagcataaaacaattcaacatgagttgaaacatgaaaaactcctccagattgcaaaggcca

SEQ ID NO: 16924 - DNA, 201 bp, Bos taurus
cagagtgctccaggactggagagcagaggaggcccagatgacatcagggacctcgatacacattgcttattgagccctggcccctcgtgttatctgattcgctgtcctccaggctccatggggctgtggcattagctcgtcaccagtgtaacatttcatttcagaggaggcctttcctgctagtgtttggcagacagctag

SEQ ID NO: 16925 - DNA, 201 bp, Bos taurus
acgtgtgtcccatgcaccttctcacatgttctcactgaccattcgagggggcatttgtgcccatttcagagatggaaaaactgtggcccaaagacgcttgctgttgttgctcggtcactaagttgtgtccgactctttgactccatggactgaagcaggccaggctcctctgtcctctgctaccttctggagtttaccaaa

SEQ ID NO: 16926 - DNA, 201 bp, Bos taurus
tcagatggcagggcttccgcgcccaccgtgtgaggcgggggctggtggcggcgcccatctggcaggatccttcttgaataggatggaagatagttgggcctgaagaacacattttgttttttattttcaacccagaatagacatgcctctcaaatgtcatcttgatggaaggggtccttgagcaatggggccctgaacgtt

SEQ ID NO: 16927 - DNA, 201 bp, Bos taurus
gatcgtctgtgctacactttgttagttttgaagagtgcacacacacagctcagcagaaagtgggctgtggagccaaattgctctggctaaaactacctttcctgtgctgctctgcgctcattacttaacttgtctgagcttcagtttcttccattgtaaataaagtgaaatcacctgcctcatagagaagcaagaatgaaa

SEQ ID NO: 16928 - DNA, 201 bp, Bos taurus
gtcagtctatttgcatttggcaggactccatggtgtcccctgaacaaatgaatcagcctgtttgggggatggggaactgaaccatagggaggctgctagcgctgcttgtgagccccagtgatcctgagatgggggaatcccagacagttcttgttctgttcgtatctggattattcttaggctctggagtaacaagcccct

SEQ ID NO: 16929 - DNA, 201 bp, Bos taurus
gcagaaaggcttctttggcgctttgtaagatcgtgatgcatcaaggaaacattccagagaaatgtagataatgccagcccaggccgggagctcagggatgagtgagcagttcggtaactggagaggagacaccagggcagcaggaggctgggacaggagctctcgtgttctgaagagaaaagagtttccatctgctgctcc

SEQ ID NO: 16930 - DNA, 201 bp, Bos taurus
tgcaggaccaggggtcctagatctagtgttggtctgctggtggggggggccagttcctgacatgcctttctgctggatctagggtgtcctaagcttaatgttggcccactggatggtggggctgtatcccagggacagctggcttagaagtaaatggagccagctcctgacatgcctttctgctggatccaggatgtccca

SEQ ID NO: 16931 - DNA, 201 bp, Bos taurus
tcggacacgactgaagcgacttagcagcagcagcagcagcagcagctacaaagacggtgaccaatttgatgagtgctcagcgaggaagaatgggggctaagttcaggtttctgggtcagtgaactgctgaatgacggtccattctctaagatcaagaagtaatgtgagtcacaattttgtggggaaatggtggtaggaata

SEQ ID NO: 16932 - DNA, 201 bp, Bos taurus
ccaaaaagtatgttttcttgactcaacatgaaaattttttaagagagctaaggtaatgggccttggctctgataccagatactttgaatttcaattactcgtaggctgttctatacttcagtttcctaatctcctagtcaaaattgaccatcaggattgtagtgattatatgagattatgtgtgtgaagtacctcttaaaa

SEQ ID NO: 16933 - DNA, 201 bp, Bos taurus
gtaggaaacacaaagattttcgtggctccttttctcaaattgcttataatttattacctaaaacaccttataaaagtaatagaaatatcaattcacctgtgatacagcctagacattagcataaaccaaatcctatgaggatcaagaagaaagagctaacactttcttagcaaaggtcacagaattatggatatctgtatt

SEQ ID NO: 16934 - DNA, 201 bp, Bos taurus
tgccataatcagcatgttagaagtttccatggcttatggcttccataaggataagaactcataagcatcctgaatctaaatatcttccctggcacgtgataaaagagaagataaaagagagaatctagtatttattgatcacatactctgtgccattgaataaaatagtgattaagaacacagaagtaatggctggattta

SEQ ID NO: 16935 - DNA, 201 bp, Bos taurus
taaactaactatgtataagagaatagtctggaaagttttaaggtagcattgaaagttttttttttttttttttttccctcccccagatgccagtagcaaatagaaaactgcaaccagggaggttcaactgaaaaaaaatcatattgtcatgtttactaaaataattcctgcttagtagcaagatctaagatcaaacagagt

SEQ ID NO: 16936 - DNA, 201 bp, Bos taurus
gggggtagaagtaaaaatgattttgtgatcaagctcaaataactagattggtgggatgcgacaattaaagatctcagagaatacattttcaagagtagatgaaatgggataataagaaataatgtagagatcaacaaggcttaccaattcttattcacattcctaggtctgttctatacacaaaagatcttactgaagttg

SEQ ID NO: 16937 - DNA, 201 bp, Bos taurus
cattgtacagaagcatgtgaagcttaagggtgagtcttctgttataattctttctgttctacccttgattgctaggcttaacctcattttgatttctttacgttacttaacaaacgttgtcttcctctttaaatcagtgcatcctccaccaggaaattcattctgtttctttctgaccactacttcattctctgttccatt

SEQ ID NO: 16938 - DNA, 201 bp, Bos taurus
tgttatttgaccttttattttctctctgctgtttctccttttgcttttttccccctctccttatgccctgccatactggctttctttttctgtcacttaaacaggccagatatatttccaatcagcccctctgaacttgatataacatatgcataaaattcacctctcccaggtcagcctatagctgtcttcttctcattg

SEQ ID NO: 16939 - DNA, 201 bp, Bos taurus
attatttattgaatgagtaaatgcatgaaataatgaatgaatagattctgttccagcttcaagcctcaaaattaaagtacctccttaagaaaagatgctgaaaaaaaaatcatctttgaatcacacttaataagcagtgacttattaagattccttttaattattattgaaacctgttcttcaagatgggcttccctgatg

SEQ ID NO: 16940 - DNA, 201 bp, Bos taurus
tttgatggctttctttagtcagcatgaaggtgcccagactgtaaaattagcatataagatttatgctttagaagtttccatcatggccctaccatgagcactcaattacatagggaaagaggagactgtgtggttcatgggagggagcaattcggcacccttcttgatcattctcagaattcttggattcatctagttttt

SEQ ID NO: 16941 - DNA, 201 bp, Bos taurus
gaatatggggcacagcttcatgattttctcactaggtgtttttaacatttaatgagacaacttgttcacgatgtgttacaatatagcacagaggccaaggtaggtcaaagggtagaggtataatttgctgtgttttttgaagctgactttggctggttcgtgtgccttcgtttctggctggagacagaggcctgttttcca

SEQ ID NO: 16942 - DNA, 201 bp, Bos taurus
cttctctttctccttcaccccactctgctaatgtcatcatttcttttcctgttgactttgtagatttcagatgcgcccccatgttttgagccagatctatcctccttggcttatgagcaaggaaattgtgctactttgttacttttgtatttatcttggtatttacagatttctgtggtctgagataatagccattaccaa

SEQ ID NO: 16943 - DNA, 201 bp, Bos taurus
cagagttcagttgcaagttttacccagactttgaaccaaatccccaaggttgcaaaccatcaactgcatgattatttgtcattcatttggccacatatatttgcaacccttttttattaaggacaatatttctcaacaaagacactactgataattctctgttgtcatgacctgttctgtgcactgtggggatgtttagca

SEQ ID NO: 16944 - DNA, 201 bp, Bos taurus
gaaatccgcttcacctgaaatagaagagctggcaagttcattctgcttaatcagattcatttaatttgtttcacgggttcaaaggcccctaaaccattaacgcgtttgaatgtgttctctatcagcctatggacatgatgtgagcacagaaatttcatattaaacctgaactatgtaaaggtcaggccctgaaggcacttt

SEQ ID NO: 16945 - DNA, 201 bp, Bos taurus
cagtaagcaaccttagtctctcttttgttccaaatgaggtaaaaataaaagattctgaatctctttctacatgttctgcttttcagtgataaaaactactgaattattgaagtctcagttggttctataatggatatattttaaattgtgtgttcacttttatttaaaatatcattgtacccttacaaatttaatggactt

SEQ ID NO: 16946 - DNA, 201 bp, Bos taurus
ccctctcaatttccctcatgggcaagggggtgataataaatatgtaaacggttcccacaaaataatcaaggagaaaaaaaaaaagaaaacctaacagcttaacagaaaaatagacaagatatataacagatgatccagcaaaataaatgaacatgaccataaatgtagaaaaaagataagtgtctcactcatattgagagg

SEQ ID NO: 16947 - DNA, 201 bp, Bos taurus
tgaaaaggcattggagcttataaaatatttcttgtcaagagatcttgaacacctcttatttttactactgggggaaatcaacattccttttgtaaactaacgcctgttattagaatatatttaggaaaaatatttgaaatgctagcatagtcactttgaaacatagattcttgattgcagttcttgaagtactaagtagct

SEQ ID NO: 16948 - DNA, 201 bp, Bos taurus
tgtgtataactgtatgcttgtatgtgtgtgtgtagtaatttctcaatctaaatcaagttattagttggaaggggctttctaagttttggtataccatggatatatacacttacgtgtataattgctcttctgcttgtatcaaatttttggaaaggcttttctcagttttataatttctaggcattatccaatgaccttgaa

SEQ ID NO: 16949 - DNA, 201 bp, Bos taurus
cttatatctatcttaaaaaatacaaaaaacaaaaggcaattctccctttataatgcatctatttctaccctgaattaccctgctcctcttcaccttttcacttcaaggttttttagttcctaccatttcactggaacagcttttacttcgtccttctaagcgcatgatgaattcctcttttttcctcctattccacgtgag

SEQ ID NO: 16950 - DNA, 201 bp, Bos taurus
accacagtgaaagggtctatctctgtttgcctgatctttgtcactatttccaaattctttaggctcgtgacattatatttcatgtcagtcttaacttggttaatcaaagggccataaattacatgcccaaaatcacagaatttcataatagttctacttctataaaactgccaacaggcctgaagaccctattgaaatagt

SEQ ID NO: 16951 - DNA, 201 bp, Bos taurus
catttttattttaacctcttatgtcacagatcttagaaggagagggcttctgagaccttggtcttgttttcagtaaacatcctgcttgttgtcctggattcctggaatgtgtctttagtctgataaattattagcactcagatccaaggaagtgcagtaattaaattctgttccatatgcttaagggaaaacaactggtga

SEQ ID NO: 16952 - DNA, 201 bp, Bos taurus
attccattttcttcatgctccaaacagaggacaattttactagttttgtccattgtagagcacaagtgagttttcatattttctatgattgctatgtaaagtgactggaagataaatctccccctggaaaggaagtgtaattaaaccatctagatccagagcagagaggtagatgatgaacagccttctgccagggactgg

SEQ ID NO: 16953 - DNA, 201 bp, Bos taurus
gtgtgcatgcagggcacttgtgtgctcctgggatgttgggggcagtgcttagtgcctgcttgcaggtcttatagcagtggctgtggccagtgtactcccaagaaagtgagggcagagtctggctaatttctaatctcatagtgtcatgaatggaaaagatgcttcatatgatttcaactttttaaaatttcccaaggctta

SEQ ID NO: 16954 - DNA, 201 bp, Bos taurus
ataatgggtttccagttctggcaatgataacaagtacccttgttgaataaatttattcaaataaaaagagtttaaagaggaattataagcaattgactatatgggtgcaattcagatcatgccatggatgtagaagtatttttaaggtatcacttggatgtgttaagattcaaaaattcttgagtaaattcttgagtacct

SEQ ID NO: 16955 - DNA, 201 bp, Bos taurus
tcaaacacattttcttacttttcatatctacatgtgaagacaagaattattctgacttgacagatgaggaaaatacagcttagaaaagatagatgggatgcggcactgaattcaaagccagaccttctgcttctgatctagtcttcattcaccggactattccacttcccacgccactgagcacttctcccaacaatttga

SEQ ID NO: 16956 - DNA, 201 bp, Bos taurus
tcagacactactgaagcaacttagcagcagcaaaaaaaaaaaaaagattcatatcatttaccaatatcatgtcgcattgccatggccactataatttcacataattcattggatgggacttccgtgaattaacataactcagcttgggaagaagggctatggtacagcaccgactggcttcaaagtctggccctgcccacc

SEQ ID NO: 16957 - DNA, 201 bp, Bos taurus
gaggtgagagtgagcaagcaccatgcattgtttttattagcatgtttcctggttcattatatctcaggtaatgatccatgggcccagcagggttgcagattgccgatattcaaagtcttaacactcagaacaagtttttctaggtagggagtattttttcccactggcctattcaatctgcaatcttatagccttaaaaaa

SEQ ID NO: 16958 - DNA, 201 bp, Bos taurus
atataagtccagaaacaagggttaccaaaagcctcaacttctgctgtagcttataaaaaagccacgtactgacctatataaacccttgtcgaatggactccatcaggacaaattggagacattacagtgttttctcccatggagtctcaagaagacttctcctatggtgcctccaatgacttcaaaaaggtaagaaaatgt

SEQ ID NO: 16959 - DNA, 201 bp, Bos taurus
tacacaaaccaaagattttaaaaagtcatcacaggagctgatacaaaaggaagaagtcatagtggccaaaacaaactcatggccagggatctagggaggcgagtgagcatcaaagcttcatgatgtcagccaaaacatgcagcctttgggctcccaccttgacggctacagaggaggccagggagacagataacagggtct

SEQ ID NO: 16960 - DNA, 201 bp, Bos taurus
acactggagggagaaagctaagaaaataaatcaggagaaaatacagctaagaacatgcagggagaaatgtgtctggaactctcaggcaacagagaaagaacaagtatagagagcaccgaggacgtgtgcaaggaggggagcagaggagtttaggcaacaacagaaagggtctggaggaggaaacagaacaggctctatctt

SEQ ID NO: 16961 - DNA, 201 bp, Bos taurus
catgattaatcagcaggccgactgggggaatgatgaatatcagaccagttatgggtgtcctcacctctcaattttccctgagggatatgatcaaatctgacggccaatgatccaaaaattttatatctgcaaccctaacctctcctttaagtaacagactcgtatatccaatggcctcctgacgatctccatgtgcacatt

SEQ ID NO: 16962 - DNA, 201 bp, Bos taurus
atcccatgtgctacaactgagtccaggggcagccaaataaatttttttttttaagatctcacacacacagagatacacacaatgaaatattacccagccattaaaatatgaaatgtggatggacctagagcataccacgcttagtgaagtcagagaaagatactgtatgacatcattcatatgtgaaatttagaaagtaac

SEQ ID NO: 16963 - DNA, 201 bp, Bos taurus
taatagcatgttggctaaaatactcagaaataataagcaagcaaaaacttcaagggacttacattagaggctcatgaggcctcttacttatgggagaggtggtcattctcagcatcatttggatttaatcaatgactaaaaatcaactttgattatcaacccctgccccccaccctaaaacagtctgatgaggttatgacc

SEQ ID NO: 16964 - DNA, 201 bp, Bos taurus
ggagctccaggtagcctggtgggtcaggaggaaaggaataggagaagaggagggggtgccccacctgcaaaatcgaagctctcatgcaggcccactgattaatgaaatgatttgccccttgaaagctgaaatagcacccatttcccctgctctgaagcaaacctgattctggctccattatttaaggcccctgaagatgct

SEQ ID NO: 16965 - DNA, 201 bp, Bos taurus
tgggctcgtgctggggtccaggggactcagacactcccggctggtgagaaagggaagaagcttggagtcaccgctgctggccccttactgccaactctgcgaccctctggaaggtgtgaggtagcatccctttagccatttatcaccaaatcaggagcctctggaggccgcactcctgtagccatagaaacaaggccctct

SEQ ID NO: 16966 - DNA, 201 bp, Bos taurus
ttggtatttgatgcaacagggaaatgtgttgagtacattattaatcagactcagcaaaggaaaggtcatgggggtgactggcacaattacggggtgtgggcaacaggccaatgagagtgtgcaagggaggaacagaaatcgatggctatgaaattatggagggttatgaatagtgggaggcaactgaaaggctgacattct

SEQ ID NO: 16967 - DNA, 201 bp, Bos taurus
atttcagccaggaaatggaacttatggccccacagggccaggtgggaagccctacagtgcctacagggagccacgtgaactaacaccccactatcaccccggacatgctggccactgggggcaccctggcttcccctgcctgcatcccctaaacccctgctccctgatcccagccctctcactcctgacctttctcagccc

SEQ ID NO: 16968 - DNA, 201 bp, Bos taurus
tgggcagagggggacaccacgcactgctataaaccctggtgaggaaaggggaacaatctgtgaaacaaaggctatctcagaagcggccaactgcccaccttttgttgatgtatctaaaaacacaccttgctccagaaaaggtgcacggggctcagtaagaaacagttgctctgtgcagtctagggtggggccctgcccggt

SEQ ID NO: 16969 - DNA, 201 bp, Bos taurus
acagggaaggagggaagaatcgcggccctaactcccagaccctcctttccctggcagtggcctgcaggaaggcactggacagcaccacggtggcagctcacgagtcagagatctactgtaaggtctgctacgggcgccggtatggccccaaagggatcgggtatggacaaggcgctggctgcctcagcacggacacaggcg

SEQ ID NO: 16970 - DNA, 201 bp, Bos taurus
ctccaggtagggaggggccaagggctcttgaaccaaagacggagatgattaaagtggtgagtgtttggggaatgggtctggcaaaactaatgatgaatcctgagccctgctgtggcccaggagaacaggactccaggatgtctagggagggaaaacccttccaggaggtcatccagggaacccaggggagcatccggctgg

SEQ ID NO: 16971 - DNA, 201 bp, Bos taurus
gcttgctcagcgccattagcaccgagcgctgtgtgtccgtcctgtgccccgtctggtaccgctgccaccgccccacacacttatcagccatcgtgtgcaccgtgctctgggccctggccctgctgctgagtatcctggaggggaagtactgtggcttcctcttaacggattttagccatctttggtgtcaggtgtttgatt

SEQ ID NO: 16972 - DNA, 201 bp, Bos taurus
gtgaagaaagtggctttgaacattcatgaacatacatatattgaatgtttatatatgaacatatatattcaaacatacatacagtttcacctctcttgggtaaatacctaggaatgggattttagagccaagtgcaaagtatgtgtttatccttataaaaatgtgccagtctgtttttccaggtagagcagacatgggtgg

SEQ ID NO: 16973 - DNA, 201 bp, Bos taurus
caaagagggcggtagctggcatcagggtgtagctctgtgatggtgcaccttggtaccccctgtaaaaacgaagcttttacagcttcccggccctgtgtgtctcccaatatttcaaaaagtctggacagaatggggcgccagcctgaggaacgtgggactgtggggtgcgtgggcggccccttgaacttccggccccccggt

SEQ ID NO: 16974 - DNA, 201 bp, Bos taurus
taatcttcgtgtaaggaattttagttggtctcaaagactgtgcaagagagggatattggtgtgtcgtttcatttccttcggctggtctaggcctcagactaatttaaaagctgaaacttcggagaccagacccacctggggggcaagggggcaagctcgaagccttcgtgggaaagaactctcaggcgagcacctcctgtt

SEQ ID NO: 16975 - DNA, 201 bp, Bos taurus
tattaactattaatcggagacaacagacactaacagagatcatcttgcaaaccaggacacagcttcacatggagactcctgggaaatcccttaaggcctgaggattctgaaatcaccatgacaggatggttttcttttgcgggacaaacaagtgaaaagagctgaccgcccctgttgtctattgttctaagcatggccctg

SEQ ID NO: 16976 - DNA, 201 bp, Bos taurus
gtgggtaaaaatcccacataaggctatgtaaatgcattatatggaatcctctaattatgataacagaggaatttgtagttctgaaataacactgggcaatgaatagatcaataaataattgttaaatatcttttttagtatgctttatttactttaaatcattgttggtatgcattttttaataagtcattttattattaa

SEQ ID NO: 16977 - DNA, 201 bp, Bos taurus
gtcctaaaatgctgctctacctcatgggcctgagcccacgcatttcctacaaggactgtgtctcccagctcttcttcttccatttcctcggcagcatcgactgtttcttgtacaccgtgatggcctatgaccgcttcactgccatctgtcaccctctgcggtacgcagtcatcatgagccctagagtctgcgtggccttgg

SEQ ID NO: 16978 - DNA, 201 bp, Bos taurus
catgtgaacaggcaagcagccgtgggtgtcccagggtgttctgaaggctctactatctgctgtgccttagtaggtgttgcccaagcaggtgggggttcttcagtccttaatatcctttgtgtcaaggaccaggccaatgaaaactgtgagcacaggtcaggtatttagcagatttttcagcaggttatgatggagattcct

SEQ ID NO: 16979 - DNA, 201 bp, Bos taurus
aggttcaaattttcctcaacatggtgagaaagaaataatattgtcattaaaattattttaattaaacacagaaccttcctgccctgtgactaattgcacaaagggatagtttctaatcaaatctctcatgcttggattttttctcagagcagttttcacatctttattctcaagctgtagattaagtgattcatcatggaa

SEQ ID NO: 16980 - DNA, 201 bp, Bos taurus
tgtcctttcctttgtctttcattgactttgttgtaatgactactttgtcttatatccccctctttctttttttcctcttgacttgaatatcttttttttttaatttaaatttatttattttaattggaggttaattactttaccatattgtattggttttgctatccctcattttattctgtgtgtctctttagatccaaa

SEQ ID NO: 16981 - DNA, 201 bp, Bos taurus
atcagagagttgatggccttttgaaggtccacaatgaggcacacaaccatatgattacaggctgctcatccaggtctccctatctgataatcccagttgcgatcttctcaggagacagctgtggcctccacaggtttagtgttgtctgttctgtgtatctcatcagcatgcgcctgagaggcttgccacaatcgttcttct

SEQ ID NO: 16982 - DNA, 201 bp, Bos taurus
atcattaccatggaggctattaggctgtgacacctcaacgcctaacagccctgcaaggttagtattcagaactatccaccaacatcatcagatccccctcgcccttcagagacattggggagaaacacataactctgaaatttcagggaacaaggactgtgtgtctgaatcccagccctgacttttatgattttagatctt

SEQ ID NO: 16983 - DNA, 201 bp, Bos taurus
tctgacttgcgataggttggaatctagaaagagagtcattttctgatggcatatgcataatttaaatgaacccagatacagggaggaagggatataggcatgaaggccagacattaacatgttagacgtgcagttgtttcccattatggtttagtttcattttcatttctctggtgaataaggatttcagtatctttttag

SEQ ID NO: 16984 - DNA, 201 bp, Bos taurus
ttatgttgatgggagagaactgaattacaagtggattttgaatgtcattttaacacatgaaggaagttaattagtataaattatttgtgaaaatttattttctgatgctggatttagggtgtttaaaggctcatattcataattcataaatcatcatggattcaatcaagtctattagaatgtgagaaccagacacattca

SEQ ID NO: 16985 - DNA, 201 bp, Bos taurus
gtacaacaggtctctagaatttattcatcatgccaaactgaaacttcataactattgaaaaattggagtgtgcataacaccttcaaattcaagtgggataatgaacccttatacctggtggtctcttgcctaaatttcaggacagtaatcaaggcacatagataggagctaaaccttagggtctaagaacgccctgaaaac

SEQ ID NO: 16986 - DNA, 201 bp, Bos taurus
ccttataaattcatattcctttactgaaattatacagtgtgttttattaaaaaccttgagtctgtattaaaccctttaaaacaaacattttaagcctattgattatgcttgatggtgaataactaatgatgagtaacaagcttaatggtagtgattgataatggcaatgacggtaatgacagaggtggttgtggtggtggt

SEQ ID NO: 16987 - DNA, 201 bp, Bos taurus
gtcactgtgctacaatccatacccactaacggagaaaacaaacagggggcctgcattttatgggactgtatctggacagtcgagggacgaatcaaatgccacctttagagcacatcacactggccaccataacgtatcagatgctaaagtgactaatattgattttatgactcttaattatggtcttacaagtctgtgtaa

SEQ ID NO: 16988 - DNA, 201 bp, Bos taurus
ggtctgggcacacctaggcctcccctcctgagataaacccaacgctctcgctgccctacgcgaggtgtcataagggcggtggaagggagtgaaggaagcaaacgggccggggttccggcccagcagacacctgcaacctaggcctgggccgtagaacccggttcctgcccggggatcctttcccgacctagagaagcaggc

SEQ ID NO: 16989 - DNA, 201 bp, Bos taurus
tgtgcctggaggagacagattgtttgccaaaagaagtgcaggatttcattaacttacatcaactcctgtaaagagttctggggaacatgcatttaactagattctaaggttgctagacaaacaagaatgtaatcgaaggcctaattacctaaaatattttgaaatgggtgctcaactggaaaataggatgtaatgtcatgg

SEQ ID NO: 16990 - DNA, 201 bp, Bos taurus
gtcgcttccccccagaccccccactccttctgaagaagggggcagtgatcccgggtcgggagtctgcagggacgcttccagcagtggccctccacgctgtctgccctgagtccccaggtctgagcacgtgcttcgttttccacagttcacttcactgccaaggaggctggggacctctccacgctgttcgatgttggtggc

SEQ ID NO: 16991 - DNA, 201 bp, Bos taurus
ttgttttgtacctacacaatctggccagggagtatgactctacagtgtccttagagtcagtttataccctgattctgtaagtcaacaccagtccaagtcacccatgacccttcagctttctggggccctgggctggagcctcacgggctggacccagcacctgccatgaatcttaacaattaagaaacacgcacacgcgtg

SEQ ID NO: 16992 - DNA, 201 bp, Bos taurus
ctggcaacgagtgtacaaggaaaacatgtgactttgaggatgtagactgaatgctgttgagggcagctgggatagagcacagcataaggccattgggagaccaggggacggaaggggacaaagaaaggaaccaggagaggaattggaagagaagggagggagctgggccgtgtgagcccctggaccctagaggcagagctg

SEQ ID NO: 16993 - DNA, 201 bp, Bos taurus
gggggctcccggggccccagcggccgcgactttgatagtacattggctcccaaccagtccatggaattataaatgattaaccgttatcagcgcacatctttacctctgtgtaaaaatagattgactgtaatgagtatttgaataaatcataagaatggccaccccgcgatcgtctaacatcctgccgatggctgcccggtg

SEQ ID NO: 16994 - DNA, 201 bp, Bos taurus
ccagggaaaaggatgcgaggcacccactcacatgcagggctgagagggtgatgagcggtttcggtaccttgaccagcagcatccttctttccatcactccccctgcggccccagcacaccaccctcacctctggtgcagcacttaccaccttgggttttcattatctgtttacatggctgtgtcccctgctctaaccgtgc

SEQ ID NO: 16995 - DNA, 201 bp, Bos taurus
tttttttgctttaaactgctctgctattgtctctcttttgggaagtacccagactgccacatcttccagttcttcacgtttaaacaaccgagacttgaatgacacgaggttgtgttttgttcactggtgcaggctgggaagttttttgtttgggttttggttttagaaacctctgtgctgataagtttctcctacttctgc

SEQ ID NO: 16996 - DNA, 201 bp, Bos taurus
caaaaggtatctgcctcccagacagcctccatcccaggtctgtgtacagagaatcctactttcccacctggcaatggtcccagtctccctccacgtgttgagtccagggatcatggccaccactgatagtatcttttgtctctttctaaccccacttacctgcaacacgatcataatagtaaaagttgtctgtgacacaag

SEQ ID NO: 16997 - DNA, 201 bp, Bos taurus
tcaaggtgaagactgatgaaagccttagactgaaaaggctgatgttttccttgcagatccagatgtcaacttgggtcattatctctcgctacactctccgcaccacaagtcctcttcaaaggcctgacattgactgcccctaccttttgggccaggtggactgtcctgaaatttaagtaataggtgcccttgatggggcct

SEQ ID NO: 16998 - DNA, 201 bp, Bos taurus
acattctatgttcatctctcagtaaaaaaggaaagcgatccagattagcataactgagagttagaaggggccttaaaaaattggcaaggccttttttccctttttaaaaaatagaactctgtgcatcacccccagatgtaattgctcaccctctttttctttaaaaggaaatgccacgacctctttaggcctccagttgca

SEQ ID NO: 16999 - DNA, 201 bp, Bos taurus
accgagaaccagggtaggattcacagccaagctccattcgcttgttcctcacgctgcttattaaacacgtactgcatcagacccaaggcctcctgagcctgtttctttgtcaaggggtgcagggatgaggatccaccacagagggatctgctggtgatcatacacgcagcaggccaaagtggcatgattgcaatggaatcc

SEQ ID NO: 17000 - DNA, 201 bp, Bos taurus
tagtccatggggttgcaagagtcggacatgacttatcgactaacccaccaccaagttgcatagcagcccagcccagttgtaagggcctgggctcctcatttaaaaacagggaccataccagccctacctacctcgcaggcttgttgagtgggtctaatgagaaaatagaaattctgagggataaaacccatcaataccatg

SEQ ID NO: 17001 - DNA, 201 bp, Bos taurus
tgacaggtcatttccatctcattttgatcccttgctcatgaccgtggatgtttccaggccgtgggcagcatcttggcatgcagagtggtggccagcacgtacttctgtggtgcttcctaaagccacttcacagcccttgggatcagggggcaaacacaccgagtcaggggcccctcaagctttttcctcttcacacggggc

SEQ ID NO: 17002 - DNA, 201 bp, Bos taurus
gtgactgacgctcatctgtctccatttccatgactgtgctaataaagtgcgcatcgactatcactgtagagatggcttacatttacatagcccctacctctaaggctaacaacagctatagatttttataaatccaattaagtgtgttatcttaagatgatcttgtctagtttctctatccggatgtgtacacatgtgatt

SEQ ID NO: 17003 - DNA, 201 bp, Bos taurus
aacataggccatcctatcagataggacaaacgtttttgtatccgagaaagagattcattctgaaacattcaaatgtaatgcagttgtggatacagataggcatcgggtcttcagtgaaggttcactccgtcctcagagaacaagggaaacactagctgggcttctctggagactgttgtagatggcgtgttcgtggagcca

SEQ ID NO: 17004 - DNA, 201 bp, Bos taurus
actcttctttaaaaatatattcagcagaacaacagaaaagaaattgccatctcaggcgagtggcacgacacagctttaagaggccaagaaatcagactgtgtgtattctcctgcaatcgggagttgcagcctggagctggtgccttggaggcagcgtggctgggaaggccagggggtaagattctcctgtagaaaaatggg

SEQ ID NO: 17005 - DNA, 201 bp, Bos taurus
ttgcacagattataccaaaacggccttctctggcttagtattttatttttatgtattttataaataattttattactttctccctccaaacccctttgccacatctggcctttaatgggggaaaacaagtctaagattacaatgcatctagatttatacccaaatacaatttagttgcatttggagccctagagagtcagt

SEQ ID NO: 17006 - DNA, 201 bp, Bos taurus
cccatctgcatcccttgttcctgtccttgtcaccctcctgagcatagttcaggaacagtttcatttcccaacctccctcctcatcccagatttttcaggtcgtggggtggatgatggctggaccatagaatatttcagctttaagtctctgcagccagacagatactcttcctgagcacagtctcttgcacagcgattcat

SEQ ID NO: 17007 - DNA, 201 bp, Bos taurus
cacatcctatatagttttattgctcttgtaataaacatttggctttgactattgaaagtccttatattcattttctttttactttgtctagcaatgccactttagataatcatttagaatctattgaaagattgttaagtataaaacaggattctggattcatagatatttttgttattatttctttgcaaatattatcca

SEQ ID NO: 17008 - DNA, 201 bp, Bos taurus
ccacaactatgcacatggcctgggctgtcgcccctctagcctgaccctctgatctgagggtgtcgcaagaggccatggaaaggactcgaccaccagttaaccagtgagctggaccctggccataggaggctccacactcctccctgtccttgtaaagtcgaagtactctctgttcatcattcccactgtgggagaccattg

SEQ ID NO: 17009 - DNA, 201 bp, Bos taurus
tgagcctctaagtatagttgatccttccatgcatcctgttaggtttgatacctataaaccagcctcagaaaacagaatttgacttaccgggccaacttgagaagcccaggtggcatggtggtaaagaatccacctactaatgcaggagatacaagagatgtgggttcgatccctggcccgggaagatcccctggaggagga

SEQ ID NO: 17010 - DNA, 201 bp, Bos taurus
gatatttgtgcattagaaaggaaaaatgtgggagtggggtggggttagactctcttcaaaggaattgagagtaaaatctgtatgatattatcatacttaataaactatggaaatggtattttagcctcagtaggagtttaaccatttgcaagtattttcagtttccctaagacactaaaaaaaccaaataaaaaaaagaag

SEQ ID NO: 17011 - DNA, 201 bp, Bos taurus
caaaatagactttaagttaaaaactgttacaagagacacataagaacatttaatattgataaatgtgtcaattcaccaagcatatataataattataaacatatatgcaacaataacagaacaccaatatgtatgaagcaaatactgatagaaacaaaggaagaaatatgcttggccataaaacagctcccaataaatttt

SEQ ID NO: 17012 - DNA, 201 bp, Bos taurus
cccacaaaacccaggttcatccctggtggcaactgttccccggggacaaggcttcatttgcagtgggctctgcatgctatgtctgacttctctgaaccatgcagtgatgagacatggcctctgagagggactcagattcatcatgacaaagaggcacttacaggaaaggctcaggaaataaagcagggtaagggcctgcta

SEQ ID NO: 17013 - DNA, 201 bp, Bos taurus
ttttccacaaaaatgaactgctatttttcaaagccaatgaaaatgcaattgtggtacaaaaatattttggaggggttctaacattcatactaatttgtgtgtttggaaaagagttgtagttgggggagtcttcatacatgttcttagtcaacaaacactgtgaggctgcagttctaatcttttcttgctgtaaaaagtgag

SEQ ID NO: 17014 - DNA, 201 bp, Bos taurus
ccagggaaagagtgagtgcaggacagaacggaagggacctgggcaatgaccctggccttgacctggctaccccgggactccaagaggtggctggccctccaggactcaatgttccatctcctataaaaccaaattcgctgggtgaagtcacaaactttcaatgacggaatttgtttcaggcaaaatttcatgataaggcca

SEQ ID NO: 17015 - DNA, 201 bp, Bos taurus
tgcaaaggaataaaaaaatactcatttagattatatttttcatttgcaatttctgatattactaaaggcacaattagacctacgtgagaacttagaatcacgtagtaaagttggaatggagcagacgctccctgctcttgtttctttcagagctggcatcaagagctgaaaggttctttatttgtgtgtgtgaatgtccta

SEQ ID NO: 17016 - DNA, 201 bp, Bos taurus
tatctataactccacaaatacatatgaatgttataaacataatattgagcaaaagaagcctgatcaaatgagaacatatttgtgattccatagataagttccagaaaagagcaaaatcaatgtgttagaagtcataataatgagattacccaagggaaagtaggtgttaactggaatggaaaaaaaggtggtctctgggac

SEQ ID NO: 17017 - DNA, 201 bp, Bos taurus
ggcagccagccctgtaggaaggccagacccctatccctgagcgcccagcagccaaggactgggcccctccttgggtacaaacaggagactggggcctcaccggagtggctttgagcagaacgcgttcctgctgcaggaggcgactgtttacgcccagagcagtactctgagaagggcagctgagataaagcagctctggct

SEQ ID NO: 17018 - DNA, 201 bp, Bos taurus
gcttcagggggacacgtgggacctgctccctggagaagggaaggaggcaacacggaaacgccccccaccttcggctctcccgccagaggggagggggccagggtggtgtagccgcaggagaggcaggaacagacaaaataggaaactctcaaagggcaatttaattttagattcaaggccaggaaattgttttgaaaacaa

SEQ ID NO: 17019 - DNA, 201 bp, Bos taurus
gaacctgttgtgcacttagcaaccatcctgagcactgcatgctaacacttctatctcattctcaggattggaaggtcaagggctcacatgagaccccacctggggcccagattctagccctggagtcccgtgccggtgcctaggggcaccacaaaaacacccagccagactctgggcttagagagacctgagtctgaactc

SEQ ID NO: 17020 - DNA, 201 bp, Bos taurus
ggggcctccggtggtagagtggagttctctctgcctgcaagagggggaatgtggccgagggtgccgggtttctggtcggatctgggtgggaagcggtctctccgcgccctcctgaaagccttgttgtcgtttgaaggtcggcagagtctgggctgaaaaggaaacaatttggggtttgaaaggatgtaattcattcttcct

SEQ ID NO: 17021 - DNA, 201 bp, Bos taurus
atgactctaccctccagacgccaccctccctgtgcagtcagcccacttcctgtcatttccttctgctggtcgaggtcctagctgcagcagctggccttgacggaggagaaggagccctcatccatctggagagagctctgctgctcgtgatcagtaatagccagcaccttctgtcacactctggccccatgcctgccttcc

SEQ ID NO: 17022 - DNA, 201 bp, Bos taurus
acaggcagaggtccagaggagaaggggtctaagtcaggaaaaaagtgatgaagggaggttccaggagggtaagagctggtgatgatggaggagagctggacggacagcgcgattttaggcaccacaaagggtgttttcatggggaaatgtttcttttaaatggtaccttgatatgtttaaacacaactgagatcttcacga

SEQ ID NO: 17023 - DNA, 201 bp, Bos taurus
aaagatcagtgatgacagcaccatgggggccaggccgaagctcagcagagttccacagatgcatctggaacttacctcacatttttaactccacaaactctgagtcaataaagacacatgtaaccagtgagaggaattttgcaagaccccggtgtgcatgctttgcaggtgtgatgtttgtttcaggtgttttctgctagt

SEQ ID NO: 17024 - DNA, 201 bp, Bos taurus
gcaccgcccagtgcccgtggggaacacgtgtgcccctgccactgacgtcagctgttttccaccagcctctgcacggctggcaccgctgcaggccgtgtgtcgatagttatcaatgtcgtagaaaacaaaatggaagtaactgcacagatttaaatctccgagcagtccacaagccaaccgaaggcaggccccttccagaaa

SEQ ID NO: 17025 - DNA, 201 bp, Bos taurus
tactaacctgccagccacgccgcccacacagcaaggcgggagggccagcttagaagctgagggcacaggccagcatcacgggcctgtcttcctgttcttgtcctctgtgaccctcttcatattgttctaggagcagcagtggtcattccattctccacggggcctaattgctcgaaaaatatttaattcatatctccagag

SEQ ID NO: 17026 - DNA, 201 bp, Bos taurus
tgagcaggccgctccccctgaggggaccttctggggtttgtaacccaccccccaagacagcatataaaatgtccatatatatacatgaaagtaccatgtggagggaagggccctgaatttcaccacctcctacagtgttcacgactctgcaacataaacgactctaaaacagcacccggtgaattaaagacatgaacactt

SEQ ID NO: 17027 - DNA, 201 bp, Bos taurus
gggcctctgttctacagacaacagggtccgatgggccggaatggatggtgcccaccttccccccattggctccagtccttcctacttgccggccaggcagtggcgcactgaggaaatagcactgggacatctgttcccactggaaagggttctaggtctcttcacaggccccatggggaggccttcctttccttcctgtta

SEQ ID NO: 17028 - DNA, 201 bp, Bos taurus
atgcagagtaattagagatggggagctgatgcagagggctggtccctgcccttgatgggctgggcatctgggggtagcttggggcaccagggaaaggtgaatcattcacaggggtcccagtggttctccctcaagtcctcatgtcaatgtgcttcccttgcttgctaggcttggggtgggcttgaggttaggaccggggct

SEQ ID NO: 17029 - DNA, 201 bp, Bos taurus
ggaggggtgaagttagctccccctgtgatcaccccgatccatagggagcagagccagcatttggagccaagggctcagatgctcacgcctgtgatgttgattgccctgtcatgacccggcgtgtatgacaacagtgttagatctcttggtggctaaaatagattatgaagctcagttcctaccacgaggtgctcacagtct

SEQ ID NO: 17030 - DNA, 201 bp, Bos taurus
gtgatggacatgattacctgggtgatcgtccgcggtaacatgtcgataagctggtaaagggtcagggcgacagccaccaggcgagtgagctgcaggccttgttggtggagctcctggccacatgtcacctgtcactgcaggatctgactcaaggaacatgggtgatgttattgctgggaaagtacaggctgggttcataac

SEQ ID NO: 17031 - DNA, 201 bp, Bos taurus
tgccatgtgaggataccgtcatcataacgtatcgtgaggattcagggctggggcggagtaccctgggccaaagtgagaagctggggcttagctatgtatggagccgaggcacccacaccagccacagatgcctgcaggatagtgggctgttagcgcagcccagtgcagtgagaaacggtgacttttcaaatatgcaatcta

SEQ ID NO: 17032 - DNA, 201 bp, Bos taurus
tatgatgtatttgcatcatgtattcttcaaaaggtttgactttttattttttggttttctggctttttttttacaatcaaattgtgtattgtatcttcttcgtttttgttcttacattatcagttatcacttcaatgttagatactcacctatattgttttataaatgcgttcacattttattttacattgaattctctaa

SEQ ID NO: 17033 - DNA, 201 bp, Bos taurus
caattaccggcgcagtgggtcaaagaggtgtgagcaaagctgtgatgggggcctggagcggggaacctgctaagccccaggtgtgggagttaggggccaccaagcaggtgactttcaaagtgtcttttgaagagtgaaaatgacttttccaggtgggaagggtggagtaaatacacaaggacctgaaataggagcagggcc

SEQ ID NO: 17034 - DNA, 201 bp, Bos taurus
ctgtacacaagcttctctgattggctgatggtgagggaacagggtggtgtcacaggggttaaccttgtcagtccttaggccccaggagggaggtctggggatgtctactcatggatatcaagtagatgttgctgttcagtccctaagttgtgtccgactctgtggccccatggactgtagcacaccaggcttccccatcct

SEQ ID NO: 17035 - DNA, 201 bp, Bos taurus
cttcacagggcagtgaggtggaaggtttatatggtgggtccctgtgctctgaggggtgtgacttccaggatgaccagcagagcttgcattttcttcaggaagatgcctgagcgctgattgcctctgcgctctggccgcaggacttctcagacatcagtgctcttcctggaagggagacagctgtcctacgtgtgactgatg

SEQ ID NO: 17036 - DNA, 201 bp, Bos taurus
tcctcccttaatgcagtgtgaagtcttagataattgtgtgcagcgttcgttaatggctaatttaatggctggtgcttaggaggcccttactttgccaggtaatttataggagattttctccctccattttcaagcagccctgtgggacaggtttttatttccccctttaaaggtgaagagtccgaggtcagagaggctgga

SEQ ID NO: 17037 - DNA, 201 bp, Bos taurus
tgcttcagaaatgaaggcccatgggcctggtcccagagccattgaatgaaagtctccaaggacagccctgaagatatgctccgtgcgcaggtctccctgggaggccagggcccccaggagccggccagtctctgggcagctgtctgggagcctcccatctatgtccctaacactctcctcagttctgaatcacaggccgct

SEQ ID NO: 17038 - DNA, 201 bp, Bos taurus
tctcatcctgggagtgattacagaagcccgagcatgtggtctcaggtggccaggaccacctcgctggctgtcttaccccgtcatggagtccagcgtgccttaagggctgagaccagcggctggggcccactgataaaagccagggagagaggtggggaggacagccagacacacttgttacaaatgcagacactattacgg

SEQ ID NO: 17039 - DNA, 201 bp, Bos taurus
aagttggtgatggacagggagacctggcctgctgcagtccatggggtcacaaagagttggacacgattgagcgactgaactgaactgaataggaagccactgtgttagaggtggcctgaccttaagtcaaatcctggctgagacactggcctcagacacaagaatggctcagttttctcatctttgaaatgcaaacaatgc

SEQ ID NO: 17040 - DNA, 201 bp, Bos taurus
cttgacgaagcattcttcaatccaaagagaagggcacagtttgagactgcctgaggccagatgacctctggattgaaggaatccaggtcctgcaaataccttgattctcatcagcaagactgctcgtgaagcgctgctatcaaactcctcaccaaatcccttcccccaacccagggttgggacacccagtttggagggcat

SEQ ID NO: 17041 - DNA, 201 bp, Bos taurus
gacagaggagcccagaggactataggccatggagtcgtaaagagccagactcgacttagcaactgagtccccatgcacatacggaggtaaggtccgacacgtctcacggccaaaaataccaaaacataaaacagaaacgatgctgtaacaaactcaataaaagactttaaaaatcgtccacatcaaaaaaaaaaaatctta

SEQ ID NO: 17042 - DNA, 201 bp, Bos taurus
catgttggggacatttgttattgcagcataacttagccaaagctgactaatacacattagtatccctcttaactaattttcattgaaataccccatcagactaactgatgctctctatttcctctgcaaaacataccaaaagtccaaagttcttagactaatacttagtatattagcacttttctgatcctacaagttagg

SEQ ID NO: 17043 - DNA, 201 bp, Bos taurus
tattcacctccaatgcctgggcagccagacagactggcttgtggagtcctcacagactcatgtttccattgaaatgtgttcaatgtgaactctctgtgagggagcccaagactgctaatatctgaagcaaaaggctggtggaagaacctggaataaaattcttactctgaacaatctatggagattttatgattctctgat

SEQ ID NO: 17044 - DNA, 201 bp, Bos taurus
aagaaggctgctgagccgtgttgcagaacacagaggggagcatctcaaaagcacaaaggctgcctgctagctccccctgcaccaggcaccagacacagaacgcacgttccctgttcctcccagaccctggagcttgtactccagctgtggtgtgaacagtttgcaactcagcaagggactctgggtacacaagcaattggg

SEQ ID NO: 17045 - DNA, 201 bp, Bos taurus
aactgttaaatggctaataatagcaatcacctcctgtgatcactgtgaagtttctttactataaatgaagcacttgaaggaaggcctggcatgtggtaagggctcagtccatggtacctttcatacggacaagagctcagaaaccccaaaccggggcctggggaagcctggcagcacacacgtctggcaatctttcaagtc

SEQ ID NO: 17046 - DNA, 201 bp, Bos taurus
cctgaaaacttaatatctgtcttccaagcaagaactcagggtcactatgtccaaaagacctgctccactttcctctggcttggctggacacatttctcccatatttctatacatcctgggctcctttccatcacagcactttctgtatttcattgtaatcatcagtttactgatttctctcctcaagtcagtggtgaacat

SEQ ID NO: 17047 - DNA, 201 bp, Bos taurus
cttcaatccctcactctctcctcttgggcgtctggttcttctctttcctttgacatccatacgctcagatcacaacctcttctcagcgcccttgggccccgtcagttcagccgatggacccttctccgtcttctctggtctccagctccctctcaacacacccagccccacttccctgctctcctctcctgtgcagagact

SEQ ID NO: 17048 - DNA, 201 bp, Bos taurus
ttccaggaaatcagtccaggttgtcctatgtgctggtctttgaagacaggtcccatgggctgatgaggggtcagtgcccttgtaagagaggccccagggatctccctcgccccttccacatgtgaggacacggcatctctgaatcagatggggagtctgctagaactttgctcttggcctccccagcctccacaccaggag

SEQ ID NO: 17049 - DNA, 201 bp, Bos taurus
aacgagaagaatgtcatgagatgggagggatatcggagggggctgagccctggattcagccaggtctggcatgtgctctgtagaaaaacaaaaccaaatggtgtaaagaggctagagtctgccaggaaggagggggaggaggtgactttggatgtctttctaatctcatcctttcacaggatttctgtctagcttggctgg

SEQ ID NO: 17050 - DNA, 201 bp, Bos taurus
aactagaggaatcaaatcccacaaacttctctcaaacacgcatatgaagacagccttatttaattatatttttaacatatttatttggccacatcaggtcgaagttgcagcatatggaattgttagttgcagcatgtgggatctagttccctgaccagggatcgaacccaggccccctgcattgggagcatggagtcttag

SEQ ID NO: 17051 - DNA, 201 bp, Bos taurus
cttgatttcagccttctctctcattctgagaattttaccttccaggaaccagccagaaagaagcactggatatctctaccccctgctctctccccatttctcaggaaacagggccttttcatggttagacgccaaccccagccttgacttagggaatccattaatatttcaggtattatcagagctttgagatgataaaat

SEQ ID NO: 17052 - DNA, 201 bp, Bos taurus
atcgatcctcattctcttctgcctcagcgcagctcacttccacggcacttcctgtggttctgtgatgtcatttccttttgtagctattagttccctgccgtgctcgtggttcactcaacccaggcctgtctggtaacagatgtgatttccagctgtgtctatgtaccaaccacagtgggttcattaataacaattattaag

SEQ ID NO: 17053 - DNA, 201 bp, Bos taurus
ctggacattagacaactcacaatgtgatccctgagaaacgagagaaaacaaggtgacgtctctaagcactttgctcatgaatggcctaaagagggtttccagatcacactgtaggcaaggacgggtggtctgatttgagaggctgtaactggacatcttaaggccaagatggctagagcttgcagggcagcgtgctggaga

SEQ ID NO: 17054 - DNA, 201 bp, Bos taurus
tgcctaaaggcctcataggcccacaggatctgagcacctgtctagaggcctcatagttaaacataagctgagcatctactagaggcctgatagttatgcacatgctgaacatctgcctagaagcctcattggctcacaggatctgagagtctgcctagaggcctcagaggagctgagcttctgcctagagaactcatagtt

SEQ ID NO: 17055 - DNA, 201 bp, Bos taurus
cccttgttgcttgaaaaataacccatctttcaagtccagatatcccccttttactctaagtatgttgaagtggcaactggtaactggccctctgttgatgacatctgtaagctttcatcttccttcaccatggctcaacctgctcaaattcttttaacgtaagttctctgtgcccaaagcactgtgaggccaaacaaactg

SEQ ID NO: 17056 - DNA, 201 bp, Bos taurus
aaaacaaggctgagcttcaaaacagggaagtgcttgcatctgttatataaaaactctgttccttgtgaaattgctttttcagtctaatgaaatggccccagattaaaacatacttccccaaaacaatggcagtgtttcatactgaaagttgctctttgcaaccctatggaatagttcatggaattctttaggccagaatac

SEQ ID NO: 17057 - DNA, 201 bp, Bos taurus
cagacactcgcctgcctggggccaccaggaacctggactaggcatgcggagtgtttgttctaatgggctgttctctgggtggtggccgggtgaggccctcgagcgtcatggatggaaaagccctgagtggcttcactttcacggcaagtccttgtgagacgtgttgtctctgctgggggcctgagctgagggtcctccagc

SEQ ID NO: 17058 - DNA, 201 bp, Bos taurus
taggtgaggatggggatagctcagtaggcctgggaagcagagaatgacacatggaggtatattttggaccctctgctaatcatgactcttgacactggacatttggacaaaggccccctctgtccctaattctgatctggcctctgctctccacttgctgtaattctgggtgtctttgggggagtccacttgaagacactg

SEQ ID NO: 17059 - DNA, 201 bp, Bos taurus
ccagtgacgcatgagagagattcaggtgggcaaccgacttcaggggccatgttaataccagtgcaggtggtctcaccagtggtgaactgagccctcgctcatgtgatactcttcagactaaaggccatgctgccctgggtgtccaatggattctgactccattctttacttcaaagtggcctggctggcggggagtcatca

SEQ ID NO: 17060 - DNA, 201 bp, Bos taurus
tattttggccggttcaggacccctctgaggggctgtttgctcaggattccctgtagagctggccaaggctgcaggacttgcattgccacctgacccctcgatgtgccctcttctgcttccttcctctccttccagaggccagggtcccagacacgttccctgttaaacatcctgaactctacactcttctcagagtccaca

SEQ ID NO: 17061 - DNA, 201 bp, Bos taurus
ccctaaatatctggtgaagagataacagaggagttaacaaaaggggggtagttctatggaggagattccaagccaagggaatttgtcttctgatggccatgtgcttagcccagcaaaagaggtcctcacagctgtgttggagagagcagaggaggatccaaggagctgaagctggcccgggaggcagaggccagctggtgg

SEQ ID NO: 17062 - DNA, 201 bp, Bos taurus
tttgtctttttgaagactggtttccttgggctaaaggcccaggtgtgagaatgtcagatcctagctctggtcacttgagagttgttcccccgcggccccaacattcagagtgtcctttcgagtgactcttgccaatgtccatttccaccgactgtgtagggggttcccacccctcccagctctctcctacatgtattgcta

SEQ ID NO: 17063 - DNA, 201 bp, Bos taurus
ggctgttaacgacagctgccctcaggaaaggacctgggtgagtactgcggaaatggattgcagtcacaactggctttgaagaggccaattacaaggtaaaatttccatatatcctttaaggtaaagaaaaaaagaataaaaatccccaaatggccagagaacaagatgttctatatccctaaatatgacagggtaagtgct

SEQ ID NO: 17064 - DNA, 201 bp, Bos taurus
aaaaaatcaatcaatatattaatagtatactgcattaatagaataaaagaaacaatcactgaagagtgatagaaggaaatattaatagattgtaatggcttatagtcttatctccttacctctaaattctttcaaaataaaaatcaatcattaatccctccaaaaaactgcatattaataaggcaacctaaaactctgcct

SEQ ID NO: 17065 - DNA, 201 bp, Bos taurus
taatctgagccgggcatggtgccctagaatggcctcatttctgagtctagaaatgatgagtcgagcataattctgctttgaatttttatcacatagcttctttggaaggtaaatatagatacattaagggtatatttagaagtagccgaaatagctcagttgggagagcgttagactgaagatctaaaggtccctggttca

SEQ ID NO: 17066 - DNA, 201 bp, Bos taurus
aacatttgtttcgcacagttctgaggctaagaagtccaagatcaaggtgccagcagcttcagtgtctggtaagggtcctcttcctggtttgcagacggccgccttcttgctatactctcacaggataaagagatcttaggtctctcgcttttttttccccatcatgagggccccacactcataacctcatctcacccaagt

SEQ ID NO: 17067 - DNA, 201 bp, Bos taurus
ttccaagctcctcaaactccccagggcctcagacaaagcctgagaagtctctttgtcaaccaaaaggaagggactgctggggctcagagtcagatctgctcggcccagcacacttctgaggcgctgaatttagactgttgcttgaaatgagtgggttgtcgactggcgtgtgagaagccactggtgatgcagagagaggcg

SEQ ID NO: 17068 - DNA, 201 bp, Bos taurus
aagctgcctcaaccctcaggctttagccaaagaaatgactccctaaaagtagacagccccattcccactgggaattggcaccgagagaggtaagaggtcaagggtgaaaggtgagggcagaacaaagggtctcctgcctcctcgtcaccaagtgagccaagcgtcttcaccatgtcctcctgaggccatcctgcctattgc

SEQ ID NO: 17069 - DNA, 201 bp, Bos taurus
gagacgcactaacgcaaggccagaacacaggctggacacacaaggaggcccccaaataaagttagtctgaggagtgggaaagccagggccagcctgagacaccgattccagacagacctgccctgactcctccacgtgtgtgtcctgcagagaagctacgcagatgagctaacagggggccccctggagaactggagggga

SEQ ID NO: 17070 - DNA, 201 bp, Bos taurus
tcgtggagtcttatcacagccgatgccaaggtcaatggggatgaaagtgtgaggggctgtggtgtgacaccaatatggcccaacatagagactgagcctggcttgtcttgatggagcacttgatcaaaaattacacccagccctgttcttgctcttaagaaatgtgtgtacgtttctctttggagtaacgaagactgaaat

SEQ ID NO: 17071 - DNA, 201 bp, Bos taurus
tagaagctgagtcacctggccgggctccacccacccaggcttctgaagagaccctggacctcctgagacctgagtgctcagatataccctcagaggacagtatgctgaagggttttggccttctgcttgtccaacttgtcatttttcagaaaaatcaaggactgaaagcactaagagtgtggcttctggtcacccatattg

SEQ ID NO: 17072 - DNA, 201 bp, Bos taurus
gacaaaagtagtctttatcttaagagagctatcagtctaattctcagaaagtcatggtccccggaggcaggagatatgattataggactaggtggccatattgaaccatgggcaacacagaccttaccactaggagcagcctttcctccacttcacccatgctggaaagcaggccagttggccatgttttcaggagaatcg

SEQ ID NO: 17073 - DNA, 201 bp, Bos taurus
gtggccacagtgctggaaagggtcagttttcattccaatccaaaagaaaggcaattccaaagaatgttcaacctattgaaatgttgttgtatcatacaaatatgccaggattcttggccccaaaggagaagaattcaatctggagccagagacaaggcttgaaccctcagagcttttgtgtaataaagttttattaaagta

SEQ ID NO: 17074 - DNA, 201 bp, Bos taurus
aaatcctgatgtgatggtattagggggtagggcctttgcaaggtaattaagttgacatggggttatgatagtagggtcttcgtgatggcattcagttcagctcagttcaatcgctcggcctctccctttttttctctcttattctccctcttcttccgtcccctctcctaccacatatgagaacacagccagacgagaact

SEQ ID NO: 17075 - DNA, 201 bp, Bos taurus
ctaagacttacttgttcaagtagaaggcaaacacgggctcagaaatgactttttgtagcatcaggctgtcaaagacagggatgatcctggaggtggcgagactggggtagcccaaacccaggactccctcaaaaggtacaaacggcaggatcttgctaatctgcctgtaggtcagggcaaaagtctggttcatgatgacaa

SEQ ID NO: 17076 - DNA, 201 bp, Bos taurus
gtaataaaaatagcttctatccatcctccgcatctcagaggaacattggcagtgaatttctgccctagggggatctctgtgaggcccttcaagttgaggtgattcctgttttccttccaccccaatcaccagctctctgccacccacaccaactgtgtcctttccagtcccatttgccaagttttgggccgtgtggatccc

SEQ ID NO: 17077 - DNA, 201 bp, Bos taurus
gccaacacacacctcgcaggactgctgctaccagtgcccctgtgcacgaggcaggccactgctgacacaagttgccacaggagaccctcaaaactcaagattctggctcagtctcttgggggtcactgctccttcccccgggtcctgatgcatgcaaggatttgtttgtatcttccaagagtctctgtttcacccaatcct

SEQ ID NO: 17078 - DNA, 201 bp, Bos taurus
gtccagggcctgtctgtggaggtcaagtagagacacagtcccttcctcagcaggtcattcactctgggtgaatgcagcaagggcatctcctgggcaagggaagccgcccttcccacggccccacttcattcacatcccactgtcccctaagagcaggggtgccctggaaccaactaatacagctcctgagagcgaaagggg

SEQ ID NO: 17079 - DNA, 201 bp, Bos taurus
accagagccatagactcggaggcacacacaggctggacacaagccatggccctcggaatggaccagccaccagcagccacggttggctacaacaggcagataggacatgcatggagtatgccaggccctggagagaagacaccaggacccaacagcagggtgtgtgaacacacacacacacacaaacacacataaacacac

SEQ ID NO: 17080 - DNA, 201 bp, Bos taurus
acagggtgtgctgggagctcagaaaacagaggggcagcaatgaagaagggattctaggagactctgcccggaagagatgggaggatcctggaatgattgcttgggccaagggttagggctgggggtgggagggctggcttagtgacccaagaatgggttactttgtctcagacttggggctgcacccaggagtggactggc

SEQ ID NO: 17081 - DNA, 201 bp, Bos taurus
ggcaccctgggctcaccctcaacttattctcatgtgttactcttgactcgtcatcacaaaaccagaactaccccaagagcaagacctggctcccgaaacatggcccttaccctggcattcaaggctcttggatgttgggtttcctcacctgctataaccccttgctgccttcgcccagtggctctgagcccccatcacctg

SEQ ID NO: 17082 - DNA, 201 bp, Bos taurus
ttgcagccaggcaaccctggcgcttctcagggctggcagtgacccgccggccctctggcatccaaccctgttcccaccccagcactctccgaggtggcccgtccctcttggttcctctcctagtttggtttccttccctttggcgcctcttccatccggctgcctttttttcttttttcttttttttcatccaccttttcc

SEQ ID NO: 17083 - DNA, 201 bp, Bos taurus
gtgataaattcaataaagacttcaaaaacggtccacatcaagaaaaatctttagaaaactaataatatttggccaagtataatggtgctttttatgacctcatcacatagtgtttataaaaaacaacgcgagggcttccctggtggctcagtggtaatgaatccacctgcccgtgcaggagacatgagttcgatccctgat

SEQ ID NO: 17084 - DNA, 201 bp, Bos taurus
tggttgcagctctcagtctggacgctcagtgtgcagccgcccctgggagatgcaactcttatactgtgtccctcaggcaggtcctgaggctacagagccatgaggtatacccgggcagggctgtctaagggcaaccagaacccacttctcatcagtcccccaacccaggggcatggggcagaagggagagcaaagggccca

SEQ ID NO: 17085 - DNA, 201 bp, Bos taurus
cttccaccccagcgcccaacacgccccggcccactccccaaagaagaaccatgaaggggagaggaaggggtcctttgagacctgcaaagagaggcgctgtcggggccagatgcccccccacacccactgcatgtagctgaagagcacaatgacgctgaggaaggtgaagttgctggcgacaccaacgaaggcgcaggtcat

SEQ ID NO: 17086 - DNA, 201 bp, Bos taurus
atgctcccttacattactacccttctttctcccaggtcacacccagtggtctacttttagctccgcccctcggcctaaccgtagcagcaggccccgccccgtccacaaagcccctccccggaagtcccgccccttaggcagcctccgcttcctcgatgcccacccggtagcttccagcacctcgtccaactagagtctcga

SEQ ID NO: 17087 - DNA, 201 bp, Bos taurus
tatggtaatcttgccctgcctcactcaggggcgtgtaagtcaatagtgagtcaaaacaggagtagcctccattgtgggccaggtggtgtgcaaagtctcgaaatgactctgaaatgagtgcttttatctccgtgctgaagcttggagaagttgagtctcctggccacagtcatgtgtccaacaagtgttcaaagcccagaa

SEQ ID NO: 17088 - DNA, 201 bp, Bos taurus
tggcctcccatttcccctctaacctcagctggtactactcttctcctcacttgtcgccagatgcagtggcttctttgctatccttcaactcaacagacatgttcttgcctgaaggcctttacataggttctgccctctgcctggtactcttctccatatatccatacagcaaactccctcaccttccccccatcttggaag

SEQ ID NO: 17089 - DNA, 201 bp, Bos taurus
ggcggcccagcctgtcaggggaggggaggcctgcagcaggggttttgaggaccagcaagggccaggccaaactgggagaggcgctggcctgggaccgtgatgtatcatgaggctgatgctgtatatcctcagtccagccccagttaggcgtgccaaccacccaccgtggccctcccgaattcagccaaggagtccccagtc

SEQ ID NO: 17090 - DNA, 201 bp, Bos taurus
caggtttgcctctttattggcttctgagtgacaagcggctgaaccccacttccagttatgttatcgagtccaaacttgccctgctggccgcacaataaatgagtgagtctgagatgaggtgttggactgggaagggactttattcgggagccggctgacagagaaggtggcaggctagtgcttcagaataaccatcttgtc

SEQ ID NO: 17091 - DNA, 201 bp, Bos taurus
gtggagtgccatcgccttctccgtactggcagtcaaaaagggactgcattcctaggcgtcgagtccaagatcttcacaagatcaatgaggccattatatccgtacaccccatggtcactaatccctacacccttctctctcatatttccctgacacactctatttcacaatattaggcctcaaagatgctttctttactat

SEQ ID NO: 17092 - DNA, 201 bp, Bos taurus
ctgaagctgaattaagaaataattgtgactataacctggatgtttggttttgcttaaaaacctcattagaggtaatacttccagatgagttaactaatctataaacctcaggtgatataatttgtgttgtgagacgtttgggttatcttgtacctggcagtggtcatccaaaagtaagagaacaactgtggcagccacaca

SEQ ID NO: 17093 - DNA, 201 bp, Bos taurus
gattcaaacttaaagccagagaagtgtcatcgcttcctccacccccagtggcagctccttcacctgaataggaccttcgccaacatgactggcctggacacggagccctgtatggacggctgggtgtatgaccacagcttgttctcctccaccatcgtgactgaggtaaggccccattttcctcttctgagtacttggtgt

SEQ ID NO: 17094 - DNA, 201 bp, Bos taurus
tgggggccaccagcctgggccagcaagtcctggagcagctacgggagctgcgaatcagtggtagcgtccagctctactgtgtccactactgaggagggagccagagggcccagccagagaagaggacctgcctataccaagggccccaccagctgatcccactctcctccccttgttaaaaatgtccccacgatgtcaggc

SEQ ID NO: 17095 - DNA, 201 bp, Bos taurus
acctgaagcatggatttggggtgaggcagatcttctccttggtaaattttaatatatgccttagaatataaacagaaaacaattatgaaaaacgccactcgtcatatttaactgcagcttacctttcagaaacagtgaccgtacaattgcattttcctagagacctagatccacacccaggaattagcaaaaacacagcac

SEQ ID NO: 17096 - DNA, 201 bp, Bos taurus
ctgtcccccaagaaccagaacagtgcccacagagacgagacatccaggaaacatttgcataataaacaagtaaaccccacctcttagtcacaatgtgactatgggtaaacatccaaccatttgtagttccatttatttataaaactaataccatctcaaagcaacagtgtctgacacaaactccgagcgtgctcagtcaca

SEQ ID NO: 17097 - DNA, 201 bp, Bos taurus
cagtcctcctgggccagggtcccaccagcccatgcccttggggagccccgcagcacccaggggctcaactcagcaagtgtgtgctgaatgaacgagtgatctttctgaacctcacggccaatagtgcctctgctgtagccaccctccctgcaccctgccctttccgagacaaaggccagactctccagacttgtccaaagc

SEQ ID NO: 17098 - DNA, 201 bp, Bos taurus
aagtcacgtcaggctcagcttttgcctgtagatgaactgagaccaggcgcgcctcatcgtcaggctgcccaggcagcgggtggcgctgggcctggcgctcactccacacgcctcctttcctcttgtaggttgaacgtctccatcgagtgtaagcgagtgtccggcctggagccagccactgtggactgggccttcgacctg

SEQ ID NO: 17099 - DNA, 201 bp, Bos taurus
agggaagcccatgaatcccgagaggggggccgcaaacagggaggagctaggcgagacactggggcacggggcgagttctgaacagggtgaagtctgggggttctaggccagggaggactccggagtgtgacaaggaacaaggctgggggcctgctcttctgtccggtgtttgggattccatcctggaggtggagagccaca

SEQ ID NO: 17100 - DNA, 201 bp, Bos taurus
ctaggcccttcagcaggcaactcccatcttcctgacttcacacgtaaaacactcaaagaccaggctaaactccaaactcctgggtatgacattccaactcttgaaaagcctggcctctgccgctccgccatccttccatgggtctgctatttcttctactggaaatgacagcactctacctcatgtcttcaagtcccaggt

SEQ ID NO: 17101 - DNA, 201 bp, Bos taurus
ttgtcctcactgactttgggcttagcaaggagttcctgacagaggaggtgagtgaaggatggtctcagcctcctgaaccccgctacacaggccttcccatcccggctccagctccacgcctggctctgcagtagctctgccttcaggaagttcccactgctccgactcgcacaagtccagcgagtcttactctgggccgtg

SEQ ID NO: 17102 - DNA, 201 bp, Bos taurus
gtggatgtcagcacaagcccgcgtcttcagtggtgactctgaactccctgggctacaccttcggccgggtcctcctggctgcggtggcctatggcgtgctgcagcagctggctgtctccgttccctgcttcctctgctttgtgtactcctggtgggtgccgcccagctccctccctgcaggagacccaccctccaccctgg

SEQ ID NO: 17103 - DNA, 201 bp, Bos taurus
cactctacccattgaaacccctgacgccatcttcagtagcatgcactctgggggcgttttcctcctcatgtctcactgcacaaccatgctacctgcccagtgagacctgggcctgggcctgcctgtgttcacctcccatgaacctcccatggtatgttcactccggcagggatggggcctccctggatgcttacaaggcag

SEQ ID NO: 17104 - DNA, 201 bp, Bos taurus
gtggccatctcagaggtggggtgctcttgacacagaagtcatctgaacagaggtggagagcctcccgtcggcagggcgaggcatggcagatacacacatgcgggccggctgaaggaggtgacttctaagggcccctccagcttggagattcttcagttacaattcacccttcgtgtcagcctcactggcaactgcgacagc

SEQ ID NO: 17105 - DNA, 201 bp, Bos taurus
cctcacccaaggcccccgagccccctgcctcccccaggccaccccgagattcaggcaagaccaccgaatgagccaggtggcagtgtgaactcagcgctccgaggggatctggccgtactcaaaactcagtgccaccgtcaccattcccatcacggtctgccggcacagggtggggggtgggggggaaccccaagcgggacc

SEQ ID NO: 17106 - DNA, 201 bp, Bos taurus
ttgggaagcttgggtcccagcactcgagccgccactatctgcgtgactctgggcaagtccccttgttcctcacctgctggccagaagctacccctcctaggatacctcctaggaaccactgtgtccttcccagagtacagtcacgcccctgagaaggtgccagagaaagcactcctgtacagaagggcctgggacactgcc

SEQ ID NO: 17107 - DNA, 201 bp, Bos taurus
ctgctaatgcattgggtcccctggtctggtggagggagtgcccccattttaagcccttgtctttgcaggtccccctgcaccattttaccctggattttctaggcctgcttcaagcccagaacctgcttgatgggcctggcacagtcccctcccctgcccacagtgctccgctctaactctccccatttctgtatctgcagt

SEQ ID NO: 17108 - DNA, 201 bp, Bos taurus
gcccccagccctctcacccgctggcccaggggcctgcccagcttcctttagccctgctcagccaccctttaggctcaggctctgtatcaaggaaggtcaggggagagctgctgaaggaataaaagcccctcatcgctttgtgtctgggaccccaagtgtatactaaccaggaagctgggggttcttgcgggtggaggtcct

SEQ ID NO: 17109 - DNA, 201 bp, Bos taurus
aaactgagttccagtctcagctgccccggccagcaaggtgatctggtcaggcatgtgctttttgaggctctcttgtcccatgtcatctgggaggcttggggggccatcaaagaggctttccaggtattggtgttgtctacaaaaataatcaacaacaatctgcaataagaattgaaaagagttttatttgagtcaaactga

SEQ ID NO: 17110 - DNA, 201 bp, Bos taurus
cctcttttttcctttttattgcaacaagcaggcaggcctttaacttaggttcgtaagatgtcagagctagaatgggccttccaaggtcctctacagaattcttttacagaaagagaaagggagtccctgggaagctatgtgaactgctgatcgtcccagtggcagaacagtaagtggacttccaaggggcccctgggtccc

SEQ ID NO: 17111 - DNA, 201 bp, Bos taurus
ggccctacattcctcacctctgtgcgcagatgatggagctaggctctttgagttcataccctggctccaactattgcttatttaaaatattgatctatctatttggctgggccaggtctcagttgtatcttgcaggatcttccatcttcattgtggcatgccagatctttagttgtggcatgtgggatatcgttccttgac

SEQ ID NO: 17112 - DNA, 201 bp, Bos taurus
gggccagacctctctcttcctctgtgtcctcaggtggtggtgcccggctggggctctcgggcagctgctggggcttgggtggcccatcggggtgcaggaaaagggaaaagtcactttcgccctgaatggtgagcgtctggtgggaggtgaggatgtggtaccccttcccagctgggcagatctccttgaaggcagctgtgg

SEQ ID NO: 17113 - DNA, 201 bp, Bos taurus
ggagtccctctagtcagtttggcagaaccaacctggtgtcaggccctgagtcaggtacactgctgcccaagagcctgctggtagttggacagagtgactcaaggcccagggccctccaaggaagcaggaggcagcaagtgtccaaaaatggaaggtccagggagtctctgtaggaggaagatggggccacgaggaggccat

SEQ ID NO: 17114 - DNA, 201 bp, Bos taurus
tgaagcatttaccaaaatccattatgtgtttacccagaaaacaagtatcaacaaactttaaaagcctgaaataatatagactgtgatctctgatctaggagactcatcaaggaatcaaaacaaaaagataactacattccaaaatatttggaaattaaacaacatacttctaaataataagtcaaagaagaaattataatg

SEQ ID NO: 17115 - DNA, 201 bp, Bos taurus
gggtggaccatgaagactgggccaataacaaccgttctggggaaacattcgcaggagcatgaaaggagggtgagcaagatggagcagggccttgaatgccaggttcagaagggcggcggtggtcctgacccctcccacccaggctgaccccttctagcctgtctcctgtgattctggcctgagccactcagggtgggccag

SEQ ID NO: 17116 - DNA, 201 bp, Bos taurus
gttccagggtcaaacctgggaagaggacaggcggcgccagacggagcatggcgacactgtcctccggctccgtcgtcatctgtgtgacctcaggcggccactgaacctctctgggctttagttctgccatttgtttgaccaaaacatctttgcttcataggaagtcttgcgatgattaagtgaactcatttcattcactca

SEQ ID NO: 17117 - DNA, 201 bp, Bos taurus
cctcggcctcgtggtcccccaccgccccctggagatgaaaacagagaggtgagattgcagggttcttcctgggaacaggagagtgttttagaaggggactatttctggatttttagagaaggactcgagagaagatgggagaacttctgggggtggggttggttggtggaggggatccatgtttacttaaaacacaggtag

SEQ ID NO: 17118 - DNA, 201 bp, Bos taurus
tcggggtcagcaaagtgggtggaaatgactaaaatgctctccataggcgtgtatggatttgagggcacagagaagtgcccacttcccccgcagcctttcccacactgttacaggggtgtgcgtgtgtgtctttctgtctatttctctttttaggggattaggttatttactaatctgataggtagaagatggcagttgttc

SEQ ID NO: 17119 - DNA, 201 bp, Bos taurus
tacgggtaggtagtggtcagcacccggcagctgaggccccagcctcgggcctgcatgagtacctgccaagctgctcaagcctgtctgttcatccggcaacacttccggtcttgtcttcatcccaggcctggctggacccgggggaaacgtgagggaaagctgggtgctgcctatgagcggccggcggcaaacacagtgact

SEQ ID NO: 17120 - DNA, 201 bp, Bos taurus
tgggtctgtctctcgctccggccttgcctcacacctgggttcttcgaaatgtccgtttctcatcccttatgctgattgccttccctgagagagggtctctttcccccactctctggggccttctcccctgcctgtctcccttccatcactgcagaactgtcagtcagcctccagcttcttttttgggacccctgcccccct

SEQ ID NO: 17121 - DNA, 201 bp, Bos taurus
gaacccaaggcccccagaagtgaaagcatagagtcctaacccctggactgccagggaattcctgaactccaaccgttatataatgcttgtttcagggagaaggtggtggtatatgagatgtgggcctactaggggcagaatgacatgttttggtcatttattgggaccctctggcctacagtagattaaatacggatgcaa

SEQ ID NO: 17122 - DNA, 201 bp, Bos taurus
ggagccaggactctgagtgggtgtctcacccaagagcctgcctcctggcctccaccctctcctgcctctctgagcttcaggctccctcccactcacctgcatttccacagcaaatttattggccttttgcccacagacccctctgctcaagactgagccatttcatctcagtcctgccctgggagtcaaacttcctggtca

SEQ ID NO: 17123 - DNA, 201 bp, Bos taurus
ctgtcttcaggattgaggacgagcagctgaaggtgaggtggaggagaaggcagggacctttcctaacagatccaatgtctgaggctgttgtctcccctcaaaggtgtgggatgtgattggccgaagcctggtcatcgatgagggagaagatgacctgggccggggcgggcatcccttgtccaggatcacaggaaactcagg

SEQ ID NO: 17124 - DNA, 201 bp, Bos taurus
gggggatggaatcatgagagatagaccatttgcatcacatagtattacattctggtgcaaattcctaacggttacttaatactagaattctccgtgtggtcttgtgctaggagttcccagcactgcttttctacttgggtttggagaacggtactctaggttgaaacaggagaaggttgagttctagaatggaatgactca

SEQ ID NO: 17125 - DNA, 201 bp, Bos taurus
agctgatcatctgggctttgaaccaataagtttactttggccatacgtgcccagatcacacagctgttttcattcccaagtcttctgttatataaagactacttcccttgcggtggacaccagctggcaggacaaaggcagccctgcctagagagaaagtaaaaagccagttatgagaggagaactactttgtgacataga

SEQ ID NO: 17126 - DNA, 201 bp, Bos taurus
atccagtaaagtctgagacataaagttaagtgttcctcagtgccctcggaaactctgaaggaagtagcaagaagtggagcttctgaatgtctggggaaatgttcacaagcctccctttcagggctcctgacttgtttctgtgttatccttcttttgtgggccagtgttttttcttaagactttactctctaggcattccag

SEQ ID NO: 17127 - DNA, 201 bp, Bos taurus
catgtgtgtttcaacatacccagaaccccttctgccaggaattagggcgtgtacctaattcttgtgtacctcgggcgtgtacacagtgccgggtttggccagcaggttctcagacaccttttgaaagaatatgccctcctgcagcaaggcacaggggttagggagcaagtgcggaacagaatggcctgcactgaacagttt

SEQ ID NO: 17128 - DNA, 201 bp, Bos taurus
ttcagttctggtagagaggaagaggcagtgatgtcatgtttcattcactgcctccagtagagtttgtctttgtagcctctcagggagtccactgttgagatctctgggtgtcctggattgtgcccaggctgtgggtggagcttcagctgttggtgcagacaggctctgcctttcactctctgctgtttgcatttgttgcag

SEQ ID NO: 17129 - DNA, 201 bp, Bos taurus
ctgagaggaggagggggcagatggcgggaagacgaaagagcccaggactgaggcttggcttggccctgagcacggggctcctgagcaggcgggccatgccctggtctgctccttttcatccgctcagagcagcagaggagacacagggaggacaggtgagcaggagcacaaccttgggacaaggctatctggtgggctcca

SEQ ID NO: 17130 - DNA, 201 bp, Bos taurus
ctgtgagccttgggggtgtcccgtgtccccaggtgcccagacttcctttcccagccctacccttgcagcagaagggccagcctggctttttagaaagagccttttatttggaatgagaatatagagcccagtcctcctgcttcctcagaggagggagcaggagggctggcggggggtgggagaggtggcccctcacaatat

SEQ ID NO: 17131 - DNA, 201 bp, Bos taurus
gcaggatcctggttccctgaccagggatcgaacctgagccccagcagtgaaactgtcagctcctaaccactgaacggccagggagttccttcagtgactccggctccctgaactcgctgtgccttaccctgctgcattttgatgtctgatccatagcacttcgctccacctcacagagcgtgttttgtgtgaggcccgtct

SEQ ID NO: 17132 - DNA, 201 bp, Bos taurus
catttgggatccagttccctgaccagggatcaaaccgtggccccttgcattgggagtgtggagtgtcagccaccgcaccaccagggaagtctgattttctgtattctgatgctctgacttctagggcctgactgaccctgcagggttaactaattctcactggaaaagaccctgatgctgggaaagactgaaggcaaaaga

SEQ ID NO: 17133 - DNA, 201 bp, Bos taurus
gtcttgatcactctagctttataattaatcttactctctggcagatctcccctcaattcttttgttcatcttcaagatgaggctggccatcctaggccctttgttcttctatatccattttatttattaaaaaaaaattttatttatttggctgcgctggatctttagttacagcctgcaaacccgggccccctgcattgg

SEQ ID NO: 17134 - DNA, 201 bp, Bos taurus
acagaagggtgcagctgtggctgcccaaggcccaggtgatcagcttctgttcgaagtcagaatagggtgggtagcggatgttgttcagcatctccaggcccgggtgggagagcaggcaggcacggtggtgggagaaggtgtcgaaggagaacttgccgtggtatcttcccatcccactttggcctgcacgggcacggaagt

SEQ ID NO: 17135 - DNA, 201 bp, Bos taurus
tccgaccctcagcgaccccatggaccgcagcccaccaggctcctccgtccatgggattctccagacaagagtactggagtgggtgccataagggctaggcgcagtgagacaactgagtgttgatgtacagggagatggcagtccggctacagatgcacaataggctgatggaaagctgaagacaatgctgtcctagggcag

SEQ ID NO: 17136 - DNA, 201 bp, Bos taurus
tttttaatttataaaaagataaattgtatccccccacactcccaacccctcctttcctgccatcctttcaagtcaagggcctgggagctgggagagaaactgctggggctgtgccacggctccatgcctctgctctcacgacacaagagacctctggctgcccagaaaggagagaaagccgagctctggggaatcagcatg

SEQ ID NO: 17137 - DNA, 201 bp, Bos taurus
cacccagaagctgttctcaacccctgttggctccagctatccgtgtcagtcttccctcctgcacaaacaccctgctttcctttcccggacgccagtccctacacctggccactacggtgtgactgtcctctgaccctcctggggctctgaccgtccacaccaggtgcctcctgtgtgaacaggctcctcactcaggctctg

SEQ ID NO: 17138 - DNA, 201 bp, Bos taurus
ggcttggccatttggacataacttcctggaggcatctagtttcctttcctgaaaatcaagggcaggggaacttctcgagcaggggttgaaaactgtggactggaggccagactgcctgatgtgtgccactatcaaatgcttgggggtttctacacttacctttttgctgacctgcgtggctcatgggatcttagttcctca

SEQ ID NO: 17139 - DNA, 201 bp, Bos taurus
gctggcctttacccagctcttcagaggaatgccctctctgtgtgctacatcaccccgactccagaagggggcgctgtccccaccctgtttcgcaatgaggaggccggaggaccgagtggtaactacctgccctcccctcctcccccgggggccattctgcccaaactgaccactccctgcccggtctctcctgcaccctga

SEQ ID NO: 17140 - DNA, 201 bp, Bos taurus
tctagactttggtcacatgtgattaaaatgatggcatgctggtgccctcagtgaatcaggacagtgtctccgagatacagagcaagcagcatatgtagtcataagttttctaatggcctcatgaaacggcaacaggtaaagttaattttaatgtattttaacccagtaatacaaaataatatcatttcagcatgtcataca

SEQ ID NO: 17141 - DNA, 201 bp, Bos taurus
ggcagttgcagagatggcagaaaggaacgtgagacgggccacttcactttgctgtgaactgccagatagtaagtgctcaggcccccgtggtctctgtcacatagtctcttcattagcagccctgttgtctttaacaaccctttaaaggtgtcagagcccttcttagcttgcagcctgtgggccgggtttggtctgtgagcc

SEQ ID NO: 17142 - DNA, 201 bp, Bos taurus
gtgtgggcctccatgacaagacggtgggtcagttctcatccacatagggagcatctgggttcctgtttgacccctggagtcacgggccacagtgtccatcgggtgattaacagttaaacaccaccgcatccaactgctcaccctgatgtaagactaaatcctttatccttatcttatccagagtactgaaaaaatacgcct

SEQ ID NO: 17143 - DNA, 201 bp, Bos taurus
taaatcttttgtcttctcacctgtgaggccatgagcagagttcaggagactcagcagagaggctggctcacctgcccacagctcttggttccagaacgtgaacagagaggccagatatccttccatccccgtctgcacacacccagacctggatgaccggcaggcatgcattgcgagtccccggcatgggcagacccagct

SEQ ID NO: 17144 - DNA, 201 bp, Bos taurus
tcactgagggcatcttccccacagacttggggtgaagcctgaggatttcttgcaagtgctccagaaagtccagctggacagtgaccacaaacaggccatcacagaggtactggtcccccctcccccctcccccgcctgtgcctctgggctccctaggtcacgcgggtgtcatttcagatcggcgcggctggcctggtcctg

SEQ ID NO: 17145 - DNA, 201 bp, Bos taurus
cgcttcgattgtggggttgggcaggcagacagacggcccgagcacagccaatggcaggttctgtatgacgtgcgtgggagcctgactgtcttcacccacaatgctgggcccccaaggtatctggtgagcactcaccacggcgtgtgcgcagctgtctgactgtggtctcacccaccccaagcacgtgcctgtgggccctct

SEQ ID NO: 17146 - DNA, 201 bp, Bos taurus
ctggtgttttgtccactgctctgtccccttcacctacagccaggcttggcacattcgagatgctccataaggagtctctgaaccaatgtgggaaggcccctgcggggcaggtcacgctgttgcctgcacttagtgcgtggagatgctgcctgtcttggaaacggacggcctgccggccacgttcctgttcttgtgtgaatc

SEQ ID NO: 17147 - DNA, 201 bp, Bos taurus
gagctatcagagaagactgatagcccagcaggtaagtcaggacatttagaccacgggcagggtccacacccagtcgggaccccagccctggccaggagcctgagagtacttgacagcagcctgtgtctgaaccagccacttcttcagcacccagcacctcccctagaagctctaggggccagagaggcccacctgggggac

SEQ ID NO: 17148 - DNA, 201 bp, Bos taurus
ggaggtaccagaatagaacccaggtctgcccgcgcccaagtctatagccccttggcccctcaaagatcctgccctgaccacggctgcccagggccccaggagttggggcatctgacgtctgatcacacccttactccataacccccgactggactggggcgacctcagagcccttgtgagatccataagtgcttgggtaat

SEQ ID NO: 17149 - DNA, 201 bp, Bos taurus
agctccggccctcttctgccaagcaaaccccacaagcctggagccagcctgcagccagagcccacttgcctcctgagcaggggcgatggttttcagcaacattcttccagcagggccaccctcctgcagctgtggggttgagcgccacaggagtttttgggttccaagctgcatcggaacccagaccacactccccacact

SEQ ID NO: 17150 - DNA, 201 bp, Bos taurus
gaggtagaaatcagaggaaggtatctacaagccaaggattgttggcaacactggaggccagagaaacaaggaaggaccctctcctggggcctcagagtgggacgagaccctgtgacaccttgagctcaacctctgttcttcaaaactgtgagagaatccacttctgaccgttgaagccacctggttaggggccagaggact

SEQ ID NO: 17151 - DNA, 201 bp, Bos taurus
cgggacagagcgtgcggaggaggggtggccgtgcccttgagccaggagaccgctgcacgctccggggacctgggcacctctccagctccgacggcgcggctgctggcggccggagaccttatatagcgcgtctgcccgcgatgcgaagcccttatcgggattgcatcagccctccgcccctcgcacacacccactcacacc

SEQ ID NO: 17152 - DNA, 201 bp, Bos taurus
ctgaggtcactcaggcccgtggctcacttaggccagatctgatgaccacagcgcctcacacagacctctgggttccaaaaggaatcaggcagcagagcacaagaaggtgggcaggggggcctccattaaccagacatcctgggagcggccaggatccgttggacgatggtgtagggcacggcaggcaggcatccgggcgct

SEQ ID NO: 17153 - DNA, 201 bp, Bos taurus
tctgtgactgattgaaatcagacatattggaccctgaggccactgacacccgtctgcaggagacataccaccaggagacccctgacagctgattggcacatgtcatgggcactaaggaagcctggccattgtaccataagcatcccaggcttcagagtgactcactggcccaggggtacgattctcactttgggtgtgaga

SEQ ID NO: 17154 - DNA, 201 bp, Bos taurus
ttccggatgacaaaagtcccctcgttaattgccacatcaaatgatcgagaacccccccccagtggaagccctcaaattaccatgaacacacactgcagcctgaaggccgcagtggcgccccccaccctggccgcggccccgcgccccaccagattaggtttcgtgcgcgggcggaggtacaggaaggtccctgaggatttg

SEQ ID NO: 17155 - DNA, 201 bp, Bos taurus
gggagacatcccgcggtggagaggctccggccacgccccatgattggggcgggggaggggagacatcaggaactgtcgagaattatcagcactagttctgtaggagcaaaactgcgtcttcacagaatcctgtgttctccagcattgcattatgcgaaaccctggtttcaatgcggaaaaaggaggtgcatggctggagaa

SEQ ID NO: 17156 - DNA, 201 bp, Bos taurus
actgaagccacttagcacgcacaggtcaaactctcagctcccagcagcctcgtctgtgaatcgggcatgtcccaccacagaggcctgcttgaaggacaggacatcaatggcagcgttttccctggtgatgctcattgtctgatgctggacccaggaagaaccacactgtctgctgcctctatttcgtctctggagtgaggc

SEQ ID NO: 17157 - DNA, 201 bp, Bos taurus
gtgaaaccacaactcgataccatcctacgcccaccagaggggctaaaatgcaaaacgcagacgatgccaagctcaggccagagcacggggccacggcgctctcacaggctgcccacgggggtgggagctgatgccagaaacttgagagctgcgagtcactgaaccaggcagacttgctgctctacccttgagacgcccggc

SEQ ID NO: 17158 - DNA, 201 bp, Bos taurus
aaggcttgatgattccaagaagccaagggtggccctcacaggcgaggtcatagtcaatactccaggagggtttgctggtctgtttatcagcgggcgctttgcaccaggcgtggccttgacctcttcctttacacacatgtcagccctggcacaaggacatcccctgtgggaattagtatttatgtttcagagaagtcaaac

SEQ ID NO: 17159 - DNA, 201 bp, Bos taurus
tggaagagggtgaatatggggtcatagtggtggttgtgaaccagggctgtaactgcatgtggaagggaagaggtgattacaggagaagcagcaaggtcagaatgaggccaccgatgagattcagaaagtgcgggggagggagccagctcactgggtgactcattcattcactcgtcagtcggttgctgagcacctggtgtc

SEQ ID NO: 17160 - DNA, 201 bp, Bos taurus
gcactgctgctgctcctcgggggccgccagggccctgaggccacttggtgttcctgccacctcacttcttacactgggagttgcagagtgatttctcggcgctcagtgctccgtctagtcactggcccgcctcttagggagcgccctcgtttagtcgctctctcgcctcttagggagcgcccgcgctgccccttctctctc

SEQ ID NO: 17161 - DNA, 201 bp, Bos taurus
agctcccacattcagtgggcagctagtgtaggccacacattgctggaactaggaccccagcagggacttaaaatccgtgtgcgttcttcatccactgctatgtgacgaatcactgcagagcttagtgactccacagggagcagctcacagtccccagtgcctgtgcattgtcgcaggcgggcctgactcagggcctcctga

SEQ ID NO: 17162 - DNA, 201 bp, Bos taurus
ccgccccttcacagatgctctgagatgattggctgtttgagaggcgagagagttttcccctggttgctgtagaaacctccatgttggtgcctgctcatcgcgtggccctgagatggccttcgatgtgtcccaggggacagtggggactccctgtccctgcctgtgtcacagtgacagagggcccccctcacacccacttcc

SEQ ID NO: 17163 - DNA, 201 bp, Bos taurus
agcactctgaggaccagccgtgtgacctgctggacccacgtcgaaagagagctgcaaagtcacggctctggggaccccagcctcctgcaggattgctgatagatggacctgggtgttcgagtcaaacgccttgcccagcaggcgtgtgaagagtgaccttgtcagttgcaacagtgaaacgcgggagtaaagaccagccgg

SEQ ID NO: 17164 - DNA, 201 bp, Bos taurus
gctgctgcttgccgagactcacgtggtcggggggagggaccacttccattggactccatggttcgtcctgaaccagccccaaacagagcagacgggctaatgccaaaggcggcggcctggcccgaggccagggcagcacccagcccaggtcagcagctcagggcgggctgggaggaggccgtttctccctgtttccccact

SEQ ID NO: 17165 - DNA, 201 bp, Bos taurus
cagatggccggcgggggacaggggcctaccgcagggcgctgtctggccagtgcccacccatcctacttcttggcagctgtgagcaggcccctgtgctgtcgtagagggtctggaggaggaggggctgtccagggagacaccgggcagctcctggaacacctgcctcgctttctccacttatcagagcaggaaaacgctcct

SEQ ID NO: 17166 - DNA, 201 bp, Bos taurus
agcagccacgggctctttgtgaaaatacaaatcgggtgactccttcgccaaagcccctctggggtttctcgtcaggtttagaacaaaacccagagcagcgcttctggaccaggaggccctgaggacccagctcctgtgtgccacccccccccaagactgtggacccccgcccctctcagacacacatgcctggctcccgag

SEQ ID NO: 17167 - DNA, 201 bp, Bos taurus
gaaatttcactggctcaccttctacaagaaaaaacccaagaaatatgttcactaaaactgctgtcatgggtcacacgggggaaaggctctgagctctgaactgaagcgctcccgtcgaagcctgaagagcttcggtggaacctgccctgtgtcttcagctccccagcggctgtggtctcatcacacaccttcaaaggcaag

SEQ ID NO: 17168 - DNA, 201 bp, Bos taurus
ggcctgtcagcttttcctccgcgggaaacctcctccctggcccagggcacactggggatcgcagaacctcagctttgacgtccccatcaggcctgggaacatgcaagttggctgcagcctcggtccatggcgtctctgacttcagagtaaccccctatgggggcccagatgccacccacgatgccactcccgggctctcac

SEQ ID NO: 17169 - DNA, 201 bp, Bos taurus
ccatggactgcagcccaccaggctcttctgtccatgggattttccaggtgtgcggtgccattggcttcaatcagagacttaagagagcccccgcaaaaaacaatacaaaatagcagcaagcaactgagggagtagacacaaacttcctgaggagctaggacggaggattcaaagtgttcacaatcccccaccttccgcact

SEQ ID NO: 17170 - DNA, 201 bp, Bos taurus
gcagggggcccaggttcaacccccggtcagggaactagatcccacctgccgcaactagcactgggcacaggcaaattaaatactatgttttaaagccacataccaaaatcctcaacactgtgggccttccacgtgggggccccagccccttttcctgatttttctagtagacatgtacttgtattataaaataatttaaca

SEQ ID NO: 17171 - DNA, 201 bp, Bos taurus
cccccacaatttggagaacaccctcacggagcactaaattgcattttctctcgagtcccctgtaagcctcacttaggccaggcttgaccttgaaaagccacgtcttgcacaccgtgttgtatacaccttatacacctacacggagacggctggatggcatcgccaggccaatggacatgagttcgagcagactccaggaga

SEQ ID NO: 17172 - DNA, 201 bp, Bos taurus
tgccgccccctccagggcccagagcagaggggatttcagcacgaggcccagtctccggggcccctccgtggggaggggcgctgggccaggtgggccccgaggctccctggttcttgcagtgtttctgatcctcaggacaagtcctgtgcgtcttcggagtgagagcagggtgcctgccgcgtccgacgagtggcgtggcct

SEQ ID NO: 17173 - DNA, 201 bp, Bos taurus
tatccatccactcaactgaacgagtgcaggatggaggtggtttcagagacgacggatcacggtgctgagaaaacgaagcctcgcaccttggaagggaggagcagaggccagtctggagacaggagtgggtggagggtggacttgagaggtgagcacagtgctggctctgaggcttttgccaagggcccagtgggtcccttg

SEQ ID NO: 17174 - DNA, 201 bp, Bos taurus
catcgcaggcagattcttcaccagctgagccgccagggtggctgagcccctaagacgtgaggtaggaatccacatgtacactgggcgcctggcctccatgtggacacagccagagcacgcgtgcacaccaagtccttagtgtacattagggcatacccattgtgttgtacattctacaggtttagacaaatgcttaggcca

SEQ ID NO: 17175 - DNA, 201 bp, Bos taurus
ggccgctgacacactgcctcccaggttcctcctgctgtggccgcgtttgcagcctggacgtgagagtctgtgtcactcctgtcctggagttttccaccagggacctggaagaccctctcgggcctgagtgcctcagccagcacagccccgatacccaggggcacgctctacgtgcaggctgggctcagggcgggtgttatg

SEQ ID NO: 17176 - DNA, 201 bp, Bos taurus
ctctgcttcctaaacatccgcctccctgaaatccgggacactgccaggctgtccacacccacgatgggctgggggactttgggcctcagtcccctccctgtagctcagaatggagattgatgcgtctgtggttggaattcctggggggcggcggtctagctcccctggacagcttctcgggcctgcggggcgtctcaggga

SEQ ID NO: 17177 - DNA, 201 bp, Bos taurus
ggcgggagtgttttggtgtgtcttccgtgagggggtattttacgtgcgtacacgcccacccaggctgggctcacgccgtgcccggcccagccccaagtccttgtgtactctggacgttttccggggtcactgcgagctgcctactgtccctaacgctcatggccaggagcaagcatcctgcgaacgccctctatgccgtct

SEQ ID NO: 17178 - DNA, 201 bp, Bos taurus
gcctgctttcctgtgggccaaagggctttatgaggctcggggccaccctcgacctgccagtgcggtcaggggcaggctcagaagaggcaaggcggggttcggaggtcaaagttgggcaggcctggcccagaatggcgtgagtgcttgtcctggcctcccgtacaccctgggaggtcacggaccactgtgggcccctgagtg

SEQ ID NO: 17179 - DNA, 201 bp, Bos taurus
gggcctcaccttgagagagatgcacacgattagagcgacctggagaccccgagtccggagaaccagaacacacttcactgactccaaggagagaaggaaagaaggccagcaagtgactcttggaaggacggtgagcaccgtgcggacatcctgacacagacggacgtctccaggagaatcctcagtggggcagcagccggg

SEQ ID NO: 17180 - DNA, 201 bp, Bos taurus
gctcgtggtgggtgtttataacctcgtggtcccttgggatcagggggcgggtgctgggtctctagcgggggctcccgccttgctccagatcccgggggcccgtgcggtgtctcccctatggctcttgccaggggctctgcatgttgggtgtctttctcctctgcagatagcctgggtaccagggaatttgccgagtgttat

SEQ ID NO: 17181 - DNA, 201 bp, Bos taurus
ccagcgaggggctggcgtggctggagggtggcagcgggcggggcagaggcgaggctgggcgggcaaggggaggaccccggggcgctccctggagaggccccctttgacccacacacaagggctccggtgagttcatgtctggtcccactggggtttcccaggcacacgcctcctcttctccttggaaacagctctgcaagg

SEQ ID NO: 17182 - DNA, 201 bp, Bos taurus
aggcaggaacctgcctgtggcggcccgtctcctctctcatagccattaaactgagtccggagtcacacacggcagatttggattgttccgaaagagacacggaaggtgaacctgtggcctccggctggggcccagagaaggtgggtggggggtggggcagcccaggtgacaccaagccctattctccaggagccccgtcac

SEQ ID NO: 17183 - DNA, 201 bp, Bos taurus
accttttgagtgacccctggggaggtgggcaactggggcaggagcctccccctcttcccagcgacctcgtacttcttaggccagagcccaggagaggcaggaggtgcagcaaggtggtgctttctgagccttttgcggtaagtggagctcaggcgaacgcgtttacagtgggcggcctccttctggggtccagagcccccg

SEQ ID NO: 17184 - DNA, 201 bp, Bos taurus
tctggctgcagctcttaacacaaactgctgctgtttccccccaaaggggctttcttccagatggttcctggtccatgaggagccaccagccgggaggtcctgggccccagagggtgcagtgggagccagagtggctggtccctgcagaggcggaactggggggctgcggagggctgtcagccagcccacagcggcacagtt

SEQ ID NO: 17185 - DNA, 201 bp, Bos taurus
gaagcggtgcgatgcagtgacttccccggcggcccactagctaagacaacacttccaacggaggggacggggctctgccaaaagctgaaagcagatgagggtaagcgctctgtgtttaggggcccgtgggaaacaacagcccagtatatccccctttcctctgtcctaaaggcccacggctgactttggaaccatggacag

SEQ ID NO: 17186 - DNA, 201 bp, Bos taurus
gacccttggggcccaggaagcctgcagccccgcttccagggggtgaggctgagtgtggtcagggaacgtggggcagggctggggatgccggcagtgccccgggggagggccacacagtgtgccctgcacaacggtcggggtcaaggccgtcctcagagggccagctcgggccagacgcaggtcccaccccgaccctgctca

SEQ ID NO: 17187 - DNA, 201 bp, Bos taurus
tgcctggctgcaggctttcccggaaagggccctgagggagagaagtcattgggccaacccccatgcccagggaccgcagcccctggggccatctgtatgcagcagggtgggagtctggctgaaccgtttttctttctgcaaattctccactgagttccccagggcctgcccacccagcgccctgctggctaaggacttgca

SEQ ID NO: 17188 - DNA, 201 bp, Bos taurus
cggaggcggagagggggaggggaagcgcggcggcagagctgaggaaggaactaggcccatccctggtggacaagcaggcctacagtagctagacggtaggggatgcccaaacaggacagaaggctgagcatcttaagtcggttctagaagagagagcctgggattacctcggaaagggcgaagttcctcgccgggaaggga

SEQ ID NO: 17189 - DNA, 201 bp, Bos taurus
tctatttctgggtggtcacagggttcctgtaaattggggccctttctcttccatcttgtttttcttgctctcttcaccacaggcagtaggatagtaactttctgctcaagaaaccagaaatgagaggaatgctgtgaatctctctggcataggtacagtgtaatggtcacaaaatgggttttggaatcagatgtgagcttc

SEQ ID NO: 17190 - DNA, 201 bp, Bos taurus
tattgtgtttctatgtgattttacctcacaatttattttaatatctttccagcactctgatctacaaatttggaagaactgaagagctgtggacctgagatcacttctcaaatcacgttttccttttgttatattctatctgtagataattttttatttcagtatagtttacacattgccaaatggaatagattgtacatt

SEQ ID NO: 17191 - DNA, 201 bp, Bos taurus
ggcttccatttgctcctctgcctctcgggctctggaagaagccggctgccatgttgcaaggacgctcaagagacccaagttgagagaaccaaggccacccatgaacaatcagcaccaacctgtgcatcacataagggagcctccttggatgctcagccctcagatgaccgcaccccaagccgatagcctggctgcaactcc

SEQ ID NO: 17192 - DNA, 201 bp, Bos taurus
tttgcactttgaggagagaggggagcctccttcccgatacatcagttctgacactctacaagctcagcagtaaaacttgctctagactcagtctaattccctcttcggaaacctaggcctaagtccagcaatggaatattattcattccttggactgcaaggagatcaaaccagtcaatcctaaaggaaagcatccctgaa

SEQ ID NO: 17193 - DNA, 201 bp, Bos taurus
agtacatgatgtccggctggcctacattcagttcgccctttcctttctgattgccggtgatgacagcacgatcacgcaagtgctggagttgaaaggtaggggggcctcgttgtcttggggcccagcctccctgtgattgttctgagcgtttaatgggttaacaaaggtcagccgcctctgtggctgctttgcacacaggaa

SEQ ID NO: 17194 - DNA, 201 bp, Bos taurus
gcctagaggctgagtggccctgggccacactaaccaccaagccaccctcctgtctatgtgaaaaagggtaatagccggcctcacaggtggtcctgaggatcaaaggaaacagcggactcagagcctcagcaacggaggctgacccccactaacatctcaccccctggctgaatgagctgagctgcacttccaaggagagcc

SEQ ID NO: 17195 - DNA, 201 bp, Bos taurus
cattccttcattctcagcaacccactttgaggcttcctcttggtggacaattagttttacataggatggttccagattactttttaagccctgttttatacaatctaggtccagaactaatctcctcaactccatgggatttacatcctagctttctgatgatgtgaatttcttctaaatccttagaagtggtaggccttt

SEQ ID NO: 17196 - DNA, 201 bp, Bos taurus
attcttagccaagcctctttctagttttggcctttagaaattgttttgaccctccaggagtgaggacatttcagtttccgtatgtgtccaaagaacacgcgtagagggactggcccaaagctagctgtcttcagtttttaaaaacggattgggtggatggctggatcatatctaccctcatagaatcactgagaagattaa

SEQ ID NO: 17197 - DNA, 201 bp, Bos taurus
atccccacagagatgctatgaaggtaaagcacacaatgagctctgtgacccccagactcaccggaaggattccctcctatggcctcgaggtctgagaagcgtcttggattgtctgagaagcgtcttcggattgtctgagaaggaagggcagtcatgggccctccctggaggacttcctcgccaggtggtctagtgagcagt

SEQ ID NO: 17198 - DNA, 201 bp, Bos taurus
caacaaggagcttagggctgaagttggaggtatcaacactgcctgggggctttcctggtggtccagtggttaaacatatgccggccagtgctggagctgcgggcttgatcgttggtctgggaagatcccacatgctgtacaggaactaagcccacgtaccttagagcatgtgcgccgcgacaaaggagctgccgcaatggg

SEQ ID NO: 17199 - DNA, 201 bp, Bos taurus
catggatactgtagtggacagtttttgtttgtctccccagtgttcatttcccatcttctgaccagcacccagcatatggtttgggggagccagccctgctcgtgggacactaactgtgtaatctggggagggaggggtgctactcccactgttggtattcttcgcggtgctgatccgattgggcctgaagctcacaccgaa

SEQ ID NO: 17200 - DNA, 201 bp, Bos taurus
aattttgatcctagaaaattcgatctgttttagaactgttttctttgggcgagtcattcagggtgtttccagagctggacacacgcctgtctgcagtgcctggagggagtctcacttggggtgtatataaataagactgaatccaaatgccttgtctatacactgacttgctcgcaaatgaactgttaacaactgtcccca

SEQ ID NO: 17201 - DNA, 201 bp, Bos taurus
acagcaaacttgtgacagcaagggaaaaagccaaagaacataaaaaacagataagcagactgacattttatgcaatggtcccaaggacaaaatggccttcatgaatcagtgggtcccggggcacttctgcatttcatcagagctcaggaaggaacagctgcgccaattactggccttggcacactgagataaagtcaactc

SEQ ID NO: 17202 - DNA, 201 bp, Bos taurus
gctgactgtgctgtttctgcatgtagccccttgctctgtctataaaagctcttgcccactgattctgggctttggaacaggtgtctgccctctgtctctcgccttgccattgttgccaccatccaaagtaaagcaaactttcctttccaccaaccttgcctctttattggctttttgagtgactatcagcagaccccattc

SEQ ID NO: 17203 - DNA, 201 bp, Bos taurus
tcttgtgttagttcttctggtaggttcgtgtggttgggacttttgctgtagcatattctgggaaccttctaaggaaagtcatgctgggaaaactgtgccacgtgacagagtattctcatagtctatctatcttcactgtcgcctgggtcctgggcaacgtgtacatttcacttactactgtgctcgtggtaagatgttggg

SEQ ID NO: 17204 - DNA, 201 bp, Bos taurus
cagtgaatgtaagaattccataaattcttaggagtctacctaagaaggggttgtggtttcattgcagcggtgaaggtcaaaaaggaggtttaaaaacttcagtatataaaaggaaagaatcgtgtctgttacttagaaggtatagtgaatgtaagttttatggaaaaaaccttagaaatgaattattttccttacccttct

SEQ ID NO: 17205 - DNA, 201 bp, Bos taurus
ataattcaaataaagtgccatgtttcagaagctttctttgattgttaacctatagctcaatcctcactcagcatctacaaaaataattttcaactctcatgatcaagtacatacccttctgtagctgaattgagactaccttgttaggactgaatcaattttctaccaaaagtttattttgaaatgtttcagtttatttca

SEQ ID NO: 17206 - DNA, 201 bp, Bos taurus
aatccctgagtgggaaagatcctctggagggcaaagcaacccactccagtattcttgcctggagaatttcatgaacagaggagcctggtgggccacagagagtcaggcactactgaagcaacttagtacgcacacacacactctttacagaaaagatttgcctggccttcagttttcattccaatcccaaagaaaggcaat

SEQ ID NO: 17207 - DNA, 201 bp, Bos taurus
ttacagttttccgtatcaggtaaacccaaaatgaacaaattaaaaagataataatcgcaaaaggaaatttggaattgcatgcaggagcattaaagaagactaaataagagtgaattatgtgtaaatacacattgtgcacaattctaacaaaattcttaatctataagtgggagtacacagtaataaatttaagaatgatca

SEQ ID NO: 17208 - DNA, 201 bp, Bos taurus
ttaataaaactacataaaatattaaatatttgtatatttccctgaaaatatgcatatttatttaatcatgttgacaagatttgactttgggatacatttaatcttgaactctgagaagtgatttaacttctaaaacttgtaaaacttgtaaaaattgaaaataaaaattgagtgataaaaatttatcctgagttttttgta

SEQ ID NO: 17209 - DNA, 201 bp, Bos taurus
aaattagaatttattttcaaaagatgtgccacttggagatttaccatgcaaacatgtttaacaaggatttcacatcaactactctgacaaaaaatagaaccctaataaaataattatatattaatttcctaagcttaaaatccaattcttatccagaccaataaaatgctgtgttgaaaagcaggcaattcttcaacactt

SEQ ID NO: 17210 - DNA, 201 bp, Bos taurus
gagcaagctacaagagttggtgatggacagggaagtctggagtgctgcagtccatggggtcccaaagagttggacacaactgaactgaactgaactgaaatatttgcaagaggaagaatgtagcattcaagcttcaggtctccctttgagatagcttcctctcttagccctttggatccatcaccttagcaggatatgatc

SEQ ID NO: 17211 - DNA, 201 bp, Bos taurus
gtcttaaccactgggccaccagggaaatcttagacctatgatttagatgtttatttctcttttacacaaaaagactgtaaagcaagacaattagagctgctgaagtttacagcgggccctgcccagtggctcagcaataaagaacccacctgcaatccaggagacgagggttctattcctgggtcaggaagcttcccttga

SEQ ID NO: 17212 - DNA, 201 bp, Bos taurus
tatacacaatgttgagagcagtggcacccaaagacaacttctccttttatgttagagcactaaggtcctaatcttctccatgtctcgtaaaaagtaggacgtgtgaaaaattactttctctccttgtaattattaattccattagttacctttggacaaatggaatagcccaaactttggtctacattgacagtttagcaa

SEQ ID NO: 17213 - DNA, 201 bp, Bos taurus
gcatgtacatggccaatgaccaagaaattccatctctgggtttatggatttaaaatattttcacacaggtccacagaatatataagaaaggagatgatggaacttcctggtggcccagtgattaagactccgtacttccaatgcaggagaattcgattcctggttggtgaactgattccacaggctgcacagcacagctaa

SEQ ID NO: 17214 - DNA, 201 bp, Bos taurus
tttctcattcattccctttgcccaggagaaaagtggctctttagtttggctcttttgtcagctgctgccctgttaagatgttcagtttttcaccaaactcctaatttatattaaggcccaaagatcttgctttcaactcagtaatcctttgtcattaatttaagccaccacttccctttatcaaactcaataactagaaga

SEQ ID NO: 17215 - DNA, 201 bp, Bos taurus
aagaaatcttatccaggaactaagagtggccctgacatcagatttctctagaaccctagagtagctacaggaccaggtggacgtccagccaaggaagcaacggaaagccatccatgtctgagatgcacaactaataatatcttagcgaaggtgtggatagatacggctcaccaggaagcctctggagatcacaggtgactg

SEQ ID NO: 17216 - DNA, 201 bp, Bos taurus
aagatgtaaatcttagcacttgtgactggagaacacataagctccaactaggctccatctactagtttgactttgacacctcggccaaaactttacaaaggatatccctttcagcaaaacttattttcagacattcatgctaaggatgagagtctattctgtgcatgggcctgagacatgtaaagaatctctggataaaag

SEQ ID NO: 17217 - DNA, 201 bp, Bos taurus
aattggatcttgctctggtgggcaggacagtaaaactttaatccaattgtctgctggtgggtggggctgtactccctccttgttagttgtttggcctcagatgacccaggctatatgggaaggttaatggcgacctctaagtggacttactcaaacatgcgcctccaaggactgctgctgccagtgcccctgctcctgagg

SEQ ID NO: 17218 - DNA, 201 bp, Bos taurus
gaacaccacgtggctccaggcggtattttagcatctttgatttcctgaattaaagaatgctcgttaaaagttaagttttgagtaggacacactgccctggctcctctggccggtctctttcatccagcacagttcctctttatcactcctagaatcacagatgaaggcacagaaccctgaaccacaaaaagttctcctgcc

SEQ ID NO: 17219 - DNA, 201 bp, Bos taurus
gcttagctaaatgaaaggtgagagggttttaaatggccatggcaggggcttagctatttaaatgacaagctaaacaggatacctttggggctatttcaagctctgatccccaaattagagcttttaggagtaggatccagagcccttacatggggaagaccaagttagctgggaatggcgaagccacagcaggggcgggtc

SEQ ID NO: 17220 - DNA, 201 bp, Bos taurus
ctagcataataccatcatgtctaagggctagttattctctggttgtgcaaaccctgttttagagagttgaaatgcaaaacaatttagaagatttgattttcagtcttttgtgttttaagttatataataatcatcttgttccttcaaaaatatatagtacatctatccttttgtgaataattgtgcttagcttttaggact

SEQ ID NO: 17221 - DNA, 201 bp, Bos taurus
atgtctgacttgatggaagacagctggattctcacgtctgcttctgctttcagttgcctgccatctgttgactgaagtatattttttaaaaactaggcccacacaggtatgtagaggttacattttctgtcaacaaaagaatatacattttgacatgtgttactagaaatgagttttcagttgtcacaagattacaattaa

SEQ ID NO: 17222 - DNA, 201 bp, Bos taurus
tggccactcctggatattttaaaagcatggtctaggactggacacggtgtgaataacctcttactgagtcccagatccctggcagacagagagtgggcacacctgggcctctctggaggggaagagggagagatacgtgacctggcagcttgagaaggttcaaatgtgctgtctcgatttcttcccttgtgttctatttca

SEQ ID NO: 17223 - DNA, 201 bp, Bos taurus
gcccagccagggcaatctcagacttgaaaagaggacagacacgtttgtgcttgcacaccttttccttaaatacatttaatgagaaacttctatgtctggctttgcttctccatccttttatggatgatatcttcttggcagacaaatttctctgaaatttgataagacttgaaacaggactaaagttcagtgtatgcaatt

SEQ ID NO: 17224 - DNA, 201 bp, Bos taurus
ataacaagagcttgacacttcagtttgtgtcttggcctaatactttcctatatattgtctgccaatgaaaagaatttgaaatgccatgtataatgtttacctttgaaataaagtcttctttggtgaaatttttattgttttgaagatggacaagtaacttctctatggttaatgagcctgaaacaggaagtggttttgact

SEQ ID NO: 17225 - DNA, 201 bp, Bos taurus
ctattcctaaccataatgaattagtcaacaagtccaccttgattgcttcacatctgtgatgcaatggaaagagtcaaccttttgttggcctttcttggtgggtttgtttggtttgttttgcacatgtaaatccagaaaagaattgcaagagaataacagggccacactatagccaggagcaaaactgataacaatgaagaa

SEQ ID NO: 17226 - DNA, 201 bp, Bos taurus
ataatagttaagattgtatcctttgaaagagatagaaaaatgtgaatatttactgaaaaattatctattttatgactcagagttgggcatgaagaaagtccggtctttaacatcagaacacaaaatgtcctgtgaaattgaacttcagataaacaatgggtcattttttagtataagtatatatataaatgcatatatggt

SEQ ID NO: 17227 - DNA, 201 bp, Bos taurus
attaagaaggcttcaaaagaaaataaaaatatgttataaatccctcactggtctacttttcattaagttactgcaaaatattttgccaaatatggagcactgatagcactcttcatgtcaagtttctgttaaaaatattctgaggagttaaaaatgtatataatttggattttttggatatgtagtaaggtatctaaaaat

SEQ ID NO: 17228 - DNA, 201 bp, Bos taurus
tggtactgagaagcccagttcattaatgctaaatattccctgctcatcttgtaatttgacagatactagatactaatagtctagaatggcctgacatccaatggaaatggcaaacagaaaaagagctttaactcagatggcagtggctatttggctaagagaatcaggaatacaataagagaaagtggtggcccatctcca

SEQ ID NO: 17229 - DNA, 201 bp, Bos taurus
tgagagatttttaaagttatgattctagatgtggaaaataagaaataaaaaattccataaggaaaatatattctgaattcctaatgaagaagcatcttacggctggcatgaattttcctttagatgatcataaaggcatcaatgtcagattctaagattttaatattttcttttcaatgttaataagtcattgatatagca

SEQ ID NO: 17230 - DNA, 201 bp, Bos taurus
tctcgccggaatagggcttcattaaatgtgtaagtgttcatgcatcctagtttaggttaagtttatgacctgtctaactcacccttaagacctgagtcatgaattttgggtgtctcaatttggtctttatcttcctaaaccaggaatctatgaccgggggtccagaggaagctagtgaacaatctgtaaggaatgccttta

SEQ ID NO: 17231 - DNA, 201 bp, Bos taurus
tggttctcttcctgtgtcagcttgactgcatcaggagtgcccagaaaactggctaagcattgtttctgggtatgtcttagagggtgtttccaggttactgcaacatttgaatcagtaaaataaattgtcctgctccttgtgggtgggcattttccaaaccattaggacctgagtagacaaaagatagtagaaaggagcttt

SEQ ID NO: 17232 - DNA, 201 bp, Bos taurus
aaatttttttttggccgcactgcacagcatgtagaatcttagttcccagaccagggattgaatccacatggaactccttacattggcaggtgtgttcttaattgctgaatggccaggggagtccccgcttgtctgtttaacccttccctcaactcatataagtttgtgtctcagctatccaaggttaacttctccacccag

SEQ ID NO: 17233 - DNA, 201 bp, Bos taurus
aaacctggcagcaattatttgaattaaaatgactatatgttttatggcaactctagttcttgaattctaccttacattaaaaaagttacaccagataaaggactatgaggacataatgctatttgcagcatgatttgtagtgtgaacaagccatgaactatctgaatgcccatgagtagggaattgaataaatcactgcac

SEQ ID NO: 17234 - DNA, 201 bp, Bos taurus
gaaagaaataaaggaaatgaagccattgcacacaggtgggtactggtgacttattgttggttgcatttgttaagactctggtctactgatgtaacatttacacctttctgagttctgctttttcacagcccagaagaagctcattctttctttcctttgatccagcaatcccactgctgggcatacacactgaggaaacca

SEQ ID NO: 17235 - DNA, 201 bp, Bos taurus
gagggactgaactgaactgaatcaagggctactagcatacacaagccagattagaaccatgacagattgttctggtaaagagaaatatgccatgtcacaaaagtggaaatcatagaaagcagagtatatatgaattaatgactcaagatacaggtgcagggaatccttagggcaaaaaccatggcagaacctaatatacag

SEQ ID NO: 17236 - DNA, 201 bp, Bos taurus
gaggtatttttatctatatctaacttgttgagagtacttaggttattgcttagtctctgtgtacttttttaatacagtgaatgtctttaaacctgtttctgccaagtcttctgttgattctcattttcttgtagcaaacttccacctgcaaaactttgattctcaacatcctgctcacatcctacagttgctgtaggttaa

SEQ ID NO: 17237 - DNA, 201 bp, Bos taurus
ctgtctcaaaacaactgactcatcccccttctccccagatttctagtgtaaagtgtgagggcaagttcagagtcagttattctttagtgagcaaaagcagcagtcctcaacatgattttttaatatataagagtttctagcttcaggatcattcccagtcaggattttgatactgtttttttcattttcttgtatctagtg

SEQ ID NO: 17238 - DNA, 201 bp, Bos taurus
tttcataagtggtgtcccagtgacccaaaagatttctcccaacttctaaaagtgctccttagtctccatggtacagtttacacagtggaaaaatatgatttattatctcacaaacatacattacaggcaaagaacttaataatttcaacattttttatgcttaaactgggtaacaataaaaggagtgtttctaaaaataaa

SEQ ID NO: 17239 - DNA, 201 bp, Bos taurus
atgggctttaacaacagacttaaaataacagcccaccatctgggtcaagattaaagaacttggctttttttatttttcaaacctgttttccagattctaattaggtcaagcttacaggaggtgctatcagactttctgcttaaaagataacctttattgtataaactggaagcataagtgacctcaaaggaacaaattaat

SEQ ID NO: 17240 - DNA, 201 bp, Bos taurus
gtagggccatgcatggagataggtagcttatgcccaaaaagctccaaatgccccaaagtattgagggaagcatatataaagatgaggggagggaagaggggagggtcatagggtctgtgatctgttgtgctcagttctctgattggttgatgttgaggtaaatgggtggtgtcacattattaatccttaagctccattagg

SEQ ID NO: 17241 - DNA, 201 bp, Bos taurus
agcaacaatatagaagacattgatggatcacattttgttactgactcgggtacttggccttccttaatagaaattgataagaggccagacaagaaattcaagcaaggttttatgggggccagcacaggggagcaaaagcaaataacaagagcctttgcttgctccccaaggtagaatgagctggttccttacatggagtga

SEQ ID NO: 17242 - DNA, 201 bp, Bos taurus
aataacagtttggcacaaaatcttaaagattccaactcatttctttagaaaatcagcacagactggaaaggtgactttaaaaactttaaaaaatcttttgtgttaaatttcattatgttaaatttttttagttcctactttacataatgattaacagaaatagtctcagcaaaattaatcagaagacttccttcctataaa

SEQ ID NO: 17243 - DNA, 201 bp, Bos taurus
cagttttgcttaggcaattgcaagtaatacagattcaaagaagcattggaataaaaactgtaaagtgtaatttggagtaatgtcaaaatatattttagctgttgagaaactagaagattatttaagcaaaaacaagcaaataaaccaaagaacccctttagatccatttcatcacaagtggtaggcaaagaagtttgttaa

SEQ ID NO: 17244 - DNA, 201 bp, Bos taurus
tacaaaaagaatctggacatacacacacacaatagtggaaggactatttacactggaacacagaattttgcggttgttgtttacaagcaaaatattgtacgggaatcctttaagctaggcttcaacaatatgtgaactgagaacttccagatatacaagctgaatttagaaaaagcaggggaattagagatcaaattgcca

SEQ ID NO: 17245 - DNA, 201 bp, Bos taurus
ctgtcttttattattaaagatgatgctataaatatgtcaccatatttcagtttttcatttcactgcaggttttataataaagtgcagatatttgaaaaactgctctctttcttaaatcagtaattgtggatttggcagtctcattttgtaaattctatttaaagagacaaaagaagttgaaaatcttaagttgttttctat

SEQ ID NO: 17246 - DNA, 201 bp, Bos taurus
atgtgaattgagattattttataaagcaataaatataggtgattataatatagaaaactttatgtatcaggatataagggatattcttaaaaataattatatgagagaaagacatgtatgaatatatgattgtattgtatgaatgtatggatttttactatatcaacaatataatacaaacatgccatgtatatatctatt

SEQ ID NO: 17247 - DNA, 201 bp, Bos taurus
aggacaaaatgctttaaactggagatatgtgatatttttaccttaggtttacagtaaaagtataatctttctcacaagtcaaaacttctgttcatgactagagggaaaaaaatgtacagtttgatatacagaattaattttgatcactgtttttaatatatgtagtacaactatttgaagaaatatgcattttctaaatca

SEQ ID NO: 17248 - DNA, 201 bp, Bos taurus
tattagacttaacatctaacatttatcaacactacatacatagaaacacacatacacattagcacacacaggatttcaaggcttgcagctcaaatcacttaagatatgaatttaaaccacttatattgcttagacatacaattattgtaaactcaaggcttctccagcatcgacttctggggtcatactacttgagaatat

SEQ ID NO: 17249 - DNA, 201 bp, Bos taurus
tgaatccactgctttgtaactattgttggcatatcttgttttgactgtgaaagaacaaaaccttctttatttttctttgtttctgtttccatgaataatgagggtgcttctgagcctctagcagaactttcatgggtgatggttaaatgaattccaaagggtaggggtagagaagacgaaagaaaagaagaattatgtaga

SEQ ID NO: 17250 - DNA, 201 bp, Bos taurus
ctgaaaatgtcaaatggcccattgattctcagaattgactaaacctgttcatcttcattttttttccctctttataattaaggaaagaacataaaaggtcgtgttggcaggcccataacaaaaagagatccatgtcagtcttcttgcaaattagataaaatttactgagaggctcaggtgaacatattttggggggggggg

SEQ ID NO: 17251 - DNA, 201 bp, Bos taurus
tctgtctttagtccatttctatacagtggcagagagttttatttaaattctggaaattgatttacttatttttcttcaagcaagttctgcttattgttcatgtttgttttattcattagttgaacaaaaaaactggatatttgttttcataatcctgtccaaattgtaggatcttctatgtaaataaacataatgttatac

SEQ ID NO: 17252 - DNA, 201 bp, Bos taurus
tatacaaaaaaggaaacacttgactatgtggatagagggagacctaactgctgaaagtttgatagatacaagagtatactgagtaacattctggcagtacgtacattatggaaaataaacaaataaactttctgaacaagtaaaagtattactcaagacatggaatgaagttaacttcagaagccatgcccacagagcaga

SEQ ID NO: 17253 - DNA, 201 bp, Bos taurus
ttacttgacacttttcactcatttggtccaattatactcagaggtccctgtcacatcagtaaaattttaacagtctgggccatgtctgaatatttcctttgaagtaaaggacaactattgtatttcacacattccagcaccaggaaggatacggtaggcagattattgggcctaccagagacttctgtatcttaatccttg

SEQ ID NO: 17254 - DNA, 201 bp, Bos taurus
tgaagctttagcttcagcatgagtccttccaatgaatattcagggttgattccctttaggattgactggtaattttaccttaactaccttttaagggctccatgtccaagggcaaacacatctgaagtactgggggattaggattttaacaaatgaattctgaggctgtagtactgaatctgtaatatgaagtacaatggc

SEQ ID NO: 17255 - DNA, 201 bp, Bos taurus
aatatttatatcccaggcctatatttaactgggtttcacctgacagatgtaataacttccagcgttttatatgaaaaggctggaatttatatatacacataataatcaaacccctgaggctcaggccagaggatgccaggagaatactgacatttaaggctgctgtggattttttttcccagcagaaggagcatttaagtg

SEQ ID NO: 17256 - DNA, 201 bp, Bos taurus
ccaattaatctcacctttataaatgcctgtgttttattgcaagtaatttgagttttctgaatcagaagtagaacacagtatgcactcatttctctcctccgccttcagttatctattttgaaaaaagtaaagggctttggaacacagtttcttagggagcttttcttgatcccttagtttcaaggcttaaaaacaacatca

SEQ ID NO: 17257 - DNA, 201 bp, Bos taurus
aatgtctattgcaacgctataattagcatcacaagaaacttcaataagtgtagctatgctcaattttcctgtaaggccccattcattcatcctaggctttcgagaatcttggcttttttttttttttttttcagaaaccttccccaaaagtaagggagagtgaatgtggtatgaattgctcaacaacaggacagtaaaagt

SEQ ID NO: 17258 - DNA, 201 bp, Bos taurus
atttcccaggtaagaatactggagtgggtggccattcccttctctgagggatcttcccgacccagggattgaacccagatagatacatagatagacaagatagatggcctggggaaggggttgaatgatttaaggaaactggcttacacaattgtaggggctacaggctggaaattcatgttgcagtcttgggcctgaaag

SEQ ID NO: 17259 - DNA, 201 bp, Bos taurus
aatgagaaagggggaaaaaaatctcaagttactgtgcactgtgccagctgaccaaatataaaacaaaacaaaacaagataatcttcccccctaccaccaccagttaaaaagaaagaggagggagacgtttctcttggtgcttggtctgtacttgttttggctttttttcagatactctcccaagtttaaatttgaaatttg

SEQ ID NO: 17260 - DNA, 201 bp, Bos taurus
ctttccccttcttcccatttgcttccaaaaatggatctgctattaaactcattttgtagatgctgtagatgttgacatgagcttctttcacatttttatggtgctgacaccagcaaaagttaagaggaagttgaaactgttggggttttatgtgactttggtgacctatatatttaaggctttcttttctgtctgtgaatt

SEQ ID NO: 17261 - DNA, 201 bp, Bos taurus
aaagtagatcattattggccaaaagcactccaattactttagaatttacagaggaaagaaaggaagaaaagtccaaattgttacttggaaaagatggtccacatatctccctaaaacttatatttttagaaagctttgtaataactattctagacataacaggcattattcaagattgatatatttcaggaggcaggttat

SEQ ID NO: 17262 - DNA, 201 bp, Bos taurus
atcatcaaaggctttgttgcaaagtgccaggatgctattgaataagttaacaatgaggcagggaggggacttttaatttgccccaaacttctcttacagcatcttggtaacaagctctgatgtattcttgtagggaaggggaagggaggagtggttggtgagggggagtaagtcattgatgtggtgcattttccaaatctc

SEQ ID NO: 17263 - DNA, 201 bp, Bos taurus
aattattagattttgatcatatttaatttcctcatttgaaaagtgagtaatttccaagttgatttctctaatgttctttataaatccaaatgagaattgaatatatttgggcatggtgctagtttgcattaaaatactactccgagtgtctaggattggtcctgctctagtttaatatttccatgatttgatggcttaaat

SEQ ID NO: 17264 - DNA, 201 bp, Bos taurus
ggactgtccccctgtcactgctaccctggacatggctttcttgggacatatgaagccataggtaaaagccaatggctcaagtacaatttggtcatgttttcaagactataaatctcatactggtcaaatatggtcaagccataactatcagaaacaagacagaaaacttggctatcaggcttccaggagaagagaggagag

SEQ ID NO: 17265 - DNA, 201 bp, Bos taurus
ttggccaacccgtggacacccctaccttcaccccatatgaggaacaagctcaggtcccctcagggaaggagctggcaagggaatctgttatttgttctcgctccccactgctgcagcagggccccagtaaattgcctaaatttcttgtctggactctgattaattcccattgattaaggaggccaagaaacttagtcagta

SEQ ID NO: 17266 - DNA, 201 bp, Bos taurus
aatgggcctgcagcttcttatagtgccaaaaagtaagtaccagaaataaaaataaaaaataaacaatggtgaagatacattaaagggatacaggagccaactgaaagaggtctcaagggccaaatttgaagcaatttaaacaacaaaatacataaagtagtattggactacaacccaaagtatcaatactaaataaatatc

SEQ ID NO: 17267 - DNA, 201 bp, Bos taurus
gagaatgataggtgcttttaattctcctgtaattcccacaatggccagttttataaagaggatatcaagactctgagtgctaattaacattgcctgaggggacacatagatgcttacttaccttactttcaacatttctttttgtgtgtgagtatattcactaaaattctttatcgtatcagattcagtaactcaccaaac

SEQ ID NO: 17268 - DNA, 201 bp, Bos taurus
tagaaaatagttgtaaaactaggtccatcatttcaggccaaatgggcagagatcaacagaaattaggtcactgggttaaaatataatattcaaaggataagaaatatctgtattacctcctctgctcttttgttataaagcttgctttgttattgttcagttgctcagtcatgcctgactctttgtgaccccttgtgaccc

SEQ ID NO: 17269 - DNA, 201 bp, Bos taurus
gcttgagcaattgggtgggtgagggtatttaacaagggtgggtgctgaaataaggctggaagtatttctactggagaaggttgattccaggccagaaagtcagcccctcataaaattctactagaggaatataaaagtcctcaccaaacataaatctcatttccttccccctgcaaattgctggccactcctcctaggctc

SEQ ID NO: 17270 - DNA, 201 bp, Bos taurus
gagatgagatggttggagagcataactgactcaatggatatgaatatgagcaaactccaggaaacagtgaagacaaagatgcttagcgtgcttaccgtccgtggggggcacaaagagtcacaaatgacttagtgacagagcaatattacagcaaaaaggatacaaatcaggaccttcacagagaagaaacacaagcagaag

SEQ ID NO: 17271 - DNA, 201 bp, Bos taurus
aaatatacagaatccaatctgatgaagcaaactggtggagggactacagaagcaaataacaattaaaatcaagtccatgtaacttgaatcttggagacaagggcagaattagcaaccaatctgcctgtatctctgacatgtattgtgtgtccattttttttgtggctatgttcccagattttctattttgccttataattc

SEQ ID NO: 17272 - DNA, 201 bp, Bos taurus
accctgtctatagtgcttcgtttcagcagccagaactaacataatgatgtcttcatagcaggagtaacacaaaaattgtgtttcaaaatggatatgagtgatccctagataaatgaacaacacagcacaagcaaaggcagaagcactgtgtgcctttggggaaccccaagagtgctgcctgacagcgctggggctgggcag

SEQ ID NO: 17273 - DNA, 201 bp, Bos taurus
catttccatttcttctcctctcaaaactcaacaacctaacatccaggagaaaaaaaaaaaacccaaatacatgaaaaccaacaaatttgaagagctatttgaaaaattagaataaatctgtaatcccaaggcacagtgttggaagactgcagtaaacagaaaaataactgagaacaatggaaatagtaaaatcttaaggat

SEQ ID NO: 17274 - DNA, 201 bp, Bos taurus
cagaaaaatgttaatggggtgatggtcaggggtagaaaggtagttggaaaatatattgttgggtgagttggggataggaactgaaacctgggaaagatttcattattctagtaacagaaacagggcatgagagagaaaaccaaaatcataatttattatgaattcagattctaatttgttccaatagctgtctccaaagcc

SEQ ID NO: 17275 - DNA, 201 bp, Bos taurus
tagatctcaaagccatatgatgacatcatgaaattttagaagatccagctggcttcccgtgatatttttgcagttgaaaaatatgtagcatctggtctttcgcttatcattctttgctgaagtagttgtcatcttaagtttctttttatcatgtagatgtgctaagtttaaaaataaagttggacaattttgatagagcat

SEQ ID NO: 17276 - DNA, 201 bp, Bos taurus
gtgtagctaaagtagaaccagggcacatacttctggaaggtggacataacatactgtgcttatttgaactgatacgttggactttggggcccacagataacgaagcttccggggatgccatgatgaatggtattagaagaacagtttagaactgtctagacttcttattctggaccattttgctcctgtcaagaagcagta

SEQ ID NO: 17277 - DNA, 201 bp, Bos taurus
agatttcatttagcatgtcatatgttttatactacaatgtattctgaaataaatcaccaatgtttttataaatataaagcataggaaaagttttctaggcgtgaagtaagtaaaaatggagctatggacactgtaagctgtagacaaagcagccatgatccctgaagtagagagagaaattctcatgaggggaaaagtgat

SEQ ID NO: 17278 - DNA, 201 bp, Bos taurus
ttcctgccaagttccctgatgactggactgacaggaaaggtgggcacccagcacttgacacttcatcgtaccctgctctcgagaggcttataattttgtgcaggggagcgatcatagttcacaaaggatcagagagcaaggatgtggtgcctgcactgctatttctgtttagtgcgtttttctctctctggagtttctcat

SEQ ID NO: 17279 - DNA, 201 bp, Bos taurus
ttatcggggccttgaagaaattttaaataataaacaattgcagttgctacagaattctcagcacattatcttttgaaaagttgtatcaagcctacatttttttctggcctaactttttctgaatcaccagtcacaagatctgaataaggctcatcttatattattgccatgttcagctttctagaaataaccattgtagca

SEQ ID NO: 17280 - DNA, 201 bp, Bos taurus
tctgatttttcaccttcaagcccatcctctaaagaactgatgcaaaactctatttaagatgtcaataacactaaataaggctgttcttcattatctacaggctaaatttcaaactcctttgataatacatacaagttattcatgatcttacctatccagcttcattgcttacaatcacttcctggaattctggttcagcaa

SEQ ID NO: 17281 - DNA, 201 bp, Bos taurus
atattcacttcttttcaggatgtctcaaactgaccccagacaacctttcttgtggatgcctgccctccaggactcgtattagtcatttaattgctcttctatcactcagtctctcagggtgtgagcctgactctgagatcattgtactaatttaaaatacttggaaactggcaaaaagacagagttgaggatatattgact

SEQ ID NO: 17282 - DNA, 201 bp, Bos taurus
ttagctgttcaaatgcctgcatttcctttccccatcttacccagtgcaatctttctttcctgtgaataaccataacattttatttgtatctttcatatgacatgccttttcctccagatgtgtttttgaccagctcttcagttcccatgtattgagcatgttaaagaccctggttgagatgtacaaaatagctctggaact

SEQ ID NO: 17283 - DNA, 201 bp, Bos taurus
gactcccatttttaacttttctaattatcaggttatttttcagtaccaccagcctattttgaaaatattataagcttgaaatgaaatgaagttcttaagatagaacatatataaagtctgtaatgtccgatatccaccatctcaaacaatatataaaattaaatagtgagaaaatatcaatttttgattccatgactaaag

SEQ ID NO: 17284 - DNA, 201 bp, Bos taurus
taatcacatttaagtatctctattttaaagaaaggaaaaataattttatcaattttctttatactgcattcttcccacaattaaggaaagaatatccttcgggcgcaaatgtagacagtctagatatggatattaaatttaattaaaattaaaaatttacttccttgctcttacttgccaagttttcagtttcaacagtca

SEQ ID NO: 17285 - DNA, 201 bp, Bos taurus
ccaaacctgcatctcctgtgtctcttgcactgacagacgaattctttaccactgagacacctgggaatcccacatacgtgaaaggctgactataaattacgtgcagattttttagtttgaggagatttggcacctttaacctctgttattcaagggtcaactatattttaacaaattgctatatatccttacactgttgtt

SEQ ID NO: 17286 - DNA, 201 bp, Bos taurus
cattcatttaaagggctgctatgtgctaatttttgttattaccttactatccaatgaggaaataaatagttaagcagcaggcatgaattacattcttttctcttcttggaatttgttcacaggaaaagaaagtgacccaatcaaacatacttgtaaacatgctactgatagatatcctagcaaactgattgcattctctag

SEQ ID NO: 17287 - DNA, 201 bp, Bos taurus
agtctatgctcatgggaagggcacagaactgcagaaacagggccacttgtatggagcaaggtggagaagaacagtgcaattgcaattttgttagatagttctacagagttgaatagaacataaagtagtacccagtccaactgttggattaaagagatgagcagactgaagctcggaaactataaacttgtgaacctgtct

SEQ ID NO: 17288 - DNA, 201 bp, Bos taurus
tgatgccagctgtggccgttttgaaactttgcaagagaaaaaaaatgcaagaccttcaagagtatataaaacctctccctattccctagaaagggaatcatagttcttgagaaactagcctgctgtgtttcctttttgcctggcaaaaataataaagctactctttttctatttcctccaaactctgtctccaatattttt

SEQ ID NO: 17289 - DNA, 201 bp, Bos taurus
tccatttctgattgtaaatggccagaaaagagaacatggtcctgtataaagtatgcttgatgtcaactggaataaaatctcaagtgctttgtggaaagttaacataaaaatcttaaaattcctcaagatggcactgtaaatttctcattacttaaattaaaaagtggagtttctattgagcattgttgttttttttttttt

SEQ ID NO: 17290 - DNA, 201 bp, Bos taurus
attcccacatgaactgactttcccctaggactaccttgaagccttcaacataattaatacttttggtagccacataatccatcttcaccctctcccaccccacaaatacaatggattcttgtttctctacactttccattcaagagctgacattattttgaaactgaattcttatatcctatatcccattaaccacatcca

SEQ ID NO: 17291 - DNA, 201 bp, Bos taurus
tgcaatgcaatgcatgagggatcaagtaattaaaatatagcttggatttctccagcattattctgcatgcaaacttccccttctcttgtctgcacacacacaaaaagtaagaaacacaattcaatagccaggagactaaaagaataacataaatctttattgcagcattccttaaaagaacaaataagtgggggttatata

SEQ ID NO: 17292 - DNA, 201 bp, Bos taurus
aatgttgccggttttatggaaggactgaatcgaatgcaccttctcacatgcactgcagaacgatttgccaagtatactgagggtgtaagtctgatagtacggaacatttttatttgtttaataaaatagtttttaaaggaacttaataaacatctatttattgaaacggtcccggcaagacttcaacttgtacgtatttca

SEQ ID NO: 17293 - DNA, 201 bp, Bos taurus
gatagaggaggtaattgatagcctgaaaagttccctagttttcctagtgttctccccaaatatatagttttttattaagtttttacatatctctaataacgttatgaaatgttgatatttctaaggaagatgggagaatgagagctaaatggctgtgtcaagggaacctatataacctaatttacatagcagctcaagcct

SEQ ID NO: 17294 - DNA, 201 bp, Bos taurus
ttcttgggtttattgaagaacagggcattttatgtgtgtagtgatgaattttgttctttttcttttttgcactaacatcatatacagactgcaaaactgactgagcatgaaattgtttttagaaattgtgagagctagtttagatggcaagaatcagatgaacagttgttagtaaaaatgtgtgtgtggaaaggatgatgg

SEQ ID NO: 17295 - DNA, 201 bp, Bos taurus
tgtgccaatataaggatgctctcattgtatacctcagtctcaattaaaatacctgcagtggtctattctgccaacccagggacatgaagatgtgaatagtttagaagctttaaaccatttattagatggtgcatttcaattagggaggagagaaaggtgttgattagcaaaatttaaaatatgtgcaatcccaggaagttg

SEQ ID NO: 17296 - DNA, 201 bp, Bos taurus
cccagtaattgcagccagctccgaccatctggagatgatgatgaggtcgtttttgaccttgcagccccagtaaagcccacagacaactatagatggctgaatggccccaaacaagatcacaagacccactcaacagagaccaaccttaattgctgacccacctaaaatgtgagcaaatggaataattgttgtaagccacta

SEQ ID NO: 17297 - DNA, 201 bp, Bos taurus
aggaagaattgaggataagccaactttacatttattacaatattttatatttaaaaatcttattaatcttcacaaaggtctaaggccttgtagaaacaaatgttacagcatcgtaaaactttcctagaacttttgtttttaccttttagaagttccaagaaatttttcaaagctaacttgaatatatgatatcctggcctg

SEQ ID NO: 17298 - DNA, 201 bp, Bos taurus
gaatactggagtgtgctgccatttcctcctccaggatatcttccccacccagggatcaaatccatgtctcttgtatctttgacactggaaggcaaattctctaccactgcaccacccaggaagccctttgagtaatacagaatttctaaactcttttccccaggacactccttgactacagtttctatactttgcctactc

SEQ ID NO: 17299 - DNA, 201 bp, Bos taurus
gtttgcttctgagactgtcctacccttccaggttggtagataatcccaaaacactgtatagtgttggtgccaaagaattagatgtttcctcaatgagaaaaaaaggaacaactagttaaagtataggcatgaaaagtggaaacttggcttttgatagtcccatttctcactgggatggaagctctccttttcagagtagaa

SEQ ID NO: 17300 - DNA, 201 bp, Bos taurus
acattaaaagataatgtaaaaatataagacaatgtatgctacatacttgctccaggtgatggtagagtgagagagccaggagaggaagacgttggggaagtttccataaaatcgagtgaccacatgccctgatttgaatggaagaattataatttatgcccatattcctggtgtaacaattaatatgattcacttttattc

SEQ ID NO: 17301 - DNA, 201 bp, Bos taurus
agactggaataaatggaaaaaagttggcattccaccttactggtcatcataaaaaatgagagaaaaagacatggctgttaacagaatgatttgatctgtcgtattgatgggcagagataaaagtgctgagaaccatacctcaagttggcacagctcactgaaagcaaatttgctgtgaatgatgataatttgtactgaaag

SEQ ID NO: 17302 - DNA, 201 bp, Bos taurus
ctgacccagggattgaactcgtatctcttatgtctcctgcattcaaaagccagttctttaccactagcgctacctgagaaacccaaaaaagacggtgtgtatgtgtgtgtgtgtgtgtgtgtatgtatgtatgtgtattttttttcagtcagttatgttcaactttttgcaaccctaaggactgtagtctgccaagctgtc

SEQ ID NO: 17303 - DNA, 201 bp, Bos taurus
atgagtctctacaaccttgaaaaagtaaatgaccttattgtaagctttgaccttgctcgtagcatcttttctgttgctttgttagctctgagtgtggtgtattgtttcagttgagcaaggtctttgaagctccactttttgccacccctccctccctaatgatttcaagctgttcaaagaaatgctttgaaacacaggcag

SEQ ID NO: 17304 - DNA, 201 bp, Bos taurus
gatatgggcttctggcatggaaccagggcctcaataactcttctgccaaggtctagaaatgcagcaactttatcaagacgttccagtttaaaaattagaaaataaggtcagaacagcagaggacctgaatggaagcccacctgctaataccagggactgccagccttggccactgctactggccctctgtagctaccctcc

SEQ ID NO: 17305 - DNA, 201 bp, Bos taurus
gaaagccacatattaaatttaccagttacctcaggtgttcatacgctttcaagctgtaccaatattagtataactgatgccatcttgggcccttatggtttcttctgtccttctgctgactctactcaggactgtactgtgcagtgagtcatttctctgttgtcaggacaatgtatgttaacacatttttgtatgtgtcag

SEQ ID NO: 17306 - DNA, 201 bp, Bos taurus
tactctcttcattgtccgcattttctaaccatagtcacggttttgtgctcttcattctaatggtgcttttgatgattggggtcattttaggccttcagctcccccaaaggccacggggattagctatgtccaattgaggaccagagagagccgtggcggctttctcccattcatccccttccattgatttccccgcaatgt

SEQ ID NO: 17307 - DNA, 201 bp, Bos taurus
caagtgtatgtacatatgtgtgataacatgttataacaaacagatattacttttaaaaagataaaaatggagacctcaggaaaaaaaatgtattcactaaggcaccctgagtgactagatcagtagggaataaatatttgttgagtgaacgagtagtttataatcttacagaaaaacacaatacatccagggacatctctg

SEQ ID NO: 17308 - DNA, 201 bp, Bos taurus
gaacaccataggcccgtttaacatcaggaagcccatttgacagaactgcattatgtcatcacatctgtgctatatgttgtctgtgataggtaacagaatttaaaagaaagaaactgaatgtcatcattttgtttggaagggtaacttgcaagtgcacatagggaacatgataaaaaatttaaaagcttgtttattaaaagg

SEQ ID NO: 17309 - DNA, 201 bp, Bos taurus
atggattctggaataaattatgaagtaaaaataatatggaaatctatataatatggaaacaagtacaaatgagtatgtgtagctgtataactctgtaactataaatgcaattaagatgttaaggaatataaaagcaaacctaagactatatctatcttttaaagggcaagtaagcaaagagttggacacgactgagtgact

SEQ ID NO: 17310 - DNA, 201 bp, Bos taurus
tagcctgtcatatgcaaacaattcttaactcctgtggttaattaaaggtatattttctttaatgtacacaagtaaatataaacaaatacctttatacatagtgctttctttgcttggtaaactcctactctccttcaaaacctttcctggacactccagagagtgttaggcatttgtcctccgtttttcagaataaatatc

SEQ ID NO: 17311 - DNA, 201 bp, Bos taurus
tacaggttttattgacatgcaagttttccaaattgttaaacaaaaatacagtatagatggcgcttctagcacatccaaatgacacaggaattataacctcggcctaaagggttttgaatgtgtatgttgttaataaaattcaggtttgagaatccatatctgctcagctgttttgaaaacaaacatgttgatgaaatattt

SEQ ID NO: 17312 - DNA, 201 bp, Bos taurus
aagatcctgatcagagtgcacaaacaagttacatgtgcagttactccaaattcccaggtaaacaccatggttttatcagcatccctccctctgctcacacacattgatctctggaggcttctggataaatggcataaaatgaagaaaaatgcatacattagtttgtggatgggtaagttcaatatgaggaagcagtgcagc

SEQ ID NO: 17313 - DNA, 201 bp, Bos taurus
tataaaagggattttttgtaacataaatctataaatgtgacaggattttttatatagattaatagttaataggtaagtacacatattcataaactcctaacagttcttaagggtatatgcatgcatgctcagtcatgttggacactttgcgaccccatggactgtagccctccaggcttttctgtccatggaattttccag

SEQ ID NO: 17314 - DNA, 201 bp, Bos taurus
ttgataccagaaagaatccttagaggttaaaactgtaatttttgtattatattatcacaatagcaacaacagcaaaactagaggcaaattctaaaagtaagatactgaaacaaatcctgagaaaatatgagaaactaggaggatagatataatatatgaatatgcaatgaggaaaataaaatcacttgtggaaaagttgaa

SEQ ID NO: 17315 - DNA, 201 bp, Bos taurus
cttactgacacaataggctgcaaaatcagtctcagttgaaaagtgattcaaacagcaagaacgagagcagagatgcatatgtaagaaatgcaagttaaacacaaccaacacatttgctaaaatatcttaaactaattgaaagatatttgagggaagtagcccagtgtcacatagatacaggctggatgctaaatcagcatc

SEQ ID NO: 17316 - DNA, 201 bp, Bos taurus
gtacatcaagtgcttaacagagtccctagcactgggagaagtgcccaagttattaactgctctttatattattattattattattggccctggaccatttaaactgctagcttaagtgatcaaaactaaaagtatgtcaacttattctcttactttttaatccaacttggccttttctttctttctgacctttattcccct

SEQ ID NO: 17317 - DNA, 201 bp, Bos taurus
atctcaagcccaacaacctttctttttctaatgtaataatcctcacataaaattcttaaatgtcagccttcttcaaatattcccaaacacttcaactcacagtaaactatttctgttcatcagcacttagtcacctcatttctgaagagttttcgagtttaatatatatcttccttatgggctttacttatggaccagagg

SEQ ID NO: 17318 - DNA, 201 bp, Bos taurus
catattgagtagcatatgattttagtagtaaaaaaaaaaatttctcacttgctaaatatttagaaaacttcaagttacatatataagaaatatatatgcagacttggtttctgattatcgcattctggattatcacctagaggatatacccagaaaccatctaatgacaatttattcctcaagggatctactaaagcacac

SEQ ID NO: 17319 - DNA, 201 bp, Bos taurus
ctcctagattcctctacccatgaaatttgccagtgttattaactatcttgtctccttgtgattgattttactatactcacagggcaaaacctcaacctaagatcaatgaatatgccttctccattccttcatccagactgcttctggggaataccaaaaagaacaacaacaaaacctcaataactataggaacaaaaacct

SEQ ID NO: 17320 - DNA, 201 bp, Bos taurus
gaaggtaagtaaagacatgtctcaggaatgaaagattttaagctagaaaaactttaagtgggtgtctataggcatatgtctcagatattaaaaaatacaagtcactgaaatatgttacagatgtttaaaatggcctcatgtttcagagatgaaagctgatggtctccagagaactctaaactgattctccttttataaaaa

SEQ ID NO: 17321 - DNA, 201 bp, Bos taurus
actttcacttctgcattaacctcatcatagacttcatggtattgatttggtaatttattcagagtttgcttttgaagattaatggtatataatacaaagtaggacacaaattttctgtttgaacacaggagatatttttctgtcatagtagaaacagtggtttcatgtgcctacacaaaaataagcagacttcattttgtt

SEQ ID NO: 17322 - DNA, 201 bp, Bos taurus
gaaatatgagcttttagtctttcagtctattattcagataaacttaagtgaaggccacagcaatcatctgggtagttctctttaggtagtttttcaagctggatcattcaggtcaaatacaaatgtttttcatttgtgcagtttttttttttccttccttgatttaatttcctcatcattccacttcacattgcctatgta

SEQ ID NO: 17323 - DNA, 201 bp, Bos taurus
aaggaaaagagcagaaatatagagtccagaaaggtgattttaccaggtttaaaaatggaataaagctttaaatgatttaatttctttacccttttgcgctccctatttctatatgcattttcatatatctcatttcttttcacagctccaatccttcaaatcttagaagtaagctataaagggagtaagggtacaagtacg

SEQ ID NO: 17324 - DNA, 201 bp, Bos taurus
gaggctgttcctggcaggcttcaggggccaccagactcgcacatggactttgccttgccttctccaaagggagttgcagtcaaggattcagggtccccagctggccaggctattatacatatctgatatatctatagtatgtaatatgtatacacatgtatacgtagtaatacatatgtaatatgtataatatacatattc

SEQ ID NO: 17325 - DNA, 201 bp, Bos taurus
agactgaagactatgagataaactgggttttgttctgatgggtggggctatgctcattaaatctttatccagttttctgttgatgggtgttcactctctgttgtttgacttgaggccaaactatggtggaggtaatgtagataatcaagacctccttcaaaaggtcccatgcatgctacactgtgacctcacccctgttgt

SEQ ID NO: 17326 - DNA, 201 bp, Bos taurus
actgaggggattactgggtcttgttttcatgggcagggccatgctcagtaaatctttaattcaattttctgttgatgggtggagttgtgttccctccctgccttttaatggagccaaactatggtggaggtaatgaagataatggtaacatccctcaaaagattccaggcatgtactgccccagtccatgcccccaaccct

SEQ ID NO: 17327 - DNA, 201 bp, Bos taurus
caccccatgtcctacatgttctattataatattgttcataaatggttattgcttttttattttcctttttttattctttggaatgtatcatttctactgataaatctggtcttattcttaccttttgatttccttacttattgtaggggaatcagaaaactcccattctgctgttgttttctttaggttattttatcagta

SEQ ID NO: 17328 - DNA, 201 bp, Bos taurus
atgagtaacacacatttttgattacttcacaggttggcactcttcatactgacccctactcagatcactaaggtggacttccttctgataagtgaggtgtgtgagagcagcaaaaaatattatctggtggcaaaatcttggtgttttcaatttcagctgatactaacacttagataaagtaatccttatgatttgaagcta

SEQ ID NO: 17329 - DNA, 201 bp, Bos taurus
gaagcctgtgtagtgactgagaatagacacagtatagtcttgacaaagtgggtctgtttgttacactgactttccctcaagagtatatgattttaatgctttttacttttagagactgaaaagaatgtattcaccaagtcaatagaaccacagcaaatgccagaggtaatgttgatctgttcttataaatatacatcaact

SEQ ID NO: 17330 - DNA, 201 bp, Bos taurus
ggcctggaactctgaggtgggagacccaagtccaggacgttggaccaccagagaactcctgatcccatggaacattaatcggtgaaagctctcccaaatgcctccagctcagcactaagaccaggccccacccaaaggccaccaatttccagtgcaagatttctcataccaaatcatcagtaaactaggaacacaatcctg

SEQ ID NO: 17331 - DNA, 201 bp, Bos taurus
agcttcttttagataaaattcttaataaacatgttattcagtactttggaaggatgaagacaaaacaaacataattttacaaaattgtgtcctaaatactatgttaggaaccaactggatgcttttttttttttttttttcaatgaagtttcattttaaaagtaatatatcataccagaggcatgtgagttcagctgacta

SEQ ID NO: 17332 - DNA, 201 bp, Bos taurus
tgattaacaacttgagcactctaccaaattatcaagaatttatcagccacaatgtcaacaactacattgtgttcactttaccagtttctgcacttcagaacgaaaggcacttctttgtgccaaagtgagttagagattctagtctgtaagaaccactgtgggtgatggacacctaagtgatcttctgctgctggccttgga

SEQ ID NO: 17333 - DNA, 201 bp, Bos taurus
taataactcaccacaggtgagaatttagtacatttcaacttctatggtttgatttatagaaacaatatttcacttattttacactcaaatatattttatcagtcgatatgctattaaagctacctctctgagaatgaacaggttggaaaaatagcaagagtgtttcccagctgggaactaccctgtgtcagatggccaata

SEQ ID NO: 17334 - DNA, 201 bp, Bos taurus
acaggtgaatgggtgctgtgaaagcacacaactgtctgtgagttaggatgaaactaggggccttaggttccctgtactatggaggagttaaaattatttcatacagtatttgataaatgaaacgaaataaatgacaaatgaaattcctaaattatatcctaatgatttgtgacctattgaagactagggcacggctgagaa

SEQ ID NO: 17335 - DNA, 201 bp, Bos taurus
gtatatgattataagatgtgggatgccttacctacgttggggtcagggtaaatttagtatattttcttggtagatgattctttgaatgagtctttggtcaagcagaggttgagataatgggctactatgtgaagtccctgaagcaagagaggactttcaagtagtgagtttgttaattagttatatctaaggtttgctcca

SEQ ID NO: 17336 - DNA, 201 bp, Bos taurus
gtatcctaacatcagttgtaagaccccactggagaaaatgataggccatacagatgaatacatttatccatggataattttcacacagagatggttattaatatttatcattgttgataactggcccccttccccacaactaatcaaaatcattcttgtcttccttaacttttgagcctatcttctggttcctagttcagt

SEQ ID NO: 17337 - DNA, 201 bp, Bos taurus
tttctccaaagagtattctgtttcatactagtaagatttaagattttgagatattctttaaagaggaatattggaagaatacatgttctgaaaatggaccatttacatgattctgacatagactttctcttttgtttatatttttactcaagaataacaaatgatcaacttttctcttgtgatcatctattcttttcctcg

SEQ ID NO: 17338 - DNA, 201 bp, Bos taurus
atatactaaaagagtaaatatcttaaagaagaagaacttcacagaaaactcagtgttcaccgtagccaccataatcaagcttcatgggtaatagcaaacacggtatagtaatcacaagcctaaatagaactttttttgttttgttttttgtcatcaattcataaaagtagtttggactttatgagaaagaaattttaaaaa

SEQ ID NO: 17339 - DNA, 201 bp, Bos taurus
gtcaaatttagtccaagtcaccagctgtggcctgagtggagaagctgtgtcccatttcccttagtgattctcttttacctggcacatttttagacacttatgaatatttttgttcttgctattggcacatacatttgttagattattttacaaagaaaaaaatctatattgacatatgccaggtttcatataatctaagca

SEQ ID NO: 17340 - DNA, 201 bp, Bos taurus
ggaaagttgtttcacactcttagctgatcacattttcttggccagggtatttccatattagattatagagctgtggtcctcaaactttagcaggtaccataattacctccagggcctgttaaatctcaggttacaggggtctgaccccagtttttctgattgagtaggtctgggttggaaactaagaatgtatatgttaag

SEQ ID NO: 17341 - DNA, 201 bp, Bos taurus
gacagccaaatggataggaaagattataatggcacctaagcatctgctaaaactaactgtatcaatgatctgtgaaccaagccatgcttttgtgatggactgttaccacttcagagatgtaattatggactatacggtcaaacatttacttgtttaaaagagcacctaagtataaaattatacattgccgtatatcatttt

SEQ ID NO: 17342 - DNA, 201 bp, Bos taurus
ctactgacataagaggtagttatacaggaatgtaaagtatacactttcagctgccactataatgattcatctttcattcatttaataattcatttgactattatctactgaacaatcactgtgtacagagccttcactagatgctggcctaatggatgtgaatgaaaagctagttaaaacaataccctggcacacaagatc

SEQ ID NO: 17343 - DNA, 201 bp, Bos taurus
agcaatagattgaggttacagtctatgaagaggcctattagctcatcttcaaagctgtggcctgagggtcagactgctaattaaacatgtatctaatggcgagttgtgatcccctccaaacttggagggtgggtgctatcttcacatgcactgtctctctgcacactgcagagacccaatacctcctggagggaagactgt

SEQ ID NO: 17344 - DNA, 201 bp, Bos taurus
aaaatggtatctctaatacattctatagtactactctccaagtaagggatagaccataggagtgctaagctatgcaagtttaagttgggcaatctaaagcccctgagacaaaatataggaccatgtttagaatccaagtttctgggccccaatttagtctctattgcatgttttcattctactggaaattctcaaacttat

SEQ ID NO: 17345 - DNA, 201 bp, Bos taurus
cccccaatccccatctagtcatctttaaaattcagctcagagtcactttctcgctctccccaaagcatttcagctatcagaaacctcctcccatataattccagattagccaagatatacatctatttttgtctgtgtagctccactgcatttcagtcacttattttcatgtctctttacctagatgaatttccttgagga

SEQ ID NO: 17346 - DNA, 201 bp, Bos taurus
gtttcattaaagtgattataataaataatttcagtaggctaactagtgattgaatcactcaatgacctgtatatgtgtctcaggaggtttaatcttaactgtatttagttgtacatttcttgtttgcacattcactcctggttttgaaaatgaattgtccatcataatttatatacaatacccaaacctggtctttctgtt

SEQ ID NO: 17347 - DNA, 201 bp, Bos taurus
atccttacatctactctttctatttttgcctacactccctttctattgactcctactccttttctctaaaattgtatttgaaaattcatcagatgacttgatctcagagtccctcacttgtaaaagcacaatttatttgtcagatctcatgtgaaagggaaaaatgagagtttggtagggaatctcacctattggtaatac

SEQ ID NO: 17348 - DNA, 201 bp, Bos taurus
gatacacccacagagaactgtaagtcttataactgcccagtcttgagataggagacagcaagagagacatgaatggtttattggatagggaatcccatctgtctgaagcaaaaggtcctagagcaacaccccatcatgtatggcagacggccggtaggcagaacaccacttaacagcaatctccccactcctctattcaaa

SEQ ID NO: 17349 - DNA, 201 bp, Bos taurus
ttggatccatttaatttggtctatccctcatgagagatggcagtgtgagtaggtggtagtttttaggttatggtgataattgttcttcctgatgaaatggtgaaagactatagataattacatgaaatttgaacacaaggaattaaatggctagcaaatgttaattgagtctggggtctgagggcaaggtagtgtagtaga

SEQ ID NO: 17350 - DNA, 201 bp, Bos taurus
tggcaaacctgaccaatcattatcgcttttcacagtaacaaggctctaaattgtgtgacaaggaagatgtctatgggactcttctttgaagagaatatttcggtaggatgggatctaccagaatctaaatttaaatgaagcttctaggaagctcaattgtagtagtaagcctaatttaagatctctaatttggcctaaatt

SEQ ID NO: 17351 - DNA, 201 bp, Bos taurus
taagtacataagggacaaataacacttctgaggacattatttcttagaggggacttcagtgctataatcaaagtgataaactgaatggtaggattttaagaataagggtagaatggtagaaagatatttttattgaagaaactttttacttgcattaccatatgtggactgcaagtaactctgtatttgtttcttggtttg

SEQ ID NO: 17352 - DNA, 201 bp, Bos taurus
tgaatgatctaacattaaccatcctcatactgtagttaccattattattagcacagcagatgatctttacaacttagcaaaactccaagaagcattattaccgattttctttaaaagtgcttctaaatcatttgccatttcttttgatttatgtcccagtcagaattattttcaagcgactttttagggtcttcaacctta

SEQ ID NO: 17353 - DNA, 201 bp, Bos taurus
gaagcaatcactgtgttgaggagagtgtgataagagttttgcctgtctgatagtaagcacaccccatagctaggggaaaaagtggaaaggaggatactacgttggctgccacatgaggaccatagatttgtggaaggtaaggagtttactcaagaagtgaatgaggtagtgagatagagagctggctaggtaggtagacaa

SEQ ID NO: 17354 - DNA, 201 bp, Bos taurus
tctgtagtcaggatatcagtactgagaaattaaagggtaacttggtcctcatgaaattgcgattgagagattcagaaagatgactttatagccttactagtcagggcagaagctgctaatagatggggcttaacttctagaaaccctgattattgaaaatattatggtacttctgactgcataatcaaaatatattcatct

SEQ ID NO: 17355 - DNA, 201 bp, Bos taurus
attaaattttataagctaggcttatcctatattgtaattgaaactcaagtattcagaaatttcataagaaataaggttgtttcttattcgtaagatgatcagttttatgatacaactgcggaacccagaaggatcaccttctttctcttcataatatggacaacatggaagaattattgtctatagtaaggagattggata

SEQ ID NO: 17356 - DNA, 201 bp, Bos taurus
ttaattggatattgaataaaattgctgaaatgttttagggcacctatgcttcattcagtggttggcattctttcataaagggccaaaaaataaatcatttggggagttaagtgataaaatagaggatagaatattggtacttatataatcttttgtagtgcatccatttaaaaatatgaaaaacattcttagcttgtgggc

SEQ ID NO: 17357 - DNA, 201 bp, Bos taurus
tttaaattcttaagcaaatcaaaaattgaacagtctaaatcaaagtttagtaattaaaaaaattgaacagtcattccctaatgacctacataagaacagaatcttaaaaagagcagatacatgtatatgtacaattgattcactttgctgtacagcagaaagtaccattacactttaaatcaactatactccaataagaat

SEQ ID NO: 17358 - DNA, 201 bp, Bos taurus
ttttctgtaacatgttaccccaatacaaagctaaattacattctgttaggttttgagaagtataggatggagaaggtgtcattatttggttttattcatcttgggttcaagaacgtaactctaagattatttagaggcatttaatgtaattattatgttatgggtattatatacaatactatatatttatatcatatcagc

SEQ ID NO: 17359 - DNA, 201 bp, Bos taurus
catgggaacacaatccacactctccttgcttccaacatcttgcctttgaatattttgtttctggattgctaaaccttgattccaccagttgaaattatataattttaacatcttatattattataaaacaaatactctcaaagtaacttgaaagaatatccttttgatttgctggtcaacagttacttggaataacttctc

SEQ ID NO: 17360 - DNA, 201 bp, Bos taurus
gccagaggatatgactgctgaaggttgcttctgttccaaggtgatgtgaaggagcaagggagtagagaggaggaaaggaatgcaaaccaggaatgaatgcgtgtcccattttcctcttttaatatgcatgcatctgtggaggaagatgtcaacatgaatgcctgcaaataaaatcataaattctggcaataaaagaatgtg

SEQ ID NO: 17361 - DNA, 201 bp, Bos taurus
tctagtcaaactttcttttaacaaaggcaatccatctacaatatccttgactgataagtatctagtctttctattttgggggcctcagtgtgtccatctacatgatgaagagagctgatcttcaatttgaatcaggacccagggtagaggctaggcctctgaagtttaaatttaataatataatctagcaaaggccaagct

SEQ ID NO: 17362 - DNA, 201 bp, Bos taurus
tgacattccataatttgatgcatatgggaatatttgaatgaatgaatgaatttaaatggaatttataatacatagatttggtccttaatggtatataggagatgaaagaatccaaagagctaagaggttcccaggttcagacaatcaggaagacattcactagacaaaataataaacacaagagaaagcagtaatgtgaag

SEQ ID NO: 17363 - DNA, 201 bp, Bos taurus
tccatcaaaatgttttttcttcattcagccatacattcgtgctcctctgtcatcttcaaatatttaatagcgttctacgctaaacaaaaatttatgatacagaaaggaataatacatagttgctattgacacatattttaaaaatacttaattttctatttatgttaaggtactcactctatgttcccaacataaaagtct

SEQ ID NO: 17364 - DNA, 201 bp, Bos taurus
tacaaatttgtcaaaatgcatactccaaaagcattattttccccaagtaacaatacagttcaaagcctattctctgctgagatatattccccaatgaaattatcagagacatcagtaaatttcttagtgtgaagtacctacattcaggttattttactttatttaggtctcctccataaacagaaagccaaaataaaacaa

SEQ ID NO: 17365 - DNA, 201 bp, Bos taurus
ggcgtgagtctgagtgaactccgggagttggtgatgcacagggaggcctggcatgctgcaattcatggggtcacaaagagtaggacacaactgagcggccaaactgaacagaactgaagatagcctgctgcaactatttgaccatatgtgctgaacaagtcagatcactggctaaggtgctccttttcctctttagtgttt

SEQ ID NO: 17366 - DNA, 201 bp, Bos taurus
aggcagtgtggtaatggcactaatggccacctctttcaaaggacttatgcgaggatgctgggcatctcaggactattgtagtcaatgtccttgaccatgtagtaggccactgtggacccacacctccaccagcagctcccaagcacacacagacaagtctggctcaatattttgtggggtcactgctcctttttcctgggt

SEQ ID NO: 17367 - DNA, 201 bp, Bos taurus
ccatctttggctcaaggataagaggcatgggagggatagcagaatactgtcagaaagcttgatggagacaaactttgaggccaccatacaggagtggttccccaaggagggagccaaggaaataacaaacctcagactcactcatccctccctctgacctcctttctgggatgcaaattggcccaacccaacctaagctga

SEQ ID NO: 17368 - DNA, 201 bp, Bos taurus
ggctcactgtcatatgatattaattttaattgaaagtaattattcaaaattatgttttcttttcttcatattagtgtcggttactattgttacatcagatgtcttggagatatcttaaggaaaaatattttcatataacttttcaaaaatatatttttgttaaaaataaaaaggtactgctctagagagaaagcagaaggc

SEQ ID NO: 17369 - DNA, 201 bp, Bos taurus
gttagtattctgtgagaattgttctgcctgcagacgtatttttgacgtgtttgtgcagggaggtgagctgcatatcctcctattctgcaatctagattccctctcttcacaagaaattcttaaatactttaaatctgaaaatcaaacttgtatgtactccaggaatagaggcaagaatattctctgttatgattttttgag

SEQ ID NO: 17370 - DNA, 201 bp, Bos taurus
aaaatgggagacattagaatgggccagtggctctgggagggatctaagaagtagggagtgtccacactggtagttccttgctctgcagaaaccctctcactcccagcttgctgggatgtctaggcccttgactctgtttttgaggtgtgttcacctgccaacttgctagcaatgagcgtggagagagaccaacactgacag

SEQ ID NO: 17371 - DNA, 201 bp, Bos taurus
catggacagaggagtctagcaggctacagtccatgaggtcacagaagggtcagacatgtcttagtgactaaaacaacaactacaccacctacacttcctttatgtactcaatacccccatgataattctctcaccaatcacctacacttcctttatgtactcaatacccccatgataattctctcaccaatcttacctttt

SEQ ID NO: 17372 - DNA, 201 bp, Bos taurus
attatttacaaactcagattcacttttcaatcttaagattcatcctgtttaaatctacatataactctgttacaggcaaactctaacatgacaaagtttccggcatgtaacattttttggagggaaggtgctatatttgaattaatgcattattctgatatgtactatttaatgctgtcaaatgaggcaaacttttgtctt

SEQ ID NO: 17373 - DNA, 201 bp, Bos taurus
tgccctctctgaggtcacacagagttggacatgactgaagtaacttagcagcagcagcatatataaaggagtgtatgtgtgtgtatgtgaatgtgtgtgtatgcatgtatatattttactaaaaacctacaggttaatatactgaagaaaaattttaaagtatcattctggattcttctttcatcaaaacaaggcccctct

SEQ ID NO: 17374 - DNA, 201 bp, Bos taurus
gtgaagttaaagtgctgggtgagtacacatttaacattgagagacagaataagaaagagccagcagattattagctcattcttctggcccagatggatgttctgacctctcaccatggatgacaaatgtgaccaagaaaacagcaaactttcttatgaggccaggataaatttagcttggcagctcttttcatttgctttc

SEQ ID NO: 17375 - DNA, 201 bp, Bos taurus
tccacatacaatagctagagtatatcattcccagatgttgacccttcatcaaggatctggcattttcaaaatgctgctttcagagctttcctagtttatctttttcattattgccatagatctaaaataagctgtactctcccatgtgagaaatctgagcttgcaactagagattatcgtactaagtaaggcaagtcagaa

SEQ ID NO: 17376 - DNA, 201 bp, Bos taurus
tgcagttcactcactgtgacagtgctaccaatccagacctcagtcctcttttctcttggtgtctgtatatatttatgaaacctgacaaatactacttgtcgtatatagctttctaggaagtgtgcatttcctttcactctactgattttcttgagagaataagatatctctatcttcataatcttcccattaaccacaagg

SEQ ID NO: 17377 - DNA, 201 bp, Bos taurus
ctgtttttatgcatccaggctgttatatctattgaagtaacagctatataaataagcccagtgggtgcatattctttcaacataggtgtttcctgaatctgggattgctccactggttggggtggttgctgttcttttgcttttctctgtattagagtctaaggacatgagccactttgtttcaccctcaatcaccataat

SEQ ID NO: 17378 - DNA, 201 bp, Bos taurus
cataaggtgaaaatattattctgctggcaatttttctgatataaataaacatagcccccaattcaaataaaatctttaaaatgcagaataacatgtatctctcttcaggattattgatgtaggcatattttaagttgtaagggtgaacgagtctattcgtccagatgcttggaaaacaatgagtatcactctttggctatg

SEQ ID NO: 17379 - DNA, 201 bp, Bos taurus
atgtcactaacaaaaaaaatcaagcagaaatgtgcattaaaatgatatataacataactacatttacttaagaatgtattgcaatatcaagcagcagattgaacaatgcagaactgcatcaacctaacactagcaatttagtaaagataaagggaaataattttaaaaactataacaaaaaatcttgagttacatatggga

SEQ ID NO: 17380 - DNA, 201 bp, Bos taurus
tatcccgtcattttcaacttgtcatcatagagctgccagcactcatgattgtcaactgatctcatattttcattagtgaaaatatagtgtggagaagttagacagaatgttcttgggcaaactgttgttattattttacctataagccttcagttcagttcagtcactcagtcgtgtccgactctttgcctccccatgaat

SEQ ID NO: 17381 - DNA, 201 bp, Bos taurus
agtatgtcatttttcttccctcagtgcaatgatggcatttaacagtaaccgttgtccttataattacctacaggaatgcaacacttataaaatcctggtttagcacaggtaagaatgttagtaattgagatactttagaatgccaggggattatcactacttactcactaccagcactgaattcttgttgccatttggcta

SEQ ID NO: 17382 - DNA, 201 bp, Bos taurus
ccagcagtgttctgaggcctctgctgagcacacagaagcaaggaagagagcacatgcccaacttttggacctcgagagtgatttctgtaaaaaggctgttacattgattggggaggcctttaattctgtcagggaagagctaaaatccaaacactcagtcggtacctgccaggaacatagagccatagacagcataatgaa

SEQ ID NO: 17383 - DNA, 201 bp, Bos taurus
tatgtatatgtgtgtatatatatacctttaaaaaagactttgcttctgaaaattatttataatatttatcgcaccatgtagttcagttatgtccaattcatagtactctgaagtgtgttttaaaaaaaagagactacttcagtcagagcatcagaaacagaggaagacattaccatccaatacatgttttcatgaatattg

SEQ ID NO: 17384 - DNA, 201 bp, Bos taurus
gtaagtccacatactatttttatcaagaatattgcctgtagcataatatagcatgatattcaataacttataagtttaggaatatttgagtgtaacaaaaagcaatctcagagatcagccttggttgcattactattcctatcagtttttagtagaaggaagtagtaaaggaagtttttagtaggaggaaggcaaggagcc

SEQ ID NO: 17385 - DNA, 201 bp, Bos taurus
gggaaaatcaaaacagggtaaaaagataaaggcagttggggcaaattgaaaagaaaggagaatcatcacagtaattcatttgttggattacgtaatgatatcagagtctccaatgagatttttgtaaaacagcagaacaaatccaactcacagaatgaaactgaagaccctaccacatcttttagccttttcttaaaatct

SEQ ID NO: 17386 - DNA, 201 bp, Bos taurus
acttttttcatctatgtcaattagttaaccttcacaaagttcctgtcatgcttaatgttatgtgtcaacttggttgggccattgtgtcaagatatttagttacatcttgaattgcaccatcagctttcacttcggtctccagtacactggttcactctgcacattttcacttgtcggcctccaaagtcatgtgagccaact

SEQ ID NO: 17387 - DNA, 201 bp, Bos taurus
tatcctagactacccccacaaaagtgaatgtcaatggtgacctattctatagacttctctgaagtgttctttggttaatggtgaacactctattgcagtggtaacatttctcaccaaacttcttagtttctctggaagttgaagaaaataatcgggtagaaaagctatcagccttgctgctattggactcactgtagaacc

SEQ ID NO: 17388 - DNA, 201 bp, Bos taurus
gcacgtagaaggctccagaagggagttgcaagtgaggagtgttagaagaaacccaacacacagaagagggaagctcacagacatgaacagaaaacaggattccagggaatctgggttaagtaatgacaccatactctctgggtttagctctgtggacaacaggctttgaaaaataatatgaaggctaaacattcaaaattc

SEQ ID NO: 17389 - DNA, 201 bp, Bos taurus
caaaccctgaccaaaagcaggttaatccaaaacacacagcatcctcagccaactcaagatcaacaaaacaaaattaggcctagggattagaggatgttaattgtgaaacataatcccatgatatttatggctccagagactgaacacagctactcttgagcacagtgcagtactacttccactggggccattgcttatatt

SEQ ID NO: 17390 - DNA, 201 bp, Bos taurus
catactgtgccgcagctgaccaagctcattctgtcttatccatttgcagtagcttcctttctgggctgtcctgaattttgaatggttggccttttcttgatattaagacctaggttcagacatactaaataggaagcccttcctgttcagtcagtctagagtagctatccacttacattatcatgttatagtaatcctcat

SEQ ID NO: 17391 - DNA, 201 bp, Bos taurus
tcttgtggccccaggaggatgttgaaagtgaaagagcagatgagaggtgctcgtagtccatctaggagacatggagtcaggagagattggctgggcagccagagggcccagggatgcgccgtcgttctccacctcttagccaaaggctcacctctcccttactgtattccacatgtttttatgtgtcgccaccaccgcccc

SEQ ID NO: 17392 - DNA, 201 bp, Bos taurus
acccagcggctggagggaccaagagacacagattcgtgggagtcagagccgtggagagggaagagaagggagcagagtgaagggtaaggctagttatcccagagctgggatccttcttttctgcaatggccggaacttgcccccaacagcgagggcagccttctgtttctggtgccggaagctcagtgtcagtcctcccct

SEQ ID NO: 17393 - DNA, 201 bp, Bos taurus
aaattgactcttacatgaattatttagcttcactgttttcagcttttttactacatttataagtacatttgtaatgttgaagttctgataactgagccttggaactccttgttcagaagataacattacttttaattatttagttgtgagactacttacagtggagcatattctggtttcttgcttatggttgtgctccag

SEQ ID NO: 17394 - DNA, 201 bp, Bos taurus
tgtgtgttttccacctcagcccacagctgacttcctgttatacaaatgcaccataattaaatcagtcttctcccagttgaccctggtagttttccagttctttttactattgcaaatagcagtggctatctttgtgtgtgtgtgtgtgcgtacatgaatgtatattcacatatatctaggtgaacttttgcaagtgtatct

SEQ ID NO: 17395 - DNA, 201 bp, Bos taurus
cctcacagctggtcccagcatcggcgttcctgagtctgtttcctgtgtctgctccatctctgctctgcgccctgaacctcctctccaaaccctgaactcacggcctgaacacacggccttgacacactcgaaggcctctgggtctaaaagtaactttcttgctatgatcctgtctttcattcttgacatcatctgcaccag

SEQ ID NO: 17396 - DNA, 201 bp, Bos taurus
ctaacttggtggccatctactagctgggagggtaagctttggattctgtcaggttgtgtttaaatctgtggctttgtcatttattgaatttatgaggagaaacaagtagcttgggcctcaggtttctcattatagtatcaggaggataataccactgcagtgctgctgctgctaagtcgcttcagccttactctgtgcaac

SEQ ID NO: 17397 - DNA, 201 bp, Bos taurus
tttcaccatttaatatcgttcacccttttgtttcctgaagacttaattttgttgggaaaataacttagattgactgacttaagctggagccacaaacttcagtcactaaaggtagtttcttcttgtgctttgcagatcattaaaaagctgatagaaagaaaacaagcccagattcggaaagtctacccgggactttcctgt

SEQ ID NO: 17398 - DNA, 201 bp, Bos taurus
cttggagatgaaacagacaggacagtgcgaatgaactctactccaaacacaatagcagtgagttacagcagaaaaaaagcagcgtgaggcctgaaggcacgcggtcgccttctggtttcctgccctaaaaccgcttgcaaagctgtgagatgtgcactccacattcacaaggccagcagggcagccctaagaaacacctcc

SEQ ID NO: 17399 - DNA, 201 bp, Bos taurus
ttgttgcatctgttgttttaaatatggccaagagttctatgaagtgtcaggaggcatttcaaaggtggttctgtttgaccattgccatggccagcagccctgctgcagaaccccctgttgcagccatgctcctgcaggctctcttaggaaaagctgaccagtttttccagtgtcctgaagggatgtgtcccagtcattttc

SEQ ID NO: 17400 - DNA, 201 bp, Bos taurus
gcattacctagcgtggtctcaggtggttcagacacatgtgtaatagatcccacaactgtatcaaaacaaaggagaacaattttaaaaactgtaagatgttaagctgcagtcaagtatctctttcttgaatatcaacctcattctcttgggaatctgcatcacatttttacagataggacaacaggttaggataagaaaaaa

SEQ ID NO: 17401 - DNA, 201 bp, Bos taurus
aagaggccactgtaaatctataaaccattcaccacacttaaattttattttcctgatcacaaagcatcaacacctccacttattcctatgttttctcttctctagggtttaatccagttgggtgggccagatttacgctcatcaacacctcacaggcagacaataaggtgcaaatagagttcagcctctcttcaaccactg

SEQ ID NO: 17402 - DNA, 201 bp, Bos taurus
tgattgaatcactttgctgtatacctgaaactattaatagcacagcattgtaaatcaataataatccaataacatttaaaaaaaagacagatagtagacattagatttaaccttgataaaaacaggattcttgcttctcaatatgaagaaaatagcccaattatcatctgttttttgtacatggatctcaagtgatacaac

SEQ ID NO: 17403 - DNA, 201 bp, Bos taurus
tttttttttttttctgtatgacttaagaaatttcacaaaggcctaatctgaagatataattacatcaagaatgctacagcataaacttcagcatgaaatcaaaggtaaggaaatgagagcctggcctgatccaggtttgtcccaggaggcccatttgctccgggggaatttagggatatattgggttggccaaaaagttca

SEQ ID NO: 17404 - DNA, 201 bp, Bos taurus
agtccttagcagccttgcctgaatttctcatctggcctcttatcaacttctattgattaaaaagtctgagaactctggttagtagtatcaccacccagggtagtaactactgaaggcccattaaccaaggtctgagaaaccccatagagagagcaacttcttacctgggaatcaatattttgtctcatcttgactaatgag

SEQ ID NO: 17405 - DNA, 201 bp, Bos taurus
tagttttatctacaagttacttttaagcaatgcttacaatcatcattactaaagttcttttccataatgtattcataatcttaatgtgctgatcaaatgccatgcagtagaagtgtgctggcttggagaacacagagctaaaacctaagagttgtgaaagaaatagatgtatctttttgaggttcagtaaaccaagggatc

SEQ ID NO: 17406 - DNA, 201 bp, Bos taurus
ggaattatataggcatgaattgataagagtcctgctccaatttttcttttcttccatgatgtcaataaagtttgtaactgaaacccatctcacagaccttcgactgccattttctcagcacaaatgttcctgctctattactctgctcttgcagaagagatgacgtgccactcacaggacaacttttacactgctatacct

SEQ ID NO: 17407 - DNA, 201 bp, Bos taurus
aggctttgtctgatttaacactcataacaaatgtgaaggttttattatcttcagattattgttaagaaactaagctttaaagaagacttgcctaaaatatcacaatatataaaggggtaaagtcaagattcaaacacagatctgcctgactctgacaccagcattctgaatgactacactacactcagtaactttaaacta

SEQ ID NO: 17408 - DNA, 201 bp, Bos taurus
tgtcccactctttgcaaccccatggactgcagcataccaactgccctgtccatcaccaactcctgaaccttgctcaaactcgaataaatcgaattagtgacgccctccagtcatctcatcctctgttgtccccttctcctcctgccttcaatctttcccagcatcagggcctttaccattgagtcagctcttcgcattgga

SEQ ID NO: 17409 - DNA, 201 bp, Bos taurus
tgccatctatagggtcgcacagagtcggacatgactaactcgacttagcagctgcagccctttataaacagtaatactgtggctcatactaatgacaccctactctatgaacatgagccctgaccatgccttggtcagtggaatatgaacggacatgatgaatgtcatgtgttatcagaagctttaattccctgtcccctc

SEQ ID NO: 17410 - DNA, 201 bp, Bos taurus
tagcctgccagaggggactggaggaatcgctttcagtgaccttctctttcacctgcactacaaaaagataaacttttttacataggtggccccatggagagatggcttctatatgtactgaaaatttagaaaggagctggactttatataatcattgtaaggagcttggaaaatacagattacacttatatctacctatag

SEQ ID NO: 17411 - DNA, 201 bp, Bos taurus
ttgggagatccttcacttgtcactgaaaatttccatttgtatggttttgtttcattgatgaaaagaaaatatttgcatacatgtgtcctaaattttccagggcacttgcaattttaagttattttgtactaagacaagagaccttggtttttgatttagaaaggaaggatttccaacatattctagttaatattttttaat

SEQ ID NO: 17412 - DNA, 201 bp, Bos taurus
ttttacttattaaacagctgctgctgggattccatttatgtgctgttactgggctggatgagatggacatccatggaaatacacacgtggcatctgccattaatgagcttataatttaaagaaggagactaaacacacacataccatctttaaataaacttcacaaatctagcagcatgtgagcaagcactcaaataaaga

SEQ ID NO: 17413 - DNA, 201 bp, Bos taurus
ggacctagatttgcagtccctctctccccaaactgtttaactctgctgttgccagactatgttgatgatggggaaaatgtatcgaaatctgcagtaagtgtatctgctctattggtgtatgggaagtgaggcacagctttcagaattccccagatctaatggaacattagtcatttttttcctccccaccctcaaggaata

SEQ ID NO: 17414 - DNA, 201 bp, Bos taurus
ctaggacttctctaacggttgtgctctcacctccgacctccagtggatgatcctgtaagttattcaggtggcagaatcaaggccttatgaccctcaggggcgaccactttccactctaattttggtatttccaccttctctgtctcactatccctggccccctattcctgtccctgaatcactttccaaataaactgtggc

SEQ ID NO: 17415 - DNA, 201 bp, Bos taurus
ctgatttcttttttgtacgctttcttcaactcaacttcatttttcttccagaaagtaccttatctttttcttaattgagagggaaatatctaaaaaaaaaacatagtcattcagttgaattgtaatttccatctcaaaatgttcctttatgtccaatctttctctgtccctccgtaattttgagctcggtctgctaccttc

SEQ ID NO: 17416 - DNA, 201 bp, Bos taurus
tggattgctgagttgattactggagaggagataggaatttttcctaaggaagaaagaattacctaagaggaaagctcaactctttcctttttgaggctcagtcttataaacaccactctgacagaccagatctttgaaaagtccagtgacataaaggtctccaatgtccccagggaggaactcactgtgggagaaggtaga

SEQ ID NO: 17417 - DNA, 201 bp, Bos taurus
ttgatatgatagtgaatgaaactgtcattatagcaggagtcaagagggactcacaaccaactgtgtgactgttttgcttctgctgaactttgtctttgctcatgcatcttttagagtctaggagtgtgtgtgtgtgtgagtgaacaagtaagagatataactgtctaatctaataatacaataattacaactagataagac

SEQ ID NO: 17418 - DNA, 201 bp, Bos taurus
gctgttgtaatagtcactctatggatttacatctaggaaagatgggttatatagagggataggaacaattgaatttaaaaaaatgtgttgctattatgccctattttagttactggaaatattaatttcagagtttcaggcaaaacctaaaaaaacccttggaaaaaaagttttgtatttaagcctgagtctggctctaca

SEQ ID NO: 17419 - DNA, 201 bp, Bos taurus
ctgaatgggctgtttattactgagtcatcacatgtaatacagggttgcagcataaacttgtattggctcctgctgtgattaggcaatcttcagagtatacagaggatgtgctcacaataaccaatgccaccagccaacatttccaagaatgtaagttcatcctgctgctcttcattgcaaagatgagtgatgttggatcag

SEQ ID NO: 17420 - DNA, 201 bp, Bos taurus
tgaaacagtcactattagtaaaacacaatgatagtttatatggtgtttaagattggttcatttaaatcttgtttaatcatcagaattctttcttctgcttgtgacctgatagagtagaaactatctgacatgtgtcaaacagcactcaaaacagaaaattacattgcaactatctgaatcatcctgcagtgtgttcaccat

SEQ ID NO: 17421 - DNA, 201 bp, Bos taurus
tcattgaattgtgtaatcattggttcttgtgtaggaagtgttaagaatcagggtatctctattttccaaagtcttctgtaggctgtatccctatgagagttagttggaaaatgaagatacccagaatatctgttacaaagactgtcctcatgcttgctctatttggcaaggttctgtacaggaaacctcccttaatggcgt

SEQ ID NO: 17422 - DNA, 201 bp, Bos taurus
atattatacatttatatatatttacctgacatatatatttatcagggtccttaagatcaaagtgtcatctgtctatgtagacaaacagacaaataggtcaaattagagtaacttcagaaatacatagggaataaatcacattggtgcccaggttatagtgaaacagaaacaattgtatactacttgtttctgtgtgggcag

SEQ ID NO: 17423 - DNA, 201 bp, Bos taurus
accattctgagtctgctttcgttaccttgtttagtctgagttttacccataaggtgactgtcatccttcaatgtataattatgtttctttgagacagaagctgtgtgagtttatcttgatctttcaagagctagtttacttttcatggttcacaccgtgcttcctggctgaccatcccaatagtgggtattagatgatagc

SEQ ID NO: 17424 - DNA, 201 bp, Bos taurus
aatgcttctattttaagacttggcccacatgacatggaaaaatagtcatagaagagacatatcaatctttaatctaccttgggcttaaagtggcatatgttacttctgttcagtctgttggccattactagtgataagcccttaataaaacagcataaagtgaagttgcccagtcgtgtccaactctttgggaccccatgg

SEQ ID NO: 17425 - DNA, 201 bp, Bos taurus
ctcgtgaataatatatcttcaaagagatatttgtcagaagcagaatacatacttacttaccaagagtaggttaaacagaaatggtagctttggcctatcccgtgccatataatcagatcagaacagatcagatcagtcgctcagttgtgtccgactctttgcgaccccatgaatcacagcacgccaggcctccctgtccat

SEQ ID NO: 17426 - DNA, 201 bp, Bos taurus
ggtgaaataaagttatgtgatgttgcttgatatatggatgagtgggaagctctaaaagatgggtttggaaagagggtatatggccatattttgtaagtgacgatttgagggcatgaaaagtcataaggagcttatttctccaggttaaatcacaattttacaattggccatttggcagtagacattgctacctagtcataa

SEQ ID NO: 17427 - DNA, 201 bp, Bos taurus
tgtaacttgttatggtttagtagtgctattggctgctgtcattatcatgattttgtatttcaaaagagctttagttagcaatactgctagtcctataaagtgtttctagcaacttgagatattaaccaaggctggcagaaaattactccattgttgttaagcaagatcaattgttcaaagatgttacctttagtgattgtt

SEQ ID NO: 17428 - DNA, 201 bp, Bos taurus
tgtatgtctacatcatagctggatgctgcttgaggaattaccctcaaccaaaaataactgcctgttttcaataaggttgacatgggggtaaactgtaactgttctttagatcaactggagactgtttgaagaccatgtgacttgttaactccccatgggatcaatagtggtctatatcacaattgtaacataattcaagtt

SEQ ID NO: 17429 - DNA, 201 bp, Bos taurus
tttttttatgattcccactcactggttttagaatttaaaaaatatctttcccaaatgattgccattcaagcatctgtccaagcttatcaagttcttctcatggtatatatattcacattttttcttcactgcatggcttagtttcaagatactattctcacagacatcctaattttttaagggcttgtgccaagcttgagc

SEQ ID NO: 17430 - DNA, 201 bp, Bos taurus
ataactgagcctttgacattttcatactttctcttaaaatcacaaacacttccctgggacaaaggaagatcacaatatgtgggtaaaaaaaacattggaatgtgtacaaaaccactaaagagattacttttaagctcttgactctttaaggtactgcttatgattttgttattttgtttttcttggtttcatggaagacat

SEQ ID NO: 17431 - DNA, 201 bp, Bos taurus
acatgcctcttagagccatgtagccagaccgacccagcagcccttgttccccatgccaactttctgtctatcaccaccccaagatgagcaaaagtattacgtgaagttctctcagtgagagtacaacctcactcagtgctggagagggatggagagaatgctcttacctgatccttcatgggatgcttgtagtaggtgtct

SEQ ID NO: 17432 - DNA, 201 bp, Bos taurus
ctcttattctttctctgactctttttgtccttttcattgtcattcccttttatgtaccaaccaacatcatatatctggctttctatctttcagcttatttgtagttaagatcaagaggcatatgtagtattgagttttgcttgcctgtttccaatcaatttatattatgataatttttcaacatattatttgttataaaca

SEQ ID NO: 17433 - DNA, 201 bp, Bos taurus
taatcttgaacagccttttaggtcaagatattcccactggggaaaaatggtatatagagaagatataatctgagtctttgagaaacttatactcaactgagatatgcagatgaataataagataattatagtgtggtgcttatcataagcttcagtgttaaagaaagtatttcttcaaaacttgtatttgagcccaaaaaa

SEQ ID NO: 17434 - DNA, 201 bp, Bos taurus
aaacataaataaaaagcaaaaacaaatgtaccctatcctgatcaaggtataaaacacacacagttttagggccatatatacccatcttagcttgtcttatataagcaggaacttttaaaagtatgtcttatttcaaatgcacatatttatgtaaaaataaatcaacatataataaaaatgtaaatttctacataaaggctt

SEQ ID NO: 17435 - DNA, 201 bp, Bos taurus
aatccctcaatagctgacctttgtctttaggataatcacaaattatttaatgacatctaaagcctttctccattgagatattatcttccttttatatgctataaagaagaaaatttaaactaacttcaggagaagagtgagtataagaaaaaataaaaccactggcaagtttcaaagtaattgcctcagtgccttgcgagt

SEQ ID NO: 17436 - DNA, 201 bp, Bos taurus
gcaggccataattttcagtttcatctttcactatagcaggacatatgaaaaggatttcctcccttcggcaagctctacctttcaggaaactattgtctcaggtggcctgtgtctgctgctgctttttaaattttgttacaagctctttgaccctaaattgagccactggttcctgaacatacttctacatctgaatcactt

SEQ ID NO: 17437 - DNA, 201 bp, Bos taurus
agtatctattcttttcctgagaaacactgatataactttgagactttctgtgattccaaggatgggcaaaatatatcaagataagccaatgattaaattccgtatgcctagacctcagattactttagagatgctcatgtgatttaagatagctcaataatattgaatttcaggatttcttctgggaaagtttgaacaaaa

SEQ ID NO: 17438 - DNA, 201 bp, Bos taurus
aatctacataataccttatcagctcacttagttttccaaaaataaacatcacagttaataataataatgatactatttgcctattttattttcttaatatttgccctgatgcttcaaaagcaaaagtgggtgaaactgctgatgcctaagcataaaatgaagcaataacatcaaataatattagtagtcattatattcttc

SEQ ID NO: 17439 - DNA, 201 bp, Bos taurus
gagcatgctccggggattgttgatggacgggaagcctggtatgctgaagtccatggggtcacaaagagctggacacaactgagcgactgaagtgaactgagaacaactatctctcaaaaccaaaaccaacccggatttgtagtgtttgccaatttccaatttccatttcccacgatggcaatttcaagctgccagtgtgac

SEQ ID NO: 17440 - DNA, 201 bp, Bos taurus
ttaaaaaaaacctctcccacagagtgtgtaagagacgtacagaaacattttactatatgactcttattcttcaatattccttattaattgcatgcttctcgtagtataatctttcctataaggtgactttcgtagataatttgactcttgatcttttgtgacatatttttaattaggaaaaatttcaagatcttcagtgat

SEQ ID NO: 17441 - DNA, 201 bp, Bos taurus
taatctgctcttcataagcagacaaatataaaatgtagaatgatgatagcaagtggtttgatgtggattctaaatccacacagagggtgttcctgaacacgtccaatatagggacacttgtgttgcccattatatttagcttgatagaggaaagcaatgggctatatcttgccatcatacatggtcatgaagggccatttt

SEQ ID NO: 17442 - DNA, 201 bp, Bos taurus
tctattagctctcagtgagccaaaaagtcatgagtcctgtccaagtttccatccagggataggggactcaaaaagaaggctcttttcttctgggatgtctggttctttagactgaaagtcattgaacggacactacagcaaccaaacaattgctgatttagccccattattatttgtatacctaggcttaacaaaggaaaa

SEQ ID NO: 17443 - DNA, 201 bp, Bos taurus
tgtccacacaacacatggaaaaaacctatatttcctagtttacctttcgaacatttgccaaccgattcatcatcaaggactcttcccggtcatcatcatcgtccaagtccagcatcggcattccaaaagggtcgatgatgctacagcaccttgatccttcatccctcggatcaaaggggtccacgatgatgggctccgttc

SEQ ID NO: 17444 - DNA, 201 bp, Bos taurus
ttctttcaatgataagctcttatctggcgttaacaggtatgttgataaaaacttcaaattacatacaaatttctagaaaaacaaaatatacataaaaccacgaaccccaacctgaaactataaaccgagtaacgtcctttggacatccatggataattctaaaagaaatccctgatatgatctgactcactgggaaattgg

SEQ ID NO: 17445 - DNA, 201 bp, Bos taurus
ggagaatggcgtaactcctaacaaagagccttccttccatgcaccataacagccaagaagtgaattatataaacaaactgattgtaagtttatgtgagactcttccctcaggactcccagaaaaaaactgggagatgctatggcagaggtgctgagaaactataatggcagacatgaacccttgttatttgagcattaata

SEQ ID NO: 17446 - DNA, 201 bp, Bos taurus
tacaaaactcttttagattaatgtgcagaaaaatatgaccagtgacaataattccaatctaaattaagattttaattatttcagattttgaatcactttgagaatgtcagtttttcattctgatatttgctatcaaattaggcaggtgttatgtcaataaaagtaaacttcctttttaaaataatacttaaaacttttttc

SEQ ID NO: 17447 - DNA, 201 bp, Bos taurus
tctcagtacctcagcagtagggcctgttgaggccaccaacaccacacagggtaggcccttaagcaataatttagacttgttatgatgacaaacagaaggatgaaacaatgtcttctcagttcagttcagtcgctcagtcatgtccaactctttgcaaccccatggagggcagcatgccaggcctccctgtccatcaacagt

SEQ ID NO: 17448 - DNA, 201 bp, Bos taurus
atcccttgttcaagaccacccacaagctattattgacatcctacaatcattttaatgcaaaatctggtaaaataaacatgaaacactatcttggccactagttttggacatatgctaagtgtcaaagcccgtgtaagtgttcagtcctggtccttcatttctcatggtcctcctcagcctgaccaccagccagtgcagaat

SEQ ID NO: 17449 - DNA, 201 bp, Bos taurus
aataacaaaaaaggagttagtctggtatcatcaaaagaatctttaaaaagtgttgacagtgtcagctgggagtaaaatggactaaataactgagtccaagtttagcaattatggtcagggtgctactataatggaatttcttattataaattaaaaagaatatagaatttttatcatagtagaataaccactctgacactt

SEQ ID NO: 17450 - DNA, 201 bp, Bos taurus
agctttaattacacctctccaacatatagacacaaactaaaatctacatcaatatccagtgactgccattcttaccagacatgctttaattatggaaatggtcattcttgttgccagcatgtaaacttttttgttcagtatagccaccacctgaaacttccattgtgtcatattttctgaaatatctttttatagccacta

SEQ ID NO: 17451 - DNA, 201 bp, Bos taurus
atctgcttttagggtttgcgctcctgacagcaccctcagtctgcacatgtccaggtatccttttacattcccatgtacaaatgtcatattaatttataacataagagtgtagacacagaagtagtatgtttgggattagtgagagtagaaatgctgttctggaaatgccttacatccttgcaagagtatatatggcaagag

SEQ ID NO: 17452 - DNA, 201 bp, Bos taurus
gcatatgtaatagggagaggcacggagattggtgacttgtatcacaagtgagtgctcatcccactgagtgacttcatatatggacgggatccttggaggctgcatgcagttagtttttgaaaagtgtatgtcatcttatgaaatagttttattttaaatctaaaacatttgattcttacaaagcattcgttttacttaata

SEQ ID NO: 17453 - DNA, 201 bp, Bos taurus
acgtctttcatgcggggaatggactgggttgactgatctctagaggctgaatgtcttgctggtggggcacaagctgtccaacacagtcaccaaacaaagcgtgtgacaagcacagagagatggaatacatttatggtgttcatgtagggttccctagagtcacatcaagtctcagtctccctaaaaagattgggaaccaaa

SEQ ID NO: 17454 - DNA, 201 bp, Bos taurus
aaaagaagtggaatgcaaaaaagaaaaaatgtgtgaagggcctatataattgctgaaaggtaagttctgtaaggctagaaatcaacggaaagggtgaatgttatggaaagatttttaagtacttattcagaagaaactaaatagaaaatcaatcaggaaaataaaaaattcataaacccaattgcttctaattggctcaga

SEQ ID NO: 17455 - DNA, 201 bp, Bos taurus
agaggctgcagaactatatagaaaggatgacaaaatatggcttaaattgggcttttccaagcacatgtattttcctgggaagttcaaactgggaaaaattaagagagggaaataattaatacttaaaagaacaacatcctgaagtatagttgacacattatattcatttcagtgtacaatatagggaatgaacatttatat

SEQ ID NO: 17456 - DNA, 201 bp, Bos taurus
catgttggttcttgtggctacaatgtgccaagaagtgttagaaacagaggtctaatttcctgagatgtgtgtcttctgttgttttctgccagaaagtatgttgttttcctgccaaaacaacaagaccatctgaagacacagagagaacaactcccactgagggtggcagcaaaaaaagaaatgccaaagtgaagacaggga

SEQ ID NO: 17457 - DNA, 201 bp, Bos taurus
gttttcactgtgatgtataggttttaattgccactgtatcatataatacacatctatatttttacttattttctaaggacaattgagtacccagggttctctgctgatctcgcttcatcatagccttttattttcatcatagccttggggcttcgatcttattattttggtcagactgtgacaccggggccatcaggctga

SEQ ID NO: 17458 - DNA, 201 bp, Bos taurus
catcaatctaaaggtgtatacttcaaatgcaacttaagtttctggtcagaaaatagtacctccttgtatttttccagcctctatcctttataaatgaggacggctcattcttcatggacctgaaaaatagaatatcagcatgttctatgagattcctgtgactttcatcagtgggacatacacccagaacaaagcccagtg

SEQ ID NO: 17459 - DNA, 201 bp, Bos taurus
accttctgatctgaatgagaagagcaaatcctgagaagacatgtatacaagcattctgggcagaaaaatgaagagtgcagaggccctgaagcaggagcacgcttagcaagttggaggtcctgccaaagacaagtgcggactgagcagaactagttggagatagcgtgtgggaagagagggctgcagtacaggagcctagag

SEQ ID NO: 17460 - DNA, 201 bp, Bos taurus
caagaggcagagattcttccttattaccagacagaaatttgagaaaagggaaaagtgatagagagcaagagagagcacaggcttagatttggtctgaagttgggtagattaactcatttgttaattcagtgactatttatagagcttctctgtaccaactttagctttggtgattcatcagtgggcaatgaagacgaggtc

SEQ ID NO: 17461 - DNA, 201 bp, Bos taurus
atatacacatagttataccacagatctccagagcttttccatcttacatgactgaaactctatacccattgaacagaaactccggatttttttcctccccgtcagccccttgcaaatattctactgtctgcttctaagagcttatataggacaattttcatagaagaaatagagaaagttatcaaaggacaacttcacaga

SEQ ID NO: 17462 - DNA, 201 bp, Bos taurus
tgtattttattttgtcttcatatgacctcacttgggaggagatccctagattttcttctgagagatgggaaatccttgttgttcaatcgctaagttgtattcgactctttgcgaccccacggactgcaacacaccaggcttccctgtccttcactatctcttggagtttgctcaaactcacgagtcagtgatgccatccaa

SEQ ID NO: 17463 - DNA, 201 bp, Bos taurus
ctgacctcaagtaacctcactcattaatgctactaatacatgatatgaaaacatctgaggaactgagacagtgggcttttatagaaaactatattcagtaaccggacattttcaggaacacatagaacagttatgaaaattattgaccacattctaagccataaactaagccttggtatatgtcaaaaaagcagaattaca

SEQ ID NO: 17464 - DNA, 201 bp, Bos taurus
aaaaatcctaataaatcagagaaaaataattgattttctgctatagtatctgcattttaatgtttcatgatccaaaataaatcacacatttttaattactggatgtgaccttagcattttaatttcttcagtcagtataaaaaggtatgctagctgttatcacactagctttgttgaaatatatttctgcctagaagaatg

SEQ ID NO: 17465 - DNA, 201 bp, Bos taurus
gtattcctggtgcaggatctttgggctgggagtccaaagtggagctcagacctgttgcttcttggagagaacctctatagttgtgcctatcctcccatttgtggattgcttatgcccactggtgagagtcttgactatactgtgtccttctcctggttttgttgtggcttcttctttatgtctttagtcgtggaaagtctt

SEQ ID NO: 17466 - DNA, 201 bp, Bos taurus
aagtgaagagaaagtggattaggaccttcctttcctcttactctgcagtcttggccgagtcaatcattcccacttaatcctccccttttcttctattacccgatgacgatataagttatgaagaactcacaagtaatatatttgaaaaagctttgagtattataaaataacaaatagttattgttcatatgtttatcacat

SEQ ID NO: 17467 - DNA, 201 bp, Bos taurus
atctgccttatggtagatctaatattggccttgtaaagtgtattactggacaggcaagtggtagcagaccttcctgtccaagacggaattcactggaccttaaaaaaacctcagagggcctggtgccccttagttgttctccagtgatcctgaagttgtaaatggagtcctgattccaaatttgctatggaatgtcatggt

SEQ ID NO: 17468 - DNA, 201 bp, Bos taurus
taaataaatttatattaaagttaaaataaatttatattaaaaattaaaaaaattaaaaataaataaataaagctagtacatgttaaactttcttagtaaaagatgctggtgtgaacttgcaggagaaagaggcttttcctcttggcatttctggtagatactggacacatttggtggagactggatacagggttgaggaca

SEQ ID NO: 17469 - DNA, 201 bp, Bos taurus
tttcagataattttggaaagcatgccaggttttgtgtctagaaaatacagaatgtccttagggtattaatctagagagactaagtcagggcatgtagatatggccctgatgacagatgatggcagaaagtctcctgacatctctacagattgctgtcacttttttagtttctgttgtttgctaggtgggttattgttaatc

SEQ ID NO: 17470 - DNA, 201 bp, Bos taurus
cttttgaaaatgacttaaaggttaaaataatactgattgggatagctccataagggagagaaaattcacctttcaaagtattaaaacttttcaaagagctttagctaaattcaagactaagccagagatacaaaatagaagttctctcagcccagttattaccttttgctgatgctttctcggcggtcatgatgtgtatgc

SEQ ID NO: 17471 - DNA, 201 bp, Bos taurus
tatacatttgtgggctttctgcatcactcatgctagcctaaatttcatcagagatgaaatcctagtagatccataggaaaattactcagataaggcactagtgaattgtctaaaacatttagtttctggatataaactaatctacgaccacttttcttgtgatgaaaaggaggcctgtcctgtaagagtggatccaggtac

SEQ ID NO: 17472 - DNA, 201 bp, Bos taurus
gtgtgaaatagaattaaataagctacgggagataatccaagcacaatttttatgacataacataagcatacattttagtgcattgtccttgtgaatcttttactatccaagtatatttttgcttatttcatatgtctatggacagcattaccgaagaagtatctctgaggaatacattatgaagtttaatatacacctaga

SEQ ID NO: 17473 - DNA, 201 bp, Bos taurus
agaggtcaccaccactgcccttttgagttgagactgtgatggtgatgtaaccccactttcttgagactacgcagtagatacgtagggattagaggataaaaggtgggggaataagaggaacttcttatttctgaaaatgtgtttgaccacacgtgaacaaaaatgaatggatactatgttttaaacaaatgtacagaaacc

SEQ ID NO: 17474 - DNA, 201 bp, Bos taurus
tttctcacgggaatgctaaacactcttgcaagtaaaaggcaattccttcttaagtcaagtcttaaccctctatgcttccaatttcatcattattacttttaaagagaatcaaatgcagaatcatggtgattacctctggaataaaaaatcattgggctataactctctttattagagtaatcatttgccaaataaacctct

SEQ ID NO: 17475 - DNA, 201 bp, Bos taurus
tggatcggtctggttcaggccatgcttagaggagatcttcagaatacacaaagttgatcctccacatatcttactactgctgtctcagataatattgactatgtggcctgccttctacttagtgtatccttgaagactctaaccacgtgcaggggatgttccgtggtgaataaaacaccaaaccacaaatcagaaattctg

SEQ ID NO: 17476 - DNA, 201 bp, Bos taurus
actgagggactaacacataccttatcttacatactaaatatgtgattcttccaaaataaaattttcctttagatggtaaagttaaaatggagctaggcccgatggctttaccacagatggactctcttgtagaggtaacacctgttcttcagcactaagcacccagcagtcaaagaatgctctaaaagaaaatgtttgaaa

SEQ ID NO: 17477 - DNA, 201 bp, Bos taurus
gtggtcaggtatgtttatgaagaaaggtgtgagaaaccaagaagcatgtgaaagaaaagaacttctggctatggagtcccagaatcccagagtgaagggttggcagggtacatgcctttaagttgggggctctttgtgtggggctcgagttgctacggtggagagcaaatggcctaactcactgactggttacctctttgg

SEQ ID NO: 17478 - DNA, 201 bp, Bos taurus
tggccaaacacaatgataaccatttgtctgagttgtctcacaaaaggaggttccaataaagaacacagtgctgctgctgtaaactaaccaggaaaatttcagaggggccacaaggaaggacgacacaccaacccatagtatgtcttataaaagtaacctgaagagagcgggggaaaagggaactcccttgcactgttggtg

SEQ ID NO: 17479 - DNA, 201 bp, Bos taurus
gaacgtaataggcctacagatgggcagcaacaagggagcctcccaggcaggcatgaccgggtatggaatgcccaggcagatcatgtaagacgccacgtccagcaacctgtagtgaggacgaaagtgccgcatcgtggtctctatgataaagaagtagttagtcaccttctgaccttctcaaagcctcctgcccctggtttt

SEQ ID NO: 17480 - DNA, 201 bp, Bos taurus
tgaggggaatgtatcctctgaggaggggaggaggagcccccgggggaggagattcagaagtgcacacaggcgcagcttcctaaaatgtcagaggctgaacgaacccagttattacttttaaccagaagccgttagtcagtgagggttttgaaagaatggggaagccccatctgcaattgtaaacaggtcataagggctttt

SEQ ID NO: 17481 - DNA, 201 bp, Bos taurus
agaggtttagagaacataagcaatagagtttttaaaaggggggtttttttttacttggctagtttccaagtcagtatcttattttggccatgtagatgtagttacaattataatattataacttcaatgtatgaaaacaaagtaaagtatgctagtcacttactcaagaataagtgcttcaactcctggtttaaaatttgt

SEQ ID NO: 17482 - DNA, 201 bp, Bos taurus
ccaatgccacccatcatatcaaaatgtcataacaaaatccagtcataaagtaggtagttaacagacctgaaagtctgggcattcttgcctgagctgctctgtgtctttcaccatggaacagatcactggtattagaaatgatgacacagttaaaacatgcaaaacttcgggttctggtaaagaattacttaagattacaga

SEQ ID NO: 17483 - DNA, 201 bp, Bos taurus
tttttttatcagttatctcttgcttcctgcaattctgtgttacttaatatttactaggaaggacagctaattccagtggtaccatgcattgaggcactcatattggggtgataaccaccaaattatctctccagtcactgtgcaacttcccccctgccctggttccctccatctgtggcacttttacaccctcccagtttt

SEQ ID NO: 17484 - DNA, 201 bp, Bos taurus
taatgcataaacataagtctctttattagagaaattgtacatattggtgaatatggtcaatggtcacatctatgggttaattccttaaaaatcagaaccagtaattaggatagattctatactctctgttacatcgtgaagtgtcttgtgtagtcatattctattgttggaatgacagcttgtacaaatttcaagaaaatt

SEQ ID NO: 17485 - DNA, 201 bp, Bos taurus
actacttttgccctgggtcctggtatgcatgagaccttgtatgcatcctccaagaatggatctcgatttcccccagtcctatggtactcctgcgatcaagtcccacgggccttcaaggccaaatgctctgggggctcctgctcgtcataccagacctcccaagctggggtgcctgccatgaccttagcactctactgtcac

SEQ ID NO: 17486 - DNA, 201 bp, Bos taurus
gccttgggagcatagaatcttagccactggaccaccaggaaagtccctctcctgtcttttcttataaggacactaatcccatcataaggacgctaacctcatggtctaattaccttccaaaggccctgcctccaaattctctcaccctggggattaggcttcaactgatgaaactgaagaagctgaagttgaacagttcta

SEQ ID NO: 17487 - DNA, 201 bp, Bos taurus
ggaactactgccttagagtgacgtttggagaaaaacaaaggagggaaatccttctggcattaagtacataagaagggaggaggagtctgcagcctaggtaatgaaaagggaagcagacaagctaaagataaagctggcttgttcacagctttccttaggcttttaccttggttctgacttctatagatttaagccaggcaa

SEQ ID NO: 17488 - DNA, 201 bp, Bos taurus
gaatatttcttgcctttaagtctgtttcagctgagagtggtataggaactccagttttcttgtgatgactgtctgcatggtgtatatatccattcttttacttttagcttctttgtctttttgtatctaagttgtgtgtctcttgtggacagagtatagttgggtctatttttatccagtttgacaatctctgtgtttaac

SEQ ID NO: 17489 - DNA, 201 bp, Bos taurus
tgatgtgcccgtccacgtgccctgcaaatggccatgacatggaactctgtacgtgacaagtagtctgcatactatcgagctgttctccagccccacactgcatttctaacctcctgggatcttttattaatatatgtatttaatagggttttttttttcccacactgtgtaatacttctgatttagcatttttaagttttt

SEQ ID NO: 17490 - DNA, 201 bp, Bos taurus
cattgtaaatcaatcatactccaataaaagctttaaaaaaatcagatactcattaggatataatatataatataatttgataatatctactaaagtagaagatgtgcagatctttctactaataatttctcttttaggtttatatcctagaaaaaattcagcacatatgctcagggatatatgtataaaaatattcattat

SEQ ID NO: 17491 - DNA, 201 bp, Bos taurus
tgtttattgagggcccattatggggctgacgctttgctggggtgggtgtactgaaatgaattaaacttgtgagatgaattaaactgtattgtgaggccagaatatagtgcgtgtggaggtgggggatggcagggggtggcgggggagcgggaagtcatgtgtgattgggaaggggtgaactgaaggcccgggagaggcaca

SEQ ID NO: 17492 - DNA, 201 bp, Bos taurus
tagaaactttaggaatcctttcatcccttagtaaattactgcttaaagttctaaaccaatcaacaattgtttttcaaaaagataaatgcaagaaaaaaattcttcctaattgtctcctatgcctttgagtgaaagtggctttacttgttttagaagagctcattaaggcttgaatagttatcaaaattattctgaaatgtg

SEQ ID NO: 17493 - DNA, 201 bp, Bos taurus
ctttgctcccaactttacattcagtcagcctcacagaaatccactaaacttaataaacgctgcctacaggctctatgttatctttgagtgatatgatttgcgcaaatttttacgtaagagaattccctttccttccaatttctattaggtctgttaatgtgtctaaaacatttcattagatgactgtttctatttttcctt

SEQ ID NO: 17494 - DNA, 201 bp, Bos taurus
attgatggggtctccactcctgagatatatattttgagtttcaggcaaattatgagtcaatggtctctcagacacaacactcactactctctggggagaatacttcagaccccaacagaggattataactttaaataaactcagcctctggaaggatttaatggagcacatgtctctggtcccttgctccttgtaaggagg

SEQ ID NO: 17495 - DNA, 201 bp, Bos taurus
tagtgtgacggttatatttgtgatcatatggaacaaagggtagcacagggaaattcctgagaattctccactaagacattggtggcacttctgttgctttcggaagtgtcctttttctgtcctttggccaagaacatttagtagtgctggtggctttttagcagtgtttgtttctgagtaatagtgattttaaaaagagag

SEQ ID NO: 17496 - DNA, 201 bp, Bos taurus
ctgctggtcagacatgtatctgtaaactagaagagtagagagtacttagggtgctgacttgggcctggctgtgctggcagagaaggggctgtgatcagggaaggctttgtgctcatctctgtgtatggctctacctaacttctgtttttcacttctggctgtgaacctggataggattatatccttttcctattcattctg

SEQ ID NO: 17497 - DNA, 201 bp, Bos taurus
ggtactcaaaaattaacattttcacattatgaaatctgtaagcaattttaatgcccccaaatgtaatcacttaccagctaatatgtcgattaacataactataggtaattcacatacatacctgtgcagctatggggcacagacagacttgcagtttatcaggtactctgaaatgtaaaacaaatatattttgtaagtaaa

SEQ ID NO: 17498 - DNA, 201 bp, Bos taurus
actgctcaaatgagtaaaagaagaccacgtagtgaaagatcttggggataaatccagatagactgcacactgcaaatgtccagtaaaaattatgcaaattgagaaagaaaatccattagatataggttaagattaaataaataaaatccataagaaggaaaatgaagcccagtttgcagagacagcaacaccaaaaccaag

SEQ ID NO: 17499 - DNA, 201 bp, Bos taurus
ccatggcaaatgaaagagcctcttgtgtccatgtataaaactgaaaaaagaaaaagatacaaaccctaaggcctattatactacacagaaccttggtttccaagacttggtgccgaatcttgcagtctaaatccccaaatagctatcttgtaaaaaaaaaaaataataataatctgtataccataaaaagaaaagaaaaag

SEQ ID NO: 17500 - DNA, 201 bp, Bos taurus
atttagaggttctttttcacatagtaagaggtgacacaggcagatttcttcaaaatatgtttgtagatgtagtagctttaaccagaacggggttgtgggcgtgacaggcacccaaagtaccacagaccttcctccagcaaggaggaagcccaagacaaagagaccacaaacaagtcaaaaattgatcaaacaaaataataa

SEQ ID NO: 17501 - DNA, 201 bp, Bos taurus
aatggagtatacagttttaggagttgatgagcctttcctaccagccacaaaatctttgccttaatatgacaaagtcaacttctctgaagaaatctttatcgtttgttaaagaaatttatgcacttgaatctaggtagtatgcaaatgatgaattctcccaagtaacttttaagcaatcaccctcccaaatgggcgtacgcc

SEQ ID NO: 17502 - DNA, 201 bp, Bos taurus
gcaccattcaccttgctgctgcccacagtccagccctcggtcgccgcggctgtccatcggttcccgtgagcttccgaagcaggaccaaagaggtgtccccatggtcggtacaggctctcagcgacatgaggcgaaggagtcaaaagagaaaccgaggcggctgcaaccgctcctgctgcggatgccaatgattccccgggc

SEQ ID NO: 17503 - DNA, 201 bp, Bos taurus
tctgctccacaactattccaaatagaccatgactcaatccctcactagccttcgttatttcattgatcacacaaacttaaaaaaaaatgtgtgtactctgacctatgctcagaggcccacatccaagaattaattttagttacatttgggtttgttatcttcccactgaactagccacataataatattctgcaaagagaa

SEQ ID NO: 17504 - DNA, 201 bp, Bos taurus
gaacttgtggttttgtttcagtggtgatactctgatttttgcataagtttatatttaatagtaagggaatgatgttcaaattttccacgggagaaacttcaacttggttctcctaagtgggctccctctttggcatacttactgaaaaggacgaggctggcgttggtcatccccagattgttggcagccacgcatgtatag

SEQ ID NO: 17505 - DNA, 201 bp, Bos taurus
acatcctgcagtgttcgagatatatggtgcattaaaatatgctgcaacatatatttcaaacactacaggctgttattattgtgggtaagtggaattgaagggttgttttgtttaataaaagtattaatttaaagtaaactctagtaagtcaaaaatgtacattgccatgtttatggtaaccattaaaagaaggtttttaaa

SEQ ID NO: 17506 - DNA, 201 bp, Bos taurus
ctcacaaggcagaagcgtgcggagcagtaagattcttgtgtcccttgtcagttccaaacagttccagatggactgagaaccaggctttttggccaccagcgtgattcttgagtctcagcccacatcttttcctgttcaatccacggggaaagggcaagtgctccttctgcctgttgctttacccattcttcctctggcctc

SEQ ID NO: 17507 - DNA, 201 bp, Bos taurus
ttagaatacagaaaagtgggaaaaagaaatacaacttttcttgaaaaaatataggaaagaggtaatgagggtctaaattagaaaaggtaagaaagcatgactcacacagggtgcaactgattgaatgaaagagacagatggggatgggtcagtaataaataaccctgctttcagggagatcaattacgccatcatcagata

SEQ ID NO: 17508 - DNA, 201 bp, Bos taurus
atgtgtccaatagaagtacaaaattttctggtagcccaaatgaagaaattaactcagccagggtaatgacaggggtttggactgttttatggagtaagacataaaatcatgcctgaataaagtatattaaatgttgccaaaaatacaaaatcttaatctaagtgggttctttattgtggtcagtagacataaaagcaaaca

SEQ ID NO: 17509 - DNA, 201 bp, Bos taurus
acaccaagaaagtagagctattagggtaaatgaacctagctgggccttgatggatgtcaaatgggctcagagaagctgctgaactacccaaactagagaggggcctgtaccaatcagaagcatccttttgctacactagtcagaaattagcaagcaggggaaatgtatttaaccctgccccctctctgtgacgggctgcga

SEQ ID NO: 17510 - DNA, 201 bp, Bos taurus
atcagagggaggcaagctggggtttaatttttttcttctcagaaggaagagattctattgcgtttttaacagcattgttcctctgtgccagccccagtcacatggaaacctatttgggatgcagccaaggggctacgctgtccatgatggaggatggctacaccagagagcaagcaaagattaatcaatccaagacaacat

SEQ ID NO: 17511 - DNA, 201 bp, Bos taurus
caatcatatttctctatagcttgattgggccactgttcactaatgccctgtaatgatcagcttctttgagctgtcatctcatacctgatacaaactgtgaggaacttccctagacccagtttggaaagccagttaaaaacagaaggtggttttctttttctactctagagttttgagtcatgggtggttgccttcccactg

SEQ ID NO: 17512 - DNA, 201 bp, Bos taurus
gtatttgccacacttgtgttcaggagctcagcaagggagcagccaccagtacagaactctctccaccctgtttgttagcaagccagcacccccttattctctgaatggagcctaggcctctccagcccttttgtctgttctggtggttcttccagaatccaagggggcttgtctccttcatataggactcgaggactggga

SEQ ID NO: 17513 - DNA, 201 bp, Bos taurus
ggtgggattcactaccgtaatgattttctgccattccctctctactgtctttttctccccttgcagctctttgagtttttatatttgtttttcttagccataggtaataactaaaagagaacaattgagtcagacattctctgccacagttagaatttcagcacagacatgctttatatatgaatcctggtgaagaggaaa

SEQ ID NO: 17514 - DNA, 201 bp, Bos taurus
cccagctatccagctcaaatagccttcttctcactgtggccacccatactatcaaagctgaagaccatttgcctcccagaaatcaagtgcacatttagcctccaaggggagggcctctggctctgttgtcagtgatatcttgcccagcacttaaatcaggcttcaggtacatcatttaatatattcaataattaccttttt

SEQ ID NO: 17515 - DNA, 201 bp, Bos taurus
ggaatcagtgaactagaatggaccggaatgggggaatttatttcagatgaccattatatctactactgtgggcaagaatctcttagaagaaatggagtcatagtcaacaaaaggcattagtatcccaactttacagataagacaattaaggcttaagccatataaacttttctgaagccaagtggtttctacatggtagaa

SEQ ID NO: 17516 - DNA, 201 bp, Bos taurus
ggcctggagaaagaaacaaataaccaacaatgatttttgtctgttgaggttgttgaagtataattgcaattttttaccagagagtctacagaagtgctgtagaaaggcagaatttggcctatattatctacaggaaagggctatactgcctatgtgaatacagttagcctgaatgataacacaactatagcaactctgctc

SEQ ID NO: 17517 - DNA, 201 bp, Bos taurus
agatggcagagggcaatgatacatttcaaaacaaatagactctaagagagtttatgaaaaaaaaaagtcatagtgggagtgtatggaatggagagacgcctaggggagttgattgttaaccctcaaacgtagcaaaggacagaaaaatgcaatccagtagtctggggaaggccgaaagaagaaaggaaattgcaatgtggg

SEQ ID NO: 17518 - DNA, 201 bp, Bos taurus
ataattgtactaattttaacagttctctgccactcctcatcctcctaactatcttaattccatctattttatctatgagccactgttattatcctccaggtctttcatgacctaataaccccttgataggaatttcacagccaacaatttccatcactctcatgtcatattagtgaaataaaactgtagaaatggtgaggc

SEQ ID NO: 17519 - DNA, 201 bp, Bos taurus
taattaaaaatatgttgctaatgatttcttttctcgtcctcttttggagaaactgcttcacagggctgacctaggttgtgtttctttggtacgcaccaaatttaaatgcagcaagagtgaggaatctctgcattctagttctgggtccctatgtccttctctcacggtcacagacaggatgacaatgttggatgggaatgc

SEQ ID NO: 17520 - DNA, 201 bp, Bos taurus
ctggcctgcaaaactgattgagaagcctagactgagcagggcaccctgtctgggactccagggaagaattcttccctgccttttccagcttctggtggaggaggctggcattgctgggcttggggccccaccactcccctctgtctctgtcttcacactgccttctccgcatgtgtctgttacagctctttgcctttgtct

SEQ ID NO: 17521 - DNA, 201 bp, Bos taurus
cttttttgttttcttttcctattggacattacacctaagtctctacatataaacaaataaatccatgactgcagatcaagtaccaggtctgggattcacaactcaggaatatatgtctcccacgtttctctcatcacagcccctcagtcttccatgtggctctaagattttactgctggaacagagtcaggggagggacaa

SEQ ID NO: 17522 - DNA, 201 bp, Bos taurus
acacaatatgggtagatgaagggaacgaggacattattttaaaattcttaagttgtatgaatggtgtgcagtagtacagcactaattaaagcatggcccaagtctaagactattcaaacacttccctgggcagttatatataaccatctttcagttcagttcagtcgctgagtcatgaccaactctttgcgaccccatgga

SEQ ID NO: 17523 - DNA, 201 bp, Bos taurus
accaggatgccctacgctgaagatgcaaatccctcaatgagctctttttctagcaggtattggcatggaggccatggatgtagtctatcgatcgaatcatctaatttaggaaagaaaaagcaaataagccagtgtactttgaaacttacagttttccagggtagggagaagtaattatgagtccaggtagttgagttaact

SEQ ID NO: 17524 - DNA, 201 bp, Bos taurus
gaagtattaaatatgaattcacaatttaaaagtatatttatacacacacaactgttcaatttggtcatcaaaagaataatgaccataactgattatatgacactaattagaaagtttccattttaatcctagagataaagggataacataaaattaacacacataaaatatatgctctacttagaggtgacttttacatca

SEQ ID NO: 17525 - DNA, 201 bp, Bos taurus
ctctcctgcctccagtttttacaaaagtagactaagacttccataactccagcagtgtgtccaaaaatatgccttagtccttctgattactaacatagtgttctatcttagcacataactaaaggtaagttttcccaccaaccttcttatataaaataaaactttctctcctgtagatggtatgattttcaaattatttat

SEQ ID NO: 17526 - DNA, 201 bp, Bos taurus
ttcatccattccttgacctttgcatttggttagttttcccttaccacatgctgtagctggtctgtattaaaaaagtcacagaatacactgtttaccaagacgtctccaaacccagtgattccagatccactgttggtgctcagcctgctggctcctgggttgtgactctgctctggcatttagcatctgctgttggcactg

SEQ ID NO: 17527 - DNA, 201 bp, Bos taurus
atgggttactctcaccaccaaaagctatcatgcatcattcattcatttatttgttcatcattctgacagatttgatgatagttttactattaaataggccctatggcatgaaagaaatgatatctaaaattgaaccatttaggagggtaggaaggagtgttccagattgaggaaactgcatacaaaggcctgcctatgaga

SEQ ID NO: 17528 - DNA, 201 bp, Bos taurus
tctgggtagtcacatactataattgacatacacaaacagtccacaaatgaagttttatagactttcttctaagggaaatgaataatcatagtttagaacattggaagaagaagaaaaaaaaaagtctacagaatcaaggactattctcttaaattttcctgtagaggtttattattttagttaagaaacactaaaatttga

SEQ ID NO: 17529 - DNA, 201 bp, Bos taurus
gaaatggcaacccactcccatattcttgcttgggaaatcccatggacagaggagtctgacaggctacagtccatggggccactgaagagtcagacacgacctggctactaagcaacaacaacttctaaaatgagagcttcctccctgaccttcattcatgaaagggccccaacccatttgtgactatgtttccaaggagga

SEQ ID NO: 17530 - DNA, 201 bp, Bos taurus
agacatgtgattataagattagactgtataaatataaaatgaaaattgtaatcaagctctagggatgcaagcaaggtaattgaaagtgagaagggacccagtattagaaatcttagttctaccatgcttagttactttgagaaagtgtgtgtgttacactaaagtcttaagaactgtttctcaagcaagactatataataa

SEQ ID NO: 17531 - DNA, 201 bp, Bos taurus
atgacttaaaaacaaatacaagaaaccaccacccctaaaaatatcttcctgttgtcaccatccacctacctttcctattctgccctcattgcattttttcttcttcaacatgttcatcccacccagggaaaaggagaatcaggagacttactttttcttttgatgaaatgtatttgtattcatattcttcattgagtggct

SEQ ID NO: 17532 - DNA, 201 bp, Bos taurus
ccttggctgaggtaactgttgcttcagtttaaagttcttaattttggtgatttaggatcaagtaagcagggacatggggtgtcatcagagttactgagaacagggagaagtgaaaggggttcacctgcttccatgaggcagaagcaacacaatattccagatatggaagactggagttgggcatgaggagtggcctgcata

SEQ ID NO: 17533 - DNA, 201 bp, Bos taurus
cccagaccaggatcaaacccaggtctcctgcattgcaggcagactaccgactgagccaccggcttaaaggatcactaaaattaactatctactacctagtattttgaaactgttcctatttcctggccagtaataccagttcaaggaatctatctcaaggaaacaatcaaagatgcaaagatttacaaagaattgtatcac

SEQ ID NO: 17534 - DNA, 201 bp, Bos taurus
ctgttgtttccatggcatccttggcaactagtgtgcagcccccaaagtgcagagtgggtgccaaaacatacccgatggacatccaaactcgatggacagacgagtctgcgaaggggatgggacatgagcacagcttgaacaatgtagacaactaaggcagggacctttttctcttccctgatgtgtctcttcccagatgtt

SEQ ID NO: 17535 - DNA, 201 bp, Bos taurus
gagatgtttgggtggcaggggacagaggaggaagtggttagagtctcagggctataatggcagcatgggctggggttgtgatctggtttggggggtaaggtggccttccagaagagatgggagctgatgccacgacatccaccaatgtgcattccctcactgccccaaagtctttgagaccttgatctcccaccagagatc

SEQ ID NO: 17536 - DNA, 201 bp, Bos taurus
ggcttagccacacacaggtaataacagtgaatgctgtaggaagtggagagggagagtgcaatctggggaggctccataagatatgttattaggttactatcttgaaatggggaaggtttgagtctcaggaaggaccagagcagggaagtataaggccggtcaggggtactgggtctgctcactgtctaccccagggagtgg

SEQ ID NO: 17537 - DNA, 201 bp, Bos taurus
gccacaggcagaggagcctgggggcctgtactgtcagagtgggcttcactgcaggggtgtccgagatctggctggtgagaagggagatgcaaggggactctgggaccaggcctggggctgagatgcagaggtgaggaaactactggtggcatgctataagggtggggcgcccacattctgctcacagtaccaatgcgcagt

SEQ ID NO: 17538 - DNA, 201 bp, Bos taurus
gctcatcacgagggcttgttgtgcatgcctgtgattgcctctcctgtcctgcttttccattttctgtctagacatccttgcaaacagctgctatgtggcccccccttgggcttaagggtgaacaaacagcagcatgtagtctgccctcgggagtctgaatcctgcgaagtggcccatgtagattttggaagtgggtttggg

SEQ ID NO: 17539 - DNA, 201 bp, Bos taurus
tgttgtagcagaagccctgaggatcaggtcaaagctggctccattccttccaagtgtacactctcccccttcctagcactggcgcgcttgccccagatgagaataatgctggagcaaggagggtggcaggggtagttggcatggattagagtgcaaaccttggcacaggccatagtggtcctagtaggaccagagatctgg

SEQ ID NO: 17540 - DNA, 201 bp, Bos taurus
aaccatggccgccttttggaggcagggcacgtgcaagtcaggtgctgaaaagcgggaagcctcacagacctaacgttattctgcagttctgctgagtcacgatatcttttgttcctgccagagctcatctcagtagaaatagcctcacttatcatttgccaaaagtggcatgcttttaaagattcctgcttttattcaata

SEQ ID NO: 17541 - DNA, 201 bp, Bos taurus
agtggcagattgaaaccacgaggttggtggactggtttcccatgatagcaccagcacacaccccagcctgaactgagtgagtgttgcagcactgatgtgcctcacattgcagctcacactggacggatggctgcgatgaccatggacactatagtgctcagactccaagcagcatctgcgctgagggaggaagccaggcaa

SEQ ID NO: 17542 - DNA, 201 bp, Bos taurus
ccctccaggtgaaaattggggaggacatctagagtacagctttatgaatgggttcgagttctttactcatttacccctcagcttgacaggggcctgggtattctctctctgcattgtgagcctggctcctctctctctcctcatctgcttatttactcaattgaaaacaggttttctgctcagcctttccagttctctctg

SEQ ID NO: 17543 - DNA, 201 bp, Bos taurus
cagaatatagttgaccttaagtgttggatgaataaatgtggaaccttgggaacaccttacactctctctctaataatgagtctcattatcactcaagtctgaaagccttcacacaaagctgtggtgctaattaacattcagcaacagttttgatttcaaaaaagcaatcatgcagcagtttcatccaactcctctcctcac

SEQ ID NO: 17544 - DNA, 201 bp, Bos taurus
gtcctcaccttccctggtcttgatttatcttaaagtctaacccttatgtcttcaactgtgtgtgctttgggttctgttagggctcatcagttggtcccttggagagatcagtgattccgagccaaagtaacaaaccagagggctagaaaaagatacaggaaagctgagtgacacagaatatgtgagtattgtagttgaggg

SEQ ID NO: 17545 - DNA, 201 bp, Bos taurus
ggaaagccattgtggttgaaaatagaggaacaaagggctccattagggcctgagtgggagaaaaggggcaaggagcctcttcctgcctaccaagagaaagacaaaaagaagaaactaaatgatacaagctttctacactcaaggtcaactcagggtaaaatttggtttgtaacaaaacaggtcttaagtttcaattccatc

SEQ ID NO: 17546 - DNA, 201 bp, Bos taurus
cacaaatatttattggatgcttctatggcctcagtataacaagaacttggtgaggaaatggatgaagtatgaaaccgatctctgatatcaaattgcagataatctggccacaaaaggaagataattatgacttaagcttaaaacatattacaccttaattaagtgcagagttatgagtcagagtttaaataatgtgctaat

SEQ ID NO: 17547 - DNA, 201 bp, Bos taurus
gttaagaatccacctgccaatgcagcagacatgggttcagtccctggtcagggaatgtcccacatgccatgaggcaattaagtctgtgggccaaaactactgaaggctgtgtgcctgagagcccatgctcctcagcaagagaagccaccgtgatcagaagcctgcattctgtatgaagagtagaccccactcgccacagtt

SEQ ID NO: 17548 - DNA, 201 bp, Bos taurus
ctcattcactctgcctcttactgatttttgacatctttaaatctcttgaaaaaaagatactctgttcattcatcagcacctctatcatttgttcatgaagacatggcccagttctcttttctctgtttatattctcctgagccgtttgttctcaaccttgtctaaaaagttcagtttcataccatggaatttctctgaagt

SEQ ID NO: 17549 - DNA, 201 bp, Bos taurus
ctgtgcaaaactgtgggatttttacgaatttgttttcacagtctaagctggtgactgttctagtagaatttcgggcacttccatgtcggtacagttcagttcatttccttgtgtatcatgagtgtccaacattcaccctcctcagcttcagacaatttataggacccacattctacagaaaatgtggtaagccaaagacct

SEQ ID NO: 17550 - DNA, 201 bp, Bos taurus
tggtattagggaacctgtctgtgaatccagcagaatttcattaaaagtagagtcagatgttgggatggctaactctcctgcatcattagaggttgtgcagcaaggctggcaataagaataggacccaaccctgggctgcagctgttctaaataaacaacaattcagaaactctgttttcagttcaatcctgggcccccatg

SEQ ID NO: 17551 - DNA, 201 bp, Bos taurus
agagccagagaaattgtggaaaaaagaaaattgtccaggctgtatgagggcatggatgtgtctaatttcttcaccagtgaatctcaggcccctaagatagcacctcaaaattatttgtataaggactgaacaggacattagcatatcctggtgaaagcatctcctcttgtgtattaaattctctaggccttccgtgttcca

SEQ ID NO: 17552 - DNA, 201 bp, Bos taurus
cagagcaacaataaaaacagcaaaaatctccagtataccggtgaagtcttctgggaacaattcactctaggtttaaattctttctctatcatttgttacagtgtgacttggccaagttgcttcccctttctaagtctcacaaaatttgtcctatgagtgagaaaaacatttgtggaaattgttaagaggatttaatgaaca

SEQ ID NO: 17553 - DNA, 201 bp, Bos taurus
tactggagaaggaggtgggctcctaaggggctggggctgtatatgaccatggttaagagcttggagtctgaaatcagacatttatgcatctaattataataaagtatgatcagtcttccaagactggaactccaagatacaagatataaaaaactgtaacaggtggacctacctaatctgagagaccctgaagagtcctct

SEQ ID NO: 17554 - DNA, 201 bp, Bos taurus
gtacactgcctgggggcacgctgcccgagtgcacgccgaagagctaacctccccgaatgccctggtgcttctcaagagctctgggaagcagccagaccactctctgcctttgtcaggtgttctggtaaacagaggcttttaggagaacagtcttggataggtcctggcaaggtgatgatggcattctggccacaagtttct

SEQ ID NO: 17555 - DNA, 201 bp, Bos taurus
gtgtctgaacatcatctcctgtgacaatgtttccaacagcccgcaaggcaggagaaaccactttataatcattatgcctgcaaccataaaaagaaaagatatcttatatccaacagtaacatctgcaaattcctttccttagagctaaaaccagaaaggtacaaggaaccctatcaggatgaggaaatgtttttggtgtat

SEQ ID NO: 17556 - DNA, 201 bp, Bos taurus
gacgccatcccttagaaccataatcgctcactggacagttgggagccacttaggttcttaatctgagcagcagtagggtcagacctatattacgtaaactattgatttgaagactgtagcactgaactgtaggattgattacagagggttaagagtgctagcaggagaccagaaaggatgcagtgaccactgcatggtcat

SEQ ID NO: 17557 - DNA, 201 bp, Bos taurus
ccatctcttcagaagaaaaactggattattgcattctatctcaaggtgttctattttcatatgtgtacaaacatcctcttgaaggttctcagtggtatgcccctaatatttctgtagggaaactcaatatttaatattgtattatgtcttcattaattgaattagctgtaatagggaaataaataaactcatgattagaca

SEQ ID NO: 17558 - DNA, 201 bp, Bos taurus
ctgctctcagctccatcatggtctctgcttccttgagctgacttcctagcacaagcttctttaccctcaacccctccctaagacctggagctaaaaactcaatctctttcctggctagtagtaaagccagatacccaggctgtcctctcctgaacaggatgatagcatgatcagaacacaggcaaatccagaaaaacctaa

SEQ ID NO: 17559 - DNA, 201 bp, Bos taurus
aatgaaaagttcaaatgtctatggtatactttggaaataatgtgcctcataaattaaaatggctcaactgcctgcagaatgaagtgccacaggcctggagaagacccagttccctggaggaggagctggggagtccccatatccagggacccttgggctggctgtgaccagagggccttatttttcatgagtgctttcagt

SEQ ID NO: 17560 - DNA, 201 bp, Bos taurus
atcttccccacccagggatagaacctgggactcccgcattacaggcagattctttaccgtctgacccaccagggactaggcctcaagaaggaaagcctcctcactgaactcctgtccccaggtggcacgtcacagtagttcactgggctcatggtggcactgctgggcccttgactgaaaatcctccatctttagggagga

SEQ ID NO: 17561 - DNA, 201 bp, Bos taurus
ctaaactgtgttgctatgttgaaattaactctgagcacagaagcaggtgctgagggaaagcaggcatcatggcactgctagcgttttcagacacagatgatgaataagatatacaaagttaacctattcaatatgaattttctgaagggataagtataggtagcactttattgcaatgtcccttgcagaagaaaatggctt

SEQ ID NO: 17562 - DNA, 201 bp, Bos taurus
aatgaggctcctcttctgtgaccactgtggactgacggtgaaggcccccagttctggagattctctgctttccactctcaggttccagaggatggtcacgcgcacagcagcccttcctctgcccagccttgttatctgaacctcattgagatgcttctggttcccgccttggggctgctggcctgattcatcctttcccag

SEQ ID NO: 17563 - DNA, 201 bp, Bos taurus
ggcccagaatgcccagtgcctgcagctgctgcatgtaactatatctgggtttgacctgaacatctgcttctgtatccacagaaaacattatttggccccatgtgagttatgagcttttaggaagaacaaagatagaacagagtgaggaaacagaaaacatgacaaaaaccaggcaagagcaggaggtgggaagacacttga

SEQ ID NO: 17564 - DNA, 201 bp, Bos taurus
cccaaacccttggaattttccgagctataagaatcatgagagcatcttttgttgtaatattcggtttttcgtcctcagtttctgaaattgcttcagagccgtaacggtgaagtgggtatcttgttatgtgtaagtccctttcaaccacaactgattttatgttaataaggcaacttttggaaagcacctaaagatgggggg

SEQ ID NO: 17565 - DNA, 201 bp, Bos taurus
tgaattagtttggtaaaatatatgaataaggtttcatgctaagtataaaatttgaaataaattaaaaaggtccaattattcccatgggaaaattagtcacgaatgttgcattgtgtatgttgattgggattattccttgcacaatatgtgacaaatagtggcctttgctgagtttcatttcaaattgttctctataatctg

SEQ ID NO: 17566 - DNA, 201 bp, Bos taurus
ttaatcaccacctcaggacccaaaccaagtctttcaagtcttggaagcatagttgacttggcagtactgttactcctctttgtcttttctacacaaagccgaaagcctgttttctgaggtcactaaataaaaattggccacctattttccttagaagcaaatgcatgactctatttttggatgtgctagagggaaaagggc

SEQ ID NO: 17567 - DNA, 201 bp, Bos taurus
gggtaggctgaagtggggttaaccgttcttggattaagaccagcgttattttcgagtctagacctctgaccgagtttggccccaaaggtgaagtgtgacaagcgtgtgtaagggtccactccagtaggaactctggagactacggcagctttacttttgaggcccctactgcccgtgaggtgcactagggaaagctagcag

SEQ ID NO: 17568 - DNA, 201 bp, Bos taurus
cccaaggtaccttgtctggcctctggttatggccataacagcctacgtcctgggccctttgaggggataagattcttcactggggcatttgaaatatattctgcagcctcattccccttcttgtggccaaatccctaaacttccctcatttattaccctcagtgtcccccttcctaggcctggggacaggacttaccgtta

SEQ ID NO: 17569 - DNA, 201 bp, Bos taurus
agagcccataggaattgagaagaaagtctaacaaaccaataaaaaaataagcaaaaaatgcaaacagaaaataaatacaaatggtcttggaacattgaggaaaaaaaaccctcccttttgcctccttgcagccgagaaagcaacatgggtcaccagcagctccactggagccatctgagaaaattcggccagggttctcgc

SEQ ID NO: 17570 - DNA, 201 bp, Bos taurus
cacactgccccagctgcctcctctcaccagagggctattcacctcctcagagaagacccagagctgaaaagaaaactctgcctgggccaaaaagctctaaacttggcaagagcctcaaaacaacaagaaaaggaaaaggaacagaagcaagcatacctctgggccctgtgagcagtccctcagtccctaagtgctgagtca

SEQ ID NO: 17571 - DNA, 201 bp, Bos taurus
gaactgcggcaaccttctaaaggactctcttgctccagtgaagtcaatcatatcaacacactgcaatcaaaatgttctttaacaagcaaaaacatgatcaacctcctacttaacattttcaatggctctctccaatcctcaggttaaaatccttactatgactctaaaggcccaggatctggcccttatttatgcttccat

SEQ ID NO: 17572 - DNA, 201 bp, Bos taurus
acttccctgctgagaactccctcagtccatggggggaccagagcccatgtatatcaattctcaggtaacaaacagctctcatagcactcaccaggcctctgctgcatctccaccatctgcatcaggctggtccatcactggacattaaataacggcttgggaatacgctgaccagtgagaaggatgcagtcacagagctgg

SEQ ID NO: 17573 - DNA, 201 bp, Bos taurus
ctgtctgcaggctggcgtcaatatttgccaggcgtgctgcaggcagagctgaagcagcgtgctctttagaggctgctctagcaaatggtgaccaaatgatgccatctgggaaaggctttgcttaaccaagtccagagcagcttctgctgtgagcagatcctctgaccaccgataggcgcctgtctcccgccacctccccct

SEQ ID NO: 17574 - DNA, 201 bp, Bos taurus
ctccttctcagcaccttcccctaactggtgcccctctccctccagccactcacaacccagccagtctggaaggagctggaagtcaagcaaacagctggacctgatcagctgcagtggccccagaccagctgatcctcactctctgagctgttgagcgcgtttaggctgcagcgggtggaggtgcggtggaaaaggcctcac

SEQ ID NO: 17575 - DNA, 201 bp, Bos taurus
tttaaagcatgcaagtcagtggcttgtggcatattcatagaactctccaactgtcatcatcatctaacttcagaatatcttcattactccaaaaggaaaccctgtactcattagcagttacttcttcatacccctgaatctccgtcacccctgaaaaacattagtctacattcctgtctctgtggatttgcttattcaatc

SEQ ID NO: 17576 - DNA, 201 bp, Bos taurus
ctcaaaatagaggatgatgaggagggtacaatcaattctcattgaagatcagggctcagtcagcagagccttcgccaaggtggtggccttgagcttatgtcatgtggtgtgaaccagatggaagagggagaggaggcacttctaagcagaagcttgaggttcaaaagaagcagaggtcagggtggctgtcagtgtaacgag

SEQ ID NO: 17577 - DNA, 201 bp, Bos taurus
ttcggtcatggctttggaggtataaacacacccagatgttttaaacttttcccctgttgcatctaatcaccagaaccactgggactcagcggactcgccccgccctgcaaggacatgcagagtctaattaaaagggtagtcttttgtttccctaatagctctcagccctggggagtccagagcatttggtcaacaagacag

SEQ ID NO: 17578 - DNA, 201 bp, Bos taurus
gtttaatgttacagttccccgacagaagaggtgtgtcctaccaggcagggccagagatggaatgccagattttgatcaggaaggaaaggaggattgaggggagtgctcaggttatggcctttataaaggagtttctgcaggaaatacaagacagggcagggtacatagatgacaactagctatttggaatgattttgatgg

SEQ ID NO: 17579 - DNA, 201 bp, Bos taurus
acagcaatgaagaaaagagagatactggggttggcttcatggaagacatagcatttgcaccaaaataagaagactgtatagatttcaaatatcttttaccaaaagaagggcatttcaagtagaaggaagcagcatgagcaagagagagctgataaatatagggcatgagtttttcaatttgaccacactgtagggtacgtg

SEQ ID NO: 17580 - DNA, 201 bp, Bos taurus
cagccatgcccactggtttctgtatctcagttgtgagctggccagaaacttctttccctcacttctccaatctttcctgaccacctttagcctttctcttaactagcttggccagtgtcatagcatggtagcctccgtgtaagtcagacttcttatgtgaaaggtgaaggcttctaaagtgaatgtgccaagagactggaa

SEQ ID NO: 17581 - DNA, 201 bp, Bos taurus
ctgggccaggggttagagaaaccaagatgtcttgccgattgacatgtgatgggctagtagctttatgtctctgagcctgtttccctggctgtcaaatgggtgtgggcccgatggcctcccacacgtcgtaagccagatgggcactagcctcctaggtgtggggagggatagccgtgtgtgctcctcccactcttaacagtg

SEQ ID NO: 17582 - DNA, 201 bp, Bos taurus
aaccgtttgttttcaaaattaagaacttgtcattatggtgccaccctacctctaatattagtatctattcttattatttagaatagattctattctgtgcctttacacaggacctaaatttggataaaaggtaaacataaattacaaaaccttgggcaaactcttctttgaagcttttcatcagcagagtagatggatcat

SEQ ID NO: 17583 - DNA, 201 bp, Bos taurus
ttatataagatctgtggtctcttcaggatggacttgagtttgaagctgaaaattatggaaactggtctaccaatagctttctatttatcagttcaaaatctggatattgagttaacttggaatagtggatatgaatattcaaggcatgagaataagtatggatgtgagtctgtgtgtcatatagagttgcatattgcttta

SEQ ID NO: 17584 - DNA, 201 bp, Bos taurus
aattttgggtggcacttttcattcccttcatttttttattgatactttgttcccgcatcccactcaaatgaggactttttaaatcttgaaataaagccaagtagtcagtttaatttatttttgaaatgacattttgcatatcaaaatactagcatgatgcctgagaaaaagtaggtattcaaggaataaaatcttttcagt

SEQ ID NO: 17585 - DNA, 201 bp, Bos taurus
taccattgctttatcactgaattcacctagacaggaacatggaagccacactcaggttattcccagataataacatggtggcctttgctgctgggcctcttctgcatgaataagaaacttttgcttgagtattatcatagattaaggaacccttagtatcaggctgaggcctgagaagataggatgagcaccacatttcct

SEQ ID NO: 17586 - DNA, 201 bp, Bos taurus
aaaaaataccaaccaaaaactgcattacttattcttttagaaaatcaggcattgaatcttatttttccttctgattttgctgatgtgtttgactttcctcagcaaaaggtaagatatattaaaaatataacatttttttacaatgatctcatatttctggcatatctttaaaaaagtaactcttctattcactcaaagata

SEQ ID NO: 17587 - DNA, 201 bp, Bos taurus
gttcaatattaatttagaggagatgcttgattattgtgtcaggggagggatctgggccaaagaagagacaacagctggtactatttctaatctaactacgcaaaatagactatttttaagaggaagagattgagacacctttatttgtcaaggtcaagtgctgaaaaaatttgtcagttgccatagaggttgatagtatgc

SEQ ID NO: 17588 - DNA, 201 bp, Bos taurus
tcactttatgtgttactgtctggatctgaaaattagaggtacattttattttaaatcattcagcatttcaatctttttatacctattaggatatactggcctttgtaaaatgttaaactcatttcaaatgtgtgatttgatatgaaggaagaaacagacacaaggaaagaggagatttgagcagcattggtttgcgagaaa

SEQ ID NO: 17589 - DNA, 201 bp, Bos taurus
cctcaaaccagctcatgtgaacctaccaatttctgctgtctcacaacctcaccttctacatcagccaacaaccatcctgtggccgatctgaatacagagttatcttaatcacatctgctaaaatgacatagggatacactcactgtttctgaagtaaatgctggtgctgctgttgctgctgctgcctgtaggtttcaatcg

SEQ ID NO: 17590 - DNA, 201 bp, Bos taurus
tcctggatctttaagaatttgccttctcgaacagattcatttcaggagctttctcttcattaaaactgttagatctgaaatggaagctaggaactgggctgtggggaagaagggattttcaccagctccctgggaagtccctctggtttctacattccatctctcagttcattttatgaagctcttaatacagctggtcct

SEQ ID NO: 17591 - DNA, 201 bp, Bos taurus
tcatcaaatgaattgggatctgttcaaaaaataaagttgtatgtccaaaccatggccattgccttcaccatatccatctaataatacatggccaaccagtggtgaaattaatagacccatggtcttcactgttaaaaatgcaaatcacaacacaatagattcctcaggccagattgatctggctgcttctttttccgttca

SEQ ID NO: 17592 - DNA, 201 bp, Bos taurus
tgaggagcccatccataagcaattataatgtagtgggatctgtgctttaacctgggtaaacacaccatcctgcagatgcagaaggagggagcctgagatctgacacatcttgcaaggcattgtcagtccttcatgctctaactctagccttcctggcagtgtctaatccaagaaataattatcttcctgacagtacactat

SEQ ID NO: 17593 - DNA, 201 bp, Bos taurus
aggccaaattgggatgtgacagagactgccctccatctgacatatgtatcactgaaatacactgcaggtcatgctgtgccctgagataatctctcatcccgttcgctgatccttcaaggccctctggaaagaatgatgtccccaccaagcaataaagccctccatgcattaaagccctccatagaataatcctgtttgctg

SEQ ID NO: 17594 - DNA, 201 bp, Bos taurus
ggtgggggcaggccaggtcctgctaggatgggaaatgggagaagtcaaggatatctgccagatggtaggattccattccaagattttacaagggcagggtctcatactgaggaggagcaagatgggccccgagaactaaatacaggcagaggaatcacagcgccagggccaaggtgtggagtcaccatgctgacctggtgc

SEQ ID NO: 17595 - DNA, 201 bp, Bos taurus
caaggtcgatcctgactgctgacccctccagtcacgtggggagttactgagaaacacgtgcagatcatttgagttgtaaagagaggacctatgccattgttgaacagctcttaacattggaagttccttccaggcactggcagaaaaaatgttggtctcttgtaaggatggtgcactcaaatgcctgcagatgcccagcag

SEQ ID NO: 17596 - DNA, 201 bp, Bos taurus
tggttgcatgaagaatgctgtttgtacactgacactgcaagtaccaataacaggaactggaaagaatcaaaattaaaaatttttcacttgagatacacaggggtagagagagtagtgagggtagagagagtaaccacgattctccaggttttacttaatcctcttttgcctagattatcatctgtataaactacatttagt

SEQ ID NO: 17597 - DNA, 201 bp, Bos taurus
ggattgaacccgcatctcctgcactggcagatagattctttaccaccaagccaccatgaactgcatcctcccaaaattcatgttgaagcccaaactcacagtggaacggtacttgcagatggggcccttgggagacaattggttttagatgacttaaagaggctggggtcctcgctgtgagattagtatctttataaaagc

SEQ ID NO: 17598 - DNA, 201 bp, Bos taurus
aataaaacagtaactactcaaacatgaattgtaggaactatgatgaaataaagtgctttaccagaacctttcttacttttgtcctaaaatctggcccttctgattatcaagaaattttatattttctagaacttaacaatattctgcacagacaagggcctgtaatatttacaatagtatttaacacacacaattccatta

SEQ ID NO: 17599 - DNA, 201 bp, Bos taurus
ctcaccaggtcattctctccacctagacatacttttgctctgtctcatgtctgtttccccaggttgggtaataggatcattaaacaactcaggcctgagttccctgcccttatgatgatcacccagtaatcctattacagtcagggtgtttcagacagggcaaaactgcatagccacttgaacttaaacagtgaaggccat

SEQ ID NO: 17600 - DNA, 201 bp, Bos taurus
tatatcacagaaagaatgcagaccatctttaccagttttatgttaaaagaagttggtaggagaaatctgggtttgagacataagatgatgtgtatgtagagtattaaaaagtaagacctagatatagaaatatgaaagaaaaaaacgttgagggaacaggatgtaaaaatgaataatttagatataaaacataaggcatga

SEQ ID NO: 17601 - DNA, 201 bp, Bos taurus
actctacacaaacagactatgtaccgttgaacaacacataatacacagctggacttatggtaaaagaagaaaagttagaaatgatagctgctgataacagtgagaaaactaacattaagaatacatctcctcatgatagtaagatttcacattttataggtccctgatgaagaaagtctcagacaaactgtcctatcttct

SEQ ID NO: 17602 - DNA, 201 bp, Bos taurus
tacagcaaagggctttggttaaatgccctgtttacaacctgtctcccatgcgcagggggtgggggaattctcgcttatgatgattgactaaaccaaacgatgtgaaagcacctgccatgggcctgtcacgtggtacatcacaggaatcaccggttaagcgtctgcttgcttccctctggttcgtgcggcagcagcgtcacg

SEQ ID NO: 17603 - DNA, 201 bp, Bos taurus
tcccaccactctgttcctgctggcctttcaaacttaggccttcttccctacatctgttggcatacgcctaacaggttcatctctatctgtcttttttccacttaggcaactcatatttggccctaaaggctctctttaggcaccactccttctggtagcttccctgaggttgaaccacttcagtgcaaccaaaacatagcc

SEQ ID NO: 17604 - DNA, 201 bp, Bos taurus
gaatggaccttctgatactgaactcagggttgtgttgatttacccatcttgccaccggcagtgctggacaagagtggcctcctacaagtccaaggccttgtctgccatgtttacactggagaagagcaatcgagaacatatactctgagggcagactgcaaagagagagaattggaaaaacgcacaggccacgaccccact

SEQ ID NO: 17605 - DNA, 201 bp, Bos taurus
gtctcgtactgccctctctccatcttccctggaaacatacacagctgcgatgctttctgtaaggatagtggtgtcccagaaggtttaacagagccacctccccaggttctggctggggcggggcaagcccacacattctcagggggctgactgtgtaggaagcagattttaacaaacaggccccaggtggggaggagaggg

SEQ ID NO: 17606 - DNA, 201 bp, Bos taurus
agaaacaacagtcctccaggttcctcagggatagttggtgcccagaagtcaaagagcttctgacactgggaatcacctccttattctcagcacctgtcagcacaggccttctctcagcctgtcagacttattcatccaaatgtccctaatggctgaagagaatgaatatggacaccccacatggaaatgggaataggtgtg

SEQ ID NO: 17607 - DNA, 201 bp, Bos taurus
caggcaacggagtgccgcctgaagagcttcatgggctacagttttataatcaaaggaaaagtggagagggggaaaggcctacttcttcctcattttggaatagacatcgaacttccatcatcaactcctcctccacgttgggcaggggagttttcttgtttctacgtcatcaaactaggactgttgtggtacaatggaaat

SEQ ID NO: 17608 - DNA, 201 bp, Bos taurus
cggttccttataacctgcaaccgggtcaagcgggatcgagtggcagccccagagctgagccaggcaaaagagcagaacgaaggatttcatggtggcttcaaagaggccccggtgtgtcagcaggcaggcagctggaggcgtctggaccaacctaggtgctctgcctggtggagtgtcgaaaggctttatttatatgttgga

SEQ ID NO: 17609 - DNA, 201 bp, Bos taurus
tccttctacatgcctatgcctggcatggtctctgagaccccgaaagagctagttaacattggttgaccagaagctcccagggccaggagcacctgaagtggtaagatagggaattgtgtttgatgggatggaacgtgtgtgtgtgtgatgctcatgagcagcgttccagggcccctgtgctggcgtcagcctgtacaggag

SEQ ID NO: 17610 - DNA, 201 bp, Bos taurus
gtggtcaaccatctgagttcactggcttgtggcagtgggggcaggcagtgagaagcggtccacataagacatttgaaaatagtccaatatgttttgaaaaagagggaaaacccacgtgctaacatttatcccgtggatctggttttcctgaagcagcatattcttcccttgaaacgaagtctacactagactggcttcata

SEQ ID NO: 17611 - DNA, 201 bp, Bos taurus
ctgccatttagccccctctccatgtctccatttcctcacctgtaaatgaggagacactagcgataggaactgtgtcgccctccaagagaatgcggtgacagtgagcgtgggagaagcacttagaagaggacctgaggcgtatatagtcacaaggaagcttctctattctgctatggctatgattgctgcctctgccagcag

SEQ ID NO: 17612 - DNA, 201 bp, Bos taurus
atgcagagtaccctacctcagacgtctctgagccagcctccaagtagctattagagttctccctgagaatgattcccagccactttgatctccacacattcccaatggaactctttctctttctctccacattcctccttctttgttccctagccaatgactagcatggtccctgaaactcctttgctccccagactcaaa

SEQ ID NO: 17613 - DNA, 201 bp, Bos taurus
gcagtgggaggaacgggcttgggttatggcccacggccaccagatggtgctggcattcagcggatagtaccctggctttgctgggagactgcaagagaaccgaagggctcttgaagacggccagtgcaacccctcatcctacagatgagagaaataaggcaaggggagggtgtggggaggatgtcacacagcagtgggggc

SEQ ID NO: 17614 - DNA, 201 bp, Bos taurus
gagatacagtccatagggtctcaaagagttggatacaactgagcacagcacacaacacaagtgaatgcattgtttgagtccctccgcaaacaagaagaaaccttccctgcccctggaagcttatagctagttactgaagaattgaacacaaaggcagtgtagtctcatggtcaatggcttgcactccagagtcagacttgg

SEQ ID NO: 17615 - DNA, 201 bp, Bos taurus
gccagtgccccgggtcaggaagccctggggcttccggccgcttgtatcccacagaccttcaacagcacaagccaggagagatcgccaggacctggccccaaatcggcaaaactaaaaagccatccagcttgtgagctagaatccgaactaaaaataagctagtcgactctcagaggcccggctcctgctgctcctgggtcc

SEQ ID NO: 17616 - DNA, 201 bp, Bos taurus
taggcttggaataaggatagggatctgggacggaatttctcatttaaacagatttctcattaaatggatttctcattttacagatggggcctgttgaaagccagcgtctcccttctgagaagttcaagaaggttcccaagggtgtggcttgaatgacaaagagggaagaggcaggaaggaaaggttgggcctggcaggggc

SEQ ID NO: 17617 - DNA, 201 bp, Bos taurus
aagggcagacccgtgccaacagtgaggggcaaaggttaaaatcccaggcctagaatctaagcaaggaacagagtgaggcgcaacccacatgcaccatcacacctccaaaagagccacttccacccaggagtgactcagaggctttgggcaccttcccctgtgtgggagcacaggtgcggccagatcaggagaatctcccca

SEQ ID NO: 17618 - DNA, 201 bp, Bos taurus
gtctgcgagcagtcgctctcaggttccacggagccctggcgcacaggccgggagaatctgtggccagtgaagaggtcctggaggtggggccccaggggcagctgcccagtcaggtctgcagggggagagaaagaagacagccctgctagccccatttcaattggcccacctggaagccacatcctcccggctcccagcctc

SEQ ID NO: 17619 - DNA, 201 bp, Bos taurus
gagagcatggaatcctaaccacaggaccaccagggaattccctggcctccattgtcataaaatacgtgcctcatatatacactgatggtgcgctaaagctaaagtaatctgtgtaaaggccacaccggacactaagctctggagaaagtatagtgataatttaatatcatctgtaaaatgggtggaacatacccaactccc

SEQ ID NO: 17620 - DNA, 201 bp, Bos taurus
accactgagccaccagggaagccctgtatctttgtagaaaaggtataaaaacttcctgcgctagtcttttcttctgatcttcattcttttgtgaagacttacatgagcatgtaaaaatttaataacatcggtgtgcttttgtcctgttaatgtctttatcacttaactttcagacctggccaggatggaggagaacttttt

SEQ ID NO: 17621 - DNA, 201 bp, Bos taurus
cccccagtttggaaatgagaaaatctcagtatttctagaagcagcactgagtgtgtatgggccataaaaaggcagctgtttaagactgggcacatgtgtgaatactgcaacacaaaatgtacacacacctgagcaattacatcataaatttcacacccaaagatggagcaaagaaacttgatgttggcaagctcaaaggaa

SEQ ID NO: 17622 - DNA, 201 bp, Bos taurus
caaccatctgctttattaggtgttcacaggactcagctttgggccactgttcccttgtcctaatccccccagggctatgtacctgacaactaaggacagctccagtgccccagagttgactgaaatcattcaaactagccaaccttaaacctgcttacctttattccttcctgtgaaaaccataatgaaggctcttgccca

SEQ ID NO: 17623 - DNA, 201 bp, Bos taurus
tattttggggtcggcactgactcactgctgaagtattgggcaactaattccctatggtgagactatttctaactgtgaaaagaggatcttcatagctaccgctgttttacaagaatctcatgagacttggtgtctgtctagaaagtatttttattacacaaagattttgtttcctgcagaagctaagggataaatggttag

SEQ ID NO: 17624 - DNA, 201 bp, Bos taurus
tccattgctaagttatagaaactagtctcagaaaaaaatagttttttcagcctgagtattcaaactttggagttttctggtgaccagtcaacatctaaacagaatttgaaaacatttctatggcattggattcaatagagaaaaacctttgaaacatggagagaaatcaacctcattcaggttgagatctacatagactaa

SEQ ID NO: 17625 - DNA, 201 bp, Bos taurus
gctaagataatgaagtccttgtccttaaccaaggttggctgtcccttgtgccaagtctaaccatccctcaatgaactgcatcctctgcagccacagctaccgctacttcttattgatcgcctctgaaaaggctaccactgtttggcatccagcctgcttacctcctagcctgtggagttcttttcattggctttcttcccc

SEQ ID NO: 17626 - DNA, 201 bp, Bos taurus
aacagattgccaagagtgtggttcatcttttcacacacacaccccgttctcacctccatgttttgcttgttgagttgggttaagatataaagtaatggacaaatctggatggttgcagctgggctgaaagacttgtgatcctcactgcctaaacctataatcagggcttcaaaagcaaccactggaaatgcatctcttctc

SEQ ID NO: 17627 - DNA, 201 bp, Bos taurus
taacttctttcctttccaaacccttctctccttctctgtttcttgtgcctttattgctgtaagccctggcacaggggcatcaggatggatggaggggtggaccttcctggtctgactgcagacctcagtgaaaacacttcactgtttcaccaaaaggtataaggcgtggagaggaggaactcgtttgtagcaccatgtgtt

SEQ ID NO: 17628 - DNA, 201 bp, Bos taurus
ccagcaggaaagcagagcacatgcacctcctcaaagatggtttcaggactttgcaggcggtccagcggttactactccagtgcaggggacacaagctccacccctgatcaaggaacaaagatcctacatgccgtgcaatgtggccaaaagattaaaaaaaaaaagatggctgcaaaggggaaaatctagttttgaggaaga

SEQ ID NO: 17629 - DNA, 201 bp, Bos taurus
ataaatgcataattagtgggacttatattttgatgtatactgaaaacatttcagcatttccagaactttcatactctagtgttctcccctccaaattatacatcagtgatgtctgcaagaccaaaaataatatttggacttgatcaattctgtcaacaaatgaagtatgcaatacttaaatattctgacttcattagagtt

SEQ ID NO: 17630 - DNA, 201 bp, Bos taurus
gaaaggaaagtagccccaattcttcagaacttttctttcatcacaggtgaatcatccaataatgaaagcctgtgtccttggtgcttatggcactttattcattggataaattggcctcaagaagtgtaagatcattgttggtcttaagtaataagaacttgatttccaggtgttgaattgaatttggaataacacttatat

SEQ ID NO: 17631 - DNA, 201 bp, Bos taurus
aagcttcctatctgttaaatataacatggacagaatttctaaggagaggccccacatacaggatctcttttaagtgatcatttctatctggatccacttttcaggtggtcagtatgttactcctacagccaatctgtgaatattagagggagctgagaaaaagtccagagagtccctcagactatgcttgctatccagata

SEQ ID NO: 17632 - DNA, 201 bp, Bos taurus
tctcactcgctctcaatccatggccatttggcttccatccgtattccatggatgttgctctggacaacatcacatctccattactgtccatgctcatagacgttcttcggcctaatttaacctctctgcaacatttgacattgttaaacacttcctttttaagggttctcttcttttggattttctaaacccagattttct

SEQ ID NO: 17633 - DNA, 201 bp, Bos taurus
gcaaggtctgtgagaactagggttgtgtaaatcataatcccatctggccacatgtgagcaagcatgcacagacctgtagagtggcacccctcgcccttcccgactgccccctacctctcaaggcccccttctcatcctactgccacccacaggcacacacacatacacacttacttcacacccgcagactttgcttgcagg

SEQ ID NO: 17634 - DNA, 201 bp, Bos taurus
tgtcagatatgttacatggaacagcacagattcattataagaaaactgttgtcttacagcgtgtttactgccgcttattggtaaagggatagttaaggcaatttcaattcatcctggctaaaaccaaatcatttatcttctgccacttttcccctccaaattgtcttcttccacaccaaaaagtagcccagttcctttgtg

SEQ ID NO: 17635 - DNA, 201 bp, Bos taurus
tattccttatccccatatcaccttacagggctccaacacaagcctgatgcaaagatttacccagacaagccatttttttgttgcttcatttttgatcagataaagttagaaggaaaataaaataactaggttgatgcctgtctacacagtgatttcctgggtgttttataagaattggacttttaggttaaactgagaaca

SEQ ID NO: 17636 - DNA, 201 bp, Bos taurus
gagcaccatgaagcttaagctgagtgtatataccccttctcattatcactgggactaccttttgttgtcaatgggaatcgtggtggttctcctcccaagtttccttctagtaggagagattgtattacataagggaaatattgaaagagaagccaggagatcttatttggtaaatcacaaatttcctatttgggcctctaa

SEQ ID NO: 17637 - DNA, 201 bp, Bos taurus
cactgcccctgcataagcaaggcaatatagctcctttgtctcaggccccccgccgcccctgcttaagcaaggcaacatagctcctttgtctcaggctcccttttttttatcttaatacagaggcctctcctttcacaatcaactaaggtcaataatcagagtgtcatcctaaagaaaagtaattttttttcctttttttct

SEQ ID NO: 17638 - DNA, 201 bp, Bos taurus
tttcatttgagtatctcttgcttaaatactgctctagtttagtttagttttgttttgttttttttttagtactctgtagcatgtatcttatttgctactgcttttcactgttacttgtaggaattctagaaaattatcagtcagtgttccttgtcagtgattcacataatccaagttagccatactagtattctctttttg

SEQ ID NO: 17639 - DNA, 201 bp, Bos taurus
tccacaggtgcctctcggtcccagaaagctgagaaagagccattggaatgctcctgcaaaggaacatgttgtcttcaagaccctgtttgccagaaacacacactcaaagggaacatgaagacaccctttgtctcattttcaccttccaagttttgtgtgctcatctatttaacaaaaactgatgttttcaaactgtggtgc

SEQ ID NO: 17640 - DNA, 201 bp, Bos taurus
gaagttgggaaaattacttattccttgttaccttgtttctttatctttacaactccttgagattattgtttcttggtgtgttcataatgattcattaagacagtacctgaaaaaagcaccttgtacataaaggagggaagaataatactagcactattattattctaatgtgctccccaagttgcatcaaatttaagattc

SEQ ID NO: 17641 - DNA, 201 bp, Bos taurus
cctgaggctggatgctacccatttaaacctccaggggacagaggtcaagcagaggaggccaggtggtgaggactctggtaaattacagcagaatcccatacagcattcaatccccctcaaaagcaaaacagtaacaagacaaaacaaaaacaacaatgtgtactaaataaaacttatcttccattgtctcctgctcacagg

SEQ ID NO: 17642 - DNA, 201 bp, Bos taurus
aaaaagaaccatacaggccaaggaaaacccagagagcaatttcagggactaatagcccacttcccattcagatctgggcctagagtgcggcctggggcaggtcccaccttgcctcccagtgccctgtctttgttctgtgctggtaaaatcagaatgaatgaaagtcaagggcagccagaggactgcgggggctagggggga

SEQ ID NO: 17643 - DNA, 201 bp, Bos taurus
tgctgtcagcttcctcagatgattgattttccagggccagttggcctctatcatctggctatatcacaccatacaatctgtatgtgagtactaatagctgaaagtatgcagaaccaaatacaacatgtacatgttctgatatagtttcatgaccctcctagacatggacgtgctgagatctactttcaggcatttgctgac

SEQ ID NO: 17644 - DNA, 201 bp, Bos taurus
ttttccaggcaaaagtactggagtggggtgccattgccttctctgggtgacagtcctgcttatcaaatatttgttcaatgaatgaatgatctaataatgccgatttctcatcttgtaacttgatgacttgctgtgaccttctatgacctatgtgttcctattaaactgtaccaacagtttccaaatgcaaatcagttgatg

SEQ ID NO: 17645 - DNA, 201 bp, Bos taurus
tcccatggctttccgtttcactcagagtgaaagtcgaagtcccaacggtgtcatttaagactccatcgggtcccaccacctaccggccaaccagtttaaccctcttgctttctcattgccattccagcacaccagccttttcactgcttctccaaagcaacagccattctctgtgtcacaacctttgagatggccccagcc

SEQ ID NO: 17646 - DNA, 201 bp, Bos taurus
acagactaatttcatactgaaccttattctagaattgagtgtctttattttattttattttttttttgaattgagtgtctttataagaggataaactcaggtctaaagagcctgtgtagtttcattgctatgactgaaacttttaatacagagttgtattaacttcactgttttgttttttttttttttaaggccacattt

SEQ ID NO: 17647 - DNA, 201 bp, Bos taurus
tgctgaaaccccccctaaccctggtcctgtcagttcatggtggtggtgagagcactgtaagagtgacaggtctcctgggcttgcttacggcagctctcactggccttacaaatggaattttacatcctcttgcacttacaaacaagaagcaatttttttcactttaataaatcaggctgatggttggttgctgtgaagctt

SEQ ID NO: 17648 - DNA, 201 bp, Bos taurus
acatgtttgactttatttgacataatgtgtgctgcaggcattaataatgccccatttagagaagaataaatagagcttttgagaggttagatacagaaatcaagtcctcttgttttcccttcagtttctccacaggctggggagatgaggcagagctgtgagtgcagtattgataggctgaagcagaggaaaggcaccata

SEQ ID NO: 17649 - DNA, 201 bp, Bos taurus
agggggtagtgtttttgagacaaattttatttgaaatttgtatttgaattaagctttggtcctcctggcaatcaaaactaagagaaggatagtgaatggtgaaagtctattactgcttcttttttttgaacaattagtgtatgctaaactgcatattaataaatttaaaccctagtgtaatattataatatgttgatcact

SEQ ID NO: 17650 - DNA, 201 bp, Bos taurus
aaatttctatttaacacatcatttatgatatttctttgtagttagtttactttgactaatctgcaagagtctctactaagtccttggctaaaaaacacactagttaaggtatattaatacttcaaatatctgttaccctattgcatatattgggttggctaaaaagttcacttgatttttaagtaaaaataaaagacatat

SEQ ID NO: 17651 - DNA, 201 bp, Bos taurus
aggcttgaagtttgcagtggactggtaataaacttaagtagaaatgaaacagtgaaacagctcagtctgagaaatgtggctcaggtaccagaagtaaacagagatactaaggaaacaaagaaggatttcttgctcaagaaggaatcaaacttgactaggaattaggacctgcgaagtaacttcatgccagctagtatgtta

SEQ ID NO: 17652 - DNA, 201 bp, Bos taurus
ccaaacctaaaacatccttttatcacccctctctatcaaaatctttttatcttttttatggaagtttagaagtaacagtaacactatgacttctttcatatgcatccttttaaaaggcttaaaaaatatacttagggatacatgagagaggacaaaagagaaggaaacatagggaaatatagctgatacaatcatacaata

SEQ ID NO: 17653 - DNA, 201 bp, Bos taurus
ggccagcaaagtaatttttcaaaaatgtaaataaggtcattttgctctcccgtttaaattctccagtggcttggtgctgaacttgggataaatttaatactccttatcatgacttatgaggccttacatgatctaaccttgcatgcctagagattttgcttctcattgtaccatcctctccttcatccattaaaatctaca

SEQ ID NO: 17654 - DNA, 201 bp, Bos taurus
gactagtcattgctggaagagcctcacattttagtaatgaatcctttagaaatgtttcacaacatttaatctaaaaggagagaaggcatttggtttgtttgttctcatactggttttccatgaaggttctgctctttgttgaaagtcactgggatatctcttatctgtctcctaactggtattttgctataatgtggtgtg

SEQ ID NO: 17655 - DNA, 201 bp, Bos taurus
ttgcaggtggattctttatagactgactcaccagggaagctgaatgatttgcagatgctagtaaaaattaaaactgagtcacactattttcaatttgcagaggggatcctataactggcagctaagttaaaacaagaaagtctctaggttctatttttatttctctctaggtctgtatcttgctactaaacctgtgatgtt

SEQ ID NO: 17656 - DNA, 201 bp, Bos taurus
actacaggagatacgaatttgggagtcatcagcatagatgataacagtgacgtaagttaacctaggaatgattgtggaaagcaaacagaagagatccaaggactaagtcctgagaaccttaaacatttggagatcaaggagatgagagacaccagcaaaaatgattgaaagattgtgacctaaaagaaaagtaggttgctg

SEQ ID NO: 17657 - DNA, 201 bp, Bos taurus
caggggctgctgtttgataggaatgctgacttgctttgctgctcagatgaaccagaagctaggctctgagcctgcctggcatatcaggccatacttcttgcagatgggcgaatggggcaagtatggaaccagaagatatgctacgtagctgggcaaggcttcaaacttgccttccggcccaggtgggctcatagaataggc

SEQ ID NO: 17658 - DNA, 201 bp, Bos taurus
ctatctagtcaccccaactcccatgctaatttttgtcctataccaatttatcctgtttctttgtatccttagataatctccaatctctcaatttctgcaaaaagtgtgttaaaaatcgtacatagtggttttggatgtattgtttccatctaagagtctgataatttttatttagtatatatactgattggtactaatgag

SEQ ID NO: 17659 - DNA, 201 bp, Bos taurus
aaggtgaatttccattattgaagagttaaaaacatatttataccttaaaaaatctagtgtgttgtggtaaaggatttatataaatccttaacaatatgtgtacccctgtttctgttatactgttaccataaatccaaagtgactattgctgtcctatctttaaataataggaatcctctaaactcttttttccctctccgg

SEQ ID NO: 17660 - DNA, 201 bp, Bos taurus
cgtgttatagctcttagatcagtgttacagctccgtgttacagcacaattttatttagaaaatagcaggccaatacgtcctcaaggtgcgagggcatgtcgacccaaagacgcaaagagaagagagggagtggggagccctggccctttggctcttccttttattatatgtttttcctcccccctgggcctgccctatgta

SEQ ID NO: 17661 - DNA, 201 bp, Bos taurus
gatttttaaagctacatatattttcaaatattggagttttgtgcttatgtttctatgtctctcacctctcttctaaatctctgccaactgctctgcctcactgagtttttctattcatgctagatagtaaaaaaatcgacagcaaagaagcaaagacaccaatcagaaaggacttcagtcacagccctgaagggatctctg

SEQ ID NO: 17662 - DNA, 201 bp, Bos taurus
cactaaactgcccagtttgtcttaccatgtttttgtttagttgctatgttgtatccaactcttttgtgacccctggtggattatagcccatcaagctcctcggtctatggaatttcccaggcaagaatattggagcaggttgctatttccttctccagggggtcttctctacccagggatggaacccacatctcctgtatt

SEQ ID NO: 17663 - DNA, 201 bp, Bos taurus
attcagaattgaaggagagatcaaggctgtaccagctaagcaaaaactaaaggatttcatcaccactaaactggtcctgcaagaaatattaaagggatttatttaagttcaaaggaaatgacattagttaatatgaaaatatatgaaagaaaaaaaataccttattggaaaaggtaaatatatagcaaagttcataaaata

SEQ ID NO: 17664 - DNA, 201 bp, Bos taurus
agtgtgtgtctgtgtgtgagtatgtgtctgctgtgtgtatacatgaaaatagattatgaaagattaccacatgcaattatggaggcccaggagtcccaagatctgcagtcagtgagttgaagacccaggagagttgattacatatccccagtctgggtccaaaggcctaagaaccatgagagctgatgctgcaaattccaa

SEQ ID NO: 17665 - DNA, 201 bp, Bos taurus
gctgctctggggaatgctgttgcttagtctttggggtggcatccagatcgctgtattggcagttaagttctggctctaaccataccttatccttaggtagtttggctccatttcatggggactcagcagcaccttgttgggccagttcctgtaacaagcataagcagctgccatactcagcatactcagcaggtactcatg

SEQ ID NO: 17666 - DNA, 201 bp, Bos taurus
agattcttgagaattgagttatcgtttatcattccagatataaattcactctaaataaaactcaccacaatgttggttttatggatactctgtaaatatttcttagatgcaaaattgaatccatttccgtgatttgtcttcatcattcctgccctagcttagatgtttttgtgagctccatgttagttttctgtctctcta

SEQ ID NO: 17667 - DNA, 201 bp, Bos taurus
gaaatatcctttcctgaaattctttctcacttgaacctgtgtattataattgcatgtctcctatattttattttggccatttttatcttgttcttttctttatctttcagtctgacacaggatttgtacaatgcttagcagtcattcctttaggcttatttctttgtgatttccattcaaaagaaatatggccgcatctct

SEQ ID NO: 17668 - DNA, 201 bp, Bos taurus
gggagagactgactgggggaaactgcctcttgttctgatgggtgggccatgctcagtaattctttaatccaattttctgttgatgggctgggctgagttcgcgccctgttgtttggatgaggccaaactgttgacccacacctcaccagacactcctggacactcacaggcaagtctggctcagtcttccactggcctcca

SEQ ID NO: 17669 - DNA, 201 bp, Bos taurus
ttggcctctctctagagccctaaaggattcttctggtaagcacctggcatgaacagaagcttcatctcactggcaatggtcctaatttaaactgattttctaggcctcactctcttgttctttatgggtttgcatggtacagacagggccccaggaggagaggtggttctgtgaagcctcatactcctttagagtttaaga

SEQ ID NO: 17670 - DNA, 201 bp, Bos taurus
gatcttttgagatttggaactccacttacttctctgtctgacccctcatcacttgtccttcatcctccaccacctggaggcccctccagctgctagtttaatcttggagagcatgatcttaaacccactagcctataagataaaacatgtaaacatttaatatggctattaagacttccaaaggcccattcctaatttttt

SEQ ID NO: 17671 - DNA, 201 bp, Bos taurus
aattttgcatgagctcaataataattgttgtttgaagccataacaatttctctcacttgtataatggaagaaaagtttttttttttctcttaatggaaacgatatagcctggaccctgtaaaggtgcacacaaatattgtgaatactacccacatgctgacagattaacagttcttttaaaagttaccattaaggatccaa

SEQ ID NO: 17672 - DNA, 201 bp, Bos taurus
taagtgtttctccctatctcatctatattatttccaaaatcacttgcttctatcttggaatatgcatatttttgacattagcaaaaactgctttagaggtagattgctactaatatcatatattttaatactgtcaatgtgcttgcttatttttcatgtaccatctgtaaacctatttttgtccaactctgtatttatgct

SEQ ID NO: 17673 - DNA, 201 bp, Bos taurus
caacatatgtgggtcattggttaaatgttgagttaataatggagagaaatgtagattctttgcagagggagatggaggatagaggaaagtgtttttggccaaaggactagagtgaggcaagaccctaatttaagacatgttcaagaggcaaagggtttccagtttgtctgggtcacagagttcctgcagggaagtgcagga

SEQ ID NO: 17674 - DNA, 201 bp, Bos taurus
agttggctgtgtcagactaacaagccagaaccaaggagaaagcatgtctgctggagagacaagcaggacatagggacaggggaggaggaccagacaccaataggtaatagtaactaccctcactgtttcatcaaccacagcagtagagtctttagagagtaggcaacagtttggtgagaaattagcaccaaggaattccaa

SEQ ID NO: 17675 - DNA, 201 bp, Bos taurus
tagagaaggcaatcttgaattttaaatttcgtaaggactggttgggttctttgctctggatgatgggtactttgggttaacagactattacattgatgacgtgcattatttgcctctgttgcactgattaaagggtctctccaaagctattgctggaatgacggtgaatccactattactaactgtatgtgcgagtcttag

SEQ ID NO: 17676 - DNA, 201 bp, Bos taurus
ttctccatctttcctcttgcttctccatgaaatgaatctatctccttgtttaccacggttgctgtgccagtgagctgcactcttgctcttagatttctgctgagtcctattatcactctgaaggaactggctgctttaggagaaaagggaagaaatttctccagtactatgtatctctagcaatagtataaggggagggtc

SEQ ID NO: 17677 - DNA, 201 bp, Bos taurus
gtgtaggccagatgttcctctatggcttgtcatttgcaagccctgcccttggcagctctgtcccagggctttcacacattgcaaagaaaatcagtcacaataaaaactgcctgatgagagactgttgcacactttgaatagagtgtgtgtgcatggtaaatcacttcagttatgtctgtctctttgcgactttatggactg

SEQ ID NO: 17678 - DNA, 201 bp, Bos taurus
ggctacagaggtaatctcaaatcagaggccagaccatctttttctgtcttcctagataaggagagatgggctcatgtatagatgagaggtctcatttgtttctaaatcctcaggaaggcctgcctgctgagaacttcctggggaatgcctgacccctgaaatgcagccaaggtcagtggcatctaggagaatttgctgcag

SEQ ID NO: 17679 - DNA, 201 bp, Bos taurus
caggactacaccttaggagctcatgctggaggaagtcaactgagaaggctgagtcagagagggaagaatagaatcaggagattttgaaggaggagtgcattacagtattaagtgtggctaaaaagataagaaggatgaaggtgaagtgctggggtccagccccagctgatccagggtattcgaaggggagacggcttaggc

SEQ ID NO: 17680 - DNA, 201 bp, Bos taurus
aacaaatggcaatgtttatgattcactgtaagagacaaaagcagaatacataattgctctgattagtaattaaaactattacacaaatgaacaagtactgcagggaacaaggaggaacaccttggttttctagcatagtgaatttatgcacaattctttaaaaaaattattatttcttggtgcaatattaattgtattata

SEQ ID NO: 17681 - DNA, 201 bp, Bos taurus
ttagcagcttagcagcatggttacttagcttttatttgggaagaatataaatgtctttacatttaggcgaaagattcacatacagaagtctttaggtgacactttcttaatgagcagtagcttgtgccaccgtcattcttacctgtctgtgcgtggtctgagtgcatggatgactggtccatgggcatcattggttcctac

SEQ ID NO: 17682 - DNA, 201 bp, Bos taurus
tgtcaccccgactcctggtccctcccctgggggatgacagtgattttagtctgattctctttgtctcttctcctcaactccctatcaagcttttggctggagtttagctcccagatgttagcctccactaactggcaactgattgctccagtgtttttgataatgccttggccacctcattcgaagagttgactcattgga

SEQ ID NO: 17683 - DNA, 201 bp, Bos taurus
gattgaacctgcaccctttgcagtgaaatgtggatttttaaccattgggcctccaggagagtcccatcacaggactcctttaaactgtcatcatgccttagaaagtgaaagtggtagttgcttggccatgtctgactcactgcaaccctgtggactatagcctgccagggtcctctgtccgtgggattctccaggcaagaa

SEQ ID NO: 17684 - DNA, 201 bp, Bos taurus
agtattttaaattgcagtattttgttggacaaaagtcctttgataggttacctgtccccagtattcccttgactactaggattcagatttattaagatactatcctttcctgcatgatgttttagactacttatgaatcaagtcatgctcttatacaacttaggaagttaatgtgcaagtccttttcaaggcatctttggg

SEQ ID NO: 17685 - DNA, 201 bp, Bos taurus
taattacccttgtttgtggccaactgttttcaaattaagatttctacaaagtggcaatagacactacaatcctttgattacagactcatgttcacaaatttattaattcatatataccacttaactgtttaacctgaatgatttattactgctaaagccaggcaaagtgtgagaaaaaaaaacaactgtggacaatttaaa

SEQ ID NO: 17686 - DNA, 201 bp, Bos taurus
gtcacttaccacatggcatataccaaatttaactctaagtgaataatatttgaaatgttaatttgtaatctgcacaagtcttactcaaaccacaggcaccctgtctatttagagcaactatctcctgccaaggtgtccacatgatatgtcccttacatatccctcccatgttttctcctctaatcttaaattgtgttaccc

SEQ ID NO: 17687 - DNA, 201 bp, Bos taurus
ttggagttcagagtgttttaggctgatttgaagagaaggaaatggtctatttgtataagccctaaaggacactccatctcctggataactgtcctagacaaactagcagtatcttttatttcccatcttataacttaaaatgcccacatgcttcaccacacattgggtaagtcttcacaaaattcaaagacacactctgct

SEQ ID NO: 17688 - DNA, 201 bp, Bos taurus
cttttgatccaagaagtagagaagtcaccttatctctcatgtaccaggatgatataattaaaataggacatgtttttgaagtgaggtatttaagggcttcaaagaaggtgtagagtgttagaggatcagcacctgcctacttctcaaatacagttatgaggacacatttatttagcaaagacatccttttgaaaggagaac

SEQ ID NO: 17689 - DNA, 201 bp, Bos taurus
tccaccagttaccactgcagtgtgaactaggaggcccccaccatcacaaatccactctattgctggggtagggacagaagggaaagaatagaaatatcactaaagcaggctctaaaccaatggtaacctataatgtggtcttcacttcactgtccactatttctaaaatgaaattttagttcaggtatattcagaggaggg

SEQ ID NO: 17690 - DNA, 201 bp, Bos taurus
tcagtagtgacttccagaattttcctggttggcaggagcagattcttaaaggggctcataagataaagcttttgcttctctcagaatttcagcatttcttcgagattactccatcccattttcaaggagttctatgccccatctctggccctcccaggacatatcttcaaggttaatgtttaagtgttaattaagcctagc

SEQ ID NO: 17691 - DNA, 201 bp, Bos taurus
aaagcatttaatgaaatatttctcattcaaagcagaattcttttccattgaagactaactgctttagtggtgttttgagatcctaaatagtttcatttagggcagaataaaaattttgaccaatcagtaataaaatcaggactcattttactgcttgtaagagtgaattcttgtcactttaatgtccacatcagaagctca

SEQ ID NO: 17692 - DNA, 201 bp, Bos taurus
ttgtttagataacaccttcggacacgaatgcagtttgagctgtgaggactgcatgaatggaggccgatgccaggaaggaaagagtgggtgttcttgtcccaatggctggggaggcattctttgtaatgaaagtaagtaatactttggagcatgggtggggggtgatgaattctccttttactgctggtgaactactggtga

SEQ ID NO: 17693 - DNA, 201 bp, Bos taurus
ttgccattccctcattaaaagagagtaaaaagagaggcctttaatgccattaaatgtccaaaattaatttattataatcatatttcatattgcctgtctgccagagaggaggaaaacatggattatatttcctgaaccaagatttggtacgcattaactaaaaatatattttacatataaaatttatttaaataataaatg

SEQ ID NO: 17694 - DNA, 201 bp, Bos taurus
atttatgaagtacaggtccctctatgacctagaaaatttcccagtccaaggtatgacaagtgctgataatttctgcattgcaaacaaaactgctgacttatattctagaaataaagcaactgatagtctatgagttatagttacacctttttcctaataatttattgagatatcttttgcaaatacaaattgtacatattt

SEQ ID NO: 17695 - DNA, 201 bp, Bos taurus
gcagagccccagaagcataaggcagttttacatcagtcttttaatgtcttcctgtcaagctacaggatgagaaggggggtggctgggggatcaggaaataggtgcttgtcaagaagaacacaattgaagtcagaaaccagaatcaactattaaaaacaattaaatcagaattttttatgttacaaggaaaatcattcatgc

SEQ ID NO: 17696 - DNA, 201 bp, Bos taurus
ctaagggccccagttgtgttcaggaaaactaactgataatgtacatttccaaggtggctggttatgttcaacaaaacatacaaccaaacaaacaaaaaaaccggcctgatattaaagattttacataagagctcatccttttgataactattttctaaaccactgagaagagctcatccttttgataactattttctaaac

SEQ ID NO: 17697 - DNA, 201 bp, Bos taurus
cctttgggttaaaatataaacatagtcccacttaagaaatgagaaccaaggacaagtcttggcatttgttgagtccttcatagaacaagaaaacacatgaaattttgctataattcaagagccattcttgtcagtgctttcaagggtagaaattaagctatattaaagcttgtcttggcccaattatagaatgaaagtgag

SEQ ID NO: 17698 - DNA, 201 bp, Bos taurus
agccaaaaaaaaaaagaaaaagaaaaaagcaaagtacatgggtagagagctattaggtaggggtctgtggtagtgagaggctgtgccaatcttttgataggttctctttttttccatgaaataggatgcaaagtcattagctgagaacaagtctgggagcatgtgctagagaacctccttaaggacatctttcactgcatt

SEQ ID NO: 17699 - DNA, 201 bp, Bos taurus
ggtttggcagggatgttgtggaagtgatgctgtgtcctcggcacattgcatccagatgcacatggttgtcagtctgtcccattgttggccgtgttaactctgataacttacgcccctgcaaggtacccctttgccttgtgcaatacaagtaatctgtgggaaatatactttgaaattgtgtaaatattttattttttaaga

SEQ ID NO: 17700 - DNA, 201 bp, Bos taurus
gctcactttctcaatgttgactacttctgaaggagtatttattctgagatattctagatctgccaccaaagaagaatcttccttgccagtattactactggaacttctcttccctttgtcaagcatcatatttgtctcttcagccatcacgtgcaggtggactcttcctcgtgtaatttgcaagctcctcagttcaggctc

SEQ ID NO: 17701 - DNA, 201 bp, Bos taurus
atcccatgaagcaaaaagaaaactttccactcttacttctcattatctcatcgtgtgaatcatagatatagtaacacagccctggtttacattatagcaaaatgaaattgtacctgcatattcaaaattttagatatattgttaaattaaatactcaaaaataggtttcacctcacaaagcctgcaattttcttgcagaga

SEQ ID NO: 17702 - DNA, 201 bp, Bos taurus
atggcttaatttcctaaatgaaaactcattgattttgtagccagaaaaaataaactaagctagtattgaaaaggaaactgctactcccttttcttctcaggaagctttctgtatttaggaagaccatgagcacaattaaaagcctttctctcagaaaatttaactattttgtcaggagcttgttttggtatatttctgtca

SEQ ID NO: 17703 - DNA, 201 bp, Bos taurus
ttatcataaaatcattcaaataacttgccaattttaaatgttacaaagtgctatatagtaaagtgcttgaaagcatgttattaaggacatttatgaagaaaagatagtgtaactaggttctgaaaatgagtagcagtaattatttggaggtatgagagagcatcagagaagacaatggcaccccactccagtactcttgcc

SEQ ID NO: 17704 - DNA, 201 bp, Bos taurus
tggaggccaagttgggaacttccatagcagtaatgaagttaagaaacatgaatcttccccacatatatccataatgaaactacctgcctttgttcaccagtatggtaccagaagagacttgataaaatggatttaaatatgatgcagaatcttacaatgtaatatcccagattcacatgaaaattgcttatccttataaga

SEQ ID NO: 17705 - DNA, 201 bp, Bos taurus
taccacagactaagtgacttaaacaaccaaaatttattttcttacaattccagaaggtagaagtctgagatcaaggtttggtttcttctgaggcctctttccttgacacacagatggctgtcttctccatctatcattacgtggtcctttctctaagtgtgtctgtgctggtctcctcttcttataaggacaccaggtgta

SEQ ID NO: 17706 - DNA, 201 bp, Bos taurus
ataaaaaatcctttaaatgcaattattacaatgttaaattcctgtgcctatgaacccctctgcagaattcactcataaacaaagtcagtttgagagctaacgtggaactcagaaattttcaagaaacacagaaacattagaggggcatggctaatttttgtctggaagaattcagcatgaattaaaatgtaacataaattc

SEQ ID NO: 17707 - DNA, 201 bp, Bos taurus
ttcagattggcttctttcacttagtaatacacatttgaattccactcatgtcttttcatggcacgatagcatctttctttttagcacagaatactattcattgcctgagttaccacagtcacaaaataccttttgatcccgtgataatatttatgtatttactttttgctcattcactgcctaatttaaattaacaagtat

SEQ ID NO: 17708 - DNA, 201 bp, Bos taurus
atcaaataatagtcgtaagaactagaaaattattttaactggatcagagtactacagttttctttttgagtagcacttccatcaataattttatttgcttttaatagaagctcaaaaactgtcagatataccttctataatatgcagcagcatttgaagactcctttcatttttcactgagatattttcaattaaaagtca

SEQ ID NO: 17709 - DNA, 201 bp, Bos taurus
tactacaagacaaaagtctatcttcatatcattctttccctggtgggtaacaatatctgacaaaggaatatgctggatatacatctcaaaaataatcatagagtagaagttactatctctcatcccaaagaactctccatatataaagagtaatttccatacaaattcccatgaaagtgaaaaatactgtattgctgtggc

SEQ ID NO: 17710 - DNA, 201 bp, Bos taurus
tgaattgttaacacattcttaaaattacatgcttttttatttgtcagaatcaaacttttgtaaataactaggccccaagataaagtcctacacaattctcagccttggattaataggccacacatacttgaaattaagtgtcaagtctatatgcttattacctagtaaactttttagaaggtgattctcatattactgtgc

SEQ ID NO: 17711 - DNA, 201 bp, Bos taurus
aatctctgaagtgataggctattacttttgccatatttgactcaaagtgagtcactaggtccagcccacactgaaggacaatatttaaataagggcatgaatattagaaagtgtgaatcctcagagactattttatatactgctttctatgcttctttatgcatttcatccaatctcagaggtaaccactaccctgaaatt

SEQ ID NO: 17712 - DNA, 201 bp, Bos taurus
gccttagaaagtagaatcataagttagccgtaattttcatggaacttaacaaccttagaaaacactcttttaatgtcttttctcgtttccccctattcttctctatagcttctgtatttttatactagaattctaattttgtcctttttgaataaccattttataataattatatctccctcttcccatttgtaaaatctc

SEQ ID NO: 17713 - DNA, 201 bp, Bos taurus
tttgggttcccttaccctcctgctctctacccaggggccccttcctattaaaatctcttgctttgtcaacatgtgtgttgacaaattcatttctgaatgtcagataagagcccaatcttaggccccagaaggggtcccctttcctgcaacattattatatttgttatggtgatatgtgatgagtgatttttgatgttactg

SEQ ID NO: 17714 - DNA, 201 bp, Bos taurus
tcaacagaataggaattatattacagaataaataaatattttttaaaatatcaataaatatctagtcatcaataaaatatgaaaggcatagaaaatttcaaagtgacatcagtaaaataatggaataggaggttctagtcctcaactctccacaaaaatactgatttcgataattactcacaaacaagagttactttatgg

SEQ ID NO: 17715 - DNA, 201 bp, Bos taurus
cccacagactgaagcatgctgggcttccctgtccatcaacaactttatttatttataaataaaacaaaaaatgcttcaaaatattagaataggccatgcagtcacttgcttctttttatcctggcatccacaacaaaaatacatttcttacaagggtttctttagtttctgttatacccaatactgtaaaatacttaataa

SEQ ID NO: 17716 - DNA, 201 bp, Bos taurus
taagttgtcagttttgtccaccaaataaaacataattctcaacttttatgttgcacattttttttcagttgacatgtataaccctaaagtgtgggaaagtgaatgcctttgagattctgaatcagtgggaaatgggacctaagggataaatgcttctccctttaatcttttgtataaacaccttgaaatgaatttcataaa

SEQ ID NO: 17717 - DNA, 201 bp, Bos taurus
ggttatttttttcaaataaattgaaacagtaatttacacacctttgttagagtattcattgttaattttctattcagagaagtattctgattctttctaattctctagtggcatattcagcacagagggaaaaatgacaagagtatagactcattctctgtacagttatcttttcctgcaatttctcagtgtagctttgac

SEQ ID NO: 17718 - DNA, 201 bp, Bos taurus
gcctttgagaattattttaaaaactatttctggtatctttctaaaaaaatgtcagcgatatcaccattggctggcagaatgtgttgtcatccacatatcattggggagtaatagcttctcactcaaagacttcaacctaagtgcatattcagaaagactcagggtcccaactttacagtattttttccagttgacaatttt

SEQ ID NO: 17719 - DNA, 201 bp, Bos taurus
tgatcaactcaatatccaattttttcagtctcaaattccaccctttgcattagttaaagtaaatttgtaaaactgaagcatcagtacatacatagagatgtatacaaattataagcatacagctcaaaaatatttttacaaaataaatttcacaagatggaataattcacaaatttgtgtgtcagcctgaaagagaagcat

SEQ ID NO: 17720 - DNA, 201 bp, Bos taurus
taaattctttataaatattttgacgaacataatgcttgtttaaataatagcaaaaatactctgtaatacttaaatgtttcaatgtctttttacaagatcacacagcttgataagtgcccactgccaagatgagtgcccattgccatgctatgatgatacatataaattaatttattgaagagctaacctctgacttagtac

SEQ ID NO: 17721 - DNA, 201 bp, Bos taurus
tgggtttaaaccatgcaatcttcattcctgaattgaaatgaaaatggagcactgcaatctgcagggaagtgaaggaatgctcatagttcattaaataatgcgagtagtaatgaggtttacacaaatcaaacagtgtgttaggtaattgtaatgttgctttgtggtgaaccacctgtcaggaagcacttctagccgaaggct

SEQ ID NO: 17722 - DNA, 201 bp, Bos taurus
agtcaaatattcatgatgcacttttaccattgatgcagttttaattttgacattaggtgattttttttttgctgcatgcattagtaagaatttttccacagaagaatggttggcccttgtgcagctcattaatgtcagtgcttaaaacaaaatgaaagggtaggaactttatcatgttttccgtttgtgatattttccttg

SEQ ID NO: 17723 - DNA, 201 bp, Bos taurus
aatgaccatgatatttcatgtcattactctgtttacttattctgtcaaatgataatgtctaccatcttaaattgggcttttgtttgcttgtttgtttcttcttttacagtcttatattgttaatgtacagttatatttttaaaaagcataacaagtatgtatatggagaaagaagagtggagttgtgtatatagcaaggta

SEQ ID NO: 17724 - DNA, 201 bp, Bos taurus
tttgtgctttatcaaaaatattgcacaataaattccttttgtaaaattactcaaaagtagcatgaaatcagcttcagctaatctccaaaatatatgctaaatgtttattttgtgttaagtgaattcatgttagtctcaccagtaaaatgaaacactttccaaggaagaaaattttatcaatagatcttccaaaatgaaaca

SEQ ID NO: 17725 - DNA, 201 bp, Bos taurus
tacttctcagtaaattttatacaatcactgccttcagatgactgcttcaggaataacaaaaagcaattgaaactaaaacctcagtactaggagtggaactgtattttgtattatgggttttgggggtattgacctttggtttattttcttgaaatatacttaccgtaaggaagtatgactctttatttgaattgtctttca

SEQ ID NO: 17726 - DNA, 201 bp, Bos taurus
aattggaagtcattgcctctgaaatgatttctaaccttaggtcaacagtttcatacagtctgcttgctggtgggtatgtcttagttgcctgattaaactacattacctagatacaccttggaagtgactgaacacttaaccctctggtgtttaaattgttttgcagaataatggactataaataaatatagccattattat

SEQ ID NO: 17727 - DNA, 201 bp, Bos taurus
gactgtggcgatgcagtattgctggctgtgtctattgtaagaagcttttaggactatttaggctttctgaaatttgttcttaccttcctacagagtctgagagaaatagctggagtgatcctgattgaaggccacaggccccacgtttgccaggatccttttgaagttttaaagttttctgtgatacagtgagatgcttcc

SEQ ID NO: 17728 - DNA, 201 bp, Bos taurus
aggcaaatataaagaaatgaacagcctcccaaggagaagtattctaactagactgaccataaaattaatcctccaaaccaaaatacttctgaaaatggaaaaggctattattagtaattacatcaggaccacatgcataatgctggacgttcccaggcaaaacaagatgtatgctctctgtgcctcaacttccattgctcc

SEQ ID NO: 17729 - DNA, 201 bp, Bos taurus
ttccagatttcaaatctatttttcatgctgcttgtcatatagggctgacatgtgtcacaggatgctgctacatgctgaagtgatgcataaccagacaaaattttcaaagaataatacattttaaatgcctgtttagtttgatgtactcagaaaattgccccaaaaatcaacatttatgatagtaatataaagagaacaaag

SEQ ID NO: 17730 - DNA, 201 bp, Bos taurus
cctcaaagtcctacctcaaatattcattcatccttttaaagagtttttcaggagcgaaatccagtagctcgtctctggctgaggagaaaatagaaaatgatttgacttgttttactcatactactatctctgtacacttcatcacttaaatcaaaaacttcccatgtgtatttctcaggctaaaatataaaagttgtaggt

SEQ ID NO: 17731 - DNA, 201 bp, Bos taurus
cctgacatgtaagcctgggcaggcaggaaggttgtgatgggggaaagtggagggaagacagaatctttgatgtgtggagctccaagaatgatatggtgctcaaagcacaagagactagaccttgctttccagggtagagcccaagggtagaaacctctgccccagtgtagagaggcaatggctgaatgagcccactgggac

SEQ ID NO: 17732 - DNA, 201 bp, Bos taurus
caactattccactgaacctggaaggcccagtgatagtaattctactggggataatctgactcacccttgtctagaattcagaagctagtaactcatcagagcaggaagccctaccatgctgtggcatccacatctctgctttgctttcttgttctctgctcattaatgcttaggcaggaactcttgtgaagcaaataaaaa

SEQ ID NO: 17733 - DNA, 201 bp, Bos taurus
caaaggtgttgccaggaaaaaaatggaatgtgaaattagaactcaactggcagctgtctaaaaaaaatatactttaaaaaaaaaaggtggatttcagagtatactgaaaagcaatatgaagacaggcctcttgtttgaaatctgataacatgaaattgaagatgacaaaaagtatttttaatctacatttttctattatac

SEQ ID NO: 17734 - DNA, 201 bp, Bos taurus
ttacttacatgttcaaacataacaatccagcacacccagacaagcacagcccagagtttcacaacattaataccacatccagacctttaaattaataaaaactgtactttctaagacaagaatcagacctgccaacaattttcatgtaaaagtatgtaataaacataatctttattaaatgatttataagaatcgaggaac

SEQ ID NO: 17735 - DNA, 201 bp, Bos taurus
gccatgataagtgcctggggctcctgaaattccacctggtttggaacaggattttccccaggacctgggaaagcagaaagcctacagacaatgctgagacatcctgacctgactaaatgagctaaagggattcaaacccagaatttccctggtgagcctgtggttaaaactctgtgctccacgttaaggcagctaaaatcc

SEQ ID NO: 17736 - DNA, 201 bp, Bos taurus
acataaaaattttgaatctctatgttgcacacctgaaactaatatgaagttagtaagatttttctgggtggttggttttttgtgtatttttaaaaccatagtaagattggaagaatcgaaagaaagtataagtaaaattagccaaatcatccttttagtaagtgtatatttcatctgaagaatgaaagaaaatgcatatag

SEQ ID NO: 17737 - DNA, 201 bp, Bos taurus
gaagaaagaggcatgaacaagggtgaggaggctgtcactgctttgatggacagaactcaatattattccattcaaaccaaaccaaaccaaagcctgtctgcgagaagagactcataaagtcatgggattttgatgatctcctactttacttgtccttaacactgaggaaacacaagagaggacctgccattaggaaaccct

SEQ ID NO: 17738 - DNA, 201 bp, Bos taurus
gaaggtttttttttttctttccttaaatagccattgagaaactccagacacatttttctgaaagaaaatatgcactgactgtcttcataatattcaggggaaaacttctatgaattaatgcagtgataaatattacagatatagcctctggatatatagtaacatggtgcttctaattaggatgcaggaagactctcgaat

SEQ ID NO: 17739 - DNA, 201 bp, Bos taurus
taagtcccttctctatgtctgtgtctctattcccatcctgaaactaggatcatctgtaccatttttctagactccacatgcttgtattaatataccactgtttttttctttatgacttacttcactctgtatgacagactccaggtccattcatgtctctacaaatgacccagtttcattcctttttgtggctaatattct

SEQ ID NO: 17740 - DNA, 201 bp, Bos taurus
atttaaattgaaatagggaagtgccaaagctagcaggacaatccacactcacatgctctctggcttcctcagccaatgaagatcagatgggaagggaggacagggagcagaaaaactgtgggggtgggaagggcagaggtctaacagtctctagcctaaggttacggaacatctggacaggtaagaagacatctcagagtg

SEQ ID NO: 17741 - DNA, 201 bp, Bos taurus
tcatcttcagtacgtcacttacctagtctgggcccaggaatcctgtaacacagttttaatcagacttgtttatatagtcagggtcccacacccagggttgcacacaccctaggatggccctgccctacatagaacagctgtcaaagtggagtgtctgatggctctgggagcccaggctgcccaacccttctgagacaaagt

SEQ ID NO: 17742 - DNA, 201 bp, Bos taurus
ttgaatgatagagtgaatgtgagtagtaaccctgatgttttcttgtgctaagctgtgactacagacatttacatatatatagaaacattcaagcttaaaagtgtggccttgcactgtgcagataaaaaaacaaaaaccaacatgggcttctgtgtccctgctgggatgagtgactgagatctggggcaggtgctctgagcc

SEQ ID NO: 17743 - DNA, 201 bp, Bos taurus
gaatttgatcaaaggcaacaattctcccttttgctacagactattaacaaacaccttacagggaggtataaactccctgactgctttccaagttctcacacatactctcatttgctcatcacaacagcacacacaggacaagatcctcattttaagaaagtggaaataaaaacacaaatgggatgaatgacgttactatgt

SEQ ID NO: 17744 - DNA, 201 bp, Bos taurus
agcctctgctcaaagcagtgaagacccagcacaaccaaaaataaaaaaagttttgcatgctcctagtattgtcatagctgcaatgcatgagataggccccagtttttacgtatctgttaaggggtgaattgtgctcccccaaatagaggtaccaaggtaaagtgaagtcattgagatgggccctagtcctatatgactggt

SEQ ID NO: 17745 - DNA, 201 bp, Bos taurus
tagaaaacattggttttctctgtttttaatgttttgtgcctctacactagatttatgttttgtggttaccatgcagtttatataaaatgtcttggtaaaagagtcctttttctgctgatggcatcttatgttcgtttatctatatgagttctatcctttccctccttcccctttgtgtcttgtctcaaattatttcttttc

SEQ ID NO: 17746 - DNA, 201 bp, Bos taurus
acctctgcctgcatcctcaaaagtatgataatgtgttaactgtgtttatgcttctgttaaataaaattattaaactgtgaactgaaatacatccattttacttacaagttctatgcaaaatagcctaaaacagagagaaaagggcttttactagaatgtagtactatcgatgagcatgtaatagcaatgggcctgcctaca

SEQ ID NO: 17747 - DNA, 201 bp, Bos taurus
taaaagatgcatgcaataaaatctgtgctagttattttgttcatatcctgagagagatgttactcagacttgctgattggtatatgtttggaggtttgaaatattcacttacctgctttttgtcattagctggtttttttttttctagatgcattttatggttctccatctttaccatatgttaaatggatataatgcttg

SEQ ID NO: 17748 - DNA, 201 bp, Bos taurus
ccagactaggggctaatcaagcccaccagacagtccatatagtcaaccaacacaacagaagtacccacatagccctcttaggagaaacttttagagcatatagcatgggtaatgagaggaagagactatgcgaggatgcattgcatatttcctacagaaggccacttttccaagaccaagaaaggtaactaacttaccaca

SEQ ID NO: 17749 - DNA, 201 bp, Bos taurus
acactttagtatggtaagcttcactgtagagaggtttggttacttactataatacccactctgagttgtgcatagtatgcaccatacacattgtgtaactttaaaactgtctctagggcgtttgtacctttggaaattaagtgaaataatcagttcctgtcacatgaaaaattagatactgttcttacatgatttaacttc

SEQ ID NO: 17750 - DNA, 201 bp, Bos taurus
agagaagaggaagtgaagcagaaggaacaaaagaatgaggacagcaaaagtaggattacactaaaacctcgtttgtggctttcttccaaatatttggccattcctgtctcctttgcagactcatctttatctgcctgtcaattacatgttcatgttcctcagcacttcattctggggcctctttttctctctctctcccct

SEQ ID NO: 17751 - DNA, 201 bp, Bos taurus
agctgccccacgcccagccccctgacagggtgccctcctgcgcctgccgcagctctgcccactgtggctgcagcccccaggtctgctccatctctccctcgtcctgccttcgaggggacggccttctgtgcacaagtgaggtcctgatggctggggcccctactgtccagatgagacccggtttctatcaggcgagggtgc

SEQ ID NO: 17752 - DNA, 201 bp, Bos taurus
ggaaagtcacaaatgaccctggatgcccatgtgaagactgcagcaaagttcaaactagctcacagagttgtagattctggtaatcattatcttactgctacccgccccctccaccccgttgtcccctgggagaaagcctatgtgtggtagaagagaatttagttaaataggaaaaagtaacaatgaaaaatgagaggggag

SEQ ID NO: 17753 - DNA, 201 bp, Bos taurus
atatgagacaaggctgtgccaaagaggccactggggagagtacaaaagtagatggagctgagtgtacacctacagaatgatttcatagacatgaacaggagcccctaacaaaataatacctctagtactcttgcttcctgccagcaaccttagctggggtaaaagcatgtgtcctgtagtatgaaggtaaccagtctgagc

SEQ ID NO: 17754 - DNA, 201 bp, Bos taurus
ttcattgcagggctgctgtaggagggcctgagcatcgtgcgtcggttcctccatcactgagggcagcagggctctgtgagacaggcctctcctcatctggggacatccaactgacttttttgcgtcttcatggctaataaatggttagtgacagggaggcctggcgtgctgcgattcatggggttgcaaagagtcagatat

SEQ ID NO: 17755 - DNA, 201 bp, Bos taurus
acagaaggttagttcatctttacattctatacatcataataacttaacttctaaagggatcatagtagtgtttgttgaaccaacagatgtagtagatgtgggatggttttcagcctgaggttcatatgccctgaagagccctcctcccagtctaaagggaaataaaagactgtgtggacttgctgctgggactttcctggg

SEQ ID NO: 17756 - DNA, 201 bp, Bos taurus
atgcaactccaacatatgcaaacaatgcttcccatgtccaattctaaaataattttaacttcttagttgacttactatttccatagacttttcatcaatataatgttaatgtaatcagataataggtactcactcaaattgagaaccttaaattatttagtgatttggtaggcatagaaaatgacacataattgctttgaa

SEQ ID NO: 17757 - DNA, 201 bp, Bos taurus
ttgtcatctactagacaacccagagctggtgctggcgtagcatttcactgcgaagaaaaccgccacttacagaaagaagtacatggaaactcatcattatatattctaaacttttatgatgcttttcttctgagcttttaaaattctgctgcataggtatcattttcctgtctatgaagatagaggaactgagccataggt

SEQ ID NO: 17758 - DNA, 201 bp, Bos taurus
atttacagcttcacagtcgagactctgtacccagtgggaagtggtgtcattaggatgtgcagacagaggaagaatgtcctgagaattttcagggacagtcggcctcgtgtgatgtgtgttaccacacgacacgcttcacatacatgaggcaggttcgtcgcgtggtccaatctgtctgttctgcccccggtccttgccttc

SEQ ID NO: 17759 - DNA, 201 bp, Bos taurus
ctttctcctgctgtcattatacctaggctaaccactgaaacatatgggtccacgtcctcccagacatatacattggtgtggtaaaggacctgcgggccaacgcaggagatgtaagaaacatatgggtccacatcctcccagacatatacattggtgtggtaaaggacctgcaggccaacgcaggagatgtaagagatgtgg

SEQ ID NO: 17760 - DNA, 201 bp, Bos taurus
tcaaacatgcacaggagagagtatagttcatgaacttttatttacacatcacagactatcaagatttttgcatacgtgctttattgatggttttctgtgaagtatttcaagcaccacacgtcacacacaccatagtgtaccctaaaagtatgggtatattgctgcataattaaaatgcattatcacacctaacaacactaa

SEQ ID NO: 17761 - DNA, 201 bp, Bos taurus
caagcaaaggcctaagcatgaggactggccagctggacaaagggatatggccaggcagcaacctggtgggaaccaaggatgaaggcctctgtgacagatataggttctaaaatcagcaaatctcaagtgacccctgttggcagatgaggtctaggcatagtcaggatggctttgagactggcagaggccaagcctgtaggt

SEQ ID NO: 17762 - DNA, 201 bp, Bos taurus
accaggtagaaaagttattactagaagggtcctagggaccaaaagctggaactttgactgggatactacaccataactccattggctcagaaaggccaagagagcatagagtctgaattcctcagcttttatggactcccatctagacatgagagaagagttttgactgtctattaaaaaactcaagatagcaagtccaaa

SEQ ID NO: 17763 - DNA, 201 bp, Bos taurus
ttttttaatgtttaaaacacacaaaattctcagaattcccgtggaacaggagtaatagagaagggatgctatcttattttaaagtagtaatcattcaaatgacttacctgtgatcatgttgttgtttagttgctaagttgtgttcaactcttgcaaccccatggactgtagctcaccaggctcctccatccacgggatttc

SEQ ID NO: 17764 - DNA, 201 bp, Bos taurus
agtttattctcttatagatcctgaggccagaagttcaaaaatcaatatcattgggtcaaaatcaaggtgtcacagggccacacttcctctggaggctccaaaaggaaatccttacctcttcccacttctggtggctataggtatcctttggcttgtggcctcttcactcagtctatctctctgtcttcatatgttctcctt

SEQ ID NO: 17765 - DNA, 201 bp, Bos taurus
cttaatggtcatcacatcttttgctccattaaattcctcatttaaaacattttgctacagatgacttaggttttcccctattttttgccttctttctgtccgtggggctcatggatgaataagtattccctgaattcttttgttgttttttaagctaatacattcaaatccaaacaataaaatccactagaataggacact

SEQ ID NO: 17766 - DNA, 201 bp, Bos taurus
ggagcccacctatctcttgtctcaggaaatgcaaacagaaggctagctgtaaatgtctaacctggaaactatctcctacatcaaaattagaagttgaaatcgctaccttaaaaagctgcactatttttttttcactcagaagtctagactttagtgatttcacccatcaaatgggaataaagctgctcttcctgtgaaaag

SEQ ID NO: 17767 - DNA, 201 bp, Bos taurus
gtgcggtttccacgattataaattatcctaaaagaaattgagtttttaggtggggagaaatgattctcggcagcaggattccagtgagtaaattgccaggtccaaaggtcagagagtcattctggtcatgttcctttttaaatgtcgttgttgttatggttcttcttccttctgtaagtcaccttttggtttggcaaagat

SEQ ID NO: 17768 - DNA, 201 bp, Bos taurus
caaaatattttgctatactattagaaaagcttacccctaccacttcttaggataggtgtggcacaaatttaatgtcatgtttataaatgaaaatcaatgcgtcaaatgcaaattacagttaaattatatgtttgcagataagcgaatctttctttcctaagaccctttcttgtggccttttctaatgaaaaaaattcagaa

SEQ ID NO: 17769 - DNA, 201 bp, Bos taurus
tttcgctttatggtggtgcctggttatctaacttagcaatcatctaaattatccattatttgcatgtgcattattaaaattataaaatcaatatacataaaaaattctcctggaagactgtgaacacctacaaatagatatgaagatattagtttgaaaaatactgaccagctcctacacaatgatttcacaagtgaaaaa

SEQ ID NO: 17770 - DNA, 201 bp, Bos taurus
cttacagttcatcaaggctaaaatatttaactggctcaacagagaaaaaaaattctgctgactctggtcacagagaaaaaactgaagaaagaggccagaataggagagacaaacttgaaggaaagattaagaagatattaaatgaggtgtcttcaaataataagatagtatttgctaggtgaggagggctgcaaatagaga

SEQ ID NO: 17771 - DNA, 201 bp, Bos taurus
cactgtcaggagtggcctaatcaaaactcaaattaagcaccatagggataaccattcattcatttttagggggaagataaggaaaagctccgcaggtggtggagtctggcctgtgttttaagaaatgcacaagaggtcaacaggtagagatggaaggaaggggccaatccagcaaacctgaacaaagtcagtggtggaaga

SEQ ID NO: 17772 - DNA, 201 bp, Bos taurus
gatgattttatttgcaaagcagaaatagagacacaaacctagagaacaaatacatggacaccaaggggattggatcaattgagaagctaccattgacttgtacatatagtactgatattatgtataaaatagattaactaatgagaatctactcaaagcacagagaaatctatgcaaagtaatgttctctggtgactgaaa

SEQ ID NO: 17773 - DNA, 201 bp, Bos taurus
agaggaacatacctctgtgcaatcctgagtaaaagggggcccctcctgaggacatgtgcggaggaggaacagaggagcagggctggcagaaggtcccctgtggccccactggacgcaccaaagctgctgcagttagtcgatcagacacacagtcaccctcactcttcaggaggcagcagaaaacccccatcattcgcagcg

SEQ ID NO: 17774 - DNA, 201 bp, Bos taurus
tgaagaaaaccacagagcaaaaaattattagaggcgccagggtggagctggcctccagggctcctctgaggtccctcaggattcacaacctggaacctaatgaaactgtgagctgagaaaattattttagaatcatataaattgggagtgtctaatgtactattaagaaaaacaagaaaaatgagatccagcctgaatatc

SEQ ID NO: 17775 - DNA, 201 bp, Bos taurus
atcggatttatccttgaacttattgcaaaagcaggtgctcaatgaagttttgtggatgagagaaggaagagggggagaaaggaatgaaccagctacagactggcctctggcagaggataaacgccctgtgttgccagattatctgttttcttaaagtcccaaattcttgtttttcaatgggatttatctatttatttacat

SEQ ID NO: 17776 - DNA, 201 bp, Bos taurus
aagtcattgcagtccttttgtttataaatctgtgtcttggattaaacattcatggtatccatacagtgaagaaaaacagagaagtgttccacccctaatggaagtttaatcgtgatctgatagcaaggtcttacaaaaaagcccagagctgcaactgtgtggcgtgatctcctcattggtcaaaaggtagggactgcacac

SEQ ID NO: 17777 - DNA, 201 bp, Bos taurus
cccctgaaactcaaagaggcaaaggaacttgaaaagcaatagttactatttatttgttaccagtaacagtcattttagctagtcagtaaattcctgcttccggttatgtcaatgttaactgactgataaagctccacaatacttgtgggatgaatacagaatgcttaattacgatgcatttaacttcagccctttaaaaag

SEQ ID NO: 17778 - DNA, 201 bp, Bos taurus
ctctgatctttccttggagcaagaggcacctgatgatgggaatggaatgttcatcatggaggcaaagatgatacaaagactcccgaccaacttccttcacgaatgtcagaagattgcctatgtaattttgcctatccatcatttcttttacgtaatactattgtccttcctaaattatctgtcagcttctagttttacccc

SEQ ID NO: 17779 - DNA, 201 bp, Bos taurus
atttaagtggtaaatccattaagaaaagcaaaaaaagtaaataccttaggagtcagaattttctttagtgaagaatgtaagagttgtgattagaaaagaaccatgggtggggattttctgaggtgtttatagtatattatttctttttacttttcctttaaaaatcattcttattgcggtttaactcacatttaatgaaac

SEQ ID NO: 17780 - DNA, 201 bp, Bos taurus
ccttaaacctaaagcgttttgctttatgatgaagaaaatgtgttggtaatatccccaactgggctgaaattaggaagaactagtaaaaacaacatataaattatagtggaagcttttttaaagctatggattattattgttataataaaatataagtttaccaggtacatttacaaacctgcttgtataaagcctcacaaa

SEQ ID NO: 17781 - DNA, 201 bp, Bos taurus
tgatggacagatgttctctggtggagatgagcctcaagaagaggtaatcattctttccactctattcccctagcactttgtctctttctctatgattgcatgtgcagcccagatttatgtaactctattactgcttataagtctactcattttgtagcctcaggccatgttatttttcatataatagacaggtatattctt

SEQ ID NO: 17782 - DNA, 201 bp, Bos taurus
agctccagcttggttaaataggagaggcataaagtagccttttatgggtaccactgacccaagtttcatttttcaatactttcccccagatcatcaaaagccaagagtattccagacaaactgcattgtctgactgtcttgggtaatatcaagaaaacataaattaaaagaagtaactttcccttattcccccttccttga

SEQ ID NO: 17783 - DNA, 201 bp, Bos taurus
gttgatgttgaggtaacagggcagttaacattatcaattcttagagacccgtagtttgagacagcgggtgggtagctagtcatgatcaccaagtacttaatgtcttccattgttggtggtttttgcatctgaaaaactcaggaaatgtgcattaaatactattctctaggtacttcagagataagctatcgcagaggatat

SEQ ID NO: 17784 - DNA, 201 bp, Bos taurus
atgtagagttctgatcctggtaatggcagaaagcttttatcagacaaatcttcctgcatgtaacaatgggaaactttagacaaaacataaaaactgctatcataaggcaccagagaacaaccaaacttggcagacgcaggagagaataaggaaggatgaaagccgcatttatacgttttgccctgaaagcacagcccagcc

SEQ ID NO: 17785 - DNA, 201 bp, Bos taurus
gtgggttaatcagaacaattctatcttaccaccaaacaaaaaaagaaatctaaatctgcaaatgcctcaaagaattaatatgttgtctctctgtgggtgcgcttagtcactaagtcatgtctcattctgaaaccccatggactgtagcctaccagactcctctgccctggggattttccaggcaagaatactgaagtggga

SEQ ID NO: 17786 - DNA, 201 bp, Bos taurus
gtgcctgatggggtattggaaggatagagatgtcaggaaggccagtaagggtataatacagtggaagagaaggggagttggtgggaagtgatgttagagacgggcagggtcctggtgacaggggccttgtaggccaaagtgaagcattagaatttcagttgcagcaggaagctattagaacaagctaagctattgtttaga

SEQ ID NO: 17787 - DNA, 201 bp, Bos taurus
catggggtcatgaagagtcagacaagacttggtgactgatcaaaaaccccttgtctgcagtctctgtgctttgttattctttctgatgttctttgcttttgggggccagaatgagttgggagcagtcttccttttgaatctgggactcaccttttttttttttttttccccacggagcatctaatgagactcttccttttc

SEQ ID NO: 17788 - DNA, 201 bp, Bos taurus
aatactccaaagaaattttgcttttctgtcatacaaatatggtttgcattaaccttatgatacaagttattaatacatgtcagctttctttccccacttttgtgggaagatatattttgaacaatttgtctgcagattccattaaatggatagagctaggtatttacttagaccagtggttttcagcatagactgccattg

SEQ ID NO: 17789 - DNA, 201 bp, Bos taurus
actggttcagcatctaccaggaaaaatcactgcactgctcttatgtgcccgttcagggcactgtgtggagaggggagaaatcgggcaggttttcagaccctaggcagctgacagtctagctggagaatcatgaagaatacagacacaatcaggctgaaagcccctttctgacctgtgtgcagctgctctcccagcttggaa

SEQ ID NO: 17790 - DNA, 201 bp, Bos taurus
tcttggatttccttgtttggccagcagcctaaacatgaaacatctctgggttgaatgtctctgggtatcataccatgtcaggggcttggaggtggtgttgactcctgccttgcctctttctggaggccaggaggtctttggggagggggagaaagagagggaacattttatatttgtcagctcacttcactgttctcgaag

SEQ ID NO: 17791 - DNA, 201 bp, Bos taurus
tacaagtctaaaaccagttgagccgggggcatctggagaatctaagatccacctgtctgattctgggggcacctggaagtgctgttaaggtttgaagtcgggaaagtgtgtctgaacgtacatggatcccagaattttgtgtcttatcaactaagccggctgagaaatttccttagagttattctcacccagaattggaat

SEQ ID NO: 17792 - DNA, 201 bp, Bos taurus
tccattatatgcttttaaaagttagtaacactttcctcagacttgtgccaaattggccactaaagtaataacataagaatggatgaaattattttaatacgttctgaaatactcctcaatgtaactcagttcagcatttcattcttgcagcagttaactggctatatcaggtactgcttcttttattagtatttatgtttt

SEQ ID NO: 17793 - DNA, 201 bp, Bos taurus
tatttcacacaattttcacatcaggaaatattttttttaattttgttcaactgtttagaagtttaaaaaccagtctttgctcatgagcagtaaaggacagtgagtgagctggagctggcactcaggctgtagaccactgtcctagcagcgtggtgaattctaatgtccctggagccctgaggacaatgtaaaactgaggat

SEQ ID NO: 17794 - DNA, 201 bp, Bos taurus
atgaagacttccaggagagtaacagaatgtattgtaagattacacagtatctgttaactttatcttatttttctcagtccatgaattatgctaaccttatccccttacatgaataagtagtgtattctaatctatgcccttggtaacaaagcatattgggtatgcaaatagatattcagctaaacaggtccaatcagaact

SEQ ID NO: 17795 - DNA, 201 bp, Bos taurus
ataagattacacttagaatttctaattagaaaccacaacttaccttgcatcatgaaaaggaactaaaacagaatcctaatgtgaatggttgaattaaagagtgacagaacaaaaagctcaacactttgcccatttgatgggaagagccgactcactggaaaagaccctgatgctgggaaagactgagggcaggaggagaag

SEQ ID NO: 17796 - DNA, 201 bp, Bos taurus
attacaaaatattattactaaataatgagcttctattccaggagattaaaacaatgcctcttaatgtaacagggactgcattacagctccaaagtacagaggcatgtacactattttatacttttgtatgtttcttttgtagcgctatccaacttcttttttttttttttttaagtaggcatgcaaattagataacagact

SEQ ID NO: 17797 - DNA, 201 bp, Bos taurus
gctttagtaagactatagacccagatgaagaggccaatcaggaagaaggcttacacgtaatatgtttagattagacatcagtcatgactttttgatggttacatcagcacctgtgagaactcatccgagcattcagtcataagacaatatcagtgatagtgagattattacatgccagccctggagcacaatgcttgctct

SEQ ID NO: 17798 - DNA, 201 bp, Bos taurus
caccatattaatacatatttataaatttggtaagtagtgttttcttagaagttgcatgtcaccataagtaagttatcagtaaaacggagccacctacactactagtaatttacttaatttattaaaaaatgcataagttcctaaaatttatgtataaaacttcagatacttgaatgatggacagtttctcggatcatgtct

SEQ ID NO: 17799 - DNA, 201 bp, Bos taurus
agaatgcaagagagatgttgactttttcctctgttaactctaacctctcgagtagctatataatacaggctggtttcagacacttaacaatatcctgattcgcaattacaactggaataaagcaaaatgccatcatagaatgatctccttcattacacagagaatcctgtaagaactcaattaggcacatatcgtttagtg

SEQ ID NO: 17800 - DNA, 201 bp, Bos taurus
ctgcctatatgttataactttgtttctactttgccttaatagtaatgatgattggtttttaatgcctttactctgtcatgaaatgaactagaaataatatgctatgtgagaactctggactataaggtacagttttatattattcctcaaactgagctgctaatatttaaatttatatcaagatttttgtttttgtttgcc

SEQ ID NO: 17801 - DNA, 201 bp, Bos taurus
gtccctaaaatagtctctgaaaactattagtgctttaggattgctgtaagaaagtgctataaagtggatggcttaaaactacagaagtatactatctcctacttctggagaagtccaaaatcaaggtattggcaggaccgagctccctttgagacctgctaggaggttcttccttgcctcctcccagcttttagtgatttg

SEQ ID NO: 17802 - DNA, 201 bp, Bos taurus
tgagcacatgacatgaaaagaaacctaaaaacatttaaaaatcaaatttacatgctcatgtatttatagttattttataataaccatatgttaattttaactaaaggaaaaaattgatttctctcctggtatgcccatagttttaaccagcttaaaatacaaacaagggaaaatttgaaaaaaaaaaaaaagaaaagggtc

SEQ ID NO: 17803 - DNA, 201 bp, Bos taurus
gttgcggtttaggagtagcgcctcagtccagggaggactatattgactgcctcaccacagcatgcataaggcagaacggaagatggggcaggttgttaacgagaccactgaaagtcaacacatcaatcgactggtcccagagtgaaaatcctggtgaaccttagaaaggaaaggatatgagttggcattggctttgcataa

SEQ ID NO: 17804 - DNA, 201 bp, Bos taurus
tactgttacgctgcattgtaggtttcatttagtcacacgatgaaataatttaaggaaagaatttgggaattatgatgctactttctgctatgtttaggcactccttttttcccccacagtgttaataataaagataataaaaaagtgtttaattttgaagcttgtggagatataactactgaaagatcttgagctcaaaat

SEQ ID NO: 17805 - DNA, 201 bp, Bos taurus
ttaattcacaccaaaataaaaaggacactgtaagtacaattttcagtttccatctacaagccacactgctctagagaaaaatgtcagcaactggcacactcattgatggtaggaatataaatttctggagaaaatttggtaaagtgtcaaaagtctttttttttaaattacatacgttttgatagagcaattttacttctg

SEQ ID NO: 17806 - DNA, 201 bp, Bos taurus
gaaaatgaaaaccttgtctctgtttaagtaatgattcagtaagtcattgtggtcaaacaagttctcaaaattgggggataaatgggggaatggaaagacaccccccttagtaatctctagagggtcagttaattttccaaataagaatgcatttaaattcactttagatataatttcctgaataagtaaagttttaacctt

SEQ ID NO: 17807 - DNA, 201 bp, Bos taurus
ttgattactttgcaaaatcacatgacgggattataaattaggtttttactcacttatctatgagaattttgtatacaaaattttgagatattgagaaaatgaagaccttagttgtcattcaagttgtttattttcacttctagaactgtagatgacatgattttagacacccaaagtaaatttcctgtgtgtttaagaaag

SEQ ID NO: 17808 - DNA, 201 bp, Bos taurus
ctgaaaaaagtcaaaggaaaaaacccttagctacagaggaacaaagataaaggttatattcaacttctccttcttgcactcaaggggatagtgaattaaaatatttaaagcattgagagaaaaaagtcaccagcccagacccaactgagtgacttcactttcacttttcactttcatgcattggagaaggaaatggcaacc

SEQ ID NO: 17809 - DNA, 201 bp, Bos taurus
tctttccatagatcaaagaagtagaaataaagaataagtaattaacagatgaccaggtttctttcctacctcccccttcagtaatctggcaaacaaattgcgtgaacaaaatagcatctaaaaaaagatcaggaagagtcacaaggcttcatactgtgggagctggcaatgctctgatcccctatctcaatgattaattga

SEQ ID NO: 17810 - DNA, 201 bp, Bos taurus
tgatctcctttagtcttttgacttttccaaaacataaagatgataacagataatgcataaacagtctagcaagtgctttctaattttttgcagtatccccaggtgaaaaaaattgactacttatttcaaattatttatcatttcaaaacattatcatgcttttcattgtcttgttccatattctatgaacctgttggtact

SEQ ID NO: 17811 - DNA, 201 bp, Bos taurus
tagttctttttcatgaagttgcccagctttgaactgtgatatatactccgtcttcagaaagtgttgtacaattactgactgaatgcatatcgacaagtttagattagacatatcctttgccctggtgattttttgctttgcattgctgttcacacttctaggattgaaaacactgtagggggctgagcaaccaaggaaaac

SEQ ID NO: 17812 - DNA, 201 bp, Bos taurus
ccagagcaaaagcccactaatgatgcagcactagtccctgggcacctgagggttccacagccagctttctcaggacccagacttgacaatcagcaaccagtagcctatgtacaaggcagggcttggcaaccactcagactgggggccagcctcacctactaggatgtccacaagagtcagttcaatacaacaaaaggacgc

SEQ ID NO: 17813 - DNA, 201 bp, Bos taurus
cttcctattcacttcaaacactgagtttgtatgtaatttagcacttgtcacagcaattattggtcttatctttattctccaactgagataaaaatattttgagaggaaagactataaagatcacttcttgatctttgtcagagtttattttacaaaaatatttgtatataagttttagtgaatttatgctgatttttggga

SEQ ID NO: 17814 - DNA, 201 bp, Bos taurus
tttactacacccattttatggtttgctccttccggtgatgaatgcaaagcaggaggatactgagatattacacatttcgacttggaatggtcctaatatcttaatgcatatggaaccaattctccacatatcaaacactgctgacagaggggacattcacaaataacccttttggggtctacacttctattttgtaatgga

SEQ ID NO: 17815 - DNA, 201 bp, Bos taurus
gaacaagtgcctaataaatggagtttgcaatccaaagtttacttggccaagccaagtcctctggctacaataccctcttctctctactctatgtatgttgtaaacattttttgtcttctactttagggaaattatgaggacactgttcagttcagttcagttcagtcgctcagtcgtgtccaacactttgcgaccccatga

SEQ ID NO: 17816 - DNA, 201 bp, Bos taurus
gatgccttcaaatacaaacatgtttgcagcaaaacagatacacgagggggaaagttgtaggaagagtttcaaatgatgccagtgagattttcacaacccaattcccttaatcttatactgcctggagctatcatttgtggcttgacataagacaaaattatttgaaatagttcaacatgctccatgatagtagtactctaa

SEQ ID NO: 17817 - DNA, 201 bp, Bos taurus
ttatttgctacgtgatatttgctaaaaattgggataaattccttttttatagagagaaaacaacatctttcaaaaaataaccttgactctctacaccttgaggagattaggcagagactgagagggagaaagaataaatcagaacaggatttgcactttaatttggaagaaagctggaaatgccaaataaactttttaatg

SEQ ID NO: 17818 - DNA, 201 bp, Bos taurus
gagggtgggggccggggccccagcggcctagaaaagcgaccgccgaagctgagcagggactgaggccggggcccgggcgtcccagtcccatcctggccagtctcagagtctttccaaggtcaaggtatttccttcttgaaaccgccttgtaggttcgaattagcttagtccatctcttaacattggccacctcatgcgaag

SEQ ID NO: 17819 - DNA, 201 bp, Bos taurus
tttcctttttcacctttcaggagctccaatcccatcccaaagtctttttcttttttatcctgcccagctacatgaggatctttcttgcagctttggttgtgtaagaggccttataccagttcacagttgcttttgtgtgagaattgttccacatataaatatatttttgatgtgtttgtaaagagaggtgagttccaaatc

SEQ ID NO: 17820 - DNA, 201 bp, Bos taurus
aagactgtttttttttttctttctttcctggactccaaaatctctgtctggaagccctgcctcacaggttcaagaaagtgcctttcggattacaggccgccgtcgacttgctcttatctctatcctcacctcacaggagaacggagacaactaatatcttcctcattttttgcgcctggtctttttacttgctaacaggct

SEQ ID NO: 17821 - DNA, 201 bp, Bos taurus
tcatttgataaatggttctcatcaatcacactctattgatgcattacatgtttcttgctcatggtaactgcattactccactttctgacagagtcagaccgtggctctagaggttatatttggccagagttgggcttatctttatcacattcttagactggttttgttagtggctgatgggtgcccatttttcaagctcat

SEQ ID NO: 17822 - DNA, 201 bp, Bos taurus
aataaagctattcttttctactttacccaaaactctgtcactgagaattaatttggcattggtgcacacagtctgagcttttggcatcaataacttaactaccttatattgaatggcattggatttgatttttaaagtggaaatgctgactacgaaatgattcagataatatgaaacttagcagattaaaaagtctggaat

SEQ ID NO: 17823 - DNA, 201 bp, Bos taurus
gatcttcctgtcccaaggattaaacctgggtctcctgctttgtaggtggattctttcaagctcattcactgtagatcaaaattcaacctagttattgattgagggtggaattattcataatagccagcatagtcattacccctgagctgtttccattctagtaacctctgcagtctaaagcagggtgcttaagaagcactt

SEQ ID NO: 17824 - DNA, 201 bp, Bos taurus
cttatcaatttctgggtggccatgtaagttactgccaatagcgtgcaggactctgtctggggcacagatgtgtttagagaagtgaagtccaatctgttctgttggccactgagtgcattactggcagcctggggaaggatgggaattgtgagaagggtgacttgggctccagactatgaaaggtgtaggcaatggctcatc

SEQ ID NO: 17825 - DNA, 201 bp, Bos taurus
ttgactgttgataataatatgcttgaacagggaaatgcaaaaaaaaatgtatatgagaattaaacataataagaatgtctatatttgaaagcttggtacatgttggtggtatctcagatggataaaacaaccaattaacttttcacataaaatatccttgcttgacagttatcttcttatagcacaaaacaaatataacaa

SEQ ID NO: 17826 - DNA, 201 bp, Bos taurus
ttgatgatatcttttggattcagattgttaatctcatcattatacataggtgaataaaacaaaataccttttagctgctatggaaaaaaagaataaatcctgtgacagcaggttcttataatgaaacagatcatgcatagaggactttgaaatttgatgctaaggcaataacagcttctgtcagatctgggtaacttcatt

SEQ ID NO: 17827 - DNA, 201 bp, Bos taurus
atgagagaagacatgcttacccatatcagcatattgttataatgattctgatggaattggctgtggttcgtgtccctggcttgaagagcttgaactcccttgggctattagagtctgggatttgattagtgctggctgcagtctagtcccttatcagctatttctgcaacacatcagttctgtgtcattcagcaatatctt

SEQ ID NO: 17828 - DNA, 201 bp, Bos taurus
cagtacaccaagtaacatatagaatttggttcaatcatttgtcatctgaaaaaaatgcatagcatcaaagttgaaaattatgttttatttggtggacaaaacagaggacttaaatatgggacacagtacctcagatagctctgagagactgctctgaaaagtctcagaattatctggagaagccaggatatataggagttt

SEQ ID NO: 17829 - DNA, 201 bp, Bos taurus
tccacatgaaaatcatgtcttctttatagcatgtattatcaagaaaataggaagtcctgcctcatgatataatcctattgttcatcattcttgaacttttatccattgatgaactctacactcaaaactttccttctactctgtttgctcataccctttcaaaatgaacatgccacccaataccagaccttcaaagtgctg

SEQ ID NO: 17830 - DNA, 201 bp, Bos taurus
tgaataattttttaaagtgtttcagagaattgtggcgcacagactctgacatgacctccatatatctctgcctcctggtattcacatctttgtgtgatccgctcctgttttgtgtgggtggaacctgtgactcacttctaaccaacggagcacagcaaaggtgctgcgattatgctgcagaagatttcaacatctgtctta

SEQ ID NO: 17831 - DNA, 201 bp, Bos taurus
agaatgtaagttccatatggtcaggtatgaagttagtacatcctttgtttcttcctccctttttttccttccttaatttcctatttgcagtctctttttttcccatgatttattccactttggtcatgtatattgatatgtattattaaattaaaacacaaaggaaaagttggataatttccaattataagtttgagaaac

SEQ ID NO: 17832 - DNA, 201 bp, Bos taurus
acctgacaggggcaactatgaatatgtcaacacctcctgggtaccaggtggacaggaagctctccagcccggcagtcccttcacttggagctatggagctacacacgtaccaatcactgtcatgtgatgaggcactgaggaagtgacaaggtaatggctgtcagtgtttgttcctctctagagtaactttggattggggag

SEQ ID NO: 17833 - DNA, 201 bp, Bos taurus
atcagaaaataactaggatagtgaaacatttaaaatgtttcataataaaggaaaaaggataacttatgactgaacattttcccttcataagcagggtggcaaaatcagaactaatgatatgaaaagttgcttttatttagtgaatgactagcacatgactccctgctagttcccttaataatgataaggtaaagaatacta

SEQ ID NO: 17834 - DNA, 201 bp, Bos taurus
caggtctttaataataaaagaacacaaatcttgagcctattggcttgagctaattaccaagcactccttcctttggttcttgctcagaagagagcaaaaactgggacaaagagcattagcttgtccttggcagccacgaccaggtatgccaactactaactgacaagctaagtctagtagggggaggattttacatgtaac

SEQ ID NO: 17835 - DNA, 201 bp, Bos taurus
aaaaagccaaccgccatatcacctgcatgaagcaaaaacccctggagtgaagacaacttcagtcttctatatccactttcaatttattttaactgctgataaatctttctttgttactgaagttcttaaaagcatgctttgtatgatttatctagcagagaaggttacgttcaggtgtaaggtcagtcatggtgtctgatt

SEQ ID NO: 17836 - DNA, 201 bp, Bos taurus
aaagattttactttgttatgagatattggctatgttgtataatacatccttatatgtagcttattttatataaaatagtttaactcttaaccctctaccactataccgttaagcttttaacttgatcaagtccttctttatagttactgcttggctttttgtcattctttttgtggttgcttataaattcattttctcaca

SEQ ID NO: 17837 - DNA, 201 bp, Bos taurus
taattcaatttttcactaattaatattaaaggcctgtaattaatttcttcacattttctattatagattatgttcataaaatagcagattacaggaatcctgacaaaatggctgaaaaataactgttaaagtgaaaaagcttccacaagggcatgttctaagaaaatcattttattttagataatattttagaaactttct

SEQ ID NO: 17838 - DNA, 201 bp, Bos taurus
ggtgcatcaaccaaccaaaacttgtcaatattttttacgctctgggccatctatgtataaggggctcattttagtcatataacttcactttaaaatttcaatagtggaatgttttagttaaaacctgaggaaacaatattacaattttacttgaaaaacatttacttccttttaaaaaatggcagcatccaagagcttaca

SEQ ID NO: 17839 - DNA, 201 bp, Bos taurus
tttttggctcctggactctaaaagcctactcagcctgttttaatggtagcatctaggtttaccagtttggcagtggccctactatgcttcatctctattacagtatcagggtcctaagaatagcactaaaagctgagctctttatggctactgggaaactttccctctggtaagtttccattatatggtggccaccttccc

SEQ ID NO: 17840 - DNA, 201 bp, Bos taurus
ttcttgaagtcgtcttcaccttgttcgcccatcctggaaggcatcaaggaagcttggttaagttctaggagccacagactgtaaagcagccaaaggctgtgattcatttgcagttctctctccctcacctcttgcccatcctcctttgccccaccccggtctcaccagttgtggttggagaaaacctttttgttgctcccc

SEQ ID NO: 17841 - DNA, 201 bp, Bos taurus
gaattgaccaagatgtctgagagagagcactcagcacacacaagcatcaggggcaacagaaaaagttaattcattccaatcccatcaccgaggtttgttctcccattggtttcaaatgacaagggcctaattacattgtcatgataaggaaaagctgacacttgaaagctcgggtcctgcttatctgtcaggtcagctctt

SEQ ID NO: 17842 - DNA, 201 bp, Bos taurus
cctgactgagccacattgtgagtctgcaaaacttgacctcagtggccagaaccagctctccccgaccccaggtgcctgccacccatccctcttcaccttcgttccaaatctgttcttcctagaggctctgacaaggtcattaaccctgaagtgtaaatgactcataagacagaaaatatcccctcccctaggtgtgttctc

SEQ ID NO: 17843 - DNA, 201 bp, Bos taurus
cttttatgcctcctgtttaggtcctaataggtctgtgaaatgatctacactcctaatatctgcagtcagcagactttaatctgagccactctagggctgggagcctttatgtcaagttgggcatgaatatgcagatgccctagagaaacagttaaaaatgcagttccaatttttatggctggaaacagaactctgtgtaag

SEQ ID NO: 17844 - DNA, 201 bp, Bos taurus
agacatgagaaggggggcctggggccccactgttcacagaggctgggctcaggttaggctcattgcctagactcacctcagaaggctgggcctcaactcccctccattctgcctcccctactccttcctcctttccttccaggatcccacactatctatcctcttctggccccctccttcctctcccccctccccacttcc

SEQ ID NO: 17845 - DNA, 201 bp, Bos taurus
tatatctcaacatcacacagggcataaaactaaattgataataaagaagtaactgagcagaaaagtatgaaaagtggcaatgtgcaaccaagtcctcttttagagaggcttacattttgttctgggtgattaccaaatctagccctcagatcttaatttttaaataacattgtctaatagaagaaatcatggcttcttgga

SEQ ID NO: 17846 - DNA, 201 bp, Bos taurus
aaacactgtgactcagattggccttgagtggaaactgggaaacaattacattcatttgacttaatgatttgtgtaaaactttttctgactgttttatcatataaattacctcaaggttagagtaattctcagtctaccatctagttattttttttgtttgtttttaggctttctgtaacaatatgaagcattttttcatat

SEQ ID NO: 17847 - DNA, 201 bp, Bos taurus
acttcagatatgcagatgacaccacccttatggcagaatatgactaaggaacatgaaggaagatttaaatgtcactttaggcagcactatttcctaagagccttggtaatatctccagggccatggacattcaagttccttgattcttaattattgtattgcaatcaacttctgataggaccatagctaccataggtaatt

SEQ ID NO: 17848 - DNA, 201 bp, Bos taurus
atctggggcaaaatggggactgcagcctgggatagagcacctcagataccttttagaaactgctccaaagaggcaggggaaggtcaagatataggtgatatggcgaagatggagtatgtacaatcaagcacgtactttttgcagaaggtttccgctagtcacaaagagcagtcatcaccaggaaggattttagtgttcttc

SEQ ID NO: 17849 - DNA, 201 bp, Bos taurus
taatgctggcacctgaagaaaggggccaactttttctcaaaggttgatttcattctcctgctttgaggtctggttaacatataatatagatgcacactgaactttgggaaaggccttccacaaagggagcatgtaatttttttcccctttctttctttgattgtcttgccatagaaaatttatgatattcttcatcaagtt

SEQ ID NO: 17850 - DNA, 201 bp, Bos taurus
gacagtggctaaggttagccaaaagatacagttttggccaatgaggtataaacagaagctgccggtagagcaaccaaagaagctgctgaaaggcactctctaacttcagcagtggcctgaaaggctaaaaagcttactcaaaactttctataatctcatgctggaaatgataaaagtgggagcccagggcccaacaagata

SEQ ID NO: 17851 - DNA, 201 bp, Bos taurus
tgtgaaaaattgttttctttgttgttatataaatatgcagataacatcctcagttttgcctccactcacagagctaaaatacttactatctggccctttacagaaaaaggctgccaacctctggtttaaaagcgggcttcccatgtgaccttaaagcatcttgatttagcagaaagagcactggactaggagttaagcgag

SEQ ID NO: 17852 - DNA, 201 bp, Bos taurus
gagaaacagtgggctactgcccctagcctgaaaggattgactaggggaaaacaagaagtctaggacagggtatgaggtaacaatgataccagggaggcccgtaggcacctgggtgaggtggttgattgtcatcaggttctaagttccaaaggtctgtgcggcccacagcctgccttacgacagaattacacatccgtgcaa

SEQ ID NO: 17853 - DNA, 201 bp, Bos taurus
ttgtctaatcccttccttcttgtgatggagaaacagaggctcagagaggggaggtgacttgcccaaggtcacacagctggctgccaagctggagtggctacgctaggttttctggctcccagtcccccctccctcttttccaagcacctcccaacaaccagtacccgtatacctggggcattactgcttagccacccacac

SEQ ID NO: 17854 - DNA, 201 bp, Bos taurus
tactggaaagggccgctttggtcctgatctggccttgccttccacatgggatgaagaatctacgtggcagtggagacatgcccacttagagacttacctccatgcttcaggtacttggggccctgtaactccctgcctgagtgacctcaagaccattttaccttgggcccactcccctgtacagagatcacattaccggtg

SEQ ID NO: 17855 - DNA, 201 bp, Bos taurus
aactttagttaaataccagtggattagagacttcaggtgacttttgggttagtatacaaaatgcaggcagaccctataacacaaacaagaaataaaggatgtaatacatacacagagattagtgttcaataaacatgaggtaagcaatagttgctgcctccctcattcatcctattcccaatattcagagacatgattttt

SEQ ID NO: 17856 - DNA, 201 bp, Bos taurus
cacccttagcagtggagtggagcagggctgaggctcaagggcaaaggctttaggttcagagaggccagttcaaggctggtgctgccatctgtcatctgattgactttaagagtgtcatgtgaacccttgaaacccggctgcagaaaatgcagctaagagtgcaggctgctgtcaacatgaaatgaactaagggctgcgatg

SEQ ID NO: 17857 - DNA, 201 bp, Bos taurus
tcccgtttagatatttatagttaattcacaatcctccaaggccaggtgtagtttactaattagaagtcattttataagcaatgttgcctggtaacatagacgactttcacctttattatgtttccaggggaacagagctaggagttaactcaaggtcatttttctggagagaaagagagcgagtctgtaaaccattcacat

SEQ ID NO: 17858 - DNA, 201 bp, Bos taurus
tgtgagaaaataaatccctgaaacctatctctgaaggttgaatcaagcccagggaagagagcctctctgcctagaacaggtctgaatgtggcagcgggcttatccctgctcacacgttggccttcaaaccagtacttcattatggactctggaagaattatagccactctgggttgtccccatgctcgtctgctcttttat

SEQ ID NO: 17859 - DNA, 201 bp, Bos taurus
aaactggccatctagctcatgtcaagcgagtgaagattcctcggcattcagggttgtcttccccggggacagccctgtggctgggatcaactgccccaagcctgccccagctcctggccaatttgtgaatacagcattgaactccatcatttacaagttttaaagaactgacaacaggcaggttagatccctaacactcag

SEQ ID NO: 17860 - DNA, 201 bp, Bos taurus
caccttctctgggacagataatgaggtgtcagaacatgcagagaggttacaggcctgatcctgttaatctgaacaacaggacccagaagtgatgctgggcaggaggttatgttttccagccccaagctaaaagcacactcaactttatcacatctaagagaatcaaaacatgtatatttactccacaaacactgtggagtc

SEQ ID NO: 17861 - DNA, 201 bp, Bos taurus
tcctgcagagataccaggacaagatccacctggccagggagccggtgcagaacgagatcagcgccacatacgtcaggtgggccctgagccaggggcagagcgtgaagtacctgctcccagatgctgtcatctcctacatcagggaacacaacctttacatcagggatgccagcccggggaggaatgaaggcttgccaacct

SEQ ID NO: 17862 - DNA, 201 bp, Bos taurus
tttgctcagactcatgtccagtgagtcattgatgccatccaaccatctcatcctctgtcacccccttctccttcttaactggttcctataagttggtctctagctcatagactggcagagcgccatttcagttccaaacactcagaactttccccctcgatatcttgaagtccatgaactttaaatgaagtgaggcagatc

SEQ ID NO: 17863 - DNA, 201 bp, Bos taurus
tttgcaatccagctatgcctctctgaccttggaataaggtgtttattttctttctcagggtctgagcttcctgtttgtagtgtggggttggtaataactgatgtactcaattctgtggaacaggctagtttaagactgaatggaaacatgtgctgagtcccaactcaaaggcaatctcatttatttctctgcttccccctc

SEQ ID NO: 17864 - DNA, 201 bp, Bos taurus
aggaaggaccaagctgtctagttgttgctgttgcagtgcccaaactgtttgccctgcccactgtttattgatgccattacaatatcaaacttggagcaccttggaagttgttttcatcctttattgtagttctttcctattctgttctttgtaagtgttggggaatggttataacttcatcaatctgattccttttgtttt

SEQ ID NO: 17865 - DNA, 201 bp, Bos taurus
ggggcagggacctgcccggagcctctttgcatcctgtaatcctgccagctcgcatgccccaggttcctagggccagacctctgcttcctgcctaccccctcacaagcacaccagctgtaatatctctggtctccagacactgccaccttttttctgggggggtctgcagaaacactgaggtgcattatctgggttcttaga

SEQ ID NO: 17866 - DNA, 201 bp, Bos taurus
gtaacagattaacacttctaataactgtagtgagctaatttctgtcttcacaagacaagacagtttatataatagcagcttctcacttacagcccactctctgcctactactgacacttcacaacatacatgatggtacagaagaaagaagaatccacccaatctgcctcagggctctcaaaaaatctgctctttcatgat

SEQ ID NO: 17867 - DNA, 201 bp, Bos taurus
tcaccgttttctccccatgggacctcctgggccgtgtcctgagaaaactgttcctatctgcatggacacagtgtcatgttgtcctcaaattgaaacctcatcaggtcctcagaagaccgagcactgacagcgctgacctgtggtatgtggaagtgaaacccgtactggtgctgaaggaggctgagctccgcaacagagcga

SEQ ID NO: 17868 - DNA, 201 bp, Bos taurus
catggagacctcaggaagctgaaaagaacccatgggggtttaagaatggcctttggatctactccttaagagggctctagcatgttacctctgttttccagtgccttgctcaatggctttgttggcctcacacatactgggaacaaacaccccatacattccctcactggcaaatgcaagcatgtgtcatctcctcatgta

SEQ ID NO: 17869 - DNA, 201 bp, Bos taurus
gctgaggtcttctttctgcatttgaagcaagttctggttcaagagaagtgtggcctcttgggggtgtcagcttcacgattactctgtcattgacattacacgcttaaccttattcttactctgggccccgctaaactttcccacatcagagttccactagaatgctgtgcccaggggacgacctgaatattaataagcaat

SEQ ID NO: 17870 - DNA, 201 bp, Bos taurus
ttacaatattgtattggttttgccatacatcaacatgcatctgccacgggtgtacacgtattccccatcttgaacccccctcccacctccctccccttaccatcatcaagcatggaaaaggcagtctttgaccataaaatgtatattatatatttacttctacatatttcctgcaagagaagatacattttcatttgaatt

SEQ ID NO: 17871 - DNA, 201 bp, Bos taurus
gtagctcactcttggccttcgcttgaattcttttcaccttcttggatggttcctggtgtcccttcctcccaggctctgccatagatgatccagtgttcacatctgtttctccttggatgggcccattggtatctggatttgtggatactttttgccctgggatctcaattctctgttgcgttaaataaaagctatgatctt

SEQ ID NO: 17872 - DNA, 201 bp, Bos taurus
acatttttataaacaccagaaccactcagggtgtgggctcttttatcagaaaaggttattgagcctccaaagagttctttggcccacagacatagggtccgtcactgggagcctgagaagtcattgctgggacctccccactgcccccttctttggttgcttgctctcaaccaacgtgaggctggaacagcccccttcttt

SEQ ID NO: 17873 - DNA, 201 bp, Bos taurus
ccttttgtgaatggataaaactccactgcatggaggtaccatagtttattcagtcatttctgttgctaggtatttggattttttccagtcttttactcttccaaataatgtcacagttaggaatcttgcatctttttattacttttgtcagggtggccttgaatgtagcctttgtttttgtgagtgttagctttatttaag

SEQ ID NO: 17874 - DNA, 201 bp, Bos taurus
atcattagggaattcttcctggtatctagtctgtatcctcccaacaggatctgaaacgcaggactcccagagagggcaaagtctgacacagacagctcctggcaaagtgtaactggtaagcccatgctcagtgtgctctgcagtggggcgcttcataaggacaggtggtctttttgttgagggaagggctcaaggaggggc

SEQ ID NO: 17875 - DNA, 201 bp, Bos taurus
ctgaagcctttgatgagaagtactgtcctaacaagaatcaccagattttcttgttcaaaaaggtctcaggggactctgaggtccttcagcatgcaaatgtgtatgtggacggttcctagagagccaactcctcattttcctattacatccagatgtccatttggaaagccctctcagaagcatcagatgcttaggacaact

SEQ ID NO: 17876 - DNA, 201 bp, Bos taurus
gacttcagcctgtttagccactactttccatcatcccatgggttgctctttcagactgaccctgaagtttgttcttttataaatgaggaggtgttcttacaacaaagaatatgaggccaactggccataaggaaggaattgacttggggcggtgctgtgacagatgagacagtgatgtccgtaaggtgatgctgacacagg

SEQ ID NO: 17877 - DNA, 201 bp, Bos taurus
tgaagctctaacaaccaagtagggtaagagcagaaaggagaggggtgtgagcgctgcccactggggtaggtgggaagtccagacccacgccctgcatgtttgcggccacctccaacaccatactcatctctacggcctgggattttggcttttaggcaacacatttagaaccacacctcagacccaaacttcttatcagtt

SEQ ID NO: 17878 - DNA, 201 bp, Bos taurus
agaacaagttgactctggctcacttatttattttctcttttcagatttaattttgagattgaaagaatatttatttgtatttgagatgctaacaccatcagtgaactttttattgaaatttaagcacacagtgtacacgtaggacaatattttataaaccactgtcctcaagtgaaaaaagatgttagcaaaatattttaa

SEQ ID NO: 17879 - DNA, 201 bp, Bos taurus
ccacagtcccatcacattcaggttcatcatggttttttccttgagtctctggtttgcattctaatcatcactcacaattgtcacaatatgaagtgacaccggtacctatcacctcagacacttgaatagaccctgaaagagagaggatcaaggaggaggcagagtctggatgaccaggaatggggaaccatgaccagaaat

SEQ ID NO: 17880 - DNA, 201 bp, Bos taurus
gaagggtgcaaacaaaaacctgtgttcctcaggaccagggaaaggagctgtgatctccacaagaggctgagccagacctgcctgtctgtgtttgaatgtcttttgtggaagtgtgcatcagaagtgaccagctgctgggataattctgggaggtgtggctagtggcataagtcctctcggaggaggtcgccattatcccca

SEQ ID NO: 17881 - DNA, 201 bp, Bos taurus
ttccctcccatcaggaaggttccacaagcctttagaccagcctcactcaccagggagcagacaactgaagcaaaaaacatacagtcttacaccctgtggagctgagtccacaaataggtcagaacttaaaatgggaacagctggtacctgatcattgcgttatgagagggaattgtactgctagaacacctaggacatact

SEQ ID NO: 17882 - DNA, 201 bp, Bos taurus
cccatgtcctaaccgttggaccaccaggaaattccttagctccatagatttgattccatgataatgggatcagtacactaccttttttgggaatatgtgtacagatatggattaacactgaacataggttagcagtttttaaagttttatagtacttcattgcaatacagcatactctttttgttactttttgtttttctt

SEQ ID NO: 17883 - DNA, 201 bp, Bos taurus
atttctcgtcctgttcaacagaatgatgacgctttcttttttttttttttttttaaaccaagagctgagaatttgctgtttaggataatttgttaaaacagcagcaaatcactgttatcaatgaggctttacttttttaagcaagtagaattttaggactagctcatcaattttctttcatccattggatttccttggaga

SEQ ID NO: 17884 - DNA, 201 bp, Bos taurus
tgtcaccagaaaactgtgcacagcaggatgctgttcacttgttacatataactctgttcctggcacccctgaaggcactagcaataaaactatgaataagacaccaacacccctggcctcatggagctcacagttcagtaagttagtcatagcataaacagatggacagaaggcagacctctgaagaagcaaagagcttaa

SEQ ID NO: 17885 - DNA, 201 bp, Bos taurus
aaaatttccctccacatctcaccacaacaagggttatctggcccaggccaggattccaaactcagggactcatgggcctgcacaactttaaaacggaaacaccaaacaggaaaatctaacttccaaactcttgaaagttcagaagctctgccaagcccagtccacatggcaacacggggctggagccagtgctggccccac

SEQ ID NO: 17886 - DNA, 201 bp, Bos taurus
agcctggtattgaccaagtttcacacaagattaacttggactctgctctgagttacagttggagacgacccaggcatacctctacacctctattaacaaacagagcaattttatgaacacaggccatggtggaaattcttagccctttgtgtattccactgatcaacctttgtaaagttataaacatagacctaggtccaa

SEQ ID NO: 17887 - DNA, 201 bp, Bos taurus
ttagaattctctaatctcaactgtccctctcacttcttgtttttcgaaatctttatttattcatcaaacatttattgacaacattgactatactggccaggttcttgtgggaaaagagatgaggtaaacaaagatacattcttagaaaggtttatatctgagagacagagaaacagtcacccaaatgcatggtaacttcac

SEQ ID NO: 17888 - DNA, 201 bp, Bos taurus
taactcacttcagtcaggggaactcccggcaaggaaggccaccccacagtgcttccctcatcagggaaatggagtcctacagttacagtttgggcaacacgccacaagtcctttataagaggccaagggaaaggaaggaagacaggggtgtctactaggtgccaggcactacacctgtgcttcacacaggtattcccagtg

SEQ ID NO: 17889 - DNA, 201 bp, Bos taurus
ttggatgaaattgctgcatcatgtagtatgcatacagtcagtcttaggctgcttctttctcagcataaataggcactctcagccctcagcactccaggctgggtcttcctctggagtggtaggttcactgacttttgcaagggataaagaacttctgatacaaagtataatgagctcatggcatcctcttataagctcctg

SEQ ID NO: 17890 - DNA, 201 bp, Bos taurus
gtggagggtgcccctctttcagagaaggtctcagcagcaggctggcccctgtggccctggacgcaccggggcccgcgctcctgttctctcgggagctccacgtggctttgatgtggagcagccgtgacatggcagtaactggggggaaggagctttaaagctgctgttttaaatgacagtcattgttccttggcaatttta

SEQ ID NO: 17891 - DNA, 201 bp, Bos taurus
tctctttgtcgagccaccagccctggtcctgcaaaggaaccaaacgggcttttgtatttaagcttttcaatagaaggagatgggtggggggctgcagaccctctcagtctgaaacgtgaatatctcatagcatcactgagccagaaatctcctaccctctcccatcgggaattgatggcatttagggggcgggaaggaaac

SEQ ID NO: 17892 - DNA, 201 bp, Bos taurus
taatttagggaacttctgtttcttgttggagcactcatcttgctgctggcttgggatgacaggcagcagacacaacagagaggtacaagtatctgaccattgctggataaaacgtttgctttgtctataggatttaatttaggccaggggtccaaaatgaatgtcttgagattcagagacaactggattattttgtgaaga

SEQ ID NO: 17893 - DNA, 201 bp, Bos taurus
tttcagctttagcatcattccttccaaagaacacccagggctgatctccttcagaatagactggttggatctccttgctacatgcctcttaaaacagctacagttagaaaggcctgccacaccaatgttagagctggcgtggaggaactgattgataactctcatacattgtgggtaagaaagttaaatagtacaaccact

SEQ ID NO: 17894 - DNA, 201 bp, Bos taurus
tacaatccttccacccttcctcataactgaacttcttcaaagtgtaatctacttattgtcgccactttctcatccccacagggccatgacaatcgtatctatctttattgatttattaaacctgcttgtttaaaagcccccaatgatttcttcatcctttctgaccattgcaggtatgtttagagactagaatctccttga

SEQ ID NO: 17895 - DNA, 201 bp, Bos taurus
gaggatgtgcttccaaatctaataggtaaggagctggtctatcaatgccttctaaatttcagtcatttacatgttatttgtgtgtgtgtatgtgtttactatatttgcataaaatcatcctttatttgctcaacactcttctttaaaaatctattaaagccctagtaaaaagaaaaaaaagtacaatgacttgaagaggaa

SEQ ID NO: 17896 - DNA, 201 bp, Bos taurus
aagcatttccatttcatgcttgaaatctaggttcatccaaggccacatatccagtcagtggcaaagcaggaattcccacaggtgtcagctcactccaacctcctccttcccatggccacagaatgcctctcagttccagatactcttgtccatgaacatttgggtctgagcttagtgatctctgaggtccttttaggttct

SEQ ID NO: 17897 - DNA, 201 bp, Bos taurus
gacttagttcccccatcagggagcaaacctgggcccttggcagtgaaagggcagagtcctaaccattagagggcaggaaattctccttcaagttttcattgaaatccttaggcctgtttattacaactgttcaaagttcattgtccgaataccatcatctctgtggtttctaggtgtgtttccattggttgattttttgat

SEQ ID NO: 17898 - DNA, 201 bp, Bos taurus
aatcctcctggggaggccagagtcttgtttagtctaattcactgatccttcctatgggggtaggggtggaggtggagagggagacgaggaagaaaaagagaggaggagaccagaagggagggcctatgagacagaatgatgagagaaaatgagagggagatgagtgagagaaggagagagataaaaggagacagaaataca

SEQ ID NO: 17899 - DNA, 201 bp, Bos taurus
gcccaggggtcccaggctctgataaggagtactctcaggccagaagaccatccacgtgtaatagccaaaagaaaggatgatgacagtaacccagaacagacggctcctctggaagtaggcctcatctcctctcgacttccccatcgctgcagagcacatcatgggatgcctggcaggccactggcagtgtgcggggagata

SEQ ID NO: 17900 - DNA, 201 bp, Bos taurus
ctaagacatggtttcctaaacatggttgttctctctatgaggaaaaagatttaaaactggcaaaatgcaactacatttacagtaagcttaatgtacatacctagttggaaaatgcaacattctggctaattgaaaaatctgttagctaagagtcagggtgtctccatggctgattcatatcaatgtatggcaaaaatcaca

SEQ ID NO: 17901 - DNA, 201 bp, Bos taurus
ctgctttttggaaatttgtctgtcacagaactacacaggcaaactcgggaagaagcattataggaataaaatccagggacataattgctgcagctccttggacaattcaggtcagaactatccaatataagacagagtttgtaatatcctattttaggaatctttgaaattgcccagatagacttctgtcagtaattccag

SEQ ID NO: 17902 - DNA, 201 bp, Bos taurus
agaatttggttcccacaaaaagagtgaacctaagtgtggtggtattaaaaaaaaaaaaaaagctgaaaatcctgtgatattctatccatcttgagggtcaatatctccgctccttgaatccacatgggcttgtgactatttctgatcaacagagtggtgtttggtgacctctgaggctaggtcataccagtccggatcagt

SEQ ID NO: 17903 - DNA, 201 bp, Bos taurus
aacctctgggctaaaatataaactgtgaacgatggaccctgaaggattatccaggggagatcaaattctagtgccaccatttgcctctttaggaaagacaagtcaattcctgatatttttttaaatgaagtctgagatgctctctccctcacatctctggcctcttccagacatgtctggtttctaggggcaggaagctac

SEQ ID NO: 17904 - DNA, 201 bp, Bos taurus
tgggataagtggttacgataaatagatttggggcttaaagaacaataagcttaataatcttgaaaaatggtttatgccttgagggctctggatagctagggctttgcttttgcagtaatctacattttgggctcaaattcagtgttaatgttcacattacctgctggtttgtttcttcacttttctgaataccactctctt

SEQ ID NO: 17905 - DNA, 201 bp, Bos taurus
ccatcgatatttttaagtgcttgtttggtttttcctctcttcagatgatcaggacagccaaggaaactctagagggcctaaactccaaatcttctgtcccgagtcaagtgtctttgtgagaagcaggccacaaggaacaatatgtttcattctagagtcttttattaattgattgtctttctccagacttattaatagctg

SEQ ID NO: 17906 - DNA, 201 bp, Bos taurus
ttttgaagacactgccattgctttgcagcactgcaatggtgacatgccaaggaaactgtttgaaaataacagcaaaacaccgtggcaggaggcaggggccatgtcagtcgaatgctctgcttctgaaagggtttgtaggtcaggctcagagggcttcgtcgtctctgaaatctgggtgacccagaaagaccccacggctgg

SEQ ID NO: 17907 - DNA, 201 bp, Bos taurus
gaatgaatctccaattgctttaccagttggggagagcagaaggcatctgctgcctgtctcaggctgtccttagcatgctctaccctgatgacttcatgcaatgatggtgagacatgagaactaggaccaagcttgggttagatgtcttggaaaatgaaaggaaacactagagctgggagaaaggaagtttcaccggaaaca

SEQ ID NO: 17908 - DNA, 201 bp, Bos taurus
tttctttcctccctcattgaatagcagtcatgagatgtgaatagaactgaccctcacttaagcctattcacctgggcacagtcactgaggcctcccaagccgaagttcatggtcatcctgatagcttacggtgaacggtgttggattattgatctccaaagaagaagatttagcttcaggaccaggggccaggcttgatca

SEQ ID NO: 17909 - DNA, 201 bp, Bos taurus
tagtgagaatttagtcagaacaaggcacacgtgcccagccagccctactactgacacagaagcagagaggaaaccggaaaggacaggccccacctctcactgcctcacctgatggacgggacatctggtgggtcctcttcaaccctgcccgaagctctctgacaggaccccaggcctccaggagtcttgagccctttgcca

SEQ ID NO: 17910 - DNA, 201 bp, Bos taurus
gcagagatttcctttaattaaagggacttgtctgagctcagttacaacttgaaatcaacctgatgacagttcttctctatacccaccctttgaaaagggtctgctcacaaatccacatctgggttcctgtagcacttggggtgttcccataccccagccggggggctgatgctgagcttttaggaatggcctcattctgtc

SEQ ID NO: 17911 - DNA, 201 bp, Bos taurus
gtaaatatttgttgcaccatttacatagatgattaactaaaagttgaaacaaagaaggtttatgcataaaaacttcctccagttggaatgatttttctctgtacattaggatggaaaacaggagtcgagctactttggggttcctgctgggtatttgggaaaattggttacataggtgttgtcactacgctgccctgagga

SEQ ID NO: 17912 - DNA, 201 bp, Bos taurus
agcagtcagggttaaagctctaggtagtaatcagacagctagacagacagagaggcaggaaggtgagacaggatgagaagtccaaggccaagcagatgactaaggcagagatccagtttccaggacagggtatgaaggtgacatttgttctgagcaaaggctgtgagcttgcgttcaagacacagtgtacgtggccacagg

SEQ ID NO: 17913 - DNA, 201 bp, Bos taurus
gcaaccaccctagctgcaagaaggcaacttcaaagtcttcaaggtccttgttctagttctacttttcccaggttacatctcagaccaaaaactttaaagcttcttagagaaaagcattccccaactgatattaaagattgaaataaaaacccatataagtattctctaatactgtttgctgttttcatgtgggtgttattt

SEQ ID NO: 17914 - DNA, 201 bp, Bos taurus
actctggctgaaggaaattttaaaggctgtttctgagccttactgtgaacataaatgggaatgatttactgcagaggtgaatgattcactgcagtggtgccgagggctcctgggccaggctttcgagctgctgcccacatctggccactgcagggagaggctcagtacccctgctggtccgactgaagcccagcagcgtgg

SEQ ID NO: 17915 - DNA, 201 bp, Bos taurus
tgttactgttagatataatccatgctttaacaaaaagaaaactgtatcaatgaactagcatacactaacagagaaggtacatttatacagtaacataagggtatgaaaattttaaagtctaagtgattagtaaatctacataatttccaaagaataaattaaaagcaagctcattacaattctcattggaattaggtatct

SEQ ID NO: 17916 - DNA, 201 bp, Bos taurus
gtggccaagcgagtacctcacgatgcacatgctcagttctataagtgatctgttccacaatcattatttacaaaacgtggggtgagatagactgaccaccgccagctggccaattgctttctccctatgttccatccccttctgggtctctcgcctcacaagctatgtgtagtccatcttctgtgacatttccttggcgag

SEQ ID NO: 17917 - DNA, 201 bp, Bos taurus
aggaattgagagggggctcagctgggtggtcctggcccagagtctcttatggggctgcagaaacctgaagtctagaggggcgcttccaagctcactcactcggttgttggccagagccctctttccttgccatgtggagctcatcactaaccagcccaaatgttcacaaggcagggcactgatcacgccagaacaatgacc

SEQ ID NO: 17918 - DNA, 201 bp, Bos taurus
tgtctatcaagtcatcacccatgaagagctggcccctttatttccagccagcactctgggctgctaagaaggcactcaagaatgttcatcaaattccctcatggagagacaggccctggggctaccctaagtggtctcaccagcagtggccccagaggctggcccctgcaggttctgccaggcttttcgccttcctttctc

SEQ ID NO: 17919 - DNA, 201 bp, Bos taurus
cagccggtccaggaactggaactgccagtaacctctgtttgcccctgcttgttcccgcctcgactgcttcctcctcctcatgaggtaaacacgattctgcactcggtgttcattttttgtttcgtttctgggacttgatcttccccactccacattgcattcctgaggtttgtttacattctgtgagcagctgtcgatacg

SEQ ID NO: 17920 - DNA, 201 bp, Bos taurus
acggttgtatctcattcttttaatttgcaatttcctaaattccccaaattttcagttttgctctgtttttcatttggtgagtcaatcttgaagactgactctcttctgccacttgcaaatatagtagcctccaccatctgcagttttgcttttcacagtttcatttacctgaggtgcaaaaataaacaattcatcttttca

SEQ ID NO: 17921 - DNA, 201 bp, Bos taurus
tctgccctacttgcatgaaggtcgagtggccccatcaaggtcgagtggccctggcacaggcaggtcctgtctgggtggctggccaggcaacgctgaccgtcgccgcgtctccccagctgtgaatggcattattctaactgcatgttcatcccgtttgccatcattgctacatcattagcataaaaacttactgagaatgct

SEQ ID NO: 17922 - DNA, 201 bp, Bos taurus
tgaagctcgaatctaagacagagtatttttgtatcactaataaaaaatgtgttacgaactgtcagggactgcaggtcagaaagtttacgaatcacatgcttcctagaaacagccaggtttttctggaattaacctgaatcagtgcctaacagttgttaattctttaccatttaaaattctccgccaaaaaggcctggctga

SEQ ID NO: 17923 - DNA, 201 bp, Bos taurus
catcagcttccatgttgctactgtaacatctcctatattcaggcccaaatggatttccatgccagaaaaaattctgcagccactcatcacagaggccccgttcactggatctctgtgtctcctgccttcctcctcttgagtctcatgctctagttgtactgactcttttgtgttttcctagcacatcaggccttcactcac

SEQ ID NO: 17924 - DNA, 201 bp, Bos taurus
agtccatcaaaaatatgaagatatagaagagaataagaaaaaagataaaaaacagaccccatagggctccagattagagttaccaacaacagaatttaaaataacagagtacaaataagttgtcaatgagatacaataaaagataaagaattgtgataaataattgggaactgtcaggttaatcaaagggaaattttagaa

SEQ ID NO: 17925 - DNA, 201 bp, Bos taurus
ccttcctgggactcccacagccgccatctttgtgacataacctccaccaccttccctcatcttttgtatttatagaacttcatcgtaaatggctgcaggacgggatgggactcacacctggtggatgccgagtgaaccttacagtcagtgcacagtgcagaaagaatgccccaaatatgattgtttgggtctctgcagaga

SEQ ID NO: 17926 - DNA, 201 bp, Bos taurus
ctttcctcctgcagtgatctcagtcctgtgctagcaatggcctgtgtccccagaccagggggtgctataagagaaggcagctgaggaacagggggccacatggcagatcagcactgaaaaccctcttgtagagtctgtcttcgttatctgtagaatttctcttatgatggccccagagaggtaccatcagcttcctacaaa

SEQ ID NO: 17927 - DNA, 201 bp, Bos taurus
gagcagacttacagagaattgacttatccatcaccagaggggttccaacaggagtcagtattgtgactggagattctgcattaggtgagggaccaagtgaacttaaaaaacccctataagatccacagattcaagggcggtaaatgaatcaactccatcacagagaactcagagatttttccttgctgagggagctgtgtg

SEQ ID NO: 17928 - DNA, 201 bp, Bos taurus
aaaagacactccacttgaacagaaggaacgtcagcacttccagatatcaagtgcctctagggcgggtatcctaagtctagactgcatctcaagaaaactggagttgacctccagagaggatccccgcggtacacaccgcagtttaaagcccattcctcctggccatttctggcagacctctgatttccacttcttgtctga

SEQ ID NO: 17929 - DNA, 201 bp, Bos taurus
aaaaagtgtcaatgcatatgctacttaagtgccttttaaaaacgaacaaaaatgggagcagagaaagctaaaggtccagggagtggaatggaaaggtggctttgaagtagggaagaacaaatctgactccacgttgcactggtttcttttactttatcctttggattcaattgcttttgctacaagctaagaatgttgccc

SEQ ID NO: 17930 - DNA, 201 bp, Bos taurus
aggcagatcacccatgccagttgggattatcagtctagatgtggttagacactattcaccaaggttacccgggagagaaaatttatcatcagccctgagtactctgtgttaaaggctgcagtctgggtcaccaatttgttgagaaaggcggcaaattatacctgtcctgctgcagaatggcaacttcagtggtgctttggg

SEQ ID NO: 17931 - DNA, 201 bp, Bos taurus
ggctccaccccagtgggtcttcctttgtctccataccatgtcagctggaactctgcagccagtctgcagaatcttggaactagaggcctggcatggatgcagccttcaagcctaaggagctaccaaagcagaagggcactctctgggtggggcaggactgagatgcaatggagaaagtcattctggacccaagagttgtgg

SEQ ID NO: 17932 - DNA, 201 bp, Bos taurus
aaggacagaggggaggggatagttagggagtttgggctggacatggacacactgctgtatttaaaatggataaccaacagggcctgctgtataacatatggagctctgttcagtgctacgcagcagcctggatgggaggggagtgtgagggagaatgcgtacatgtgtatggctgagtcccttcgttggccacccgaaacc

SEQ ID NO: 17933 - DNA, 201 bp, Bos taurus
ctcggatccacatggtatgaacagatccaggccttgaaatctaccgagagccttccgagttcagtgcagcgacactggccaggccccattcaccagccctggcgtttgtgccctctgaggaccacctgcagcttcggttcctaataagtccatgactcagtaagcacagccacagaccaggcctggctgcctcttctggaa

SEQ ID NO: 17934 - DNA, 201 bp, Bos taurus
ttttcacttgttttgtttatcatccggcttttctgttagaccaattgttctcagcgggggttgatgtcctcccaggggccggttgtcccggtctggagactgtcttgaatctcatgaatgaccaaggatgctacaggcatctagcaggtagaggccaggggtgctgctaaacattctacgatgcacagacagccccataag

SEQ ID NO: 17935 - DNA, 201 bp, Bos taurus
agacagaggcgctcctggctggggtgatagtgcggatgtgggatgctcctctgggttgacagtgaactcaggacgtaccaggccagcttagctagcccagcggtcatctctgcagccccctcctcacctctccccagccctccctcgggggagctgacccctggcagccaagcttgcctctggcgacccctccagacccca

SEQ ID NO: 17936 - DNA, 201 bp, Bos taurus
ttctcctggagaaaatcacgagaaccatctaagaccccctgaggaaaattcacaggaaaattctcagtgtttgaaatatcaatacacccccttagaagaactgaaaggactgttcaagaagggcccaggtaagtaactcttctaacacaacatgctcagatacatattactctatttttgtccttcttaatgtaataatga

SEQ ID NO: 17937 - DNA, 201 bp, Bos taurus
tcccagacagatgcaaccggcctggagcatcagggcaggacctaaagttctgttttgtttttttttttatttggggcccagacaggttagaacgaaggcctgtgaactctatgtccagacccacgaagtccgcacccaggacgagctcctgcagcagagggaggctctgctcaaactcatcggcgcctatgtccatggcca

SEQ ID NO: 17938 - DNA, 201 bp, Bos taurus
actgaggaaagagaacccaaagttacagtacacaacacccacctaatgaagaaacaaactaaaaggtccagaacaggaaacaaggcctctgccccctcggggtagacgattcaccagtgagctgataacccgaagccactgatgcctcgtctgtgtccaacactgggtaacctggtgtggagaaaacagcagcataagggc

SEQ ID NO: 17939 - DNA, 201 bp, Bos taurus
agctagaacgtggcaggtgataccggaagccagtctcccccagcccaggccccacagttcataagttgtagccaccaagacccctgttccctccccctccgtctcccaacccgaaggcttatggccaacagaccgcctctgtcacagcacagcattcacagtcctttccagtcactttgtcctccgctcctcttcacctgc

SEQ ID NO: 17940 - DNA, 201 bp, Bos taurus
ctaaatcattagctcaatcacctttagtggcaccaatcatctccactctccctccttaacctgatgtttgaaagcactaacctatcgctgaaaccagttgctgttcagtcgctcagtcatctccaactctttgcgactccatggactacagcatgccaggtttacatccttcaccatctcccggagcttgctcaaactcac

SEQ ID NO: 17941 - DNA, 201 bp, Bos taurus
ctataattcaatccaatcccaaccaaagtcccagtagtatttgtagaaatgaataagcagactgaaaaatttatatgtaaagacaatggatctagaagagccaaaactatttttaagaatgaaactgcagtcatatagatctaatgggatggaatggaaaagtccagaaatatatccatacatacatggtcaactgatttt

SEQ ID NO: 17942 - DNA, 201 bp, Bos taurus
ctctgtgaggatgagccctcaccttaggcctagactgcaggcttgctgttagacttgaaaactcagagtctgctgtctttgttcttggttttggggccacgttgtagtcagctcagcggttgtaacaaaaaaccacaggttgggcggcttaaccaatatgagatttattttctcctgttgctggacctcatttagccttaa

SEQ ID NO: 17943 - DNA, 201 bp, Bos taurus
aaaaaaaggccaccactgggcttcagcctgcaggccgacaaggccagcacttgcctgcctttaagaccttacgaccaaagaaagaccacagaggaggccatggagacagcagtggctttgtggatgggggggctcatccgtctgcagtacaatcctggagggaacccccaccacatgcggctgaaggccggcagcgcgtgg

SEQ ID NO: 17944 - DNA, 201 bp, Bos taurus
tgaagaagttcaatgtgtatgaactcaggggattaggagtttctgtccgattcaggccagtggcttgagccaggagagctcacggccaggcagccccgaaaagaagagaccagagatctgctggggagtggagaatgaaggctggcctcagagagagcggcccagagctgaagcagggtgcttgggctctggtcttggagc

SEQ ID NO: 17945 - DNA, 201 bp, Bos taurus
taatagttaaaatggtttaatgtttgttcttggaggaaatacagtgagttgcttaggcttttatttctattaatccatgctaatagattatatgaaatatgaatagaattatttggaggttttcatattggggctgatagaattcctgatataatatgggtttaaaggatgtgtttgtctttggggtttttggtggtttgt

SEQ ID NO: 17946 - DNA, 201 bp, Bos taurus
aaaatccaggcccaacctgctcagacctcaggaaatgattcaccagcatctacaatagtcccattattttaaattaattaaaccatgctttgtagggccctatgatcttgaaaagcgttccaggtttgatctgactgatggcttgctgcttttgttttgttttgcatttttgcaggtcgttagtctggtttaatacgctgg

SEQ ID NO: 17947 - DNA, 201 bp, Bos taurus
ctgggctgactggggcacgactgtgcgctggcacctcggtcaggttctggactgtgtggtggtgggtgtgtgtgtgggatgcagggcgggttaatggtatcgattaccagctccttccactgccttgttagtggaatccttgagataagtgagggcacccgtgaaggaacccaggcacgcacggcaagctttcacggcctt

SEQ ID NO: 17948 - DNA, 201 bp, Bos taurus
cggttatggaaggagttagagaagaggaaaacaatcagagacccatgaaataaagacgcgaaggatgagagatgagaggctaattaacaaggccaactgctttacccccaagtaactattactccccagtaagtcctgaacatttcgccttcatgccttagaagataacagttccaatttgaggacaaaaattatgtccct

SEQ ID NO: 17949 - DNA, 201 bp, Bos taurus
ggctttaggtggactgacatggggtgaaagcgtcatgctaccggtgtagagtgacactgcctccatgctgactgataatgagacacaagcagctctggtgggcaagagcggccgaggcgcgaataaacaccaactttaccccttcgtcctgggaaagggggttattgatcatcaggtcttgctggccaacagccttcctag

SEQ ID NO: 17950 - DNA, 201 bp, Bos taurus
catacagagctggacacgacaagctcctgagcacacagcacacagactgcagcacgccaggctccttgttgtccacgatctccccacgtgtgctcagatttatgtctactgggtcagtgatgctatctaaccatctcatcctctgctgctcccttttcctttggccttcaatctttcccagcatcagggtttttcccaatg

SEQ ID NO: 17951 - DNA, 201 bp, Bos taurus
gccagtgttaataatttgaatgttaataatttcaaccttttctctttattccctcagtccagggagcagtggctagttcctgaagttgctaccatcaagataccttacagttcttcctatccttttatttagtcagtgaacaaatatattaaaatttctatttggataactggcatcatttttgcctctggagtgggttct

SEQ ID NO: 17952 - DNA, 201 bp, Bos taurus
gttgattccagcctgtgcttcttccagcccagcgtttctcatgatgtactctgcgtatgagttaaataagcagggtgacaagtgactccacacaaatgtgtgttgagtatatattgttgctgttgttgagtcgttaagttgtgtctgactcttttgtgatcccgtggattgtagtctgctaggctcctgtctgtctatggg

SEQ ID NO: 17953 - DNA, 201 bp, Bos taurus
cctggggctttgcgtcagatctttccagctttccctcttccgagcgtgtggtatggttgcgttttccggctccctgtgaagttgggtgaggctgtgtggcacgtttttatgaatgaagtgttagctgaggtgtcacgtgtcatttgtgggtggacactttgcgatctactgggtgatttatcttgtcttttgagccctgcc

SEQ ID NO: 17954 - DNA, 201 bp, Bos taurus
atgagctgtctctttggcccaaacaccttcaccatatgctttaaccaggaggtaaataccaaacacatctattgctgaactcaagtgagggtcagagagaaaagccaaaactgcatgctggcccaggtacactttcttatccttatcctatggcccctcctttatttttatttgtttttttcagttggttatgtatattca

SEQ ID NO: 17955 - DNA, 201 bp, Bos taurus
gatgctcagctttacatctagaaaatgagggagtctcccaccagagttcttattgccctccaccaaaattcatcctacaataataataaatctccgtctcgtttcaaaaacccctgacagtatgccaggcatctcagaggaaaacatatgaccccatgaaagaaaaaaaaaaaaaaaagtgggtgggggggggttgaacca

SEQ ID NO: 17956 - DNA, 201 bp, Bos taurus
atggactgcaacacaccaaccttccctgtccccgtaaagcttgacttgagttaaaggggaattcgacttttgaaactgacacacacacttaaagataactaaagaatttgctgattgtttctggcctgaatttttattccttttgacgaaaggggcttcccctgtggctcagctggtaaagaatccacctgcagtgcggga

SEQ ID NO: 17957 - DNA, 201 bp, Bos taurus
tgccctcggctgcctctggcccccgtgacaagcttccagttgtttttggtaagaacacaatgcaatgtctttttaaactctttctagaaaaataggctcacgattattcactcataggccagatattttttttataaactaaggacattttgcttatacagacgacttgttcaataataggagaataactctaatgagtta

SEQ ID NO: 17958 - DNA, 201 bp, Bos taurus
agacggggagacttcaccctctgaactctcacctctcagagatggagttgtatacgtttgcatgcagacagggctcgtttatcccttaaatacatactattgagcacttctactaggtgatggcctctggtttggaggggtaagtttggaatagccaattccagttggctactactggaatagcaaataattggaatagtt

SEQ ID NO: 17959 - DNA, 201 bp, Bos taurus
aactgaactaacttgacctctgaagcacacttaccaaacgtcgataactggatttccttctttgggatggggtggtgttggttggagaaacccctgttgcatttttgagtgtccggggaaaggaaggattatctgaacatcttgcagtggttcctggtcacgtgaattctagaatcacaatgctgctctcctggtcctgtt

SEQ ID NO: 17960 - DNA, 201 bp, Bos taurus
ctaccatctaagcaagaaactcatgatctttacagctttggattcttcccaggtcctaggcactggcccacaatcaaataaaaatcactgaaccaaaagagatgcttatggaacaatttctttgtatatacataggctcaatatgtagacgggctgcaaatggccagcagatagtttctttatctggaaaaagttctaaaa

SEQ ID NO: 17961 - DNA, 201 bp, Bos taurus
caaaacctcgtgtgcaccaggacccaggaggaaggagcatgtccccacaagtgactgacccagacttgcctgtgagtgttcaggtgtctctggtggaagcgtaggtcgacagtggccggctgcaggatcaggggcactgaattcaagaacttttgaaagaggttgcactgccattatcttcattacccctaccatagcttg

SEQ ID NO: 17962 - DNA, 201 bp, Bos taurus
ttactggtggagttctaagccctatgttgagtgttctgcatgtcccattgaataccactcttctcttgggttagaatcttcttttttggtctctgaagcagaagtgacctttagtagccatccttgaaggtggacacaagtcaagaaaggaagaatcctttgttaattttcattttggcaagttaaaagtaccttcctgaa

SEQ ID NO: 17963 - DNA, 201 bp, Bos taurus
ctactccaggctgcttgttttcagtagatcaaagatatttttttaatcccagcagaagtgtttttaaaagtgtaaaccaaccaagtgatattaatttgacctctgatgaggtaaaaggaataaaatgtataaaactggcttctctgaagggattcttttttcctggataactctgtgggggataagatgtctccaatctat

SEQ ID NO: 17964 - DNA, 201 bp, Bos taurus
gctagagaaaaaccacgagattcccccgtcatcgagagatgaggcccttcttttcctgtaggacctagagagcaatcccttctcaaaactgttttgagtcccttctcaaaactccaaaggaggcctgactccctttaggctactcaatgggcaccaagagatactcgtcgcaactcgagaggagagcagagttctttgctt

SEQ ID NO: 17965 - DNA, 201 bp, Bos taurus
tcattgctgtgtatgatgagtataagcagctggagatgagttatttccacagtaaaaccaggttacactttgtgaagaagggacccactgagcagtggctgtgatttatcaagtagcatcctgttattgtcagtgggatcaaacaatagaaatatttgagtaacagaacaaattaatctgaaattaaacttgtagctgcaa

SEQ ID NO: 17966 - DNA, 201 bp, Bos taurus
tgtctacacaaggagtagagaacaggaggccattctccagtaaatttggatgaaaaccaattcccactcaaaattaaacttctaggactagttctcttgggaaccatgccaggggtcaggcctgcagttctatggagggatcaccaaatacaagctgttggactaacagagaatttcatgtgccagtgaatatttatcagt

SEQ ID NO: 17967 - DNA, 201 bp, Bos taurus
ggtccctattgtttatcccttttaaatatagcagtgtgtacatgttcatcctaaactccttaactatcttattccccatccttccccctgcaatcttaagtttgttctctaagaccgtgagtctctgtttcataagttatttcatttgtatcatttctttttagatttcacatatatgggctgtcatatggtatttctcct

SEQ ID NO: 17968 - DNA, 201 bp, Bos taurus
ctgtgagtggttgtgtgtttgtgcagttcattctttgtctctgtgaacaaaagttcagattcacttttcactgtgtgaccaaaactgtttgaacaagataattctagatgaagatcacaagaggtcaacaagcctgtacacaaggttgtacacaatagaggatggtgatgactccctatctcaatgattaactgagcttac

SEQ ID NO: 17969 - DNA, 201 bp, Bos taurus
ttcagtgtgtggaggctggcaggtgagccgggcacatgccaggcgtccgcctcccccgagtgcaggccctcgcccccggccttctgtttttctactgtacacctgcaactgtccctgtttctgggtctgaccccaccagactacaagtacctgagggcagggacatatctgcttggcctggagctaacaggagcgtttggt

SEQ ID NO: 17970 - DNA, 201 bp, Bos taurus
aataaagggagtcacacaatgttttcggtttcccagagcatctaaagttatgtttacactatactgtagcctattaagtgtgtgatagcattatttttttaaaaataatgtatgtgggtgctcagttgtgtccaactctttttaagaccccatggactatagcccaccaggcacctctgtccatgggattatcctggcaag

SEQ ID NO: 17971 - DNA, 201 bp, Bos taurus
agtgaaaaattctaaatcttcatgagatcaataacaaaacagtaacagactgagttaccggaaaatataaaagcaataatattttaacataatactcacaatggggaaaggatcctctacagacagctttgtttaaaatggttacaagaaacatatggcagtttttaaaatcagactccattttctctatagattccatcc

SEQ ID NO: 17972 - DNA, 201 bp, Bos taurus
gtacttcttggaggaggcattagaaactttgggggtggggcccccaataccaggacctatccagactcctcttctaggtctttctggccttcccaggtctttccataccagagagaggcttaggaatgttttggggtgtctccaaagaccagtcctcaggcaggaggacagccaagttcaaggtgcctccacagtctccag

SEQ ID NO: 17973 - DNA, 201 bp, Bos taurus
aacaatgaacacaaactggtttttatcatggtgtaaaggaagcagaacaaaacatttctataactggtgggaatcacatgagtaaatgacagagaacatgaagatacaataaatggcatttcctcataatttttgaataaagttgtgcttggattggagaagattaatgaaatccaaaaagaaagtccatgtttttttgtc

SEQ ID NO: 17974 - DNA, 201 bp, Bos taurus
gtgaaaaaagtgaaaacacaacacttcctaacactatacaaagaataaacttaaaatgaattaaagatctaaatatgaaggcagaaacctcaaaactcttggagcaaaatataaacagagcactctctgacataaatcacagcaaaatcctcattgacccatctccaagagtaatgaaaagaaaaaaataaacaagttatt

SEQ ID NO: 17975 - DNA, 201 bp, Bos taurus
attccaatgggctactgtgaggtggacgcatggggaggctccatttatgacctggcatgccttccacttctcataggccacgagttcatgttagaacggaaccagtgctcactaacttctgacatgcccaggtgtttctctgtatggagccttcagaagattcatagtactgtttgcttaggatgttattgcaggtgactg

SEQ ID NO: 17976 - DNA, 201 bp, Bos taurus
acatgcagtgttctgctcctattttgctgaaggattggtgtgaagcatttcgcactggagtttgctggcttttgggtggagcttggtcttagtggaggcccttgggagaactcttgcctattaaggttctgtggagttgggagttcactagtggtccaaggtcctagaatcaagtctcctgcctctggtgttcaggcctga

SEQ ID NO: 17977 - DNA, 201 bp, Bos taurus
agacagtggacttttcacagattggaagtacagcaagtcacagactagtaaagctacttacagtatcttgtagatggcaaaagattggtgtaaagaatgtgtgaagaacttctgagagtggataagaggaagccgggagtcaccatgatagtgggcatatggtatgaatacacagtgcttaacagagcacctaagtagtca

SEQ ID NO: 17978 - DNA, 201 bp, Bos taurus
tctggatttcctcttgcagatttttagatttctgtgaactgtttttctgcacacatgaagcttcttgcttgctgccttgacagaaaccaggggatagtagtccctgctggtttttcttactagcattctgtattattaatggctgacctgaggttcttaagtctacccaaactgagctggtatattactatgaaggtactg

SEQ ID NO: 17979 - DNA, 201 bp, Bos taurus
taaaaatggagagcagattacgttagcagatttaaggcttaatttaaattcattaacttctggatggggatccttggccctcccagtctctaggctttatatgtctcctgtgttcctggtctgcctgccatcctgatgaacactatggggcctaaagcggacactgtgggctggggtttgcaacttcattaggattctgct

SEQ ID NO: 17980 - DNA, 201 bp, Bos taurus
ggaagcttatctcaggaaactcggcagagggattggggcctggacagagggctagcttccaggaccatttccctggagatgaaggcccagagaatgggtcgtctgggttggggaggaaatgtggagccactgtgagcagtgcggatattcacttggaaattggccttgctgagactcacgtgttaggggtgcagatccctg

SEQ ID NO: 17981 - DNA, 201 bp, Bos taurus
acttatatagggtgattctacctatgggaagaggcagcaagggaatatgtttcctggatcataatatgaaaaatccatataatcttttattattaatggtgatctaatctaaaatttaaggtcttctctaacggctcagtgataaaaaaaaatccacctgccatgcaggagacttgcaggagatgcaggttcaattcctgt

SEQ ID NO: 17982 - DNA, 201 bp, Bos taurus
cctctgcttctcttgggcctcagggtccatatcaccccagttcttgtgctgccctgggctagctgtcaagattttcctcagacatttcagggagcatttgccaaggaaaaaaaaaggcctcttcctgctagctgattgattcttcttcccattatacagaatttctgattttattgggtggttgaaatgttaaatccatag

SEQ ID NO: 17983 - DNA, 201 bp, Bos taurus
cacttcttcaagtattttgcctatttctttccttttcttttgtgactcccaatatacgtttgctgatattcttgattatgtttcacaggccctgaggctcgtaatttttcttgactcttttcctttcaattcttcagattttatatcaatggacttgtctctaaatcccctaattctttcttttggctattaaaatctgct

SEQ ID NO: 17984 - DNA, 201 bp, Bos taurus
tgtagggtcttatccaggactggttggatcatgtgacttagacttgtgtggggtttcttgcttccagtatccaagtctgttctctggtgggccctaatcccaagagatgactgatggttccacagtgcttcaggtgggaggaagtaaactgaaggcacaatggccagccttgttccaaggaaaaagacacagaaccgggtc

SEQ ID NO: 17985 - DNA, 201 bp, Bos taurus
ccaagtttagcgttagatatcaggatgccaacattcacctctaggaaactgcctatgaaaggttagcaatccagcaatcccgtaaaagggccttgtctccgatgtccatttcataccagggtatggagaataacggacaaagaacaacttctcagagggaaaaacttggcatggccagatgggcattccattccactgcca

SEQ ID NO: 17986 - DNA, 201 bp, Bos taurus
atctaggagtagagctgggactctagtcacctgaggaccaggagaccagaagtatatttaagactgggcaggacatgatttgctgcccacagagataaccctttaggtcaaggccaggagtactgttacctgacttctaccctagcccacctgagaaatgacaaaatccaatgagagtgctggcaatgagggcagaaaaga

SEQ ID NO: 17987 - DNA, 201 bp, Bos taurus
tggccttgaattcaaagctgtgaccctgaacttgaaagcacaaagatagatgggagagaaacctccatgggctttgagggaggcaaaagaaaaatcctttgtttctgtttaaatccagctctggccctgtttgtgctacattctgcccttgcagcagttcttggcccacaccccggggtggtctcccctggcaccttccat

SEQ ID NO: 17988 - DNA, 201 bp, Bos taurus
ggatatctggtctgtgagcatgaaaaagtaacccaagatttgactgatggctgactgaaagacaaggattccatccaaggagcagtgagctcaggccagaatcaccaaccacatacggtcatgtgaatgtaattttaatgtaaaataaaataaaataaatttccttagtcacctcagccatgtttcaaattacaaaagcca

SEQ ID NO: 17989 - DNA, 201 bp, Bos taurus
agcacatcaagaaaaaacacaattggccttggatgattgactaaatggtgttccctgcacctaggctttgccagccttcagctgacgatgctacctttacggggtgagataagaaggcagggtaaaatgggcacaggccagtagagtcttgcaacaaagtcattaagcaatgccctcggtagactcagatgaagcacagta

SEQ ID NO: 17990 - DNA, 201 bp, Bos taurus
tcccatctccacctccaaaaaggtctccttaaaaggccatgtgtgaacattgtaagaagtgaccatctttaaaacttactacaaagataatcagactctggtattggcctaagattagacatatagatcagtaggaaagaatttagagtccagaaaaaagccattacatttactgtcaattgaattttgtcaaggatgcca

SEQ ID NO: 17991 - DNA, 201 bp, Bos taurus
cttagtttactaactgggattgaacccaagcagtggaagcacaaagtcctagccactggatgcccaaaatttctcttcttctccttttaataaaagccatcctagccgaggaaacagaggtcatattgctaacatctggatcatagaaaaagcaagaaagttccagaaaaacatctacttctgctttgttaactatgccaa

SEQ ID NO: 17992 - DNA, 201 bp, Bos taurus
cccagacataccctccccactgtatcctgtctggattcctgacccacagaatcatgagtcttactgatgggggtcatatgccactcagtttgggaggcctgtgatacaacacggtgactgcctcaggtacagaggtgggagagatgccactcttacacaagaacagccaggggcccaagcctggaaggaccacaacagaaa

SEQ ID NO: 17993 - DNA, 201 bp, Bos taurus
gccacagtctctccaaggtccaacccctatgagccttggccacctcaaggtgacctatcatcatcagtccttggggcgcccactctgggtggggaagggattgggaaacatggccttaccaggctaatgattccatcaaaggagctgaagagacagggggaggggccacatctggtgggaatggtgaagggagtcagacca

SEQ ID NO: 17994 - DNA, 201 bp, Bos taurus
aggcctttcctcagctggtgagatggacacacatcctcaggagagcagcctggtatggactgcacacacaggtacacacacatgcatacacacctcgacaacccctggccagggccctctgtcctcacctagtagggaaacgtcagctcggagtcccagagctctgtgtctgggcctcggctctgttcccagtgtaagcca

SEQ ID NO: 17995 - DNA, 201 bp, Bos taurus
tgagaaggggtgctcattctgctcagacacgtacggcaagggaggggggggtccctccctgccctgccctgccccttgaccttctccacagggatgactgtgagaagataaatgtttcattattcagagacgcttcccaccaagcagatccagggcaggctctgggctctggccacccctgacctcacagatccccctgga

SEQ ID NO: 17996 - DNA, 201 bp, Bos taurus
aacttatatgttaaaggcctaacccctagcatgatggtagttggagatagggcttttgagagataattaggtttagatgaggtcataagggtgagaaccttgtgatgagattagggcccttataagaagagaaagacacaggagcgctctctctgtcatatggggacacaacaagaaggcggctgtctgcccagccaggga

SEQ ID NO: 17997 - DNA, 201 bp, Bos taurus
aagattccagaatgcagaggaaaaaaaggcctctctgtggaggcatcccccaatagatcgtaaggtgtcagaggacaggggaaagcctgtctttgtacacatctttgtaaagggtgcatctttaataaaggctggccaaataaataaaggaacactcaattaattaaaaaaaaagcctctgactgaatctctaaactataa

SEQ ID NO: 17998 - DNA, 201 bp, Bos taurus
ttttaattgagagtttagatcttgaacgtggaaaaattgttttgatttgagtgtttttctccttaggtcgatcagagctaacattcttgtcactttctgcatcatttgtagtttcagctcaggctccaaactctgctatcacagctcagactggagtaggggtggcatccacagtccacctgaaccccatgcagttgatga

SEQ ID NO: 17999 - DNA, 201 bp, Bos taurus
cttactgtactgtatcttagtcattgggagaaatgattttataacccagacagacctgataccagtttacacaggtgattcaaggtgggttttttgcctgcgtttgatgaagaaaagtatttctgagatcatgattccctcctcttgtttgttgcagacaaatctagaacatgatgtttacgaaagactcaccaacctgca

SEQ ID NO: 18000 - DNA, 201 bp, Bos taurus
cagaaattctgctgcagaagacacttggccttcctttggatagaacaacccagtgcttcgtcttggtttaggttgctatttcaagcttgactgttggccaatggtgacctgaacaaccctggagaggtcttgcagtagctgctcatggctgcctgagcttgcctctgggaaggacgaggtggggtgatgtgcatacaagcc

SEQ ID NO: 18001 - DNA, 201 bp, Bos taurus
caaaaaaacaactaggcccaacatggtggaagacttgacttccagtagacatggagcctcattatgtgctcattgtaatacatcagctaaacgacacacccgcagagctcccccatgagctctgaggtcctgaaaggccaaaggtgggtggtggcacaattcctggaaatcctcgacccttcccccaaataactggaataa

SEQ ID NO: 18002 - DNA, 201 bp, Bos taurus
aacaggtgcctttcccaagcttgctctgcaggtataatgctgcacgttactatcagttcatcgctctgaattccactgtttatttgtgagttgctacttcacatggccatttctagatagtttttgtctgtttccaagaagtaaggcaatgttcagttggtttaacagaccaggctgctcagttttattccagccttggta

SEQ ID NO: 18003 - DNA, 201 bp, Bos taurus
ttgatcaataccctcacctttggagggccctaagctttggcatcttccccctaactccacaagacccccaaaattacagctaaaattcctaatgcacttttccagcacgttgtgactttgatgggccctttggatgagaacccacagggatttcttcctcctctcatccccatttttcctccccagggggtgtactttggg

SEQ ID NO: 18004 - DNA, 201 bp, Bos taurus
gataaaattcaatactgttgaaaggaagatggcataatccaaattcctacaaattatccacaatgtctaccacataataaaatattactaataatgcaaagaagcaggaaaatgtgcctattcaagaaataaaatttactagaaacagatccacagatgaccaagcacttggtaattaacagaacttaatagaactttaaa

SEQ ID NO: 18005 - DNA, 201 bp, Bos taurus
ctttcgtatctgaataaatgcttaatatggtctagagtggcaaaacaagttaatggttgataacaatttattatattaccatctcttttttcctggcacatagtataaagtgtggaaagtctaccaacgaataactgaagatatttttagtagttgccttttatagcatataacatttaaaaataaatgacctttaattgt

SEQ ID NO: 18006 - DNA, 201 bp, Bos taurus
tgttcagggaagaatatggtaattctattgtaatacaaagggtaaagcgattgagtatgtatgagagaagataataaggtggtggccttgttagtgcaccgtaaaatagtttaagggatcatctgtgtgggaatgaattaggtttatttcttgcaactccaacaggccgcggtagctccatatggtagaaagtagaggtag

SEQ ID NO: 18007 - DNA, 201 bp, Bos taurus
gactgattagaaggacaaacataaactgtttagaaccaaatgggtcccagatgacagacaaagcaacttccactagatcttgagcctgagtatacagtcattgaagcacatcagcaagctaaatgacatacctggaaatgccctgactattctgaggtgaaccatcaaagaccaagaagtgggcagtgacccaattcctgg

SEQ ID NO: 18008 - DNA, 201 bp, Bos taurus
ttccccaaaagggctgaagatctgaaaatcagttgacttgctactagaaggtaaggttgattaaaaaaaaatggaaattattggttaaatttataattgttaaaatatatttcagctggtagcaataaaaaaaagcatgggttattgctcccccaagtataatttgtgatatctaaccattttgaccacccagtccatttt

SEQ ID NO: 18009 - DNA, 201 bp, Bos taurus
aattaatgactcttaattgattgctgataaaaagtaaggacattttcttaaaggatgagtcccagcatgtgagggaattacaaggcaattagttaaaaaggggacagtgcgtgaacaatctaaagagacatgtttatcctaagaaagtaactttttattagcataaaatttttaggtgtttatgtctagtaaaagagagta

SEQ ID NO: 18010 - DNA, 201 bp, Bos taurus
actcagtccaaggtttttaaccatcagtgcagatttttactaaagacagtagtcaaaattttcttctacctgcttcagctttcacttctgcaacagaaacgtcacttaaattgagagaacccagagccttttaacgaaccaaagtattaaacacacacacacacagcttgagcgcctatgtgcaacaatataatgaagtat

SEQ ID NO: 18011 - DNA, 201 bp, Bos taurus
acttgtgcaagttttgtttttttgtttttaatgtacagttttatatctttaagcttttgttttatctccaatatctagatcaaaacacctttgagaaatgcgtcttattcaaatgcattatgccatcagctgatgcttgcttgttcataattctaggctttattttcttattggttgtacaacaactactttgccagaata

SEQ ID NO: 18012 - DNA, 201 bp, Bos taurus
aattataaggagattaagaaagatcctttgcaactggagcttttacttctacatataataatttatatttgtagtttaggataaatagcttacatttatttattgataatgaagaatattatgcatttccaaaaacgaaagagcttgtcattagatgtggaaaaccctagtctttttcaagatgcaataatccataaaaaa

SEQ ID NO: 18013 - DNA, 201 bp, Bos taurus
tgggagaaaacggggagaagaagaaaagggaagaaaggaaaagactttagacctctaaccaagaggaatggtaaacattttatgtgttctgaattaatttatttgtactttcttgaaaaagtaattgctacttaatttttaggaaaagcaagttttatatttccataaagtgttgtttaattatgaactacgcagagcatg

SEQ ID NO: 18014 - DNA, 201 bp, Bos taurus
aagtgtatttataaagtatattcaaacataattactatttaagaataagtaaattttcatgggaacaaaatgataaattgttctaagaatgcaaatgacctgctgcttggtacaaaaactagactgttatttgaatggattaaaacttcataatttgaaatagaaggcacataagtaacatctttcttccccaaatcgtaa

SEQ ID NO: 18015 - DNA, 201 bp, Bos taurus
tccttgggttttccaaatatctgtgtagaagttcttccttaagcaatgaaatatttctatgcatttttagagcaaatagaagattcaaatgggaagaaatgtaatttttttgctatgttgattttggtctcctgattggcctctcgtgtcatttctcagatgtagctgaaatcaagagtagtcagttgacttaatgagtca

SEQ ID NO: 18016 - DNA, 201 bp, Bos taurus
gatcaggaccttttcagtctccatttcctcaaatttgttccacatccaacttccagactcatattcccaaattgcctaattcttcactgcctggccaataagacagcctcctcagactgctgatcacatcctcttcaaacagcacttcccaccaagtctccatagggccctacattttagctccacctgcttagttctaag

SEQ ID NO: 18017 - DNA, 201 bp, Bos taurus
agcctgagcacagcagtgaagactcagtgtaaccaaaaatacattaattaaaattttgaaaaaagataactgctgcattttggtagccattctataaacagaaaggaaaagccaaaggttgaaagaatcagccaaggtacatgcatctcaagcagtcagttcctttaagggttaaggccttctggcaggattggttatgtc

SEQ ID NO: 18018 - DNA, 201 bp, Bos taurus
aggccaggatctccctcttacctcattctctgcctggcgaccaccactcctctgagagttggctgaatgagccacaaacggtgtctccttgacagttgctcttttggggaaggggcccactatggcgccaatcaatggttgagcaggatcaccaaccgctgctcattgagagttgcttgcttgggggaggagcccactgca

SEQ ID NO: 18019 - DNA, 201 bp, Bos taurus
tattttaaatctcttcaaaagtgctgcttaaaagcatatattctacttaactttcaatttttggtgaatttagaaatttctggtcatatgcctataaacgtttcaaaattaacccatctctgaaatgttaacctttcacgtgtcaaatatagacaatattttttcaacaaaaattatggcaataaaattcaattatcagta

SEQ ID NO: 18020 - DNA, 201 bp, Bos taurus
atatgattaacattatggcatttttttaagacccacagagctatacaacacaaagaatacactttaatgtagtttggactttaataacaatgcatctatactgattcattgattgtaacaaatacatccccctaatgcatgatgttaataacagagaaaactacatgagagtgagggagtaagttggaactctgtactgtc

SEQ ID NO: 18021 - DNA, 201 bp, Bos taurus
gtgcattctaaatgtatttcttcaaatttttttattgtaagaggagagaaacaccttaagataaatgtctgtgctaattttttttatggcttattgactctaacaagcatttgagaatcttttgagatttcttaattgagattagaggtgatgagttattttattacctctaagccaatgggatggagtttgtattgtaaa

SEQ ID NO: 18022 - DNA, 201 bp, Bos taurus
ggacacagagtcttgagtcaacagctgaggcaaaggtgaacttgaatggtgattcttgttcctctgtaactgaggcattcgaatgtgagtgaatggtatgtattagtgtctattgttgttatttatttacgctgaatttgctatttggaaaaaaaaaaaagaagaagaagaagaagcattgaaaatggccaaaatgggaat

SEQ ID NO: 18023 - DNA, 201 bp, Bos taurus
aactcatagatcagtatgactatatatttgatattttctgtgatgcatttcagcctacaaatctgtttgtttctagttgcatttatgatatatttcaacagtttttcaaaaatttgattagctaaaacaaaggataaaaatcacgtgataagctcagatgctgaaaagttacttaacagaatatctgtacataataaaaac

SEQ ID NO: 18024 - DNA, 201 bp, Bos taurus
caatctattcatttctttggcaaaggtctttctcttctattgcctacatgtttctcaaactattttttctcttctttatgccttaacttgtgctttgttatattctctgcatcttttttcctgatacaatgaaatagcctccagttaatcttcctgtaatatcctggccatgactaattcatcatccaccactgtcatatt

SEQ ID NO: 18025 - DNA, 201 bp, Bos taurus
actgtacatggacaatggcagcagcctagacctgattagagtctggtatggttcagaaatttgaggaaagaggatatggattagggctctggatgacactgagatgagcagagtactagctgagggtgagggaagcttagaaggggagagagctttacttgcatccctgagaccagctttagtggtaagggctgttgttga

SEQ ID NO: 18026 - DNA, 201 bp, Bos taurus
tcaaatctgtatgtggctgcttgataaatctggcaagtcagtgtttagttggaaccacatatggagcaaccttatgccagcctacattttgccaacagacataacagttctgggtcattatattgccaactactctgacacatttttgcctacatagggccatggctaagacctgaacacagctgaaagccccaagatatt

SEQ ID NO: 18027 - DNA, 201 bp, Bos taurus
ttattcttcataagaagttgttatgaattattttctactaagctgacaggaaggagtacactcaaatagtaggtagaatcacaatgtggtactagattttgcatggacacgtttctcttctatctctctatccaagggacagaaatgctaagtggtagatctgctttcaaaatggagaaagacttagatttctcaggcttc

SEQ ID NO: 18028 - DNA, 201 bp, Bos taurus
catatgcaaaagactgaattttttgtgatataatcataaggagagagattactaaaagtagtattattgatgaaaaaattttactgtctttgaaataaagcattctaacatatttcctgtgagataacatgtaagatatcttggtaggtactgagcaaccaatattttagtgatatgtcctggaagaaataagagaaagaa

SEQ ID NO: 18029 - DNA, 201 bp, Bos taurus
tgtaacaaagccttcaagttaattttattattacacaagaagcagatgccaagggtttacaagtattttcctaatggtaacacaaactatcccaccccttttggtttttgataggactatatgcaaatttaacatgatagaaatttattcaaaattattataatgaccttataactacccttgtctctatgttattagtga

SEQ ID NO: 18030 - DNA, 201 bp, Bos taurus
ggttaatagaagtctttcttttcgtttcacagaagattttgttttatcattggtatattaagatatcacagttagttcctgattagatatgaataactgacaatgaacatgtcttcagaacactattattgtgtggaaaactctttcttcaattgttgatattagttcgctaactcatctgagaggttatatattcactct

SEQ ID NO: 18031 - DNA, 201 bp, Bos taurus
cctgggtatattgttaaatggcagattctgatttgcggtgaggctgagatcctcctcttctaacaagtttctacatgatgtggacatttctattctgtaggctacattcagaatatcagatagttctagatgattgtgttgaagtttggcagacttacggtttactgcatacatgtccagtatggctggattctatcagaa

SEQ ID NO: 18032 - DNA, 201 bp, Bos taurus
ttggggaaaagttcatgaaggtcatccttatccaactgccttcctggagcagagaatatgtattgagaaagagctgtgtgttggcttggatgaaggagtgtgacaagttctgtgtaagggacatgaagagaccaggatcaagggagtcttggggtggtggtggttggtgatgggagcacggcttgactgatgggagaatgt

SEQ ID NO: 18033 - DNA, 201 bp, Bos taurus
ttaccccttgcaacttttgttttaatatgtggcaccattgttttcccagatcctcaacacttacacttcatcgtccatctaccaataaactctttagtccgtccgccccaaccattcatcacaaatgtgatgaccacccttgtactggcatactcaatgccatgaacagggagggagtgaaggagtgaacagctgattgca

SEQ ID NO: 18034 - DNA, 201 bp, Bos taurus
aagaattatattttctcaagaaattggcctgtttaatcaccatattagagatgctttgtgaagaaattctaatcttccagaaagatcaagatctagaagtcatcacggcctcttgttcagacacagagaaaatagatttgacataggtctagtgctgtggattgattgacattaaatagactaactaagggttgaaaactc

SEQ ID NO: 18035 - DNA, 201 bp, Bos taurus
cggaagtcaacgatggtggcccagtcccaaataggtaatactgacaactggtggtcgtggagagcgagtgtgagcctgttagttttcaaatgaatacacaatgttgttcactcatgaaaatccactccatatgcatgataaatttaatctttagactgatctatatgggggtgaatggtaagaattttgaaacgttctcac

SEQ ID NO: 18036 - DNA, 201 bp, Bos taurus
tatccaactggtgatttgtgggacgaaatttttcctggaaagatttccttttaaattttaaaagataaaaatttatcaccagtttttagaccattttctaagaagtcaaaagagaaaacgattggctacaatgctaatgctgttaacacgcatgcatgctatacatacatggagtatgtgtgtatttctaacttaaacgat

SEQ ID NO: 18037 - DNA, 201 bp, Bos taurus
ctctttaaaccattatttatttcaacatttttatacattatgcaccaaatgcgataaataacccttaaaaggagtctgttctttcaagctgttagttttgagaaaaagagctaagccctaagaacaccaataacaccctcagtaaagaaactatctgattcctcaccttattttttttgtcattttaagagatgtccagta

SEQ ID NO: 18038 - DNA, 201 bp, Bos taurus
ccaggttggctggtcagacactgagtaatgccaagttggcttgactcctctgaaatgtatccaaaatacaatctcaaatgctaaacactgcagaacccccaaaaagtcatatgctataaagtatgggcttggtccacttaaaaaggttattattttcccgagagagactatggtgtctgtaagtggtggcatgaaagcaaa

SEQ ID NO: 18039 - DNA, 201 bp, Bos taurus
gcggtctgtgccctagggtagtgtgaaatcctgaagaaatggaagaggggtcaggtgaggattttcgggtcaaatgagaaaggtcaggcatgtttgggtcgcaagaccctataggcggagcaggctgcagtgttagcccccagcatggtgcctgggaccaggcgtaaggtgtcaaaaattgagagctcagaaagggaatgt

SEQ ID NO: 18040 - DNA, 201 bp, Bos taurus
ttatcaccaagatcatctttagtctttgtcaaaaccattgtttgccattcgtggcgtagaattgatgaagaacttgcattgtgagtggagcacataagccttttcaggatgaatacaaattgaacttgatagatttcccacaatatttgtgcctagaattagagtagtagtgacatgtgagtcagctgctggtaatttttt

SEQ ID NO: 18041 - DNA, 201 bp, Bos taurus
taagtgatttcaaccttccttgaagattgaagtatctgagtttgataccaaaataaaaatctgaaatttttattgttcttccaatggctatgtcatttctatagtgacctctaacaaaacctagttttagatttgatggctgttcaaaatgaagtgatcacggacatctaactgaagtatcagaatacctaagtagttata

SEQ ID NO: 18042 - DNA, 201 bp, Bos taurus
tcacagagagtcagacacgactgagcacgcatgcaaacatgcgatcaagctgcatgtttactttctccctaagtctgggagtgacatcaactggccactgtggcaacaagcattaggaggcttccatcctgactttcaaactcacctcatagtatttctattaatagctggcagagctcggctgagagctgtcataatccc

SEQ ID NO: 18043 - DNA, 201 bp, Bos taurus
cactttggctatttgcaaagttttttatgtaagataaatcaaattgtctcctactattagtagagctctgtttttcaaatgcagattcttaatatttgagaagccatgagccctcagcagaacatatgaaagctatccactctctcctgataaaaatacaaataaatatacattgtatacaattttagcagagctggagag

SEQ ID NO: 18044 - DNA, 201 bp, Bos taurus
ttacagtccagtgcatcccagcacatgtttagtctaaactgaaataactcaaatagttgaagattttcataagggatctttcagttaccctgttctaccgaagtcaaaatcgttttaaaacttctcattaaatccatctagaacctatgtcaacaatctcagttttaaaacatgtacagcatataaagtccttgaggaagt

SEQ ID NO: 18045 - DNA, 201 bp, Bos taurus
acacagtgaagaaatctacctgggaaaatgtacgctggggtaatggcactttaagcagcctttcaattctaacatttcacagccacctttttaatctgtaccgaaacactgctcagctgaccgcagggatggagcactgcaaaagatttgctagatttagtgtcttttctctaactgctcttgaaatcttcaagatcaaag

SEQ ID NO: 18046 - DNA, 201 bp, Bos taurus
ataacgtactatgaaagagagtcaaaacttgataggaaatctaactcatactctactttgggctattcaattaaaaaaaaaaaaaattcttcaaaatttgctattttcattcctactacattctggtagtgctggtagaatgtcaactagctctcagaccttcaaagttaaaaaaggggaggtctggaggtcaggcaggct

SEQ ID NO: 18047 - DNA, 201 bp, Bos taurus
ttgggctacagtccatagggtcacaaggcatgggacatgactgaagcgacttagcacagcacatttactttactaaggcctccagtccacctgcgaatctttccagatacattctcatagacaaacccagaaacaagagttaatcagccatctgggcctccctcagctcagtgaacatatagtaataaccatcacaggtat

SEQ ID NO: 18048 - DNA, 201 bp, Bos taurus
aaagaaggacttagttactgccacattagcaaaataaaatgccaggtgaaaccccaaatctcatttttacagccaccaagaatttacagttcagaatttacgctgggaagcaagctgtgaacatataaaattcagggcccacatcacaggagagcaccaccgatacgtctcagccccctgctgcacttgggacagtgagag

SEQ ID NO: 18049 - DNA, 201 bp, Bos taurus
tattttttgaaaattatgctggccacatgataactcacggagccaaaaaaccaacactgcctacccagtgtcactggatcagcagataacagctaggctacgcaagagatggataacaaaaggactggtgattatggcaaaccccacagcatcaccaaacccatccccagcattaaccaatgacaaccaagcagtcaagat

SEQ ID NO: 18050 - DNA, 201 bp, Bos taurus
aagcctcatcagagagcagcttgataacttgacatttaaagattaggaaattgcacagaaatatgcatttaggggctttgaaatagctctgactttcccccaaatttaaaatccaggttaaaacagaaaaaaaaaaaggtggccatttcagaaaaataaatagatttacaatctatacatctagatttcaactgatgtatc

SEQ ID NO: 18051 - DNA, 201 bp, Bos taurus
tgtcctcccacactcctgtctcaggtcataaagcaagaataatcaatccttttgaaaatattaggaaggaaactgcagcctgtgtctctactcaccatatcccaaacctccccaatactggtgggcacctgactgataacaagcaaaattaatgaagttggaaaaaaaaaaacctgttctcatgttctatactttatttgt

SEQ ID NO: 18052 - DNA, 201 bp, Bos taurus
tcagagttcctaggccttagagactcatttttaaatgatctgaatatgctagaatgtctcataggaataactgatgaatactaattaagattccaaattcctcacaaataaaaagttaaaagacaaatgtttagacataagagtaccttctagtaatgttttgagctccttggatgaagggttttcaagaacagctcagtt

SEQ ID NO: 18053 - DNA, 201 bp, Bos taurus
ggggaggaaccccgtttaaataatgctgattcagtaccacgtctctgacgctgttggtcctttccaaaaacattgtatttattattttttggccgtgctgcatctttgttgccgtgctgtggtgagcgggggctgctcttcgttgcagggtgcgggcttcccattgcgctggcctctcctgtcgtagagcacagactctag

SEQ ID NO: 18054 - DNA, 201 bp, Bos taurus
aaaacgtggccagtacctaaatgccataggtagttatccccaaataatggaaatataagttttcatttttatcatttcttatgcttttcaaaatttctctgataaagttgtattgctgttataataagaaagaaactcttcaattatttttataaattaatctgttttgtcaaggcaactcttctaagaacagattaacaa

SEQ ID NO: 18055 - DNA, 201 bp, Bos taurus
ggttacagggagaaggaacatagtggactaaaagtttgcttcaatagctgctgcttaagaaagctctttaagaaatttagtcagccttttggaggcatatagtagttacttatgcatttttttaattgccttaaattagccctgtaacattaccaaatgttatagcctttctcagaactaccttattataaatgggcattt

SEQ ID NO: 18056 - DNA, 201 bp, Bos taurus
tgcagggaagaaaaaggatcagataagggagagttcttcaggttcagagtttctttactaaagctatctttcttttacagtcctataaacataagagaaactgctcaatctttctctgtatcttttctcatctgtaagaaggaacagtagacactatttgcaaaaagtaagtttttaaattctacttttccacccaaaatt

SEQ ID NO: 18057 - DNA, 201 bp, Bos taurus
cacgaatactaggagccataatcaagttatgatctggggccaggatcaaggtatatgttagcattaacaaaagaaaattaccacgatatagcgtaggtgggactttaatgttactaattcacttgttattcttattcctgacaaatttaaagcagtcttacctaagtgaaacaaagatgaaatagtgtaccttttctatac

SEQ ID NO: 18058 - DNA, 201 bp, Bos taurus
gctttaccaatgtattagatactgaatttacagtgagtggacttgtggaagaccaaagatatgaatttagagtaattgcaagaaacgcagctggcaactttagtgaaccatccgagagtactggcgccattaccgcaagagatgaaattgacgcaccaaatgcctcactggatcccaaatataaagatgtcatcgttgttc

SEQ ID NO: 18059 - DNA, 201 bp, Bos taurus
agaaaagttttatagctcttatttcaagttatcaaatagctttcagatatattgagcccatttataaagggagcagcatacccatacctctcctcacagacacctgccaactttgttcaattcacatttaaaaactcaaattagttttccttagtctgccaggcaggcttcagagaacctcctcccacatttaccagtatc

SEQ ID NO: 18060 - DNA, 201 bp, Bos taurus
tctgatatacgttcataaacaagtctttttattttccttaagcactgtgggcatctgtgggtctaagcctcaggaaggcagcatcccttagttgacaaaagctgggctgcctcctaccagacacttcatcatggctggaaactactgttaccctgggagtgaagaactttcatcccctaatgtaatgagctctttacatgt

SEQ ID NO: 18061 - DNA, 201 bp, Bos taurus
acacccgccttatcttcctagggcaaatctgactgtgggcccttcagatcctcccttcccatcagagaagaaaaaatccaagctggcacattggcctgcctgtgctcacctcctcgccctccatcctgagccctctgctcttgacacacccgccactgttgttgttgatcagtcaccaagttgtgtctgactcttcacgac

SEQ ID NO: 18062 - DNA, 201 bp, Bos taurus
aaaatataaatatgaaaaaggttgtagtgttttattagcatgtcaattttataaatatagtatctaaaaattctataaattctgactttacaaaacaatattgaagttaaattctgctttattctgtgagagcttaaggcagataaataaaacctgcttaaccttaatatctttaggagttaatgtgcattacaaatttat

SEQ ID NO: 18063 - DNA, 201 bp, Bos taurus
cccccacttaaattttcccaataaacaaagtgccatgttgtcgcagcctagcctttcacctcgttacggtggtagcggagtgtgatgtcacagttgacccaataccagcctgcccataaatgatacagcctgttccccctttgcttcctggctcaagcactgggaaggagcttagtatgaaattcatgccgtgttgacaga

SEQ ID NO: 18064 - DNA, 201 bp, Bos taurus
aaattccactgtatcattttaggatgatgatagcacaaagggaagtggaggaaagaaataaaaaatgaatgagaaagggtgatgtggtcggtggatcagtacatttagaaggtatcttaacatacattcagtggaggatctatcaagttctaaaataggaagtagttccagaccacacccaagaaaatagcttttctcttg

SEQ ID NO: 18065 - DNA, 201 bp, Bos taurus
ggccagatcgtataaggcctgaggatgccctgtgtacagtgctttaggaggagtgtacaggaccttgtttgaggagggatccctggtgtaaagaagaaacatttgtaagtgaaaagggcctggaagaagtaactaagtatttcaggagtacacatactaaacataccccaggaatcacgaaagtagggggatactacttcc

SEQ ID NO: 18066 - DNA, 201 bp, Bos taurus
aaatgagtttccacagagatcagaattgggaccatatagatgtcctgcaggagagcacaagaagaagctcctggactataggtgatgtaaggtagccaccgtgggatgtccatagaaacaaaataccagaagaatctctcaaaactctatgatttcatatagaattgagagaggggtgtcagcatttagaagtcacacaaa

SEQ ID NO: 18067 - DNA, 201 bp, Bos taurus
tggctgaaatgcataaaaactaggtcattgacttaggcatgtattttttttttcagttttgcattctgacatttttttcatacacagacacatacatacatgtgcagactgtacacatttatacatagtgtgtatgcatatgtatatattttccacttgaactctcctttgtttaaatgtaaaatgtctctacttgcagaa

SEQ ID NO: 18068 - DNA, 201 bp, Bos taurus
attaagatgctgtgatagatatggaaatctacatacacatagtaactttgggtattttatcttcagcctgcccttcttgttaggaagcaatttttttttgacagttctttgtccataaatgctcttcttggaaaaattgtaaagttaacatgaaatacctaggtttaaaatgtcagacaaaaaattaaatttatatctctg

SEQ ID NO: 18069 - DNA, 201 bp, Bos taurus
gactttattgttttgtttttttaatgaattcgttaggtacacaagactataaatacagaatccttcttaggtacacacacagaatgtttatttgaacaaactcatgccacacattaaaaaaaagaagaagaagaagaaaatgttcctcgagttctctaagtttgaattttgcaatacaagtaagaaaaagaaattctagag

SEQ ID NO: 18070 - DNA, 201 bp, Bos taurus
gaaggacagggaagcctggcatgctgcagtctatggggttacaaagagtcagacacagcgagctgaaaaaaaaatgatttctgacttttcaagatattgacaccattctaagtacagttgatttttgatgaacacaggtttgaactgcatgggttgacttacgtgaatttttttcagtagtatatacaatattactgcgtc

SEQ ID NO: 18071 - DNA, 201 bp, Bos taurus
gtctgggcttgaaattggctttcctcgtatccattagcaactctattctagcatttcttatacagctttatgattttttaaactttctttagacataaacgatggaattctcaaatacagggacagtgtcttactcctatttatttctataaagtatagaccaaggtcccatcagtagttggtacttgatacatgtttggt

SEQ ID NO: 18072 - DNA, 201 bp, Bos taurus
cccacctccaccatcaacatcaattagaaacggcttccaagattcttcatgtgaaggtaagctgtggtcccagctcctgggaagctataatggggcagcaactgagtgggaggtgtgtttgtgtgtttgcatgaacgtttcttgtttgtgtgacctccactgttcacattgcacggcactaatctaagcattctagggcca

SEQ ID NO: 18073 - DNA, 201 bp, Bos taurus
taaacacttttttcctagagccattgtcccctggccagctgctagtactggaaaacttgtccactctgtgcagctggctccaaaccacatctttggctgtattttttctctgtcttcagcttctgttttctcttccagtgtctcctagcaatcttacaggtgctgacactatcatgagcaattagttctgaacagtgagca

SEQ ID NO: 18074 - DNA, 201 bp, Bos taurus
ttttttttttaatgaccacataataactctcagaatgctcaggagtaagcataaagcctcactgctgtaccaggagacttagagtgatagcaataaagatactaattcatatgcatgcaagcaacacaaactcaagtggggaatttgttttgcttgtgaacaggtcatattacacatgttatttgcatgaagggaattgga

SEQ ID NO: 18075 - DNA, 201 bp, Bos taurus
ctttcagatattttattattattacttttggctgagccgggtctttgttgatgcacccacgctttctcgagttgtggccagcaggagctactcgagctgtggtgtgcaggcttctcgttgaggtggcttctcttgctgtggtgtttaatagttgtggcactagggtgcagctggcccgcagcaggtgaaatcttcctgggc

SEQ ID NO: 18076 - DNA, 201 bp, Bos taurus
gtatctattggtttcttaggctttcttggataagctcatcatatattcacaaaaagtatggatgttgacacatgagcatactttacacagctactataattattgctgttcctacagatatttagttgtttatcaactctccatggaggtaatactgaatgatcatctgccgtactgtgagccttaggttttattttctga

SEQ ID NO: 18077 - DNA, 201 bp, Bos taurus
agtccttggccagaacagaatttcctacacactatttttgaaatctgacatttttactctaaaatatttaaataatttattttgaaaccaataaataatatctataatgttgttttaagtggccacatagtattccaccatttggacagaccagaactttctaaaccagtcttatattattgaacatttatattttctcca

SEQ ID NO: 18078 - DNA, 201 bp, Bos taurus
ggaaacttagacaaggatttgaatagatgatttaagaataatatactaagtgacttgaaagacataaaagtgaaatatgagcaatttggggcttgcatggaactgttctataataaagacaagacatctgaacttgtagccaagggaagaatgccttgtagttaactgcatgcactcaaaatgtgctcagcgttataaaag

SEQ ID NO: 18079 - DNA, 201 bp, Bos taurus
catttatcagaagtggaatttaaaaggttatactgattcttacaaaatttaataaagtattaggataaaaacatcttagagaaccaaagatagaacttctcagaatggctgtattctcaacaaccttttacattaaagttacaaaaactggttctaacaatggcactggactgaaggccttaagcctttaaattctctaac

SEQ ID NO: 18080 - DNA, 201 bp, Bos taurus
actaagtcagagccctgggctgatctcagcagactatctggtcttaacaagttatttgattctcttagtttcctcatatgcaaaactgataaccttgtatttcatggtttctaagatgcacgtttatttcttcaatatcactgcaatcgaggttgtatcacaactggtgtcattttaggattttcatcagtagccatttct

SEQ ID NO: 18081 - DNA, 201 bp, Bos taurus
ttaactgctattagggcataatcaatggttcagctgtccataggacggtctgacacaaaagcacccactatcagtcaaaccaatctaagctcgagcattatagctctctttccttaccaggtacagttttctggtcacagctggaactctgcttaaggttagtagccacacaagaagtagcctaaatgatccctgcagtat

SEQ ID NO: 18082 - DNA, 201 bp, Bos taurus
cctgttgtaggggtccactcttctcaactctccctgccgaggaagactctgaaccctccccaccggtgccaagtggaggatactatttcagaaaccagctgtgcttacatgccctggccccagcctctctctctctctctaagtctggaggttctcccgtattagtcagtgcccacaaactcactgtgctttgtgctcact

SEQ ID NO: 18083 - DNA, 201 bp, Bos taurus
ctggactataaaataagcacttcccctgcccgcctccaaaacacatgctgagaacatggtgaactgccttaggaattcttcacaatcaaggaggaagtcagtgagacttgggtttgaaagatgtggccagccatttatggcatgtgcttggatatccgtttatcaccttgtatttgggaatgttagcaagtacatgtacag

SEQ ID NO: 18084 - DNA, 201 bp, Bos taurus
tgtcatgaattgaattttgagttcccccaaattcatatgttgaaattctaacccccatttgagggtattatgaggcggggccttgagagatgaagccctcctgaatgggcttataccattataagaaacacgagagatgatttttctcttggccatgtgagggtataataagaagatgctcctctgcaaaccaagaagagt

SEQ ID NO: 18085 - DNA, 201 bp, Bos taurus
ctgccttaacacatcagaacaaatatttgttagactcggggccagtttcctcctcagaggcagacacaaaccgtctaaataatgaaatgcattagagtaacgggaaaagttcattgtctatgctatttttcacatagttttgtgagtgcagttgttgggactgatctggttttcaaagcagcctgtacatgcagattcatt

SEQ ID NO: 18086 - DNA, 201 bp, Bos taurus
atttgatggatacaatatttgaagcatgctattgtctaatgtgaacattttttgaactatacttctattagagtgttacaaaagaaaaaaataccaacccccaaaatgcctcaataaaatatagtccaattggaggtaaaaagaagaagagtggaatttcaaacactttacattttgtttgtagtgcgacatggatttccc

SEQ ID NO: 18087 - DNA, 201 bp, Bos taurus
ctaactggtcaagccagaaagccctttgtggtaaagcagaggtggtggtagagatctctgatttctaaaagcttgtttttaacctctaacagccaagagatagaacctacaaacctgtgggagctattgaagagcaggtagtaaaactgttggaagttatcatcacctcccattataacatgcctcttatttgtacagtgc

SEQ ID NO: 18088 - DNA, 201 bp, Bos taurus
tcagaactcttgttttcttcactttagaaatgctgtttggatctcaagactgtttctgttcaggccaccctgagtattaaataaagtcattggtggttgctggactgatttaaaaaaatattttactgttactttctgacaatttaaacttcagtaggaatattttagaatttcatccctgtgggcttcttttcccagaga

SEQ ID NO: 18089 - DNA, 201 bp, Bos taurus
atggcgccaggcggccagagaccgagaggccctgtgctggccgggtctttccttgcgccccagggtcaacacctggaggggctggcgtggctgtttttcttccgccttttcaagccaaccctcaggcaccctcctctctaatttatggtgtcctctttcctccaccccagtttctttttctttagggcaaaactgagttga

SEQ ID NO: 18090 - DNA, 201 bp, Bos taurus
tttctttttaccgtcaaggtgatgaaggtgtcttagtaaggtggaataaagaagcaaagctttatcagaataacaactagcagcagaggggttcatttgctttaaaggaagaacctgaaaggttcaggcttcttcccctaagcatgaaacattatcctggcctcagagaccttgactgtatccttctgggatgggggcact

SEQ ID NO: 18091 - DNA, 201 bp, Bos taurus
tttcatagaaaatctgttttgttcagtgaaatgtgaaagtatggtttacaaccatactttgatttttaattttttatcttagagaaagtggttggaactcacttagcataatcatgagaaacaacagaggccctgtgtgcctttcacacagagatgagagttcccctcctgggaatgagggtgaaggtctcaaattgcagg

SEQ ID NO: 18092 - DNA, 201 bp, Bos taurus
agcaacagaggcagaagctacattgcaggagtgaagaacagacgagctgtaaaccacttccccccaaaactctaaaagggaaaaacagggtaaagagaaatggggtgcgatatggccaactgaaactttttctcaagataggaaaaaaacctagggctattttccagcaaagaataaagaaatataatatgaaaccaaagt

SEQ ID NO: 18093 - DNA, 201 bp, Bos taurus
aaaatctgtctctaaaattatagtcctgagcttgagtgctctgcactcagtgttcagtgttcagttctgtgcacacactgtgtacatgtgtatgcactgcgtggtttatacaagaaaggaaaaaagaataaagtggttaggagacaggttgcgctgaggaaacactgacaaatctgaccttataaatggattatgcaagcc

SEQ ID NO: 18094 - DNA, 201 bp, Bos taurus
aaaatttaagttttagtctattctcctgaggcaactcctttattatttgatcattttgatatgattttagttctctggactgtccctaagttctttccttcggtagactgtatgagaagcgtacactttccagtatggcaccatgcttggagtgggagctgacatagactggttatgagcacattgcttgtgtttactgta

SEQ ID NO: 18095 - DNA, 201 bp, Bos taurus
aacaatggaccctttaagaagtctaaagaaagccttagttgttgagtgcgtcttattctggacccttgtaaataaggtaaaccagaaagcttgatagatatattactcagcattttgtgacaacgagctttagttaactttctgctgaggaatggggaaaagagactagtaagtgctgattgcagaaggcaggctttcagg

SEQ ID NO: 18096 - DNA, 201 bp, Bos taurus
attttgattcagcgtgcctaaagcaaatcaggctgtacagtacatagatagataaagacaacattttattaggcttataaagattagcaacagtattaggcagatcatggatatcaccacatcttacattacaatgataaaataatgctttggggctcagacctgatagatgttcttccaacaatattttgtacctaaaca

SEQ ID NO: 18097 - DNA, 201 bp, Bos taurus
ggtggccaaagtgttattcagcctgctctaacctgagtgtgggctgtatgcctttgcaatcgtgctatgcagatgctgcaaaactctgctccactggtgcggcgtggactaaaactgtttggcctgtgcagtattattgttttataatggtgaaatatttcaaatgtatggaacagtaggatcactaatataatagtgata

SEQ ID NO: 18098 - DNA, 201 bp, Bos taurus
atcacactgcccagaatggctcagaatttaaaactcccaaattgtttatttctggaattttccatttaatattttctgacaatgattgaccttgggtaaagaccatcacagagagggaaaccacaaaaaaggggggaatggctgtaacggatttttttttttaagtggcaagcagtcatatttacagagtgattcttttat

SEQ ID NO: 18099 - DNA, 201 bp, Bos taurus
caaagccttttcgtctcagtcaaaatcctaatggtggcccttacaagagctagctcctcattatcttgttgacctcatttcctacttctccgtctccctccctctcctgcagtcagaagggccttcttgccattgtgcctctgcctcagggcctttgcgtgggctgttcctcttcctgggatgctcttctcaggacctcac

SEQ ID NO: 18100 - DNA, 201 bp, Bos taurus
tgagtttggagggaggaagtgggcatgtgtggcccagccccttgccctccctttctgagggagctggactgctcatagagaggtgctgttggtcagtcaccgtggccctgcctgggggaggtcggaatgcgctggacgtgcttgctggggacaggataggtaagtcttgtctaaatccaggggtcgttcatcaaggaaggc

SEQ ID NO: 18101 - DNA, 201 bp, Bos taurus
ttatatgtcagattcatagacgtacaattagtagatcaaggggtatgactactttgaaattttggaaacattgccaaacaaccctgtcaagagagagtgtgttcccaatagcagagaaagtcgaaggcactgtatccttgtgagcatttcgtgtttcctatgatcattttgtagtctttgctaatttaatttgggagatta

SEQ ID NO: 18102 - DNA, 201 bp, Bos taurus
gccttcccttctggtccagcttcctaggttgttgccactttggactctatttgagcactgtagctagtaatacctggtaaagtgaagtttctgggaaacgttggccattcagtggctctgttgagagagcatactcatcacttgatcaagcgtcacgcacacaggattttttcactctgctttattgactggcgtatcctt

SEQ ID NO: 18103 - DNA, 201 bp, Bos taurus
ctgtgtttaggtggcaattctgttctgttccctattgcttgtcatcttgaattgcaggcctctgaaactggcactggttgcctgtctcccattcagcaccatgagcactctgcttatatgtaaccccctttcatcctaaaggctgcacatggtgttccttccaggaggtcctgctgtactcttttctccatcctactgggc

SEQ ID NO: 18104 - DNA, 201 bp, Bos taurus
gccattctacacaaggcacgtaactgagacatggaaccagatgcagatggacctgcaactctgcccagattaagaatgttcaaaaaagcccatcttgagggaaattgcagggcccccatctttaagtaaaaagaagcgcctaaattaatgccttagcttgcaggactgaaagagaaggaatcatagggtaataaacactcg

SEQ ID NO: 18105 - DNA, 201 bp, Bos taurus
aattatccctggaaaatagtcataggaattccaatgattttaagaaggagcattaggcagagatacaatgttgcaaaacaaaagatgatggagttaccaactcattctcaacaacagcaatgacaggaagctacaagtgagtaacctgactccatatggttagaggatccttcaaacagcaagaaggaagggaaagcgcct

SEQ ID NO: 18106 - DNA, 201 bp, Bos taurus
aattgggttcaatcatacacatcaaatcatactctagtcatgccacatcaggaaatatatgcattattttactcagtcatggaattttagtcaatcaactgaaccagaatattatttacaacaatactgtcttgaatgaaaagagatgtatagaaattcacaatacacccagcaaaagcagacaacctacaatttattgag

SEQ ID NO: 18107 - DNA, 201 bp, Bos taurus
agaggaaggcaaagtcgagctgcaaattaaattcattctttgaagacttattagtaggcaaagaaagtcaatgagcaatgtagaaaatgatttaagcccgtcgctgccattttatctaggggcaagctctgtcaaagactatttagtgcttcgccctattaccacaaacttatcaccatctgttccttttgtacatccctc

SEQ ID NO: 18108 - DNA, 201 bp, Bos taurus
tcagcaaaaatgaataatcctgttttaaagtaagttcagaatttcacgcaaacagaacatgactaatgcttttatttggagttgttttaataattgatttataagtgccaagactgaagactgatcatttcaatgacttaatattaacatccattgctgccatttggttggtagtcttgtttgaatgaagacacttcctat

SEQ ID NO: 18109 - DNA, 201 bp, Bos taurus
tgttgtatgccatattatttgttattttcagattcctaaaaagtgcctaatacatagaagtgttcaacactcttgactctaaagcgcattcttgggagcggggagtggatgagttctgggtagctgtggatcaagcctcgattgtgtgctcaaagtccaagctgactgaacacctcatgaccaaatacactggctatgtaa

SEQ ID NO: 18110 - DNA, 201 bp, Bos taurus
aaaatgtgcaaccattctcaaacataaaattaacatcattcctagttcaccagtaaattattcatctgctccataattattttaaattactaaataggggtgaagtaatctttaaaattaaaaaaaaaaaaaaaacaacttgtaaaaaatgctgacattttggacagctcccttctgatttctacaacatttctgtgaggt

SEQ ID NO: 18111 - DNA, 201 bp, Bos taurus
ggaatatagccaacattttgtaataacggtaaatggaagataacctttaaaaattaaataattttaaaaaattactaataattgactgaaaactaaagatgctattgtcataaaatacttgcagaaaatagggaataataggacctgtaagtgttctaatggaaaacagagggtggaggaacatgttataaggctacagtg

SEQ ID NO: 18112 - DNA, 201 bp, Bos taurus
ttggttgagtccaaaatgaatactcctatgtcccaactttttactttattttattttttgccccaactttttaaagaaaatattcagtgtgccattatttaatattcttagaagaaatattcttcagggaggggaaaagatgattcaggtcttgaatgcacatttccttatttctttagtttaacatatctcatttagaag

SEQ ID NO: 18113 - DNA, 201 bp, Bos taurus
tttatattagattctgatatgaatgcacattgtaatctgagaattattccaaagtgtactgtactggtctaaggggtacctaagaccatttagtgtgtccatgaggatggtttgattttcataataagatgctatttgcccttttcactgagttggcattttatttgactgtgcggaggccatgacaagtaaaattgctag

SEQ ID NO: 18114 - DNA, 201 bp, Bos taurus
cccaacgacatagaagcctgcaagtactcaatctccttagtaaatgccaccctagctattgcttacttatcatattaaaatatttctaatacaggtaaggtttatgctttctctaaggagaactggctttatttttattatgtacttaaggaacatcttaactttccagaaaattagtgaagaagggaatatattaagatg

SEQ ID NO: 18115 - DNA, 201 bp, Bos taurus
ctttcttctgaatataatagaaaagagggggaaagaataactgggagatgtggttaatgacagtatcaggatactgatttgtcttatgtgatagaaaacagcatatgggcccagtgagattggaaggtaattatacacttagatgagttgaagcagccaactagttgttaatggtagatcaagacaatgatagtatttgta

SEQ ID NO: 18116 - DNA, 201 bp, Bos taurus
agtctaggattaatcaccaaagagacctagtattcatggtgataaaaactactctctgaatgtagagagatgtgaaatttgtataattctagacatgtttgtcttaactgcagaagtcccagaagaatagattttctcacgtctccatggggtgtttcttaaatctattactttatgaaattaaatattggcatatgaaaa

SEQ ID NO: 18117 - DNA, 201 bp, Bos taurus
agtaacctcagagttcagaaataaaaaaggctataaaacaagcattaattcctttatgtccatttcttgcacaatttcactatagatatgtcatccatagggcatagagaataataacatagggtgtccaacccagagaagctggcatgcaaccactaaaaagattgctttggctgggatgaccatatgcaagggacaagt

SEQ ID NO: 18118 - DNA, 201 bp, Bos taurus
ttttcctactggcttccgttgggcatggctccatgttcttagaagatagccacattccttgctgcgtggactcagccattttcaaaatgaagaatctccatgtcaaaccactcttctgttttgaatctctctcatcagcaaaaagttctatcccatttaagagttcaccagatccactaaggataacctctttaactaatt

SEQ ID NO: 18119 - DNA, 201 bp, Bos taurus
ctttcttgcttattgtccttacgtgccccttacccataccacttctctcattcttttttgctgtcttcagctttagggtccttcatcacttctcccctgtatttttcaagagagagatgcttttcatgattttactgaccgtatactttctctaccatcacttaggagtgatgaactatgttctccccacagttctgacca

SEQ ID NO: 18120 - DNA, 201 bp, Bos taurus
atttgcactgatggcttcttgcttcaagccccagtgactatgaaaactctctggtatatgttgtaagtggtcttatttacattttatagatgaaacattgttaatgagattgggctgataattattttaaagaaaaaccaagaaaatttgaatacttttaactatgagtattttttaatgtaaaatgtatgtatttttaaa

SEQ ID NO: 18121 - DNA, 201 bp, Bos taurus
ttgtttgatttgttttgttttatctcgttctcttgcgtttcaggcttaccttcactattctttctcagcaagactggtaatggtggtggggcagtagagacaatttttgggcagagaaaaatattctttcacttgagtagacgtcttcaagaatacagtcattcctgcccacttcctaaataaatcctttcttatgttttt

SEQ ID NO: 18122 - DNA, 201 bp, Bos taurus
tcttttagcttaactaatgctgttcacttatatcagctgaaaatctaactcatatgcaactttttttcactgggaattgtttgggagaaaaccacgccccgtgaaagagggggccctttattattcatgggtagatattctgtatttgtgatttaaccttgatctgaaagtcacctaagagtaagcagtttttcttttctt

SEQ ID NO: 18123 - DNA, 201 bp, Bos taurus
tcattttccaaatatgtataatttgggagatttccaaaaaactgtagggtagatcattaaaagctacaattagccagtggccatcatttcagccttctgtcaccatcctcttccttccccagttcccatgaggctgatgctttatgataacaaccctcaatgtgggctagtggcctaagagatcagaaaaaacgtttatat

SEQ ID NO: 18124 - DNA, 201 bp, Bos taurus
taatgttgactttgctgcaccctattcctctcagaacaatgagtctgatcctgccgtccaagatttgcatattaaatcaagatgataaataattgttgagccttagtagatagtaattaatgtagtctacttaaagtattcaaattgtctttttatttctaggctataaaacagattttagtactatcttggaaaatcttg

SEQ ID NO: 18125 - DNA, 201 bp, Bos taurus
ttctttgctttaaaagtctcattaagttgcaagttggcacaattcttggacagaatattttattacaggaactctgaaagcattatatgttccacttatttcaataagtgaagtttatcttctgggaaaagtaaacgcagatcttggcttaagttaccttcagcacaacagacactagtcacaattttcttgttctacttg

SEQ ID NO: 18126 - DNA, 201 bp, Bos taurus
ctgcatgcacaccagggtctcacacttttcccctcatctctgcatttgggaagcccaataactttggtggaaaactcctttaagcctctcctttgcggtcgcggcttttgtaactgccctcaggccatcgcatccctcttgcaggggtagtgttgcagtttaggccttcctccacaaagcttcttgaagagatttttagat

SEQ ID NO: 18127 - DNA, 201 bp, Bos taurus
tctacaatctaggctatgatttgaagatgtaatttcttgctttgtgtagttattcttaactctttgtagcatgctttaactcaagttgtaagcaagtttcgtataccaattaggctttgtgccagctaagttcaactgaaaccagaccttgaatccctaaaattgtaaaggtttattgtgacaaatacagaaacaagatat

SEQ ID NO: 18128 - DNA, 201 bp, Bos taurus
aactgaaggcatgctatgacagaggtcctctttagctcattttctgctggcagatatcctgtatcagaagcaatattgatctttttcttacacagataggcttgtgattgttactgagtttttaaaacctagagtatgtgttgttagaaatcacatttagtgaaaaatctaaagaatagcaagtcaatgactgacatgaaa

SEQ ID NO: 18129 - DNA, 201 bp, Bos taurus
ataattaacaaaataccattttatcagttaagaaacactaaaattttatacccagggcattcaaaaaaataaaggaaaagtgtagaaaaagtttaagatgcgtaaaaactggtgggtttaacaacaatcacagagctaaatctaatagttatcaactggctctccacaaaaatgtatttatttatataaagaatgcataga

SEQ ID NO: 18130 - DNA, 201 bp, Bos taurus
caactcatagaaaagtctgaataattaaaattcatttcatccaataaatgcctaggatatgaatgcacttttaagaccccagtggggcatgcggggtgaggacttcttcttcctacagaagagatgctacagttacactagtttttgttaaaatttttcaaattttactctctctgactcagtttcttcatccttaaaatg

SEQ ID NO: 18131 - DNA, 201 bp, Bos taurus
tctctgccttctattctcttcttccaatgtatgccagatatataagtgaaatcaaaccaaatctaaaatacaaaccaacgacattttctctgtttttcttttatgtagccctgtgattgtttcttcctgttccatgcattcctgcatcttctgaaatcaagcaagttatatctggaattgtagtggttttaaaattatttg

SEQ ID NO: 18132 - DNA, 201 bp, Bos taurus
tataatatgaaattacattttgatgattagaagcttatttgccttcattggaatgatgatctttcttcttgtttgaatcctaaagcaagaccttttccaacatagcaaataatttttcataaatcttacttttgctataattaaacactagagaagatcatagtaaacttctagacatgagacatgtgaagtaggtacagg

SEQ ID NO: 18133 - DNA, 201 bp, Bos taurus
aagtgaagtgatatagagatgaaccatttctacaatttcacagtcactgatattgacaaaattaaaattgacaccaacaaagcaaaacatctgttattggcgacatatttaaacacacagtagacaacagaataatagctgtgtgaaagaagagttacagggcacatgtccttagttttcagttctttgacttgaggtttc

SEQ ID NO: 18134 - DNA, 201 bp, Bos taurus
atggaccactttttctgattctgtataacttttttctcctatccaaagaccaaaagatactatcttcatatgaaaaccaaactatcctgtattataactatacaagctatattagatgctattattatccacagaatgaactgaacatgtattaaattgatcatagtttatggaggtggggggaatcacattttttatact

SEQ ID NO: 18135 - DNA, 201 bp, Bos taurus
cttacaggtcactggcttctcctgatacccctacaccagatccccgattccactcctacccacagcagggtagggccccatgcagagctttgtcctagcatagggtgccttcacctagcttcagggtcagagtccagcccgtactttctctaaggccctctctaccccatccagtttctgctgtggtgacggaggagggtg

SEQ ID NO: 18136 - DNA, 201 bp, Bos taurus
aacattaaaataccctgagatacacaaggagctttaagccatctaatctgaaagagaattttccagtgactgcttttactgcattgtttgttgattatacgtctttatatgtaacagcacagttacaaagtcaccagtcctaagagacagcagttatctaaactataagtcaccttctgatgctgtttgttcttcttgtta

SEQ ID NO: 18137 - DNA, 201 bp, Bos taurus
ccctttgggaaagtgtagcattttccttcaaatgttcccccaattcagtttcttttccgatagttaatcggaacacagcagtgctctcaagagaccatgaacattcagaaaagaatcgggaaggaaaagtctgttttatagctaatgaatgagagttgtacagttttcttgatttgagagtagaaaaatcatttttacccc

SEQ ID NO: 18138 - DNA, 201 bp, Bos taurus
tttatatgaatgttattaaacatacctaccacagtattaaaatatataagctgcatatatttctcagctttgtggtttctacagaaatgtggtaatagattgctgaagattaattgttttcttgaaattcatcatataaattttcttcagatccaatgaattggattgaattgaatcattctatccaattgaatgatctta

SEQ ID NO: 18139 - DNA, 201 bp, Bos taurus
cctgacccgaggattaaggcagcacggttctggtagcacactaagacaggaaatggaatgttaaagcagcagagagtgctcatggtcaaatctgcatctcgtggtccagctgagttttccttttcagtgttctaatagcctgggttcaagtctcatcacctctcttctcaggaattcctttcttctcacagctggtccttc

SEQ ID NO: 18140 - DNA, 201 bp, Bos taurus
aaaaataaacgttgatattttccaataagttgcttctatttcttatagcaaaaatgctctatgttacaaagtatgaaaaaagaaaataagaattttaggcactgttcattaattgcatgcatttatatactgcatatttacttcttaaatacatgtaaattctaaagtaagtcattaagcattcatgtgatttaaatagtg

SEQ ID NO: 18141 - DNA, 201 bp, Bos taurus
catgtttttccatacactctactacttataagaaagaaaaagaatgtgtgagtttctccctgaatccttgaagctcttttgaaatgtgatttaatagaaagttacattttacttatcatgtgatatttcatgtttaagggccaagaatattctgtatgtataagagaaaagcatagccagagtgtgttgaaatatgagtca

SEQ ID NO: 18142 - DNA, 201 bp, Bos taurus
tttttttcattatcttcactgctctctgtacactgtatcatggccccagagagctctcaaagaggtcaggtggagcccaggcctctttttatcaatcagagtaatactttgtttcattatctaggaattgtcaaggcaaaaacaaagataatggccacaagaatgctacctcaatgttgaaaacctcatggaggttcagat

SEQ ID NO: 18143 - DNA, 201 bp, Bos taurus
catttgtatcatttttttagattcaggctataagtgatacatgatatatgtctttatctgacttcacttagtatggtgatttccagttccagacatgttactgaaaaatggcatcatttcattctcagtggctgagtaacatattctgctgtatatatgtaccacatcttctttatcccttcatctatcagtggacattta

SEQ ID NO: 18144 - DNA, 201 bp, Bos taurus
ataattctgatgagtgtttggatgcagtaaggcaacatttacagtctgagaagacccaacaaagaagagtgggcaagtgctaagcaaaagatttatttctcgaaacagaggtgatgacagcactgttcttggcttatttcctctattagctgctagtccttaatacaatcatgatgtttttaccccaagtttgttctctta

SEQ ID NO: 18145 - DNA, 201 bp, Bos taurus
ggtgataactttatgttatatagaaccatgtctttaagaatgccttctttcatcttaggttacatgtccatgttatctgagcacatgaaatccagtgcttctgttttatattcctgaatagatagtattgtcattcccttgtgaatacatcagtatgtcccacaagttcataatctccttgaaggcaagaattgcattact

SEQ ID NO: 18146 - DNA, 201 bp, Bos taurus
aaattcagtttccctttcttagtgtgatccattccatgagaacatgctaggagtttcccatccctttgacttttctgtggcaccaggacacacatggcccggtcgctgacagccacattgccactggcatcttccttgtactgcacactctgcatgtgtcaagaagccatgcctcctgtcttctttgccaggatattatgt

SEQ ID NO: 18147 - DNA, 201 bp, Bos taurus
gctttcttttactacatatttgatgtaatgaatagccactaaactagcatgagtaattttatataatactgtttttatccacggccttgattataaagttactttataacttgctttcgtttcttactttgaattggcttgccctcaataacaacataaggttctaggtgttcactgcatttggaaatcagaataccatca

SEQ ID NO: 18148 - DNA, 201 bp, Bos taurus
acattgtaagttatgttcacacaattcaaaattccatatattaaatatcattgagacaaatatatttcagttatacacacacaccatttacctaccattgcccaaacagacacaactgtaactcagctatacagctatacagtctatgctgtcacattttggatggcttccttaccccatcaatataaatatcatcatcat

SEQ ID NO: 18149 - DNA, 201 bp, Bos taurus
tgtccttcctatttttcctccaggctctttattctaaagtctcaaaatgccacagagcacaataattataccatctggagccccctgacatgaacaataccaagcttaagacaagcatctggtattttcagattacaaatggtatatgttaaattatggttcacaaatgatgacggtcatttcaggctggtctccaaccat

SEQ ID NO: 18150 - DNA, 201 bp, Bos taurus
aaagtctgtaaagataagaaatgattgtaactacattgcaagtttaaatgagatcaggactctgggggtgagattcttgtatgtgttagaggaaaaccataaaaaaaatgatgccatttcaaaataatctcaaattttaatcctgccatgctggctttagaggtatttcaagaggtttcaaaattctgagtgaccatcgta

SEQ ID NO: 18151 - DNA, 201 bp, Bos taurus
tgttgcctagagaatcccatggacagagcagccgggcaggctacagtctatggggtcacaaacagtcagacatgactgagcaactaacactgtacattattagattgatttgctaatattttttaaggattgttgcatgtgtgttcatgagagatacaggtctgtcgttttctagcaatgtctgcttggtttgtataaggt

SEQ ID NO: 18152 - DNA, 201 bp, Bos taurus
tgacaatatcagataatgatgaggaagtagaacaatcgaaactcttcacacgttcctggtgggaagtagtccagcaatatattttaaaagggatcatgactctaagacacaaactattttataaaaagttatgtacaagaatgttgataatagatttttaaaaataatttcccgaaattggaaacgactcattgaccatca

SEQ ID NO: 18153 - DNA, 201 bp, Bos taurus
ggatttcatttattacctatttcttttgttatctatttcctttcaggaaaggattaacaaaccggcataggtacagcatataataactcctgaaaataacgtactcttattgcagaggacttttatgaaaggcttttaggttgtatatattgttgagctccaatttattgttttacttgtgtaagacttctgagtggtaaa

SEQ ID NO: 18154 - DNA, 201 bp, Bos taurus
gccccatggttggggagcatgagtgaggaggggacttggacacaatccatacaaagagctacaatccatagatttgggctccattgcaactctccgcctagacctcttgttctggccggggccctgtatcctcagcagatttgcctcttccctgggtgcctatgagtgctccccctcagtcgggtcactactgaattacac

SEQ ID NO: 18155 - DNA, 201 bp, Bos taurus
acatagagaggccatcccatcccaagagctggcagtcattactaggtccctagagttcaatttggctcccagccaggtttactcagtgtttattcccccaggagtgttttgaggtgccccagggctggtctagccggccccagattgttattgtctgatgtgaatgaggggctgggtccaggcaagatccaagccaaacag

SEQ ID NO: 18156 - DNA, 201 bp, Bos taurus
atatgattcatcaagaattctacaataaaatagaccttcttttccactcaacataaacttgaaagttatttgaagataatttgcctccaaatttggagcagtgtgcctgaatggaacatatcctatccaacatggttgagggttatgtctgaaaaaagaaaaagaaagaaataaattttcaaatattttagaaggatcatt

SEQ ID NO: 18157 - DNA, 201 bp, Bos taurus
tgagcaactaacaggctttgcaacacacctttatattttatggcagattttggtctttatagcagagtttagtgaaaacttttaatcttaaatgttaaaaaaaatgtttatctggatctatcctagttgaaagcagtgtccttcataagtattattatcagagtttgctaattctgtagcccagtttatacatatcgattt

SEQ ID NO: 18158 - DNA, 201 bp, Bos taurus
aacaatgttcactgtctggcccatctgaaaggcagggtgctgaaaatcattaatatactgtaatttcacatgagcccggcatgggtcacagaggatggtatggcctgttgtgaaagactccattacttcacagggagttttggcttggagaccctggctctgagaaaaataacccactggttggcagctctagcctaacag

SEQ ID NO: 18159 - DNA, 201 bp, Bos taurus
tgtatgtcacaagaaacacaggaacatgcccaaacataacactatagtgcggtcttacgagagcagggttttggatggaattgtgggcctaaacaacctattgatttgaactcttacaaacaaacttaaaggcactagaatttcaatctgtttgaactgaaattacataaatccttatttggcctttttttcctttggttc

SEQ ID NO: 18160 - DNA, 201 bp, Bos taurus
gcagagtcctttactcctgactccatgggggagggcctttaagccagatgcatggaaagcaggttcagcgaagacagtgattcaaaactcacacagacacgtctccaaagtcctgaggccagctccctggaggaaatccggcagcctctgccatcgaaagagtgtggtttccagggcacgtgaggctgggagcagctgggc

SEQ ID NO: 18161 - DNA, 201 bp, Bos taurus
caccgacttaaaacttggaagaagggcaagtttaaacttatgttgaagttaggcgagtgagtaaaccagcagccacctccatctcctaacagcccccaggtcctcatgtgacttttccattggctcagcagccctgcattcatgcttcggtgtggatcacctggcatggttccccttaaatgaacctcaacacccccgctg

SEQ ID NO: 18162 - DNA, 201 bp, Bos taurus
ccactgtgaggacataatgggctgcctatgacctagaacccactgcttactcttcaaagagacacgtgcgtctgatctctgtggaactaaagagtggtagcgatgagcagttccattaaatgatagtagtgggcttcctttatgattttgtttgtatttcagaaaactctggtccaagggcttctaaaacttcatagaaac

SEQ ID NO: 18163 - DNA, 201 bp, Bos taurus
tccgtccatgggattttccaggcaagagtactggagtggggtgccattgctaatagaggaatcgtgagcctcgattcttagctgctgtgtaatgctgtttcttcctttggcctggagggtccagcctccctgatgcttatggttgcctgatacctgaacagaatcggggatctatgagctagaaataagtgagaaatgctt

SEQ ID NO: 18164 - DNA, 201 bp, Bos taurus
aacaataactacagccaaggtggatttttttttttttaattgtgtcaggggagggatcttggagaaagactgagtctagaggggaggacatgttcaaatgagtggagggaggtggaagggagttatcatcagcagagatcagcttaagcaaaagagtgcagatgactgaaacagcccaatttatgtagggtctgcttctca

SEQ ID NO: 18165 - DNA, 201 bp, Bos taurus
gcaaatgtgattaaataaaggctcttaagtggggagattatcctgaattatcagagtgggccccaaatgcaatcccatatatccttataagagggaagccgagggagatttgaaaggcagtatgaccacagaggtgaagacaatgctgggagccacgagcagctgaaagaagcaatgaacagcttctcccttagcacctca

SEQ ID NO: 18166 - DNA, 201 bp, Bos taurus
ggttcttcactgcttaaagataatccagcagcttccaaacaggcaggcttttagattttgttagacatcaaattgtatttttgagggcctggtattttgcatcagactctaatttagagttactaatcagtcactcactatgacagcattttgaactcaatctatagaaacaattttaaaagatacctggcctgatgaaaa

SEQ ID NO: 18167 - DNA, 201 bp, Bos taurus
ctttccgtttcctgagcacggctggagacgacagctggggctcgaaggatctttgctccgactttaatttggctcttctttagggaaattcccgcttccgtccgaggacgcttcgcggagcatgacagaggggccccaccccacgccagaggcgtaaggaagtggctgcacccctatctcctagccgcgatgtgcgttccc

SEQ ID NO: 18168 - DNA, 201 bp, Bos taurus
agcaaaatgcaagcaaaaattaaaaatacttctttagcaactttgcttttaaggttttcatatcagatcattccctcttgactgtaagctttatttctgcattaataacattttatttctttctacttactaggctgtcttaagcaatatttggttttgctgctttattggattgtagggcatcagtttcagtttatttct

SEQ ID NO: 18169 - DNA, 201 bp, Bos taurus
caatcccttcctgtcacagcctctctctcaaattcagaccataagttgaatagagcctctgaaaataataaatccattttcagttagaagataaacaacccggtaagcattagaatgctctgaggccatgtctttctccactcagaaaacattcacttcttgtttattcagaaataaaatggcatccttggaaggaagaaa

SEQ ID NO: 18170 - DNA, 201 bp, Bos taurus
gagaatagaatcaaagcttattcagcagcatcttttcccccttagagacaacacattcacatcttatagcaagtaatctaatgagagattatcatctgcttctgggctcttcatgtcatacatatttacttttacagcagccatttttaattattttctattcccattcaacacccataaaataatgttatgtaatttttt

SEQ ID NO: 18171 - DNA, 201 bp, Bos taurus
atctagcgatgagattctaaactgaccttcccgcagtttacttcccgcagtaaggttagaaggcaagtgtttggctatttcatagcacttcaacttgctaatcaatgaaataatagagtacttctgatatccattttagtgttaaataaattatccatacaaggtaacacaaaacataaaatgaacatccatttttttgtt

SEQ ID NO: 18172 - DNA, 201 bp, Bos taurus
attcatattagttgaaatacaagaaaaaaaatcttatcctggtgagattcattatatttgaaatattggtgtgactatgaaatatgaattctatatctgccattgcaacccattttatccctaattttaactttttgtctaactgggaaaattagagtgtctattgctttttaaaaatttttctagcagttttctatcaaa

SEQ ID NO: 18173 - DNA, 201 bp, Bos taurus
gtgctgagatcctaacctatggtaacatttttcatttcaaagatggagtcaacaatactaatctggagaaaattaaagagatggggacagaaaaaatggcaaacaggtgtaatgaaagtgaagtataaatgagagtaaactgggaggcaaagaaattaagtgacacaaagtgtaagaaatggaagattgaaaaataatgaa

SEQ ID NO: 18174 - DNA, 201 bp, Bos taurus
gtacagggtttggggatgaacagctggcacaccagggtttttagggcagtaaaactattcagtgcttacatgctacatttcaaccattttagtctgccttaaaggtgaacctaggtaccatgatgcacatggtgggaaaacaaaacaaaaaaactattgacagatacactatcaaatctgttttctttaacagcttctaaa

SEQ ID NO: 18175 - DNA, 201 bp, Bos taurus
atgcatacaaatatgatgaaaataaaaaaactgcatggtattgatacacatcatttcagaacagtaatttccttgggggaataaggaagtggaaagaagtgcagttagatcttagcaacttatatttttaaaacaaaatttcaaacatttcaacttgcaaacaaatgttaagactgagaagtggacacacaaatgtttctt

SEQ ID NO: 18176 - DNA, 201 bp, Bos taurus
tctgggcttattccactgcatacatctctctctttagtccaaatatgaatttagaaaatctcgtgctatatagtccctgtattttacacccctaagtctgcaatttcctcatcttaagtgtcatcatcttcagacatcaaatttcatcagggtcaatgtgaaattttacatacctcaacaagacttttcaacaagtctttc

SEQ ID NO: 18177 - DNA, 201 bp, Bos taurus
aagttttgccttctgctagtcagtcttttctctcaattaaaatctctatgaattttactctatataatggaagtatctctttcccttcctcccacctcttctaatgcagatgtcactcagaaggtagaccctagaaatagatatctcacttgactgctgatgggtttcctcctcattacatagaatgcagtggctactcca

SEQ ID NO: 18178 - DNA, 201 bp, Bos taurus
gatatgtaatttacattgcaattaagaaatatatctatagaatactatctgaccctgtataataaatttatctttctttggatttgcaattgaaaaaaaataattaactgatgcatgtacaagccactccaattgctgggaaacactgcaagttagaaacagcaagcagtgattctcccttgaaggtttctgaaagaatat

SEQ ID NO: 18179 - DNA, 201 bp, Bos taurus
agagatcttttatatattatgtgctcatatgaatgataatacactaagaccctgataaataggcaaaaggagagattacaaaagaggaaatataactattaaaaacataaagcaaaatattcaaaatttttattaatcaaaggatataaactaaaatattgagataggattaatcacctgttatttaaaatttaataatga

SEQ ID NO: 18180 - DNA, 201 bp, Bos taurus
ttcaacacatatttttcaaggactataaagtgacaggaaggtttctaagcactgtaacactggtctctgaactactttggctatagagataggtaataaaaataaaacaatatagcacacagtaagaattgattggccattgtatcaaaactgcaagaaatacacttttggcagagaaagagtacccatttagttcaagac

SEQ ID NO: 18181 - DNA, 201 bp, Bos taurus
tgatagaatcacatttcctccctgtggaacatggaaatacagtgagatagtgttcctatttaccatctttccccttggctatgtccacattagagaaacacagattgttacaatttgattttatccttttcaaagctatattgatgttttcatataagctactgaacacaacacaccacatcaaagaaagaaaaattgact

SEQ ID NO: 18182 - DNA, 201 bp, Bos taurus
ctgtggttgaatatagcattagctatagaggacttggcaataagctggattgtcagtggcagcctgaagaagtactgcttattgaggagaaacagagaggagctagaatgaggcatgaaggaaaatgagaaaataacagggaaaatcatatttattgcaggaaaagatgtgacaaaacaccaactcttcctctctccctca

SEQ ID NO: 18183 - DNA, 201 bp, Bos taurus
cccatatgccagttaccagacttctttatgcagaagaaaacttgaactctaccttgttgaaagcaatgaaattatgttatataaaatccattgagcctcaattgctcacaaaaatgttagagcaacaattaattttgtttgtaaagactactaaaaataatactgactcaagtgttctagctctgacaagtgcagactagg

SEQ ID NO: 18184 - DNA, 201 bp, Bos taurus
tggcaagcatcaaatacttatactattaaaatagaggacaaaaaataaatcagctaaaaatgactaaatgatggagttttaggggtattactgtgaagagaagcgagaacagtgaaagggaagagttgatggtgttggtgtcaggccatgttgataaacttacttggctctgcaaagggagctctatctatgggtatcaga

SEQ ID NO: 18185 - DNA, 201 bp, Bos taurus
tagacattgaaccatcagtattcatttgttggtgggggggagtagggtgggagtgggatgagggtaggggtagggtggcaggggccgtggtttgagctgctttgcctgatccatacttctaacttggagaaattaccttgctaactgtaactagctgctttgcaagtatcttccccccaccatgagacttgtagaagtggg

SEQ ID NO: 18186 - DNA, 201 bp, Bos taurus
gaataagaataatttgctaatttcctatctttgaaagcaaagtgtccactttgtataaatttgggggcaaactattcatgtgttacatgtgagtataccccctaagaaattccagaagtcactttgtaccctattttatcctgagagtcatttcttttcaagaaaaaagcaaacaaacaattgaaacacattaaacgcctc

SEQ ID NO: 18187 - DNA, 201 bp, Bos taurus
ctttccacagatagcatacatggggaaagcaagagaggcgatattcttgagcgtgttacctactgcgagttacctgtgcctttttctgtggttcagactgcagctgacaacacagtgtattttaaatcaataaagggggaccaaccctcttcttaatgcacattgtttaactcttactgatttcaaccatctcatactctg

SEQ ID NO: 18188 - DNA, 201 bp, Bos taurus
tttgcccaccttccactacctcatctaatacctggttattacaacagccttctagctcattcctctacttcatacttgttctcctgcaatccattctccaccttgtagccaaagtaatgcttttgagtcataaatttgttgtgtatgtcagctgttcagtcatgtctgactctatgaccacatggactgtagcctgccagg

SEQ ID NO: 18189 - DNA, 201 bp, Bos taurus
atctttacatatgtaaaaccctcttttaatcactactcttataatcacactggagactaggctatctccagcacaacagaaggttctctttggcccctccaggtcaatattccccttcaaggataatcactattctaatctttatccccatgcatccatcatgtttgtctttgaacttttaaaaatatggaaccatgaaga

SEQ ID NO: 18190 - DNA, 201 bp, Bos taurus
gaatctaggtaataaaataaaatctaaccttttattcctttgtacttagtccatctgtgcttgctcccggaccgcgtgctgacggcttgtatctggccctccacaccagagttcctactgccaacggcaagacttcagccaatactgtggctacgagagccacgtgcaggcgcagcagttgaaggtggcggtgaggacggg

SEQ ID NO: 18191 - DNA, 201 bp, Bos taurus
ctctttctagtgttaagcctgcttagatgtgatgcaatttttcttcattggcccattgagactatggggactttagtgtggctgacaccttaagtgaggagggtcacaagaggtggaggggcctggaggctggcactgtagcccccagaaggttgtcagtcctctttcaaggcatcagaatgaaacttctctgctagtctc

SEQ ID NO: 18192 - DNA, 201 bp, Bos taurus
cctgccaagttttccagcacagtcctccatgcatcagcatgcctaccttgcacaactcatttgttcgcttccatgcactgttaggaagcaaattgcttcattggaaaaggccatagaaaactctgctgtcttgctgattctttattgagaaagcccttgttcctccctgctaggaataattcatttagtgcatccttccat

SEQ ID NO: 18193 - DNA, 201 bp, Bos taurus
gctttccggaggtttccccacatctcaagtctgaagccacaggaactgaggacattcctctcgctgttcccttcagctgccccagggtccgaggaaccccatcctggccctagggcttgacaaatcaagccctaattacatctgctggtgagctcatccctgcctgacccccatcagtcagatcttaggattttttttttt

SEQ ID NO: 18194 - DNA, 201 bp, Bos taurus
ttcaagtttggccctttcttggtctcctttctgcggcttagactcagaaagaagcataagcccgaaccagggtgactgggcttgtacctcactcagattcactgaaccccaagaaatggcctcagacttgtgggaaccagacaggcagccccatcccacgctcggtcactgcagactgcttcctaaaacagcaccaccctc

SEQ ID NO: 18195 - DNA, 201 bp, Bos taurus
aatcatctcggttggaaatagtgacagatctctgagttttcttaggggttagcaaggcccaccttggccatcacctatggcctttaggggagtggaggataaatgcaggatcaggaggctcgctctcttgctgttcaggtgctgtgctcagggccagacgtggggacccagaggcattacaatatgaagtgaatctgatat

SEQ ID NO: 18196 - DNA, 201 bp, Bos taurus
agggagaggtggggattgggagggaaaggtcatcatctaagtattacttatagttggcctcctctgttatttgcctgttgtcattaacaacaacaaaaactctataattcaagtgatagagtcatatgatggtacgaggcatctgaattcccacatgacgacgccctgttttccagccctgtttctctctttttctggctg

SEQ ID NO: 18197 - DNA, 201 bp, Bos taurus
tgcctgtgaggaagacatggcctggtttgtagagttgtcctgtacagacattttatcttggagtaagccctctttctggaatattctcgagtatcatatgtgcatcctgcagttctgttgtataccagggctaccatgtgacacctgtcagacaccagtcctggggtgcctgcttcttcccttgaaaccctcttcctcctc

SEQ ID NO: 18198 - DNA, 201 bp, Bos taurus
tcctgtcacctatgcaatcatctttatacatcattcaaattgctcatcatatttcttttttctctctttcctgcaaatatgactttgaagcttttgtaatcaaattagtgatctcctggaatcacaatttctttaaactttttgaagtgatcttggaccctttgcagggaccaaattcagtgattgtaagaatataatttt

SEQ ID NO: 18199 - DNA, 201 bp, Bos taurus
ggaaagaacttcacattttcctctgcaaaggtaagaactatattctgttcagtctccaatcaagctttttatgacatatggaatgactaggttccttttttccacagaggccagctttcattaatcaagtttctcaactcctatagaagaaagcctgacacataacttaaacaaatggttaaactaaaaatatgatgtggt

SEQ ID NO: 18200 - DNA, 201 bp, Bos taurus
atggatcaagaaacatttacgtgtattgcttaaaagttgtagtcaacccctagaagaaaggagaaaaaattagcaacagatcaagaacgaaagaaatggaaaaaggacttgattcttcatatttcatatttgggagtaaatagataattatctaaaattgacaaattaacaaatcaagtttcaaatatgtaatttagtgtt

SEQ ID NO: 18201 - DNA, 201 bp, Bos taurus
ttgtttcagaatctacgcttcaggcacagaaatttgccttaggtctagtgtttatgatggtggagaccatgtttgtttcaagttgaatcagaatggggccggtagagatggccaagtgggagtcagccttctggggaacggcaagtcacccgtgtagagcgagtgtgaatcctgtaacagaaggaagggagggaggcccct

SEQ ID NO: 18202 - DNA, 201 bp, Bos taurus
ggagccgtgggcggtgctggcatttcttcctaatgcagcttctagaggggagtttccaggcagggtgaagccagcactcacctgaacagggtgactccaggggcctggcttcaatttgtgtccttcctgtgcttgtcccagcaccgaccgtcaggctttgtaaatgcctgctttcttctgcctctcagagtttggggaaag

SEQ ID NO: 18203 - DNA, 201 bp, Bos taurus
cacaatacctaggacagggcctagaatacagaagttgttcaaaacgatctcttgcatgagtactgaagatgaatagtgaggctagcagcatatcagctagttgatcaacaataaaggcctgaactagggtaaaagcagtgagaatgaagaggacagacaggagagtaatataggtgctgtaacccataaaatttgctgagt

SEQ ID NO: 18204 - DNA, 201 bp, Bos taurus
caacattccatcctcaaaaaaagaaaaaaaaaacttaaaaaatagaaatatatagatgtgccataaaattcaaaatgtataagatataaccttataaccagattattgtgtatcctttaagagatcttctaggcatatacaaatatataggtaactatattcttttattttcttataaaagatatagtaacataataaaga

SEQ ID NO: 18205 - DNA, 201 bp, Bos taurus
caagggtgcttggcatatgtagaaaagtacttttagtatttggcatacaaatactgtcttcagtgcagtagccattgaaacacatatatctcatctgttaattcactttaggcctcttaataacaatggggaaattattcatatcacaaacattaatttctagctatactaattgagagtatttgtgtcaaattggtaaga

SEQ ID NO: 18206 - DNA, 201 bp, Bos taurus
aggtcatttcttcacagctgaaacacagtgtagctagaaacactgattggttctgttctgatctggtcttctcagctctcctgtctttctctgggctgatctgggtaatttcaaaactatatttttccactgatttccacgaaaaattctaacacagacagtaactaattagtttgacctaattttatgattgacccattc

SEQ ID NO: 18207 - DNA, 201 bp, Bos taurus
atggtggctgccagaggccggggaaggggtgagtgaggagttgttgatcagtgagtataaagtttcagttattcaggatgaataagttctagagatctaacggcaacattgggcccagagatgacaacactattgtactgaactatctgctgtggtttcatatattaactgttctcataaaattaaaaaaaatatattaat

SEQ ID NO: 18208 - DNA, 201 bp, Bos taurus
tttttacacattgggtcttccattccaatctatactcattatatggggcttcatttttacaatttttctttaaaaatttgatctaaataatgttttgtatatttagtatacaggaataaaacacaacttttggtaggttgcaatggttttgattctaatatagttgttattattttaaagaattttatttaatttgcttgt

SEQ ID NO: 18209 - DNA, 201 bp, Bos taurus
accactgcagtacagatactgtcctagtgtatcacaggagaaggcaagggaaagatgggcaggatatagaaatgcatattgtacacattatagtctaggtgtacagatgaactaaacatatttggaaatcttactaaatgccaacattacatattaactcaacagtacaagaatggctgcagagcaattcaaaataaaatt

SEQ ID NO: 18210 - DNA, 201 bp, Bos taurus
cttctccactgcacaatttctcaggccatcagatacttttacttcattactccatgtcagttcttttcccttttaaatcaagttttatgttgctgccagatatatgcctataattatcctgggtctttataatgagaggccaaggaataaaaatcttcagttagttgtccaagtctaaataattcaacctaaacttcaact

SEQ ID NO: 18211 - DNA, 201 bp, Bos taurus
tttccctacactagggttaagcaggtattaagatgtgttgagttcgcttttcagaaggttctgtttcttaggcaaacgtttgtggaattgcaggtgagaatgtgatcctaatgaaatatagatgaggatgttttgaaagttgtggatatgaatggagagatgttcaggagtgagaaagatggtcagaagagggataccaga

SEQ ID NO: 18212 - DNA, 201 bp, Bos taurus
tccatactgtcgccaaagtcaactggcaaaaacacagacctgatccctgctatataaaaattcttccattggctgggaaaggccctaaggggaaagacacattcttaaacataacgtaattattttttattattagactagtggtgtctacttttaaatctaattctcacaatcctgctagtccattatttgccctttaac

SEQ ID NO: 18213 - DNA, 201 bp, Bos taurus
ggaaaggaagaggatcactctgataccaaaccaaagaaatggagctgatgcctctgtgaaagagagatatcaattagcccgaggggaggctgagttttatcgtattcagtggagttactgagagtgctgggaggctgaacattgaaccaaatagagctcaaaggtcttgcatgcccatcaagaaaataaataaagcttaag

SEQ ID NO: 18214 - DNA, 201 bp, Bos taurus
aatcccattactaattccccgagccatcaagtctcccctatggcctggatcttgtcctgaaacccaggtctcctgttgaaataacattagacagcagccactgcattggcaggcaatggttttaaaataaaggggggagaaagaaggggaaaatgtgcacttacagagttggctttaattattactttaaagtttttcagc

SEQ ID NO: 18215 - DNA, 201 bp, Bos taurus
tataaaactcatctgcatgttgttgcaccaaaaggttgtccatatgtattttcactgtgtaagaataacagaaatatttccttgaaaacttggggataatcactaagcaaacaacaattagtattaatcagttatgtaatttattcttcctttgaggttccaaggttttctgtcttgatatttagaaaaaatgcaaatgca

SEQ ID NO: 18216 - DNA, 201 bp, Bos taurus
aaactttcctggtggaagaaaagagaaattataaatgtatgagaagtgaagatcaatagttcttaaactatcatgtctagactggacagtgtaaagaaaatatgtcttgacatctctccctaaatgatgcagagtctcaaacacctttttaaagtgttaatctggacgcagagctgacgtgacggcgtcaggcgccgcggg

SEQ ID NO: 18217 - DNA, 201 bp, Bos taurus
ggaaatgtaccatattcaccagccccctcacattcaacaaattctgtcaatatctggatatttctaaataaacagaccaaaaatatgcttctttaaagttggttttattctagttgtcatctgggtgtttgaaattatgaagaaatgatttagtagcaaagatatatcaaatacaaatgacaattaggacaactgtaagat

SEQ ID NO: 18218 - DNA, 201 bp, Bos taurus
ctcagtaatcttctttactggcttcagggcctcctactaaacccccgaagtgcaattcctctccaacacacctaattttcttttaactcctgtatgaaaacaagctatcatatctagacgagtttcttctccaacattcttactcaactcctttagagggtaatttaaaatctatatcctttgagaaatcttttgcaatta

SEQ ID NO: 18219 - DNA, 201 bp, Bos taurus
aaaagagggcccgattcagctctacaaataattttctcatctctgcagaggacctgatgcaatgaacctacaaccatcatctttaaagtacgtcctctgtgcatagaatggtgtttggcccataccaagtgttcaatgagtatttgttgactagacaggaaatttttttggaaccacctagcatgaattggttcttttggt

SEQ ID NO: 18220 - DNA, 201 bp, Bos taurus
actttctgctgcattttacagttactccccactgtgctatcctcagaggtgataaaggagacctgtttactatcagacttttcccagcctccatcttcttattcccttcgatccatgtacttgaaagctgtgattgtgtcttaactgaaatgaatcttataaggaatatccacattctataaggaagtttaaacacaacca

SEQ ID NO: 18221 - DNA, 201 bp, Bos taurus
tgagacttaaaattcaacaataaatttgatctaatttatgaatttaataataagtttaaaagcttaaagaaaagccatttttccttcccttgtttccctctgcctacttctacaagagctcttagcccttgttaagactagagttctcttttaaagactcggtagaaaaataaccatccaaagatttcctccatcagagaa

SEQ ID NO: 18222 - DNA, 201 bp, Bos taurus
aaagagaaaaagtcaataactgtttctttaaaaaaataataaatcaaaatgaattttaaaactctgcttagaggtgagcaactgctatatactactaggtattttgatagttgatttgttcctttagtatgcaaattttaggtttacaaagatctacagcttttatttaagaaatgtgcctgaaggctagattggtaagct

SEQ ID NO: 18223 - DNA, 201 bp, Bos taurus
aggaaaaaaggaataaactaggaggcaccaaaatcattctttctactctgacatttgaatgactgttactgtagtatttgaatccagtcttatcttgatatgtttgataatctgaacatccaatatggatgtatttcaaaacccattttaaccaggtacctcttttactgaagatgagtgctattgtagtttggtagcttt

SEQ ID NO: 18224 - DNA, 201 bp, Bos taurus
agtgtccacaggctggggctcatggtgggagatgctacaagggaagtgagctccctagtcgcagagcggttaacaggatccttgaagagccgacatttcctgttatgactgagtattgtcagaccctgatacaggaatattccttgaggacaccagtgagctgcttgctagatattgactacatcagactcttcctacagt

SEQ ID NO: 18225 - DNA, 201 bp, Bos taurus
aattccacctatggatatatttatttattcttggatgtgcctgaagggctcacggttgtgtgaaagtgtggagttttcacacaccactcatgtcaccatcgtagttcacccccacacgtcctcagggaactgttgccccaactctgtcagatctacagttgtttcccttttctttaaattaaaacactccattacattgta

SEQ ID NO: 18226 - DNA, 201 bp, Bos taurus
aactgaaaatccaataataaatcaccactgtgatttagcactaatgctggaattcatatcacgaacgatgtgacagcatcagctgaaactcaaacaggtcgctgaaaggtgcatttcatcagcaagcaatttaattcgtatcaaaggaattttactccaagtgagtggcaactagttacttttgagagcagttaactgttg

SEQ ID NO: 18227 - DNA, 201 bp, Bos taurus
aaaataaattttatacatttttcacagtgacttgactctggctgcacaagtggaggctccaaggtgaatgtgtgcatctgagtgacaggctgctcagtgacagagggcagggactgatggtgttttgcttcagaaaaaagaacagttagggcagctgtgatgactgaatgcaaaaaaagaaaaaaaaacaaacaaacccca

SEQ ID NO: 18228 - DNA, 201 bp, Bos taurus
ttgtggggttagcaatgtttgcatccctatgatgggaaatacacagggccatggtcagggatgggaggaaaagtaattatttttacacacaaaaggcaacgttggaaattgagaatataacacatcaacaaacctcaaatcatgctctaatatgagcagcaaagagctgaggtgaagaaggtgaccaaaatgaaattataa

SEQ ID NO: 18229 - DNA, 201 bp, Bos taurus
cccattctcttggcactctctgtaggggtcactctgtccttaaaaaacggttggttgttagggtggcagcctcccatgcctttttcaggacatcagagatcaggaaatgtcaggccagagtcagtctctcacaaaatagttttactgggatgagattctctatgagaagcatcgttttgacataagcttccagttatttgc

SEQ ID NO: 18230 - DNA, 201 bp, Bos taurus
agacattctttctgcttgatttttccttggcccactcaatatgtgccccacacaaatccacactttctggtttgttcccagttttctgtaaacaaaaatgcaataagaagaaaaagcacacaacactggtgatgcatgtcagaaaaaataagttattgatttaatagctatatattaatggcataaaggctttcttctttc

SEQ ID NO: 18231 - DNA, 201 bp, Bos taurus
agagcctcatgatagccctgagagaagaagactccttactactgccaaagaggtccttgaccatctttctccttggagcaaggctacttcttagactgatctgggctgttctgcaatgccaaattggggggccttttcagccttactttcccaagatggccagcaggtaacatcatccattgatgggagccaattaatgca

SEQ ID NO: 18232 - DNA, 201 bp, Bos taurus
tacagagtgttttaccaagtcttatactcatattggaatgatgtgactctttcagtcactatatatttttatttcccttttgtgtaaccttatttctttcatgatcctatttttgatactttaatatacttgattatttttttcaaagatatgcttataacagtacagagaaaaatggcagtctttgatggtgtcccctaa

SEQ ID NO: 18233 - DNA, 201 bp, Bos taurus
taattggaattttagattatttccaacatctgccaatgtaaatgttaccatacaaagagcatatttatttatataattgatctcccactccttatgaattttatatatatgttttaagaatcagttctcaagaatgagatgactgggtttaaaatatgtagcttttttggagcttacaatttggcttatcgatttactttc

SEQ ID NO: 18234 - DNA, 201 bp, Bos taurus
gaataaaaattacaaaggcaaaatccttatttatgacaaagttattaagtaatgaataaggagataaagaaactgtatcaaaagatctcaaaaacatttctccacagaagtctcaaataatacaagcagacaatccagaaaaaaagaaagaaaaacaaatgaccaatgaacgttttaaatcgtttgaactggctacaaata

SEQ ID NO: 18235 - DNA, 201 bp, Bos taurus
tttattgtggatggagttggtttctttccaggaatcaattcccatttttaaaaggaggcctagagtgtctgggcttcagccagatgttcctgagaagagggtgattaaaatggtttctaatcccatggtgaatatttttctcataattctcgcattccaccttgaaggattgagacaaaccacccttctggattatagatt

SEQ ID NO: 18236 - DNA, 201 bp, Bos taurus
catgtgacaaaaaaatgaaagttttaaagtctggtatattttatatctttatgacatacagttatgaagaacgtggattagctctgaagtcaaaggtttaggtttgtttccggtctccaaattcactacttcctaagagtgatggtgaacaagtcttaatctctttataactggaggttgtttttttttttattttttagt

SEQ ID NO: 18237 - DNA, 201 bp, Bos taurus
gaaaatatgtgttgggataagaaagaacatgaaagacttaaaattatgctgcaaccataaaaaattgtctttgacaagtctataacaacaaaattgtgacgtcatctgagataaaaataggtttcaacgagactgaggaacatttggatttcaaatatctaataaattgtggctgggaaaagctaaattacttcaatgaca

SEQ ID NO: 18238 - DNA, 201 bp, Bos taurus
ttcaagggacatttgtgacgaaaagatagttgagctcatgacagtagatgaacttgtcaaaaagtgatactgagcttaccagttcctatgatgaaaactgcattcagggatgtgaatgagaaaaagctaaaataaactaccagacacttcttattcagaatttttatccactttaggaatttttacattttattttaaaag

SEQ ID NO: 18239 - DNA, 201 bp, Bos taurus
tatatttcagatcaacaattttttctctttcacaggatttttttaatcacattttccatgtctttttcaataatttgacccttatgtttgtcttttgactgtgagattaacattgttctcgccttatcctttaattgtattagcgatcactgcttttaatgcatggtttatttagcctttatttggcttgcactgaagttg

SEQ ID NO: 18240 - DNA, 201 bp, Bos taurus
tgataagcaccattgaaatctagagagcaattctttctctttatctgtaaaacttcagtgactttagtataaaccacaaatgccttattttcaaaactcagtgatgtttgcctggcagtgaggttttgtgctttgaacagtctgttgtgttcagggttgatgtttagaaaatccttaataggagaagtttgcctcttttgt

SEQ ID NO: 18241 - DNA, 201 bp, Bos taurus
tctagggcaatagcagggtggaaaaagtgggcagtttaattgctatctttttaaggtatgatcaaagaacagggtagaaaacaggagtttgggaaagtaattcaatgtgtgaatattagaaaagaagttaagagaaatgaattggtagaaaacagcttatactgaaaaattctggaaggctcagaaagacaagagaaagaa

SEQ ID NO: 18242 - DNA, 201 bp, Bos taurus
cattttaaaagttcctgttgaaaagtattgctagtctctttctaaattaaaatgagttcaccatgctacatacagaatggaatttcagcatgcagaatccgataacagaggtatggagaagactgaaaattgcaagcagtgttatgcaaagtgtatctgtcagcaacataaagcttgacacatgtggagggaaacttcaca

SEQ ID NO: 18243 - DNA, 201 bp, Bos taurus
gtgttgctaacagaagcaaatgcagtgtaacactggcaggcatgctggctgcagacattgaccatctgctcaacacagacctccaaaagatcatcgtgtcgtgtgatagataggcttgacactttcagtattctgacaaaccctgtaaagcaatgcagttaatgataacaacaaaaaaaaagacaacagtgtaaatccaga

SEQ ID NO: 18244 - DNA, 201 bp, Bos taurus
gcttagtgttataataattgaatttatgccaagatatccacacattttttccatttccctctatttaacttttctaattgacctagacagtaagcatcagggacttgaagtctggtctctttgttattaaatttttcattaaatcccttatgttaatacatggtttagatagtcccatccaaattcttatccagataatct

SEQ ID NO: 18245 - DNA, 201 bp, Bos taurus
cactgagaaagccccaaagagagctatatgcattatcaaattcacagttgcattctttattcaggaatattatattgtgacttagttctagtacaccaagtcattatcttgtggaattccaggtatgaaaatgagagcataatgaagtgattgcatagggatgctcatcctgagattcgttataaaaagaacatgcctttt

SEQ ID NO: 18246 - DNA, 201 bp, Bos taurus
actggaaagtaaatgttatctagaatcacacatgtcaaggccatcttattttctagaaacctgtccctacctaactccttattataaacatacctgtggccttagaatccaaatttctgcttaaaaatgtaataataaataagttctgtcttgtgcacctgagaaagggacttttaacaaatgttttgccttcatgcaaga

SEQ ID NO: 18247 - DNA, 201 bp, Bos taurus
gatatttgtgacatttttctaaagggagctccaagtcttctgggaacttcctctaggaagtatgtagtacagttaagcagttgtgcataaatgatactgactgatagactaaaaacatttcagcttaatctcattgaactttagagccttcattctcctgtctttcactcttaaacaactcaatagctgtcattttttatg

SEQ ID NO: 18248 - DNA, 201 bp, Bos taurus
tcctcatatagcctttttagacacttggcaggatgggcatatgagctcctgctccccatcaggtctccactgtcaccactgtggaggtggcctcattaccgctggattacttgaaaatcctgattctccactgtgcttcctttgacatcactatggaggggagggagaggggacaccattactatgggtgggagtccagac

SEQ ID NO: 18249 - DNA, 201 bp, Bos taurus
tttcaagttcatttctttgttaatccttttaacattggtgataacattttaaaacgtgtaatttataaagctttcatagaagcagtatatactgagagaaactatcaatagactaaaagagggagactgtttctcactacctgctttacttgtattatgcttgtattgtcatactaggctattggtgcagctgtataatct

SEQ ID NO: 18250 - DNA, 201 bp, Bos taurus
gcctagaggcaggaagctgttaatcctataggcaatattagactaaatgttatacttaggatggaggactgggaatgagactgaagaggaaagctctgatactgatgattgtagtaaaaaaaagtcatggtatttgagtttagtgacttgggaatttagttattttcaaactttttattaattctacttagaataacattt

SEQ ID NO: 18251 - DNA, 201 bp, Bos taurus
agtggcttttatttagtaactttttatttcaagtacagatgacgtacattgttttggttcttaacaaatacattcatttcctctgagaaatttcagggaccgcattttgggtaactatgaaccttattacagtgcaagttatttttgcatcttgcattgagctttagagatgaaccatatctgacatcctccttaatatcc

SEQ ID NO: 18252 - DNA, 201 bp, Bos taurus
aacactttctttataaattaaagcattcatttctcaatgccaataaacaaaattctatgagtacatttcattaattttaaagaatgataccttcattttgattgttttatagaatgtcactgctgcttggcaatacttattaagagtcaaaaatactgccttttgaagcaatataagcccaagaaataaatgagatatatg

SEQ ID NO: 18253 - DNA, 201 bp, Bos taurus
aagttgcaaacaagaggatcagcaatacttatgtagcatagagatacatttttggctaataaaattctaaaaagaagatttattttgccaacattaaaattcaagaattatacataaactctggcattttggagttcaaacgcatgaaaataaatgttagtcagaactgagtgtatgtagagcaaatattccacaatttgc

SEQ ID NO: 18254 - DNA, 201 bp, Bos taurus
cagaataatggttgtcttgagaaggaataataatggaaaggaatatgagggggacttgtatagtgctgaaatgttccatggattcatctggtgatggctacaagattatctttgctttgtgtgaatttgttatgatttgagcttgtttatcagttatgcaatatttcagttcagttcagtcactcagtagtatccaactct

SEQ ID NO: 18255 - DNA, 201 bp, Bos taurus
gggcaggcctgggagccgaaacaagtgcacacaagccagcaacacaaaggatgagcttaggcggctgacgatgagcttagcggggctgagggaagcaaacataagtcgaggccacagcagaaggatccacacaggcacctacctagcaagtttcagccagtagcgcagagcaggatggggaacagaagcacaggcaacgat

SEQ ID NO: 18256 - DNA, 201 bp, Bos taurus
ttaaaatgcagatgccaaccccagagggtctaatccattttaagaaactctctgaggtcatcagtatgtccattttgtaaaacagtgtcctggcctcttccattattgcatgatttcagaatggaaatactggtttcctccatgtgtgctgctgaagctcattatcatggtaatgacagtggccaatctaaaacttgccca

SEQ ID NO: 18257 - DNA, 201 bp, Bos taurus
ataaataaaaatctaactgtagtttgtctacgagtgaggtaatttgttttcaaacttttgtcctagtttttattttttatctaattttatacacgtcagcattactcttagaactgtgaaaacaaactaaccataataaatcattaagtacttattgaaaatacaaatttcttcacaaatgccccttttgtcattttataa

SEQ ID NO: 18258 - DNA, 201 bp, Bos taurus
cctaagatcccatataaggccattgcgctcgctacagtgctgtttttgattggcgcctttctcattatcataggctccctcctgctggcaggctatatcagcaaaggtgggggcagaccgggccgttcctgtcctgatcattggcatcctagtgttcctgccaggattttaccacctgcgcatcacatactatgcatccaa

SEQ ID NO: 18259 - DNA, 201 bp, Bos taurus
caataaaaagcaattgatttatttgcctagtataaggttttacttggtagatagccaaatcaaaatccagaatatctgaccccaaattcagtgtttatccgcaataacaggctgtcaggtgagtaagttcactgggaaagtgaggctatgtacgtgtatatgccatgagcataagagtgtgtccagtgaaatatagttaaa

SEQ ID NO: 18260 - DNA, 201 bp, Bos taurus
aaaatagaaagctcaataacaatttctaaccctttaattgcttagaaatacatttaatagagtctatatgagagaaattattaaatataaacaaatacgaggtaagacagtattaagcgaaattgcattccactgtgaatcttaatgcttttattgtgttttgtttggggaactagattaaattattttaaagtttagatg

SEQ ID NO: 18261 - DNA, 201 bp, Bos taurus
tcaaacataaattctctctattcgtaccttctataaaatccctaacttctttagtttttgtttgtttaagggtaattaaaaaccaaaaagtagagcaggaactagataagctccactgctatcaatagtcaagcctcccccatcaatgtttacaccaactgtatttaaccatcattcttttctctgtttacccatatcttt

SEQ ID NO: 18262 - DNA, 201 bp, Bos taurus
acctcaaggtggatggataatgatttgagatttagagatcccagacattagtgtcctgtgaggatggggaccaagggaccagagggagagagtgaggatataagtggaaaatgtcagacaagaaggcagggaacatgaagaggggctgctggtgtcaacaatagtgtctggtgttcactacagtggccaagacatgttccc

SEQ ID NO: 18263 - DNA, 201 bp, Bos taurus
cccatgtggcatagaactgaagtctcctgtcatagttctgtgagtgagctgtcctagaatcggatcctccagccccaatcaagtgttctgatgactgcagtcctggccagtatcgtaactgtgtcccatgagagactctgattcagaacctctcatctaagcctcttcctgaacttgagacccataataactgtgagataa

SEQ ID NO: 18264 - DNA, 201 bp, Bos taurus
agttttatgatcacaggatataaagaaaggactcaattttaattcgtgcattttttgtttgttttagaagaacatgacagaatgatcaataaaaaactttcaagcataaacaaccatacattaggataagattttgtggaataagcagaatagatggaaaataaagatgtaaaatattcaaatgctaaagggaagtttgtt

SEQ ID NO: 18265 - DNA, 201 bp, Bos taurus
gacattttaaatcaccccaacaagacacccccccaaacccattagtagtcaatcctcactccccacttctccctagtcccttgcaaccactaatctactttctttctcttgggatttgcctcctctggacatttcattaaatagaattaggcaacatgcaaattttctgtcttaaagtttcatttttttctgttatcaatt

SEQ ID NO: 18266 - DNA, 201 bp, Bos taurus
actccaaaggctatcagaagcgcaaggccctcaagaccacagttatcctcatcctgactttcttcgcctgctggctgccctactacattgggatcagcatcgactccttcatccttctggaaatcatccagcaagggtgtgagtttgagagcactgtgcacaagtggatttccatcaccgaggccctagctttttttcact

SEQ ID NO: 18267 - DNA, 201 bp, Bos taurus
tgacaggaagaggtgcaggtgggcctttctctggattcctttctattcacataccccctgaagtcagcacactaatgggctgatttgaaagccaaataaatggcccagaaacagactaaggaaaagtatcttgatgtacttagccccacgtggaaaagagcaatgaaaaaaagggcccagcaaacccaaaccattaatgtc

SEQ ID NO: 18268 - DNA, 201 bp, Bos taurus
agggggcgggcagcagtagggatgaagatggcaaactctgactacttcagccttactcttttagaattgtagtcagaaaagattgtgagtcgtttggaaatgagcacttagcccatttctatcgcacgctggaaactatgaacattttcactgcacgtacacggatgatcaatttctaagcacatctttgtttttcctaaa

SEQ ID NO: 18269 - DNA, 201 bp, Bos taurus
attctaagaaacatattttttgaatcagaatgttttaagcccattgccaaattgatctctgaaagcattgtacaagcctatcttgctatggacaagttataaaggaacggttttcacttaattcttctgaacattgaataatagtgtatatttttaaatttattctagtatgagaggtatgtgtcgtaatccgtatttgtt

SEQ ID NO: 18270 - DNA, 201 bp, Bos taurus
atccgccacgggtgtacacgtgttccccatcctgaacccccctcccaccgccctccccatgctttacattttaaccttaatatgactgagtggtaaacttaaaaagttcaaattataaaagtttataatgcttcttaaatatctattaaggcagaattttaactgagaataaaaaaccttgtaattacactcttagattga

SEQ ID NO: 18271 - DNA, 201 bp, Bos taurus
ccacaaaggttgaactcaggaatcggaattgacccaatcaatacttgacattccccaggcctcagtggtgtgttcataaataagcatgtggccagatttggtcagatcagaatgaagcctgtgacgttcactccatggttgttgagtttctctatgtcttgctttcctttccctcccttctcccctctctgaagaagcacg

SEQ ID NO: 18272 - DNA, 201 bp, Bos taurus
gccttggggtgttttgtttagcccatctccccttcctgcttcttgcaggatcttcagtccttttgcctccctctcactcagaatcttgggttttctctctctgctttccctttcccggtcccctgcagaccctgctagcctcacccataaaaccttccaacgttttcaacaccggagtgcccaggagtctatactttttgc

SEQ ID NO: 18273 - DNA, 201 bp, Bos taurus
agtattaatagaatgtcccttcatcaaggtcataagaagctctccctaccccaaagagtatgaagaatattctaaactcctgtgcttgggggattgttagcgggtgggctgggggaggctccatacagcaaagcagccagagtgggatggtaactgctttttatatttagatgaaaatggacccaggtctgagcttccctg

SEQ ID NO: 18274 - DNA, 201 bp, Bos taurus
tgaaaaccatgttaaattaatcccctggtgccctcagatgacaggtcagcacgcccagccaggggcaggcactcatcatgggcttccctggccaactcagctgctgctaatggccttctgcctttagagaacaacatcctccctgcatggcagagccatgcgccaacagccaccttcctaatcctcacagcgtgcctggga

SEQ ID NO: 18275 - DNA, 201 bp, Bos taurus
cacaggctccctggcaaagccccaagccccagagaggcctgttttcaggttccaagcttttaaagcagagccctttcttgaatcataccagccatatcactgtagagtaaccagggcctcctcagacaaccaaatggcccatctctctctctctcttttttttttaaccccatacctggttcactccaagaagaatgtatt

SEQ ID NO: 18276 - DNA, 201 bp, Bos taurus
ttttgctcaaatcagagctaatgcctacaacacgcctgcaaaggaaccacaacctccctttccaggagaaggaaaagatgttcataatggtgtaaggacattttatctgggaggcatgacatgtatggtatcaagggcccgatagcatacataaaaggaagcttttaggggccatgaaaatgctttcatgttttgtttgtt

SEQ ID NO: 18277 - DNA, 201 bp, Bos taurus
ggaggaggtgatgataaactaacacgtccctttcttagagcctatgaaagtcatctctaaactcccaactcaatcacaagtaaggccgacttctgcctctactgtcggcattactcacctttgcttaaggagcacagcccactgaatcactaactctaaggagaggcccagcattaaccctttcctccccagtagctcaca

SEQ ID NO: 18278 - DNA, 201 bp, Bos taurus
agggaagccttctcttggaagacaagttggtcccagtagtgatttgaaggcaaattacacttgagaatgtcaaatgtttacaaatttcataccttaaaaatgatagagtatattttaaagataatcataatgcttaagatgacattatttgtaaaaacaggagagttaggtttcttcctatatatgattgtattgatggtg

SEQ ID NO: 18279 - DNA, 201 bp, Bos taurus
gacctggcattagtctagcacctgagcacagtgtaggcacttcaaatatatttgttactgtatacacgaatgaagtggccagtcaaggtgtcaagcatggcgatgctctcatcatcagcttcatcaacaacaagttcatccttactgagcatttcctatgacaggggtccccaaccgctaggccacaggctggtataggaa

SEQ ID NO: 18280 - DNA, 201 bp, Bos taurus
tcaacttataccctaaggatacctttgtcaaaattcatctatagtcttgcccctaggatgctgtgtctcccaggctgggtctgaagtagtagccatggagacaatatcagagaggactgggaagattcacaacaaagcttgaaagaatttttgatgtagcagatcttacttaggagggggtcaagacacttctagcagtag

SEQ ID NO: 18281 - DNA, 201 bp, Bos taurus
gtatgttgtacgtgcttgtttcgattttcatcatcaatgtcttgtgcattctgccaccagccccttgcctatgcatgcagaaagtgtatttttccttctgggttaatattcaatcagacacaagtgttctgtcttactcaagcaaatcccaaatgtttggaaatgccttgctttatctcaactttccttggagaagctgat

SEQ ID NO: 18282 - DNA, 201 bp, Bos taurus
acaatttttaatggaatggaaatccacccactccagtagagtccaagagcagccttctagactctgtattgaatgcctctgtgttaacccttttacagaatgattaaaagtagggactttcattcccttcagagaatagaagatcccagccccacccacagggagatgatctgtctgaccactggggcagatgactcactt

SEQ ID NO: 18283 - DNA, 201 bp, Bos taurus
acctggctagaagatggacccctcctatctttccctttctgaatgcctttctgttcttctggtctgatcccatttgcgtcttgtctgttagtgagagcccagcaatggtcatgctctgacaccaaccccttctctccccactgtgtagctccatattctggccttgctttccactgaagcttggtcagctctgcatgcgtc

SEQ ID NO: 18284 - DNA, 201 bp, Bos taurus
ggactgcagcctaccaggctcctccgtccatggtctggagaccttcaaatgcctaatttaaggaatgggattttatcccttaggaaagaaggaactatgtgagattttaagtgtggaaaacacaatcaatgatctgtttcctatctcctactggctataggatactttctcaatatctcatcactgcttgcttgttccaga

SEQ ID NO: 18285 - DNA, 201 bp, Bos taurus
ttgcctatgttagaacctgagggatggcaactcagggctaaaaagaaatgttctgatacattctgttctctaacacaaaggagggtgtttgggatagtgagctgtgtgccagtacaagtgtccaggcagagcctgggtgaccgtctttcagaggtcgtgtccaggggattctccttcagtggatggggagaggtcaggtgc

SEQ ID NO: 18286 - DNA, 201 bp, Bos taurus
ttaaattctaaaagaaataaaaataaattggattgtaggaggggaatagggagtacttaataaaagtttaaaatggttctatagatcatgtagggaaaaactgagaaatttttgaaaataaaaggaatagcaaatgatggcttactctaatattagaacggtatggacttaagtcatgtaaagcagtatggttattagtct

SEQ ID NO: 18287 - DNA, 201 bp, Bos taurus
gatcaggggccatcactcttctgatcctcatacacatagtgtacaaattccattataatagtatatcctgtctttcttagtcataggctcatggatctgtttggcccatttatctgatatacaccacaaaaggctctccttcaggacagatggagtatttactatttttatgtttgatagcaccaagcagatccaacatgg

SEQ ID NO: 18288 - DNA, 201 bp, Bos taurus
caatattagtagctgaaataagattcttggccactgtgatatcgtgattaaaaaaaaatatctgttgggcttcattcccagttcctggcacagagctcttagaatttcctgagtgtatgggtgagcagagtgtcttttttcccccctaataagctcctttcaactatatcagagtttatgctaatgagctagctttctgag

SEQ ID NO: 18289 - DNA, 201 bp, Bos taurus
cttctccaatgcatgaaagtgaaaagtgaaagtgaagtcgctcagtcgtgtccgactcttctggctctggttaaacaacctgcccagggcttgactcagagtagatgcttaacacttatttgtcaggggaaaattagaattccatgtttattaaatttcagcagttctggttcaaccaaggaccaaaacctaagcaccata

SEQ ID NO: 18290 - DNA, 201 bp, Bos taurus
aagaagagcattaactgttctctatcacacagcctgtgtacttctgcaatcaataagaatgagtgggctcagactgggcctcattgttttaccatgaaatttggaattgagcaatagagtcaatctcccattttctacatggtgttagaccgaagctcagttgacacagcatttaacaatatgcaaatgagtcaatggcct

SEQ ID NO: 18291 - DNA, 201 bp, Bos taurus
tgtattgaacttcagtgaaatgccaacatcagtgtgtccaaactgtaactgtcttgtatgctattggggaatgttccacaagctgggattgccatctcagcagtggggaggagaatgaaaataagagtcaggcaaggatctggtccatgaaaatgtttcatgactttttctcctactgaagttattgtaaggaagacagaa

SEQ ID NO: 18292 - DNA, 201 bp, Bos taurus
agtgtttaattttcaagtatttgctctttcttcttgactttagcatcttctgtacctcattctggaaacttcttttggctactcttttggaacataaattgtatttgtttaaaaatacaaggtctttaatactcaaattaatatatcttcattcatggaaaaaccttggacagagtaagtctatttaaaagagatctttaa

SEQ ID NO: 18293 - DNA, 201 bp, Bos taurus
ttaaagtactgcctaattttttggcacttcagcttttctccaaggtctgaaccactggtaataaattttaggagaagtataaacacttaatacagacatatagtcagatatagccatcccctctaactttttaagaagtctctgaatgctattctttcctccttacttctttgcatttaatcattcaggagacaaacttag

SEQ ID NO: 18294 - DNA, 201 bp, Bos taurus
ttactctaacagagaatacatagacacccaaatcagtgcatcagcactgacataaaaatagctacaacaatccttttaattagacatcttctgattttacggatgagaataggcaaatttaattcagaagaccattatatctactactgtgggcaagaatcccatagaagaaatggagtagccctcctaatcaacaaaaga

SEQ ID NO: 18295 - DNA, 201 bp, Bos taurus
tttcatccttagtgaaattctttaaaacataggcacacatgcacacgtatgtacacgcacacacacacacacgtcatatcatgttagtaacaaagggcctatagagacctttaacttacaaatggggaaacatccattatttttcaaatcaaatagttttattcacttacagtcacacacataataagaattattcagttt

SEQ ID NO: 18296 - DNA, 201 bp, Bos taurus
aaagagggatgacctacaaaatagaagcaaaacaaatggatgaggaagaggaagttgacaaagaagacagacttttgaataagtccaagagagtttgtaacactagctcaaggaaatttaaatcaaacacagtccattctaacaaaatgttagaatctatattggagataaacaaaggcaagggaaataaataattgctat

SEQ ID NO: 18297 - DNA, 201 bp, Bos taurus
aaattcaacaggaaggatagagtcataccccaaagtgtgactggtaacaaataatcggtcacttaattagactagtgaaaagtgtatgagcaccaaagatacagaacctaagaatgtgaagcctttaaaatctttgaaaattatataaaagttgtagttaacatggactctgcaatctgaaggctatatcttgaaataagg

SEQ ID NO: 18298 - DNA, 201 bp, Bos taurus
tgcatatttcctgagttaacagatgctaaaacaccaccaaatgaaagaaattaactagttgatgagcatcaacatgtagagcccagacctactggtgcccgagaattaatcatgttaacctctatgacactgccttgttacctcaccatcaaccaatcagaggattgtgtaccagttgatcatataccctgagttccctct

SEQ ID NO: 18299 - DNA, 201 bp, Bos taurus
aagtacaggattcctgctcataggccctcatttgcagaaagggctatcagatcaggtggcctgggagttacccacagccatagacatgaggcccctgggacagaaggcgctgccaggaagtataagactcagccagcacctccagcaaccagggcagaattcattgaccaggtcacaagttattacctccacagaataagt

SEQ ID NO: 18300 - DNA, 201 bp, Bos taurus
cagctatgccctctcaccgagtggtgcagacattgctaatcgatctcagcatatcttcccactgagctggaactcagcctcagaatcctttctggacagttcattcggcagttattgctaattggccagaattcatacaagactggcatcccaggtggggctagtggtaaagaagctgcctgccaatgcaggaaatgtaac

SEQ ID NO: 18301 - DNA, 201 bp, Bos taurus
ctttccctggcatagagctttacaggactgtcttgatgatctgaattaattgctttgtctttatgtcccccaagagagggccaggagccatccaggatggatttgaatgaaaggcagagctaggcttcctgaatttgtgaatagtgcgtcagctcagaacctgggcctcacaaggctgaggtcatggatggacttctggtc

SEQ ID NO: 18302 - DNA, 201 bp, Bos taurus
tggtcagtcagccttagctgcccagcactgcctcattttcagactgggttttgaagctctgagtccagactctgcataggggcctggcagaataacagggaatcatttacctgaggttggtagtgcttgccccatagatggttacttgcagaattatgggcagaggtggatagtcaagctggccacaccatctcacttggg

SEQ ID NO: 18303 - DNA, 201 bp, Bos taurus
ggcttcctggaagcttccttgcaagtctctctagtgccacagtcggttttccaaaaagttcaaccactttcctttcaggccccttctggaaagctttattgtcactccaggtgacagcttcctgcttgactgtcacctcggcaaacttcaccatccagtgggccaagcccccaccctctccagcaagatctgaatctcagg

SEQ ID NO: 18304 - DNA, 201 bp, Bos taurus
ggcaggggaccaggccactgacaaacagactgggaggtgatgagttgccttgggctttatgatattcagaatagggatggtttcctgtccacaccttcccttccctcacaaggccagccagtgaccccctggcccaagtagcactccctagttcccttacagccagaaaggcacctaaaaacagaaatgaattaatgcatg

SEQ ID NO: 18305 - DNA, 201 bp, Bos taurus
ctcatcagacaagagtggtcagaggggcaagtgggggccacatccttgctttctttatactagtcctctttccctgacactggccaggcctagaagtaggacaggtggagaaaaggcagagagagccaagcaagaaggtagcttctctgctctcccaccactcacgccaggctgttctggatttcacccctgaagggccca

SEQ ID NO: 18306 - DNA, 201 bp, Bos taurus
caagtagggtcactgccccaaagcagagatgaggaacccaggccccaagaggcaaagtgacagacagggtgacagcagctaggatcccacctccaggctgcccgttggtggcagcaggcctggacgctaactccacatggtactgctcatgtcccaagccctgtgacatggccatcctctcccagccttggccttgctgtc

SEQ ID NO: 18307 - DNA, 201 bp, Bos taurus
gttacatgaggaccaggcagccaactgcaagccagggatggaggtcttcccagaatccaaccatgatctgggatatccagcctccaggcctacgagaagataaatttccacggttcaagcccggcatgatgttcaagggagggcaggaggacaggaacaggagggtacaacttagattcatctatgaggccaagatgctgc

SEQ ID NO: 18308 - DNA, 201 bp, Bos taurus
gagtcttcagccagctacagacctcagaagcttgctcgggccctgaggcaaggagctgaggtaacgcgtcccacctttgggagaggaaccacccccacctcttccttgctgcccaggcctcgagactaatgtgctgcccttggtcctggcccaggacgaagccaccacggtcatcaccctgcccaagcaggattcctcgcc

SEQ ID NO: 18309 - DNA, 201 bp, Bos taurus
gctttgcaggcggattctttaccatctgaaccaccagggaagcccagcaagacccatatgggatttctgacgtagggaaggcctgaagcagggagctgggaaacctaaaggcagttctaggggcaggaagacacaggaccaattggactgaattcttcacgggccaccaggacctcggggcagggaggaggcataaggcac

SEQ ID NO: 18310 - DNA, 201 bp, Bos taurus
cacttctgaacaggcacctgacacttcatgtatactcatctgcctctaccatatagttaagtgaaactgcatttaaaaaagatggacactcaaatatcaaccgcaaaagaaagataagtaactcagtgagttgaagtttaaggcattttagtttacacaacactcagtgcaaatggaaatggaggtgtttgatccaaagtt

SEQ ID NO: 18311 - DNA, 201 bp, Bos taurus
ggcctccccatctaagcccttataggacactcaggagtgctgactcagcagttgggttgtggaatccaaagcccaattgatgtggggcttgaggggaagtcgtcttcccagcggtatggccagacctttgtgctcttgtgagatggaaggtgcagggtgtatgctgtggctattgcttgggatcggctgctgccaagcggg

SEQ ID NO: 18312 - DNA, 201 bp, Bos taurus
gggtgacaggcattcaggaagtccaccaatatagaccctgagtctgcagaagtgaggcctctgttggccctgcgttttctcatctaggccacccctgataccaggggaaagttaccaaagctcgaggctgagcccccaaaccactgtcaacgttggtagaggaggccttcaaggcctagaatgccaactgaaaattgtcac

SEQ ID NO: 18313 - DNA, 201 bp, Bos taurus
ttagctgtcacctggaagaatgtagtggagagaaatcatgggctttgggattgctcagatacaactcatactctaccaatcactaactccatgtcctgggaagttaatatagctcttggcacctctgtgttcttatctgtaagatgggctcatcacactacctgcctggcaaggtgtgttaggggagctcatgcctgagga

SEQ ID NO: 18314 - DNA, 201 bp, Bos taurus
tgtgggcctgcaggcatgatcctccctgtcctgggctcctgcagcctgaacaaggagaaggctgggcatatgatttctaaggccccttcagctcaagagatatgagattgactgtcatctctgtccctcaggaagctgcatagactccggcaagacctttgaccttcagaggcctcagtttgcccagctataaaatgggag

SEQ ID NO: 18315 - DNA, 201 bp, Bos taurus
gggggcttgtgaatcagactggatgcctcaccctctgggccaatgctgtctggtatggagcacagggctccacaagcattttgtcaaaggagtgcccacaggagagaataaacgctggcctcgactcagaaacgggcctctgcctctccagaggcaccagcccaagcagctgtgggcctctcccatgcccccaggaaagac

SEQ ID NO: 18316 - DNA, 201 bp, Bos taurus
gccttgcacgtggctgttaataagatggtgatgggggctgcttcatgctcagaaagacccctgcaccggagaaatcctgtgggggtccaatgtgccagcccaggaaaggacagaaacggggcagccatgaagtgacaggccctcctgttgggctagatcaaaacccagaacgcagggatggggccacaaggctgctgccta

SEQ ID NO: 18317 - DNA, 201 bp, Bos taurus
ctaaccctcaaaacttcctcaaaggtgaaacaagatggacaaacactgaaaattgctgaagcatgttgataggtacatgagaatatgttacaccattcgccccacttttgaacatgtttaaaattatcagaaatttttaaaaatcgaaaatactttaatttcttcaaaagaattgtaaagctgaagtctatgtggaaaaaa

SEQ ID NO: 18318 - DNA, 201 bp, Bos taurus
tggcctggatgggtggtccttgcacctgaatctttagaggagctgctaaaactaaccagtgatctatagccacaggtaagtcagtgatgctcatatgaccgcagggaaaggaggcccttctttcccttgccccccgacccttcccaggttcacaagttctccttctacattttcataggacccttctgaagcaaatgtccc

SEQ ID NO: 18319 - DNA, 201 bp, Bos taurus
aggttatgaggccaatgctaatgtgatgctccattgaaaattttcagaatattctcttttaaaatggaatcaagaaagtaaataaacatgtttttatttttcttatttttcattatgctgccaaagatgtgcacaagggaatttgtacaatgagcatgtgtgggagatgacagctgttgcttaagccattgagatggagat

SEQ ID NO: 18320 - DNA, 201 bp, Bos taurus
gtatttatatacttataagtaaacgtgtgtatgcacatattcatatatcttactgacagtataaccattgctccagtggtttttaccacaccagagaacagataaatcatctgatcaggaatctatttgccaagtatctgaatctgcattacacatggattttgttatttcataccacctgtaattcacattcacatggag

SEQ ID NO: 18321 - DNA, 201 bp, Bos taurus
ggctcaggccttctcattgtgatgggagaacatgttactgaattggacctctttgttggtagagagttgcctttaatcagaattccagcaactggggagattgtaactcagtgtccctaaagaatcacctctgaagattcttcttgacctcgtaaaagggaaagagggaaataatctcagttagtccttgaaacaagggtc

SEQ ID NO: 18322 - DNA, 201 bp, Bos taurus
gaccttttggacccagggatcaaactcgcgtctcccacttgacaggcaaattcttagccactgagccacgtgggaacccccattagctttgtcttggagttggccaaatctggattcatattaaaagattacctgcctgctgagttgttgtgaaaagtaactgcaaattgtcacaaatcgatagcacagaatctcttaatt

SEQ ID NO: 18323 - DNA, 201 bp, Bos taurus
tctaggctacactgcctcattttgaagataatgttagcatagttatgattattaagaataaagaaataactagattttaaggatcatagaaaagaaagtggattgggaggtcacagtgaaaaataactgtgcttatggatttttctggagtggtcctgacatgaaatttcctagcttacacggtcacctcgcatctgccct

SEQ ID NO: 18324 - DNA, 201 bp, Bos taurus
tataaaaagaaaaaaaaatccacatattttttagtgattatcattatgaatgtctacaatgtagctagacagtgggccaagaggaccaggtactcaatgcgtattaattcctttaaatttcaaactttactgtagtcttgtgtggtagatgtatcatcaccatttgacagatgcagaaactgagggccagagaaatcggac

SEQ ID NO: 18325 - DNA, 201 bp, Bos taurus
tagaacagagaatatagacttgaaagtgcatagatcgacagaaatctgtaagggtagggataagtagatcagaagaacgtggaatcatcgaagaaaaatgctttgttctttgctgtgtactcttctgcaactttttgcattttgtaccacttgcaaaaacatattttaagaagaaactgaggcaatagaatgaatgcatga

SEQ ID NO: 18326 - DNA, 201 bp, Bos taurus
ctctttgatgatgccactgattttaaagcaaaggaaaagaaaaataacccaccaaaggtatataagaagtaaaggctcagcaaagtagtgcaataaatcatggccaagtatgttgtatggaagtcataaagtgtgtggtccatgcgggctggtggaggaacggcagtggctggaataggttccccacccccccgcagcctg

SEQ ID NO: 18327 - DNA, 201 bp, Bos taurus
gaaaaattaaactcctaatttcataattttgtgtatttttctgtggctgaaaaaaaggctgacattacatgatgcagagaaacaatgatgggtttggacaaactaccatggaagaggggcggttggtctgcattttaatggggctctttttctatacgaacaactgttcagttaaaggtaagaggttgtggaatattttgt

SEQ ID NO: 18328 - DNA, 201 bp, Bos taurus
gtttttctgtcctttatcttaagaaatcttcattttattctacagaaatctttagaaatggcagttctccccagacttgaattatcaaaaagccagtattatatggagacagatactaaataatatactccaggaaatcactatccaattctatttagatgcctacctcccccacaggacactctgctctcccatctatac

SEQ ID NO: 18329 - DNA, 201 bp, Bos taurus
caaattgcctttttcttgatacagcattcccttgtatgctttagctattttccagagttttgacaaagttggttctgacagtttctgctttcttctcattgttcctgcaaagggtactagagcttgaagctacctgctctaccattttgccaacatcatacagttactgtttttgaagatcataacctctgctttatgcac

SEQ ID NO: 18330 - DNA, 201 bp, Bos taurus
tttatttctgattgctgaaattctgtctgctttcaaaatttcactcagatactttcatatagtcaaaaaaacttccttagtcacactgtaaaatttgactatgaggagtctcatgacacattacattcttctgcattttatctacatatatgtgtgtcttatcagtcctacctgacaattacgttttgtgaagacataaca

SEQ ID NO: 18331 - DNA, 201 bp, Bos taurus
tctgttttttttttttttttctcttaaacacacacacacacattttctagaaagtagaactgtcttgaagatgaagtatggccgtatgtcttttattaccgaattttaagaattttcatattaataatagtgtcactagtgtgctgtgctgtgtgctgtgctggccttagtcgctcagttgtatccgactcattgcgaccc

SEQ ID NO: 18332 - DNA, 201 bp, Bos taurus
tttaggtaagtgtaacttttgtcatatttcttaactaatattctctttcattcaaatttggtgtactaaacatcatgttttagttttttaaagaaaattagtgacaaagtttaaggtccatggataatgtcatcccttgctttttctaagagggccaagcagttctctcactagtaacctttccacagcaaacatgtttgc

SEQ ID NO: 18333 - DNA, 201 bp, Bos taurus
ttatcatcatggttttcaagatagtaaaatcattaaagactcagcaagagtattgctggaagtaagattgcattggtaggatgaaataaaatagattgttcacaacctcaaatgcaggagaagaatttggatttggagaattaggctatcattgaagattttgaagatcaatatatttattttagcagcagaatgttctaa

SEQ ID NO: 18334 - DNA, 201 bp, Bos taurus
aactatattcacccaaattaatacacataaacacacataatccaatattgtaaaggcaatgctagtcattaaatattaatgatgaaaaagtgtgttatagttaatagggtaaataatttattactgcttagggaattcttccaaatggaggacaatactggatcattaaaattgaccaatacttagttggtggtaatttta

SEQ ID NO: 18335 - DNA, 201 bp, Bos taurus
ctttaaaacttgaaacaaatggcttccagagagtctcttgccatcaaatttctgtgtaactgtttcagactcagggaaattccttagccctgttcttctaagtttctataaagtccaaggtcatgtgtctgtatctcatctgaagagtgtacttcctctatgcatctggttaccttaatctcacaatgtcctatgcatgta

SEQ ID NO: 18336 - DNA, 201 bp, Bos taurus
ttattctcccttcaaattttaagataaataatatttgaaggaagaataagataaataatatttcttcagaaaagtctcctataattcatcagaatgagtgaattctctcattataagtcccacagcatcattttattctcctttggagccccataattatacttggttaattacttgcatacttatcatagtctatttctc

SEQ ID NO: 18337 - DNA, 201 bp, Bos taurus
agctcagctcctctcacaaggcctgagttccgagatggagggctgtcagtgaaaacttaagaagtctttttcatgaggaaatctgcaggacacaaaaaaacacagtgttgtttcagggcccagggaccaagtgtgacacacaaggcagaaacaagcagctttccagttctgtggggagactgcagagagtaggcatgagga

SEQ ID NO: 18338 - DNA, 201 bp, Bos taurus
tacaagagaaagaacttgggagtataagacagagtttggggaccaaggcctgtattgcctttaaataaaatggccttaagtgtagtgaatggtggactacggaaattccatgccttgaaactggaaacaaactaaaacaaattttaatgactagtttatcttaaattgtactgtagatgagagggaaatgtctcctctgct

SEQ ID NO: 18339 - DNA, 201 bp, Bos taurus
gactgtggagtaaggctctgccatcacctatggataactactctccttttgagtaatggcttttggaccactactgagtcttagtggagattgaatgcttaactgggccaccaaactaccatctgacctaagctgccaatcacagcctaggtgttgtcagacccaccaaaatgtgaagtagggtgtatacagtaggattcc

SEQ ID NO: 18340 - DNA, 201 bp, Bos taurus
tcctctctgtgcacctacaccgccggttttgcagcgtgaaagaaatcctggctctcttagagcaaaagttatgcagccaggcacaaggaccactggcctgctgagggctgttctgtgaggcactgccttgacaactcccagatcctgacactccaggtcaggaagcggcccctcctttgccacctgggacatgcccaccag

SEQ ID NO: 18341 - DNA, 201 bp, Bos taurus
atcgacaacctcaaaaaacgctttgaccacaatgagatatatgtgagtgtgcacggaatgtcatctggggagtttagactttgcattttatggtgcagagtaggcttctcttcctcagactcttcttttttctgtttattggagtccagaggtatttgttgataccctcaggaagaagtttgtgtttgctcacttggtgcg

SEQ ID NO: 18342 - DNA, 201 bp, Bos taurus
tggccaaagtgctggtcatggcgagggcagcagcgactgtggcacagagcagggccagggaccgaggcaggctgctgatgaggccccagaggagtgcagctcacacagggtcattgtgggtaccatgtaagtttctcagggactcagggaagtagatgagacatctggccacatggcaagggtgggatgagggtggtagat

SEQ ID NO: 18343 - DNA, 201 bp, Bos taurus
agggcctaagcacgaagcaatgtccttgagaagggatgggtttacacatgggtgtaatgtttggtcttagaaatacaaatacatcttctggctcatggaagttatctacagatgtaggcaggaggtgacactgaaaagaggaggatgaaatagatctcttctgattccatttattgcctgtattgcatttgtactcaaaag

SEQ ID NO: 18344 - DNA, 201 bp, Bos taurus
tctctagcaacacagctgaaaatcatcttcagcactcagccttctaatttagttcgtactgaaactttctttgtatgtaagatttgtctacaaattcaatgcttttgatatatataggattattcatgtttctcttttatcttgttagactttggtagtttgtctctttcaaggaacttatacattttgtataattcatca

SEQ ID NO: 18345 - DNA, 201 bp, Bos taurus
tcaaattatttatttcagcaagaagaaaacattaatctgtgagattaagttcacaacttatgaacaagaaaatatttagtttattactttggcctatttgcacaggggatatatggaaatcagatcctagcaaagtgcaattttagtgtcctgaataaaaactgggaaatactgactgagacaggggctagaaagctacct

SEQ ID NO: 18346 - DNA, 201 bp, Bos taurus
gggttgttttaagctaactagtggaataagagtgtttacaggcttgtgagataaagagccaataaagattatttttgacttagaacaatttccaaatttggagacatgtcacatgggaccctgagtgactatgtcttctctaagatctagcccactctggtcatgtttgcaagcattcaagtagagcctagttcccacatg

SEQ ID NO: 18347 - DNA, 201 bp, Bos taurus
tcagaaacaatggagtacatgagcacagaatacatagtattaagaaagaaatttaaaaggtggactgcaagtcatattcatgagtatttgaagtaaagtataagggataaccttgcatctctacttataatttgatgatataatatttgataacagaaacttttagtactatataaattattgaattatttctcctccagg

SEQ ID NO: 18348 - DNA, 201 bp, Bos taurus
tgacacccaggctatatttggagatagggcctttaaagaagtaagtttttaagaacttaagaatttaagaagtaattaagtttaaatgaaatagtaagggcggggccctgatttgataccattagtattcttaggagaattcagagagctcactctttcactccatgtgtgcacagaggaaagagcctgtgaggatgccat

SEQ ID NO: 18349 - DNA, 201 bp, Bos taurus
cagctggtgttttactttctatatctgtctcattgacttttgtattgttgttgtcttttccttcctttttttttttcttcatctcatgttaaaactgctgattcttttcttctctttagggtgtctccatattactttcttttgaacattttctgtttcctcagtttctattacctactgctttgaagcagaacaacccca

SEQ ID NO: 18350 - DNA, 201 bp, Bos taurus
ctaatactgccactgaaaggacatacgtcactgggaaggcccagcgggttgccactctccctgatacaattaaaacacatgaccataaagtttacaaaggtattacataattcagagttggccatgataaagactaagacattcaaaaaatcttgtgtcttcactgctgttgctgaaatatttatagaaatacttctctgc

SEQ ID NO: 18351 - DNA, 201 bp, Bos taurus
taatcccatggacagatgagcctggcagcctacagtccatagggtctcaaagagttggacacgaccgaagcaacttagcacacgtggcctatcttgcttattttcataaagaaaaaacaagagttatactttatgtttctacaaaatacttccaatgaaaagttacccaaatcttaaaatatttggcctttttatcaatat

SEQ ID NO: 18352 - DNA, 201 bp, Bos taurus
gatcacaaagagtcgaacaggacaacatactgactcaacaagaacaaacagggtataagggtggagttgtcagccctctgatgtcaaaaggtcaccaagccagatacttgcacatggccagttggaaggtcagggagcctacccagtcttaattagctcatccataaatagacacagctgattccaatctcctggaaaaca

SEQ ID NO: 18353 - DNA, 201 bp, Bos taurus
gctcacactaaacatatgatagctagtaatattgtcaaaatgcgacagatgagaaaactgaggcacaaagaatataggtgcccaagatcacacaagtgttggtcgctcagtcatgtccgactctttgctcccccatggactgcagcccgccaggctcctgtgcccacataattctctaggcaaaaacactggagtgggtgg

SEQ ID NO: 18354 - DNA, 201 bp, Bos taurus
agtactaacctgatagtataacctctatagcttctggaatcaaactgcctgggatgaggtgaaagggaaggaagagagagatgggatgtggcagggagaggacgggaggaggacctactatttatcaagacctttctctgggcctttttgcagatcccattaaatcctgacagcaatcttgtgagataggaagacagtgag

SEQ ID NO: 18355 - DNA, 201 bp, Bos taurus
gcacagcaagcacctattagatgcaagggcacttggcagagtcaagggagatctgcaatttcaataggacaacatcctcaccatcagagtccacaggccagtgtatcagacacataagcacatcaggtaagtacctaacttggagatgctccctgaagcagaagaggacagcacagtctcagggcccaacaccaactgaaa

SEQ ID NO: 18356 - DNA, 201 bp, Bos taurus
tactattacacagaaactgaaaaggaaagtggcttaaataagagccatatcggtggcttaacatttaacagtccagaggtaaccaggccaggcaggaagaacttctgcttctaattccaaatggttaatttcgattctcagcttatcccagtcagcaagaaggagaaaaagaaatggagagacaccctttctccattggcc

SEQ ID NO: 18357 - DNA, 201 bp, Bos taurus
atgtgagccttaaaagttttggcagatgcgaggaacaagtatctttgattttttagttataggcaaagacagaacttggtgccagcatgacccacagcagcgcacttgaaagaggtattagtaatgaaggtgcttgcttgtcaacatggtggctgttgagactgaaaacctgtcataggtcacagaatacttttaacagat

SEQ ID NO: 18358 - DNA, 201 bp, Bos taurus
tttcagtgtaacactctgcctttggctatgcccggttttcccgaatcccatgatcctcattcagcagctccagaaaattaaccactggtgttctgcagggaatgggtgaagtgggaacctactctaggtgaacatggcaactaggaaaatctagcagcttaacagatttacaactgcttcaccaatttttagccccacctc

SEQ ID NO: 18359 - DNA, 201 bp, Bos taurus
aaaaagccttgggtggtggtagagctttgaccaacaatgtggtaaaaaaaaaattttaaatcaaggttcctgatcatggccccactttctccactgaccaaagctatgactttggacaacccagtaaatccccccgtgatttggtttgctcacctgtaagataagagattgccccttggccacttaagattctactctaaa

SEQ ID NO: 18360 - DNA, 201 bp, Bos taurus
acagagagagtggcacagatagagagtcattctaccccttttcttttaggccaagagtgccagcacaactccaaacccaataaaacttccaaaggtttccgttcaaagcataagctttccttaggccaaagagaccatgactaaaaataaagtaatgactattaaatattccttgagcctattttagtgtgaaatgagtac

SEQ ID NO: 18361 - DNA, 201 bp, Bos taurus
acatttttcacacacgtcagcccccacacacaagccaactgcctgtctgatgttcaaagaaagtgcaatgtgttccaactctgcaggcaaaataggctgtgttggcctccatgacagacagagcatgggcctccaacgtggggctttccaaagagactctcaaagttaatttttgactcaatgtgacttctgcctcatata

SEQ ID NO: 18362 - DNA, 201 bp, Bos taurus
ctcactaagactgtgattatccagcaggtgatagcatgtttggtttgaaaaacccctcaggagatttttaagcatttttactgagaaccgtattgtataccatgttgggtttaaaaaaaaaaaaaaaattaatcccaaatgaataaaatctggaaactgggagaaaaaagtttccatagctaattcttaaaaatcacatta

SEQ ID NO: 18363 - DNA, 201 bp, Bos taurus
gcaaagtagcaagctcttgggctctgctacccccacccatctggctgtgagttttatgaatatgcaagtaatggaacccttatttgtggctatcattggggctgatgagtcacaactcatacattcatatggttcacaatgtcacacaactaggggatgcagtaagagggaaatggagctttcagattcagacagtcttca

SEQ ID NO: 18364 - DNA, 201 bp, Bos taurus
atttatccaataagaaccccgtgtgtctcagtgtggtttattgtcagttaacacagtgttcattgagtacccactttgtgcagcagatattgagataaaagggcacagctcttgctctcggcccactattactggcacagatggggtcatgacacaatgcaatggctatacaacttgagggggtgccttacagctgaatgg

SEQ ID NO: 18365 - DNA, 201 bp, Bos taurus
ccagaaagagtggtcagacatgactaatattctgggagactgttttcctgagcattagtatgggtcgggcatttgtttttcaaaggtcatatattatagatcacatggatttaaatgggtaaggttttacgacatcaagtaaaattaaaaaatcatttagcatgagaggaagaaggcaataaaagattcattctcagtcat

SEQ ID NO: 18366 - DNA, 201 bp, Bos taurus
ttgaacaaatgggtttgttttccatattggagaaattggttggagggtgcatttttgaatggatttcaacacagagactgagtttcagttttaggaacagcaatttgttttaatggaaacatcatcaggcatgtgataagtgtctcctttatggaagacttcctgctacataatactgtatgttaaagaggaaagagagtc

SEQ ID NO: 18367 - DNA, 201 bp, Bos taurus
gatgtttatttctgcttgtttgtagggccagggagacctgttgaagaatgccaagaatgaagccatagaaaacatgaagcagatccagctggcatgtttgacttgcggccttagtaaagcccccagcagtggtgctgaggtgaagagtaagcgcagcctggaggccatagaggagaaggagagctgtgaggacaatgggaa

SEQ ID NO: 18368 - DNA, 201 bp, Bos taurus
ttgttacatccgtgtttattgacatggtaggagatattctatttcacaggatgaacctttgttagatgcaggctatcagggggttgggggggagttggccggtgatgccccactctttcaggaacaaagctgtagcttggtgatggtctttcacacagtgtccatgggttgctaatcagggccacttttaccttgacttct

SEQ ID NO: 18369 - DNA, 201 bp, Bos taurus
caccagtttctctatcctcaggttgagctgaggccaccctcacctccactggagaccctccatgaccaccaggtaggtctggcccaggtttctgtcagataactgcttttgtcctgcatctagatttgcatcaagttttgtttgtgccctttaaaagtgaagtctctatctcccaggctcctgaaattaggactcactggc

SEQ ID NO: 18370 - DNA, 201 bp, Bos taurus
ctgttgtcttcatctccctggtgtctagtttcttgtgtagactcaaatatgaaacatagcctcttatgcttgattctagggttctccttcctggggggctctggggagaactagaaagccttacagaagagcacatgcttaacacatctccattttcaaaaattcttttgctacttcagcctgaaagtgctcccctacctg

SEQ ID NO: 18371 - DNA, 201 bp, Bos taurus
atagctaagaattactaccattatttaagacttgaagtattataattttttgacaagaacctcttatgtgggatccttcgattatatgtcactgttcccacgattcctggcatgcccctggttttctgatactcacaggatgatcctgacccatcctaagtgttttcccttagcccatcacctctaacttccccctccttc

SEQ ID NO: 18372 - DNA, 201 bp, Bos taurus
ctccagggaagagtactggagtggggggccattgcctttctcctctatggggagaaaacttctgtcattaaagcaggtgattgaaaaattaaaaaaaaaacaaaactgtacaattacaaggatgaatgcctctttaccttaagtctcccagtgaaatcctaaaaatataggtgaatattaaatttttaaaaaaaagtaaat

SEQ ID NO: 18373 - DNA, 201 bp, Bos taurus
tgacatgttgcagtccatggggttgcaaatagttggacacgacggagcaactgaactgaacagaatggtctctgatgttgaattctgttcatgtgattgttggccatttatactaatctttggagaaatatcttattcaagtcctttactcatttttcagttgtattatttgggtttacattgttgagttataggagttct

SEQ ID NO: 18374 - DNA, 201 bp, Bos taurus
aaattttccgtattgccttccagcacctggaatgagctagggccaggaataccatctagatgtgatggcctgaggccagacttggatgtgcatggggctttttccctgtcgttttcccttcagggcactctcccacccactgtctgacaggtgggattgaccacatcccccaagttactctggagggccccatggctatgt

SEQ ID NO: 18375 - DNA, 201 bp, Bos taurus
tgcccctgaaacactgaagagagtggcagcatggtgatgaagaacataaaatcagggtatgtcacttatcctcactgcctcagcttcatcacccgtcagaggggctaacaatagtaattgcctcatacaatcatgtgaagttgatatttgaagtgtttagaatagcactggcatataataaatgctgtaatagtgtttgtt

SEQ ID NO: 18376 - DNA, 201 bp, Bos taurus
agagacagggctaccaccggtgctaagccccccaaataaacggccctcctcaaccccccaccagctgcagtctatgcgcccttatttcgtgcggaagtcaggggctggttctctacaggactcagtgcacagaggcacttaatatgtgtagaatagtgctttctgccacacccccgatcccccaccaccaagcgaccaggt

SEQ ID NO: 18377 - DNA, 201 bp, Bos taurus
aatggctaaaagtgtgttgaaaggcatattcaaggataacatagccttgctcttcagatgcctcttagggtgtttcatcacgggcccctgcagacgtgtcttggggactgagagccagaaattccgaatgtctccactaggggctgccttgactgagggccaagaccccaatgggagcagtggacagtgctgccaggggac

SEQ ID NO: 18378 - DNA, 201 bp, Bos taurus
aactgtcacaaaaaacttatgaaataagtactattactgttcctattttacagatgagaataccaaagcacagaaaggtaatgaggacaaggtttgagatctaataaatagcacagctaggatatatggaaagctatagttctcatatatctaacattcttttataagaaaataatttagtgattacatattaatgttttc

SEQ ID NO: 18379 - DNA, 201 bp, Bos taurus
gaacttgctttgcttttgaagcaactgcatgtaaggactcctgtttgggacctccttactccaccaccccatctagaaggttctgtccacaatgggccacaatatacttagtaaggatttttaagtttttcaaggtttcatgtcactttgtttcacagggttgagtctggaggtacttatatttagttgtgtgatcaggaa

SEQ ID NO: 18380 - DNA, 201 bp, Bos taurus
aaggtgtccattgcactcacatggcctctggacctactctcctgtgacttcccatgctccagatctttcctatggactttcttcccatcagggtgtatctatcctggattccagtctctcagggccactctgtctcttgctgtacagatatttactttgcttttgagcagatctcagactgagggccaggcaagaatgggt

SEQ ID NO: 18381 - DNA, 201 bp, Bos taurus
agggggttaggccttggactgggccccaaaagtgattattgtagtatggcatcaaatttcaaatccatgagagaactggaggaaataaagatcccttcctttcttttctaatttctcagtggccatagtcatttgaaagtaagagatttcaaaaacacacgagaatagagctctcctatccatacagaacttggaatttct

SEQ ID NO: 18382 - DNA, 201 bp, Bos taurus
cgtgggttcgatccctggccagggaactagatcccatatgtcacaactaaagattccataggctgtaactaagacccagtgcagccaaataaattaattttaaaaaaaactacataaggccttaaaatatatcatgtacatgcgtgcgtgctaagtcacttcagtcatgtctggttctgtgtgaccctatggactgtagcc

SEQ ID NO: 18383 - DNA, 201 bp, Bos taurus
catacaacacaataaatctcaatgaacataatattgagcataaaaagaaaggcacaaatgaatatggtttgttttcatctgtatagagcacaaaaatagtaaaaactaagctatattgtttagagatgcatatgtaaatggtaaaacttataaagtcaagaaaattcttatctccaaatttgagatagtggttacctctta

SEQ ID NO: 18384 - DNA, 201 bp, Bos taurus
ttctgctggtcgggaggccaaaaaattttcagagagatgcactcgaggctccatgggcaaaggagaagggcaaggtgaatgagatggtgaatttggtggtgtggaaggggtagacaggcctcgagggagaggctggaggagggggttctctgaaattgggctgtggtacactttagcggagatgcctcgctcctgtagaag

SEQ ID NO: 18385 - DNA, 201 bp, Bos taurus
tgtcaagtagtacaaaagaaccttttatattttattggtttccataggggtccactggcttttggaattgataccttatgtaaaattagctaaaaagtaaataatattatgtgaaatatattataaaatatagactactattatggagattgcatattacagagagtatatagttacagaggaaaagtacagaatatagtt

SEQ ID NO: 18386 - DNA, 201 bp, Bos taurus
taacagctatgagaaaaaaagaaattattttattatttggctctgtgacacgtatatgtatttcacctagttctaatgtatttgcctaggttttttcctctgttaaggggaagctaagtaaggcattaatatgattttctaagcatatttcctttgattaggttggaatcgtggaagttctgtttatctctggaaggatct

SEQ ID NO: 18387 - DNA, 201 bp, Bos taurus
catgtgagagaccagctgggggggcacttccagcagcaggacaaggtaatcacttatggggtagatgcacccctttggcttgtctgtgactctgggctcattttagtcatcttccagggccacacataagctgtctgaaagccaccccactgaagaagggaaatcagcagtgtttccgaccatgtcagtgggattaacgct

SEQ ID NO: 18388 - DNA, 201 bp, Bos taurus
tgggattgtttctgttaaggcgaagagcagaagtctcagtgttaccaccgagaagctccagggttcagatcccagattccggccttcttgagttttcagcactcactacacaaatggggatttccttcatttacttagcaaccatttgctgatcccttgctaattgccaggccctccatgactggataagacacactcttt

SEQ ID NO: 18389 - DNA, 201 bp, Bos taurus
tttttctgaaaactttttactctcaatttagatgaggttgctaagtaagaaataagtaatatttggttcacttccaataaatccatttaaatctaatgtgctatagtcaatagaactgctgcttctgtgcaatgacaatctagtactagaattagatagcaaatacatagtttctgtatgaaatatcccccctttctatga

SEQ ID NO: 18390 - DNA, 201 bp, Bos taurus
aagtttaagccatacagcataatgatgtgacatatgtgtagcaaagaaaaaaaaaaacaaaacgtaagcttagttaacatccattacttcatagttaccaaaaaaatcatttttccttgtgatgagatcatctaggatctagtctcctagcaactttctaatacaccatacagcaagtgttaactatagccattgtgttgt

SEQ ID NO: 18391 - DNA, 201 bp, Bos taurus
tgcttacttgggtgggctggagtcaggtgttcattcaacttgttctcagagttagaaaatggtcctacttggctcgaaaattggacagataggggttaatcggcatattgaagtaagggtagttatttttccatataagatacaatgaaaggccagcatcttccattttctttctcacttatgttggtagtatggggattg

SEQ ID NO: 18392 - DNA, 201 bp, Bos taurus
aaatcaaagacaccaagtgatttatgactttagataattttggaaagtcttggttgcaaagttgactctcagtgcttcagtggcctctttttcaagtgattgtaatttacttgggatttagtcttcactttgctcaccatctgctcagtgataccaggtagatcatccaatgtttctaggcctcatatagtcactactaaa

SEQ ID NO: 18393 - DNA, 201 bp, Bos taurus
atagggagagatttaggaatatttttagcaacatgaactatgatgttaaaaataatgaggacctaggactgttgaaaaggctattttcaatttcagttaaaacctggctatgtctggttacagcacagctgccaaaggtgaatgtcacacttcagaacatagcatcccaaatttcacaatgctcccggagcttcaatactg

SEQ ID NO: 18394 - DNA, 201 bp, Bos taurus
gcaggtgtagaccctctttatttcttcagatgacctctgaatacccacagcagaatctgtcttggcttcttcaaaagtataaagcaaggatccccaccccctgggccacaggccagtactggtccttggcctttcaggaaccgggctgtacagcaggaggtgagtgacagagagcaggaggtgagtgacagagagcaggag

SEQ ID NO: 18395 - DNA, 201 bp, Bos taurus
gggtttggggggactccgggtgttggtgatggacagggaggcctgtagagctgcggttcacggggttgcaaagagtcggacacgactgagcgactgaactgaactgaactgaacatcccaaggcctcattcaacagtccagtctgtgtgtggggaggggtgggaggtgggggggcctgtttggtccctggcccagtggtaa

SEQ ID NO: 18396 - DNA, 201 bp, Bos taurus
tgaaaatctgtcaaaaggaattccaagtattttaaaaaatgcatgttaaatgggctttgctacagttttgaaatagattaaaattatatgcaaattaatgcaaatcatgtggcttgaagattaagttttgaagtgctatcttcattccctggagtaaatggcttttgaagaatggatgtatataaatatctggctggctgg

SEQ ID NO: 18397 - DNA, 201 bp, Bos taurus
ccttcctgatgagtatgtgtcagtctggctcagagctgttgtgggaccagcagattcttccttaccagaggtacatgtgcctcctctatggctgttaccagctgtgacagtctccttggcttgatctattctttgtccttattttatcttctttttatttattttcatgatattgagactatataggcaatttcataagtt

SEQ ID NO: 18398 - DNA, 201 bp, Bos taurus
cttagtacccatagctgactagctccaataatcacattttcaactttattttttttattctacaaacaatttattgctctgtgaaaagtattcaatgaaaatttcaggcccaattgagttgcgtccctttggccacgtgcccttcattttggcaaagggccagtgctcagcgcaatccagttactcaactcaattacacct

SEQ ID NO: 18399 - DNA, 201 bp, Bos taurus
tagcaccttctgggccaatcttaaaaattggattagtacatgaagtactttcttctttatattttgcacctcagttgaggctctacatctcagatactaaacattttaaataaggccaaatataaacctttctttcccacttgcttttgttttctaaaccattgttcatatttaaatgaaattctgtgttcctttttaaaa

SEQ ID NO: 18400 - DNA, 201 bp, Bos taurus
aatgacatggtttctgaatttcattacaactttaaaactctgtccagctttaaagtgttataagaaaagcctgttttactatacatctgcttttaaaggcaaaggcagcataatttacaagaaatcactacaatataaatctgttttgttatactgcttgagttaatttaaaataaaatttcagcacattgaaagtgcagg

SEQ ID NO: 18401 - DNA, 201 bp, Bos taurus
aaatcctctgtcctaggaattacccatgaggaagggcatgccaactttaaccttggagcttcctgtgggtgttaaaaagcaggagagaaatgtgaacctgagaaggtgtttttcgcttgatttagaacctttctgagttctttggggaaaaggcaaatattgctgagaggcactgacccattgaagggaagagacatctgg

SEQ ID NO: 18402 - DNA, 201 bp, Bos taurus
ccaagcaaatcagtaaagtggcccacccattcaaggccaacccttgctctatcaagccatcaacagtcactgtctgctaaaacttcctctgtgtttggcagtggcgggccataatgttccagaagagcagactccattgacactgcatgtgcttcactcacagcagagacagggatgccgggacttaaaggagctgcagca

SEQ ID NO: 18403 - DNA, 201 bp, Bos taurus
atttcggtaggatgttgttgcctttaactttttttatccaggggaaaattgccattttagggtcagcatgaacagctctttcttatatgcgatttaaaacaaaccagaaagaaaacttcacacgtcaaaatccgtagaagcgcctccatgttagaagcggacaagccttaacgtgctttgtgaataggagccattcattca

SEQ ID NO: 18404 - DNA, 201 bp, Bos taurus
agcattatatttgggacatatcctcatcgtagctttaggttattcgaatgtgaaatttctatattagagattgaactacagtcaaagcacacacgatcaggtaatctccaagttctgacacctacccaagggcactgaatcctggaaacaactatctaataccaagccagaaatgtcttttttttttcaaatccccataag

SEQ ID NO: 18405 - DNA, 201 bp, Bos taurus
ttccaggacagtccttcctggtttatgtctgttgtcctggaataattattaatatgcctctttctgtatcctgatttggatgataaatcatatggccagctagtgcttcagccttggtgcttgctactgttcttctagacttttcctctagctctgctggtgaaggaatgctgtatgggcctcaggtccctccaaaagaga

SEQ ID NO: 18406 - DNA, 201 bp, Bos taurus
atgtggaatctgaaaaaaaggatacacatgaacttacttataaaacagaaacagacccacagacatagaaaaagacttgtggttactgaaagggaaagaaggggagagagagataaactgagaatttgggattaacagatacacaccactctatataaaacagataaacaacaaggacttcctgtatagcacagggaacta

SEQ ID NO: 18407 - DNA, 201 bp, Bos taurus
cgtctggagatgtttctctgctctccctgcccccaatttccctgagtcttgaagaacttgctgttttctctctaggcacttactactcgaagtgtggtccgtggaccagcagcatcagtctcacctggcagcttgttaaaaatccaattctcgggcatcagaacttgagttttccttaagtaaagtgatgttcttaaaaat

SEQ ID NO: 18408 - DNA, 201 bp, Bos taurus
acaaacccatgtctggtgcccaggacacctggagatcctaaggttaatgggtgagtcactcggcttccctcccaggcctgcctgcctctctatacctcctcgttggcatggatgccacttctcggaacagagagaagcccttccccccacaaggctaaaggacgaaaaagaagaaaccacgtgcggccaacttgtaccact

SEQ ID NO: 18409 - DNA, 201 bp, Bos taurus
ttccaaacttctttttatcaccttccctcactcctgcccaagaaagctattgtaagagaaaaggttaaagaaaagaaaaaagaaaaacactctataggccgtgctcctctctcgtcatcctaaccccttcctggaaagctttgccccctgctgtgggggaagccctgaggggccaggcaggcagtgcggagctggggacct

SEQ ID NO: 18410 - DNA, 201 bp, Bos taurus
aacagtgggcccccatctcttgcattagagatgggagcagacactccagatgtcctgcaccatagcccccacctacatttatgcccattcaagcttactctcatggccacctctctctgcttttcagccttagggccctttctgaagctgtaggagcttcgcacaaggaaagctcaaacagaggagttaatgctcccctcc

SEQ ID NO: 18411 - DNA, 201 bp, Bos taurus
gatgaacctatttgcagggtaggaatagaaacgcagacacagagcacagactcatggacacagcaggagggggagaaggtgggatgaactaagagtagcacggaaacatatatgttaccatatggaaaacagctagctagtaggaagttgctgtataacacagggagctcaacctggtgctctgtaacaattagaggggtg

SEQ ID NO: 18412 - DNA, 201 bp, Bos taurus
gctggctcttgctggccagtaactttgcccattcctgtggagcctgggttctccagcccaccattgccccagacttcccacactcacatccacaacttgtatttatttagacaacttgcctggcccttagggacgtgggaatttgtaattcaaaaaagacaggaaagatgaagaaagagagaagaaggataaatcccgtaa

SEQ ID NO: 18413 - DNA, 201 bp, Bos taurus
tccccacacccattagcagtcactaatcttttctccctaacccatcccacaagcaatctctactttctgtcttcataattttacctactctggatatttcgtgtaaatagaataatatacataatatgtggtgttctatgactggcttctttcacttagcataatgtttcagggttggtgttgattttttaaaaaaaatta

SEQ ID NO: 18414 - DNA, 201 bp, Bos taurus
tctgagaggcagaactcagggtgcagccggcattatttatgttgtcacaactgcagtctagtgtccacagatgcagagtcgtggtgccactgaagaaagccgcagagggccatttacaaaggtccacgtctccaggcagcactataccagtacgggtaccacgggcacatctcctctctcttaaaccctctctgttaagca

SEQ ID NO: 18415 - DNA, 201 bp, Bos taurus
actcatctttctttaggttggtaaagacaggaagggccagtgcaaagaacagagcgtgatgcatgctgctcacaaactcctgtttctcagacactcccatgagtcttcaaggcccgtccaggggccttctggttcatgaccagttctccagacatgactcaactagcttacttcttaggtgtctgcttggatagcagttcc

SEQ ID NO: 18416 - DNA, 201 bp, Bos taurus
caagggccttggttcagaagagcaccagcatttctgtaagttatacacacgacatccataattactagttttgatgtcaatacccactcagacagcgattctgttcacctatgggccccctaaacaaaattgaggttcaacaaagtatttgttgaataaatgaatgacaggaaaggagcagggcacaacatttgaagaatg

SEQ ID NO: 18417 - DNA, 201 bp, Bos taurus
tttcttcagtggacccagtaagcacttattattactaaaattgctatctgggttaatacaagtgtttaaattttatttagtaaattgtgagcatgctggaaagaatctattaaattatgtacttttatagaattttgcagtgtagaagctatcatatttttcctagaaaatatgtaaaatcaagcttatagaatattcagt

SEQ ID NO: 18418 - DNA, 201 bp, Bos taurus
catggagttacaaagagttggacatgacttagcagcaacatgctaaaaagcagcaacgacatcgtgataaggcattgtacttgttcctagcacaaattcaaatccatgcatagtttgacccctcaacttcttttttgggactccattagcttcattgacataagagacaaaatacctttgcatttgatgaaaactagcatt

SEQ ID NO: 18419 - DNA, 201 bp, Bos taurus
aaaatggttcttaagtttcctgcgaatcagttctggaaggttgagtcacctttgacaggaaatgtatttttcgttaggacctagaaataagaaaggataaaggatattcagcatcttagtcccctttgaaggactactaattatatttttaaaaataaattttcattttcaaagacactttgtatttataaactaaaatta

SEQ ID NO: 18420 - DNA, 201 bp, Bos taurus
tcttcttcctgacaaaagctgttttttctccctccaggaataaggctgggggaataaacaaaaataagggaataggagatatcttacttgattggagactaggcagcctgtgatttgcaggtggtttaagcagatttcttctctttttctgtgggcttccaatggtatacctccagcctctttctgctaattcttctgtcc

SEQ ID NO: 18421 - DNA, 201 bp, Bos taurus
tctaagaacctttatacgttcctttattctgcaaactatgaggagttttacagccagcattttccagaaatcactgataggtttgtttttttcatgctcagttcagttcagttgctcagtcgtgtctgactctttgagaccccatggactgcagcatgccaggcttccctgtccatcaccaacttccagagcttactcaaa

SEQ ID NO: 18422 - DNA, 201 bp, Bos taurus
ctgagctgttcttgacaatacttgccttgtgctccttctccagcctggcatgagaaacacttccttctgtagagcagacagatgcaggaagtgcgagtcagttaactattgtttgctctttctgcatggtaaggaaaagaaacttctttttccttcctttcacttcccccaccccttaatttttacttagcctggtttgcc

SEQ ID NO: 18423 - DNA, 201 bp, Bos taurus
ccaaaaagtcgcacacaactgagcaactgaactaaatcttttggagacaaaaggacatcagacaatatcagggacatgggcccatatacctgcaaaagaacgatggttattaagcagcccagggaaggtagaagccaagtgaccccaggaagggcctacattaccctgctccacagttgttctgttgggttctggtagcca

SEQ ID NO: 18424 - DNA, 201 bp, Bos taurus
ctcagaagagagctggctgacccatccagcatccgcatctatgccattgccaaggtagtgtgtgacaaggggccctgagctaccttttattttcttttcataatatagtcagtctggacttcaatgtaaaactgaatcacaaagtggtcttgaattcagggatttctggaaagtttttaattctttttaatagtattaaac

SEQ ID NO: 18425 - DNA, 201 bp, Bos taurus
catatgcattataaaatctattggaaaactgaaagcaattaatgaatttttgtgtattctaagtttctttgaaatgtcccacatcttgtgaaattccttataaactatatattcctatttaaatatattgcccaaataactgctttctgaatagcaaagtgagattacatttaaagatatgtctttatggatgaccaaaat

SEQ ID NO: 18426 - DNA, 201 bp, Bos taurus
tggtgccaagagcaaatattgaagtttaagaaaaaaatatatttgataggcatttgtatccatttccctctttctgcttttactgttccagttcaagttcgatttattccaaatcttaactactgaaaagcctactgagaccaaaattcagaatttgttctttcttcattaattacggaatccacacttttcacatttaac

SEQ ID NO: 18427 - DNA, 201 bp, Bos taurus
ttactgtctggttgatcattggagtggagaactcttcagtgttgccttatttaaaatcttttttaaaaaatgtagatacattctagaggccaggaattacctctgttttgtacactggtatatctctaatacttcagtttatctctgggctcaaaccctggcctgcaataaaggagatgtttaataaatataatcaactca

SEQ ID NO: 18428 - DNA, 201 bp, Bos taurus
cgtctaatgatagccttgtgctctattctcatcttttttggcccttgtctgggaagaaggagccattctggcaaaatgcctttacggctttttggaagtggtacaatctgaatatggccataagtgcaaccaatgaaatattaggatctcaaaactattccaagtcttcttgccactctccaatggtcatggtgtgcttac

SEQ ID NO: 18429 - DNA, 201 bp, Bos taurus
tatggtacattcttctgaaatactttgacaagtagaaacacatatgctaaaagtaatgttttttaaaatgttttcataaggaacttaccaaagttcaatacgaaagggggaggacaatatgatattttaaaaagaagttgcaattccatctattcagctcaaacatatcatgtaataaaatcatataacttttttttttaa

SEQ ID NO: 18430 - DNA, 201 bp, Bos taurus
ctatgagtacacattccaaccaccctttggtacattctacccgatgttatctccttgcagtagttatagttaaaaattacaggcaaagggtgacatcctggaactggtgaaaataagtatctgtctcctacacagacccatggaaggcaaagactgattgaaaattgtatttcaagaagttaattagataaggtgaaaatg

SEQ ID NO: 18431 - DNA, 201 bp, Bos taurus
tgactccagtgttctttcctgggaaatcccatggatggaggagttcggctggctatggtccatggggtcacaaagagacagatactgcttagcgaccaaatagtaacaacagctggatccatacatgatctatctgtaatatgagtatcttttcaatctatgatatcagatactcttgaattatcctgaataatgctatta

SEQ ID NO: 18432 - DNA, 201 bp, Bos taurus
atggatgactccagggtttttggtcagatcaaatgaagacagagtggctattaatttcaaggctaagggagggccaggtttggaatgtggggttggtcatgtcaagtctgggaagcttattaaacttgcaagtagacttagaggtgaatgggacccattgggctccactgtgaacacaattcacagctgcatgtgctgcct

SEQ ID NO: 18433 - DNA, 201 bp, Bos taurus
acttttcctaacttagagctcctcgatttttaagaatgttacttcagccttaccaagttaaaatagtaagtggaatcctgccaattgccttgtcactttgaatttgtataacaaactttatagattggacctatttccccccaggtactctacatataatgccagtaacagtcaccacataaagaataatgctgtaaggta

SEQ ID NO: 18434 - DNA, 201 bp, Bos taurus
acaaatatttcaagtataaaatgtaaccattttaaaaacatctgtattattataacttttatgaaacatcaaatgattgcattttcctattgaattgccccatgatgaaaattacacaaagtacacttcagttcagttcagtcgctcattcatgtccaactctttggaaccccatgaaccacagcattccaggcctccctg

SEQ ID NO: 18435 - DNA, 201 bp, Bos taurus
actgagcaactgaactgaactgaactgacagctgcttcagttgagatgttccaagatattatatagtataacaaaagtcagaatattttaatgactgaatactccatctcttcaaaagcatagctttgtcaagggactgaatttttcttaacttggagctatgaatacatatcacaattcaacgttcaacgctggcatatc

SEQ ID NO: 18436 - DNA, 201 bp, Bos taurus
cattcattataataaggaaaataaacacaaaatggccttttgaaagtgaatcactgtaattcactccccacactccacttctgctcttatatgagaaaaagagaattccagaaggcctcagcttccacacgaaaacttgttctctactcggcaattttcctacatctcttttttaatgatgaaatatcaaggcatttaata

SEQ ID NO: 18437 - DNA, 201 bp, Bos taurus
actcaagagtgctggactaaacaatatttgaagtcccttccaggcctatcacccaatcatgtttgagactctttcttatttattttacaaacataccaggatactttgagggaaaaaggatggaatttaaagttgctcattttcttcatggaattatttcccaaagtcaaaagacaaaaacaggaaaagaacagtcgcttg

SEQ ID NO: 18438 - DNA, 201 bp, Bos taurus
gtatttctatagctctgttgcctaggatacctcaaccatctgaaatgttaggtactctctggagtcgcaatttctctactacagactgccctaggcctccatgccatatgcccaaacactcattttccttccttgttgttccctaacactatgctcagtggggaggcctctgagattggtccaacagtggagagagagggt

SEQ ID NO: 18439 - DNA, 201 bp, Bos taurus
tcctctctctcactcatgctggcctccagggcaggagcttattggtgacatcactggcccatagcctttgggcagaagggccatggtgccagcactgagcggaagctctgagaagctctgtgagtttcactcatcctcctgtgctagaccccagtcgttcctgcccctttagcctgggccccatcataaggagacactcag

SEQ ID NO: 18440 - DNA, 201 bp, Bos taurus
aaaagttaatttaaaaataaaatttgaaatcaaactctggatacttattagtttcaggaatatagcctatgtcattaattaagccacagtaatattattggtaatgatttcataataatccatactgtggctgaacttccagtgtttttcatgtctttattgtcaaacaatttttctcattttcgttttaataaacaagca

SEQ ID NO: 18441 - DNA, 201 bp, Bos taurus
ccgtcccagcatggtccctcaaggataagctcttctagagatccttctctagctttccctgacgttgctagccacccctcctgtgtggtccttcagcacagtgggtgtgactctggtccaaggtactcattgttttgattatgtcatcttatggttgcttctcagcttgccagactcttccctggagcatcttatctccac

SEQ ID NO: 18442 - DNA, 201 bp, Bos taurus
cccagcacccagctttttagcaaattaactgactctactgggggacagaaagggcagggacagatgttcattcatttttgctcacactatatagtaggaaatggcttctgggtataagtaatgaaaggcctaagaagatatttgaaggcaggagaaggggacaacagagaatgagatggttggatggcatcaccaacttga

SEQ ID NO: 18443 - DNA, 201 bp, Bos taurus
ggcagcctgaagggcctggatcagcagttggaatgagactgatcaaggtctagactgaccattactgaaatatgcacttctggagtcaggtcctttctcctaggacagtgacctgggcccgggagaacctggctaggtgagtcctgcagcctgtaggaactgcaaaggcagagagaaaacagcctcatctcccattttgtt

SEQ ID NO: 18444 - DNA, 201 bp, Bos taurus
actcttttggaaggggtcctgaagcaggcacaagggacactgagctgcgggaggctctgctggccccagggcctgtggggaggcctgtgggggcagtgccctaggagaaagcccgagtgggaggaggggagagccagaggcgctggtcgtcagagaggccggcagagagtattccactgggagagaagggtcagtgtatgt

SEQ ID NO: 18445 - DNA, 201 bp, Bos taurus
aaaaaaaaaaaaaaaaaacccaaaaaacccagaatcacaaatttgaacagtgatgttaaagagcacacatgtgtgttaagagcatgaaagtggatctgaccaatccaggggtgggaaagtagtggtaaggccagctgccctaacagcatcccttcctcatagttctttttctgagtttagttggaaccagggagtctagag

SEQ ID NO: 18446 - DNA, 201 bp, Bos taurus
agggatggtagtccctcccttgtcaggggctttcctgggtgtgccctctctgatgatctttgcttcctaggagcagagagggagatggatctgaaggatgtctgaaggtagggcctggggtggggctgggcctatagcagcttttctcagagtggtcctcagaccagcagcatcaacatcacctggaaacttggtgtgcgt

SEQ ID NO: 18447 - DNA, 201 bp, Bos taurus
atatcagtcttaagtccactttgcattatgtttcttccctgctgaggggagtaggaaacttggaattaagagagttggggttggtggtgaaaaccacctaaattacgaagcctctggttcagaaaatacgcatgacttctgctgtctgcctacttcctccacttgcctccaccctcccatttgtcacattgtccctccctt

SEQ ID NO: 18448 - DNA, 201 bp, Bos taurus
ctcctgtgctacatgtggtctcctgcattgcaggcagatgctttactagctgagccaccagggaagccctttattccccaatagctccgtgatttttaaatcacaaaacacttggtcttggacttgagccatggccctgtcatggtatatttcccactcagcgcagtccccttgttggggacagagttagacagaagccta

SEQ ID NO: 18449 - DNA, 201 bp, Bos taurus
cttgcaaggacttcatggttcccaagaattaaaagaaaaaaaagaattccacttgatcaacttaattccttttctttatcttccctccctcactcccctttcctgccccttcttttccaagctgttttgctttgcaatatgttactggtaatgagttgcaggataatgcaatcttaacttgttttctctaagtatttgagt

SEQ ID NO: 18450 - DNA, 201 bp, Bos taurus
tccaggagactctcaaaagagtcttctcttagagaagtgctagtgtatttcccctttatttacttttttttcccagtttatccagtcaacagaatattgatcacttactgtgggtgcgacctggtactgggaacaacatgctcgttgctcctagttagatgagtagtccttgttaaagttcagtgtcatagagacagcaat

SEQ ID NO: 18451 - DNA, 201 bp, Bos taurus
gtggtactgcaagggagcagcggatgcctagaggctggagaagggaggagcagggcacagaaaatagagaccttgaactggagtcaaagaacatgcatcagcgcaacagctgtgccaagggacgcttgtggttataggtccattcttgtgatttcaggctatttattaataggtgagggtgattgtgtctcctgtcaccct

SEQ ID NO: 18452 - DNA, 201 bp, Bos taurus
aaaaaaaaagccctgagactttataatatttaaaggaatttgcattaaagtatcaacatgattttttcaccgacaggtaaaaaacgggtttatataaatacagaacagggtctggaagaatacgcagtaaattatgaacaggaattcattttaaaggaatgtaattggggaagcagagcagaagtctttcaatttgttact

SEQ ID NO: 18453 - DNA, 201 bp, Bos taurus
agaggacaccatattttgaacagaaagtgcttagatacaggcagtgaggtcacaaacatggtcggaagagccctaggataggcctacaggaatgattctatgggcacccctggggaggctcatcagtcaaggaagccacactcaggaggatggggtttgggaaactcactacgactgttggccccaaagctactccatgtc

SEQ ID NO: 18454 - DNA, 201 bp, Bos taurus
ctgcagagccccttggtggcatgcaaactcaagggacttcggtcctgagaggtccgattagtctacctagaagcacaaagagaggtcttttgagaagtctgggcctcagcagagcttctgctctgtccagccagcagtatccccctgcctatgtaattttcagcaaaccgcttatgttctttgaaccttgatttctacatc

SEQ ID NO: 18455 - DNA, 201 bp, Bos taurus
gaaagctgtgacagtctaggcacttgtcaactggctgcctggcaatcccagaccagtccctgcccagagccctggcagcctctccccttccctctatgatgaggagggcctcaggagctcctgtttagggacaagaagcagtatgagtcagatgttcctggggcggggtggaggggaaagagaagaggcctaggagggggc

SEQ ID NO: 18456 - DNA, 201 bp, Bos taurus
atggtccacagggaggcgaatgcaaccaccatcacatttaaggcaacccaagaactcccacatgacagacacgtgctgcacaaaacgcagtcagacccctatgttacctccctagatgagcactggccaccctgacccggtgctgtcacacagaaagaaccctgagagctgcaaaaatgcaaacaacatccacccactgga

SEQ ID NO: 18457 - DNA, 201 bp, Bos taurus
tcacgatgttagtgagttattataaaaagatttggggctcatctgaggaaaacgtgagtaacataagccatacattaatggatcacatggttggttaaatataggcttttaatgaaatccccaactgtgagaatttctgtttctctaactatcccttggacctccagagtccttgtcttggggctccatcctaggggagtt

SEQ ID NO: 18458 - DNA, 201 bp, Bos taurus
ggaagtctaaaggaccaaaaatgatttccctacaatctgaatccttttctacaaagaaagttccaaaaaagtttcctaccaagaaagagttggcagttctcgggtcttttgtaagcaaatatcttgttcatcacaaagcagcactttagggtttttgtatgtgcatgaatcaaataacaatgaaaacaagtatttgtatgt

SEQ ID NO: 18459 - DNA, 201 bp, Bos taurus
ggctgggactctgcccattctctttaccagtgtggccagccgcagacacttggataaatgaatgctcaactggggtcaggtccctcagtggagctggcagaaacagctcgcaaggggccacttgctgccaggggccaggccaggacagagagacccaggccaggccaggttggggtgctgggctggggaaacaaggagaaa

SEQ ID NO: 18460 - DNA, 201 bp, Bos taurus
gttaccttaggctctgcttttgagggaactcaaacaaggacaggttgctcagagagtctctaggaaggtcagaaaaccaggctgggaggccacatagccaaaaatgatgttataggttgtctacagagctggttcattgttcataccactgctgtctcgcaaacagcaaacacatcagtgctgatcctggccactgggcat

SEQ ID NO: 18461 - DNA, 201 bp, Bos taurus
cccttggtcatgcctgtcaggctgcgaggagggagagagctgagaaagatctaagcctgagcctgtgaagttgcaggggagggaacttggttgtttgaaacgaatgagcttggccatggggattcggtgctggcagggcagccacagcccattgtaaagagtctggatatcacttgctggggccaatccatatcataggag

SEQ ID NO: 18462 - DNA, 201 bp, Bos taurus
tttgataaattcaacattaatagaatataacttccttgattaagttatgatatatggcttcaaaagagatcactcaagtgggccaagttaataataaaattttaaaatctacatgaaggagtcagaaagaagaatactgaggtccagaatcactgttccattgctggcttaaaaatggaaagagccacgtggcaaataatt

SEQ ID NO: 18463 - DNA, 201 bp, Bos taurus
gacaaggaggtcagggaacggtgactatgaaattatgtttgcgtaattctccattctgctacatgcttactgggtgcttggtcatgatggtagacagctcgtccctttgtatgtgagacatcaatggtgagagaggagccccatctgccactttcaaagtgtaccatatgtcagggttgatgaggactggtctgtttcctt

SEQ ID NO: 18464 - DNA, 201 bp, Bos taurus
catgcaaagccccaggcatgtaaagtacatgaaagatatttaaccatactggttaagaccactgtctctgtccactctggcatcaaattgtgccaagtgagtctggggtgggcctgagccatttttttccctaaatatgcattcatgttcatacgtaatacctaatttttgttcattctttcagcaaatatttattgagca

SEQ ID NO: 18465 - DNA, 201 bp, Bos taurus
aaagactggatgagaatcttgggatatggaggaaatgaaaattggtggccctgcttaagcttgaaagggggagatcaggtaaaagaaaaatacctgacttaaagcaaagggtctcaaatgttccaatagccatcagataatctccaaaatatacaaacagctggtatagctcaatatcaaaaaaccaatctgattaaaaaa

SEQ ID NO: 18466 - DNA, 201 bp, Bos taurus
caattgctccggtggcattaacatctgatttccacttaattgatctgatcaactctgccctgatctgaactggtcaccaagacaagtgaaagccccggattgaccctgccaccgtctgctgtttttcagttgtctagacatagtcataaatagctggatgactgcccactataaatttttaatgagagattttgaaattag

SEQ ID NO: 18467 - DNA, 201 bp, Bos taurus
ttttatagactagacatttcactcaggcagaaaggaattcccactgcacttgaggggtagcagaatctccagaacaggctactggttctgcttggctctgcgctgtccacggtctccaggcaccccgaagacaaagaggctggagaaattgggtgaggaatgaaattatgaaaccaacattctggattttaactgaaccta

SEQ ID NO: 18468 - DNA, 201 bp, Bos taurus
tgcccatgagttgaactgaaactacaactttgtctccagtgaagacactgcttatttttaaactacagcagagtttatacttctgacccctccattttgacaccatatgcttacaagactgagggaaactgcccacaaaatggtggccaccgactccagctgtgcctgtaccaactggcactcctcccatcaggagtgggc

SEQ ID NO: 18469 - DNA, 201 bp, Bos taurus
aagcattttcttaactatgcattttgattgtttcattgtttatctttgtacttcaactggagtttaaatatttaattgtttccggagaactggaagaaaatcttatttcagaactcttcacacgaactgccaaattgctttttggaaaatgtatcttagttattgttctgaactgcaatccaagactgctagtctattgtc

SEQ ID NO: 18470 - DNA, 201 bp, Bos taurus
gcagctcagccaatgcacttgtctgtgtgcccttgtcctgagcctgtaaaacagtgttaataaagtgcatctcccagaataatcctgaagacattcacagcatggccaacatgtgggagggatctacaggttgctataagcatgtaatgcatagtgatgagtccatgaaggtgaaagtcttaaagatcaattcttaggtca

SEQ ID NO: 18471 - DNA, 201 bp, Bos taurus
ggctttctctgtgtggacccattctcttgatggacaggatgtgctgatgtgaagcttgctgttggcttgttagctggctctcatgctgtcaaagggcaacagcagcaacatgtcttctgggtgttggaagaaataactggaaaagaattgactcctttaggagggccgcagaggccgtgttcctgaggaccatgtgaggac

SEQ ID NO: 18472 - DNA, 201 bp, Bos taurus
ttgtttacatcagaggtggctgcacgaattgacctcagggccagaagacaggccatctgtgggaagctcccaatttaagcagaaaattcacagacccagagattgtgtgaacacatctagagaagcagcagcattcgtaacagtgcattgtctggaaagagcatcgggttggaagtctggagatcaactaacttgttgagt

SEQ ID NO: 18473 - DNA, 201 bp, Bos taurus
aggaaaccttgaaaattcaaattatggagaatgtcacgcacagaaaatcaacagactatcaaggcctgaaaatccttttttattcttttacgtcatctccgaatgcctggctttgatgttctaagatgtcactgcatatttatattgctacataatggtatttggatcctttgctattcaaacttaaccaaacatggttaa

SEQ ID NO: 18474 - DNA, 201 bp, Bos taurus
ctggaacagcagcctcatctcgtgtgagtatcagaatcaaccactcctgccagggtagaggcaacttgctttaccttcttgtttcttggcacaaggagagcgaagtgactggtgcagcccagtagcttaaagtttagtgggacccttgccttgccccttggtgcatgtttccattctgggaattaggacctttacatccat

SEQ ID NO: 18475 - DNA, 201 bp, Bos taurus
agagcaaagtatcagaggaaaatgacaataggtagcagtgtcagttgtaaaaaaaatgttgagaagatatgcaggaggccccacgatgtacagaagggtgctaaaaagtggatagagcccagcaatgggaatacacaagcagattatatttaaagattgaggcagaaatccagaaagtctataatggattatcaggttcca

SEQ ID NO: 18476 - DNA, 201 bp, Bos taurus
ttgtgaaaaataaaaatttggatgatggttatgaaggttgatataagcaagtgacattgagctgttcctacaaactgtacatactttttgatgactcactatcaacaatatagtttgctcaaatcagacccaatgcaattagcatatcagatttgagactatatgatgttgaaaggtgtttataccattgtttccactatg

SEQ ID NO: 18477 - DNA, 201 bp, Bos taurus
tatccctgtaggcccaacgaatgtgctcagaatctggtggaatttggcatcctagaaatagtcatggtttctcaagttgtatattctattatcagtggtctgcaaccttttcggccccagggaccagttttgtggaagacaggggcaggggggatggttttgggatgatccaagtaactacatctactgtgcactttatct

SEQ ID NO: 18478 - DNA, 201 bp, Bos taurus
cctccaggggatcttcacaacccagggaaagaactcacgtctcacatctacctgcattgacaggtggtttctttatcattagcgccacctggggagctccgtgttgcatacagagagcgtttccaactttctctgagactgtccatgtctgagttgcttcctgttctttcttgcttcttgctgtctttacattaaacccat

SEQ ID NO: 18479 - DNA, 201 bp, Bos taurus
ttgtgctgaaatggggacacagcttctgggccaggcgtcacaaagacgtggagacatagaaagagctacctacaatcttgaaaatctcttaagtgatgtgtctgaggcccttctccttactgagcactgaaagttgtcaaatctgacttgtagttcctatgattcatcctggggaaagccatcattcatgtttcatttttt

SEQ ID NO: 18480 - DNA, 201 bp, Bos taurus
ccaaatagagcagtgtgtaattaattgtcactctgtagaaaaaacagggataaaactaagaattggaagagttagggatggcctagtggaagaggaggaactgccactgaggacaagtaagattaaaaaaaatgcaagcaagaattagaaaatcaaatttaaggcctgaagtcaaagcttatcaatcctagtattaaggaa

SEQ ID NO: 18481 - DNA, 201 bp, Bos taurus
tttcattcattcagttaatgcttatgaaatagctactctgtgcaggcactattccaggtgctggcatgtctattttgaagtgtcaaacaatgcctgcgtgttcatcgcttcagtcatgtccgactctttgtgaccttatgaactgtagcccaccaagctcctcaacccatgggattctccaggcaagaatactggagtggg

SEQ ID NO: 18482 - DNA, 201 bp, Bos taurus
aactagattatccactttgttttattccaacatttctcttctttcttataatgatgaaattgtaaaatgtgtagtcagtgggcccaaataatttctttaatctagttgtcaaagctgattttaaatctgtctcatcctttatgattcacctaatgggccatatttaatatgaaaaatattgtaagtgtatatgagtcaatg

SEQ ID NO: 18483 - DNA, 201 bp, Bos taurus
gggtttagcagtacagattagagcagtgaaacacaggacatttcgtacaagtggatgcatgagcaaaagcacagataatggcctggaatgagggagttcaggatatattgacagtcacagaagtgttaagcagcaagatcagatcagatcagtcgctcagttgtgtctgactctttgcgaccccatgaatcgcagcacgcc

SEQ ID NO: 18484 - DNA, 201 bp, Bos taurus
cacttcatattctatgaatttccctttgattcctgctgtacatattctgggtctttttttgtagctcctcaaaaaagtatttgcatcatttccttctttcatattgtttttgcttcaggaatttgtattgttttcttctccagttgaaaatctctcttcatgttgtagactaacataaccccttacctgcttctgattttt

SEQ ID NO: 18485 - DNA, 201 bp, Bos taurus
ccaaatggtgcagggctatttgctaagagacaaacctctctccaagaaggcttatggatcagaacaaaacagcagtttttggataagcaagaagtatgagagtgggagaccagggggccatatccgaatccaacttacaggtgagcacacgtggaagggatgagcgtttctaacctcagatcagatcttgaagaaagtaaa

SEQ ID NO: 18486 - DNA, 201 bp, Bos taurus
aaagagtcagacgtgactaagtgactaaacaacgatttattaaatactctgggaattttaaaaagagggaagacatgattctgacaaacatcagtggtcacttgtcttgttggacatggacattacttgtgtatgtgactcatggctgcctacctttaagcctggactcccaggggggcctggaggtccctaaatcaacag

SEQ ID NO: 18487 - DNA, 201 bp, Bos taurus
tctctgggtgcagtcgtgtgggctctaaagccacttggctctctggcagtcacttgttcagaactcatgtattgattataggtgaactcattgattgagactaaatctctggtatgaaaagatttgttaaaaattaaatagcttttcattttctaacggtcatcaagagccttggaaagctgaagatcttgtttaagagct

SEQ ID NO: 18488 - DNA, 201 bp, Bos taurus
ggagacaagcctctcttatctgggtgtgtctccttaggaatctgagagattgttgtaggtctatttctgtgactacagaagatcttttggatagcacctattggaatttaaaaacatgcaggaaataaggtaagtgtgagtcgtttaatgacacctattgttattgttgtttagtctctaagtcatgtccgaccctttgca

SEQ ID NO: 18489 - DNA, 201 bp, Bos taurus
tgggtaggagacaggaatgctacacccattgaatttcacgggatagtctgacacaatgaagaaatgaagtttctcacccaagtgccaattatgccataaattgagcaacactagacaaagcgggacatatgcaaagagagggtatgggatggaatagctgcagcttaagccaaactgttatatccagtggctcagtggtaa

SEQ ID NO: 18490 - DNA, 201 bp, Bos taurus
tctataatgtgtgagacaggtcctttacataaaaagattactgcaaaatactaataccattcctaatgagaaacactgagacttgtatgagaagctttggatttgtttttctgcttgaaatagaaaggaatggaaaaatttgtcttgggaatgaaataatctttgaaaaagtaagttcactggggctgctatatggagatt

SEQ ID NO: 18491 - DNA, 201 bp, Bos taurus
attccaggatgtctggctctaggtgagtgatcacgatgttgtggctatctgtatggtcatacaaatgggagacacccttatcaaatgtgtggacgatctaagtttaaaaaagataataaattcatggtgcaatagaataaatatccaaaaagttcaacagacaggactagattaaccagatgaaaccaataagaaatagct

SEQ ID NO: 18492 - DNA, 201 bp, Bos taurus
aaggtcaggatggggtacacatgtacacccacagctgattcgtgtgaatgtatggcaaaaaccaccacaatattgtaaagtaattagcctccaattaaaaaaaattaaaaaaaattagttgtgatgtatgtgctcaaccacaaagaccacatcctgcctcttcaaagtgggacatgcttgtgttttacacatagtgctaaa

SEQ ID NO: 18493 - DNA, 201 bp, Bos taurus
agacagtcaccttattctctctcttgataaaacagagtctggtggcttgaatacgtgaatcagggaccattcatggctcatttactaagtttctgccaccgtgttaagcatttatatagagtatttgattaataaacataagccttacaaagaccctataagataagcattgtttttctctgcacattagagatgaggaaa

SEQ ID NO: 18494 - DNA, 201 bp, Bos taurus
aattcttgaacacactgaaggcaatgagtcaggcatccatgagcattaggtcctagcactttctaccctctcatggcacctggaagaaaggtggagatcatggcccagcttctttaaccgtgtctcttatttatctccacttcatgggaggcaggtggttgtcaagaggcagttacactgtcagtggcttatagcttccag

SEQ ID NO: 18495 - DNA, 201 bp, Bos taurus
cttaaccacagaagggcttgatcttttaaatgtcaacactgctcctcaaaattattcaaataagtctaatgaacaaactgtgttacctaacacagcagccactagtcaagcaacatactactattcaaatttatcagagttcaacacaattgaaaaaccagcctcttcatcacaatagccacatgtcaagtgctcgacagc

SEQ ID NO: 18496 - DNA, 201 bp, Bos taurus
aaagatcctgagagctgatagtttaggggcttctccctttagaaaccatttgaactttgctattgttcttgggggtagtagtggtggagaggcttcgttcccttaatcaaatttttcacccaaccaaaaagcagatatcttatagggaagggagacttgtattgcccttctaaggaaataagattttctccacactttagg

SEQ ID NO: 18497 - DNA, 201 bp, Bos taurus
gcaggccagcccaggagggagactgacatacagggctatgtctacataactgcctctttccaaactcacatagcagagtctttgcctgatgaagaggaggtgagaaggccctggagaaatatgcaaactcaactaccctgcctaatttaaatgagaagaaaaacaccattcaaagttgagtttttagtgattgacaaaata

SEQ ID NO: 18498 - DNA, 201 bp, Bos taurus
aaaaaaaaacagtcgtccgcggcttgcgtgcagcctctctgtcagcgtgggaaggagggaaagaaaagactcagccaagtgtcccgaggaggagccggccggggaggggagaaagggaggatttcttttccagggtagggtttaattacgggagattttgtacatcttatcgcgggcttttacgtatataccaaggccaag

SEQ ID NO: 18499 - DNA, 201 bp, Bos taurus
taagtgtggtaaacgctcccacatgactctgtgtatttgactcctcactagtctattgttttactttaaatattttgatggtattcatgactatatgacttaatgaatcttttccatttattgttatacagtgtttctctttatccctactaatgcttttaatattaaaatctctttttctgggtgctgatagtgtaatgt

SEQ ID NO: 18500 - DNA, 201 bp, Bos taurus
tcttgcacagagggtgctgagtgttccttcaggaagtggccaccctagagagtccccagcattctcggcaccctgaatcacagtgcgatactggctgtaggcaccacagaaggggccccaggtctgaagactcagggtgtagggagaaatcaaagtggagtaaatgtctggcttcacttctgttagatgctgggtatcggg

SEQ ID NO: 18501 - DNA, 201 bp, Bos taurus
agctcgtgggcaactctgagaacagtccctgaggttatactgacacacggagggacatacacaaagacacagagctgctgtgtcaatgggttgtttggttgggggccggggtgtgtgctgaggatccataggggtctttcttgtggctgtaaaatgtaacctattaagttttacaagtaactatgtgagaggcatgatcct

SEQ ID NO: 18502 - DNA, 201 bp, Bos taurus
gggaggagaggcctgccatccaactgagccttgagcaaggtgattgagaccaagaacaaaccaattctcccttgctaagaggaaaaagagaaggggaggcggaggcccgagtcctgagcaaagattgagaatcagggaagaaacgatgaaggaccacggagaagttaggcagggatatttgtatgaacatctaagcagagg

SEQ ID NO: 18503 - DNA, 201 bp, Bos taurus
tttggtcagttttcattgttggttctttgtcatgtacagtgatgtaatcagtgttgttggctaaggaagattctctgtagatctcattgcgatagtaagggtgcctctacaccacatgctcccaagaagactatacagattgaccacagataagcagctctgctgacctcatgggtgaggcgggagtaggcagcaggcgtg

SEQ ID NO: 18504 - DNA, 201 bp, Bos taurus
agtggagccttccctgcctgcccccgttccccacccagaagagggatgagatgcggttgtgcatacatgcacgctcagtcattcagttgtgtgtgactctttgctaccttgtggactgtagctcaccaggctcctctgttcatgggatttttcaggcaagaacactagagtgagttgccatttcctactccatgggatctt

SEQ ID NO: 18505 - DNA, 201 bp, Bos taurus
gctgcgtgctgagaaagcccaccactcagccccagccccatcggcccactcaggatcggggagctgccctgaacatactccgcgccctcacagagtcccagagacacttcaaggcagggccccttggtctggtctctctgaagaccccgcacctgggcactgaggtctctcgccacctctgctccggagggctctctctgc

SEQ ID NO: 18506 - DNA, 201 bp, Bos taurus
ctaaagttacatttgtaataaaaaaggggcaccacataagtaaaaagaggaaaaatacaatcccgagaacctttgaggctctctgttcattggaaatggtttgcactgactttttccctactgtggacattcttcgcataagtatgtcagcacttgcattgggcagagttttgtccttgtgaaagccatccagcattgcca

SEQ ID NO: 18507 - DNA, 201 bp, Bos taurus
gtccagctgtgcccagggtggcttggccgtcttgtgctgctgtgaggggtgggggcagggtggtggtgggcttccaggaagagaaccctagaacctttcatggctactgctctaaggcccagtggggtggcttatgctttctcaaactggcagagtgaacacctggcgtcttacctaattgtggatttgaattttctcagc

SEQ ID NO: 18508 - DNA, 201 bp, Bos taurus
ggcgcccactgcagacagcgatgattcaagatggcctcatcttctggctgattgacatcctgaaggagcccgactgcctgtctgactacacgctcgagtactcggtggccctgctcatgaacctctgcctcaggagcgcaggtctcacagccctactcccctcccccagctctgggttggctttcatttttccctcttaga

SEQ ID NO: 18509 - DNA, 201 bp, Bos taurus
aatattttttaacctacagaaaagttgaaagaattattaacaataaagagcttccagctgttagcattctgcaataaatgtgctctcttgcttactcactttcttggtctcgttctgtgcataaaatataatttacacacatacacattttctttttgctgagttgaaagcaggtggcatagtttcagcccacatctccaa

SEQ ID NO: 18510 - DNA, 201 bp, Bos taurus
ttaattttttcctaatgagagaaattaaatactaaggaataagattttttttcaggtagggttgagctatggagggccacaagccattgttaacaggtaaattttttcactccccttcagttcagttcagtctctcagtcgtgtccgactctttgcgaccccatgaatcacagcacgccaggcctccctgtccatcaccaa

SEQ ID NO: 18511 - DNA, 201 bp, Bos taurus
gctgggtgcctccgcaggttacagccttttccacctggtttgctcagctgggcctgagtaggccatgtctgggagagaggaaaggtctgggccccatgattggagtctggaatgcatcttaggaagctgcgtggcttcaatagtcacccacactctacacaccaccaggcctgactcctcttacagaaactgattcactct

SEQ ID NO: 18512 - DNA, 201 bp, Bos taurus
acaaatctgtcaaagaaaaaaaaatataagtaaaatactttatagccttgaagttggagacatttctttaagcattgatctaaagcctataaatatatatgtaagactgataaagattcattgtaagatttatctggcaaattaaatcatctggggaatgtaattgctacatatatgacagataaggagtaaatatgctaa

SEQ ID NO: 18513 - DNA, 201 bp, Bos taurus
aacagatgacatgtttgatagtcatggaaagttctcacatggctgtggtcagcacatggagcagcctatgtgaagcatctcccagggccagcttcacatgagggcagcgccctcacctacaaacctgcccagactttcagccctcacacacatctctccttgactctggggcccatcagatgacagagggggcattcctcc

SEQ ID NO: 18514 - DNA, 201 bp, Bos taurus
ttgaggagaaggcctacaacaaggaactgcggcccgcagcgcacaaagagagcgtggagatctccctggctctcaccctctccaacctcatctccctggtaagcggcccctcctggctggtgggggaagggcagcagccacagcttcctggaggtccagctgggatggccatggggaggaaggtcaaggccccagccccag

SEQ ID NO: 18515 - DNA, 201 bp, Bos taurus
ggaagaaggtaagaggtattgagaggcgatgagcaagtaccaagtcctgcctgtggggggctgtctgggccattctcgctgaagccttgagggacgtggcgcctcaggaaaggagggattaaacacggtgtttgcaggtgccaaggatagtctgagctacaagggggtgtttaccaagtctggtggcccgggtttaggcac

SEQ ID NO: 18516 - DNA, 201 bp, Bos taurus
atatcatctgccatccatggtgggtagacccagtgtgacgcctctgctccagttccagccccagaaattccagaaaaggctgaatgttttcctggtgccctgggcctggtgaggaagcccacagccccccacacttcacagttgcacccccacatactctgtgtctgtgggtctctccctccctgggaatggctctgagat

SEQ ID NO: 18517 - DNA, 201 bp, Bos taurus
aatggagttgttgttattgctccaaattaggcaccaatttgcccgtgtaattgttggctaattggcatgaaatcctaatgtaattagttgggccccttattggggagcttggggagccaggggcggtgggggtgggccgctggagcagggagggtctagaagtctggggaaatgtgtctgagggaggaggccctgagctgc

SEQ ID NO: 18518 - DNA, 201 bp, Bos taurus
actagatggtagccccagtggtgggagatggggaccgaggctctgactgctgcccccaaacactgggacctcatcctgttggtggagggccttaaggaagcgagaagttaggcagcgtgggggaagagggatgagtcagacgtagtccctgctctcggggagctcctggccacgtgggggatgtggcggagacccagctag

SEQ ID NO: 18519 - DNA, 201 bp, Bos taurus
gtagccagggctggggttgtcagcgtgaagctcgccatggccctgtgagggagaggggcatcagcagagtggagcatcagcccgcccgccgggaccataaggctgccaccagaggtgaaagatgggtccccctgccactgggatgcagagagccgtggagacgtggtgacagggctgatttagcgggggaggagggaggat

SEQ ID NO: 18520 - DNA, 201 bp, Bos taurus
tttgctaatggcttctggttttgcgtcatataaaggtctttcaaactccaaagttaatcagaaacccttctatgttttcttctgccgtttttatggtttcataatgtatccactggttcatggaactggaagcttttcttgtcattttctcagcggtgagcacctagctggatcctgaaaggcttggggtctgggtagaga

SEQ ID NO: 18521 - DNA, 201 bp, Bos taurus
ccctctgttcttagtgccttcagggaggacaagcatcagatccctccctgccactgccccagctctccactcaagctgccgcctccttccccttgcccctacttgcccacattcaccctcttgagaaaaaagggccccttgttctaaagctccccaggagagggtcttgaaggagagaaacactgagagctgctcagagcg

SEQ ID NO: 18522 - DNA, 201 bp, Bos taurus
aaactgtgccacattgctggtttgagtcctggtggtttagcaggttaccttggagagggaatctaaaagattttcagttgccgggtttctaaagaagaccatgaaaaacaggtccacggttcagatgtcttacattctgacagagtaagaacctttctaggtatttgtacatgattttcagtagagctgtatctttcctgt

SEQ ID NO: 18523 - DNA, 201 bp, Bos taurus
ccacatgtgcctgtgtccatgctgtgggtcaaaaaagacgcagcatggagctcacttgtctcctcattgaagtcagggtgaacccacatccaggcccttctcagactgatttctccctcttcatctctcagtgacaaggactctagattggctcagccttcagaaaggccctcattctggggagacgttccagccccatcc

SEQ ID NO: 18524 - DNA, 201 bp, Bos taurus
accatagctgtcaaaacctccgtgcgcttagtagcaggaggtcacgattatcaaggggagaagctgagggcggtcaggaatcacggggcctctgtgtgcaaagggaaagagaaagaactccttgtgctctgactgcagactctgtcagaacctttgcttcagtcctcatgaccttctgggctatcctgttggcccatttgc

SEQ ID NO: 18525 - DNA, 201 bp, Bos taurus
ggagagaagagactgagggcttcattcattgagccctggccccgagacaaatgtccaggctttatcttcatgaagtttaaaaacagttgaagtccagcacggcgatccgagagcaggtggtgaaaaggatgagctggatgtgagtgcaggcgtcaccctgcctggacatagggtgtgatgcgtgcagggcctgcccaaata

SEQ ID NO: 18526 - DNA, 201 bp, Bos taurus
tcatctcctacagaactgacatgcctgtcttcctcctggatcagggactggtgtcttccattgattgtcagaggccagcagagggtctgagtcagactgaggttgctctggggttggttcctgcctctctgagcctccaggttcttatctggcaagtggggacagggttatcactctcctcctacaggatggtcggatgag

SEQ ID NO: 18527 - DNA, 201 bp, Bos taurus
gattcctggccaagtgccccccaacctcatgaaaattacttcactccagtggaggtgggggagggtggggctgttattttacaggggaaggactgcagccccaggaaggagtggagtaaaatggggccaagtcacacagccaggaaggtcccacccaggatccacccacccacgtgggggcagggaggagtcagggccggg

SEQ ID NO: 18528 - DNA, 201 bp, Bos taurus
tggactccacaatgaacctgaacttcaggagcgaagactctccaacctgggtgtgaattcagagcagtcctcagagagcaaccagccagagttctcatttcctgctggtcttagtctaaagctctctcctctaatgattggctgcttagcacttgttaatatgatggatctgatttgttggaattgattttctcataaaga

SEQ ID NO: 18529 - DNA, 201 bp, Bos taurus
gggttttggattcttaggacctgtcaccctttccttctttcctagttctgccctgtggaatgggaatgtcaagtctaggcctgtctcatcactgtattttggaagcacttatctcttcttaatcctaaaggaaatcaaccctgaatgttcattgaaaggactgatgctaaagctgaagctccaatactttggccacctgtt

SEQ ID NO: 18530 - DNA, 201 bp, Bos taurus
ggcagctggaagtggggaagagccaggccaggttgctgggtcacactcacatatgtgtgttcctacttcagagcatgaccttgaacaagcccctttgcctcgcagggccacagggtccccagctataaaatgaaggtgctgaaccttcactttaatctctgtagccccaggcacctctgtctccacatcaatcagggattc

SEQ ID NO: 18531 - DNA, 201 bp, Bos taurus
gtggccagacccagtgatgttagtactcatctttgttactataatggttaacatgcaacctcacccaccagtccacaggaggagtatgtttaaggcaagtgggcccctgttgttgaccaaaatcttggctttctctgcccaccaaagccaaataaaaaatatggaaacagagtttgaaggaaatagaaaggtggctttaat

SEQ ID NO: 18532 - DNA, 201 bp, Bos taurus
cctgcactgccacaggatttttttttactgctgagtcatctaggaagccctaaaaataaaaatatggcctagggtaaaagcagctttaaggccagagccccgccccatgtccaaatcatggagcagcccagggagccctgctccaaagcccagatgccccctcatctctagacagcttctcagatttgaccttgaccagcc

SEQ ID NO: 18533 - DNA, 201 bp, Bos taurus
gcaaagaaaacgtccaccaggttgtggcagcggatcatttccaggaccgtggcgcaggcgcagaaggtgccgctacggccgcccccatttctaaaggagagacatgaaaagatttggggttgggcttgcggggtagggtgaactcaaagatggagagcagggccagggaacccaaaagagaggagtccgggaatccagaag

SEQ ID NO: 18534 - DNA, 201 bp, Bos taurus
tttttaaactcccatttgggggcagatggttcccctgtgtgctgtgagggtcgagttcccggccaagctaaccctggaacacaggaggacacaaagccacatgggtttcttcccaggaggactttccagagccttcttgactctaatgtgcagtctgaatcttataaagggagtttagtgttgcccaaaagtattgtgcct

SEQ ID NO: 18535 - DNA, 201 bp, Bos taurus
atttttttcagcatctagttctcatttagctatttttcaataattttataatttcctccattaagactcaatacatcttaggccaacatagttttcttggcatcataaattgggtcttaaaaaatgacattttctgtttattgcttgtttataggaacatgattgattttttttttctttttggccacacttcatgggttg

SEQ ID NO: 18536 - DNA, 201 bp, Bos taurus
aagtgtgggatctcttttgattatcaagtgacagaaactttgacttctactggcttcaacaacatcaaaagaagagcccaggattacatgttttgacccaattgaatagagggattcaaacaatagtatagagacaaaagcgacatttaaaatacttaacaattggcattgtgttgtcactgaacagatgtcagaggaggt

SEQ ID NO: 18537 - DNA, 201 bp, Bos taurus
caaagagtcggactgagcaactgaacaaaaacaaccctcaggctagcctaagaaatcgtccgtttttcactgttactcttgtttctttggtgttattttttctcacaggctctcaaagtagtgattccttcaattctccaagtagtcctaacacttagcagggtttactgaggctttagtgaaacagaaggaaaagttcag

SEQ ID NO: 18538 - DNA, 201 bp, Bos taurus
caatttaactttaattgtatgtaaattagactcctgaaatgcttaaaaacagctcattaaacatttctccctgcaatcttatttacaccattttcttagcaaggcttttctttattagagtgcagaggttaactttagctcagatctgagtttatctcaagtttcaaatgggtatggagtctatgttaataaagtgttgcc

SEQ ID NO: 18539 - DNA, 201 bp, Bos taurus
gaaaaaaatcagataaacaaggtcctaccatatatatagcacagggtactatattcaatattttgaagtaaattataatggaaaagaaaaaatgcaaagaatattaagaatagatattttactattttatgtattttgaaaggattttagattcagaattataggggagattttttttttccttaaggagaaccactttat

SEQ ID NO: 18540 - DNA, 201 bp, Bos taurus
ggaagtgaccaggcagcaaaccaaaggagccagatttagtacccaaggaccagcaagaacgtgatcagagagggatgggccgggggctgccacaaaatgcgtccatcagcaagcagaagtcttgactgccactcgacctgtcaccctaaatgccaactagttggggccagcagaaacctagaatatcatttcttactcctt

SEQ ID NO: 18541 - DNA, 201 bp, Bos taurus
gttacgtgaggcttccgaggtactcaggaaggggtggccagggaggagggaagacaaagtctctggttccttgtttgaggctgggaatgttaggacggcagtcaatggctgtctggggccataaatgccaagctgaggagaataggtcctgaggctagcctctctccaccccctgccctgcgacactgaatttcacccccc

SEQ ID NO: 18542 - DNA, 201 bp, Bos taurus
tctccaggggatctttccaacccagggatcgaacccaggtctcctgcaatacaggcagattctttaccagctgagccaccaggctatgagtgagcatatcgtaaactcttactacatttcagctagctttataatcattactgggaaaggaaatccttggtcatgtaagcttggcaaatgtattgagctgttcaaaaagta

SEQ ID NO: 18543 - DNA, 201 bp, Bos taurus
ggcctagaggatcctctttggcctcttacacagtgattattcaacgtgcaaatgtattcacatctctactccaccccccacacacacttcaagatttccaacactccctgtgaggcccacaggtggagcaagagtgggtgagacacttccctacgcacatgtacgctcttggtgcagggtctgcaggcagacaaaagatgc

SEQ ID NO: 18544 - DNA, 201 bp, Bos taurus
tcctttttactgtagacattctgacagttgtgatttttcaaggtagttttgatttgcatttccctgatgattagatatagaacatttttcatgctcttctcggccatctgtgtgtcttccttggaaaaatgtctgcccatttttcaactgagttgtttggattttttctgttgagttgtacgagctgtttatatattttag

SEQ ID NO: 18545 - DNA, 201 bp, Bos taurus
tttaccaacttttattcacttccttttccgaggaccaagccagggatggaatgcaatggaaaatagtcaaagtgcagagcccagtatcagataaatacttttagggtgaagcaatgaatgatctaataattggtctcctagcctccaggctcttcccactccatttttatgctaccggctatatatatatatatatatatg

SEQ ID NO: 18546 - DNA, 201 bp, Bos taurus
gaatggcaaaaagctaagacttgagagtcgctcagcttggtgaccttgagccaatgtgcttaccctctttgagcctcagttttccagtctgtaaaacagaggtgataatgataccaattttatggactgttacgaagattaatgagttaaggtaagtaaggcacttggaacaacacaaaatcagtgtccaaaaatgactct

SEQ ID NO: 18547 - DNA, 201 bp, Bos taurus
caacacaggttagggcaaccagccctccttgtggtggaaaattcacttatacagggttcctccatatatggccattccatcttctcggattcaaccaaccacagatcatatagtactgtctagtattactattaaaaaaaattaatgtgtaagtacaccagtgcagttcaaatgtgtgtgggttcaatggtcaactgtgat

SEQ ID NO: 18548 - DNA, 201 bp, Bos taurus
gccaaaaaacaaaacataaaacagaagcaatatgctacaaattcaatgaagactttaaaaatggtcagcaaaatggtcagcatcaaaaaaaatcttaaaaaatagtatctcttcctgaaggccttttcttagctcccaggatggggcttctcggtgccccagaaatggccggtttccttgtctgttgtctgcacacgctcg

SEQ ID NO: 18549 - DNA, 201 bp, Bos taurus
ccacggggcagctaagcctttgcacctcaactgccagaggccgagcgcactagagcctgcgctccatgacaaaagaagccgttgcaataagaagccgctacgtgccgaaactagagaaaacccgggcccagcaatgaggacctagcacagtcaaaaaagtgataaatagacaaagccgaggtcccatctgcttactaccct

SEQ ID NO: 18550 - DNA, 201 bp, Bos taurus
gccccagagtggagcctggagggcgtttgtcacatcccacaccgccatgggtgtgtcttccttcagacaccggcttttggacccccttggggtttctggggaggagtcctgtcccgcctgatggcctagcaggggtgcccgcaggccctagactcagatttgggtcagattcccagttcagccactttgtggggagctctt

SEQ ID NO: 18551 - DNA, 201 bp, Bos taurus
acacccgtggggagggaggcttgagagacagtggaaggtggtggtggagggtgtggctcgggaatccaacaggaccccagtgtgtgacttcgggccagtggctcaatctcccagaacctcagcttcgacatttgtaaaaagggggtaaatcacgtcttcaaaggattttggcctcagctttctcatttgtaaaatagagtt

SEQ ID NO: 18552 - DNA, 201 bp, Bos taurus
gagtctacagggtcgcaaagagctggacacaatggaagtgactgagcagaaggaaaccggacagccccagggaagggccagaaagggcctgctggctggacgggagaatctggtcctggagttcctgggcaagacgactcctaaagtggacggggtggtctctgaagcccccttgagcatcatctgaaacggccagcctgt

SEQ ID NO: 18553 - DNA, 201 bp, Bos taurus
atccgatcagatggcacctcaccaacgcagctgaccgcagagagggcagcagtgtggtccccctgccctgaggggaaggacagagttctccccacacaactagccgtctgttaatcgggccactgcaagtgtggaagagcttattccattcccaggaaacggatatattcttgagcccaggaacacctgagtctggagccc

SEQ ID NO: 18554 - DNA, 201 bp, Bos taurus
taggatccaaggacctatctagtccagggattctcacactgggttaggtctccattcacctggagagccaattaaaatagattcctagattgcaccacagtgcttactggatcaaaatattaagggggaaccgtccaggaacctgtacgtccaacctggcgcccaggtgatgctgatgcagatgcctatgcttggaaagag

SEQ ID NO: 18555 - DNA, 201 bp, Bos taurus
gagaagtgaaggaagcagtggccaggcctggagcggccctgggacccaagtgggctcagaatgaagctctgcaacttgcccgcccagcctggccccttcttttcccaccctgggctcagtgtggacaccccagccggtacgtccaaattctgtccaccaccacccccaccccaccaccagacatccactctgtgaccatct

SEQ ID NO: 18556 - DNA, 201 bp, Bos taurus
gctggggcagtggccgtcacacccatagcaccggcaaggaaccaaactgttgaagtgttttaagtgatacaaactcatctggccccttgagataggcttctgtcttgcaaatgaagcaactgcagcacccagagactaagtcacttgcttacggtcacagaactaaaagcggctgagccaggccttgagcccacaaggtcc

SEQ ID NO: 18557 - DNA, 201 bp, Bos taurus
agtaccaatttaccattctgctatccagagtggctagaagtcattttgcaccaacagctaaatactattttctttttaataatgaagttcatttgtaccacaacttggaattggttggcgttgagcaaccttaggcacaaaaaatgactgccaatcctaaggaagaaaaattgtgaaataaggtgatctacattccttccc

SEQ ID NO: 18558 - DNA, 201 bp, Bos taurus
gcggctggtgagcagagggctggtatctttgagggcgttaggggatgaggcagggtgtgactcattatgcttgggtggatggaagactgctgctgggagaaggccagagcccggcccaggagggattttcagccctgtgggtgtgttggccccaagccagataaaggctcaggtgagtcactgtgctcagggttgccagaa

SEQ ID NO: 18559 - DNA, 201 bp, Bos taurus
tcttcttggtcctaggccgctggccgtgatcaggtgctgggccacccgccttgtcccctcggagggactcgtcctctgagagggcagctgatggccagggcgggaaagggcagctcctgtttgggttttctcgtatcctccagccaccagccagcggtcacctctgttttactttgttggcacatctcatggggccttggg

SEQ ID NO: 18560 - DNA, 201 bp, Bos taurus
ctctggagaggcagctgaagggggaaataaccaccaacacactgagatttgatgattaaatgattatgtctcatttaatcctcctaaaacctctgagcaagtgttagcatttttattttactgataaggaatggatggggaaacagtggaaacagggacagactttatttttctgggctccaaaatcacagccgatgatga

SEQ ID NO: 18561 - DNA, 201 bp, Bos taurus
ggtgttgatgatatatttagcccagagagagtgaaataaaattgaaaaaggaaagccttcacaacatgtgaggttatgtaagatcacatctgggtaaatcatttcctgcttgggtcgtttctatgaggcaatgagctccctggtagaaagagatgggtcagtgtcctttgctaccagcagagcgcatagcagaatgtctta

SEQ ID NO: 18562 - DNA, 201 bp, Bos taurus
ctggccagagtccttccctgagactctataattcaacccagagaaagagaagggtgcttttctctagggctctcagctgcccggacgcaagcctggccctcttctgtgggttccaaggacatcaggagataaggacaagggcacacacagagggaagctgagggatgggagcagacgcagggagcggcgctccggcaggcc

SEQ ID NO: 18563 - DNA, 201 bp, Bos taurus
gacatttcatttgttttcccttttgtttttattattattactgctactacaaattgagattatggaataaaagtagttaaggattcactgtaattgttacagaaatagcaattataggtgactattgacatatcagaatttgttttagttaaaaactaatctgagttttggagaaggcaatggcagcccactccagtactc

SEQ ID NO: 18564 - DNA, 201 bp, Bos taurus
gcagctaagcctgagttttggctcagtatcctcagatgaatactataagcatcttgggtactctggcctaaggcagtgaggagacaagggaattagcatatttaaaaaaatagttgctggtgagttggagggaaggttattttgtccagcactgggataaaccacttgatggcctaccttaatccgcatttaacagccagc

SEQ ID NO: 18565 - DNA, 201 bp, Bos taurus
gcccggcctgccatctggtggcaggttcgttacactggatccctttcatcacagaagtagcatagacttgctctcagtacaatagacatttattccagctaaggttttacattctctgctggccgtgcttctgctagcaacttcattggtagatttactgaatgtcttactaataaccatggtactatcatgcagagtgaa

SEQ ID NO: 18566 - DNA, 201 bp, Bos taurus
agagatgcttcatttctcccccaacacgcacttttcagaggcttagtcacttgctgaaggttatacccagcgttggtggcagacttgggactcgggccacgtctgtgtaccccagtcccatgttcttgcatctctgctgggctgacaggcagctgcactcctggctggcagccctctggccctgtccttccctccttggtt

SEQ ID NO: 18567 - DNA, 201 bp, Bos taurus
gctcctctctgtctccccagattgcgagggcaaggggcgcaaaccggtgccctgggctggctgacgagtagcctccacatgttttgttggccagcgtggtattctgagagaatctggattcattttcaacatttagaatttggggagtttcacattttcagaaaaggccaaactggtaatagtgctcatttctgttgttta

SEQ ID NO: 18568 - DNA, 201 bp, Bos taurus
cttgccttgtgggaaaggtgtatgctgacggcatgaatgagtgagtaagtgaggaacacagtcttgcctggaagggccttgcagatcctcataaaagccctggctcctacaagtgcttcattctgccttcccctgagccagtggaagggtgctcgtgttatccctaagggcccgtgagccaaggggagaaaaaaaaggctt

SEQ ID NO: 18569 - DNA, 201 bp, Bos taurus
ggagttatcaggcctgcttcggtaggaaaaagaggctcagagaggttgagtaacctgcccacagtcgcacagtgcacagagcagatgtcccgtccaggccagctggagtcaggttacctcgaggttcccggagtgtagacttatgcttcagcaggagctggtcaaggacataggtctgctcctgggggcccagcgctggtc

SEQ ID NO: 18570 - DNA, 201 bp, Bos taurus
cacatggctggtctgtaatgatgtgaagttcaaagttcagtcagtctgactttctagaactctctggtctggatttgcaacaagttccctgggatgggccggtgaaatatgagaatgagtgtgcaaaacggggctccagagagaaggtgcttctccacctttggactttgcacatgctgttccctccatctcaaacactct

SEQ ID NO: 18571 - DNA, 201 bp, Bos taurus
ccactcaaggggctccacggccccctcgccagcccccaagcgtgggtcactttcccaatttcagggttgcctagctggtctctgtccccacacttgttttagagagggatggatggggccctctgcccggcacccagctctttggggaccctagaccccgcatgccccccgtgcccttccatttggggcctcggcagagtt

SEQ ID NO: 18572 - DNA, 201 bp, Bos taurus
gagagagagcaaaggagattgtcagcacagcaggaagatggggaagccgaacctggcagacaaaagccagccaagagaaggctgccggggaaggagagagccttgggcaagagataaggccgggaatgaaaaggctggggaaggagagaagagcaagagctgccagggtggggaggctcggagctgagcggggcggctttg

SEQ ID NO: 18573 - DNA, 201 bp, Bos taurus
cccttcttcctgtgtttcccatgacctgtcctctgccctacggtcccacctgccagatctgtgtcctgaaagactgccagactctcatcttggggctctccgacatatcaaagaaagttgcgtgtcctccgagggcgagtcacccactcatcttggggctctcagacaaatcaaagaaagttgcgtgtcctcctagggcga

SEQ ID NO: 18574 - DNA, 201 bp, Bos taurus
ccttggggcccggaactaccacctccttctatcagacaaacgagaccaacggagccccaagtcaggcagtgagcaggaagggggctccatccacccaccgcgctgccttccacagaggccatgctcacaatccccaggctcgttgagaaacactgtctccagtggagacagagtcaccaaatccctgagtcttcaggggcc

SEQ ID NO: 18575 - DNA, 201 bp, Bos taurus
gtccctcaccccgacgtgccaggtggctgtgaggggtcatcttagcttctcagctctctgatgacctcgtgagctttgccatgaagtgaaacggcaaagtattagaggccgggaaccttttccatcataaaaagtgcaatgacaatctgggtataggaaagaggctctgctcagcaatcaggaaccaaggtcttgtcccta

SEQ ID NO: 18576 - DNA, 201 bp, Bos taurus
ccacacacctccctcttttcttggtagcctttcggttctgcttagtaactgaaacagagcatcacaacctcactgactgaagccaggccacctggaattcgggtaggatcagagctggacgtcacgccgtgtgactcatgacagttctgagatccgcattcctgcctggtttccagctgtggagtctcagctgcctgggcc

SEQ ID NO: 18577 - DNA, 201 bp, Bos taurus
gctgggacaccctgcacccatccttatcttctctgagtctctttagcttattagaaccctgctttggtttgcaaactatgaagtcctagacattgtgaacggggattgatgccaaaatcttggttccctgttcaccgacgctgaaaagaaataaggagacagattggagggaaaataaaaaaggaagagtggtttcattct

SEQ ID NO: 18578 - DNA, 201 bp, Bos taurus
gatggtaggacttctgtgtgtgtatgtagtttttttgtttttgctttttggagtttttttttttttgccttattcaggaaaataaaaatttgttgaccctatatgagtccaaaaaaacttgctgatctgtgaaattcaggggtctgagaaccactgcaatagaagctttccccaaaaggctaagagagtcttggcatgcag

SEQ ID NO: 18579 - DNA, 201 bp, Bos taurus
gccccgcgggctccctagaggctgcaccagggcctcccgcagaccggggtgcgggggacgagggaccgggaggaggctggctttgacggggaagccgagggtttcacagacaggctccttgacccgcctccagattcgaccagtacgtgcacacggacgtgcccgagcgggacctcgcggccttccggcaggcctggccac

SEQ ID NO: 18580 - DNA, 201 bp, Bos taurus
gaggcagtggccccgcctcgaggggagtcaggcagccaggctgcagctggctgggctcccgcctctgggatctcctcctggccccagccctgacccctggttgccctttcaggttcctgcaggacctggagcagcggctggaggcagacgtcctccgcttcagcgtgtgcgacgtggtcctgcagcactgtccggccttcc

SEQ ID NO: 18581 - DNA, 201 bp, Bos taurus
acctttaataagcttgacaagaaaagccacaggtaaatattctctgtatagggaaaaggacagccaaagtttgaataaattacagagaaagtttcaaaaggttgaccaaaaagttcaatctaggggacttccctggtggtccagtcattaagaatccatcttgcaatgaagggtcacaaattggaaccatggttggggaac

SEQ ID NO: 18582 - DNA, 201 bp, Bos taurus
ttggttttctcatactgttagccccaaactgaaaaggtgtgtcagtttaggttttccctgggtgccagctctcaccaggccactgcaatactttctgcctatgaaggctcgttagcagattaccatggcgttccctgaggaattgagatctctggcctccctgagggttggcaggcagggccacctcatggtgggtaggtc

SEQ ID NO: 18583 - DNA, 201 bp, Bos taurus
actcaacaaccagagttcacactgaaaaccaaagacttcctctcctcctctctccccaacagttctgcttatcagttggtcttcagagagagtcctgcctcgcaccacaggtgagcggtggagaacgcagggccaattatgcaagaggcctgtattcaccccaccttgcccatggggacctggatgtggcgcatccaggcc

SEQ ID NO: 18584 - DNA, 201 bp, Bos taurus
catcaagggcaagcagctctttcgtgaggtccagaacagaaaactggccacagacaggcagacagacgtacacacacacacacctttcaaaggtctccacattctatttttcttttatatcactgttcatagtgctggaagtttcatccatggaatttatgttgactgctgctagaagcctggacaactcaaaactgatac

SEQ ID NO: 18585 - DNA, 201 bp, Bos taurus
ctgccagagataaaagtacaattcctttcctcaagagaactttaggttattgggcattcaccagtgtgggttagtatacagtgtgaaatccacataaatcaggggatctcagagtagatgcatctgacaactcagacacgtgtagaagccagtggtaggagggaaagggggactcttgaacaaccactggcttcccggctg

SEQ ID NO: 18586 - DNA, 201 bp, Bos taurus
caagttaaattcaaactacttttttttaagacatatattaatggaagcttcctagaggtagaagagagagttgatgtatatttgggataggaagtgcaggggggagagagagagagagagagagagagaagagagagagagagagagattctctttctacccctgccccaggctctccagacactttgattgagaagcttt

SEQ ID NO: 18587 - DNA, 201 bp, Bos taurus
aggaattcactggtgtgttaggatctcctgaggcctttgggaatcttttcccattcaattatctccccttaaggcaatcctaaggaaagatggctgtgcacttttaataataaaaggtacccagtgaaaagagctctggggtagacctactagtgtttaattggagggcaaatttcttgaaagctaaaagtgcctgaatta

SEQ ID NO: 18588 - DNA, 201 bp, Bos taurus
aaaagccatctgctggcactaggccagtatgtctgaattttgtcattattagcatctcatttttccaaaaaaggaaatgtgtaagtagcacgtgtacatacatggccatttctacaaagccttctctgcagtcttgacctgtgtgaggacaggttctactgatggaagcatttttagaggcagaaggaaaaacattaactt

SEQ ID NO: 18589 - DNA, 201 bp, Bos taurus
tctgcaagcctgcaattaagcaatctcccatctcaaagttagactggggaaagagccccttccaagttcacatggtggttgacaggattcaggcccttcaggctagaggattgagggcttctgtttcttgccagcagttgacccaaatcttctcccaattcctagatggttttgtccagaagccattcacagctccttgac

SEQ ID NO: 18590 - DNA, 201 bp, Bos taurus
gcctggacaggacagggcgagtgttgtttaactgcccttggtatgaacctttgtattacagaagagctgcttctgcaagaggctattaccagcttcctatctggccttccctccatcctctgctgttcagctttatcattgccaccaagaggatgaagagccccagtgtggcccaggggcagtgaaagctgagactcacag

SEQ ID NO: 18591 - DNA, 201 bp, Bos taurus
gaaaaaagtaaggcatggaccgtgtcttcctggcaccagccccacacttccagctgatgattaaataccatcacttaaataacacttgggtgttccacaggctttgccaccttctgaattctgtttctattgataatatgacggtcttctcagacatccagaatgcatactttgcgatgatctttaatgtccccttttcac

SEQ ID NO: 18592 - DNA, 201 bp, Bos taurus
ctattaatttcataatctatttatggatcatggcctgaaatttgaaaaatactgcttcacagggcaattactttcaaacctattcccaagttttagaactgtaaatcctttgaatctcaggccaataaatatgttttaatcttctgcatatacccacactgtgtcaggtgctaagactaaaaccaaagacacagaaagtat

SEQ ID NO: 18593 - DNA, 201 bp, Bos taurus
agaggagagcattcaaggcctcgtttgaagtatcctccaagccgtgcaggaaggtacagaggggaagaagggaagaaaggggataaggcccctcttctctatgtgtaccctggactctggggtgtcgatgggcacctggtggggatcggggtgggagtgctgttcagacagtctgggcgggtggccttgagccccattgga

SEQ ID NO: 18594 - DNA, 201 bp, Bos taurus
catcctaattgtccaatatggctcacagagtgccaatcacctaccactttcgttagacttccatgaagtattcacttacaatacaataaaatgttgaatgtagcatgcttctatcacttcaaaacgattctccactttaaccaactcatttaaattaacaaccaaccaccaatcttaatattatctattaacagagcttct

SEQ ID NO: 18595 - DNA, 201 bp, Bos taurus
tttcttattgtagactcagtgagagtaaagataaagcaactgtcaaaatagcatgttattttgacagtagccatatcataaccataaatgatacagtttatctgtacatttttaccctcactaatggggtctaaatactgtattctccgatatttcatacatacgcaaagatacatgcacatgggttttagtaagaaaggc

SEQ ID NO: 18596 - DNA, 201 bp, Bos taurus
attagaaaacctatatatgtagacacataggtagagatggacaccatctcagaacctagttcaaacttggatgcaacacagtagaggcctctatccctggcgaagcctcatttctggcagttacaggcttaggtggtatctgtgaccacaccctccagctatttagggccagttataatcgttaaacagtttttcattata

SEQ ID NO: 18597 - DNA, 201 bp, Bos taurus
ttaggatgtattgggaagtgatgatctgtgtaaattttcttcaaagaaccagataatcagtttgactttgtgggtctggccataggcatctatacaactattcagtctgccattgtagtgcaaaaatagccacatagataacttatgagtgtagctgtgtttcaataaaactttatttacaaaacaggtgatgggttgtgt

SEQ ID NO: 18598 - DNA, 201 bp, Bos taurus
caacgtggtctgacactacagacagagaagagatgggcctgattgaaaaaaaaaaaaaaaaagacaggacacattttcttttgcaagaaaacaactattgggtctgtgataaacagaataatggccttgcaaagttgtccatttcctaatccttggaacccacggattacatggcaagaagaaattaagttttaaaatgca

SEQ ID NO: 18599 - DNA, 201 bp, Bos taurus
acttctcatcttggaattaacttatggggattttgagattgaaattagagtcaaagaagctcttcctgaaaagcctctgtggtttcaaatataagatggtgtaggccagggtcatatgaaataccatcattagtgatcttaagcttcagattcaactattatacttttcaaatgcaagggtaattgagggagtttaaaact

SEQ ID NO: 18600 - DNA, 201 bp, Bos taurus
gctcatagcatctatactcctaccaaactaagataattaactaaagtagggttttgtaagcccaaggaaagagacagccattccttataataacatactttgtttttgccacagagggtgctctgggaaggggcctatttttggttcttcttccaccctacatcctgcacaggatctgaggctccctcacgtcctgtcagc

SEQ ID NO: 18601 - DNA, 201 bp, Bos taurus
acttttcctcacaggatttatggccacccgctttctggcctgcaggtcaaggcataaatgaaaaagaaggtcccataggggaattgctaacaatttaatgagacaatcagggttttggccctgaggtcaaacacctttgaagatttcaggttatttctcagggaaaatgtttctggctgtggctccttcagccacctacat

SEQ ID NO: 18602 - DNA, 201 bp, Bos taurus
agctcattgtcataggtgctatcattaataatccttatgaccatgattacaatgccatctactcagtgtgctggggagagagaagcataggcagcagacagtaggaaccagatcctgtgggatgcaaggaatattcactgtattgtactatcgctcacactggctttcagacagagtcccagcgaggtgatactggaattc

SEQ ID NO: 18603 - DNA, 201 bp, Bos taurus
aaaaattcaaattcattaccataaaaatgagcctcttctctgtcacagcttacaattctctctgacattcaattgactgatcagcagacctgggctttatagtaggagactttttgcattcctctttgatctgatttccccctatttaatagacaattataggctctttaaatcccaaaggttcagagagagcaaataatt

SEQ ID NO: 18604 - DNA, 201 bp, Bos taurus
agtaagcaagcagtttgttttctttcttaagaatatgaagcacagataacaataaaactctgttttcagctggatatgacagcaatcatcttcaaaggctcccacatcacataagactcagcacatttgtaatcatttttctattgttgattagaagagagtattctacagtttagctgttctttgtacacatgattgata

SEQ ID NO: 18605 - DNA, 201 bp, Bos taurus
gtcttacactcacctgtcccacgtatctcttagacaagggacgtctttgtaacccttgaaacacccagcacaggactttatatatagttggttattgacagagtttatttgaacataattaaaatatgcatttttattctgctacatttttgttttagtgattgcttgtactgttttccacacttactcaccttttaaggt

SEQ ID NO: 18606 - DNA, 201 bp, Bos taurus
atactacagcaaagaggcaagaggtaacgacaatggctacagtgatccacattgttatcgggcaacatacgtttggaaatgtattaagacctaaagtttagttcagctcccctaaacactgtgttattggtctggtctcacactgtgaactgggatttaattctgtccctgaatgaacaaatgaacttcctcttcatgaag

SEQ ID NO: 18607 - DNA, 201 bp, Bos taurus
aaggtaagacaagaacaatagggaaaacctttggaaatattatggaattgcagcaacagtttggaacaaagcaatttttcccactctggatctgataggtggacttctaaaagtggaggttcctaaacttgtttcttcctgctaaattacaaaaatgcaaataaaaatagcacactgacctgcaacaaggaggcaaacgta

SEQ ID NO: 18608 - DNA, 201 bp, Bos taurus
ctggttttgacaaatgtatgcaacatataatcaccacctctatttccctcagggagtttcctcaattctttttgcaatcaggcttcattcacctctctcagtctgagcaactaagcatccaatctctgtcaatatagattaattgcatctgttgtaatatttcaagcatatgggatcagttttgctttgtgtctgacttct

SEQ ID NO: 18609 - DNA, 201 bp, Bos taurus
gtttctccaaagaagacatacagatggctaataaactgtgaacttcttaaaggtaggatcaatgactttactatatttgaatccctaccaaattccttgcatgtagtaacagttgataagcaaagatttactaaactaaactgaattcaattgatctctgctttcctctgagccttgatttatggcagttgggtgtggcta

SEQ ID NO: 18610 - DNA, 201 bp, Bos taurus
gtcaaaacaatattgtttgtgaaaaaggatgatgctaatttttccttttttaatcttctccctcccactccgtctattactctggttggaatcactagtacaatattacatattttcctttttccaattattatttcttccatacataggttatttaaaattctatttcttgtttcaaaatactataagatttttcaaaat

SEQ ID NO: 18611 - DNA, 201 bp, Bos taurus
gcgtcatccctgtccaccacctctgtggtggcctctggctgggaagcatcagctgggctgggttgggcggaagacgagacctggggctgcccagatgacatctctgtcccatactccagactgcttaggacaggctgtgacgaaatcagcatgtcctgggtggtcttcagggcccgaggggttcgcttcctggtggcagga

SEQ ID NO: 18612 - DNA, 201 bp, Bos taurus
aagcagacagagagagcaagagaggcagcgcacacaatgaaagcgaggaccttcattaaaggcgctgctgaaaaacccagaaggggaagggcccacaagatttcaaagaagacagcaaagcctccacacatttggattcctccagagtaaacaagtttcctcggcacaacaaagggcctgcctggggcagctctactggaa

SEQ ID NO: 18613 - DNA, 201 bp, Bos taurus
gtgccctccccgtggatggggtttatagctctgtcttgcgacttgtaataacccagagtaagttccttggaagtgaagactgtttaactttgtatcttttctacttctgattctccttcccaaaaaagcctggccctaagaacacaatatatgttgctgtactaagcctttctctgcacaacttctcttacacctaccctt

SEQ ID NO: 18614 - DNA, 201 bp, Bos taurus
gtgtggttgtatcaaattgaagtaaattacataaaaatcctctctaactgtttaagccagaaaagaaagaaagaaagaaagagggactttcttggtggtacaatggataagaatcttcctgccaagagaggggacatggatttgatccctgatctggaaagattccaaatatggtggagcaactgagcccgtgtgccccac

SEQ ID NO: 18615 - DNA, 201 bp, Bos taurus
ctgactctacgaggagctctggagctgggatgctcctcaagggctgctctaaactgaggcaaagagatgggacttcgatactcattgaccaactgaccaggtgttaggtgtgggtggccctcagggaaggaacttgctgaaggcagtgcctagagacggactcagctgagagctgtcgaccactaatgcttcgagcaactg

SEQ ID NO: 18616 - DNA, 201 bp, Bos taurus
ccgctgctcctgcgctgtcacagcctggcactctcagtcgctgcccctgaccttgggtgtgtggtagctcctctaggccccatggtccattgcagccaccgtgcttctggggacgtttcgaaagaagttgccattatgttcatcacctccaccatagtttggcctcagatcaaacaccaaggagggaacacagccccaccc

SEQ ID NO: 18617 - DNA, 201 bp, Bos taurus
attcaccatacggccaagaaagtccttatgtatttcttaattgaccatttcttcctctttactcaggcaaaagctagtcatttaatgtctcttagtgagatagaggcctgatacagtgactggcacatagtgaaaccagatataaatgaataagtgaatgactgaataaattaatgactgaataaatgaatggatgaagat

SEQ ID NO: 18618 - DNA, 201 bp, Bos taurus
aagataagactctctccaaaaggcctataagggaaaaaaatttgaaaaccccaggcataaaagtttagcatttcctgaatgtcagaggtatggggaccaataaggccagagcactgcatcctctggcctgggaggatcttcttgcagagaggaatcctcttgaaaccccaaatctgggagctctgcttattccccaaagag

SEQ ID NO: 18619 - DNA, 201 bp, Bos taurus
agctctccccggctgtctgaggcccacagcttctcggtgtccacggcagatttgtcgcaaaggaaagcctgcatcgttcctccaacatggctggggagctgtggcaaagacaccctcagctccagccacccgaaaggtggcccagaaaacaggtttccggaaaccatgtgctgacggccctctgaactcttcggcccccaa

SEQ ID NO: 18620 - DNA, 201 bp, Bos taurus
catctcccaccttactgtatttctgctcttctttggcagtgtggctctcatgtacctacgcttctctgccacctactccttattctgggatacagccattgctctggcctttgcagttgtgtccccatttttcaaccccattatctatagcttgaggaataaagagataaaggaagccataaaaaagcacatgagtcaagc

SEQ ID NO: 18621 - DNA, 201 bp, Bos taurus
aagacttaatggcacctgcagtcaggtaatggtcaggtatggtgtagcacagatgagaggagctgaagaagaggactaagagaggactttgacctttcctatgtgaggtctgttagatgtaggaagaaagctcttgggacattaggatagatctcctttctccatcctcatccttaaaatatttttcagtaactttagaag

SEQ ID NO: 18622 - DNA, 201 bp, Bos taurus
atctgctgtattgaaggtggaagaataagagttaggagtaaatggaagtgtgaaaaatgctgcctgtgtgaggattacagggagtaaagaagatattgatcaatttcctactccagtggtgaataagcacacagtacaaaagaaatattgaaaatattaaaaacaggattctggttaattagaagatacagtcttacagtg

SEQ ID NO: 18623 - DNA, 201 bp, Bos taurus
ggctatgacctgtgggcccagagtgattgccttgataagctaaacaaaggcggctcgttagcctcatgatccccatgaaagttgaagaaggtgcggagccttggtagtcaatggccctccttccagcaatgggttcgggtctctaccagtcagcctgaaacattcagagaaaacaagctgatttacaggatcttttcttcc

SEQ ID NO: 18624 - DNA, 201 bp, Bos taurus
ggagtataattcaaaaacttcttggcaaaactgcagcctcacccagttttgctcagtgttgcattttatgcgctgggactttatttgccaaaaactttgtagaaaatttgagattcacatcacgtctctctcctcctggccaatcactttggggcctagtctttttccttttctttaagaatttgattcattgccttcact

SEQ ID NO: 18625 - DNA, 201 bp, Bos taurus
ttttggcccttgaaatagtgctgatccatattctaaaactaccctcactaaaaccccaaaaatgcaagcagagctgtttagagagcacctctggtgggcaagggccaagtagtgtgtcacctttggggctctcctctccctgcaacctagagcgggcaccacagtgagcccttcaggcggtcaccggggtctgggcactgg

SEQ ID NO: 18626 - DNA, 201 bp, Bos taurus
agagaaaacagagggccacgctgggttcccaagaggggcttgaagaggagcaccccctcactccttgaaaggctgagaagtgaccacagggccgctgggggtcttctctttgaaggtgccctaaacaggctcacctgttcacagtccctgtcaggacgcaggaataggacaggacaggatgaagagccagagcagaggcct

SEQ ID NO: 18627 - DNA, 201 bp, Bos taurus
ggcaggatgagaggaaaatgcaatcatcccggggagaaacagcagcctggatcaaggctgaggcaggggctgaaaaccggcacagggaggccacccttgctggctttctccacctgactttccccttttgtaagatcttctcttggatcctagagaagactcctaaaaggggaggggccggtccctgcctagggtggggag

SEQ ID NO: 18628 - DNA, 201 bp, Bos taurus
actagaacccaggcttcctgattcttctgtttagtgctctgttctgtaccccactctactaactcttctccatgggaaatgtctgagatttcctcagataagaaatctggctgctttccagagttctgttgcatgggggcctgggtgctggttcccttcctccagatcccagcttagccctgttcccctaactggtctggg

SEQ ID NO: 18629 - DNA, 201 bp, Bos taurus
cgccctgccgccggctgctgccagagtcccagaggaaatcaaaggcctgggctttgggctctggccaagggagctcagagtgcggcctcttaaagagccctttcagcctcatgtctatgcaggaacccagtctagggtgggacaggggggtctgtccagggtcctctcagaaagtgatgccggaggcctcggttttcccat

SEQ ID NO: 18630 - DNA, 201 bp, Bos taurus
accactgttttaaatgaaatccactatttttaaatagcagagcactctacacaagaaattgtattatttttattgttataaattccaaatggttaatggagtaggaaaattagaaactgcctaggcctgaagattaggaaatactatcagcctaaagaaaaactctaagagacagacagaaaaataatattatgttaggga

SEQ ID NO: 18631 - DNA, 201 bp, Bos taurus
ccgagcctggggagaccagagggccgggagagaagtaagggcagatggggagtgagaggtgctttgagcaggggcagcctggcaccgccgctggatctagactgactggggattgagggccatttctgtcacctcccagtctgaattgagcaagtcacttaaccttgctaaacctgtttcctcatcagttacgtaggaata

SEQ ID NO: 18632 - DNA, 201 bp, Bos taurus
ctggaggaaagtgtccaccatggtgtcgaaaagcttcaccctcgaaatgttagtgccggggcgcgcaggttcctgagacaattcctcgggccctttttcttcacagccgctgcctacgttgacgctgctcgcttcagccatgttgaaatagaaccgccaaaaccgactgacccggccgccccgcccaccgaagcctccgat

SEQ ID NO: 18633 - DNA, 201 bp, Bos taurus
ggatcaaacccctgtcccctgcattggcaggcagattctttaccactgggccatcagggaaggttccttcctgagtgttttgatttagattatttttttctcttgtgagttatagtatatttagattttctgacaaggttaagtgttctctttgtattgtttttgttttgtattttcaagaatttccttctgttacaggca

SEQ ID NO: 18634 - DNA, 201 bp, Bos taurus
gcccttcctctccccactcttcttcagccctctgggaccccggtaagtgaggaacattggggcatgaacactgaggtgctcgcttggaagctctccagcttttggagggccctgaatctgcttcggaggtgaatgggcacagagcatttgtgaatccccgtgccctccctggcatgctgggcttattgtgttgggagcagc

SEQ ID NO: 18635 - DNA, 201 bp, Bos taurus
gtcgtaatccgcattgtacttctgtggaggaaacgtccacggtgaggtggatgctgggggactgcgggaacgcttcctcaaggagggaggcctcctgtccggcaccacccaccctgacctctgagcacagcagaggtagagtaaggagcttttcttgcggaggccccctcgcctgggcccagtcagtagcctgttgctgtt

SEQ ID NO: 18636 - DNA, 201 bp, Bos taurus
gcaaaaggtagacaacctaggaaggccactctttcaagaagacctggtctcttgttaaatttcttcttttatctttttgtattgctattgctcttccctcgatggcctcacttttatctcaataactcctttgagcattttccttggtggttctgtataccatagatgccacacttactgctggcttttctttttacttgt

SEQ ID NO: 18637 - DNA, 201 bp, Bos taurus
ttgagttaagtttcctggagaacgctggatgatcatttggtatcagggttagagaattcacaatattaagtttgtcacaaaattaagtatttgagaaaggcctgtgatggatgtgcattcatgtgggaatagtaaatgggttttaaacagatgacattcttggtgtttttgatcagctgttctgtgttgtttctcagtttg

SEQ ID NO: 18638 - DNA, 201 bp, Bos taurus
aaatgctgatgaggaactaattataattccatttcaaaccatcaggccctgagatactgtctgcccccacctcagctgcgggggaaagaaaagcacaagagaccttctcccacactcaggcctagaaaaaacggaattttgaaggcacttgggtttctagagtttgagctagaagaggagggtcaagacataagcgacttg

SEQ ID NO: 18639 - DNA, 201 bp, Bos taurus
gcagccatataggccattagagtacagagttgagttacctgtgccatatagtaggttcttattttatatacagcaacctccccatttatctctcccctccggtatcccctggtaatcataagtttgaaaaacaggtattttaaaaaaatgtttttaaataaatatccttcatcttaataagcactgaatacatgaacctga

SEQ ID NO: 18640 - DNA, 201 bp, Bos taurus
atcaacattcccattgtcctttgggttctgatttttggggttgtaactggtgattcttagctcctgcatcttgaacgcaattcctgttcccagataggccaccaggagctgctgggctctcgaggtccgtagtcatggtcagggcaggatgccaagagggtgggcaggatgttcagtagtgaggtgggtgacctgagcagg

SEQ ID NO: 18641 - DNA, 201 bp, Bos taurus
gtacctttacagcctgctagcggcacaaccagaagccttgtcctctttgtcaagttacaactgacaaaccttgagatcagggtctcctttagttcttgatagcccactgggaccttctcaggatgtgtttactcttgagatgtatctctctcaggtgctcctggagcgcatacttgcagggaggaggaggacggtggctga

SEQ ID NO: 18642 - DNA, 201 bp, Bos taurus
ccaggggacctgttacataggtctggacaggctgaggtgccgggcagggtacatagctctggcctgggcattccacataacaagtttctgtataacaaaccggagcacattctacatagcaggtctgcacagggcatgggccttcacactgcacataggaaacctcagactggcatggaacctggcattgaacacatgtaa

SEQ ID NO: 18643 - DNA, 201 bp, Bos taurus
cttacaggccaccagggccgtggaggagccacacagctatgggcagctgactttctcccaggtcccagcactgaggacagaggtcacattcagagaaacatggactctcagaattggaaggcctcccatccaggaaggcaccagctccacagtattcccggcagctggcagcctggcttctccatgaacacattccgaaaa

SEQ ID NO: 18644 - DNA, 201 bp, Bos taurus
cttctccgggggatcttcccaacccaaggatcaaacctagttctcctgtattatgaaagattcttcaccatttgagccactcaagaagccccaataggccatgtacctaaactcttttaggcagttaaagagagaggcaaaaacaaacaaactccagaaaagaagctcttcctgagtcagctaggccttgattaccttcag

SEQ ID NO: 18645 - DNA, 201 bp, Bos taurus
tttttttgccaaggatgcgcatgttgacgaccaagtcaccatctttgctcaattctccaggcatctgactcaaggttcctaggaagaaagcaaagttgctctaaagagatatggcacagattggggaaagaatggaaaataaagagggtactgggttattgggacaaatggggtaatctctgatccttaaccacttttcct

SEQ ID NO: 18646 - DNA, 201 bp, Bos taurus
caattagcattaaaagaaagcatcattatgtatatttactgttcatttttctcaaaagcctcaattttgtctctaatatcaatagaattttctctctctcgcttgagtgctatggttctctatagttgagaatttgcaaataaagacaatgcttaaaataatggttttctatttaattaagcagatatttacaagtaggtt

SEQ ID NO: 18647 - DNA, 201 bp, Bos taurus
agtctgaatccaaggagggcacaggacaaggctgactgcaggatacttttatctcctgatatcccctcacctttccatctgggccctacatcgtctttaatggtgacatctattatctctctgaaaaccaagaagttcatcccttgtgaagaaacttagctttccatcagcctggcccacctgtgggacaaacagatttga

SEQ ID NO: 18648 - DNA, 201 bp, Bos taurus
tgagtatttttgtggaaagagatgctaaaaaaaaaaccaaaacacccttcctctccctatgcctttttctaatttagagatgtgttaggatattaggcctgaagctcccgtcttcaggttggggtgggtcatcctgctcagtccttggctcggtaccacaatctcctgccgtttccaaaacgctctcttcaaacccttttt

SEQ ID NO: 18649 - DNA, 201 bp, Bos taurus
gactgtccacagggctggtaatagaccaaactccctatgtgaccttgagcaagtcacaacacctccctgcgcctcactgtccttatcttaacatgagagcattggattaaatcaggtctgaggccccctccagttctaaaattatattatctctctaatactgttagactggctgccttccaaagtgtcactgcttatcat

SEQ ID NO: 18650 - DNA, 201 bp, Bos taurus
agtacagagcacctatattaaatcttccttctccttaccataaacactgtcaaacccatcattaataaacaccattctactacaccaaagtactacactttttatgatacaacagatttttgctctctcaggatttacattatgttccatatgaatttgttgttcagtcgctaagtcatgtctgattctttgcaaccccac

SEQ ID NO: 18651 - DNA, 201 bp, Bos taurus
atctgaaaaggaaaattaggatgcagcttctttgggccaaattgtatagccagaacaatagctttaattcaatgtaaggtaaagtcagttctcccaagaatagatatatcttcagtctttcagtggaatccaagcttattttttccattaaggtaggaaaggaaagagtcttggccaaatctgttaacagagtgttacaag

SEQ ID NO: 18652 - DNA, 201 bp, Bos taurus
ggtcatgtacaaactgctatatttaaaatgaataaccgacaaggacctaatgtgtagcacatggaactctgctcagtgtcatgggccagcatggatgggacgtggggggttggaggagaatgtatatatgtatttgtatggctgagtcccttatcagaatactaccacaactttgttacttggctacatcccaatacaaaa

SEQ ID NO: 18653 - DNA, 201 bp, Bos taurus
gatgccgtgaagcgaatattctcgggcattcagcctacaggaatcccccacctcggcaactatctgggagccattgagagctgggtgaggttacaggacgggcatgactccgtgctgtacagtattgttgacctgcattccatcactgtcccccaggacccaaccatcctccggcagagcatcttggacatgactgctgct

SEQ ID NO: 18654 - DNA, 201 bp, Bos taurus
tcaagaatttgggacttttgaacatgctaagcagaaacacagtgaggaatcaaaggatgaactattcatggtttggagagccagcattttaaatgttggcgtatcatgctttatgcctaggtgcagggtgataatgagatggctccttaagaagcagaaagtctttctatgtggaaagccacaaggaatgatgaacaactt

SEQ ID NO: 18655 - DNA, 201 bp, Bos taurus
cagaacagtaacagcaaagccacatcagcggtcatgcagcttagaccagtgccccttaaagagggtttttctggagggcctcagctctgccctgtatttagaatttgttctgagaggaaggtagtcatgtgttttctactgctattggcagatacctcagtggtccagtgtggtactcatttaaactatctttgtggccaa

SEQ ID NO: 18656 - DNA, 201 bp, Bos taurus
tgacagtgttgtttgagtttctggtatacagtgaggtagttcagctctatgtctatagtctttgtcatatgcttttccacaagatattaaatatagtaccttttgctacagtaggaccttgttgcgtatctattttatatacagtagtttgtatctgctaatcccaatcctaatatatccctcccctgcccttttcccctt

SEQ ID NO: 18657 - DNA, 201 bp, Bos taurus
ttttgattactacttcagttactacaagtgaggcaagaaagggaagcttttctcaaacgttactcgagaaactgcaccaccttttaaaatctacacatatttttttcttccttcaaagatgtacccttcagacaaagatttctgaggattggtttttcatctaagatccagttcctggtgggtggaagtgtgaactgtggg

SEQ ID NO: 18658 - DNA, 201 bp, Bos taurus
atgactaagtgaggatgataaggccagagaagacaggacaaggaaggcagacattccttccccacttgatgacgctgtctgagcctgtttctgttggcactacccattcctggcccacccatgtgtcaatgcactcggaaacacaggaacagtaacagccacagcaaggcatgaggttgttagtaagctgtgactgagtca

SEQ ID NO: 18659 - DNA, 201 bp, Bos taurus
tatcctgggtggtgactgaaaaaagcttaacccaagatctcgcagagccgcatgtcacatcctgtctagaagagggctttcccaggcaggccggaggctccctcagcattccgtagttattgccattaggtcatagtctcaggttctttgacagacaggtaacatacagagaagtacaggttacggcatgcagtgctccaa

SEQ ID NO: 18660 - DNA, 201 bp, Bos taurus
tcccagaatctgtagtgcctgggtataatagatgctcaataaaccttaccacaaacaaaaaaagtaaccttgaactcagatatgtatgtggccctttaaaactaggctgatgttcccccaaagacttgcctgggtgtcacctatcacaaaggaaacttgaggcaacacaggcccactcagttaaaacacagaggaaaactg

SEQ ID NO: 18661 - DNA, 201 bp, Bos taurus
ctggggaactaagagtgccacattcttgtgccccccgtgagaccgtgtgagagaggacggcgcggagcaggaaggccagtcgggggcccgtgcggctcagcgttaacctttgtgctccagatttccttttgtgctgttttcagtgtgctgggaagaatagccccacggggcagaggcacaaccctccttgggtggtggcct

SEQ ID NO: 18662 - DNA, 201 bp, Bos taurus
ctcagcggctcacagctcaggcctggcaccttgaagtattgttcctgcacttgcctggctggtgctgctggctgttgattgtgagctctgctgggactctgcactggagtaccctcctcgtggcctcttcctgggccttggactccctcacagcatggcagcctcaggacttcttccatgatggcctcaggttgcagagtg

SEQ ID NO: 18663 - DNA, 201 bp, Bos taurus
gtacatgaatgttcacagcagctttattcataacagtcaaaaagtggaaacaattcaagtgtcaatcaactgataaatgggtaaataaaatatggcctactaatacaatggtatactattcagtaatataaaggaatgaagtgctgatagatggtacaacatggataaatcttgaaaatactaagctaagtgaaaaaagga

SEQ ID NO: 18664 - DNA, 201 bp, Bos taurus
cccagccagctcatggagcacctgcaggcctgggtgggctccagtcacaggagtctgcagaaagaaaaggcaggaaggggaatcaagaggctggcctgaatagggacaaagccatgactctgtgggggtgtgggatcacattgggcttcacagccctctaggtaaggggcctaaggcagtgccattaacacaataggcttt

SEQ ID NO: 18665 - DNA, 201 bp, Bos taurus
agatgccagcacagcttattaaatgaactgaaaaaaagttcacagaggctggagctgtaggaaagaaaaggaaactgcaggagggggagatgaagaggcgtgagaggccggatgacacagggctttaaggaacagaggatttatgttactgcaatggatgataatgaagagactctgaagctcctagtgggccaaatgctt

SEQ ID NO: 18666 - DNA, 201 bp, Bos taurus
agtaattccagggtcctggcgcagatctcgtgagtcagtgaggaagtccagaggggagtcctatgcacccatcagtagagggactgcaggcatgcaggttgtgtcctgtatcacagcagcccccaaccttttgggcaccaggaagtggtttcgtggaagacaattttttccatggacttagtgagggtggatggtttgggg

SEQ ID NO: 18667 - DNA, 201 bp, Bos taurus
agagtaaggaatggccttctctatgtcatttcaaaagggcttaacttagtggttgttttaggatctgccctgacccttaaaagggctgttggcagcaggcgataccatggccctgacgtttcctgacgtttgactaaagtttttctttagagtatgattagcctggttccacttttcctgaggactgaggtctccaggatg

SEQ ID NO: 18668 - DNA, 201 bp, Bos taurus
aactcctaattccattcctttgcattcatgctgtctctatcctgttggagacttggaatagataaaactgtaatattacaatactgtaatattgtaaggcgatgaagaactaccttaagacacttcaactttgagtcccctcttctgcctagctcaggagggccaaggttgatttttccccacacccagatgtaacttatg

SEQ ID NO: 18669 - DNA, 201 bp, Bos taurus
tgctaaaacaaagctataatactgctgagtagacagagttatagtttaagtatctgaaatatgaggatattaaagaaagaaaaatcctggaagaaaatatataggaaggcaataaaatacaaattaaagctcatcaaagcagaggaagaagaacaatgtgatcaaaggagagattagctcactaatctctatgttgaccac

SEQ ID NO: 18670 - DNA, 201 bp, Bos taurus
acccctctattgtgcagcccatgaagcccaattcccacgaatccccttatataatgaatatccccaagaaacacaggccctaggcaatgccagttactaccattctctgtgctaatgcgccacctagaggtcagcgctagctcaaacgattgtgtgggttcgtctcaccatttgcctcggcccagaaaacgtggaaaagaa

SEQ ID NO: 18671 - DNA, 201 bp, Bos taurus
ttctctagacagactgtcctggggaagtctggggcaaggccagagtttcttaaggaacattgttgaagaagtctcaagtcttcctgaaggaacaggaggcatctgaaaaatttgcccaggccccggcttgtttgtggtgacaattgctttggcggggtggggggtgtgtgtgtgtgtgtgtgtgtgtgtgtatgtgtttaa

SEQ ID NO: 18672 - DNA, 201 bp, Bos taurus
atccagcatatataaatagctcatatagctcaacattaaaaaacaaacaacccagttttaaagtaggcagaaccgtgaagaaaagctacagggctcaaaatagcctggagttaaaactcccctccagatcctccccactattccatgcaaaataaagaactctcacccgaagaaaaaaaatggacattaaggttgattaca

SEQ ID NO: 18673 - DNA, 201 bp, Bos taurus
aagttggagggactgtggtccacatgggacactgaagtgtaaattcggagagatggagcctgctagtaatggtccagttgtggccttgaaaagcatggctgagagcagcacagaaagttgtctgaagtgattaggataaagttagggggaggttagcgtgtcgaatgcatgggtgtgagcagtttgcctcaggcccttggt

SEQ ID NO: 18674 - DNA, 201 bp, Bos taurus
ccttgccctgcccctagtcacaggatgaaatgaggcaggggatagaggggagctatcctgaggctggccacctagctgtggggtaaaggccactctcccccgggctcctggcagctgttatgctgagccctggtgcagctgtttttgcagcagctttcacactgacgcagaaaatagaagcagtgtcaggccaacgctatg

SEQ ID NO: 18675 - DNA, 201 bp, Bos taurus
agtgggcatctgattactattgaggtgagatacttccgatggcaagaggacaaagggatgctccattaatcctccaagagagaaacctgaacttggggcctatctgtcctgtgacctccacagtcacttatccagacgcgacagctataaagattgatggatcatgtgttttgggggacttaggagcagggacaagaggca

SEQ ID NO: 18676 - DNA, 201 bp, Bos taurus
ggtctggtggttaggactccatgcttccactgcaggaggcacaggttcaaaccctggttggggaactaagattcccacctactgcctggtgcaggccccccaaaataatttgtctgcttcaccaagtacccaccacagcttctttatcctggcatgtcaccacctctgtggactttgacctgagcgcttaccctctttagg

SEQ ID NO: 18677 - DNA, 201 bp, Bos taurus
gaagctagaaagggtgcgagaaattcctcctggatctctatttgaagtctgaagtcatgcctttgggcccagagttaaaaggctgccctgaagtggccactttggaaaaaccacagagatggacagagctgccagaggagccccagctgtgagacctatcaataaagaagataattccagacagccaccatttgactgcat

SEQ ID NO: 18678 - DNA, 201 bp, Bos taurus
agtgggaggcttgtctttaattattagctctgtaggcattacctgctggttcacagtctcactgaggcagcagaatcacccgggctctgactgggcttccagtcatatgtcctctggacagtgtggtagggcacaagattgggagagcgagagtgggaaggtgtatatagttattttccactcactcagttacagagggct

SEQ ID NO: 18679 - DNA, 201 bp, Bos taurus
atgtgaaagagattttgataaacttttaatgaccacccccacccccaaaggaaaaactttcacaccttaactttgacagcccaagttgaacatgtctacagctttgtagcatatggtctccagctcagggctgggtacccaaaccacactcaatgctttcttgattataataacctagttttccctgcattctaagccttt

SEQ ID NO: 18680 - DNA, 201 bp, Bos taurus
agaccaccctggaggcccattctgtctaatatctctgcatttgtttcagtgttctgcacctgatgtggcagctgggtcctggaccttcctgaagccaggtgtccaacctctaggcccagggtgatctgctcacactgaacgctcacgtggtacacaggaagtactgtgtgctgactaattcaggaaagtaaacgaaaccac

SEQ ID NO: 18681 - DNA, 201 bp, Bos taurus
gtctagttcagcaaatccaggaaatttggcaaccagggatatgctctataagtaaatccaggcaagtataaaggtctgattaatggacaaagtgctgtgtgggcaattattattcattgactcaaattgaattaaactgacccaggccaactgttgatacacagctgtctctgtccagtggccagctcttccactcaagtg

SEQ ID NO: 18682 - DNA, 201 bp, Bos taurus
gcaaatgcccttgttgctgttcagtcgctggcaaaggctcttggaaaatgccaatttctagtttacaggcaagtgccaatttgctgacaagaaatcatctattcttaaaggggtgggctgaaaaaaattacaagtggttttaaaattttttttatttattttttgtgtgctgggtcttcattgctgcatacgggctttctc

SEQ ID NO: 18683 - DNA, 201 bp, Bos taurus
taacccatttggccaagtcagttccttttcacttgttctcacctaaaccatccctgcatagcccttattacaggtgtaatacctaaagccccgctaaactatgagtgcaggggccatgtctagtttggctcattatggtatcaacacctagcacatcgctgggaacatagtaagaactcaaatgtttgttcagtgaaggaa

SEQ ID NO: 18684 - DNA, 201 bp, Bos taurus
taagaaattggcagcttccacctcctgtctcttgaaatggtctctctgggtaacctgagccatcgcatacaagtctggccacccagatgtgaactgagctgtggagtctagttgtctggggagtgcgtgagcttagcttgccaactgttctcactgaggtgccggtcatttgaatgaatgtgagtaagcctgccttgggcc

SEQ ID NO: 18685 - DNA, 201 bp, Bos taurus
cgctgtattcggtcatgtcaacctgtgcagagctgatctctcctagtctctgcctgaggcaggtttgggctggccctgttgccaggcctgacagatccttccagaggcagattccagtttttatccctggtgtgagcatgggcacctgcaggctttgctcttaagggaggctcggtttccccacctggagagctaagcagg

SEQ ID NO: 18686 - DNA, 201 bp, Bos taurus
gaagtgggggagggacactaagaatgtcatctagagggccatcctgctgccagggacagttagaagaaggatggagaaacaaggcctgagaactggcttggggtgtgggggcttaggagactgaggaactcaggacgaacaaagcagatgagggtgggccctgggattccgaccccagcctcccagcccctgaatggagct

SEQ ID NO: 18687 - DNA, 201 bp, Bos taurus
ccttcttcatggccctgcccccaaactccagctgggtgataaggctttacccacaatccctacccctgggtataagacagatattgagatttcctcttaactcagaaagcaggacttaagtggaaaatgatgatttttttttctttcattcagaataatttggttatgcaaatattcaaacagtaaagttgttgctaaaga

SEQ ID NO: 18688 - DNA, 201 bp, Bos taurus
tcaaagagtttcatgctttcatgcattcggttctgagaaagaaacaaaggatgatataggtcagtagcaaaaactaaaagtagattaactattaatgaaagagagaccaaaaagagtttatttcttttcttttctttgactatgccacacagcatgcaggatcttagttcctcgaccagggattgaacccatgcctcctgc

SEQ ID NO: 18689 - DNA, 201 bp, Bos taurus
agctggatggttcaggctcaaagtgtctcatgaggctgcagtcaagatgttggccagtactaccatcatctgaaggctttattggggctagagaatctgcgtctaaggttgttctcacacatggccattggccagggaactcagttcctcgccaggggggccagtaggctgtttgaatgtcattatgatctggtagcctcc

SEQ ID NO: 18690 - DNA, 201 bp, Bos taurus
cctatttgataggattctgaaggtgggccagtgtgatcacatattgaagtgtcggatgaagtgtgtgatcagatatcaagtgtgggtgacttaacaggatacctgctaaaactgtggtaggccagccaaagacaggacagggttcaggaaggtgtagtcaaaagaggacacaatctaacttcagtttggttaaggagagtc

SEQ ID NO: 18691 - DNA, 201 bp, Bos taurus
taagacattgaccacaggagcaccagctttcttggaaagttctttactggctgtccttaaagcctggggctgagagctgaagatgttattgttgttcagttgctaagttgtgtctgactctttgtgaccccatatactaaagcaccctaggcttttttgtcctgtactatttcctggagtttgctcaaatttatgtccatt

SEQ ID NO: 18692 - DNA, 201 bp, Bos taurus
tgattatggtcatgtgatcatattcagacgatggctaaggtggtctagaggttcagagacagctttgctcacaaggctggttcaacagtaaacacagttgggaagctggtatcagctggtcccctctccctctccatgtagtctcagggcctttccacaaggtcacttacatagtagtttgtcttttttcatgggggcctc

SEQ ID NO: 18693 - DNA, 201 bp, Bos taurus
agatagaagaggcatcaaccgttcttcccctaatctgccatcccagcctccattatgaagggctctctcagtctagccattgagatgtctccaggtggctgtggagagcaaaacaagtgatgttaatgatctccttgtgctctaacattggttctgggctccaaaatgcatttgctttgtttattttttacgacagtcaaa

SEQ ID NO: 18694 - DNA, 201 bp, Bos taurus
atgatattcaggataacattgctatcactaaaaataggatgagtatttcagcttagtattttgcacctctaattgaggaattcttggttttgaaggctcaaggatctctgcagatcatgtaatgatataataaaagggatgaaaaccaaagggtaagaatgggaaaagagtattactgacagctaacatatacagttagat

SEQ ID NO: 18695 - DNA, 201 bp, Bos taurus
attttattattttgaatgaattttgaaggttaaacatttcaatgaaaattaaacaactggatctgcacacagcgaagctattgcccgaggtatctggtgtgctgttacaaggaagttttatgatatgtattgtttatctcaacctacatcttaccatatcttagatgtctgctaactaagattatttaacttagtctacaa

SEQ ID NO: 18696 - DNA, 201 bp, Bos taurus
tgatgtggtggataggctgctatatatatgatctagtattatagatacaaactttaaaatgagaagttatttggaaaagcagatctctggttcaagagaaaggggtatagatttttgatgattatagatatagctatagagaaagcacagagtcggacacgactgaagcgacttagcagcagcagcagcatagagaaaaca

SEQ ID NO: 18697 - DNA, 201 bp, Bos taurus
catgtgttttatacctggtctaactagaataactatgttatccttaataattgagttttgtcatagtgtaggaaaatctattctctacctcatagtcctagaatttttaatcttggttacattttgaaaattttctgacgatatttttgtacaaatattgattgttagtttcctccttcagaatattgttatgcttacatt

SEQ ID NO: 18698 - DNA, 201 bp, Bos taurus
gtttttataataagctattatctgcccccttcaaaactactctgaaaggaacactgctctgccagtcaagctgaatatattgtttatttttcttatgttatgtacatgctttgtacaattcataaaacataataattatagaaaagaaattacacatcaaataacacatacaaaataagtgaaaaacttttatcctatact

SEQ ID NO: 18699 - DNA, 201 bp, Bos taurus
gatcaccaccctgcttggttacatttcctttcgtccatgtcatatatggaattgaattctatcctgaggtctcttgcacttgttgtgatacttcctgaatgaaacaattttttaaatcactctatctactgttgagttccagttttctttaacaattattagctatatatacaaaaatcattttagcaataaaaataatta

SEQ ID NO: 18700 - DNA, 201 bp, Bos taurus
ctggctggaaaccttttagaaaagcagaatattgaaggaactgtgtatgctgacatttccactgtgtatctggacacatatgcatcttttgaaacaaatacaataacccatttactagctagtatgtacaccttgatgatgggaaaagaccctgatgatgggaaagattgaaggcaaaaggagaaggggatagcagaggat

SEQ ID NO: 18701 - DNA, 201 bp, Bos taurus
ttcttcaaaatgcatatgtgcctacattggctattatctttctaacatcaatttattcttctaggcatgtattaacatggaataaatctttggtatgaggaaatgagccctgatagaaaaactagcacaggagatagagagcatgacattaattaaccttgtgatgtgatattgatcccactcatgtaacttcactgaatc

SEQ ID NO: 18702 - DNA, 201 bp, Bos taurus
ggaagctatagaaggttagcgttgaatcagcccagaaagctttctggatgatgtaaagtgccattatacaactgtactgttgatccattataaccccattcgtcgagtgttgcttaagtgtctattgcaaaggtaagtttggcttaactctatggcaaagctcattagagtagcataaaatttttgtaggataaaattctc

SEQ ID NO: 18703 - DNA, 201 bp, Bos taurus
tatgaaaaagtctgtatcttactgagtcattataataattaaatgagaaattgtctctgaagcaattaagacaatgctaactcagataatcagtgtattacgaagttcaataaaaataagttatttgtatagtgaaataatgttgataaaatatgtcccacttcttaaccaaaaatatgttttataaaaatattccattaa

SEQ ID NO: 18704 - DNA, 201 bp, Bos taurus
aaaataaatagtgtggacttttccaattttttcttcagtatcttctccaaaatcacaggatatcaattcacataataccccagaaaaacccagatgtgatggggtaaaagaacactgctggggttaaacctcagttaatgggcagaagaagctggtagatgaaacttctaacctatcttttggaagaaaatattggaaatg

SEQ ID NO: 18705 - DNA, 201 bp, Bos taurus
aaacgaggaggcctacactaccaatgagctaaaagaatgcagaggaggaggagcagagggcagagatgtgctggtggatgtgcaaactagctcaaaacaatgcctgatttgtagcaatggcctaattctgtagtgtgtaaatgcccctaccattgccaattacaaactgctttaccaacttcaagtgtgatcactgaaagc

SEQ ID NO: 18706 - DNA, 201 bp, Bos taurus
cattaggctccacagcctggagttactataccaggaagccatatccccagaatatctggctttgacggtgagtgggtatagatacagcaaagttggagcactgtaggaaacagagactctgctcttaaagaatctccacacactccaagttccatttcaaagacagtaatttgaaagaagcctgggttagaccctattggt

SEQ ID NO: 18707 - DNA, 201 bp, Bos taurus
cactgctgctgtaaccaaatccttgggggccatcttcctgcccttccccaagtgtcactagttcctgaaacaggctgctgtggctagaacctagggtcacagctgcactctagcttcaaggccatctgagaaagtcaatagctggtctttgggtatcttttacatcaagagaacatgtttgcaaagacacattgtttctcc

SEQ ID NO: 18708 - DNA, 201 bp, Bos taurus
acataaattatgtacatttaacatatactagttgtacatttcttaggctatcagcgaatgagattttaaaaacaaaaaaaaactgctgaatacttgtctgcatatttttgtctcagagttcagtaactcaaaccctgcaaaattagtttcataaggccgtattgtgaatataatatgtagttcatatgtttctgtagtgca

SEQ ID NO: 18709 - DNA, 201 bp, Bos taurus
ccagtattctggtctggagtattccatggactgtgtattccatgggtcacaaagagttggacacagatgagtgactttcacttttcactttcagaggagactgtcaggattgtcagctggtgccaaaaacaaatttaaataggactgaaatatttctgaaaggcttttgggatgaagaaaacaagcgttcaatcttataaa

SEQ ID NO: 18710 - DNA, 201 bp, Bos taurus
aagtgacagcaatgctctggcagatgcaggagattatgaggcattagtcaacagtttgggggagatgtactggtccagtgaaggacatcttggaagcacacggacagcaccctctatgccatttctgagacagaatttcaagccatgcttgcaaagcataatgccatctactaatttggggccttttcctccatttgcatg

SEQ ID NO: 18711 - DNA, 201 bp, Bos taurus
aattctgtcaaggagtagaatagaaaacagaaacaactctaggcattctattcaaaaagagaaattaaatatagggagccaggcacttaaaaagtcgtggcaagtttggactccaggctgggtctcctgaaatgatccctgataaagtgcagaactgatctgagagggagctgttcattatcctaagatcagaaatgtggt

SEQ ID NO: 18712 - DNA, 201 bp, Bos taurus
tgctgaatcttttttcaaattcataaagaaagtctctcaggatatttcacagtgtgagtatacacagcctcctttccctgacaggtcattattgaatatcatgctgggtttgagtacagggctggtgagtggcttctctccctgcttcttctgtaaatgtatgaggggttcaagctttggaatcttaaatgtccatgagag

SEQ ID NO: 18713 - DNA, 201 bp, Bos taurus
gcctttggaaaatgccaatttgtggtcaacatgaccatttaccaaaacctttatttctgggaattaaagagcatataattattttaattggttactaaagtaaataggaggaaaaacttaattacttggcaatggtggctttattgtatcaacactaacctaacaaatatatcacttctgaagcaccaatactttggccac

SEQ ID NO: 18714 - DNA, 201 bp, Bos taurus
gatctgtaggtggggacattgaaattaagtcagagaagggttcaagacaaaaataacactgtgatctagggaggcagtgatgcattctgtataaaagaagttgtattttattcatatacattactgaaatattttaaagtgtgtttttcagggcagtataacttctttaattcacttgagctaaaaaatagctatgatgat

SEQ ID NO: 18715 - DNA, 201 bp, Bos taurus
ataaggaaaataagtaaaattatacgcaatgagtatgtgaattaatttcttctactgtcattaactacatggaaaatattcagtttggtaaacaggcaaagtcaaacactgtcttatgtttatctttaaacaagcctatcattacacattttaactagcttttcatgagacactgatcacttattactttctcattcaata

SEQ ID NO: 18716 - DNA, 201 bp, Bos taurus
aaatttggttaaatatatttacccttttggggagcacttagtatattctttttgtaatattacttatctgaatatttctttccttgctaattagttcatggattttctcaggacaggaattatgtcttctatcgttttgaatttcctccctcccctgtacaaaaatgcttgcaattatctttgtatgtaggagcagataat

SEQ ID NO: 18717 - DNA, 201 bp, Bos taurus
ttctcacagggtggcccccatgggccaccaagaagatcaggagcactttattagaaatacagtgtcctgtttccaccttacccctttaatcggaactcaaggagaggggcccagtctgtgtcttaatgagctctctgggtagttctgatacatgctaatgtttgtgaaccactgttctagtccagagtagacaatgctatt

SEQ ID NO: 18718 - DNA, 201 bp, Bos taurus
ttttagttgggtatttaatttgtaatacaaactatcactctgctgaatgccatttttcagtttgtccctgacttacaaagatgtttatttcttgtttcctctcttgttttccagtttgaacaaattctgcatccagaatgaaatcaggcatttttccatgatcatacttatcattttttaccacatttttcattattattt

SEQ ID NO: 18719 - DNA, 201 bp, Bos taurus
aagaaagactcaccttattcttctccatccaactctctcctatttctatattatttgagtctatccaaactattcatttgtggatatttagcagactattctgcttcatgtacagatgaatagagcttggatttataaaatacacttactatttgggaaaagatcatcaccaaaaaaatactaaagtgttacattagtaat

SEQ ID NO: 18720 - DNA, 201 bp, Bos taurus
ctttatgcacttcatatgtttctagagatcttcccccaaatagtcttctagttagttccaaaattttgtgattctgtgcacttcactgaacaaacacatacttaatcttaaattatgcagttacagactggtattgataattatagtagtattgtaaagtgatttctatattgacaaaatagatatattttaattgggggt

SEQ ID NO: 18721 - DNA, 201 bp, Bos taurus
ctgaacccaccttcttcctccctcctcataccatccctctgggtcgtcccagtgcaccagccccaagcatccagtatcgtgcatcgaacctggactggcatctcgtttcatactttgtgtatgtatttgattgaaagtcaaagtgaaagtcgcttagttgtgtctgactctttgtgacccatttgattatattcctataat

SEQ ID NO: 18722 - DNA, 201 bp, Bos taurus
tttagccataaaaaatgacaatatattagcatacactataacttggctggcccttgaaacatattatgtaagaaatcaaacataaaaggccacacattgtgcaattccatttttatagtatgtccagattaggtaaattacatagagacagagaaagatgagtgttggccagggactgggggagggagaaaatggctgctg

SEQ ID NO: 18723 - DNA, 201 bp, Bos taurus
tggtttagtcgctaagtcatgtctgactcttgtgaccccatagactgtagcctgccagcctcctctgtccatggggattctctaggcaagaatactggagggggttgccagttccttctgtgattctatggttaggcaaactaaaagaatgtattttaccataatagaatagggaggtttgcttatgcaaaagaaaggagt

SEQ ID NO: 18724 - DNA, 201 bp, Bos taurus
atttggtatacagtgactagatatgaattaagttattaagtaaaatataaagtaaaatcttggcaatacaaaattcttcattaataacagactcacttgaaacactgaggtgaaagcattgttaaatccactatacatttcctttccttcctaaaatgagtccaaataacatgagatagcttttactttatgattcaatat

SEQ ID NO: 18725 - DNA, 201 bp, Bos taurus
caaatacaccaagagatacatacaaaatcattcactagcagtattgcagtaaaaacctcaaatgatacaaatgtctgtgatacgtgacaacttgacagcatattcatgcaatggtattctataacatattaaagaagttattatagaaccatgcagcagtatggatgaatctcaaaaacataaaatgtatgggtgaaaaag

SEQ ID NO: 18726 - DNA, 201 bp, Bos taurus
ggccacactgggtttccccctggcatgtattctttcccagtctacattgctcaggctccaggttgctctgcaggggaactatctaaggtgggccctgagttgtgtgcaattccaggtctaaaccactcaggttcaggttcttgggtactccacaaaggcacagactcagttgggcctgcgttttgtgcccttcccaggtct

SEQ ID NO: 18727 - DNA, 201 bp, Bos taurus
aagaaaaagaggaagagtattgaattttagagttcaaagccataaaacagaaaaagcactggtagcctctaagctgttttctccactgagttgcagcccacttctcaatcagcaagatgcctggagatccagaatgtaagactctcaaattctcggcagatcagctatttgggaaatatgagcatagcgactgcttaagga

SEQ ID NO: 18728 - DNA, 201 bp, Bos taurus
tttcaataggcagtatataaatgtgacttttgcttttttaatgtccacttttaagtttttgcaactatattaactttttaaattataattcaatattgtatgtgtatggctagaatgaaaagcaacagtcacctcccctgcacccactggcactaacaagttagaggaagaatttcaaaatggcaaccaccagcattggcc

SEQ ID NO: 18729 - DNA, 201 bp, Bos taurus
ttaactcttgatgatttccagtatgcccattcaagttcaaggtctttgcaggccagttgttactagccaaaaagtgcctagtattctggccaaaatgccccgtggttttgctgattgaccaaacgtgtcacagtgtacattttcagatagatagaatgttttccttagatctaattctaaaacatcatggccaccattgtc

SEQ ID NO: 18730 - DNA, 201 bp, Bos taurus
acagtaaaatacgagtctcagcagaccctaataaactgatcgttcaaataggttgcttgtcttttcacctagtgtgcatttgtttaggccacagagctccgcaataagagacttaaattgtattcagtgcttaaatgggagtaataaaaataagtgggtgggccagggattgaagccatgtatttaaatgaattttaaacc

SEQ ID NO: 18731 - DNA, 201 bp, Bos taurus
tccaatgaatcaaggagacagtatagggttaggggagatgtagcctccttcaactgactttcaagttatcagtctatgaaaaatgtctctcatttgtttagatgccttcatgtatctgccacatctgagtcattaagttctctctagtttcagaaaagataatcaatattctcagccagggatgtgcccaattgtttctca

SEQ ID NO: 18732 - DNA, 201 bp, Bos taurus
tgaatatcaacttttaattacctatctcttatcaatcttctccttcaatcctgctctccatgtcccctggctattggggtgcatcaggaattgccagagaaatatgatactactgccctccctgacttttagcaccatttccacctcatcctcttttatttagctttaggagctatgacagaggtctgcagtagacctatt

SEQ ID NO: 18733 - DNA, 201 bp, Bos taurus
gaacagattgaatgatgcaatttcttcactttttaaaattaaagtaaagttacactaaaagtccacactgtcatttgaaaaaaaaaaatagttgcttctacctaagaatacaaatcagatttttattgtttcattacattttcaaagcccacatattttgaatactatgtgaaatttctacccatataaagtgcaggtatt

SEQ ID NO: 18734 - DNA, 201 bp, Bos taurus
ttttcacttgaggaaagtggcccccaaaaaaattgctctgaaagctaattaagctgatgtccatgagacccaaatggccatagtaaagaaatagttcttaccttattttattttcagttcagttcagttcagttgctcagtcgtgtccaactctttgtgaccccatgaacctcagcacgccaggcctccttgtccatcacc

SEQ ID NO: 18735 - DNA, 201 bp, Bos taurus
tccagagagcacaggaaaagcagggcagggcatccctggcaggtgcttcagctctaggaggtcaaagtccactatgcaaaagggccagcagaaggtagtcaggaaaccaggataggggaaatgtttgaaaagaacttaggcgtctgattcagcagaaattccgtgtacttcctggctaaggccagaattgtttttgtggtg

SEQ ID NO: 18736 - DNA, 201 bp, Bos taurus
aataaaatcccatgtgatttgattctagacaggagggctcttcagggaggctttcctcaaggtggtaactcaggctatttctccctggggccctgccttctcgtggttttaaagttgccagcaggtgtttagaggatcagttcagaagtgacatatcacttcctcccacattgttgacaataactagtcatgaggcccact

SEQ ID NO: 18737 - DNA, 201 bp, Bos taurus
agttttcaagtattgttgatttcctttgcaggttgtatatatatgttctgtctttttcattatatttgtcaatgtcttggttctccctttattatctcttgcctggactcttcaagtagtcttacaaatgtcttcagcttctctccaaccccttcaattagcttccaaaatctccagtttgcctactgaatagattctaaa

SEQ ID NO: 18738 - DNA, 201 bp, Bos taurus
atgccagctgggggaaatgccagagggaaaggggttgggggtatcttactttctggctggtccttagctggtgggtagcagaggaagggaggccagcaaatacctcctcagcagcagcatctgcggtcctgcaatcaacaggagaaactcagctgggatcagcgccaggggcaagtgcctccttcccagtgcagcatccac

SEQ ID NO: 18739 - DNA, 201 bp, Bos taurus
aatggaacaccctaaaactgcagacataacatgacaacaaataccccttgagtgtcacaccaagaagaaatttaaatgccaccaaagtctactatacttacagtaatcaaggataagcagtagatggaggtaggagtgggagaattgaacgaagatggtcaaaaggtacaaacctccagttataagataaacaagtactgg

SEQ ID NO: 18740 - DNA, 201 bp, Bos taurus
cctgtctttcccctcaggcctccagcagaagcccgtagccagctagctcagctgtcatgccagcaacttctcaggagctataaggcccagctgaagggagtgcttgactctaagttagagatgctaaccatttctggtagtgaagaatgaagagccaggtgtcctggattcaactccctgctctgtcacttgttagacatt

SEQ ID NO: 18741 - DNA, 201 bp, Bos taurus
tcctttaataaattacatcttattccattgttctataatatttatgaaatgattagtgcaataacatcattgaagtatcatttaaaaggcaaataccctacagatttggatttgtcatcccgattccttggcattcaataatataagtgtctttagaggcatcttcttcatcttctgatttcttcacagtaaatttagcct

SEQ ID NO: 18742 - DNA, 201 bp, Bos taurus
aaccctggtgaccctagacctttgttccatcattaagcttttgaccgatacttggtgccttagtctgtgctggtgatggggggagaaaaaaggatttcagcggaatctaacccctgatataaattagtcctcctattccttgtgtatgtcatcgtccacagcacccgaaaatatgtaaaccatatcttcaccattaagaag

SEQ ID NO: 18743 - DNA, 201 bp, Bos taurus
ggtgagcctggtgataagttttcagtgtggtttccaggccttgagagaagttcagtctggagatttactatgaaaaattccagcagagtaggtttaaaagcgcctctatggccaaccactattcttgctggacttatacagataatcaggccaagcttattgaatttaaacttactttgcaaacaaagtagtcttaatttg

SEQ ID NO: 18744 - DNA, 201 bp, Bos taurus
aggccacggtaagtattttggcttcttctctgactcaaatgagtcagtgaacagcttagagcagagtgacaggacctaacttgtgtattaaaaataccatcctgaagatatctgcttctggccataatggagtaattggtactagacttgccctctgctgataaactaaatatgaaacagctgttctcaaaaataggtaga

SEQ ID NO: 18745 - DNA, 201 bp, Bos taurus
attagttcttagaataatacaaagcagacttcttcagggagccttccttgattttcctggccatctccaactccccattatggaggcccttattagcctccgtatatctctttattaatgcataatatagcagcaattttacatttacttgtgtgattagtgaggccattgagtagagtatttaaaagcaaggatttaaaa

SEQ ID NO: 18746 - DNA, 201 bp, Bos taurus
agtcatcagcctcttttgttggatgtggggcatctcctctgcttgctgaatcattgatcggggatgaggtatcggccgagctgggctgatgtgattgacactgttacctctctcctctgcaagtccattgtccatgttgtgtatggatccattcacatcgttacccagtccattagctttaatttttaccctttcttgaaa

SEQ ID NO: 18747 - DNA, 201 bp, Bos taurus
agttgcaagcagaagggctgaaactctcagggccactaatattctctaaggcattaatatgcaaattaggaaattaatatgcaaaccaggagagctccccgctcctacccggccaggtcagtgcacagcttgggaaggtggactgcacttttgtgcagagagaaacttcgtccagacagaagcagccctatgctagggtgc

SEQ ID NO: 18748 - DNA, 201 bp, Bos taurus
gagaggctggccctgggtcatggcattctcaccagttccagtaaaaaaaattcccaaggtctcatgtgtagcacagaacagatgaaggccatgtgacacaatgtaggaaggaaaaaatgggcttttctgcaataaccaatgtgcactgaaggctggataggcctttgcagtgccttgggacagaataagacaccccactta

SEQ ID NO: 18749 - DNA, 201 bp, Bos taurus
ttccaataagcaaatcttaggagacactggcttcaaaatggccacctgggtttaagtagtttagcaccagccattcctgtcaggtactcatcgaaagactctcattctacagtaagcaaaaaggcccaaaagaagcctgctgccaacaatacaatgaaaaatcaacccactgaaagaagatatttgcaaatgatagatccc

SEQ ID NO: 18750 - DNA, 201 bp, Bos taurus
ttgatatttttttttctcttattcatagagaaatttaccgagcacttctaattttcctagtactaaagcacataaggataaatgagtcagatggcttcctgtcaaggaaattacaatccaatagaaaagagtcactagtaagtcaacaataatgatagattacattaaagtgatgacagaaacaaataagggatgcaaaga

SEQ ID NO: 18751 - DNA, 201 bp, Bos taurus
tctgatttcagctcattgacaagagatctcagggccaatgtcaagccaaatttaagtaatttctaattgcttggaaaaactcagaattgtttttcccctcaaagagctattcatttatggaaatgtttctaatgttcctaatgtaagcttgtacgtttatctctaaaagagagaatatttcctgtgacacctctgcttgat

SEQ ID NO: 18752 - DNA, 201 bp, Bos taurus
aaacagaaacagaaatgcctttataaagcttataagcaagtcagggactcaggtggaagtatagttcggagtccttaccattaacatttcactataaagcgcatactcatgtacaacaggaagcagggcctctgagaatccagacatccgtttttcagtggccttacagcatttgtcaatgcagctggcaacacttttcag

SEQ ID NO: 18753 - DNA, 201 bp, Bos taurus
caggcaagagtaagggagtggggtgccattgccttctctgaaggaaatatcagatagtgacaactcacacaaaggaaaccacttgaatatgagacccagcgtcacttgaccaccagtataggatgcctcatctaaacaacaaacaaaacaaaaatacaaacccaatcatcagcagacaggattaccacctcactcagcctt

SEQ ID NO: 18754 - DNA, 201 bp, Bos taurus
ctttaaaactaatgtaatctttgcatcgatgacataacatttttgaggtaaatgttcaaaggtgctcataagttctgtttcagtatgttagaatgctgttgttgatggagagccaaagataaggcaacaccaagaaaaatatgaaaagaaaggtttaagatgggaatattttggaacatttgttgacagagcacagaatat

SEQ ID NO: 18755 - DNA, 201 bp, Bos taurus
atctgtatttttagtctgtaaagtctctattggatgttactgttacttaagcaacaatccttgttctctctcaatctctctctttttttctctctctcaacatgaattaaatgccaaaattttcaaataaggaagaactgatttaacttccacttaagagagggtaaagcatctgcctacaatgcgggagacccgggtttg

SEQ ID NO: 18756 - DNA, 201 bp, Bos taurus
atgttttccttttatttcttccctgatgccctgaatgtattaccaggcattttaatgagatgtggctaggtccagccctggccaataattaactccttcccctctgtcagactgttagcattttatggcatttctagcctctgggagcttaagtgtagggcctaagtaagaaagtatctctggcaccgtttccaggataag

SEQ ID NO: 18757 - DNA, 201 bp, Bos taurus
caaaaatcacactaaatagaataaatataaaatatttaaatgagactcaaaagaagagagatattccagattgaatttttgcttcatcagaatttaataatttgaatatttatcaaactaaaaaaaattgtccacatctggtatctatattatttaatagtgtactaagaaagcatgtaagaacatgaagaccattaaaag

SEQ ID NO: 18758 - DNA, 201 bp, Bos taurus
tcactcattttgacaagtgtgccaaaactaccagttttttagaaaccacttatcgtcccagttcacacctgtgtagcttcataaaatggcaaatatcctgaagggaaaacttgccatgtaatgtgcaagttttctaccccttgtttctcagtaggctccttgccccataagtcccaaattccatcttttaaccagcttgct

SEQ ID NO: 18759 - DNA, 201 bp, Bos taurus
ttccttccttcattttttatttatttatctcctactatgtgctggtcattaccttagcccatcgagttacaacggtaaataaagcaaagtgcctgttctcgtgggagcatatgttctggtagtgagttgtttaagtcactcagccatgtccggctctttgcaaccccatggacttcagcatgctaggcttccttgtccttc

SEQ ID NO: 18760 - DNA, 201 bp, Bos taurus
agaaactcataaaaaacatctgagagctgaaacagcggttacaaatgtgtctcactctgaccatgttttagcctctaaggaaaaatagatacattctcatttgtaggagagtaatgtagtaatttgaaaaatcaaatccatgacacttcattatgggatcatgtaggattttattttcaagatgcctcattgcaaaattaa

SEQ ID NO: 18761 - DNA, 201 bp, Bos taurus
gcacaagaaagtatagaagagatgatgattgattctgtctggctgtaggtatcaggatatggagtcagcagacttcataaaaatcaggatatgagtaaagcgggaaggtaagaaaaactggaagaatattgagtgatttgaattgttggaacttaaagaacactgctagataagattgcatagcatgctcactgtgcaagg

SEQ ID NO: 18762 - DNA, 201 bp, Bos taurus
tgtaggaactgtacacattactctgtccttaggacctaaatctgacaggaagaatttcccatcaactagtaaaaaggaagagttcctggagacatactcctcatgtaaataaacaaacatgaaatatagagagctttctctctacttaaggaagagcaaaaagcaacacctgagaacaaggaggagcatgtagaaaactca

SEQ ID NO: 18763 - DNA, 201 bp, Bos taurus
ctattgatcagtgtttttgttcaattctaattattactaaaaaggtattttcactgactataaatcttcagtgtccacactttatgtatgcacaaaaatctagaagtttattaaaatagagtctcctctgataatctctatagatgctttaatcacacattctgtgtatttaagccaacatctaagttcttgtcacatctt

SEQ ID NO: 18764 - DNA, 201 bp, Bos taurus
tcattcattttcacgggttgcaaggagtttggaatttttaggttcagaaactgatataggcttactttgacctttctcagcatgccaaatgccctccagttctctgcactggagtgtggagagcagagctgaattctcatcagtctcctgaaggaaggcaatgcatctgatctgctgaatagtttcaagccagtgcttcaa

SEQ ID NO: 18765 - DNA, 201 bp, Bos taurus
tgattacattagagtccacactctaagatccaccacagaaaataggtgtgtaataaggagttcacccaaatctccagccatatcaagttagttgcagtttactacgggtcccatttcttcagatctacatggctttgcttatcctgctttctctttccataaagctctttccttttaatgttcttaaaattccttgttttt

SEQ ID NO: 18766 - DNA, 201 bp, Bos taurus
aagttaatgagagttatatattgctttgtagttaagagatgccattttgcttttcttatgtcgctgaatacaaatttctaattttaatgagccttcaggtcgatggaattaaccttacatttccattgtcaaaaatcatattcagactgtaaggtccaacttaggtgacctttctaaagagaatttccccaaaatcttatg

SEQ ID NO: 18767 - DNA, 201 bp, Bos taurus
ccctagagaccgttttgttcatcttagctcaatacaagatcagatccattgtcagcagtaacaatttgtactatgttcttttccactgggctcaaacttaaagcatccctgagtggaaaataaatggcaatagctgtatctcagattttacatgggcatggagggagaggggcggaatgaacttagagaagagtaagacct

SEQ ID NO: 18768 - DNA, 201 bp, Bos taurus
ttccatcaggtgtgagtacccgaagacaggactgctctcagcctgaacaatttaaactgagtctggttgattaaaagaaaaggctcaagcccaaatggcactggaggcagcagatgataaaccagcctgtaacttttgggtggtgttaaaatggtcatacatttagtattatttaaatattttgttatcaagctcagccct

SEQ ID NO: 18769 - DNA, 201 bp, Bos taurus
taaagacagactagaagagatgtttagaaatgaatcaagaagtggaggaaagtgtgggaaggttaatgtcattgttgtaaaagtttagaatgaagagttactgctatgggttaagaaaaggaggttaaaaatatggtttgaaattacaaggatgaccagtagaggaactgagaataaaattttaaatgttttgcaagattg

SEQ ID NO: 18770 - DNA, 201 bp, Bos taurus
aagaaatgaaagtatagaacacaattgctgtttcctgaatctgaatattcctccctataggtctttcaaaagaagtggaccaggacaaacacaccaggaaaaattatgtttctgaagaagtaagctttcagcacttaaaatttacttccccttgtgccttcctgaagatctgtgggctcctggcaatcatctattctaagt

SEQ ID NO: 18771 - DNA, 201 bp, Bos taurus
agcagactcacctttacttgtagtatatccagtcatgtacttgtctaagtcatactgctagattatcagtgctttatggagaggaaatgtattttaatcacatttgtatcccctgcagcactttgcaaaatgtttagtatcaaaagagaattcaagaatgtttatgaaattggatcataaaaattgttaaacctggacagg

SEQ ID NO: 18772 - DNA, 201 bp, Bos taurus
atgttgttaagttttaaaaaaacagaagagaatatataatgtaaacatatagctgcatacttgcatatgaagaaaagatatatgaaagtggcttttaacacagaacaaaattattttattcccctatatccacttggctaaatcttatctggcttaaattgacaattctccaagaaatcttcctgggcctccattcaaaga

SEQ ID NO: 18773 - DNA, 201 bp, Bos taurus
ctcaattttttgcattgttcatttaagaaggctttcttatctctccttgctattgatagagtcttaataatgtctgagcggagaaggttggtatcagaaaagcacatttgtaagacttttaggatgatttaaaggggagttttgcaaggaggcgtattaattgggaatttgaaaattttatgatataatagagttggattg

SEQ ID NO: 18774 - DNA, 201 bp, Bos taurus
gaaccctgactggaaggagacagtccagggaaagaaactgtgacaatggcccccagttaaacctcttatttggggtactcttaccttttgagatggattgcgtcctgtctatgaaatgtgtatctcccagggcctctcaccttctgagatggcccacacactatctacggcatgtgtatctccctgagtaagcctgctttc

SEQ ID NO: 18775 - DNA, 201 bp, Bos taurus
ctcagaaggacacacagtgatgatatagtccctgactgcctctgagtgtgccaaaaaggaggataaaccttgctttcagatggacaaagtaataggtgataacatttcttggacctggagcttcaagctcagaattcaagtttcagatgatttgtcacagctagatccttatcagaagttagatccaccaccctcctcccc

SEQ ID NO: 18776 - DNA, 201 bp, Bos taurus
gtgggctggattatgccatccagttaaatttagattatttgtcttctaaattctattcctaaaattcttgaacacagacatgtttgcttgttaggcttgaaggatagcttgcctatgtgaaaattattggggtacagatttcccaagaaggcaatagatgctgttttctagcattgagtgtattatggcagatttaatacc

SEQ ID NO: 18777 - DNA, 201 bp, Bos taurus
caggaccaaagttctgcatacaaaggtcctcacaaagaagaatgcacattctctttccaaagaattcttttctaagggaaagtcttctttctatcctcagtgccccatactaggttagttcactggttctcacattcaaagagcaaaaaatctctacagcctcattcaaggtgtggtcacagacagttgctcactgccacc

SEQ ID NO: 18778 - DNA, 201 bp, Bos taurus
ccctcttaaggccaccagtcaaaaaatgggactgcagggtagcatgaaatcctgtctccaaaactaatggcagaaacctctttagaagacgggttacattagaggccacgtgtgaataaaatgttcccgaggatagataagcttggcaagcaatttggcagctgtctcctggacaagtgtccttcactggaggtaacaatc

SEQ ID NO: 18779 - DNA, 201 bp, Bos taurus
aaatgagggaggaaaatactggaaggtaataattcaaataaatgtataggatgtaaataatggtaatcgccaagctataatctacatggaggaactcagggaaaaaaggattactcagcagtgaacttgtatactggcctcatgttctatatgctatttgttctatctctaattttctgcgatctataatgttgataattg

SEQ ID NO: 18780 - DNA, 201 bp, Bos taurus
tctagacaggtcacttagcctctccataccttagtttcccttctagaaatagagattactattgcatctacctcacagaagggttaggaggacacagtgcttgaaatgtagtaaatcgtcactacattttaggtatttatcctgcatggaaagtcatttaagaaaatagtatcaagaagaaatagaaaaccatctgctttt

SEQ ID NO: 18781 - DNA, 201 bp, Bos taurus
gaactgtatgattttgtgacatttctgctcattccccattaggactgaatcattagttctttctggttttgcagaaacagaagcaaaaattactagcacacatgctgattaaggtaagtaagtgccatttctggaaaaatgaaatgttttattcagtgtaggtacctgcttgataatttatagtgtgttttggtcttagta

SEQ ID NO: 18782 - DNA, 201 bp, Bos taurus
atagattgtgctttgttttacttgttatctctaccccaattcccaccagttttcttcacccttgagtatatttatatatatcaacatcaaacaagtagattactacccatgtctttacctgtgaatcacattcagaggaataaagaaagcacaaaaggacaaaggaaacagtggattactcctaatgaagtcccacagttt

SEQ ID NO: 18783 - DNA, 201 bp, Bos taurus
tgctagtctgctctacccagggctaaactctaaccctgattctaattaccattattacagaatgatgaaatctgaatttgaaatttgaaaaggggccttcaattcacccagtttaactcctcactttacagataaaaaaacaaacaccagcaaggtgaatgcacttggctgagatggttccgtttggtggcccttatacat

SEQ ID NO: 18784 - DNA, 201 bp, Bos taurus
ccttttcccatttctcagtcaggaatccagagctcccttaccatctctctggtcacctggttggggggaaggggggggccttccagccccctcccaaatcgtcccttcctcctcccctactcctagctgaagaagctctgaatcaatctagtcctgaattagatttctgatggctccctgcccgaggcctctgtttatctt

SEQ ID NO: 18785 - DNA, 201 bp, Bos taurus
cctaagctccccatcctccttaaatccctgatccccgcctcttgccctctccagtccttcgccttagtgttatgagcatccgttaggccttcagcatcattctcctggtatatttgtttctcccaaatgctttcccttctctggttgagacccctcagcagggcccctctatccactctcttcatacgctcctttttagca

SEQ ID NO: 18786 - DNA, 201 bp, Bos taurus
caggacaaggatgcagtgctcagtggtgagcaggccctggatacagggctgcacaggagcgccacctgcctcccccaggccctttcggagggctctccccacgtcaacctcatctgacctggaaatcattggtggtagaaaagagggaggcaaaggcaggcctgggtgtccatatggcaaaattaaagttgtggatctgtg

SEQ ID NO: 18787 - DNA, 201 bp, Bos taurus
aagtcctaaccctaagtatctcagaatatgagtgtgtttatagatagggcctttaaagagattattaaggtaaaatgaggtcatatgggttggccctaatgcactaagactgatgtccttacaagaagagaagacaggaacatacagagggaagaccacatgaacacacagggagaagatggccatcttctacaagccaag

SEQ ID NO: 18788 - DNA, 201 bp, Bos taurus
ttcagcgtcttggtgtaaaggctagatattgaggctgtcccaaccctgagtatggaagaggaataaggaagaaagagggaatttctctggcaagctagaagattctctctgactcatcatatacactggaggacatgacatgagtaccttcaaatccaagtcagtgaaaaatgcttcaagtaggactcagactggccttat

SEQ ID NO: 18789 - DNA, 201 bp, Bos taurus
gcaatttccatgggcccaaatccttctcctgaggcctgtgcctttgccaaaatgggcaaaggatcctgtggctggagggataattggagatgcgtgggccaggcagatgtccacatctgacaagaccagcactttaaatagcctggagagaatttcagtcaggcaggaagacttctgtaccgacatcccactgttccctgg

SEQ ID NO: 18790 - DNA, 201 bp, Bos taurus
ggcagactccttccccagcccttccttcctgccagagtttgggctgacctcccccaatgctaatgaacagctcagaaatactaacaagtgccttggcacccggaatccaggcagcatcacttccaatgtgaagctgggccaagtcccggccccagtgcagtctcaggggtttcctaggccccgtggagcctggtggcgtgg

SEQ ID NO: 18791 - DNA, 201 bp, Bos taurus
acaacacatacattgctcctcactggaaggagcacgtgccacttttccacgaccacttttgattttaagacttggctaattcacaaggcctcaaaatccagtctgctttgctcttggattaactgtgctatttgaactaaaggcttaacttgttcttaatcatcttttggaaatgctgacttagagaattagtgcctggcc

SEQ ID NO: 18792 - DNA, 201 bp, Bos taurus
gctctgtttacccattctagattttttaagatcatgtattagtcatttggacaacaatgcttcactgagttcaactgcaggccttccaattgcaacacattatacaatatttttcaaaattacacttgttaatattgccacccatcttaccagaaaggccttaagcactgggaagctagcaagctcagggtagcaaacaac

SEQ ID NO: 18793 - DNA, 201 bp, Bos taurus
tttgtttagttatgtgtcaataccttattgtctccattgttttatagtgttttaatgtctgatagggatagctcctctttccaatattctttttgttcagaattttatttttccataagcacttttcaattgatttttcctagttccaaaaaatatgtgctagtattttgaaggtgatttgaattaaatttaaattaattt

SEQ ID NO: 18794 - DNA, 201 bp, Bos taurus
ctgagctgtagatactgtaggtaaaaccaaagttctgggattatacttgcatcaagtctgtaaaggaatttttaatgtattttgctactgctttatttgataattcagaaattatttttattttggtataaccattctcaaaaaaaaatgtcaattcaaatctagtagtataattagcaatccatagaaaaagatattaat

SEQ ID NO: 18795 - DNA, 201 bp, Bos taurus
catcaccgactcagtgggcctgaacagtgaaggactgggaagtctggcgtgctgcagtccacagggtcgcaaagagtcaaacacgacttagtgactaaacgacaacagtaatagccaggcacttggccaggtgctgggcacacagtaacaagacaatcacggtctctgcctacatgatgtttagcctagattttcactcag

SEQ ID NO: 18796 - DNA, 201 bp, Bos taurus
tgaaggggtgccatctggccgtgcactcactctctagtggacctttatccacatgcgagtgacctggtgagtgaaggagggaggcatccatggccctggacctggcagctccatttgttctggaagcttccccagggaagcactgccttcccaagccttttctcccaccaggccagtctcttaaaggcccaggcagtcttt

SEQ ID NO: 18797 - DNA, 201 bp, Bos taurus
gaggacccaacattaataaagttagctaggaggtagcaagcatgccacttgatgccataggtcttggagctactcaagaactcatggttctctgcccaccccaccaggatggagccagaccttgtggacagaagagttctggccctctctgaaactcagtgaggtccacagtgattcttcagcttcccctcgcaatcaaca

SEQ ID NO: 18798 - DNA, 201 bp, Bos taurus
gctgctgagccactctttgctcacagtgctgctctcccacctgcagggcaggctcacagcctgggataagttcctgacaggccaggcagtggtgaggacgaagaagtaccagtgagttccctgccctgtgggtccaggtctgcacctgtcagtgaataggcctcaaaaaactggacagtgttttttaaaaaatggacactt

SEQ ID NO: 18799 - DNA, 201 bp, Bos taurus
atttttagaaaagtataatattttattaaaagatcagagcttaaagattgtaaccagtcattactgaattttaaaaaatatacaggcccttagcatcatttcttccaaagaaatcccagggatgatccccttcagaatggactaaagctgaaactccagtactttggccacctcatgcgaagagtttactcattggaaaag

SEQ ID NO: 18800 - DNA, 201 bp, Bos taurus
agtcatagcttgttgactagatgaaaccttctaatctagaaggattagaaatccttctagaagcaggagagaagcccttgaagctaaacaaggccgtctcgggacgaatctggtaagtccagcaccattttattagatggtcagttaatatttgaaagtcaaaaaacttaaatgattcagtagtatttaggtgtttttctg

SEQ ID NO: 18801 - DNA, 201 bp, Bos taurus
gtgggtatcgtgggtgggggggacagttcagcctaatgagaatcaggcagtctcattcctagatatctgccccctcctttcttgtggaaatggtagtgccggtcctcttggttcacttcccagggactttgtggagcttagtgcagtaatgcctagaatttcagaggacagatactatcaccatcaaaggcattgcttatt

SEQ ID NO: 18802 - DNA, 201 bp, Bos taurus
atcccatgggcagagaagcctggtaggctgcagtccatggggtcacacagagtcggacacgactgaagcaacttagcagcagcatagctgataaatcagtgttggagataaattggagtgctaaaaatacttaatataaaattaggcaggcaaaaagggaaaacaaaaaataaaaaacaaatatgaagatgatatacttaa

SEQ ID NO: 18803 - DNA, 201 bp, Bos taurus
taactgtccaggaagcaaagtattaacttatattaaattttagtaagacacagattcaagttttaatctagggaaaccaattaatgattagtaaaagaacgtataaaaacaagcaaacagaggacaaaaaaatggaataatgatactggatccaaagaaagaaaggagagaaagaacacagaacagatgggacatgcagaa

SEQ ID NO: 18804 - DNA, 201 bp, Bos taurus
tcaaaaaacaaacaaaaaaaagcatgatttattaaaactgcctaaacatactatcactagtttcaattagcaggctgttaccgaacggaagcaaataaacgttaaccctaccacttactggaattcctttaaaacatcccttgtcacaattataggaataaaaaatctcaaggctaacatacctgcttggattttctgttg

SEQ ID NO: 18805 - DNA, 201 bp, Bos taurus
gttcgtatttctttataagcatatagaaattgaaaatggcccaaatctgggactgcagattcctgctcatttatgacactgtgctttactaaattaatgtataaacaggggcaaaattctcttgtaaagctcaggaggcatttgcacagtgatatatacaccagtacatgtatattatatgtcatttggcactttggttct

SEQ ID NO: 18806 - DNA, 201 bp, Bos taurus
agtaaatggccgcagttcaaccacgatgaggaaattcagctttctctgtggggacggctcccattagccagatacagaaaagttggatgaccaatgataccaactcatgcacgcctaaggcccaaggtggggggtggagggtgagatctgaagaagggctgtccccatttaccaggagcaccactgccccagctttctccc

SEQ ID NO: 18807 - DNA, 201 bp, Bos taurus
gaccgttgaaattggaatttttctcttttaaagtctgctttgcatttcacctgctgcagcttcaccactgcacatggatattgtctctccctcctctaaagttctcagtcatggtccaattgtaccttgacctaaattgaagagcaaagactatcttgttttcccttatatcttccagagtttttaatttcagaggctcag

SEQ ID NO: 18808 - DNA, 201 bp, Bos taurus
ggtaacaatggtagacagcacacagtgggagctggaggccagcatgaaagaaatataatctgaccaaggtcactgtgcctatgggctgggatatgtgaatattagcttagcaggaggccatggaaattttcacagaccaaattggcatttggagctgagatggaaagctgtgaacacaggatgttactgcaaacagggctg

SEQ ID NO: 18809 - DNA, 201 bp, Bos taurus
ctgggtgattcttggtaacccaaactaatttcttggcctcatgaatattagactcttaattttcaaacttctcttgtttgggtatgtcctggaaagccaacatgcattttttaaactctgaattatgaaagacaggcaaccatctggaaccggaaaagtgcggggtttcagaagagctcttcacgtcatgaagcatcattc

SEQ ID NO: 18810 - DNA, 201 bp, Bos taurus
tctttctaaaagctcctattccagcagaagaaacagatgagttaaatacgtactgtccataatacataatcaaaacttgtcaagaaatgcatatgtgtaactagaatttgaaaataagctgaaagagagagtgaaaaaactacttttaaaaatgacgaaatcattttttcttaagtttgatgaaaatcatcaacccacaga

SEQ ID NO: 18811 - DNA, 201 bp, Bos taurus
gaatctgattcctgatggagtgtgacaagtcagtgtgaactctgggcagaggcaaaggagcaccagttaaacacttggccaggtgatgtaaaaggtcaggaaggaagaagcacaagagaggcagactccctgagataatgaatctgccagagcctcaggccttccttctccttgtccttatgggggttcgctgtccttccc

SEQ ID NO: 18812 - DNA, 201 bp, Bos taurus
cccctttacaggacctgcattttctggttcagtccaggcctgcccccactcccccacccccatcactctaccctgaggtgaataccaagtgcctaagtcatctcacgtgaggcccacttcaggcagtgtttggtatatgcctaagaccatagctaatatccaactccaactcgctctctggttagcgcagaacttacaggg

SEQ ID NO: 18813 - DNA, 201 bp, Bos taurus
ggagtagctcctctcggccctccttgcctgtgcagctgcctcggctgcctcccctgacctcgggcgtgtggtacctcctccaggccgccgccctggactcgagtgtgtggtagcttgttttggaagctgcccctgaccttcaacgtggggtagctcctctcggccgctcctgtgccaacgtagcctggcactctcggtcgc

SEQ ID NO: 18814 - DNA, 201 bp, Bos taurus
cattattgataaaggaattctaagacaaccaatgtgtttgaggaagattattctgccaagtaatttgttgctctagactggatacacttaacataaaatttatcattttatcatatttaaaagtacaattcagtagcactaactgcattcacatttttgtacaactatcactactgtctatctccagatatttgggtttct

SEQ ID NO: 18815 - DNA, 201 bp, Bos taurus
gaaactcaggtttcagaggacagacctggggagaggactgggtttggatgctcagatttacactgccagtgcccatgggccatccaagcagaatactggtacatggttggtctggctgctatgggctttgcaatgtaggcacacaagggtggggccagggtctgggctgattccatagttcccatggtggatcctggtgcc

SEQ ID NO: 18816 - DNA, 201 bp, Bos taurus
ttactggaagagcaagagagaactcttgctctcaaactgcaggtatttaactgcaacaccgtgtggttcctgttattctgttttccctccacactccctggtcacaaacgtggcccagcagtgaacttgaagcccagaagaaagaccttgcttgctcacttgtacttttcaatctttttttgcctgcctgaactggcccct

SEQ ID NO: 18817 - DNA, 201 bp, Bos taurus
gaatctgagaacattgcttagatgttcaatctaaggtctgtcttgtcagctataacaattaccacaaacttgattgtattacagtgacagttactctcacggtactaggctccagaatccaagatcagaatccactgagtcaaaattaagctactaccaggactacagtccccccagccccctagagagagtccattccta

SEQ ID NO: 18818 - DNA, 201 bp, Bos taurus
tgtgaaaatggaagatttttcaagtgtatagttatccattgtattattcatctgctatgctgtggaaaaggtttgaattcatcacatgttattgatccatatatataatgtcagtagtgaatttcattcagtctcatggacttaactgtcatcagttctataaatttttgtcagaaatagaagctgagtatcttgacttgc

SEQ ID NO: 18819 - DNA, 201 bp, Bos taurus
taagaattgcatacctcttagtttgattctaagtcccagaattagtagaattaatcaaaactgtaatctccagccccttacaaaacaacaatatgcaaaatacatggccattgtgtagagtcaaagcaatcatatatgtttgcagtttggtcatattcaattaacctcattcattttcttgataacatcattgagtatatc

SEQ ID NO: 18820 - DNA, 201 bp, Bos taurus
agtataaatatgagcattcttttttaactctgatcaatgaatagaattgaaatgtttgtatcagtcctcatttttccagactttaagtgggtatatttcaggttaatatatggtcatttaactcaggcggtgtctgtgtcagaagacacagggttgggtaaggagtaggaatcccggaaggaacactattatgtcaaacgg

SEQ ID NO: 18821 - DNA, 201 bp, Bos taurus
tacaacattgaaaattatattgctatgtaactatggatgtcacatatctgatcatcaaagagtgaaagggataaaagaatgtgtagctttggccagacatgccacaagatgaagcatcactaggttgctcttagtttttgaaggtaggactcctttttaaacagggtagaagaagctgtctttaaatgcatggccagccac

SEQ ID NO: 18822 - DNA, 201 bp, Bos taurus
gtattgggcataagttgagtgagtgccttctcatgccttcacaactgcacaatagccaggcaagcgctgaagccttcttatatttggaaaatgactccatatttctaatactagtttttctttgggactatttgtaaatgatttatcgttgtagcaaatcggatcatgataacataaagctttttagaggtcattaaagag

SEQ ID NO: 18823 - DNA, 201 bp, Bos taurus
aaacacagatagtacatagaagtgattgcaaagttgaataaacaccagattagttttaaaaagtctgcaacttcctggtggagcctttcaaactgaactgcgctattgtctgacaaagtcgatggtggccaaaatgttgcattaccttccactagtgttcacgtgagagggtatctgacactggcgtgaagaagaggtagt

SEQ ID NO: 18824 - DNA, 201 bp, Bos taurus
ttaaactcaaaaacttttgcacagtgaaagaaccataaacagattgaaaagaaatcccacggaaggggagaaaatatttgcaaatgatgagactgacaagggtttaatctgtaaaatttacaaatggatcatgaggctcaatacaaaaaacacaaacaacccaactaaaaatacatagaagacctatagacatttctccaa

SEQ ID NO: 18825 - DNA, 201 bp, Bos taurus
ttggccacctggctagtctccagatagcagtggggccactaaataggcaccctgattgggtaggtatgctggctcggttccatgtcagatggggccattaactggcttctgaagttacctctggtagggtatgatctcaggctattttccctggaaggacagtagcacttgttggattctgcaattaggcaaggcctcatg

SEQ ID NO: 18826 - DNA, 201 bp, Bos taurus
ataacctcttgaaagactctatttctaaatatagtcacattatgaggtactgtggttaggacttcaacatacgaatttttgagaggatacaattcaggccataagactaagtgtagctctttcttcaaattcctcatggatgtagcagagggaggaaaacccatttctttactcttcaagcataaactctggatcccaagt

SEQ ID NO: 18827 - DNA, 201 bp, Bos taurus
cacagttcctgacttacagctccccaaaccctttgaattttctaagtgttgagactgacaaagctgtctcatgataatgaagtggctctcgggcctcactgaggttgggggcagtttacctggagaaccaaccttgtgattgaagacttccagagaggggaaagggcctggaggttgaatcaatcaacaagggccaatgat

SEQ ID NO: 18828 - DNA, 201 bp, Bos taurus
tatggcttaacccctatttcttttaggtaatctttgttatgctagagcgttgatcaaatggaatcgaactcacttggcctgtctgttgaattaagctgaaaagaactgctcgcatctctgctctcagaataatacgaagtggcagctgtgtagaactgatagagaatctagtgcccctgcctaaaaaatagaaggcctcat

SEQ ID NO: 18829 - DNA, 201 bp, Bos taurus
ggctctgggagctgtggcccttgactcctgtctggtcctctttcagtaccttgtgccgcttccctgaggggacagtgccctgaacaagatgagtttatttgaagagctaagaccaaaacagacgaaaacatgagcaataagaagtcattgtataatgaaatacctcatggtgtggcatggactctaaggacatacccgtct

SEQ ID NO: 18830 - DNA, 201 bp, Bos taurus
gcataatctacagtaggcactttttctttctgtctacctttcactagcagtgaagataagtgaagcacctagggctgcgtaactggtaaagacataggcccgggaatagaagttggggcttttgatgctgtctgaaataaaaagttctgaaaagccagcattgataccagtggaatcatagtggtggccaggttaaatacg

SEQ ID NO: 18831 - DNA, 201 bp, Bos taurus
ttgtcatataaataagggtttttgaaatagctttcatgtcttctctcatttgccttcaggccctttgcttgcactggattactatggtaaatgtatcatttataagtccctttgagtaagcatgcttatctactgctagttatgctaccaaataatttcacttattagtatataagcatgataaaaaataaatggttctaa

SEQ ID NO: 18832 - DNA, 201 bp, Bos taurus
tccgctttccgtcgtcccatcctcaccgactgcagcctcctgagattcttcagtagcggctttgcgtttcaggcctttctttccgctgccgccgctcttacctccggctttcgccatggtatttttgcttcttgtggtctgtacggaaacggaagtagcttcctcttcccacccccgtccttaagctagtatttccggggt

SEQ ID NO: 18833 - DNA, 201 bp, Bos taurus
ccataggccaaactcaaaacgagatgacagttacagaagcattttctaaatgataagttctttaacattgtaaaggtatggcttttattttaacatcctagacaaggagtgattaggcctctgaattcccagtttgcttttgatcaggtatctcattcctttgtcaaagttctaattgttagaaacttgtaccctgttatg

SEQ ID NO: 18834 - DNA, 201 bp, Bos taurus
tctgctgaccctagtgggcaataaaaccccatcggccgtcctagagcttcgagctagtctgatattccatgaaccaccctgacattagtgccttctcatgccaggttttgagcttcctcttgttttctagcactgtgctctttcccttatttatttatttattttttttgaaactgtctgtagctttacacttctgagctt

SEQ ID NO: 18835 - DNA, 201 bp, Bos taurus
gctgttacttaaaagtctatttaaatgttacttcctctattctagctcctaaaatgtattaacacccacattattgtactcacacattgtacaataattatatgcttatacttctctttttgagcttcttccataattttctacttctagaatctaacacaatagtaaccacataaaaaacatttaagaaatggttttgaa

SEQ ID NO: 18836 - DNA, 201 bp, Bos taurus
ccacatcactccctccatttcttttgacagtctctcaaggcctttggcactaaatttctccttccttctttattcagaaacatatgctccaagaacagcaatgtatacaaacagatgactggagttgtcggcaagtccatccggtttataaccaattcggttctccagcccactttggtctcaggtggcccaccaaagacc

SEQ ID NO: 18837 - DNA, 201 bp, Bos taurus
tattatgcttagtgttaggatgtcaagaacatttttgtgtgtgcttataaacaaagtatattttccattgtattaagtcagtatacttagcagcctgtgggtatgctttttgctattgttgtttgttttggttttaagaagattatttatttattataattacttttcaatattatttttttataatataactgcttcaaa

SEQ ID NO: 18838 - DNA, 201 bp, Bos taurus
ttaagagtttgaagcatttaaaaaatatttgtttgaaagtatcatgaaggctagtgggagattaactgtcagagtgcaggcaggagagggatcaggtgtactgtagtcatggttaccctagtcattctcttttcttggacccagtgatatctggttgctctgggtggggtctgtggttcccaagacccttgtactcgtgga

SEQ ID NO: 18839 - DNA, 201 bp, Bos taurus
catgagaaatattggcctgtagttttcttttcttgtaatatctttgtctggttttgatattaagtagtactgttggcctcacaggatgagttagggaacatttcctctgtttcagtcttctgagaaaaattgtagacgactaatataatttcttccttaaatttttcatagaatttaccagcaaacctatctgggcctggt

SEQ ID NO: 18840 - DNA, 201 bp, Bos taurus
aagatgtagatgctcttatactactttttctgtgccagcctttttgaacaacataaaagagtgtagagcgggcagcatgaggtctgacagtctctgaatgtggaatgtgggaagtgaaacagaggggcaagtgctgaaggaagctcttggaactgagaaggatatccaatggtactctcttgttatgacttttctggtgac

SEQ ID NO: 18841 - DNA, 201 bp, Bos taurus
agaatcttctgcagctataaaattgttcttttgtttctccttgacttgcttactctctttttctgtataagacaggtgaatttacaagttttaaatctgtggatcaagtgactgcactgcacaaaatgatacattggtatgatggcatatatttttttcttttctgttgacttaccttagaatgatgaaacaaataaaatt

SEQ ID NO: 18842 - DNA, 201 bp, Bos taurus
tattatccacattatatatgttatctgctggcccacatggctgtccagcaagtccatagtgaggtcatatgggtccatgtgcaagctgctgaagggtgatcttccggccccgcttctcagccactgtcctgttgggctccgtctggtacatgtgtttgatgaagcacagcaggcacttctggtttatgcaggcagctgcat

SEQ ID NO: 18843 - DNA, 201 bp, Bos taurus
aaaattcatattcaaacatttgaatggaaggattctaaacagtatcctctctctttctcttaattctattcccttccatgtatcttcattttcaataatattctcttcaagtggtagcaaaaaacgaccaatggcaaactaaagtcacatttttccttttgctcatgatctcagaaaaaaatgttttctttctgattagcg

SEQ ID NO: 18844 - DNA, 201 bp, Bos taurus
cggaaagaaagcctgatgtttatccatttccctttgatgtcttggcatactaatgctatgccaagtggttgactactgaattcctcctaaaagttatcaaacttacaatttcatgaaaagaaacagaatacaggtatcctttgaagagataatttaaatgtttagtagaaggctgaatttttgtttttttgtttttgcagt

SEQ ID NO: 18845 - DNA, 201 bp, Bos taurus
ctaaactactttttgccagcccacaagtgattagcattaaagttttggcaggattccatgcttattttgccatacctaggatgggaactggttttgcttctttgctcaaaccaaccatgaaagtgaaagtgaaagtgaagtcgctcagtcctgccagactctttgtgaccccatggatagtagcctgcaccaagctcctct

SEQ ID NO: 18846 - DNA, 201 bp, Bos taurus
agttataaaaagttaatctgctccacaattcttatatttatcctcatatatttaaagttctaaagcattggctcttaaactttacaccatgttaaaatcacttgtagagctttttaaaacacagggtttgaaaaccccaatccccgagtttctgattcagtaagtctgggaaatggcataaaaaccatcatgtttaccatt

SEQ ID NO: 18847 - DNA, 201 bp, Bos taurus
gagagcgtttatccattgacaattcccactgagagctgttcagcctgactcaggaggcaccgcataaaggttttaacatgccctggcctgccactgtccatttgcaaggacagagacagagcctctgtgtggcatttctcagtccatttgtgagggcgcattcatttgacagaggaagggcctggatctaaactgggagta

SEQ ID NO: 18848 - DNA, 201 bp, Bos taurus
gttttaatgtaaaagactggactaaccatcaatgaaagatgatttgcccatatatgcagaaaagaactttttaattgtgcagtaaaactgctggagtgtgttaatgacagtgtgaaaatcagaaattttttctaagtctcctcttaggtttatgctttgtcccctactgtgaaataaatataaagcagtacactcacattg

SEQ ID NO: 18849 - DNA, 201 bp, Bos taurus
tctgaacataaataatgtacttttttttttttcccaactaaatgcacagactgtaagaacaaaccactatcttacagggaagaaatgatgggtcatccaaccattaaagcaattactgaaaaatataagcattttcccatttaaatttctatcatctattattcatgaattaattagctaactacttctgtgccaacttta

SEQ ID NO: 18850 - DNA, 201 bp, Bos taurus
gacattctgacttccgtcccttttgattactctggggaaagtcagctgacatgccatgaggacacttgagtagccctgcagaaagatacccacagggaggaactgaggcctcccaccaatacctggtgaggcatggagttttcctgccagcagttctgtcactgggctacctttaaggcagatcctccagtctcagcaaag

SEQ ID NO: 18851 - DNA, 201 bp, Bos taurus
agaaaacactgtcagatcagaatctcttttctgaattttgataatgctaattgctcactttctatcctagttattttatcagtaaaattgttggaactcttgacattgcattttatttgatagaaacgtcagtggaactccctgaacaatgtagactttgctatttcctttaatgaaacagtctcaatgctaaaaatatgg

SEQ ID NO: 18852 - DNA, 201 bp, Bos taurus
gtgaaaataaataccaaaaaattacagagagaattattgcagggggacaggggagggttggcaagcagtgaataaactgaataattagtccccagccactagtttcactatatttacaaatttcctgatgccaattttaaaagactaatcctcaagaaatacctaggtagtaacagaggagatagtggaaatagaaatgca

SEQ ID NO: 18853 - DNA, 201 bp, Bos taurus
ccataataatacattcaatcattctttctgaatataaaggaactagccaggatttttttgccattctttctgggactcaatgtgatatcacaagcttctttagatccttacagcaaccactttaagaactttaagatcagatatgctgtgtgtcagacttggactcccctttggcatgttgagtttctttatcattctcaa

SEQ ID NO: 18854 - DNA, 201 bp, Bos taurus
agtgcaacaatttgataattactaggtttcattccattataaactaagttaagcctccttatgcaaccacctatcagcatatgatgtattattatgcaagcaggggaagctttctctggttatttctaactgacattcatggtgagagtggacaggtatctgtattattatcttccaggctgtgccacaggagatgtagtt

SEQ ID NO: 18855 - DNA, 201 bp, Bos taurus
tcctaaaacatacatagacaagaagcaaacatttaagaaataaataagaaaaccaagtctgaaataaagtaaataatgtgccaaaggtttcaggtttctaatgttcttttttttctgaccccagcaccaattgttttccattatgtcatgccatttactgaggctagagccacgattttattcatctttatatatctatca

SEQ ID NO: 18856 - DNA, 201 bp, Bos taurus
aatatttagattgctttcagaatgagattcggcacagggccttgcacctaggtccagaaaagcccccttctttccttcaccttcacttaccattgcacactgaagtagggcctatctgctcttaagataaccaattcacataatatcacgacattgtatattccatcctaatactttctgtccacatacacacatcactga

SEQ ID NO: 18857 - DNA, 201 bp, Bos taurus
caggtatttacattttcctgttgattactgaattagctttcattaagaatacacttaaattctaataatcactgaaccagcctcatttaattttatgttcgcagacttaaataaacttgtgtctctgacctgtccaagattagaaactcaaataggaagtcttttctttcctctctgccacttctccattccccttctctc

SEQ ID NO: 18858 - DNA, 201 bp, Bos taurus
acagatcaaggcaagtgccctctgctacatctcagtcacaaaggcaaaaattatctaaaatcagatagataaatgatagatacctaaactgatggaaagaaagaaaggatggaaggaaggaaaagataattttatatccactggtggttccggtactagaaacagtgatacaagacattatctgctgctataccctagtta

SEQ ID NO: 18859 - DNA, 201 bp, Bos taurus
cctccccaagctataaaacgtcaagcgataactctctgtgatttaggccagtgattggaataaatacctcctggcaacaggtgcagtgacttaggaccgagatcattcacattcacattcctaataaacagacgtactgctatgagatgggaatttgtaagaccagaattggaattctaacactggatttcacatcattta

SEQ ID NO: 18860 - DNA, 201 bp, Bos taurus
atttttaaaagatatttttaatattaaagaaatatatggcttatgattatggatatctgacattctggaatgattgagaagttctcccatgaccatagttgaagaagactgctttttatattaatcataaatatcaatattttatttcaattttttgtatttattgattttaatgaaagattttaatggaaaattttagac

SEQ ID NO: 18861 - DNA, 201 bp, Bos taurus
ccaggcccagctcaagtaagtgatctgaatctggcttcaggaaaaaaagaaagcatttatgctctgagtgcacagaatgaaacactgataaacagttcttggtaaaactttgaattcagatggcattatttttcttcttaagccataagttgtcttttaaagaaaaaaatacatgtagcaaataaaataaaagaaaaggaa

SEQ ID NO: 18862 - DNA, 201 bp, Bos taurus
tgatatttgataaaagcaaagtaattttgcaaatgttatagagatctcaaaccactgacttttagttaatcacaatggaaattatcttgggtgggccttacctaatcaggtgaaaccttaagtggagctggaccttcctgaagctgggttcaaggcatgagagagtctccttctggctttgaagaagcagaaagccatgct

SEQ ID NO: 18863 - DNA, 201 bp, Bos taurus
tactaactgcacatatcaggtaggcagtagcagaaatcctaagaagcacaattaccttagtaaggcatgtgattgctagggaatgggagataaactccaaaaaatgatttaccaaatcaggtgtctatatctcaataaagctgggcaggggtcaaagtaaggcaccaattgacattctcacaaaaaagcctctgaaaagtg

SEQ ID NO: 18864 - DNA, 201 bp, Bos taurus
ccttccctgtcttttagccaccgccattttggactcctgtttcctattctaactacctaacagcttcacatgcttttttattttgatgtgcaactcaaacgtgcacatctgaaaatctgaactcttggcagtctttatgttgaagtgctatagttttcccattgaattttttaaaatgtatttactttttaattgaaggat

SEQ ID NO: 18865 - DNA, 201 bp, Bos taurus
gaaaactataatccaattcccagtgaagcaactggcagaaaaaaatgaaaacaacagaacacaaaacttaaaaagtgttttttagccaacccacatgatatgaattggaaaaaaaaaaaaatcactcactgttgtctaggctgttcagcatttgaaaatgaaatatccctgtcaggctacctgacaataaaacagagtttg

SEQ ID NO: 18866 - DNA, 201 bp, Bos taurus
tatgtaatgaaagacagggaagcatggtgtgctgcagttcatagtgtcacaaagagttggacatgacttggggactgaacaacaagaacataaatgttgggtctggtacatagcaaatatgagggaattaaatgagattagaagagaggaaaagaagagagaaggaggaaatatccttttcattaaacattttttttaact

SEQ ID NO: 18867 - DNA, 201 bp, Bos taurus
tattagtcaatatatgtattcataaacttgacctcaagtcagttgatacattcatgagatgagattcaaaagatacacaactggacctatacatttgtagtagaaaatggacatcactatatattgaattctgaacatgatttaagtaagtgctgtccttcaaactctggtgtgcatgccctcagtgcccagggaaatcac

SEQ ID NO: 18868 - DNA, 201 bp, Bos taurus
cagttgggcgttaacaacctttatagagagaacacaatacatactgaatattaattatattctatgaatgcagatatatatgaaatacagatatattttctcaatcacagcacttttgccaacatatatttcttaaaaattcaaccattttcaagctaaacttatcaattaaaaaaccctagttttatttcaactcataaa

SEQ ID NO: 18869 - DNA, 201 bp, Bos taurus
caaatgacaaatgccagttgccaaattatatcttcaaacaacttctgtcattcaaaattcaactgaactatattcctaaaacaatctattcctggggaaatacaacagaaaaattaccttaagtgcctctgtattctgggtcatcagtatttctatttaggagtgatcaaaaggaagctttctagtctagactgggcagac

SEQ ID NO: 18870 - DNA, 201 bp, Bos taurus
ctctgtgagttagtgaagcacagggaggcctggcgtgctgcagtccatggggttgcaaagagttggacacaactgagtacctgaactgaactaatggtgttcaaggccagtagaatctgtacttacagctttagtcctataaagaatagaggtggtaatgccattttaatatatcgatattttcacaacaaagattccttc

SEQ ID NO: 18871 - DNA, 201 bp, Bos taurus
ggagtttcatttatttttgtgaaagtttcctttgagtaaagtctttggaatttcttttactcccttgatttttttttttccccagagactcattttgtcaatattctggaccttttttttaacctatctttaatacttgccccttattttcaagcctatcaaattcttctttcatttattttccttttgattgtttttatt

SEQ ID NO: 18872 - DNA, 201 bp, Bos taurus
ttgccattctttggctatgaggtcagttcttcttgcctgtgaagactatccaggattcaatgctgcctcactgggtaatatgagaagatgattctaatgatgacttcactaatggctctcaccagttatattttttaaggaaaatcaatggcttaagtagaaaacatgaccatgacttacaatgctgaataaagaagagtg

SEQ ID NO: 18873 - DNA, 201 bp, Bos taurus
tgtataattggtattaggactcctgggctcttgaaagttaatcacatctacctcagtcctttgctgggtataatctttgaagtaaacaatctcccactccgtaatttagggacctttctattgagtcacatacatgcagttattctttgatatttgaccttttatgacaggtagaatgtataggtcagctaagacatagtt

SEQ ID NO: 18874 - DNA, 201 bp, Bos taurus
aaatgggaagttttagtgcaaaataattcagtttaagtaatgacaaacctggaagtggtgctgaaatgggattccaaaaggaagtagaatccacactctacaaagagtttgtattaagctgttaaatggggaaaacaactcaaaagttaaatttcttaaaaatctcaaggaaatctcaaagacctaccggcctctgaacta

SEQ ID NO: 18875 - DNA, 201 bp, Bos taurus
atcagatggtggcgtgtttatttcagtctgtcacagaagaggaacaagaaaacactgctgggccatgcaatttggggtataaaaatactaagggccaaaagaaaaactaaagacgttctgcctacttgactaaactcctaaatacaagggttgggggagaattcaggaggggttaagagaagcatgatggctcagtagtga

SEQ ID NO: 18876 - DNA, 201 bp, Bos taurus
tgggcacagaccatgtactctaatcgatcataatccctcctatgattcctgcttttgagttgatggccaatattccaaaatatgtagcatctcagagagtgtgagtttcatgtcacacagaaagacttttagaaattggagactctgagactcaattagtaaacatatggaattaccaacagtgctgacaagtacaattgc

SEQ ID NO: 18877 - DNA, 201 bp, Bos taurus
gccagaattatctaaagaaaggaatcagttcacttctttgtatatacattgctttatagaatgaaagaactattgaagtgaaagagacaccttagatgccgtctggccaagcctctcattttatagatgaggcaactggggttcacagaggttaagtgctttgctgacagtcacttattcttgcagaaaccaaggtcctga

SEQ ID NO: 18878 - DNA, 201 bp, Bos taurus
tgactaagcgactgaactgaactgaactgaaacatagtgtgatggttaattttatgtgtcggcttgtccggactaagggatgcctaaatagggaacagtgaaatattatttactggtgtgtctgtgatgtatttctggaagagattagtatttgaatctggagactaagtgaagactacccttaccagtgtaggtgaggat

SEQ ID NO: 18879 - DNA, 201 bp, Bos taurus
ttgtaatagaaattttaggaaaccaggaaaagttcttacatgaaggtcatctttggctctcaaacaggaattccactggtaaaattatttggggagagggaaaattatttattaaaggatagaactaggcaagtgactagaaatttcatgatatgtagtgagaaagagatcaatttaaaaattgagtttgcaaaacatagg

SEQ ID NO: 18880 - DNA, 201 bp, Bos taurus
ctttgcaacccctatggtgtaacaggcctcacatagttcattaggaccacaaatttatatggtcaggaaacaaggtttcaatgatctttacaggaaaaaaattccagtgctgtctttagatgtggcaaaaagatgctctggaaaaggagacatccaagtgataagggctaaaagctgtagagaataaaagaatgaggaacc

SEQ ID NO: 18881 - DNA, 201 bp, Bos taurus
atttcagatattggccttcttttttagattttagctatttatttgatttgtttgtactcataaatgaacataaatatgatatatttttaaaaataaaattcttggtatggaggccactttcaaatggggaataacatatttggctctgtactgaaaaaggaaataagtcaaataccttctacctgtttatattgaaagaaa

SEQ ID NO: 18882 - DNA, 201 bp, Bos taurus
ctaagaggattttattatatgcaatttttgtttttcatctttgtttacatgggaaatgaaacattatgtatgatagctgtcaaccttctgaaattaccatgggaggaagcatattatgttagttgtgcaaaacaattgaacgcagagggatggtatggggagggaggagggttcagaatggggaacatgtgtatacctgtg

SEQ ID NO: 18883 - DNA, 201 bp, Bos taurus
caggaatatggtttcatttcctattgggctgcaatttgccatgtatcagcatccaagggccaggctgctcaacctgaaaatgattattttctttcttttcattaatgtatcggaagtggatctaaaagaacctgcactatacaggggggttaattatcctggcagtcagttaagctttgtaagttttaggtgataagaaca

SEQ ID NO: 18884 - DNA, 201 bp, Bos taurus
gcagccttagtgattttcttaattcctttattagacaagtagtttcctgcactttccccttcaatgtctcccactgcattaatgtgccatattccaaccatgactccctacatcttgcagaagctgaccccaccctcctctgctgcatcatctcacatctcttgattctcttattattacactccacacattctgatcctg

SEQ ID NO: 18885 - DNA, 201 bp, Bos taurus
atacataattttcattattttattacaaaaaaagagaaaataatttcaatccaggcaaaatcatgtgggacatgagtaaatatatatatatcaaataaaacggacaaagatttctttttttttttttttttttcggacaaagatttctacaaagtttttaaacatttattattttttgcaaataccaaaaagcattcttct

SEQ ID NO: 18886 - DNA, 201 bp, Bos taurus
actgcctagtgttactcgcataacctttaacctccgccacatcttagaacattcctttttgtaaaataaatgaatcctctgttgaattaaattgcccctgaattagactgaaatatgacctctctttagtttctttttaaaaaattattccacttttttgttttgtttatgtgctgtacaattctctgtgaaggactgctt

SEQ ID NO: 18887 - DNA, 201 bp, Bos taurus
gtttactacactggccttaaaaatcccatgaccacatgagaaatgtttgcaaagcagcacaagagaaaagtaatctacaaaacagtacacagttattaccacaactttgcacttagggcctcacttgttctcttttttcaggccccttttaagcaggaagtaaccaaaacagccacatagggataccctacagatcaaaat

SEQ ID NO: 18888 - DNA, 201 bp, Bos taurus
cctttcacaagttaaaagcagcaaggcttattgtaaagactaaagtgagtttagttatgtcacattccagtacttgcctttcttttggaatctctttagggagaaagaagggccagcatttaagaatactggtcctcataaagacatgaatgggcttgtcttcctcttttctcctaccctttcaataactgttattgttca

SEQ ID NO: 18889 - DNA, 201 bp, Bos taurus
tagaggtccaatggagaagcactgtctagaacatagcaaacctcaggcacacaggatccacactaatattatacatggaagagagacctggggattccttagaagcctgggaaccctgatgtgtatttctttgggttcattatttggaaaagcttaacttaatcaaaccacaggtctactaaatttactctttagttcata

SEQ ID NO: 18890 - DNA, 201 bp, Bos taurus
tctctggtggtgccattatatattccataagtatgccttgtgaatacatttaaataaatcatttgccattagtgtttcaaaagatattctggcccacagaccacaaatctctccagaaacacatcagattcatttttaaaactccaggaagtccatttccaactttttgtttaatgccttccttaaacaggaactgagttg

SEQ ID NO: 18891 - DNA, 201 bp, Bos taurus
ataatagtctttccccatttcgagtgccttgaaatgaacttagatttccctttgtgaaagaaaacagcgtccccagtcttagcaatacaatgattctaaggaaaataaaccaagctgggtattttaaaagttaaagcaaatcagcaattcagcttcgctgtcttaaggcagcaagcagacagcgcctcagtatttaattcc

SEQ ID NO: 18892 - DNA, 201 bp, Bos taurus
tccgactctgtgcgaccccatagacggcaacctacctggctcccccgttcctgggattctccaggcaagaacactggagtggggtgccatttccttgtccatatagttaaatattttaatactgtcatttatttcacattacaatatgatccaaatttaatttttcacatacagctaacaaatgtagcaaacaacagattt

SEQ ID NO: 18893 - DNA, 201 bp, Bos taurus
tatacaacgtagaaaaatatgtgtatacattgtaagaccacaatgctaaggagggagggtgtacaaatctctcaagaggccagaaatggtaggatgaagcagacttccaaccgcggcgctacatagggacacctttcctccttgggtaggaccaagttagacaacagcaggggttggtccgggggccgcccttagaagacg

SEQ ID NO: 18894 - DNA, 201 bp, Bos taurus
ttgactggtttttagaggctgacattaaataacatccttaaagataaaaatcactgaataaagttaatggaaatttagcatcttctctaaatttaactaattgacaaatttataaccatcctaaatacagcattgcagaatttgaatttaaactcattataaatacaacacttttaaaaactgaagtgtagttgttgtgta

SEQ ID NO: 18895 - DNA, 201 bp, Bos taurus
cagctcaaagtgtgtgtatgtatatattttcttgtcaggaactggagggctgaaacaacagcgtccaggaagctcttagtatgatatgacattcagctactaactatctaccaatctgctttatttcaattaaaaaattataaagatgaaccattgtagaaggcagccctcaggccttaagctaaaatagtcttaggtaga

SEQ ID NO: 18896 - DNA, 201 bp, Bos taurus
aggctatagaagacgtagcagctggaaagtcacgcatttctgccccttccccaccacctgccctgctgcaagcaacactaggaagaatttcaggattctgtcacatcactttaggtttctgtgcctgaactgggcccaagctggagatagtagacatatgtcaaactgaatgagaagctgaagttttgatttatattgggc

SEQ ID NO: 18897 - DNA, 201 bp, Bos taurus
tttccatttttatatatcctaagctagttgaaaatgatgattcccacaacaagcataactcagcttgtttctgcttactgagtattttccaccatggtatatgttgatatcacttcttccattatgtatgttgtacagcagagttactgttactgtgggaatcataatttgaaattttgacttgtgtgtttctggaatctt

SEQ ID NO: 18898 - DNA, 201 bp, Bos taurus
tgcagggaggaggtaagagcctttaatgttcagttgcagtccaccattcctgaggactttattctttgaagttcagtttctccttgggaattcacaagggggatggcttaagtccgaatatgcagcagtgttttttttaccagagagtctttaggttgcagaatcagtaaagagctaaattagccatggtgatggaaatga

SEQ ID NO: 18899 - DNA, 201 bp, Bos taurus
ataaagtgaggagaatgagaggaggccatggggtatgctcacatagaagcctggggtccagctcagcccctgactggtgcctgctgtgaaacccttctccctccctttctagggcctcctctacatgccttgctcagcaaaacttgctttagtggcagatttctggatatcatgcttcagcatactgggactcaagcaaca

SEQ ID NO: 18900 - DNA, 201 bp, Bos taurus
aatcaggctgatttaggggaaatctttctatctgcctaggccttctgcccccttcaaaatttactgagaagcttataagtactgaaatcaatctccaacaccagaaatcttttgtttcatgaaacttagaggaatcaattataaccttttctgttgaacagagaatcaatgtacaattatttaacatgggagaccatgata

SEQ ID NO: 18901 - DNA, 201 bp, Bos taurus
tgaaaacttatgactgcctaggctaaatgaagatttcagcagcttcatctgccaataatattttagttttattatcactttcaaatgaactggtgtatttacttatccaaagtttaaagatttcccagatgtcacactgccgttaaagcatgaacacacaaaatggatccagtacaagatcctggtctagctccttgactt

SEQ ID NO: 18902 - DNA, 201 bp, Bos taurus
tcttcactcttgagaggtttaggattagtttaggtaggctcataaaaaaaattgaatctcaggaaagctttgaggtaaatgagatcatgcctatgaaaataatgtgtaacctgaaaagtttgtgaatgtatcagggttcggttcaaaaagcaaagtattgtgaatattatgggataaaggatttagttgagcacttaaact

SEQ ID NO: 18903 - DNA, 201 bp, Bos taurus
cagctgtaagcccccaaataatttgaacttatcgagtaggcattccttaaaaacaatgtttttagtaaaatcatctactcggtattttattcatctccataaaaaacataaacattcaatagctaactatggtgactcgatcagtatggccacattggtagagcttagaagctgaaaagtacggaaacacagatgagaaac

SEQ ID NO: 18904 - DNA, 201 bp, Bos taurus
tgttccatccaatggtttccaaactttcagaaacactggtaattcaatccaaacttagtgaactgtcaaaaaacaatgccagacatttcaataacatataaaagcagatattgctcaatgtgttaagagaaatcatcactattcacatttaaaattctttactcttagggttattattgcaaacttgcttcagcaaatctc

SEQ ID NO: 18905 - DNA, 201 bp, Bos taurus
ttgttctgtacatttttggaaacttgtgtatttttctttgatagtctctaatttttgaaggttatgacatgacctttccccttgtttgacggctgttgatatgtttttgctgctttaaaaagttgctcttttgcattaactattcaagtaattaagctatgtggaagggagatttttagatttgactgaactctagtatct

SEQ ID NO: 18906 - DNA, 201 bp, Bos taurus
gctagaagtagaatgttttaaggtagttatttgaagacagtaaagcttttttcttttccagtttttttacatttgaataattccttagtatgaaaaataataccttcagtattgttttggaagccaaattttaattgcatgaaatttcaaaagtttgtctctcaaatgttactttactacctataaagctttatctatatt

SEQ ID NO: 18907 - DNA, 201 bp, Bos taurus
taaaacatgtttacctaaaaattaatgaagatagcatatagggccattaacttttaatgatgagtaataatgaggatgcaaacatagctgagacagtattacttggtgtagcagggtcctccaacaacgttgcatgcctggtgcatcagtccagggtaaggggtgaccagcagcaggacctgaccctggttgacttagaac

SEQ ID NO: 18908 - DNA, 201 bp, Bos taurus
atcttgagcagcctctggcctggatcttctgtcccctttgctccttgaatttgctaagttgctaagtatccttggggttatcatgactttagctgtattctcctctctcagggttctcgctttcactttgatttgagcctggcatttcttcattgttttgtcagctctccagtgctctaaaaatattctttaaactttata

SEQ ID NO: 18909 - DNA, 201 bp, Bos taurus
agtgtgttattgtttttattttatatttttgctgtgtctcagggtggataagtctgcactcaggcccctcaataatacctgcccctgttgcaggtcatgtcgtcaaaggtgaggtttcagtgtatagtgtttctctgtctttcctaccaatttctatgtggtccttctatttgtagagctgttcagtaacccctcatgatg

SEQ ID NO: 18910 - DNA, 201 bp, Bos taurus
attttctctaaatctcatttcacaatatccagcttacagaataagtcgaaaattacagtttagagcatttcattttgtaatgcattatagacattgttttctgaatagttgcaactctgttcctcatagaaagcttatgtagtcaaccctttatttaatcagagtaccctttatatgtgcatgtagaaagataatggagag

SEQ ID NO: 18911 - DNA, 201 bp, Bos taurus
tgtgtgaaatgagctattggaaggctgagatctgagtagctgctaaaaagctagatggcacagtagttagaattgtttttgtcacagtgtctatggataagccattccacctttcaaagtgaggggcacaccttgaatgtcttcaatgagtggcaggtggacttttcaagataactaacctgctgctgacaatgaccctga

SEQ ID NO: 18912 - DNA, 201 bp, Bos taurus
ttactaatgttaccatttcattaaaacacaaatgcacgtatatatacaaacacaacacaatttagagcatatcattttgtagacttggggtgttatacagcactattaagtctggtaagttagtatgaactatttcctgacaccaacagattctccacttggatggatttttttgctgtcaagagctaggagctaaatgtc

SEQ ID NO: 18913 - DNA, 201 bp, Bos taurus
tggaaaatgatgcttttaagtaatgtgaaatttcagtacctattcctgaaaagcaagaacctggtaccatctgaggtatcaggcagttgatgacagtagcttctgtgaactaggatactttatagactgtggttccaactgaagagcaaggtgtaaatgtcacatgttttcttaaagtctatagctgagagtgtttccaaa

SEQ ID NO: 18914 - DNA, 201 bp, Bos taurus
taagaaaacaagagaaaagaaagcatcataatttgtatgatacagtaatttggtattttgtttcctttatctcaagaagaagaaacctgctcatgccttgataacaccatttatctgtcagatggcgtaggcaggagtcagctgtttcccataaagatatcttgggaaacagcaacggtgctgtctacactggcagatgct

SEQ ID NO: 18915 - DNA, 201 bp, Bos taurus
tctataaggatatttccttgaatcatggaaattgtatgtgaataagagtgtcttatgctcctatggataaaaccattaaggagtattacattataaacatagtatatactttttttctggatcagaaagtcagaatttagtaagatgaagaaaaaaaaaaaaaaaaacctcagtaagacttaagaattaatcaatttagaa

SEQ ID NO: 18916 - DNA, 201 bp, Bos taurus
tagagaaaagaaccaaaagagagcagggctgtgagaatcaaacagttaaagagaatggaacaaaatgaaaccaaaatctaatctgcctaaagggactcagcatacaagattcatttattcaagattcaagaatacatactcatttattcccattctaacagtatgtctcagggctggagatgctacataggacagttctgt

SEQ ID NO: 18917 - DNA, 201 bp, Bos taurus
agggggaaacagtgctgagttttgtcttgcttctatttgtactttctgtcctcatttaaatcacattcctttgggattatgttgtgtatttaaaactgtggagaatttgtgaacacagccaacatcctgatatgttggtggggagtgctctgttttattgttagcaaaataaatagaagaaaaaatagttgacacataata

SEQ ID NO: 18918 - DNA, 201 bp, Bos taurus
tcctgtacacatctccttgtcattctagttctgtccttgtctgagttttcagcaaactgttttcacagcactattgctgcttgtagtcccagggctactatcccagtcaccagtgctgtccctgatacaaagtagagaataacttgtagaatgaacaagcattatttcatgttttaaccatctgaatttctgtccatttgc

SEQ ID NO: 18919 - DNA, 201 bp, Bos taurus
ggggtgccattgagactgcttggcaattgggattgttcaagaagagatgatattcacgaagcactctcccagcactgggacaggcacacgatgtgagctcgatcaacaaaattgcatttccatgcagttcagctttgtacttttatcagcattacactcattttccatttttaaagccaaatcttttggaaccttatttta

SEQ ID NO: 18920 - DNA, 201 bp, Bos taurus
cttgcttgtttggttctactctacttgagatgactttgtttattccagaagcaccaacactgcagaactccggtaaaagttaaaactatccctcaggagactgatatcacttataatattctgtaacttttgtcacacccataataatacctttctttagttattttgagagatgtgctttccttcttccagtttgttaaa

SEQ ID NO: 18921 - DNA, 201 bp, Bos taurus
ctacagatctaaggctcttactgcttctttttagtctgagcctagagaaccagatatcaaaaaatattatatattttctattctctttagaccccaacacattgcattgagttactgcaaatcacaaggctaaaaacctcctcatctgtcatcagccccagttcataacatgacacagccattgtggagagaatgactatg

SEQ ID NO: 18922 - DNA, 201 bp, Bos taurus
tctgacttggagcagtaggtgttggctcggtaactgaaaaacgcagcaacaggagtcttcagtcaccagatgaaccaaaacaaggggctcaccatgcacacacttctcaacgtttactactcagatgctaacatttctcatttgcttgcttaccgttttatagccactattttatttctgcatcgtcctttatacactttc

SEQ ID NO: 18923 - DNA, 201 bp, Bos taurus
attttcctgaagaatcaggaatataatatcactctacaaataagtctattgggcacctgacccctaacctttttctccttgtttttcattttccacccattccctaggtctcttagctccatccacacacattatggtcttgttgctgtacttcctatagtcagataggtttaatatatatgatttcctcttcctagaaag

SEQ ID NO: 18924 - DNA, 201 bp, Bos taurus
ttcaatataatgagttgaaattcttattctgtctaatattgcttcttgtagcatctcttgtccagcttgttatctttttcttgatatagttttattttaacctgtgaggacatattgccagagattctctgacatctcagtgcttattcttcttaccaggtctatgttctagttacatataaagtgctacttacaattcca

SEQ ID NO: 18925 - DNA, 201 bp, Bos taurus
ttgtactaagatctgtatttaacttaaacaatgaagatcatacagtgttactcgcctccttcttgtctatcattgggccgtatccatgtagcgagggtgatcatatatttttttccaaactacgtcacttctgaagctaaccttcactaggatggtaggcataaagtgggactatccatggcaaaccagggtgcatacata

SEQ ID NO: 18926 - DNA, 201 bp, Bos taurus
atggactacattgctgaagaggatctgataattagtctgttgcattggacaaatggacactcctttgtatatcaaattttatacttgaagaataagacatgttacagtaggattatatgacaagtgagttctagaacaaaacaactcatttgaggtgacatttttatttctggtacctgatggaacctcaggatcatgtta

SEQ ID NO: 18927 - DNA, 201 bp, Bos taurus
atattgaaatcaccaagttgtaaaaattgatgttttgcctctttttattgctgtttttgtagtttttaatgaaagagagacacaatgaaaagccttctctccacctgagtttttatggagagtaagtcagtcagtattccccatataactgttgagagaatcaggtaatgttttgttcaaagactttatgccaggatatgc

SEQ ID NO: 18928 - DNA, 201 bp, Bos taurus
gtttagtagtaggaagttagtagtttagtacaaaaacagatgtttaaatgaatgtgtgcaacatcatgtgataaatgctatctatgatatagatagataacgtgagctgacaaagtatgctttgaaaatcaaagtaccacttaggttggactgtgttctgcttcatgccaggagtgaggtttggggatctgaactgctaac

SEQ ID NO: 18929 - DNA, 201 bp, Bos taurus
tatccagaggattttcccaacccagggatcaaacctgggtctcccgcattgtaggcagacgctttgctgtctgagctaccagggaaatcctccaagaatgttaatcactatagtatttcttagtatatccaaaaatctcaaaattgtaaatacaagagggaaaatagcatgttttgcaagaaagctaaatttggccttaca

SEQ ID NO: 18930 - DNA, 201 bp, Bos taurus
tctaaaattgaatgcattgaacttgaatcactctggggttaagaaataataaagcatgtgcttgattactggaaaggcttgttcttgtccgtatctcaaatttttaaaatttattcaagaatcatcattgttattttcatcactttttgtcttcctttggtattccagacactggaaggtcagcacagtggctgtggaaag

SEQ ID NO: 18931 - DNA, 201 bp, Bos taurus
attcttctcaccacattttcacaatttagctgaaactccagcagagtcatgtatgcattcatctttgcacataaattattttcctggaagacaacaatacgttccttattgcaacaattctaccacatttttaccttcactgaaatattaactaagaaagaatttactgaagagaaaaaatattgaagcagtactttgtaa

SEQ ID NO: 18932 - DNA, 201 bp, Bos taurus
gatagtgaaaaatgggagtgaaattctaagaatggaaaggaattcaagatgatgtatcaattttatgtgcactttttcacaacgatccaaagaaacaagaatcattgtttagaaaataaaattgcttggccctgaaggaagaattctcaaggcctagtgacacccaaatcatagcttggaatagtctgtccaagaaataaa

SEQ ID NO: 18933 - DNA, 201 bp, Bos taurus
ctcacatgatagcaatctggagtcctagttgggaaaggttccaggcagtgcatccactccaagggtaagacacaaattgcaattctgaagactcctgcttgtaatcccaggcgacaaattgatatcatcatcagtttgcatgcaaaaatggaggtctggttttcctttaactttacaatgcagtttgtttcactttgtgag

SEQ ID NO: 18934 - DNA, 201 bp, Bos taurus
acttcagcagcaagaaaggctcatctttccttccagctctttcttggactaggatacaagggaatgcagatcatttacatgtcacttcactgctccaaatacctcagagatgccaagtcttcctaggatatttttctctcactaaactgacttctaattcccctctgcaataggggaagggagacctggagaaaacaaatc

SEQ ID NO: 18935 - DNA, 201 bp, Bos taurus
tgcctagttgacaaagggaaggatatgggaaagcagtcaggagaccatctggtgtgggcaaagactagaaccagaggcagcgtggagattccatgtgggggaataggaggaaatggtgcaggaatagaagactaacaccagaggaaagaaagaccttttaaaccacactcaggaccttagtggaaaagtcataaaagggtt

SEQ ID NO: 18936 - DNA, 201 bp, Bos taurus
ccccctcccacctccctccccataccattgaactttgatcctaaattcatctgttctattgattaacccctgctgttcctatttccaaagggaaaaaagtgtattacaagcctgtgtattttatcctttatgtctgtcgtactttgaattagataatattaaattgagattatttgaaaaattcattaattcatctgaata

SEQ ID NO: 18937 - DNA, 201 bp, Bos taurus
atccattttcaggtccttttatctgaagctgagaagttgagagagaaagccagacagaataagaaatataattataacagaacagggataaataggagaataggtcaaatagagaagtaatatttaaatccttatcaaagagaatcatggggacactgtacaatatgtaggtggcccacttgtccaggacatcatattacc

SEQ ID NO: 18938 - DNA, 201 bp, Bos taurus
ggtattacttttgatgaatgagtcaaagcagacaattatgaaaataataaaagtagcataagcatgcatcagactttttgttttaactgaaaacatactgggatacattcattattggagaaaggcttcttttttgagcatgagtttacttatttcaatttccccaagttctgtcttacaaagacaactaaaatgcaatgt

SEQ ID NO: 18939 - DNA, 201 bp, Bos taurus
cagacagaatttctttttcattattggaatagtatctccttgttttaaacaattgcttcccacctcaagccagcagctagcaatattttctgagtggtagaggccataagtttataaaatctcagccctgtaccctcaggggctttctaagacgttagggtctaacctagggttggtcaggcatagcacttaatcattttt

SEQ ID NO: 18940 - DNA, 201 bp, Bos taurus
taagatttcactggaatattgaattaatgaagtgattctgttcctaataggtaacacatctcatgtgctttgcttgtcttttcaattagaaaaacaaagagatgtaaaaatgggccaatttcaatttttttaatgctgaactaaaagttatattcaaaagtcttcacttcagagttgtttataggtctcactactttcttc

SEQ ID NO: 18941 - DNA, 201 bp, Bos taurus
cctgaaatattccccataaaaggctcgccaggcttttagggtattgagaaattcctgtaattcatttatataatgcaggccagatttctgaagggacaactttcccccttaatttttccctttgttggtagcatgaagtaaaatttctgggatgaggtacaacttcagtgtatttcaacttctcagagtctcctgaggggc

SEQ ID NO: 18942 - DNA, 201 bp, Bos taurus
tacaaaattgcccagtatttgtggaatgaataatatgcctccgaacatcacaagtagctatagcattctctggtgcacaatttcaaaaccattagcttagtggacagggtttccacaaaggagtaagatatctggtttacagccttgagtttcacataacctctctgtatttcagtaacaatttttatttcacttgactta

SEQ ID NO: 18943 - DNA, 201 bp, Bos taurus
tttttactaaagtttcagttacaaatctaatagcatggctgtccaatttgctagattcctgaagatgctaatcagaaaagtagaagaggtaagtaagagcagcacagctactgccaggcaaagtgacagtaatgagacattagagatgaagtcagacacagagaaagagataaaaggggaaaaaggcaaactgtgcagtaa

SEQ ID NO: 18944 - DNA, 201 bp, Bos taurus
caatcttcaaattctttttttctctacattccccctttcttccttttctgataagtggatattggtgtgtgattctgaattttgcttttgtagtttaccagactacattacaagatgtaataaatttaaattaagttagagtgctggcttattgtaatcatctttttcttactatatcaaatatgtaagaacagaaaaagt

SEQ ID NO: 18945 - DNA, 201 bp, Bos taurus
ggtgttttactactggttaacaggattgaactgtactagaaatcttctagagatacaattaagcctaaggttttgttgagggaagtaagcggtggtggccggcattgtttattttgtctaagaataacatgggtaaagattctctggtaaggtgatgtttgagcacagacctggaggaaatgaagcagaaggccatgagga

SEQ ID NO: 18946 - DNA, 201 bp, Bos taurus
ttaagatctagtttcttagaaatcttaaaatatgcaacataatattgttgactatattgtgtattggatctccagaattattcatcttttaactgcaaacctgtaccatatgaccaacatccccccaatttctccaccttccagtccccggtaattaccgttgtactctgcttttgtagttcacctatattagattccaca

SEQ ID NO: 18947 - DNA, 201 bp, Bos taurus
ttttctgtttatctgcttttattttattatttgttcataaagtattataaacctattatagtgcagtactacatagctgattgtgttagtcgggtacctaggctaactttgttggacttactgtatataaacatgtacaatatatttattcagataaatacactaaaggcaagaaaacagtacctcctacaagtggcatca

SEQ ID NO: 18948 - DNA, 201 bp, Bos taurus
tttcattcaagaagcaatgtatctggccacatagaagaatcaacatgtgttaaagcctaccataagttgaccaattcctttcgtcctagtcagttactgttttggccaatggaatgcaatcatctgtgaggagacttctggaaaatatttttcattctagtaaagacacataaaagggagatagagaaaatccacccctct

SEQ ID NO: 18949 - DNA, 201 bp, Bos taurus
gagaaacaccagatccttcttttcctctaaagacctatattagtttccacaagtaatgagggagatgaaaaaaataaataaaacatatatttttttccatcaaacagctcagtgactagtggagaaaaaaaaaaatgaggtgggtagtccagacaaatagaaatataatgtaaatttcctcaagatgatataaaacccaga

SEQ ID NO: 18950 - DNA, 201 bp, Bos taurus
taaactcccggagttagtgatggacagggaagcctggcatgctacagtccatgaggccacaaagacttgtcagacacaactgagtgactgaactgaactgaactgatacagtttagtaatattactatcaaaatcacttaattctctttcaatacttaagtcattaaacctgagaagaatgggaaacaatatcatgaatta

SEQ ID NO: 18951 - DNA, 201 bp, Bos taurus
aacaatatcatgaattatacttcacatgacttcctaaataaaaacagttcatagttcaaagttttaaaagcactttaccagtgaagctaaaactaatcatctgtcttagctaatcaagcatttcaaagctagttttaaatttacaggtcattttttgataatttccattttatttctgttctattatctaaaccaagagta

SEQ ID NO: 18952 - DNA, 201 bp, Bos taurus
gtcccagccaaggttaaggtctgtccctcctggctgagtctgggatgagccccattccaggtgtcttctgagtggagctcctgaaataaaacaagactctcttgtggatcctgaccacctctcttagaatagcttttatttatcaatataatgatgttgaaaggtctgtccctaccatggatgggacagattaaagggaca

SEQ ID NO: 18953 - DNA, 201 bp, Bos taurus
acaccctcaactccgtgagacaacttaaaagccaaccactacaccctcaactctgtgctgcaacccccttgccagggggcctttaccttcatcttccgtcaaaactgcacttgggttgatggctacaaagtctttagtgtcagccacagccacactgggaaggagaggaggagaacaagagaagcccccagaatcccaggc

SEQ ID NO: 18954 - DNA, 201 bp, Bos taurus
gtaaagatgttgccacaataacatcgaaaggagtcacaatagcaaactcagcacaatatttgccattggcatcttttaaataaaaaccatcaatgaaccatgagaattcattgttacatggaggaattccttatagatcatcacaaagagtcagaggtgatccatcagcattaagcagtcatgaaggacttcatcagtggt

SEQ ID NO: 18955 - DNA, 201 bp, Bos taurus
aagaaaaatcaacacatttgtgtttggtggtggcaggaaaccaagttggaatcttttacacagaaagcagaaagacttcccacctgcccagggtaactgtggaaaaccgagttcaggaggagctggttaccacatgtataaccattttatcctagcctcacaaccccaattcacctttctcagcctttcccaaagaaggat

SEQ ID NO: 18956 - DNA, 201 bp, Bos taurus
ccagctactttcctctgactgtttcagctaagaacaccaggataagctgcaatgactcagcccatggaaaactagggccgctgaagtttcccaggaagtcgtgttgctgtacacacgtctgcagccagccagggcaggaagtcgctggcagtccagggttctcccagcctcctgggggggtgggcagaaggccagaagaat

SEQ ID NO: 18957 - DNA, 201 bp, Bos taurus
tgtagcgaagagcttaaaaaatgaacttgctaaaggacagaatcattgagagctgtaattacaaagacccatcctgaagtcaaattcaggttgggccaaatccataaatacaaggatagccctgagagccagtagcccagcgaaccaagccctctccctgtcatcttctctccctggcctgggacataagaataactggcc

SEQ ID NO: 18958 - DNA, 201 bp, Bos taurus
tctatgctctcctagagctcaaagtcagagtgtctgtacaggcaagaattacacagtgtgactgacgatgctactgccaaagggaagatacaaggtggtctatctggaagcacatgggacagaacacttaaccccaaatggaagtactgggctcggggagggcttcttggaggacaacacactgctataggtgaggcttca

SEQ ID NO: 18959 - DNA, 201 bp, Bos taurus
tgatgtcaagtgtctcacagtggaattagaagattggagttaactcctggcacttacacttttacagatgtgaacttgattaagttatttcaaataggaagtagtttcacctgtgaaaagggaaaattatttacctaacaagttgttgtcctcattaaggttattcatagtacctggaacataaagatgcattttctatag

SEQ ID NO: 18960 - DNA, 201 bp, Bos taurus
aagagaagtcatactaaaggtgtgtttttcaagttagtgaaggttttttccccgtcttgtctgtcttaaaacataagcatctccttttgatttatttctttttattctccttattctaataatctcaactgtttcacagcatttacatgctatcttcctaggctagtttagttttatggttggaattcaacattatttggg

SEQ ID NO: 18961 - DNA, 201 bp, Bos taurus
tgtgacataagtggtacagctgagagaagttggggccagaatgcaaaagaccagcaacttccaggtctgtttatgagcactatctggctctgggcaagtcttgtctgctctcttggcctgttctgtcacgtggtaactgagtaggttggatctactaagttgatgggttctgtaggtagggccttttcagggctgagacag

SEQ ID NO: 18962 - DNA, 201 bp, Bos taurus
ctgccacgccctcctccaggggatcttcccaacccagggatggagaccctgtctttctgtggctcctgcattgcaggcggattcttaacccctgaatcaccggggaagccccaaataggagacataaccacttagatgacactagaaaggagccagctagagaaaagactttgaatttaagagtcaaggcatagctgacag

SEQ ID NO: 18963 - DNA, 201 bp, Bos taurus
aacagtaaagaacatatcatttacagagaaataaaccaatagcattattagagatagagtcacttcataaggataagggaggtataattctaaacatgaaacttctaataaaataacctcttaatatatgaggcaaaaattggaaacttggtaagtattaaaatagatataaacatgcctctcaattactgatgtcaatca

SEQ ID NO: 18964 - DNA, 201 bp, Bos taurus
tgcgcaggtcagtgcttgctggttcacaccgccagttcactgccaagttcagaggcgtggactgaatgccctgggctgacaccttgccaaagacagaaaaaagaacatttaaggcttgaccattaatctgaaacaaaaccagaagctatgattatgtcttatgggaatattcatagttattaaaagatccttgtgctgctc

SEQ ID NO: 18965 - DNA, 201 bp, Bos taurus
tctcccccaagccatctgactttcttaagttgacataccaagtcaagtcatgaacaggcagccccttggtgctgaacagccaaagaacaacctcttcaaacagagataaacaacactacacagggtgctgctgggtggtcactgacaacacatttacttcaaagagaaatggctgtcaggtgactcacagccacaggaaat

SEQ ID NO: 18966 - DNA, 201 bp, Bos taurus
acagttaaagatgcataactctgtcttttctactcagaggcaatgatgagtataagacaagaacgatagcacagaggcagctgaagcacacttgggtggcggaaaatcaaagcaaaacaaaactcaaagtgtaaagcaggaaagagtcagaatgtatccacctttccctggaacatgattaaggatggcaaatttcaagga

SEQ ID NO: 18967 - DNA, 201 bp, Bos taurus
ttccaagaattggaagggaagtctcaaggtcatctggccatgcctctgcttctgtccataaagaagaggtaggttggtataaaatgaaagctgttccaagcatatgagtgtctgtggatctcacagctggtcaacagagcctttggatggaagttccagtaggacgcaaaacagagtgaaattgacttacctctcgggatg

SEQ ID NO: 18968 - DNA, 201 bp, Bos taurus
atgaatggcacggtgtgtttcatttaccctttaatatcatgttacttcaggcagagggataccaggaggagagtgcagacccttgtaggaccccagagacagtgcagcctctgacttagggcccatgcacaacttaccagttgctggagggcacctacctgccaacttccaaactgtgtttcatgccccaggcctgggcag

SEQ ID NO: 18969 - DNA, 201 bp, Bos taurus
attcctcactttctcttctaattcaatttctggccagtttctcagctcttcaatttttcttttacaatgcttcatctgtttctctcttcttttgtctcatcattcagaattaacaagaataaaaaagttcatatgcaaagaaaatctacataagtatagctctaaaaaataaagaacttaagatgttactatttctttctt

SEQ ID NO: 18970 - DNA, 201 bp, Bos taurus
attcaatgcataatttatatttcttttttgtctgctattattagagtttaaggaaacagatatttattggaatttctcaatctcactgacaataactctattgatattgtttgtagtgagtacatttttgcatttttaaaaagacataagaagtaagaaatacctaaaatgaaattaggctcacagttgatctagttacaa

SEQ ID NO: 18971 - DNA, 201 bp, Bos taurus
gctagcctggatcctcagagccttttatatattaacaggtggaattctcacaattattaaccctattttaaagaccgggaaacaaagacatagaaaagtaagtaccctttccttggtgtcagagctgacaggtccgggatatatatccaaatttccagactccaaagcctgagggcttaatctaagccatcctatagacct

SEQ ID NO: 18972 - DNA, 201 bp, Bos taurus
gtggccacagccatgagtatgttgaggcttcagaagaggcttgcccccagggtccctctgctgtggcaaaatggtctggttggaccccaaggagactaataaagtcaccaaggccaatttccatcagcagatccagaagccaatcaaagatgggctgatcacctggaagcctatgacttcttggactcaatggtggaaaaa

SEQ ID NO: 18973 - DNA, 201 bp, Bos taurus
accagtagactttcttgagactgacagattttaggtgggaggaggttagtggagagtactgacaaaggatgggaagcacaatgagaaggacaagggggaatttcctgtacaaaaccctggtggcctaagaaatagcttcttgtgtcatgctaaaaagtttggaccttattctcaaagcaaacagagaaagggatttatgga

SEQ ID NO: 18974 - DNA, 201 bp, Bos taurus
cacatcttctgtgggccaaggattatgttagaggcagagaaatgcacacgacgcagtccctatgccccaagggattccagcctaatacaaaaaaatgttacagataaatgaggccactgcagcatatgatcatcagcataatacacacacacatattaagccctggggttgcagaggagaggatggtcaagatccctgagt

SEQ ID NO: 18975 - DNA, 201 bp, Bos taurus
gcaggctacagtccatggggttgcaaagagtcaggcatgacagaatcataggggtcaacaggtaactgatggtctgctacaggcctgtataaaatgcacctggtagtaatggggtaatccaaccatcaatatttactacaagttggcactgtcctaggtgtacaggatacatcgatggccaaaaataaaaatctctgcccc

SEQ ID NO: 18976 - DNA, 201 bp, Bos taurus
gaaatattaaggaaatgaagaaccacataaactgtcaaccactgaatcccctcccatactatctctcgaaaataacagatgaccatgccatcttattaacgcattcaatgatttcataggtagtccaggaagaggatttttaatataaaagataacttctcttttggagagtcagcccaagaacagtaagaactgaaggag

SEQ ID NO: 18977 - DNA, 201 bp, Bos taurus
atgactaacacacagactgagaacctcatagcacaacacgtgctcctcgaaaacaaggacttatcttccttcttctccttttaaatgtgctctgcacacacgacacactttgccaatattcacaagtatagttctaattggaagctttccacaccctattcatacagtgggaattgctgagtgatggaggtggattgggat

SEQ ID NO: 18978 - DNA, 201 bp, Bos taurus
gggcagtacagatgtgtagcagaaggacattttagcagtaatggctgacttttttaagagattgttttcatttatcatttgtgaaattttaactagataagtaataaaggccatcacctctctcttcctcagaaaaggattactagccctgtgggcccaagcaagtgactccttcagcttcctcatctgtatttgctgttg

SEQ ID NO: 18979 - DNA, 201 bp, Bos taurus
taggggctattatttccttcccttattctgctgagttttttttttttttcagtctgatgagaggcctggcacctgttggaaaggagaggtgctttcttggcacctaagggagtatctgaagaggtcacctgagtttatagccattggtatggtggataagttcagtttgacaacctttatggaatgtcgagctcatgatgc

SEQ ID NO: 18980 - DNA, 201 bp, Bos taurus
tttttcttgaagtgcacctgtgggtcaagagaccaaaagcaagcaaatacatctatttgctccctaacaccatcatggcccacagagattaaacatttaaggattaatttctgcttgaatcaagaggtactgatatagacgcattttcccatgtcgtgagggccacggataagacccaatatgtaacagtatgtaagcatt

SEQ ID NO: 18981 - DNA, 201 bp, Bos taurus
tgaagaaacaccaggcctgatttgtctagatttgtattgggaggggtacatggggcgggtagaaggtgggtggtggttgtagataactaatattgattgaaggcctgcaagctatttttatacacatcacatcatggaaaactcagcatatccacaatctttgaaatcaaataatattttagtactcttacaaatctctgt

SEQ ID NO: 18982 - DNA, 201 bp, Bos taurus
ctaactacagacaaatgctgcagagctctgcagccactcccttgctctacagttagaccactgcttaccagtgctgattgctgcccttaacatcccatgggctggagaagaaaagccaaactttgagagcaggattgctgctagaaaaaggaagctgggtgtgggtattggggaatggtagcagatctgtcgttaatattt

SEQ ID NO: 18983 - DNA, 201 bp, Bos taurus
gggccagtccagacttgatagcaatgaccccagaactgaggagcattagtgaattccataaggagtgtcattctgcagttcttgttttacaaaggtcattgtgatacaaggcccaggggaacagccaagcaaatagccttcctggaagatggtggggtgagggaaaggggaggggtgatgttactaggagggaggggtgaa

SEQ ID NO: 18984 - DNA, 201 bp, Bos taurus
tggctaatgaatttaataatttcctgaactgggacttaaagggcctttgctaaaaagctgcttttcctctttaccatccagttccttcaaatcccatcaacgagggttcccattaggcccggcaccggcacttgagctaaccttgcccggtgttcacaagccctcttattctcttttcagtgctcctcataggtggtactt

SEQ ID NO: 18985 - DNA, 201 bp, Bos taurus
gcaaaatccagtccaatcagaacgagagcggtgggcaggggccaccatctggggtatcaggaaagtagcagctcttttgcatgtgggaaaaagtgcaagggggcaagtgaggcctgctcttcccttaaaatgtattcaagatgcacccccccccttttttaaattatttggctacactgtgggatcttagttccctgatca

SEQ ID NO: 18986 - DNA, 201 bp, Bos taurus
cagatgcagttagggaagcactaagaagttgtacaaaaaggcatttatttggctttggcttatctttagactgtcacttaaacatttggtttgctacacttattacttgacaaagtcatcagacctgagggctcatgtgcagatcttgcacctgcagtgtgaacaagatagtcttcctgaattaagaatgaggataaatga

SEQ ID NO: 18987 - DNA, 201 bp, Bos taurus
cacacagcaccgttgcaatgaagcactgtgtctggatgaaagatggaagtttcagagcaggtcagatctgagttcaaatcttgaatgtaaactccaagtgatcaggcatgttttgcccacccttatagccctggtacctatgacagtatctgattcaaagtaggtatcttataaatctctgcaaaaatcaaaatcaaaaga

SEQ ID NO: 18988 - DNA, 201 bp, Bos taurus
cttatcatgtttgtggccacagtgatcttcacagcattgcagaatttaaaaagccagaaagtctgttagtaatcatcttgtctccttactgaatagatgaagaaacctaggcccttaaagtttcagtgattttctaaaatttcctagttaaactcagcagttgaattgggacttgaatcaaatatagcactgagctcagcc

SEQ ID NO: 18989 - DNA, 201 bp, Bos taurus
tcagatttttaatatttcttgaatgaataaattgaatgaatgcttatgctgatgttattatagtacattatccctttgtttggagggggatctctgtaaacacatgctttcaagtctaaaaattcttcaatcaaaaagaacatttagccaagactaaagcagataagttcaaggtgtctatacaaatgtaaacgctcagtc

SEQ ID NO: 18990 - DNA, 201 bp, Bos taurus
aggctgaatgcctattggttctggagtggaaggaagtgatcattctgacactctgccacactaccaaaaatctgttttacatctgtattaaatatgatccggaaaaatggaagaaatcatctcatagcttccccacagtgcaattgcagggatgtgagcaaacatgtctattaggaataatatataacaagaactgagcca

SEQ ID NO: 18991 - DNA, 201 bp, Bos taurus
tagtagtagtagtattatattattctcctaaataatatcaataccccagaactggcattctacttgatgtaacccttttctccagaggtcctcaccagtattctaaaggtggaactgaatatgtatgatgtattgaatatcatatgtttctcctccatatccacaattctgtaccacatgatccaggagaccagtccatat

SEQ ID NO: 18992 - DNA, 201 bp, Bos taurus
tcacttgcttaccaaacaagtgctgcttctgtctctgtgtctcagagtctccccatgtcgtctcctttaccatctacttctagctatgtatagacttgagtacgtggatggggcacctaattttcaaacagcataatgtccatcctctttcaggctaattcctagacatccacatggaagcactttattattttccttcag

SEQ ID NO: 18993 - DNA, 201 bp, Bos taurus
acaaatcattttgtctagatttgagagtttattgcctgtctaccaagtaaagactgagcttctcacgggtaaatggaaggtgagaagaatacaatttaggttacatgattaggaagatgaaagcagagaaagatgctgcagttggatgagcttttccagcagctgagttaaataagaaccaagataaccccctgactcaga

SEQ ID NO: 18994 - DNA, 201 bp, Bos taurus
gaagggtggctcagccattccacctgtttcaatgggtattttcttagtcacccagtgtgtaggagtctctagtttcgtgaagtttatcgaatctgtgggtggagggttgtttgcctatttagatactccttccaacacaccctgccctgatgtccagggcagaaaacattctgtccagcatcagcaattctcgttcagcta

SEQ ID NO: 18995 - DNA, 201 bp, Bos taurus
acaaaaaggggttagcaggttacaacgggatatgagtagggtacaggtaggtcactcactgtcacactgtctctgaaacatgacactagacccaagaaatgaatggtaagaagtcaatcagccactgaaagaactagaagaaggatatttcaaagagaaattaaaaagctgtgatgcatttataaataaaaacaaacaaaa

SEQ ID NO: 18996 - DNA, 201 bp, Bos taurus
tttctataaagaggtcctgagaatgagagtctctcctgatggtagtaacatgtaggatatttcagtaagggaagctcttgaaattatgtgcctttggtgttttctagggacaacagcagaatttgctgtgcggtcacaaaccttttgttgtccctctgctggaacactcttcatgagttcttgttatggtctctcttgttt

SEQ ID NO: 18997 - DNA, 201 bp, Bos taurus
atactttgaccacaccccttggaacacactctatccttctgcccgctagtgcaaccagcaacaacacagactgctctgatattaagaccaactgcccagctgggatccccctgagagggcatcgtgttcagctgctgcacttggacgctagcgtcaggtcctgctgtctatccctgctctgcaccacatcaaacgttctgc

SEQ ID NO: 18998 - DNA, 201 bp, Bos taurus
atattgggttgtttaagaggaatgggtcttggaagacatgatctgtcacttagagaagactttgtgttcagaagagacagctgtgaagataccaaggactcatgttttctgaagacataggatgtgttaggaactatacctgcaatatttcctttaatcttcataatataccaattaaggctcagaaaaatcaagcacttc

SEQ ID NO: 18999 - DNA, 201 bp, Bos taurus
gggtctgtgattgcagagagatacgaggatttggggaaaaagagctgaaacagtcttgccattcttcaggagtatttcggggaaacaagccagcatatcatggtgatttagttttataaagcattagtttgccttggaaggtgaaggtatgggagtttggagagtcaggccttgtgagaagcagagcttatcctcatgttt

SEQ ID NO: 19000 - DNA, 201 bp, Bos taurus
tggatttgggaggatggggcagatttgagaggccaggtctatggaatgtggggatgagggctggagagcatcatgtctggggtgcaggcgttgggtggacgatggtattttccacaaagccggggagtgtgatacagagatcctatgataccctcatgttgagagacaggtccttagcagctctgactccgttctgtttgg

SEQ ID NO: 19001 - DNA, 201 bp, Bos taurus
ttctttgaggacgaatgatacactatactgagcacagtgcctgtgacacacagtagggtctgaacaagaacaatcacagagaagagggaggattaaatgaagcaacccatgtgacaatgcttggtgcataattcaatgagtacttactgcatgaatgaatgagctcacagaatggttgtgaaaacaagacataaatcccca

SEQ ID NO: 19002 - DNA, 201 bp, Bos taurus
tgagacctagaaagaggaagcaactttgcccaagatcacacagccagtaagtgaaagagctgggttagaactcaggccactagcatgaaatatgtttccaagtgatgaatgacccacagaatataggcatcatgagacttagagtgtcttcctgggagctccccagcaccggggcctggcacgtggcaagaacacttttat

SEQ ID NO: 19003 - DNA, 201 bp, Bos taurus
cacactacagcccatgaggttacaaagattcggataccacttagcaagtgaattacgacaatgacagaaacatatactgaggcttacctagtgtgtgactgtgatgatgaaggatgttcttgcatatggtagcaggtcaatatacagtaacgctttctctcctaggtaactcaatcagggcatgggagatagaatttgatt

SEQ ID NO: 19004 - DNA, 201 bp, Bos taurus
attgttcttcatgccctgaaacctccatcttaaggagtctggcagtgcagttaggaacgaagccacgtgctcctgggtccctatgttctgtcatgttctaactgtggggccatgagcagattacttaacctgtctgtgccttatttttctcatgtaacgtaaggataataatctttatctcatcaatttgttttaaggttt

SEQ ID NO: 19005 - DNA, 201 bp, Bos taurus
tctttttcagagtgttggctcagaataaacccttgaaattaattgttttgaagatgatgagatttgtaactttgagagctgctgacatttgtgcaccttcgcagaaaggcaagactaggtttctggaagaagaaatctggcctttggaccagagcatgtggtcgtggtttctgctcttttaaccacgaaaagggctaatgt

SEQ ID NO: 19006 - DNA, 201 bp, Bos taurus
ctgtagaacagaggagctgcagggtctgcagacactgggaaaacgcctcgctctatgttctgaaaactgctctccctaacttgcttcactgggccaaggactttccattcattcagtctcatcttatccttacaaagacccaatgaggaaaatgtttcttcactttgtagtcaaggaagctccttaacagagaggttacat

SEQ ID NO: 19007 - DNA, 201 bp, Bos taurus
ggtcgcaaagagtcggacacaattgagcgacttcactttctctcactttctctctctctctctgtggtaggcacggtgctaggtggaaaggacacagataaaccacttccttgggatcaaagcaccaaagctgtattatactgggtacctgagattccacgttgctagaacagactttggatatttgaaaagaagagatta

SEQ ID NO: 19008 - DNA, 201 bp, Bos taurus
caggcaggtttagtaagacaagtcttgggaacatgctggaactggagaatacagatccagcctcagtgcattcgaatcctgatttctaataagcctgcctatgggcctcgcttactaccctgtgtcatccttaccccaaccttgagggatggagatagagttggcccgaatctgctattcaatttacaagatggcaacatc

SEQ ID NO: 19009 - DNA, 201 bp, Bos taurus
gaagggaggggactcagaggtgggtgagggtcctggctttcatagctctagggacactgcaccatgagaacaggaggaagggcacagagcataggtgcagtgctgggggtgcagcatcgtggtacatcggtgacaggaggtcatggcaacatctctgcagtgaagtgtgacgcgagggcatcagctaagagggtctgggcg

SEQ ID NO: 19010 - DNA, 201 bp, Bos taurus
aaattctgatcttatttttttcattagtccgggacacttttttctctgtaaagccccatttataatttctttctttcttcgtaccttctcttatagatcatgcacattgaaccattattgtatggtagtgactcatgatgaaaaattccatttcagagtgtaaatggtcaatgtgcttaattgaataggaattctaaatta

SEQ ID NO: 19011 - DNA, 201 bp, Bos taurus
ccgcggtcatttctcagactttttattaaggtccaggtagtaaacttggcagccttatggcctcctaaccattttcttttgccgctgtcatttgaaggccaccacagatggtatgtagacaaatgagcttggcgagttcccataaaacttgctttgtaaaaatgagtagctggcccacaagccataagctgctggctctgt

SEQ ID NO: 19012 - DNA, 201 bp, Bos taurus
tgaggactctgaaacagcaggaggggcataaagctttacctccagaattctgggaggtgagcctggaagacaaggaactctacttaagatagacaagtctgggcacattaatccacaggaccaggtgaccaagaagaaagcatgagctgtgtggagggcggctgcttgaaacagctgctaagctcagccctgggtacttaa

SEQ ID NO: 19013 - DNA, 201 bp, Bos taurus
ctgtcccggctccagcctgtgcccggaggcactcagcatgcctgggtctgcaccctgtggcctggacacgaggcacctccgttctggggtgcgggattgtcacactctctcctcctctcctgggtgcccgatctgcaagcagaccaggagctccagcagctccaacgaccatccgcctgagctcctgcatggatgatttcc

SEQ ID NO: 19014 - DNA, 201 bp, Bos taurus
taagaagatgggaagggagacacacattcattcctggggaaaacatgaccaggtgtcttgagctgatccttaaatgaaagtttaaaaacaggaggtctacgaggcagctccatgctgatcctgggctgtgttcccaactttgctgtattagttgggtgatagaatggagatgatgatttattccttgcctacttcatgaag

SEQ ID NO: 19015 - DNA, 201 bp, Bos taurus
tcatcatcatcgagacgagcaccatcaagccttaccaccggggcttttactgcaacgacgagagcatcaagtatccacagaaaactggggagacaatcaacgacgctgtgctcactgctgtggggattgttattgccatcctcgcggtaagtgcccagacttcgatgggcaacctgtctgattccctggcagcacatcatg

SEQ ID NO: 19016 - DNA, 201 bp, Bos taurus
caagctctcacagacaaatgcttgcagctccgctctttccagaggagctagtcagatccaagctctggagggcaaaggccattcctctgagagaatgaccgctttctctcccaaagctgcttctttcagagctgtggctcccccagccccagccactgaatgcagctacaccaagaaatcaatggttctcacggccagaga

SEQ ID NO: 19017 - DNA, 201 bp, Bos taurus
tggtcagttgtattaaaaagtttattcctccttgttttcttgcccactgggactccatctagagaaacatttcctccagctctactagacttatttcaaaaagaaaatattccgttttttcattccactttgaaaagataaggcatccagcttcctgtcctgtggctgttgctcagacttctgtactagttctcagcaatg

SEQ ID NO: 19018 - DNA, 201 bp, Bos taurus
caatggtgtaaacaccatcaatgaatcccaaaacagttttgggcacttatttccatgtaaattgtattacttaattctctgaaatgttttataggattgggagtataacacatagttttaaaatgctgttcctcttcctaaaagatctttcttccctttgctgtctgttaaatacacctgatctttcaggatccatctcca

SEQ ID NO: 19019 - DNA, 201 bp, Bos taurus
ttaaatacctgaactgagatatgagcctctgcccatgacaggtatgacagtatgtgactttaggataactaagttaaacacccactgaaacaaaacagaacgaaacaaaacaaactcttttagaggaccataaaaaaatctagaatccacaaaatataaaaatttacaatgcgcaggatacagtccaaaattactcaaaat

SEQ ID NO: 19020 - DNA, 201 bp, Bos taurus
ataagtagaagagacttacccgcaactaccttacagttgtaaggccacaaaaagagaaaaataattatgttaccttgtagtaaagcttgtaacagaggatttggtaagagatcaaggagaaaagaactaaagtgactttgagacctgtgtccatggttctgttctgagaacttcttatgaacatcgagttctgttgggccc

SEQ ID NO: 19021 - DNA, 201 bp, Bos taurus
agcagggatgctggcatgcagggatataaaacccaccagatgactgtcccaagaaagacccagtggacaatctcattactaaagcagtaagaaatatactgatgggagggaaccagaatcggagaaactcagtgttggctgtgttttgtaggcttgggctgaaaaataaatacattacaaatctagattcttcaaaggtga

SEQ ID NO: 19022 - DNA, 201 bp, Bos taurus
attatgcttctgagagggagaagaggcagtgaggagcagagggctgccgaggctggaagggaaaattgtggtgaggacaacatctgctttctattccccagactcgggcccccggccgccctcccggtggaacgtttctccattccgtataaacagaaaggatgattctcgtaatctcggcaacaaaatacgcaagcataa

SEQ ID NO: 19023 - DNA, 201 bp, Bos taurus
attttgcctcgttgcctcgtggggttgggcaccaaccctgaaacagagtagctaagccgtcaggagacatgctagttctcctttgcctctctctcattttactctgcatgtatctaaatccccctttaccatctcactccttcttctgctgtctgttaaaactgaaggtctaactacagctaccagcttttttgttcctga

SEQ ID NO: 19024 - DNA, 201 bp, Bos taurus
ggcagttaacactttgcactgtccagcttggccccaggctcctggaccaggcacaggtgaagggcagaggtgcagcctctccaggccatagtgtgtatgaggttgaagcaggaggtcagctctgaatctgcattgtcagtgtgtgaaggtaggcagaggaggttggcatgggtgagtctgggtgggagagtgaggctactt

SEQ ID NO: 19025 - DNA, 201 bp, Bos taurus
gcagagcatttcagcgtcggggaagccaatacaatttgagttagtcgtgatggctgccactttaaataccgcggtgagtgtccgtcagcgactaatgtgctgcacagggcctcgcagagaacctgatcaccccagcgcttcagtcgattctgaccccgagctacagaaaatgaacttaaatctagtgggctgtcgccacgt

SEQ ID NO: 19026 - DNA, 201 bp, Bos taurus
ttaggtggcaggccaaatagtgtaacagaaagagagagccatctaccagtttaaggggtgtgggatgccaaaggtcacacctgctaagcttccaaccgttatgcctcctcccgtggcccccatggtcactctgtggtttagtccaactcccagatggagaggttgtgcccaggataaggagatgacttggctgaagattct

SEQ ID NO: 19027 - DNA, 201 bp, Bos taurus
gcggcctcccggctggaggacgacctcagcatcaatcaggggtgacacacagttcagcgccaccaagatcatcgtgggagacggcaggcccataaatccccgcctgcccagacaccagaggctgaaatatgtctgaggcgtttcccggagagaggttgagagttcctggcctctgcctgccagctccttccttttcctccc

SEQ ID NO: 19028 - DNA, 201 bp, Bos taurus
atgcaccatggccttctatatgccaagtcccatgacagcttctggggccacaaaaacattaagacagtctttccagatgcagacagtataccaggacacatgcatggaaaggaacacgtttccatcacaatactgtaaagtaattatcctccaattaaaaaagaaaaacaccttttacatagcacaagtacaacaagtgca

SEQ ID NO: 19029 - DNA, 201 bp, Bos taurus
gcacttagcactgtgtactgtctgttcacttgttaatatttccaaagttgtgagctctttgagggcaaggcacttgttggattcatctctcttttttcaggccaacacaatgcctagcttgagtaagccctcagtagatatttgctgaaccaaacgagaggaagactgagacctcagaagaacagacttagggctctgagc

SEQ ID NO: 19030 - DNA, 201 bp, Bos taurus
cttccttcatcttgatgataatgctgatgattcacggagtggctaagaatgtttctgacatcatactgatgctgtgtctacattgctttatttaatcttatgctcaccagaacccatgaggtcagtgctgtgtgtctgggactaactcggacaacctctatgaaccttggctgtctctcttctctccaggttgggacctgg

SEQ ID NO: 19031 - DNA, 201 bp, Bos taurus
tgtgcccaccaggcccctcatactcttctccttgccccacagccaagaagacctgtgcagacagcgacttcacctgtaacaacggccactgcatccgagagcggtggaagtgtgatggcgaggaggactgtccagacggctctgacgagtcggaggccacgtgcagtgagtcctgcccctgggctgtggtggggcctggct

SEQ ID NO: 19032 - DNA, 201 bp, Bos taurus
atattatagtagtgttggaaatatagtgaacaatagaaagaaattgtcttgactttagttgggggaggtggggaagaaaggcaagcaaggaaaagaaatatcattttaggcataatgataaatattataaagaaaaataaaagacttcaagggatagagagtgattaaggagcaggtcattttattgaacatcttggtttc

SEQ ID NO: 19033 - DNA, 201 bp, Bos taurus
gggtggggtttccgggagaggcttccgtgcagattccgtctgggccctgctcctgcggcgggtgtctggactgcaggctctggatgtcgtggttgtcggaggcttatgggaagtaggttgtggaacgggctgctggagtctggtgccattcagtggcacccgttgtttcaatccctttcagtggacactgtattgacctga

SEQ ID NO: 19034 - DNA, 201 bp, Bos taurus
tcttctgaaactctctgtcagggtggggtaggagaaaggaaaaagtggcagctagtttggaatagtcattccaatcagactattggggtcttgtccccagtgtgcccttctgtagagggtcatctgtcaatgtcctcctcattcatctactgtggacttgcagcagggttgggtgatagtggcggtggtaaaattctgctt

SEQ ID NO: 19035 - DNA, 201 bp, Bos taurus
tgttccccaaaccaaagagacttttaagcttgtgtccagggtctgtgggaagaaatgagtgcaccagctcatgggtatgcgtaccctgactccctgagacgtgcgggaagaccagacacatggacaccaagaaaagcagggcactgacatctcacatcgaagaaacagcctctgcctctcacagtctctgcatccacaggg

SEQ ID NO: 19036 - DNA, 201 bp, Bos taurus
tcaaatatctgactacggtatcaaatcatgatcactaacttttctttttacattaatactaggacaaatcatttacctactaaaatttagaatatgtcctgtttctatcaggtatgttattaagatagttagcatgactttaaaatcctcttgtcattcatcctatggatctatttagggagacaattttgtaacgaggac

SEQ ID NO: 19037 - DNA, 201 bp, Bos taurus
tcctaccttgggcacctttgagaggacagtgatgacagctctttggcatgacatacatactctctgtgtttggttgcttacggcctcttatctcaccaatttgagctttctgctctaatgataaactgctctgggcattctgggataataaaggctgttttctgcccccttatatgtgtttatgctgtttcctgggcctag

SEQ ID NO: 19038 - DNA, 201 bp, Bos taurus
aattaagtagactgattgtatgattttggataaataaaatagcttcagtgatttcataataaggtagagatattagtaaggcccacctcatagagtttttatgaggattatgagtggtaacacacatgaatgaaacatactgcatagtaatgaggaagtgttcaataggtgttagcaatgattactatttactctaagagg

SEQ ID NO: 19039 - DNA, 201 bp, Bos taurus
ttccactgttgtaaaactaagcaaatgcctctgtaactgaatatttgtggtttccacaggctactggatactctgtattcctacaacactcagtttgtagcgtggacccatttgccaaattcttctcgaattgcctgcaacctgagttctttccctctcaccttattgtagcctcttgttatctactcttattgtttaaaa

SEQ ID NO: 19040 - DNA, 201 bp, Bos taurus
gtttgttccagacagcgacggtgggcccatctgacagacttcccaacgctgtccagcgctgacctttcaagcccttcaagcaagcagcttgagagcaaaacatgctgctggccactgccaagcccctgccaaggcatggcatcaggctggctccgctagacagtggaaccgaattttagcccctgggctgagcaggcactt

SEQ ID NO: 19041 - DNA, 201 bp, Bos taurus
acttgcattcatttctgtttctagactccatattcctactatgctcaagggacttcccatgcttaataagtgcaaacggggagcagaaaacaatccaacagtttgtttaaagtttgtttaaattcaagaaaagctagtcattaacaccagacatccaaatctttacaaatgtttcaaatcacttttaagtgttttaataat

SEQ ID NO: 19042 - DNA, 201 bp, Bos taurus
agcagcatggtggaaaaatctaaaagaagaaatgaatgcatgagttttctttttaaagaaggtgcagataaaaaagtagaagaaagaaggaaaggcagaactgtatgaagaggacaggcccccttaagcattgaatggcaaatttaacaaagaaaactttttttctttaagataaaaattatcttgaagtaaaaatgggaa

SEQ ID NO: 19043 - DNA, 201 bp, Bos taurus
atggatggagaagcctggagggctgcagtttgtggggtcgcagagagtcggacacaactgagtgactaacacacatacacacacacacacacccactcacacacaacttccttatctctatcaccatgtctaatttattcttggtcctgttatggaaagttggtttatgtccagtgggtgaattattccatccacctgctt

SEQ ID NO: 19044 - DNA, 201 bp, Bos taurus
tgtctatgggatagcacagtgtcagacatgactgacatgacttagcagcagcagcagtagcagcagttgtaattataaatgagcaggtttttttcctagcataaatgtataagtgctattgctaatgtataaacatggctccactgaagccattccttctgctgaacgaattctctccagctatgctcttgctatttataa

SEQ ID NO: 19045 - DNA, 201 bp, Bos taurus
gaaccgtttaacttgttttatataaaaaaaataatccaatatttaaagggcaagaacatatgctttttaagttgacagacttcttgaaataaccttcaatagacaaatacagaaaaataaaataaattttgcaatcttaaagatctgtttttagagagtcttaaggcttttccttttgaccagttgatttctggttatgtt

SEQ ID NO: 19046 - DNA, 201 bp, Bos taurus
ggcatgcaggtcagttgcaagaaagagaacaacttgattatgtcaggtacacagaaaagggagagagacggcttcttgtggaggtgccaggaaatgcttcccaaagagttaacagttaaacttggtctgacatgatgcatagtaggtgttttccaaataaagtaggaaagggtagtctatgcagatgggatagtaaaaggc

SEQ ID NO: 19047 - DNA, 201 bp, Bos taurus
tttagctgtttgagaaggaatttgacaagtctcaaaacggccctttcctgacataaagaacaaaacagggaaagaggatggcacccctagaaaaagtaagaagtaattcgtgaggcaatggggcccattggttaagaacacaaactctggatcaagctacaagcgttcgatatcagtttagacccagagggatggtatggg

SEQ ID NO: 19048 - DNA, 201 bp, Bos taurus
aggtcatggtccctgtttggtggttggctgcccatctgatccactacagcttcctgattcccagccaaacctttacatctgagaagtatgctagcacatcgatgagatgtgctgaaaactgcaattcctgcagccagtgttagtcaacagaaggggcccaattcttctccataacaacaaaagttgaacaaattgggctac

SEQ ID NO: 19049 - DNA, 201 bp, Bos taurus
tcaaagaatgcatagtctgagagctataacctagatgtcaagtctttaagtaagtaagataagctgtgtgaagtgtctatcacatggcctagtgcacagtacttacatagaattagttctcctttgaagtttcccagcctcctacctactcctacctactttggccttttgtatcacttaccctttccagaatacatcctg

SEQ ID NO: 19050 - DNA, 201 bp, Bos taurus
atatggtgcatcctaccaataggagctatccaacaatggagggctgtcagcatatgaagagtgctggagctgcttcagttaaaggagaatggccccctgttagggagacatggagaaggagggtagaccctatcagtatgtgttcccaattaaattatagggaatgatggccaggtgttatagttactggtattgttttaa

SEQ ID NO: 19051 - DNA, 201 bp, Bos taurus
tttgcagcagtacaagaacttctttggtattattgttctacagtttgtgggttgcctactcttcaggtattggattttattttaatgtgattttgccccttctgccatctcgttgtggccttgaatgtgggatatctttttttagtagcttccaacgtcctcctgttgatggttgttcaacagcaagtttccattttggtg

SEQ ID NO: 19052 - DNA, 201 bp, Bos taurus
tccttttcctaagagagagataccaccttatacaccaagtctgactgtttctctatgccttagctcttcccttattggcctatctagtactgacttattcttgccattccttcccataaacccatccgaggatctagagacctgatggccattccctgctggcatttatctctggatattgctcttcctgttctctcctgg

SEQ ID NO: 19053 - DNA, 201 bp, Bos taurus
tatatatatattttacaaaatatgtgctaggttttttgtttgactctgaagaagcaacattcagtcaatagatatttactgattacgtatatactatgagattctgttctaagtcctggggatacaacttgaagtctttttactcatgaaaatggcattctagtgggtgagacacacagcaaaacaacatatactatgata

SEQ ID NO: 19054 - DNA, 201 bp, Bos taurus
aaatagaaacgctgctcactcaaagtcgtgtcctagagaggttgcatgcttatttcagtgatactattattgctttcttaatttccgttgaacaaatttatctttagtatcgacctttggaatcaattttcaggccatgtaatagaaagaactgggttttggaattagacaaaaacctcgcttcgagcctagattccccca

SEQ ID NO: 19055 - DNA, 201 bp, Bos taurus
tcatcccccatttttgccttcccctaggccctgcaaccactaatttactttttatctctatggatttgcctattctagatatctcatataaatgaaattgtacagtatgtggccttttgtgaccagattctttttttacttaacatgttttcaaggtccatccatactctagcatgtatcagtacttcactcctttgtatt

SEQ ID NO: 19056 - DNA, 201 bp, Bos taurus
cctctgtggtcctcttctccttttgctggagaggaaatggcaagcactccagtattcttgccacaagcaccccatgaacagtataaaaaggccatctggtataaggacataaatcactgttatatgcaatagaaacacttaatccttgcttcattcccacaaatgcctgactgtaaaggccaggtccctcaaagttccttc

SEQ ID NO: 19057 - DNA, 201 bp, Bos taurus
ctccttccaggcaagggctggcccctgtgaacacctgctgtgggcctgatactagctgcttttcgtagagaaaaccacctcaggagtagacaggatcatcagatgaggacgcgggcccagagaggaaatgaatgtctcagacaacaggagagactgataaagatttggagttaggagagatgctggcttattcgggaacca

SEQ ID NO: 19058 - DNA, 201 bp, Bos taurus
ttctgtgccctggacccactctgtgcaggccctggtgaggactcagctcatggagaggtggcagacctccctccaggagacgggggagatgagatgtgtctggggacagggtgcagattgcaggcctgtacttgtctcgtgtcaggtcatccctaaacacctccttggtgccaaggaaacggtgtgggtttgaaatgaggc

SEQ ID NO: 19059 - DNA, 201 bp, Bos taurus
tggggctaatctaccaatgggcatttattgggcatctgctgtgtgcctggctctgtacagcaggagaaatagcaatattgaacctttagttgtggtttgtctgatgcaggtcatcatggccacgtgaggtcggcacagggcagtgaggtcggccacccagcttccatttccaaactctgccacttttccttctcttcctcc

SEQ ID NO: 19060 - DNA, 201 bp, Bos taurus
gttcacctagaaacttcctccaccctctgagtcatccctgtggagccctgaccccgtgtcacttgggtcttcctttgcctcaaaaatcatgaatgccctcccactccagccacacagagttctgatccccacccctcagctcccctaacttcctctcagcttccagttagagtttcttcacatcctttctaaaccactttt

SEQ ID NO: 19061 - DNA, 201 bp, Bos taurus
gctgtccctattgttttctcttgcctatagggaaaaatagcagtttcattatagcccctgctttatcgcttctgagatttgctgcttgttttgtgtctgccgtatttaaaatgctttcacgtgaagatttgaagcctgagaataaatccttcagtgtctgtgagtgagagactccctgcctcagtcatcaggagagcttgt

SEQ ID NO: 19062 - DNA, 201 bp, Bos taurus
gagacatttcaagccagaatcacctagttcagcctctttcagattgctgacccttagaaactatgtgacataataaacgtgtaatgatgttttaaactgctaagtaacatgctttgcaacaatagataactaataaataagcatagtggatatcatcaataaaagtatgtttgctgaaaaagtcatccacttaattcatag

SEQ ID NO: 19063 - DNA, 201 bp, Bos taurus
ggtgttaaaaactgaatgtgtaaattttgagtttatataactaaaatttctctgagtctgtatgactgattgatgctataccactgattactatgtcttccgccttcctgagttttctgaacaagtgtaaggaaaaaagttccagataatggaatatgttttattgctaaccagggatatggactgaaatctctgatcttt

SEQ ID NO: 19064 - DNA, 201 bp, Bos taurus
gtaggcatgcaggctgcctctgggacccggcgctgagcgtggaactgtcgcagtgctgaccccacttcccgaagcgccaggccccattgctgccagctccatgctcatctgctagtcagtcacaaccagactggactttgaggtgctcctggcttcattcctttcctgtaatgattaaacaggcccgagcgccattggccg

SEQ ID NO: 19065 - DNA, 201 bp, Bos taurus
ggagcagcagtttagcaaaaatatgccctcactggcactcaacaaatgggttcccaagcacaattctggaagtgtatgaaagtgagtgtatatatgtctatgtattttaagttgtatgtgtgctcaatcatgtgcaactttttgtgattccctggacagtagcctaccaagttcctctgtccaagaaattttcccagaaag

SEQ ID NO: 19066 - DNA, 201 bp, Bos taurus
gatggccattaaactccccacctctgctatgcccttctttataaacaagatcccgttcttcaagaggagaccaatgccaagaaaaggaggccaagagaggaacataaaaggggcagacaagcttacattgaatctgagtaattaggaaagtcaccttgccaactacccagcaagggccctaaggtccggctcaggagtgcc

SEQ ID NO: 19067 - DNA, 201 bp, Bos taurus
tgcctccggcccccaggtgactcattctccctgaacaaagcaggccctatcttcgttccccagcgtagccttcaaggaccggatcatcagcgcctcctttctgaagccgcccccgggcccctgagggagaatgaatcactggctccactcggctcccacagctctgaacttactctgctttgtgctgtgggtccagctcca

SEQ ID NO: 19068 - DNA, 201 bp, Bos taurus
cagggcaagaggggagccaacagacatcaataagctcagagggagaggtttttgaatctttaggcagagtgttcattcatttgggggaagttatgtattactagatcccaacctggtctagatcaactacaagatgcccgtgaaatgccttaagtttcctgtcccaaacctgtcgccatcctcccaccctcttgccttctg

SEQ ID NO: 19069 - DNA, 201 bp, Bos taurus
agtgggagggatgacgaaggctttggggccacccttgattggctgcatgacatcccagcatgtcaactgttactcttatctgtcctgtgtcgtcaccacacggcaggcctcatgagggctgagaccttttctcttttactcacggctttatctccagcatttaaaacagtgcctggtacatagaagggatctgaacagtgg

SEQ ID NO: 19070 - DNA, 201 bp, Bos taurus
gcaaggagcagccctgaaactctgagtggcttcaaacagcagatgcttatctctcacccatgtgaccacgtgactgtcacaaacccaccagaggcctcagggcagccactctgcagaatgcggagagacaacgagagcaggcaggtttcacttggttttgaagctgccgcccatgggtgacacacaccatatccactcaca

SEQ ID NO: 19071 - DNA, 201 bp, Bos taurus
ttctcccattctcctttaggcccttacaagccaggttcttctgcctggagggcctgtcctcctctctccacatccacccctctctgaaaaactcagctcacgccacctcctccaggaagccttctaaatggggatacgtctcctctgacttccccacagtgtttgtgcttccctttcccaaagccattacctcactcagta

SEQ ID NO: 19072 - DNA, 201 bp, Bos taurus
ctttttacataaattaggaaagagacaaaaagataatcattctagctcccatgatagagaccaccagaactaaggattccacataggaaggagtctgggtacaaaacttcattgtatacttatagcaatttgtagtaacttttctttgactccctggagaatttgactacaagggctcagtacttagtgtcttgcactgtg

SEQ ID NO: 19073 - DNA, 201 bp, Bos taurus
tgcctcactccatgttaagcaagagttctacagggtatggtatcctataatattccaaatggaaactcagatacagggttatctatattcagaattccttgtaaatatctaaggtttttatatacccttatcaatttacccattccctagacagtgtaataagagactataagatgatgcagttactttctgttaatcata

SEQ ID NO: 19074 - DNA, 201 bp, Bos taurus
aaaggagttggatgaagcagaagagagagaaggggagggaataacagcggggaggaggaggggagacagcacctgctctatggggccgagaccctagcaaggacagtgtgtccagcccccctgcagcttcacactctggagtcactcaagccccacaccctgcctggcgcctgaggctcccatgacagctgagtcagaaga

SEQ ID NO: 19075 - DNA, 201 bp, Bos taurus
attgttaggagacaatcacaggttgaacagatctgaggcctctctttctctgcagcacgattagagcagagtggagacaaagagaagaactagaagtagctcaagccccatgcaggctggcccagtacctctctcccctctccttcctaatctcctgcaccttgggtgtctcaaggtcctctccacctgcctgtgcattcc

SEQ ID NO: 19076 - DNA, 201 bp, Bos taurus
acctcggcccggaggtcttcatctgatagcttgatgccttcttcatcctgggtcaggaaagcacaatgggacagcccaaggcatgtgaggtaggttccaataaggcctcacaagagtagctgtcaaatgaaggtctgggagagggagggaaattccttttcagactaggggttcggagcgtctctttgattcctatctgtt

SEQ ID NO: 19077 - DNA, 201 bp, Bos taurus
cttcaatacttcccctgcccatgtgtctgacattattggtctcctctcttttctaacacatttgctcctaacacaattttccctcctatttctcagatgaaccccctaattcccacaagtgctaaatattgaaggatccacagggttcagtctttggaacttttcttctatttccactcatcccattagtcatctcatcca

SEQ ID NO: 19078 - DNA, 201 bp, Bos taurus
attagtactcattgcctataccaacctctgttcctgttaacagaatcagcacaccttgaaggagagcaatggaagcaaccagatcattccatcaccttctgctatatctgaacttgacaataaaacccacagtgagaatttgaaacaggtacttttgattctgtttaactcccttgtgaccacactataatctgaaggtga

SEQ ID NO: 19079 - DNA, 201 bp, Bos taurus
ccaagaagaactccaccacaggggtgaccaggttgtctttagatcctgcagacttcacccatgacactataggcctcatggcccaggagctggagcccccgtatgacattttcaccagagtgtacacagcctgaagaattcttaacaaatggcagccccaacctgaacttcaggcctgaagaccagccccattttgacaca

SEQ ID NO: 19080 - DNA, 201 bp, Bos taurus
gccgggccatggattgggtactgctggtggcagccaggcggctgaggaggaaaacgcgagtggacgacctgggcacgatagtgagtgtgaaagaggaaagtgagagctctgggggtaggcctgcctgcctgggcctaggaggccttgggcctgacagactgctggagcgagggggtggggccggaggcctgggctgaagtt

SEQ ID NO: 19081 - DNA, 201 bp, Bos taurus
ttgcattgtgtcaaccacaaatgtcttcagacattgtctgatagcctctagggagcagatcgccccctgttgagaaccactggtttagacagatgcatatggtcgattcactaccacaaccatgaaaatacagaatagttgtattatcctaaaaacgtccctcatactgcacctgtgtaatcaacaccctcctccatccca

SEQ ID NO: 19082 - DNA, 201 bp, Bos taurus
atgttaagagcttcaattttaacattcgcaaaaagcatgattactaaactcagtaaactccagaacacaagcataagactgtgatgggtatttaattggcggcttcccctcaaatgttagacaaaaattgacataaaggagaggatttgaggtagggagtgatgagggagagtggaagagctgacctagtgagagaagttg

SEQ ID NO: 19083 - DNA, 201 bp, Bos taurus
atgctcacataatctcccagaggtctaaaaggacccaggggtgctgtagtgtgtgaatgtgcgggctgaaaccactatagatcttttttctattattaataagtatgaagccagttgaaaaagaagccactagctgagcaagactcaagatcacccaactgtgaaacccatccaacctatggatttccatacttgtgagtc

SEQ ID NO: 19084 - DNA, 201 bp, Bos taurus
tgtgtaagttaaatgtaatatattgacatttatgttggtgctgatgtgaagttttagcagctaccttggaacttttcagtcaagtttctcaagaagttaagtcctaagtaatcataataatcagcttagttatttttactttgataagttttactgaatgctgaaaacttagctgctcccaccatttctgttagtcgacta

SEQ ID NO: 19085 - DNA, 201 bp, Bos taurus
aaaatggaggctctggattccagatcaagctgcctgaattcaaatcctggatcttgggaaagttatttaacctctgagatccttagttttcccatgtatagtgaggataatgaccgtaaatccctcgtagagttgttattgaggattaatttaatccatataaagcaccctggaatagtacttggttttgttaagtgtcca

SEQ ID NO: 19086 - DNA, 201 bp, Bos taurus
agtttagtcaatctcttcccttttcttttctcttctaaactagagcttcttgggccttgtgggtattgttaatgagacttttcttgacaacctaaggcctaagtgtcactggctttatgtcatttatcttctgtcacttaatgattatcatcagtcataatattggtttgtgatttttgtttaaaaattatttttacctaa

SEQ ID NO: 19087 - DNA, 201 bp, Bos taurus
ggagagcaggatgggtgagcagagttcatccccacctcaccttggggacagaccttcagctgaagccacagggcccccttggtgcaaagcctagactcttcccgggggcccagagagcacacaagctaagccaagccagacttatctgtgaggcgaggcagccatgagaggccttcctagttagggccaatggctgatacg

SEQ ID NO: 19088 - DNA, 201 bp, Bos taurus
tgtattagataaagggtaggcaaactacatacagcccataggccaagttcggtctgctgggtttttgtaaatacaggtttattggaacacaatcatgcttatttgtttgagtgttttctatggccaccctttttcagtactggcagagttaagcagttgcagcaggaatcccatggttcacaaagctacaatatttactgt

SEQ ID NO: 19089 - DNA, 201 bp, Bos taurus
taacttttttcattttcccaaagtacttatcactttttaatatatggcactgtttactgatttattatttaaacttcttttttatttatgctgcctctcccggctaggatgaaggctggatccttttttgttcactaatatagcctaggagcccaaaactattctcggcacatagtagtcattcaacaaatagctgttaaa

SEQ ID NO: 19090 - DNA, 201 bp, Bos taurus
ttggacatggagaggccgggcagcccggccctccacaccggaacctcctgcaagcctgtccagcaacacccacctgcagggcctcgcaaaccagctccacatccagtgccttcaccacaaactccaggcacagctgggaacagaaacgaaggtgggctgtgcccagatgtccctgttccaaggccccagccccaggccaga

SEQ ID NO: 19091 - DNA, 201 bp, Bos taurus
aagtgcagttctcccccacatccctgttgaaccttgatcttgacctagggtttcgatcccttgtggtgacagagggaccttagcatggcccataatcttgttaatttaatttaatttttttttaacgtcaagaggtccaggtaagagtggcaatactcttcatctcccggatccacaggagcccccgcatcaggtgaccca

SEQ ID NO: 19092 - DNA, 201 bp, Bos taurus
ctctggaatcagaagccaggaaaataccccaagggcagtccttgtattccttctctggggatattgcctcaagaaccagtgagactgggcagctgccctgaaggaagccagtggctaaacatggcccttcccttggcccctcccttccccacatggattctcctgttgctgttctcattcactgaaagactgattgaccta

SEQ ID NO: 19093 - DNA, 201 bp, Bos taurus
tccttacctggaaacttctccctggaacagataaaaacctttcccatgtgtctgtattttgttctgaagataaccttggattagaaaggccttttcagtatgaggcaggaaagctggagcttgtaccttgacctctgaggtaaatctaatgaagccaagccaattccccaggctaaagaccaagttgactcaaatggttta

SEQ ID NO: 19094 - DNA, 201 bp, Bos taurus
tgggtactggggtctctactcagagcttggcagtacaagctggtacagaattaggtagttccagaagctagcagcaaccagcccagaggcggtttctatatggggacaaccctaacagggccgaactgtgtaagaagtggtgtttgttggtcttgttaaagagctcttctccacaggcatcagggaactgggctccacagg

SEQ ID NO: 19095 - DNA, 201 bp, Bos taurus
gatggcaaggatgccttggatttctagaggaagagtgaccaagaaggagggaaggaagagccagagggagaccatggacacgaatggagactctcctgtcgcttgtgtcagtaaccaactggggcagaacagttacttggagacaagttattgaaatgtcagagggccctgagcagcagcagtcaggagggcttcctgaag

SEQ ID NO: 19096 - DNA, 201 bp, Bos taurus
agaaactgaggtgtaggtgaattaaatgctgtgcccagtgtcaaatagctggtaaatgtcagaatagcaactcaaaaccaggccttcttactagagattcagtattttgtccagaatggttcagtctcctatgacttacttttgaagactcttatgctttcccggagttggtgatggacagggaggcctggcgtgctgcaa

SEQ ID NO: 19097 - DNA, 201 bp, Bos taurus
cattaagaaagtttttagtaaatgttgagtgactgctggcaagtggtaccactcttctgccttagctgtttagaatgctgattatatattctttctctatcacccccagataatttttttaatctataatattctttagcttaatatatgtggcaaagattatttcactttcagtcaaatcagttttctctagaagagagc

SEQ ID NO: 19098 - DNA, 201 bp, Bos taurus
tccctttatctttaacctatatgtgtctttatatttaaagttggttttttttaaacaacatgaagttgggtctcatttcttgatccactttgagaatctcgttcttttaactgatgtacttagatcagttcagttcagttgctcagttgtgtctgactctttgcaaccccatgaattgcagcacaccaggcctccctgtcc

SEQ ID NO: 19099 - DNA, 201 bp, Bos taurus
catatttgttccaagtcccttgaaactgagcacagatggaaccatgcaaacttagtgacagagtcttggccccaaatggccttcactgggcactgcacactcctttagtgttggacctgactcagccacactcctgctgggtcccaggacaggactctcctcttctaggagcactgctctcctctctacctgccgtggtct

SEQ ID NO: 19100 - DNA, 201 bp, Bos taurus
atgatcttgataacataagtacttgagataaaaaaaatgcctgagagttctccctcccaccccttcgttttactcaaattgaccttaataggtttccaacgtgtacactttccctctgatgtaagacactattcccagaaagaactttcttgacattgagggacaaaagggctgatgaaactagaaaacctgactcttgac

SEQ ID NO: 19101 - DNA, 201 bp, Bos taurus
ttttactctctaggctctcaaggaacacctcccatccttgcctccatctgtctcctcagcaggcagctggaggctccaagtatttattcccaatcaccacgatgggcagaaaacatcagtgttagtgaaaggatctaggaagttcaatcacatggtcagaacttacaccaatcaatgaaaatttcttttacaacagataca

SEQ ID NO: 19102 - DNA, 201 bp, Bos taurus
ccaggacattctattaaggtctcaaaaggaccacaccttaggaaaaagctatatatcctataactaagagttagaccccagaactaggaccaaaagcaaaagtagacttattttaacaaagagtaaaactaaaaatccacaaattcaagatgatcctccagtaatttaattgttggcttaagaatatttgacattctttgg

SEQ ID NO: 19103 - DNA, 201 bp, Bos taurus
tttcaatttataagcaaaacaaaactggtgtacaaatggattctgttggccaattcttttacaaatgggtaacgatttttttaagaaggatctaaggcaatggcaccccactccagtactcttgcctggaaaatcccatggacggaggaacctggtaggctgctgtccatggggtcgctaggagtcgggtacaggcctgag

SEQ ID NO: 19104 - DNA, 201 bp, Bos taurus
cgggagttggtgatggacagggaggcctggcgtgctgcgattcatggggtcgcaaagagtcggacacgactgagcgactgaactgaactgatacaagggagacagagcaacccgaccctcttatacaattgctgagttcaaggaacctcagtgtgctgcataagtaattggaatgtacacccacctgcatttcttctaccc

SEQ ID NO: 19105 - DNA, 201 bp, Bos taurus
tgtggtcatcttcaaaatatcagctcaagtaataaagaagacactcataaactatctggaaaagaagttaatggtaaccagttgaggggaaaaagagaaattgatggcaaagacagcaaaagaaatcactactttaaaggtcactgttccagtccaggtgatgctatagagcttaacaaccacgtgggacagtcaccccaa

SEQ ID NO: 19106 - DNA, 201 bp, Bos taurus
aggtcaagtccaatgaggactggtctggggagttaggtcatggtgatgggttaggtcagggatgagaacagcccctgatcctattaatcaggcagggagaagggcctgccagtcagtgtaggctggtgcaggtaattgggtatccaccacatactcctctgctaagatcacaatttccatgacacagccgctctctaatgg

SEQ ID NO: 19107 - DNA, 201 bp, Bos taurus
cctttgccctcctctgaaccatccccctggccccctggaagttggctttattctcatgtcacagccgaggaagacaggtcaggagaggagaggcaagtgaccttcctaggaccctgcactcagaaagcggcaggcctggaagctgggcccacgctctctgacaaagagactgacatgctgcctactgcgctcagagggcag

SEQ ID NO: 19108 - DNA, 201 bp, Bos taurus
atttgctttttctaatttgtcctaatgagcccacattttttctttatcagacccattttctctggcaaaaggtcatcacgggcaatcatgcatgtctgcttggtataaattgttttcataacaattttcatttgccttggaaagtgcgccacgctgaaaacatggccactttatatctgtgacagcacgcatcatatttcc

SEQ ID NO: 19109 - DNA, 201 bp, Bos taurus
gttcctacctccctccattccagcctcttgattgggttgcagggcagaggcaaaaactgctgagcagtgttcttggtcaacggattatttattggcagaaatgaaagtcccttatcttcccaagcaggagaatgccttaatgctacttttaccttttagattatgcacaggttcaatccaattaattgcagaatgtgaatt

SEQ ID NO: 19110 - DNA, 201 bp, Bos taurus
tcctggccttcttgaagggcagtgactttgtttgggatgtcagagtctggttggaggtgctgggctttgaaaactgttcaacttggtgacttaaaggctggtgttctgtggccattacaggagaaagagccctggattagaagtcagaacacctgggttctcacctggctcctccttgtggcctctcagggctctcgtctc

SEQ ID NO: 19111 - DNA, 201 bp, Bos taurus
ttagtcatcattaaaggccccatagtccctctccacctctctgagagtcacttgtgggcttcaccaactcaactgcttctgcaaactctccagtttcctgtggccttttaggaggaacccctaaaaaaaaaaaaaaaaaaaaacagattgggctcaggacagaggtttgaatgctgagtcaggtctctgggatccttcttg

SEQ ID NO: 19112 - DNA, 201 bp, Bos taurus
atgcaaatccaagcatcagaaccctagaacccctagctatctcaccacacagtaaatgcagggtcctcacatggaagggtgtgggcccccttgtcaggggcgtatctgacctcagcagtcagaccactcaaggttggacccacagggggtcaactcgggatgggcaggagcaggccagccccccaggcccaggtgcagaga

SEQ ID NO: 19113 - DNA, 201 bp, Bos taurus
taaccagaggaagggtaacatataaacacaaggcatagagctgcggtgacatagttcctaaatcctaaagcagccgtcatggccttctctgatctgatacatggatttctgctcaacatgtctcacgaacctatacacgatctgatacataatctgactcacacacctgcctgtagtctgacttgcggtccatcacagctc

SEQ ID NO: 19114 - DNA, 201 bp, Bos taurus
gctctctgttacataggccaccggcagcatggagaaagaaagtcaccacatcagaaatacagttgacatcggtgctatgtttgaaatttgaacttttcaggtcaggcctgggaattttctgctgttggcagtaaaagaagtgaccctcccagtgctgagatgtaagacttgattgtcaagccacacacacagagaagagat

SEQ ID NO: 19115 - DNA, 201 bp, Bos taurus
cctctgtgtgagtgttttagaattggagacacctatgaaaatgaaaaacatttgagaagacatcagtacccctccccattttctggtgtgtccattggccatgcctctgaccttctacctccccagcctctgctgtccatcaggagagaacccggactagtccaaatctctccagagccaggtgatgccctggccgcttct

SEQ ID NO: 19116 - DNA, 201 bp, Bos taurus
cgatgtctctcctcaggaggagagagaatggggcctcagcacaggcgctgcatatgaacacggtcacacccttgacaacgcgcgttggcctcctttttcctcacacagccccatgaggcaggcaggatgggctggtcccgtcacacacccctgctgaggctaagggaggaaatgcggccgtgggtggcagtgtccgcggca

SEQ ID NO: 19117 - DNA, 201 bp, Bos taurus
tgagcctgtgcttctgtaaatacagccataggattctagctgtttggccactatactccaagctcagaatctcctaagcctctgagctttttctggcaacctgccccatgatatcttggccatgatgcttaccagaggttataaggaccttcatgatctatctgcttcttcttggaactaaggagagaaaggagtttatgg

SEQ ID NO: 19118 - DNA, 201 bp, Bos taurus
ggagactgggatgagggcgaggattttaattaatgtagggaagacagagacaaacagttctgttgtggaaagaagctggtgggaccaatgatgcagcccagtggagcccaaggaggcagatagccctctgcactgtaattccattttacttcccctaaggcttcagcaaaattttgttaaatgttgcaatctggtttacaa

SEQ ID NO: 19119 - DNA, 201 bp, Bos taurus
tcaaaaactacaattgaaaactattaataacaaaaaagcaaacagctctattcaaaagtgagcagaagacctaatagacatttttcccaaagaatacacatagatggccaataggcacatgaaaagatgctcatcgttgctaattagagaagtgcacatcaaaactacaatgaggtaccaccttacaccaatcagaatggt

SEQ ID NO: 19120 - DNA, 201 bp, Bos taurus
ctatgagagctcggcctccctttttggccatgtaccggaaattgcatagacaggctgatggaaagtgtggtggggagtgctttccggaaggaatctggtgagcaggcttgggcccaggctcctattctcttttcacttttttttgcctacccctgcactgtaagtaggattgaccatggtgatttggaggaagacatagag

SEQ ID NO: 19121 - DNA, 201 bp, Bos taurus
agcagaggaattcaggctctgaacatgggcagtctggctacagaagaagtgcatgactgtctcttcagtttcatggtacctatttttctttagagcagtgctttcaaagagtcatccccagacctgcagcatcagtgctaacttaggaacctgttagaaaaacacattctcagtctgcactctgacctcctgaaccagaag

SEQ ID NO: 19122 - DNA, 201 bp, Bos taurus
tttaatccttcactggggaataagaccctgaaggccgtgtggagggaccaaaaacaagacagacaaacagattcctttttaaggctgagtaaacgaagattgtggcatctggccctgtcacttcatgggaaatagatggggaaacagtggaaacagtgtcagactttattttggggggctccaaaatcactgcagatggtg

SEQ ID NO: 19123 - DNA, 201 bp, Bos taurus
ggcctctgcttgggcaggcagctgcacccctgagcctcagtttcctccttcacctcttggatctgttggaaggactcagggaggaagtctgtgtgaagtctaggctacagggccaggcacagagtggtccccagataaggtttacttccttgaggctgagtaagcccatggccccatagagtcaggactgatcccaaggaa

SEQ ID NO: 19124 - DNA, 201 bp, Bos taurus
caatccaggcaggctggctgcagagtccactggcttgactgcactcccaccctggttcaggatccggggtcttctctgatgctgcctctgccaggcccccgcctcccttcatcacctaatccctgaccagtcctggtgatagagaagcaaacccagcagctcccctcctgtctggccccctgcttcattccctcatcccgg

SEQ ID NO: 19125 - DNA, 201 bp, Bos taurus
aatccagtccccagtaagctcaggtttaatacagtaagcacagtgagtgttctggagaaaacctctgcttctgtccacaagcagggccctgaacgtcccttaagattgacccctgaccgtggtcacagaggttatctctgtctagcacagggtgcatcatatatgttgacctggggtttaaatgcctttgaggcctggctc

SEQ ID NO: 19126 - DNA, 201 bp, Bos taurus
aggagagttaacttgccaggactgaggaatagtgaggaggcccataggagtggagcaacgaataggaggagagaaaaggcaatgacgtgggagtggtgacggtgtctcgtggggccccctgtgcaacactgaaggcactcaccatgagccccacttcacagatagggtgagggaggggtggagggccgaagctggtggcca

SEQ ID NO: 19127 - DNA, 201 bp, Bos taurus
cattgtctgggtcgaaacagaagcccagagagaggtaggtgtaggaggcctggagataggggttgatgaggttgtggaataattctgacaaaccagggagttcatggttggttggcaataagaatgatgaaagtgaaagtcactcagtcgtgtccaactctttgtgacccaatgaactatacagtccatggaattctccag

SEQ ID NO: 19128 - DNA, 201 bp, Bos taurus
aggggccccatcctgcactctccggggagagggagagaggggatggaaatactaggtcgggggaagaagaccactgacaggcccacggagaagcccttaggataactcgtcaggaaactggagtgggattagggcaggatgcatgatcaagaaaaggtggcattagagttgatacagcaccgcacgccactaacagggcca

SEQ ID NO: 19129 - DNA, 201 bp, Bos taurus
gttgacggtgactgatagagccggcaggagagaatggccagggagatcctccagagccactcggtaagccctctcatgggagaggatcagttgcagagtccgtggctttcggtccagctttgggccaggcttctctctggttttgcctgagtcagcgcctgggaaaagggcagcttcccttcctcatcttccctcttctca

SEQ ID NO: 19130 - DNA, 201 bp, Bos taurus
ctgttggtttctaacagggaacaaaccaaaatccaagttatatcgctctgccctccctaccccagcccccaccccacacaccaacaataaatgagaaacacgtagctaaagcccaacatggtgtgttctgctcaagagctgggcctgaccccaggccagctgcctctgtctggtggaacgccaggatgctcttcggcagtt

SEQ ID NO: 19131 - DNA, 201 bp, Bos taurus
aagttgggggtaattagtggaccaaatggtaaaggttggtttccacgtctgcctccctcacctttctgctttcccttgggctcacaggacccatcccaatgcccagtgctcaggaggtgcctgggaccagccggaaggaaagacatacgcatgggcacagtgggatgcccaggtgggatccccaacagggtaggcaattgg

SEQ ID NO: 19132 - DNA, 201 bp, Bos taurus
agagcgcggccgggccggtggggagacaggagcaagcggggcagccgatcccgcagaaatgtctccacaacaggaagcgtctcataacatacctgtggtttggccaggccccggggctgcctgagcttcccgcggctccctcagctgcagccgcccttctggggtagggggcttggagcagcaggagcctgcgcagagctg

SEQ ID NO: 19133 - DNA, 201 bp, Bos taurus
taaatttctaccctaaaatgagttttaaggaactcatttagtcctttagtttgggttaaggtatatgaattgaacacaggtgttggtagcaaaggagtttatggtgtctctctgtgtattttttttccttaaacgtttgttgaacctggcttgtacttcttaattgggatctaaaaggcaaactgacatactggttggtgc

SEQ ID NO: 19134 - DNA, 201 bp, Bos taurus
ccccttgggcctgggtttggttactccttgctggccagtcttggctctgatatctgtctgctcaccaagataccagttcactgccactgcaggatcttcacgatgggctggcctgctacagagccctgttcaggctggttctgtccatctcgggtggtttctgtgtccctgccagttaagtccctgcaacctctgtagctg

SEQ ID NO: 19135 - DNA, 201 bp, Bos taurus
ggggagggcctgaagggggctgagctcaccaggctgcggccccgagcggcgaagtcttctccgagcgcgatgctccgggagcctggggccgctgctcacgccgcgtagcccactccaggctccgggctgctgcagctccacccccacccccgcagcgctctcgaccaatccgcggcggcctcactccaggctccagccaat

SEQ ID NO: 19136 - DNA, 201 bp, Bos taurus
tttcccctggtaggattttttttagggacagtggtagtttttgtttaaatatagttgtgtctgaactaaaaatgtgttgcgggctgaatttttgtgaatcagtctttaatatttagcagacgttagtgtaacatgtgtcttatgaaggagagctcctacctggactgtggtgacactacctggataagtatcaacaggcca

SEQ ID NO: 19137 - DNA, 201 bp, Bos taurus
tcaatttatatgtacatgtgaacaaactgcatctcaaatgaaatgactgcaaaataccctgcatatacagaataactcattaataaaaattaagcactagcgataaatagttaaattacaactgggtaacagtggttatatttccaaatagcagtatgaaaaaagtcaaggcaagagatgtttattttggattctatgcta

SEQ ID NO: 19138 - DNA, 201 bp, Bos taurus
tttttctgacttatttaaacagtgtctaatgaccaccctgcaaaattagttcatattcctcaaatgatcctgtcataattttttgttgttaaacactgaactataacctctgagatacttcagaaatactgagaaggtaaaaataaatatacttgaatctaattaaagttaatatgaaaagtattaaatgaattccaacta

SEQ ID NO: 19139 - DNA, 201 bp, Bos taurus
tatataggactgcaggataacaactgcattgttgtgtactgtggaatggggagggcactcttggaggaggactgctgaaggtggtcagtctacctgagaacggaagacatacttggtggggagcagggtatgtgcttttatatgaaaagagccgatgttaaaactcatttggttaggtaaacgttgtcacataccttcaca

SEQ ID NO: 19140 - DNA, 201 bp, Bos taurus
cactcccaactcctttttgtagaaattgaaccagagggcctttagggttggagacatcaggtacaatggagggtgggatggtgagtggagattaaaatagtgtatgaaaacaatgaaagtctgcaaacagaaggatgagacttgaagtcttttccccccatgttgtgcccaggtcacattgatcatcaggtgagaacttga

SEQ ID NO: 19141 - DNA, 201 bp, Bos taurus
gcctgtccccttgcagcccagagaactgtgaactgagcaggcaaatagtgtcttttgttgggcccaagcagtgggttttcctgaatctttgtgttctgtaaccattgtcctatacgataaaaagtttcaagttgtgtccgtgcctggccaccccactgcaaaaaaagaaccaggattgcacttgtttctgtctgtcagagc

SEQ ID NO: 19142 - DNA, 201 bp, Bos taurus
atagtttcaggtggacagcaaagggactcagcaaaaggcccagtttataatgtaatagctaacacacttggatgttgaaactgcttggcctttagaaacatatgggacatttcagtcttcagccagccggttgtgggtagatagaaaaccagatccaagcagcttggctaacaggaaatggaagcagcaggagaatttgag

SEQ ID NO: 19143 - DNA, 201 bp, Bos taurus
cagaatggtctcccaggtaggcctggccctggccctactcctgtctccaccaccccagctggcaccctggcagccaggcctgtctgtgcttatcagctcccgtgttgactcaggatgggtacgagcctcctgtccccccttggaaaacaagaaaacatgttttgccagtggcggggtggaatggggtggcctctctggctc

SEQ ID NO: 19144 - DNA, 201 bp, Bos taurus
cccccggtgttggtggctactgcggagagaggatgatggtcatttcccacgtttagagagcactccctctcctggtttatagaaccgggtcattaactttaatcctcatggccatggcagagctgggctctatcctcgtcccctttacagacgggggaaccaaggttcagaggggttatgcagggtcacagctgatcaggt

SEQ ID NO: 19145 - DNA, 201 bp, Bos taurus
cccaaactgtagctctctcctctgttctacaggctgctgcagtcagcctcttgacatttggatatctccagtgaaactgcaggggtaccacttaagttctccaagtggtctctcaaagccattctcttgtcacctggggtgtaggaggtagcatccatgggctaatcagactaggctgggataacaccatccaaccaaagt

SEQ ID NO: 19146 - DNA, 201 bp, Bos taurus
ttggaaaaccaggccaaagcattcaggttaaatacagtgggcatggctaaccatgtgtggttttcaagcagaaatgtaatgcaatgatagtatgctttctatttgtctttagatggctctgatcagacaaagcaactaatttcctgaacttccacagctaaaacatatgtacacattcacacttaccatttgtttttgaac

SEQ ID NO: 19147 - DNA, 201 bp, Bos taurus
ttgttgcatgttgcttggaatgaaaggccattagatagggggctagaaattcccttggttgtacagagatttcttgtttccagagggcctgacctagcaggctttctggcaatcctattgaaccctgtctgtctgaagctagccctcaaggagcaggggagggtgcctggggaggagggtcaacagggaacatcagagagc

SEQ ID NO: 19148 - DNA, 201 bp, Bos taurus
ctgtgctggcaaacatcctattgcattgcattttaatgtgggatgaagttttctaatggaacatgagcaaacataatctatggagctgctgctaataaacgacatcactgtgtattggagggtttatagggcactggtgatgactgcaccggttaagcacagctaagcatcccttaatttagacatttgggctcaggttat

SEQ ID NO: 19149 - DNA, 201 bp, Bos taurus
ctattcccagttgacatctgagcacgtcgttgagccggtattgtggttctgtcgagcccacctttcctcttcttgtgcatttatacctcattgaaacctgagtactccatacctgccacattttcctgattttcccaactggtaagtcttttgagacgggaatgaaggtaatgagggtactcttggagagagaataccact

SEQ ID NO: 19150 - DNA, 201 bp, Bos taurus
tggcaggttctgagccgaggatggcctgatctgatctgcaaaggagggcgagggtgtgggcagggagactggtgggagttggctgcagcgatgcaggtgacagatgaggggccctagacaattgcagtagcagtgaagggcatgacgagggggccagttccaggtagattttgcaggtggagcccgcagagttggctggtg

SEQ ID NO: 19151 - DNA, 201 bp, Bos taurus
ccctgaggccaccagctctgcctgaatcagctacttggcagcctctgatagtgaccgcatagcagtcctgaggatgtgagcttaaggtgcatgactccagccttggtaacgtcaaggccacccccacccctgctgtgtgtatacggcttggagtgctggttctgtgagaagccaggacagcacagaggagtccaaatgtga

SEQ ID NO: 19152 - DNA, 201 bp, Bos taurus
tgccctgcagcctggcgttgagggtgagcactgagtgctggccctcggtggcagggaggactcacatgggtgtgtgtggcaggagctcagtgcaagtgccatggacaggaaggtgaggcctgggtttcagagccctctcgcttttcaaccgcagctgcgatccgccaagagagcagaggatattgaagaagacaggtcggg

SEQ ID NO: 19153 - DNA, 201 bp, Bos taurus
ggctgctctggaaagcagacaataaaatgactgtctctcctggaaaggcattgagaggatagccaatcctatcaaagctcttccctgccccaggatcttcgtacttatcctggcttctgcctcagactctgtcccctgacgtcaccacatagccaactgcccccatgtcactcccaggtctcctcatctaaaggcatgccc

SEQ ID NO: 19154 - DNA, 201 bp, Bos taurus
gacacagggggcgcggggtggattcaggagtcgaaggagaggtttgcccacagaaggacattcggcagtcggagctgttttggcccatgacagtgaggagtggggggcggttgttgagggtgtgcccctggtgtgtccgtgggtgctcgccaacaccccgcagctctgtggggtccgtcctgtgacaaagacataccgggc

SEQ ID NO: 19155 - DNA, 201 bp, Bos taurus
agtggggaagccttgataaatatttgtccatggacatggtcacggatgctgcagaatccagggtgtggactgctcaggatggagggctgaagctagcccccggaaccttccgagatgtcccccagtgggagtgggacagacccatttttagggatgcagagaaaaacaaaaataaatcgagaggctcaggtgaacgctggt

SEQ ID NO: 19156 - DNA, 201 bp, Bos taurus
actggacggcgagggaattccctacagtgcgtttttgactcatcagactaggaccttgtgatggttaatgctatgtgtcagcttgaccaggccactggatagccagatatctggttaaacgttatttctgtgtctgtgaaggtgtttgcggaagagattaggatctgaactgacagactaaataaagcacccaaatatggg

SEQ ID NO: 19157 - DNA, 201 bp, Bos taurus
tcgagggtcatgtttctctgttggtcagtggcccgccctggagtgaggctgggtgggggggacgcgtgcctctggggacatcacgcatccatggcactgggcagcgagtggtcatccggccttcaggagcacagagacatccacctctagtccaggtgcttccaaaatgtcactgctttgcttaaaattctggcagtattt

SEQ ID NO: 19158 - DNA, 201 bp, Bos taurus
aggccgtgtgcacatcaacatcgtgagtaaaagcaactgctccgttgacgctaatgacagagagcttgaatgatgctcggagtccacttgggggagctgcccggtgcttccaggtcggccggcctggcagaggttttcgcgtggttcctgtccgtggtctctgtgcaggacaagtccttgtttcggtgcagctcatgacaa

SEQ ID NO: 19159 - DNA, 201 bp, Bos taurus
actcagagtcaagcaaagagctcaggaaagagatgaaggaacagatctctggcactgagggtacaaagcaactcacaaaagaaggaacacaaatgcacccgaagcactggagaaagcacatcacctctctaatagccaacaaaatcacaattaaaataccaaggtgaaagggaaggagaagagaaaaagggaaatctcaaa

SEQ ID NO: 19160 - DNA, 201 bp, Bos taurus
gtgaaggggtgatgacagcttggtggccacgagcctgccacctctcacgacaacaggcagctctgcacttagtgggcaccatggggaagctttctgtgaagtcctggccccatcaaagagccaaggatgaagctctgagtaaagggtcacccccagctttcaggccctgagctgactggtaatgtccaatttttcctcatc

SEQ ID NO: 19161 - DNA, 201 bp, Bos taurus
gagggactgaacaacaacaaaaaatatacgtgtgtatgcgtgtgtatgttagatatagattcagatatatgatatgtgtggagattttccaaaaatacacacaggaacacaagaaactattacagtggttatctctaaccatggagtagagcatgtgagacagaacagactcacatttcattgcattctttctgtgctatt

SEQ ID NO: 19162 - DNA, 201 bp, Bos taurus
agtactgatgaaacatagcagggaatagtgtgttaggaagccccatctgtctcaccatgcacagatgtgcacacagcctcatcctctggcctccttgctggtggacctgggtgcccagctcaaagtgtggatgccttctctgtgtctgcagagccacatctggtgcattagggccagctctctcctctctgcaaagactga

SEQ ID NO: 19163 - DNA, 201 bp, Bos taurus
aagacaaagtaggcaggggcctggggatctgagattgtagatggtgcaggcaagattctaggtggttctttgcttgtgacacccctgttacgctccattaaaaaggccattaaaatcatattcacagatactcaggaaaagtcttccaaactcagaaaaaaaggcaaaaaaaaaaaaaaaaaaatgatctcattaccgtcc

SEQ ID NO: 19164 - DNA, 201 bp, Bos taurus
gacggaagcagcttgggttccaggctcaaatgagagcctcataggaaactggaggcttttaaaggcatttaataagaaggttgatgtcagcagtgtgacggttcatccatttgttccttaacaaataattactgagatcctcaatgagggataaagtggtggaaacaaaactcacagcaccctggcaccctggacctgata

SEQ ID NO: 19165 - DNA, 201 bp, Bos taurus
tctctagctgcagcaggcggggctactctctagctgcggtgcgtggttttctcattgtggtggcttcacgggccctaggatgcgcgggcttcagtggctctggttcccgggccccagaacacaggctgtagagttgtggcacacgggcttaattgccctgcggcatgtgcgatcttcctggatcaggggttgaacccacat

SEQ ID NO: 19166 - DNA, 201 bp, Bos taurus
aaggtggcagaaccagtctaacacagcagcatgcccagaccattgcaggctttgtgcaagtgtggaatacacgccatccctgtgtgggccccagctgtaggtggctttgactgttcaccctagagcgatttccagaccacggatgttctcacttgcatagcctgaagggttcggttcgattggtttcctctgggattttga

SEQ ID NO: 19167 - DNA, 201 bp, Bos taurus
ccaccccaaacctgctgaatctgaaattctggagttggagcccaagcgcactggagtttggaaaccatcactgtccatatcacattaaaatttcccaaccgtttgctccaggccaacgttccttgtgagcgctagacccgcactctaaactgccctgtgagacgtctcctttcctgatgtccaccaggggcctgaactcca

SEQ ID NO: 19168 - DNA, 201 bp, Bos taurus
aacatatcgatgaatgaatgagtgaatgaacaggtggatggacggacagatggatgcatgaacaaagaagcaagccacttggggcccgaaggacaaatggggcactgcaagaaggggacaccgttaggaagagactgaacgggagctcagaatttcttcttgtagtaagaacccaaacctatgtctatactgcttgtgaag

SEQ ID NO: 19169 - DNA, 201 bp, Bos taurus
aaaagtgaaattggtcttggctctgggctccatggaggttttttccattaaccagaggtgagcccaggtgcgaggttaatggaaagatgcaaaagaggccatcgaggactaaggggatagtttacacagcaaggaggacgcaatgcctgtgataagtggatgctcttttatgaagcagagcccctggcagggcagggaagg

SEQ ID NO: 19170 - DNA, 201 bp, Bos taurus
tcagcatgagaaatcatttctcctgtgtatcaaggctttcaggcccatggaatgacaccaccacaacagaataaaaaatttcaaggaatatctacaactattgttggcaggagggaccactggaaaactcacaccttttacacaaatagaaaaatgttagattctttatcaaagtctgctccaaggaattcctcatttatt

SEQ ID NO: 19171 - DNA, 201 bp, Bos taurus
ccagccaacctggttttccctcccatgctcggagcgggccagggcatagccgtaggtttgcatggtaacattgaactcttgagtctttttaataagatttgaagccacacaggaataaaaaaaaggcctccaagagcagtctgtatttcaaagggtgagacctccgagggaaagagtgagtgcctatcaatctttttcctg

SEQ ID NO: 19172 - DNA, 201 bp, Bos taurus
aaaggctgaagcccaggaccaaacaggcagagaggacaaattatcccttcccctgccatcttgttctgttgggttggcctaaaggttcattcaggctttttcataaaatgctgcagaatacgggaaagagctttttggtcaacccaatatttgggtcctcaatggattggacgaggcccccgcacattggaaagggccact

SEQ ID NO: 19173 - DNA, 201 bp, Bos taurus
gggacctgcgggctaggggtgtgacctggaataatctgtggaccttagagagacagtctggccactgcacttgcagaagagcctcagggcctgtctttccatggggcttggtgcacggacaagcctatagctgctgggtgctctccgtctgatttactgtgacgatggacagcaaaatatgcgatttcacacgggtgtgca

SEQ ID NO: 19174 - DNA, 201 bp, Bos taurus
cctggctctcctgttcatggggcctccaccctctgacctctttccctcccaaagcccccacctccaagaccatcacttggattagaagacctcaacatgggcatcttgggggccaagtcattaaatccataacaccagccaagttgggctgggggcccgccctgacccagtgtgacctcagcatagcctgatcacatctgc

SEQ ID NO: 19175 - DNA, 201 bp, Bos taurus
tgttcatgtggttgagtcactgtattacagaaccaggagtcatctttcccacactgtgcaagaccagcatgtgtgtgggtaacacgttagtcatgactggcgggccccataggcagattccacttaaactatcaaaagttatatatccttcctcttcattcttactctgatattctgtgtgagttagtatgagttgaaatc

SEQ ID NO: 19176 - DNA, 201 bp, Bos taurus
tgaacggggtctctgagcaggagcaacacggcccacgtcacgtgtgggcagacagggttcccacacaggagagcacatgtcccaccagcatccccactccgaggtggaccaggactcggccccatggaccaggacacaggctgccacttcactggctgggtccgcaggaaccactgctgccaggcacgtcatgggctgcaa

SEQ ID NO: 19177 - DNA, 201 bp, Bos taurus
gtaagaatgggggcccaaccccaagaacctgatgtgtgtagccccagagccaaactttcttctccaaagaaacttttaaatggatgattaatcacaggagctgcaggggatgggcgggttagggcccagctgggatgagttaaattatcctcagaatgcagaggactcttttaagagataaatctcatccagctgtcaact

SEQ ID NO: 19178 - DNA, 201 bp, Bos taurus
cggtgtcctcactgcgcccagcctggccgtctgccctgggccttctggggaggtgccgccttgtgtcttgtgccccttaaagccccaggttaatgggagggtgcagaagtggggcatggccacccccagggcacttgcacacgcactgggcctggcacaggtttcagaggggtctcagcacactcgtgtgtttttattgta

SEQ ID NO: 19179 - DNA, 201 bp, Bos taurus
cccagcaagggctcgcgtcccacacgctccatcttcaagggaacggccgtataagacacttcactgcagccagaatctgcagggctcgcagcagtaagccgcaggtttcacccggaaattgtctaggaaagaaacacgcgtttgggggacgtcaaggggctcggcatcaacagggaggccgctttacgtttgtcctgttga

SEQ ID NO: 19180 - DNA, 201 bp, Bos taurus
aggtcacacggcgggcggcgtctacaacctgggcttcctgcagctggtttccctcatttgaaccgtcaccttcactcgcttctccccagcgagtttgcctatttgaagctggccagtggatgcaggccgtttggactggaggatgaaatctatccagtgtggccgcggtttgggactggggtggtgtcagagcccctcctt

SEQ ID NO: 19181 - DNA, 201 bp, Bos taurus
tggtacagcataccccagggagaggctggatgagcagcgtgccttctcttttgagtgggagaaaggtcgtgaaagggaggtgggaggtgacagggccatccgcctgcctgccccttggaactgacttctcacggggagatgagcagcagacagacgaccaagagctgaggcaggacagcagcctgtcatgagatgtgccgg

SEQ ID NO: 19182 - DNA, 201 bp, Bos taurus
ttaagaatccacttgtcactgcaggggacacgggttcaatctccgatctgggaatcatctacatgcagccgagcaactcaacccttgccccaccaataccgagccagtgatccagggcccgcaaaccacagctactgagcccatgcaccacacctactgaggctcgcacacctagagccagcgctccacaagaggagccac

SEQ ID NO: 19183 - DNA, 201 bp, Bos taurus
gtggccgaagtattggagattcagcttcagcatcagtccttccaatgaacattcagaactgatctactttaggattgattggtttgttctccttgctgtccgagggactctgaagagtcccaggcctctgggcacaagttttcgagacgtgaatggcattggcctgcctctgtgacccctcaggacggcagacgtccagtc

SEQ ID NO: 19184 - DNA, 201 bp, Bos taurus
gctcagcatcaccccagacggcatcagaggtgtcccagaggtggcccccgactgcaggaccctgcccccatccctgggtgcctctggtgcccgagaaagcagaggtccctgagagctctgtggccagggtggtccctccgcctaggggtggggaccccaggtggcggtctccacaatgcggatctctgcagtgctcagctg

SEQ ID NO: 19185 - DNA, 201 bp, Bos taurus
gcagtgcacactgcctaggaagaggcgactgaaggctctggggccctccgtgacccctcatctctggacaaccgagcacggtgcaaagtcaggataaaacaacacgctcagggcacggggcccctcataaagcaggaggacagaggccgctggtgtgtttcagggtctacacggcaacacgtcttcaggacagcacccctc

SEQ ID NO: 19186 - DNA, 201 bp, Bos taurus
ccccaaaccagccacagttatggcttttattgtattgacttcctgttttccttacaggtttcaacctgaatatgtctctccaaacacttaaatctcattttgccattttaccaccaggtacatggaatcaggactttcctggcggctcagatggtaaagaatctgcctgcaaggcaggagacccgggttcaatccctgggt

SEQ ID NO: 19187 - DNA, 201 bp, Bos taurus
gaggggcctctgaagacctccagaaccgtctgcccttgtagatgcccctccctgacaggagcctggaggcttattcctgcctggcccttagcatccgaatcgagggcgtccacgagtctgtgactgtctccccgactctgtgcctcacgccaacctcaggcctctcgtcacccgtcccccatcccatgacactgtccattt

SEQ ID NO: 19188 - DNA, 201 bp, Bos taurus
tggcctctggaatacgaaccatctgcctgggccctcaactcagacaaaagctccccactttcacttggacctaaacctggatgagggaccacggcgactgcgtgttgtggccgcgaggtgcaggaacaggcaggagctcgagttccctgaccagaggctcagatttctttagtccagggacagcccgtctgctggtccgca

SEQ ID NO: 19189 - DNA, 201 bp, Bos taurus
agtgagccggacccgtgaaggctggtcctccctgtctgccggtcactgcctgtcctgacccctggggtcacagcagctccagcctcggccgaggagggctaaccagacaagacggtcctgagaaaatcctttaggacactggtctccatttctgtcaaggcgaccttaagaatcagagatgggacttccctgtggcccagg

SEQ ID NO: 19190 - DNA, 201 bp, Bos taurus
gaacccagtctcaaaggaaaagaggcaatgactgctttgacttcctcaggctgtccagggacgtactggggctctgggttccctttgtttgctcctcatcagggtgcatttatggagggatctgagagtccatggagtgataaggtaacttgtttcagtgttgtctgggtgttggtgagggaatattcttgtcatactacc

SEQ ID NO: 19191 - DNA, 201 bp, Bos taurus
gggcacgttatggcaaaaccataaacacagaagaaaacgcagatgatgatctcatgacctggcaaaattataggcagaaacggaacagccgggcactgggggcaggaggagacctgctccagagggaccgggtgcatgttcggggctgacgggactattgggacccttgaccgcggtagtcatcacacagcaccatgcttg

SEQ ID NO: 19192 - DNA, 201 bp, Bos taurus
ctccttttcagacacgaaattctgaggacccaccccccaccccctgcaaactgccgcctgagcagaggatagggaagggcccgtcctgcctgcactcgtctcctgaacgactcagcagcggctttcagtgctcctcccatctcgttccctggacttgctgcacggccctgtgggtccagacactgctggccttggcccctc

SEQ ID NO: 19193 - DNA, 201 bp, Bos taurus
gagggggtcatggggttcccagtccccagccccatccggcagggccgccccgcctctggggtggacgggcacacacggatttagaagccgcgctggccctcggacgtcggctttctaacctcaggctgcccaacttggctgacttgaagctggcttcccggtgtgggaggtaggggatggggatgcggcacacagaaagga

SEQ ID NO: 19194 - DNA, 201 bp, Bos taurus
aagtttctagagatgaagaacataatatctggattaaaaagaaaacactggacggtgttcacagcaggttagacgctgcagaaggaaaggtcaacggccttgaagagagaaatgggaacgattcgacaagcagcccagagagggtgacacggagggcagcagtgagggggggcctgtgcagggacgccgcgcgcccagcag

SEQ ID NO: 19195 - DNA, 201 bp, Bos taurus
tgcatggggctcttctgcttggaatgcagaggccaaccctcgagagccctcctcgttttccagtgcctgtccccaagccctgaccaggcagcctctgtgccgcggccactgcctgcctcctgacggcatggcacggcagggcgggagctgcaagcaggccagtcagtggcgctgccagggaggggcagagctggccttgcc

SEQ ID NO: 19196 - DNA, 201 bp, Bos taurus
attgtcttgaccgtcgatgccaggagggaaggccctcgggcgtccgggagcggcctggacgctgggacctgcctcctgcctccctttcccgatctgtgtgtggccttcgtggcccctcacacgttcttgtcctcttgtttgtggtggatcgctccatcttttaacaattgacattggattggatgtcagtatttatggtta

SEQ ID NO: 19197 - DNA, 201 bp, Bos taurus
agtgaggccggggcggacgctgggcaagacgagcgcgttagcgtgttccctcattcatgttgcaatattttacatttattttaaaactaccttgtttccagcgatatttaataactcaacggccagttgtcattctggatgtttccttgaacagacgagaagccacctgagccctgttgcacagagaagcaatcttagggg

SEQ ID NO: 19198 - DNA, 201 bp, Bos taurus
gacctgggggtcatctctagaagcgtctggcaggttggaatcacctcctctttgaacgtttagtagcttgcagatgaaggtgcttgggcctgaagttttcattggtgatttttttgaggagattgactacaacgcactttctttcgtaactacaggactctccggcttgccttttcttcagaattgactgctcatcttttt

SEQ ID NO: 19199 - DNA, 201 bp, Bos taurus
ggtccccaagccccagcctccgtgggggataatgttctatatgatggtctacactgcaggtccttgcctcactgtgtagggccgtgcctaaggtcctgttcatagtctggctccatggccagcctgtgtccaccttcacagcttcatggatgctctctggtgtacacacccactcacccacctgccacccaccttgctcct

SEQ ID NO: 19200 - DNA, 201 bp, Bos taurus
gggctggacctcggcagagcactgtgccctgtgagcccttgacctggcccttcttctccacatctccccatttagggcaactgtgaaggcaggggcaggaagaaaagggcagagtgtgggcccgctgtatggttaggtggtttgtgggaagctgctactcattgtcattcacatctcattggctgatatgacttacatgag

SEQ ID NO: 19201 - DNA, 201 bp, Bos taurus
tattagaaagacataaattcttcctccctttagtcaattcagagataatctcaaaaacaaagaagttgttacctgactgcatgaattcttatgtggccaagagcaggttcttttaaatctccttatgaattggcatctcaacactgatatttcaaagtgcatcttctccaaacatagagtgaagttatctgccatagaact

SEQ ID NO: 19202 - DNA, 201 bp, Bos taurus
aactaaactacagtctttacaagggcctcccttccccatactggacagtaagtcattgtccaactttgaggtttcagcctaaagtgaagagttcagaaactctttatggccttcacgtttgggcaggttctagattccagtctctttcctcctggtctatacagattgtcattctttgtatccaatctcttactcttgcag

SEQ ID NO: 19203 - DNA, 201 bp, Bos taurus
tattgttgcctggataatcccatggtcagaaaaccctggccgactacagtccatagggttgcaaagaattggagataactaaagtgaccgagcactcacgtacacacatgaacttgttctggggccaattgaatatgaatattgcattatttttattttgggcatttaaagttttcagttagcgactattgattgtgtcta

SEQ ID NO: 19204 - DNA, 201 bp, Bos taurus
tccagtctttagctggctgtggggaatcccatccatggtgatggattattctcttttcactttccttcacatttagcaacatcacttatcaagtggggccgcattcacactgaaacaaaagtaaagatgtattgaatgtgcatacccaaagcacttatacaaatgtgataataattttgaaaactatatcctaacccaaaa

SEQ ID NO: 19205 - DNA, 201 bp, Bos taurus
gctttttctggagaacatgttcacacctccaaacttaatcactataatcaattacttggttgactgccaatactgtttttgttgtcagatgctttacaattgttagttaaaaccataagtcactctactgtagttgcatgaagaactgactcaatggaaaaaaaaaataataataaacctaatgctgggaaagattgaagc

SEQ ID NO: 19206 - DNA, 201 bp, Bos taurus
acccatgaaacttggccacaggtaagaacgaagtccttcaaaaactgtagaagcaaggtaaccccagatttagagggagagagctgtccatggttcagaatccatgccagaggccataaagagagccagctcagggagcgggtgaatgaggcctgaggtggcgctgcccctctcttcagcctgggcagaggagggcacaca

SEQ ID NO: 19207 - DNA, 201 bp, Bos taurus
tcatagcatgtcacagccccccttggcctggggtgctgactcagctcactgtgtcttgtgtgcgtgcatttaaggagaccccagtgctctgctctgcccaacaggcaggccgccctcagggtggaaggtatgcaggcccaggctcacagggctggggtcgggctttctggtgggcgaccttggctggactacaggctgagc

SEQ ID NO: 19208 - DNA, 201 bp, Bos taurus
tgttcaatccagtagatattgtggagtctctactgggtgcctggcttgggatcctggtccgtagtcaggaagatacaatgtagtgatggagtgggtacttgatgaaatagggagagttcagcatagcttagatatctggtccctgcattcaaggagcttgggatagagatatcaaaatctcaataactcctattaaaaata

SEQ ID NO: 19209 - DNA, 201 bp, Bos taurus
gcaggacatggggcaggaagcatttgcagatttcaggcagagcatggcctgctttgctgtcctgtggcaggatctcaggtgggtgtgaggaggccagggaggggctgtgacacttattcagctgagaaatgactgtgggttcaggcgagtagtgacagggacacagaggaagactggcctctgctggaggggtgtggacta

SEQ ID NO: 19210 - DNA, 201 bp, Bos taurus
agaattcttttagactcagggtaggcaagtgatatgggacacatggagaggagagcagacattaggtcattgcccaggcctgagaactgggcacaggtggtgccaacaaggaaatagacccctgtgacagcagtgatctcaaagggagccgggcccagccgcagtgcccgcgggactgcacgttccaggagaaagccagca

SEQ ID NO: 19211 - DNA, 201 bp, Bos taurus
ggtttcaggagctgggtgccagaaccagggacaaaggctaactacttattttttttattataccatgcctcccccactgcaggggcccagggctctggaggttaatgtgtgttgcaggctagggaaggggcatgcacattctgggtgggggtgttaggaagggtgtcagggagcagtaggccccaactgagctgggaggag

SEQ ID NO: 19212 - DNA, 201 bp, Bos taurus
tgatgccatccaaccatctcatcctctgctgcccccttctccttttaccctcaatctttcccagcatcagggtcttttccaggaagtcggctacttgcacttggtggccaaagactaatagtcatattcaaaaaacagacctgttgagcctaactctgcggaggacatggctagaacattgtttcccatctaacaatgcaa

SEQ ID NO: 19213 - DNA, 201 bp, Bos taurus
gctcgcattcatgagctgtatacatttagaggcgcacaggaaatgaagtgtgaaagagagtaattgagccactgtaaaatcagattagaaaaatgtaccatctttgccttacctctcttttttcctctctcccaagcgtctcactcatataatcctctatattgaccgctacagcatctatccatgatattaaggagctgc

SEQ ID NO: 19214 - DNA, 201 bp, Bos taurus
gcactcatatttatgaaaacggatgatccactcattctccttcatgacgtaggccttctgatttactggctttgcaatctcaagtctctgaggccaatgatctttttgcccttcctgtgttaagaaatgttaatgctcaaggacaactaatacctcaatatgaaggcattgatttttctcacatgcaacaaatgaaaaagg

SEQ ID NO: 19215 - DNA, 201 bp, Bos taurus
attttctatgtttttcactttcccataaaagtaaacaatttggtattttccatctttttataaatttgtgcatcaagagtagtttcctctcttttatctactgttctccagttctctaaccatgtctgattcactacaggatccatttatgttctctgttttattttccagttctgaaactacattttcctcaatttttga

SEQ ID NO: 19216 - DNA, 201 bp, Bos taurus
gaataatgtattgatccctttaaaagaagaaatactctcacaggcccccaatgtttgcttcagttcttttcattgtagaaaatgtatgcaaatagaaaacactacaaactcttaggcctttagcttgtaagtacctatttaaaaagcacctataaatttactgataggatataaaataaactacaaatccaatggaactga

SEQ ID NO: 19217 - DNA, 201 bp, Bos taurus
atttatctcttctcagccatcttatgtgttggtgagatttaaagtcagcatgcacctagttttaaaacctcattgctgtgaaaacagggtggttctatgaagtgttgcctacaattttgaccatgatggtgttttctactgagtgagttgcccaacgtacaccacagaggaaggtaatcttgtccttggcattgtgaaaag

SEQ ID NO: 19218 - DNA, 201 bp, Bos taurus
gttttagcatccaaactagtcaaattggttgaaatctcttcatttcattctccaaaagaagcaaccaggcagagagtcgatgatgcatacaagcagctcaaatttaatcctcagggggatctcagttattttagctgatacttcaccttctttttgcagtgcccagtaccctaattactttgctcctgagtccttttttag

SEQ ID NO: 19219 - DNA, 201 bp, Bos taurus
aggctcactttggcctgaaaacacagatcccaagggaagctccacagcctggagattgccagccacacagcccagagaacccccatgcctccgtcttgtaacgatgctgggccccagtctctcctccaagtggaacttctctggatgctcaagcaaggtggacataaagggtgaggaaagatgggaccgtgtagctaaact

SEQ ID NO: 19220 - DNA, 201 bp, Bos taurus
gagagagaggctatggtgatgcttccaccccactacgtgtgactcagcagtattgccttgtttccatggctgcctggatttccttcatagttatttcccaccacaatctcttccctcacatcccatagatccatctctccacagccaacagcggccctcgcccagggattgctccacaatccctaaactccaggtcccaga

SEQ ID NO: 19221 - DNA, 201 bp, Bos taurus
tggttaaggtttaaaaagaaaaagaagaaggatctggtgttagcacagtacaaattgagagtttcttaaaagcagttgggtacataattgaaaactaattgaatgttctaatccatatgcatgaaaaacaatttgcattgcttcattacttaaaagcagtgtgaagatgaggatgtgctgggaatctacaggaggagcagt

SEQ ID NO: 19222 - DNA, 201 bp, Bos taurus
ggtgtccaagcaagcgggagacagtgaggcaggaagaggaggggtgttcagaggatgtgggggaccccaacctgccatcttcacagtgtcctccaggcccactggcaccggggtaccatttctcacatctgagctggaccagactgaggctggaaggagaggaagatgctcttctcactagatcctggaacttatgcaaaa

SEQ ID NO: 19223 - DNA, 201 bp, Bos taurus
acagacctcactcactcactcaacttatcagttctttctattctctgttcttgaacataattagttccaaatactgactttttaatcaattgtcacagacccaccgaagtttaatgcagtctctgtccacagacagcaatgattgtaacagttaagagcccatacaaatcaactataacataaagcaaaacttaaattaaa

SEQ ID NO: 19224 - DNA, 201 bp, Bos taurus
taataatttaaaatttgatagtagcaataaagatatctttactttccttgtgaatctgtcacagctccttgtcactctggtaagccatccaaagaggtgcttttcttaagctatttatttatttttccttattaagttattgggcctcttgcaaaatccaggtgctgttagctgtggtgaaggcatagctcctggccagta

SEQ ID NO: 19225 - DNA, 201 bp, Bos taurus
gtgttccttatattaagaaaaatgagttttccccagcttcccataatcattaattgtacataaatggaaaaaataaagggctaagatactgaagctaagatagctgatgtcatgaatcaacaccaatcaaatattcatggctaaactcataaaagtattcatatgaataatttaacagacaaaactgaaatactgggccaa

SEQ ID NO: 19226 - DNA, 201 bp, Bos taurus
tgacaatctgcaaacatggatgctacctatcaatctgtctatgtagtggaaagaaaatgagactatgtatcaagaagatttagggcctacagaagccccagtcacagcaaggaaacctaaattttcaaattaccgtaaatccaggggaagtcaggcctaggcagttaaaaaacaatgcagaggccaggcctcccagcagct

SEQ ID NO: 19227 - DNA, 201 bp, Bos taurus
catggggttgcaaagagtgggacatgactgagtgactgaacaacaactggcctttgaaaaaatcaaacttaaaaggcagattccggggccacgagacacacacagctgacaagcaacgccatgctatctatctggtgctcctgtcaccttttttttctccttttcaagttcctcggcctctctttgccaaatcgtcttcat

SEQ ID NO: 19228 - DNA, 201 bp, Bos taurus
attttaccatatgtttgcttcagatttttttttaagtaataaagtaccagtgaatgtttctccaattccattctttacctgcacctcccagaagtaaccaacaacctaaaatttttatattaacccataaatgtttatatagtactttagcatgtaaatttttaataccagttttgtacttatataaaaagataaatttat

SEQ ID NO: 19229 - DNA, 201 bp, Bos taurus
cctaatagaacagggaaaaggaggggggaccaggcgtgagtggtcagagaagatgagggaggttctctgtctgattcttctgttttctttctggtgttcagggcctaggacagagtaatatagttacatcatccccagtaattccaacatcttatcgtaatattatgttagctgtaaatcaaaatatgatttaatttataa

SEQ ID NO: 19230 - DNA, 201 bp, Bos taurus
aggggcaggaatagagacgcagatataggtaatgcacttctagataaagaaggggaaggagaggtggggacacattgagagagtagcattgacgtgtatacgttatcatgtgcaaaaccgatagctagtgagaagctggtgtgtaacacggagccagcctcgtgccctgtgatgacctacaggcgtgggatggggtgggga

SEQ ID NO: 19231 - DNA, 201 bp, Bos taurus
atcaagctttcctgccttctctccacgttcccccatccatgcaccctaccccccagtgacaacaagcctcagccactctttcttatatttttgtttaatgcattgtgttctctgcctctgggcttttgtacaggttgttccatctgcctggaatattatttacttactcttgctgtatttcttgtttcagctcaaatgtca

SEQ ID NO: 19232 - DNA, 201 bp, Bos taurus
cctgcaatttgctcctggctttgttacaaagccctactgctgatggagagcagagtccaaaatcccttggttggcatgaagagttccctgtgtggcctctactgagctttctgtttctcatgagcttcttggttggtacagccccccaacctggtcaacaggaactaccctcctattgtaatttgcacaccaagaggtgaa

SEQ ID NO: 19233 - DNA, 201 bp, Bos taurus
aaaatgagatctacagataagtagctcttccatctagttcatcccacccctacccccacttcctcagtctctgagttggtgaaattgtgacttgctggccgtctgagcatggtatccaatcaccgtatatgtcagggtgttcaccagctctgtcttgtgaagatgccagaggctggccccagaggatagactgataatttt

SEQ ID NO: 19234 - DNA, 201 bp, Bos taurus
acagtgataaaggtaaagcatgccctctctccacgacattcctcagcactatacagaggtctgcggatcttgccagtcattagactgttcacgctagctgcatgtggaagaggaaaaaatctatcattggggagaacttccattttctctcacattttagtttccatctcatgaacaggtcaacaaatctggaggttggta

SEQ ID NO: 19235 - DNA, 201 bp, Bos taurus
gcagaggagctccgacttgtcccttggggctgttggtgcgtaccgggtgcctcacaaggtgggccatggaagtgaccagccgtggcaattcttttatttttttaagttggtatttcctacaaaaaaagtgcacataagagagattaatagtccattgttgtttttcagtcgctgagtcgtgtctgactttttgcgacccca

SEQ ID NO: 19236 - DNA, 201 bp, Bos taurus
cattgtgggttttgcccacccacttatagtcaccaagaatctctacttgatccactaattatggtgtatgcagttgtgacgacatgtgatatgtccactatgctaaaccccactacatccttcaaagtcaggaagtcttctcttgattttcatttcctcttagcacagggctttgtttagcacatggtaaaggtttactgt

SEQ ID NO: 19237 - DNA, 201 bp, Bos taurus
cctcagctcatccacgcttgtggtttcaaataaacatgcgtgtaaaatgaccgccaagtggaaccctcctgttaggtaactgtcaccagcccctggccagattgattcctttatacagtcaacgttaagagctggctgctgtgcttggcactgggaatacagcagtgaatgagaaaactgcgaggccctgtggaaggagca

SEQ ID NO: 19238 - DNA, 201 bp, Bos taurus
tatgcactaataaaaactggtaattctgataataatgtacatcattctgtaggcaattaaccaacagatccctggttctgactcactaggagagaagctccccatgcacagcaaggaaatccgccccactaagggctggcagagcagccgaatagcagagcatcctgcaaggtgaagaggcatgcacatcttcagttggga

SEQ ID NO: 19239 - DNA, 201 bp, Bos taurus
cttttttacctactttcaatttttagaatgtaaatttggcaccttaatcaaaatttctgtaacaaatgaaaacaatgatgtctaaaccttaccaactatagaatcttcaacagaatagcaaatactttgcccaggacattcgagatcaaattgaatatgaaaagttttcttataagcccttagagcagatctgaacaagca

SEQ ID NO: 19240 - DNA, 201 bp, Bos taurus
ctgtgttgtggcataaaagtgtatattacagcttaagaaggaatttcaatgatgattggtggcaaattactagcaactcccaagaaagcctcctttggccttggttcagacttgttagaaaactagttctgatgatattatcatagctatagttaagttgagatggaaaatgtctttgaagagacttgtttgttatttcca

SEQ ID NO: 19241 - DNA, 201 bp, Bos taurus
gtcaatggaaataaagagaaatgaattattaaaaagatctaagaattgttcatcccatgacaaggttaagttctgtaaatatagagactttttcaacttgttcactgatgtatccccagcttctaatagtgtctggcaaatactgggcccttgataaatatttggtgaatggatagattgctgataaaacatgttatttta

SEQ ID NO: 19242 - DNA, 201 bp, Bos taurus
gtgaaaattccaaattaagaatttctaaacaaactttacaagagtttatcttctgagaaacacttcaacaaatttattaagaggtataattcagcaatttctctggtggtctggtggttaagaatctgccttgcaatgcaagggacaccagttcagctcctggccagggaagatgccacatgtggcggagcaacgaagcct

SEQ ID NO: 19243 - DNA, 201 bp, Bos taurus
tctctgagatagttgtgtgtgaaagaagcaggctacagaacaatatgatcccagttctgtaaaaataactccctcccttctctctcggtttctctccttccttttttttttttttgtaaatgcatagaaaacgccctgatggatacacatcaaactattatcagtggttaccacctggagagaggtgggtggagagacggc

SEQ ID NO: 19244 - DNA, 201 bp, Bos taurus
gagaatgaccaactaggctttacaagtcacatggcaacatgtcagaggaaattttctcctaacagagttaatggtggctgtagcctgttgagatttatgacgaataagttgttgaagattgcaaccgaacctcttgggggaaaaaatactggcttccttggttgtggatggggagaaggaactgacagctgtcctactctg

SEQ ID NO: 19245 - DNA, 201 bp, Bos taurus
cctggccctgctggagccaatggggaccgggtaagcatgcattttcactgacttgcaactctctgactgatagcaatatcgaaaattccctgctgccctggtcccatagggccccagcaattcatttttatgcctttgtataaagcccatctatttaaaaacatacctgttagtgtggggcagcagagaacaaatgctacg

SEQ ID NO: 19246 - DNA, 201 bp, Bos taurus
ggcggcccttcatgaactgtagatctgaactgtcagatccaaagaaccacgtttaccctacaacactccaagaagcagtatatgaaagaataagctttactggccacaatgctatttaagtaaatgtgttacttacttggaacacaaaagcatacattcatatattacaggaagtgcttaataaaaatctcattaaataaa

SEQ ID NO: 19247 - DNA, 201 bp, Bos taurus
cccaggagggggaactagatcccacatgccacactaagagcttgcacgccacaactaataatctcataggctgcaactaagacctggcacagccaaataatattttttaaaggtcaatctagaattttgcttaaatgggaagaaaactctgatacactaccataaggatgaatcggagaatattaggctaagtgagatagc

SEQ ID NO: 19248 - DNA, 201 bp, Bos taurus
cacagaggagttaagcaatttgatctcacacagtggcactgtaggtattcaaccttagttcacttggtgctagtctttaattttataatatactacacaacctttattttaaatagtatttattgataatttctaatgggctgctgctgctgctaagtcacttcagtcgtgtcagactctgtgcgaccccacagatggcag

SEQ ID NO: 19249 - DNA, 201 bp, Bos taurus
ccgtactgtcctgctatgaaaagtgtggaccgtggaccagcagcatcaactgtcagattattagaaattcggaatctcaggcccaatcccagacccacagtatctgaattttagcaaaactcccaggtgatgtacattcacattaaagtagatcactgaaagagctgactgtcctccgaatatattctagtcatagacggg

SEQ ID NO: 19250 - DNA, 201 bp, Bos taurus
agaaagatgatgaagccactgcctttgtccagaagaggtcgtaggaaagaattcaaagtgtatacctagacgaatctcaaaagaataagaattcactaggtggggaggagggaaagacatgttaaactcagcagaatatgttagaaaagaaatgaaaatgtgtgaaagagctcttgccaacacccaaatggggagactgga

SEQ ID NO: 19251 - DNA, 201 bp, Bos taurus
ccacctttgtgtcctcctggggcaaacaagtcactcagatgactgatcaaatcataatggcctgtaagctgtgatgtactaaagcttaatagctacttatcttaaatcttcagatatcctctctaaacttgtagttgctaaaatgtcagataaataggtgcctaatctcccttcactctggttctcagtagcttctttttc

SEQ ID NO: 19252 - DNA, 201 bp, Bos taurus
aacagagacctttcttagagaaataaaaaagggaatgatgctgagtagtcaagtaaacaaggtcacttaccaccatttataaatattcccttggccactcctcaaccaggaactcttcacagtactcttgctcctgtctgttggcatttgaagccagaaggcaggagagcagtgaggccctcattttcaccctctggattc

SEQ ID NO: 19253 - DNA, 201 bp, Bos taurus
tcattttaatgtggtttgaagggagaaatatgttttgaatatgtaaatgacacaagtaaatatgataatccagaacagatttataaatactagactgacagccctagcaagatatgatataaagtactaaaattaaaaaaacaaacaaacactgaaagtctaggattttagggactttattatgaatttcaccgactttct

SEQ ID NO: 19254 - DNA, 201 bp, Bos taurus
cccacaattccagagcatcctttggtttctgacttccagacactttcctcataattcattaccctgaaccttgcttatattatagacaagctctttgaacctgagctcctgtctcccctggacagatgccaatgatcaagtacattggctcatgtgctcagacttagcttttcccagaagcgcagagccacgttgctccca

SEQ ID NO: 19255 - DNA, 201 bp, Bos taurus
tactatttctcttatttgcaggcctcattttgggcttcggaaatgctggctttaaatagatatctttcccctaaactaggcacttgctcagtttgttgacatgtaattatgaattcataactgaagacttatatatatataatgttccctaacacaactgattcattagcaataatcacaatatctcatacttaactacta

SEQ ID NO: 19256 - DNA, 201 bp, Bos taurus
gcctagtcactccgaggtcccttggcattggcagaggctctgtgtgtcttgacaagtggaagacggctttttgggtttgcaggttatgttgaacttttaggttaggccttctaagagccaggctcacaccatacctctgaccccacacattcagaatgggtggctggatctctgccttttcagcacttctcttcagaacct

SEQ ID NO: 19257 - DNA, 201 bp, Bos taurus
attgcataaataaataatatgtgcaactacaaatgagataaactaaaggaatgatttcagactttcagaaagaaacagctaatctctctaggattgtaaacgttttctagttcacagcagttacagtcaaagttaataaaacaattttgatttgcactaaagatcagttacctaatttctaagcacagcagaattctacat

SEQ ID NO: 19258 - DNA, 201 bp, Bos taurus
tattcattagctttagcaagtcataatcatttgcttttcacagtccctcagtacccattcacctactttgtggataatgaagtggcttgtttctgttttaccaatagctatcagcctcctgcatttgaaatgtttgtcaatattcctctttaaatactgctctgaaagtgatccttttgtttttttaaggatgtctgctat

SEQ ID NO: 19259 - DNA, 201 bp, Bos taurus
tccaaaagattaatgaaaatttaacaatgaatatttcaaaacaggccaaaagaaattaagaaaatggaaaagcctatgaaagaaccaggaacattgccataagaaaactgaggcaaatatgcaaaatatttgaaaagagaggttatgaaactgagaaagatattttaaaattaaaaagtcatttaaaaaatgaagtataaa

SEQ ID NO: 19260 - DNA, 201 bp, Bos taurus
actgtttggtagtcgtttttcctcttcatgcaatgtaagatggtgaaatacctcatgagcaatgagttcacatatctgatgaaatacagaataagtctttgaaattaaacccctgtaaaattacccatcactacccgccacagacttttggggctacataagtgaacaggagaatctgaagtcaaggagtgctgagtgctt

SEQ ID NO: 19261 - DNA, 201 bp, Bos taurus
ctagaatagattcattctgaagaaagagcttatgaaacaaaagaacaaaaaattggggaaccagaactatttgagaggaatattagttgaagaaagtggcatggtagagtgtatgtctaacatgcacatttcccttgctaagaaaaacatgtatttatttggtcctcaaaagttggattcattcaataattactaagagaa

SEQ ID NO: 19262 - DNA, 201 bp, Bos taurus
aggaaaacacttgactggtatcatggctttgaaatttggcctttgatacatggtactgggatgctaaaggttattctcaatctttttattttcttgactgttttctctcaggccatactctgattttattaattcttaatcttatccctttcagtctgtttcatgatggtgtataggttggaagaaaagactgttgcttgg

SEQ ID NO: 19263 - DNA, 201 bp, Bos taurus
caatggactctggcctttatgtgagtgtcatgttgattgggagccaatcctatgtattaatctaggaagggtcttattttctgtaaaatagaccaattctattaaggaattgacttatatgaaacagaatcaaaatgtcaaggccttctggcaaaatcttgtggttgaatctcaacagcagcctcaaaacagatgcacatt

SEQ ID NO: 19264 - DNA, 201 bp, Bos taurus
agcacaatttagagcaatcgaggaaaaaagtatttgactagaagagaagatgtgtttttatcttggttttatttctttactagtttaccttgggtaagtcacttaacctctctgagcctcaattatcttacatgtaaaatttggagataatcacacttgatctgccaatatcacagggtagttatgggagaatcatttggc

SEQ ID NO: 19265 - DNA, 201 bp, Bos taurus
ttgcctgggaaatcccatgaacagaggagcctgacaggctacagtccatggggttgcaaaagagtcagacatcacttagcaactaaataagaacaataaatatggatcattaagaattttcattttggtcatgatatctcctggtcatgatagtaacctgagtttagtgatcagattttttatttataggaatcacctgtg

SEQ ID NO: 19266 - DNA, 201 bp, Bos taurus
atacaaagttatacgggacttgagcacagcgggttgtactgctgaaagatttccaagggcatgagcagatggagatcagtttattaaagaacgaagcagacgtgtttcaggtatgaaaatgtctcatcgttctcttgtgctgtgaagaggaacttgaccttattgtgcattttcatgtgaattcttttgtttcatgtttta

SEQ ID NO: 19267 - DNA, 201 bp, Bos taurus
aggtacaatgagacaaaggttaacgactggattattcgccaagccaccttggtttcagctggtcgctgtcacatcccagcacctgagtcccttcttcgtcatctagagtttctatccgcccctttccctcctttcacaaatcaatttggagacaattgagatcttaatggctaatactgattttttcccaattcacaaaca

SEQ ID NO: 19268 - DNA, 201 bp, Bos taurus
ttgattccaggtgaggaacaaaacagataaagacttggcctctctcctgtgtatctgagagagagtaaaaacacaaccacaggccaaaaagatatataaaatcaggaccacagagaaaactaaaaaacggcaagaggaaataaaagggataaaggtagtcaaggaagacttctcataggaggtggcatttgagcagagacc

SEQ ID NO: 19269 - DNA, 201 bp, Bos taurus
aaaacaaaaatttcctaactctatgtacctttttctggttttgtttgtttgggccagtctcaacttaatgatgaataaacaagagatactcgagttttcaagaattatggctttcaatctttctcctctgccactgaatgcaccttaggcacgtcatgaatcttgccagttcagttcttaaaagtctgtctagttcaaaac

SEQ ID NO: 19270 - DNA, 201 bp, Bos taurus
cagatgaaggcctctgaaactaaagaaaggatggaggcccctcagattctttagctgtcccgccaaagtaaattaggatgttattctggggaagagagaacactgggccctgaaggcacttactcaattcccaaggtctaagttggcaactgtttttttttcccctagcagaaacattgcttgtctctgatgagatttcaa

SEQ ID NO: 19271 - DNA, 201 bp, Bos taurus
agatagatattatttatatttccttttttttttagatgaggaaatgaagggatggaggttaaataatttgcttcagatcacggcttgtaaggaataagattagggttcaaatgcagaagccagtttgtccccagagtccatccacttaaccagtatgttatgccacctaagaaaaggcctggtatactagaaacgtctagg

SEQ ID NO: 19272 - DNA, 201 bp, Bos taurus
gtcagtcatgaagatatgtggaagaatgtgtcagtgagagggagtgataagtccaaaggtcctgagggagaagcaggctggcctttattaggaacagtaacgcttccactagagaacactggaaagtaatgacctatggaggaatggtggatgagttcagtgagagaggagtctcagattatacacagtcttctaagctat

SEQ ID NO: 19273 - DNA, 201 bp, Bos taurus
ttcctccagatttatagcaggccaaatgatttgtccacagctatacctttcatcattctttctacttactccaccttttttaaatcccctcatttgttccgcacactgaaataagtgacagagtaactcattaaaacccacatttttaattagttgtgttctcttaaagctccagttaggactctgaactcccatgccagc

SEQ ID NO: 19274 - DNA, 201 bp, Bos taurus
ctccttgcttgactcttgtcatctgactccagtgcccatttcccatattgagaggtaaaagatagtttcagctaacctgatgtccaatcagctgaccaaccaattgctatccattttatatatatatctcccaattacatgggtggttttcttggggttctatcacacctctttaacttgggcacttgtggaataagtttc

SEQ ID NO: 19275 - DNA, 201 bp, Bos taurus
tctgtataccatctagagtaccagtttttacattttgtggagtcatgatattcctcacgagggtgatgaaatccataggcacataaatttcctccagtattggtggaattcattgcctttgctctcagcaaatgctatactgggataaaacagaaagcacaccataatatttaaggaaaagtagaaagaatattaaaatgg

SEQ ID NO: 19276 - DNA, 201 bp, Bos taurus
ctgggaagcagccttgcagagatcacaatgaagatggaggcgggagcagtgtagtaaccagcacccccaattcccagtgcagagtcagaggagaggaaagactggggccaaagcttggcaatggcagtggaatggccccaaggcgaccagaaccagcagggagtcggggtgcctttcactcctgggcatcctacaacattg

SEQ ID NO: 19277 - DNA, 201 bp, Bos taurus
ttagccatggtaaagtagccacccaacaacctagttatgaaatttgttgttagttgtttctagactccttagtcacagattattactttagttcagttatctatatggctgactgagctcagttgttttgtgataactgtctaatttcattctcagagggaaatcttaattctaagagctcaagttacctagcactacctc

SEQ ID NO: 19278 - DNA, 201 bp, Bos taurus
caatcttacctgaatcctttttacactgtccccttattttccactcgtggccctgcttctatggctttcagtgcccatgttccatgaccatttatttctgcaactgctcagactttgtcaactctatttctatggttctagctgctctggccactccaacacctttattatctagtctgcttaaaatcctgtctttgaccc

SEQ ID NO: 19279 - DNA, 201 bp, Bos taurus
tgagggtcaagagaactgcattaagtgaatatgaagaagcagatggtacacctcctcctgttatattttatcaaagcaataatgatggctcagaaaaggcaagtccattgaagacaaggaatctgactggaggatgacacaccaaatataagccacatggaccatggtcctcacttacctccagaatagaagagcggttgc

SEQ ID NO: 19280 - DNA, 201 bp, Bos taurus
agaattctttatggaaaagataataacttttaacaatcctccattccacacctactgccaaactactgttttgatctctcatgttacattaaatttcctttgcatagctaaaactgtgttaaaatagttggctttttatagagatgctacccagagcgattctgggtaatataatggaaaatgtttttctgaaaattccac

SEQ ID NO: 19281 - DNA, 201 bp, Bos taurus
aggctgttatgggatttgttaaataaatctacatttgaattcactgtcatattcataattctataattttaaggaaatataattagagatgaatctctttaatttagaggagcggttttatatgttcatgctttatgaacatgctcattgttcgctatagtgcagtcctgagatgccggtaaggcatctgtcctattcctg

SEQ ID NO: 19282 - DNA, 201 bp, Bos taurus
aaaatatcatcttggaaaatttgtataggtcatcattagcttaacagcataattcagtgacagttactttccaaattaccactgtatattcttccaaaataatacaaggataaaagattcattccaagtgcaacctggatcaaagtattttcaaacaactttttcaaggttataattaacatacaacaaactgtacatatt

SEQ ID NO: 19283 - DNA, 201 bp, Bos taurus
ttcacttaagtttgataatctctaggttcatccatgttcctgcaaatggcattattttgttctttttaacggctgaataatgttccactatatatatgcgccacatcattgggcttcccaaggactcagtgacaaagaatctgcttgccaatacaggagatgaaagttccatccctggtttgggaagataccctggagaag

SEQ ID NO: 19284 - DNA, 201 bp, Bos taurus
attcttagaaaaggaaaggacagtgctgggcacgttgacattcagttctgtatttattttcttggtggcacgtatcctgacctttccaacttgatacctctggttgataggctgtgtgcagttttcttttattttcctttactttggcaagtcttccagggaagaaaggatgacttcttccagtatccagtgaggcttttt

SEQ ID NO: 19285 - DNA, 201 bp, Bos taurus
tgaaggtgaacaagttggagaaaagtatgttcctacttcatttatacaagtatggcttaaatgaaacacaaaacttaaatatagacataattccaactttccaagtgaaagattgtgccttgggaaaaattcatgatgctatacctctgcacaattatttacagaaaatactttacatgaaaatgtaaaatacatgtaatc

SEQ ID NO: 19286 - DNA, 201 bp, Bos taurus
agcacctaattagttaaacatttctcgtttgtcaagatacaaaccacctttttttctttttttttctgaaagtataaggcacagagctaaaaatctgccccctggacacacttaaataatgcagctttgatctgcatgaactgctgcgctcctaggtaaattattgccaggggttctgtgtggagagtaatgagcatagct

SEQ ID NO: 19287 - DNA, 201 bp, Bos taurus
catttagttacttttttataatatgccgtctgaaggcccatgccagcttgaaaaggggtaaaacaatgaaaatggcccataaccaaagcaactgggcagcttttaactaaagtgtggataaagaaaggttttcaagcaaatagactatatctacaaaaggcgaggtctggtctgaaagaaggtactataatcatagagtag

SEQ ID NO: 19288 - DNA, 201 bp, Bos taurus
tggataactgtaagcctgggtatttgtccttccgtgtctggcctatttcactcagcaccaggacgtggtacttaaggaggcactgactctcaggctcatgaaggggcgggcgtggcccctcagagtaagcaccaccttaaattttccatccctggaagccatacttgcactatcctaatccagaccctcctttgaagacaa

SEQ ID NO: 19289 - DNA, 201 bp, Bos taurus
ctgagaatttgggggcagcatgtctaacggatggggttttactatttttaatcacacagctcttaggatttatcctaaaacctctcactcaagactcatcccaaagcactttcttctgatgtagttttttaggatgttaatattctctgagtggtacattgccatgaataatgtctttttattaattatgttactatatat

SEQ ID NO: 19290 - DNA, 201 bp, Bos taurus
atgcatcatataccacaatcaccttctgaggaaatgcctgctcaggactcagactctagacctcattgcaaatgagcccagaaactattcgcctcaactggttttatcacaatttatccactttaagtggagttaaaaatatttgaaatcccctgtctcatttgaacaatatgagtggacatatgttgatgattaaatcac

SEQ ID NO: 19291 - DNA, 201 bp, Bos taurus
tataatctattatacacatggaaagtaaattataagtacatgaaatacaagtcaacttattaaaaataaaggtaacctgagtgttcagatttgcagaggggttatcattagactatatgagccatgtatattaaatactttgaggtctctagaatctttgtttcttaaaagagaaaagcactattatctgtgtaagcatct

SEQ ID NO: 19292 - DNA, 201 bp, Bos taurus
tatgtttgttgtgtccatgggaggaagtaagttcaggatttttctgtgtctccattttgaacagcctcctctaaagtctctttttgaagagtaggaggatgttactggtgggactggggatttaccattctctggattcattcaaggaaagtcagtttctttaagatcaaacaaaagcatccagaagaggtattagtggtg

SEQ ID NO: 19293 - DNA, 201 bp, Bos taurus
ccagcctgctgcgtgggttcagtgaaaaccccaggcaacaaaatagcagtgttggcagatggaagcctgtgggcatacagttgagtagtaagggccagggcaaagtgggtgggcattagtagagtccgctatatatggagatagtacaccactctgtgaggagtgctcaagtgtgaaaaatatcagaatttaagttggcct

SEQ ID NO: 19294 - DNA, 201 bp, Bos taurus
agtgtgacaatatcaggagaaattcctattttctcttctttggtgataagaaaactgaaatttataaggaactaacaatttatgcaaagtcatggagataataagtggtggagttggaatttggattagctttttaaactttgcttagtgaacaagggtaggaataaaggagtgactaggaggtaatgatgaccattatat

SEQ ID NO: 19295 - DNA, 201 bp, Bos taurus
ctgaatattcacagaaattctatgaaataggcttgataagcccactttttgtaaatgaggaaataaaggcagagtgtttaataacatttctgagacagtacctagtgactcatggtatgttatggatatttctcaggaaaatcctgaaatggtggctaaggctctctaatattgagaaatgaaaatatttcacgcttgcgg

SEQ ID NO: 19296 - DNA, 201 bp, Bos taurus
aggctgctgaatgctgatttcacagggtgaagctgcttttccagttaggggcacaagaagagaaaacagacagatatggataaggcataccttggagagactgttggtccagttccagaccaccactattaagcaaatatggcaagaaaatgagtcacagaaattgttttgttttccagtgcatatgaaagtcctgtttac

SEQ ID NO: 19297 - DNA, 201 bp, Bos taurus
aaccgtaacttgagacccaagtagctctcaccttgaatctgccctgtgcttggccccatctatgagaggagggaaattaaacacctgcagggataccccgcgtagcactgcaatgtttgaggcagttaccaggtcccttttgtagagcttcatgaagacaaatggaaagtgtcccatcctaatgaagtcgtggatgaaagg

SEQ ID NO: 19298 - DNA, 201 bp, Bos taurus
ctgttaacccatttctagacaaaaccatgataaatgtactaaagtcagcatctgccttgctataaataggaatgtgtattcattctggaggtaaaattcatttggttaaacagatcaagagcgtatctaataggttgttattaataaaagcacataatgatctattaatacaagcacaaaataggtaagtatttttctcct

SEQ ID NO: 19299 - DNA, 201 bp, Bos taurus
ggattaagcgatttaaatgctcagaataactccaagggcagaacgctccattttaacccaatgcaacccaaattttatgacgttgtattggccacaagaccaagcagcacatctgataaatcttgggcttagtattaatagcctcataaattgttatcattcaggggcctggaaaacacatcaacaggtgcatgggtccct

SEQ ID NO: 19300 - DNA, 201 bp, Bos taurus
atttttttggctgtagacagaggccttgacgctgcagccctgggccaggccgaccttcactgaagaaaagcggcgttagacattttcccactattaaccccgccagccttgcttgtctcagagccagatcagacttgtgcacatggctttttgaaagttgattttcaatttcttattaaccattctcctgaaatgttgaga

SEQ ID NO: 19301 - DNA, 201 bp, Bos taurus
caaaacccaacaacaaccaccaccaccctcttgcacttcaaatttaatttcagtatcacctttctagaggatctaaactggcagttgctaagagtgtcctgaatacctggtaagtgggattggaatctgaggagtggatcgcttgccatcccaagtagtatgtgagacacagttcctgtaaaaagtggtgctaaaactcac

SEQ ID NO: 19302 - DNA, 201 bp, Bos taurus
ctcttaaaagcatcctgtcagtgactactataaacttcctttacttggagcaggatcaagggcacctaccatttcttagtcccttggatccccagtaattggacttcaaatggtgctgagtccatgttccttgaagaccaaactggggcttttgtagcatttaacaaaataatactccctggccaaatccgagtctcaaaa

SEQ ID NO: 19303 - DNA, 201 bp, Bos taurus
aaaatgatatcacttaccttgtttgtatttcaggaagagggtgagagtaacaaagcttattcagttgaaatttgcactcgtcttagttgagaaaaatgagcaaattaaaaaagttaaagccactaaatcagaattcttacatattcttatgtggcagtgtctgacaaaaagtttgcaataaaaagaggaaggagaagtaca

SEQ ID NO: 19304 - DNA, 201 bp, Bos taurus
taggagagaagtaaactagtatcttggtctttacaatctgcttctggttcagttttaatgattatgggaatgtactgatatccaaacttacccttcattcttactatctagtcttgaggaagatgaatataattcattagttttagctatgtcacttaggcagctgacttagcaaaaggccttatataatgaaattttgaa

SEQ ID NO: 19305 - DNA, 201 bp, Bos taurus
tgatcagccaggtttttttttccctcattttttccatgcattagcatttgccagtctctcagaaaagaaggtttacaatcactgtggattcgtcccttatctacattctttctatggttactcttggctatattacttaaaaattagtatacttcattccctttttgaaaatcacacattgtcacacagttgtcaaattca

SEQ ID NO: 19306 - DNA, 201 bp, Bos taurus
aacaacaaacttttacacctctctcaagcacccatgataacctttcctcctcatcactgatgttgtcaaccatctctctatataaacttgctgtcagtttgcttatcttctcaggcctcaactctttctgacttctacttccattaaattccccttatgatcactttcctaaattcaatggaattttttcaactctttaat

SEQ ID NO: 19307 - DNA, 201 bp, Bos taurus
cactggcgtgtgctcgcagtgcctcagccacactgggcctgcccccactcacagcacgtgtgcccgccctgcccacactgctcaggctctaggttgctgcgccggtaacagtccaaggttggccctgggttatatgcacttcccaggtctaagccactcaggttcaggcactcaggtagtcctcagaggcgtagactcagt

SEQ ID NO: 19308 - DNA, 201 bp, Bos taurus
ccgtctgagccaccagggtagtaaaggggagtttagtttagaatccagatgctaccttgggaagaaagtgcttctttaaatggtgggttgtgctgatgtcaggatgcatttgtagaatgacttccatgagggattttttaaaattaaataatatataacgagacaggatttttaaaacaaatgcatttaaaaaaattttaa

SEQ ID NO: 19309 - DNA, 201 bp, Bos taurus
tttcagagccaagtagaaaaccagttttataggcagacatccttcttatgccacccccatagcaaattcccagattaactctgtctcttcacagagaaaaatcagccctgtacctcaagtagatggagttccctttctcaaactggggtgtgtgggtgcctcggggcatatgtgggtatgcaagggaggtttagaaacatg

SEQ ID NO: 19310 - DNA, 201 bp, Bos taurus
acaggctaaaaagattttgcagatgcccacattgtccgatccatttaaatgtctagactgtgtgtaatctgaccactttaaaggatagaaggtgctgatacggcctcatcgtcctctgctgcccagcatcagctgaagggatagtcctcaacttttcctcatttgcctcacagaactgagaatggctcagtactaccttta

SEQ ID NO: 19311 - DNA, 201 bp, Bos taurus
ttcagtttaaaaaaagaaaaaagagagagaaggccatctcttttcctccacgggcaccaaggaatggtcacatcaggacaaagagggacggtgactgtctactggccaggaagtgttctcaccagaaactaaatatgcaggcaccttgatcttgcacttctcagcctccaaaactgtgagaaaacacgtttctgttgtgta

SEQ ID NO: 19312 - DNA, 201 bp, Bos taurus
gtattggagccacagcaagacagtctaaaatgcaggggaaggggtgcctggggaaatctcacttggaccaagcggatggccgtggataagcgtgctgttaaaggaccaaattaagatgtcagcgcatcatggtacaggctgtccttccagagcgagctggccctctgctggaaaacagccaggcactcagtaatgagacag

SEQ ID NO: 19313 - DNA, 201 bp, Bos taurus
cctgcttaccttattacttcagtgatatttttgatcactcaaggtggatcttgctttgagaagtaataaaccccaatggctcagttacagagcattcaacatgtccaaagaatatcatggaaattattccatcaagaagattagagagactttccctactttcatggattcagcttgctaagaagaacacatattaaggta

SEQ ID NO: 19314 - DNA, 201 bp, Bos taurus
aggctgaccctgaagtattgaaacttaagtggcctgaattccctgccactgaacctaaaaacagacctggcatttgggccaccttaattatccatttagatctctctagaacactgacagtgcatttggaaggacaagttgacgaggtgagccaggtttttcttagccacccagcttacccaagggcctatgctgctgctg

SEQ ID NO: 19315 - DNA, 201 bp, Bos taurus
ggaccttatgtcaaaggtcatgtattaatattatgcttacaggtaattggcccaccttagcagatagggaagatggacgagttcagaagcaagcaaaataggtacctgttgatatgaagttatttttctcagaaagctaattctatcctgacagctaaataagctgatgtacagaaatcctatgtccccaaattcctgcat

SEQ ID NO: 19316 - DNA, 201 bp, Bos taurus
agagaatgtagggaagcaagaaaaccacctgtgaggctgaatcagagttaacaatctgaacaagcaaggcttttattttaatggagaacagaaatccaagtttttatatgaataaaaacagaaatccatgtttatgtgaattctcctgatttttaaatagcaattcaaattctctgttatctaagcaaaacaggctacagg

SEQ ID NO: 19317 - DNA, 201 bp, Bos taurus
tttcttacaggctctcaagtgagatcagtgctgcagagccagagcactctgcatagcaagagtttagactgaagtgggaggtcttccaaagctaactctgttgtttctttggcctgcattcaaggttacttcaatagctgaaggcctgaggccaagaccttggcttggagaaaggagactgtgagaaatagttgtgccata

SEQ ID NO: 19318 - DNA, 201 bp, Bos taurus
tttttttttttaaagagctgtttctataacatccaatgaaagatagtctattccaagctgacgtatgagcaagaactctcaccactttaattggcagctctgtgatatactcagatgtttaataacttctgattctttagcagaagatccagcacaatttttctcttaatctaagaattagattaagagaaacatttttta

SEQ ID NO: 19319 - DNA, 201 bp, Bos taurus
tatatacatatatattcttttttcaggttcttttccattatatgttattgcaggttattgtatatagttccctgtgctatacaatagatcattgttgttttatctgttttatgtacagtagggtgtgtctgttaaccccagattgctcattaatccctcccctccactttcccttttggtaactgtaagtttgtttgctac

SEQ ID NO: 19320 - DNA, 201 bp, Bos taurus
gatttctgctccttaactttacctctttttccatcttatctttctcccccacagaagacaatctgtggatgtgattggcacagtctgacgttcatggatcatttttccctaactgtcagaatcacagtgattaagaaagacaggcaggtactcttctacctcccacggccaactgatggaggcaccaacctctcagggctg

SEQ ID NO: 19321 - DNA, 201 bp, Bos taurus
tgtacttttcctgttctccaacttttctaccttgactatattatgatgttgaagtcctatagtatttgttcaaggaataatttttaaggacagtaggaaatattaagtatactgtaaaatagaaaacaactaaagaattcctactggcctttggagtctagataattctctagggagtagagttgtctttttttttttttt

SEQ ID NO: 19322 - DNA, 201 bp, Bos taurus
tcaagggaagaatgatactcatttcccatccaaataattgactgcataaccttgaaatttttttgcacagtttatgatcaggcttcaagttacaaaatgacaagcctcattacagattgttaaatgctgattgtgcaagtgaaatgatctgaaatacataccgtagtctaatagtgaaattttatttgcaggataaatgaa

SEQ ID NO: 19323 - DNA, 201 bp, Bos taurus
cctttggttatgactatacacttgttaaaacataaatgtccttgataaggtaattaattcagtccgttaatgtttaatgccacagaacaaattattgctcacatctttttgttaggtagttagaataggaaaaaggagtccagaatggcagtggctaaaagacaaaaaagggaaaagcccacaaaaatagaacaaagtaag

SEQ ID NO: 19324 - DNA, 201 bp, Bos taurus
ctgggtcctggtgtgtacaaggtttgtttgagtcctctgagtgtctctggcggatatgggatttgattctaaatgcaattttgtccctcctactgctttgctggggcttctcctttggccttggacatggggtatatcctcacagtcgctccagtgccttgtagccaccactccagcactgcacagccactgctccatatg

SEQ ID NO: 19325 - DNA, 201 bp, Bos taurus
cccaaagtctgttctaggttattattgcaaactcaatggactcagctgcagtgatgatagaagccagtttccatattattgttaactgaccattggcttgggatagagcctagatctcacaaaaagtgactttatactatcaaaagactttcttttgctgatcttgtaactgcctgtacacgtacatagcaggcagcttgc

SEQ ID NO: 19326 - DNA, 201 bp, Bos taurus
aggtcatgaagccaaccattcactagttccacatgccctgagaaaggtcagtagctctagtagggattatttgatgatctgtgcttttattaaaaaaaaaaggaggcctctcttgacatgtaagatagtatcacacatggcaaatgactaagcttaataccatagtagagatgcacacaaacagcatgaatgcaaaaaata

SEQ ID NO: 19327 - DNA, 201 bp, Bos taurus
acatcaattgagcaggaatggttaagtgccagtttatggagttggggggaaaagtgacttccatggttactttcagtcttcagattttaaatataaaggcgccacaaagtcaactaaaaggaaatatacttataaataaatcatggtatttggaaacagaaaactgcctccttcatgaacccatactgattttatttatta

SEQ ID NO: 19328 - DNA, 201 bp, Bos taurus
cagggaaacaatctgtactactgtatttcaagccattgccatcccaaccattacttcatttgcaataaaaagcacacaaaaaactgggcaagtgcattttatacatgtttatttctaaagtgttaataagtaaatgcctgatcagtgttggcacagaagtggcagaccccccgcatggtagtaggatttgagtacctatct

SEQ ID NO: 19329 - DNA, 201 bp, Bos taurus
aattgctttaaaataccacttatagataataatttttcttaaaatatatgaatttacaggtatgccctaagtagatggatgataaatgtgtctgctttaaatgcaggtgcattcaaatattcagatgcaacatttgaaaaatgaattttgtgcctacttcacactgatgcttatcagagtccctggctgtcaacccttttt

SEQ ID NO: 19330 - DNA, 201 bp, Bos taurus
tgtctacgaacatgaaatagaccactggttcacagggtcagggaaccggaaaaaagaagataagataatgaattaagagggggaaaaaggaggcaaaacacgtagcacagatggtaaatgaagtatgagataaggggaagaggggtggcagtgatgctctagttacatggttttgtttttcacatttttaagtgagtaaac

SEQ ID NO: 19331 - DNA, 201 bp, Bos taurus
caaaggaaggcatggtatactgtcccttagaaggttggagaattcacaggagagaattaacctagatcctggaatctgagtagattcacatggtaagttcgggtggaagatggcaaccattgggaaacagaagacattctaagcagtggtgactatagagtgtaggccactggggtgactggtagccattctgttaataca

SEQ ID NO: 19332 - DNA, 201 bp, Bos taurus
tgacacattgatgttgtccttgtgaatcccaggataaagaagcagctgagctatatggtgcctgggcttccaacacactgaaattgagagagattatatgggttttattttaagccactaacttttggtaatttgctacagtgacaatatgaaactaatatgggagataagtagtcccatatttttatttataaaaaataa

SEQ ID NO: 19333 - DNA, 201 bp, Bos taurus
cagacattaacatgctctgtgacttgctttggccaattaaattaaatcagaattgacaagtgccatttctgtgcaaaaactgtcagaaactaataccaagcgtgtaaagtttcctttcctggcctcaacagtcacagatgcacttgccaagatgaaggctctgatatcctgggtcccagagttacttgctaagcagggtct

SEQ ID NO: 19334 - DNA, 201 bp, Bos taurus
cttgggatacttgataaaaaattgatatttttatttcttgggatactaaggtgtttttggatacagagtttatattttacaccaaattttcggccatcatctttccaaataatacctcttcctcattccttcactcttcttcggggacttatggaaagatgaatataaatagatagagatagatagattgactttggggcc

SEQ ID NO: 19335 - DNA, 201 bp, Bos taurus
tgattgacaaactttatgaaggactattaaggaatatctctttggtagaattgttgcaggttgttgtaggggctttaattttaggtaaaagaaactatgtattataaaaggatttattacacaagagctctcaactaaggacagtgaaaaatcttgatggaccttaacagaaaagcctaggaaggttaaaatacccattta

SEQ ID NO: 19336 - DNA, 201 bp, Bos taurus
tacttagagggtgtaatcactgtgcctgccctgcctttattctgtaaacaaaccctttaacttcccacccttccctacagaacagttctctgaccatggtactgaaaccactcctgctttatggtaacctaacaattttcattaaagatactggaaatatgaaaaatcttgatgtaggtgtaggcttttatcccctacttc

SEQ ID NO: 19337 - DNA, 201 bp, Bos taurus
acctcattttaagtttataatttattagttttcctgtgaaactttctactccttaagggcttggactgtattctgttcatctgtgtatccataggatatgataagatgttgagctcttggtaaacactcaaaaaatgaatgtacaaaaaacttattgaatgaaccagttaatatatgacatgacatattccttaacttttt

SEQ ID NO: 19338 - DNA, 201 bp, Bos taurus
gtttaacatgacatttctagattagaattaagaatttaatgatcaaatctgaggtattatttcccaatagaagctcatttcattgtgatattaatgggggccatcattgtttaataaagatttcccccaaacaagggttcatggtggtccttgaaatttgaacttaactacactgaagaaatcgatgtcatttaatttccc

SEQ ID NO: 19339 - DNA, 201 bp, Bos taurus
atctttctaacgccttattgacatcaaatatcaggatgcatattctgattcttatctaaccctataatattgtattttcagattcagaaactctgaaaccagataattttgaagagtctggctatacgttcatagcaccaaggtaggttttgtttggttttcttttttaaggctcattgtggatgtataggccttcaagaa

SEQ ID NO: 19340 - DNA, 201 bp, Bos taurus
ttaggtgacacagaattctagtaaaatctagaggccacccgatgtctaaacatttatttcctttccctattgagttaatttttaattcaattaggactttcccaatgttataaaatcttttgaccttattctcttactgtcttctctcttctcattatcttccaacattttcacttctctgtcaagtcacctagctcatga

SEQ ID NO: 19341 - DNA, 201 bp, Bos taurus
tgtatattaaatgtcaggccatagaaacagcaccccagaaataggagctgatgattcaagcttggcagagtctcctgtactcaatgttaagaactagctacaaggctcgtcataataatgttggagaaaaaagaattcttccttccaacatgtttctcaatggagatatcaaaatgactgctgaaaattacaggtctagaa

SEQ ID NO: 19342 - DNA, 201 bp, Bos taurus
ttcactaaataaatgtccttacataatttaactgagactatgctgatatgctgtagtagttactacattcaaatcaatagctaaaactgaagatacttctcgattgagtttgagagcatcctctaatctacaagaagccatataatttttattaaggaaggacttatgaactaaatgaggcttgtatgggaaccaccacca

SEQ ID NO: 19343 - DNA, 201 bp, Bos taurus
agcattgtgttttggttttatcctatgtaattcataatacaaaaatacttcttacaactttaacaggcaattttactgagaattcaattagaggcacagtgtatccaatctcactatttgatatttgttatagacctgagacacagaatggtttatttgatatttctgttatagacctgagacacagaatggtttatttga

SEQ ID NO: 19344 - DNA, 201 bp, Bos taurus
aagcatgagttaagaggatcattcttaagacattacaggcagatctactggcaggaacataaagatcaaggaggaaaagccaagtgttgtgctgaggaagtaagcaagggtcaggtcacagagtgtcttgcttagtatatttggaggttacaaagtttctctttaggtgggacttcgataatctgagcgtacccctccctc

SEQ ID NO: 19345 - DNA, 201 bp, Bos taurus
tggagggccgcatttcttacccattggtaggagaagccagtggctaccggtctgcagatcacacttttgagtggtaaggctctatttcttttataattgatagttgagaggatgaaggtagattttggaggaagagaagagacaattgatttctttctccttttcccacacgcttcacagtgaaacaattgcttcatttct

SEQ ID NO: 19346 - DNA, 201 bp, Bos taurus
aatacaaacagtgagcaaaccaggcctccaccacagctttactagggagactacaagctctctggtgcaaagaaaatgtctacttcttgtctttgatcattaatcaagtggcccaataactttcatacttagactccggattttatttaaacttctctttatcagtaaactctctgacaccatggctgcagaaggatacga

SEQ ID NO: 19347 - DNA, 201 bp, Bos taurus
tatccttgtataagctcaaacttaatttttaagataatttcagaaaatatataacattacccttatatatcaattttaaaagtttccaaaattcaagcaatttccaaaaacaacagaaagaagagatgttaggtgatagaactaaaattctatccacgatgaagaacaaagcccacaagctttaataggatgcctaatgcc

SEQ ID NO: 19348 - DNA, 201 bp, Bos taurus
taagtcataactatattatattataaatgctaaaactgaagcttaacctggattacactaactgcccaaggttacactccttgcaagtagagatccaaaagtcaaaggttctatgtttatctaccttctctgatatgataaaccaagacagaatattaaaaagcagggacatcattctgccgacaaaggtctatatggtca

SEQ ID NO: 19349 - DNA, 201 bp, Bos taurus
cacatataatggaaagaaaactttcattattaaaataagtttctttaggattaccactctaatactaaagcctgaaagctaaatctaaaaggtcgaaccacttaaaccctgacctaattttctttaggtcaattagactaggtcctctgttttgtaaggcctaattcactgctcctagtaaggacagtgaaatacctccga

SEQ ID NO: 19350 - DNA, 201 bp, Bos taurus
atcactttgagagacatgatacatatcctagactggactacagagttatttggaaaatataaaaactcatccacttgtaactttctactagacttccataaacatcaaaacaccatgttttatgccatagcaaaagggtagcaactctacctgacactaagggattgcagtagccattttatttagttttattttggggac

SEQ ID NO: 19351 - DNA, 201 bp, Bos taurus
atttttaagactacccttgaaagtcccactgtaactgagctttctcaaaatgatttttattatgtggtgtttccaaacatgggaaggggtggaaattatagggaacttggaaatattggtatattcctaatagcaataatgaactgctacaaagtggagtgaaattaaaattataaaagtattttaaacttttaaagttag

SEQ ID NO: 19352 - DNA, 201 bp, Bos taurus
ttacttggtagaagccagtgactggtacccagtaggttctggatagggaagttgtgtagattgttcagccagcatcattccacacacaaatgtgatcagacgaattgccagtcctgttgattttttttttaatcattagaaactaaagcatcctaacaaggtgccaccatggcaggaggaagtggcacacttccagagggc

SEQ ID NO: 19353 - DNA, 201 bp, Bos taurus
gtaaaaaacattgaacatgtaagttaacagcattcagtttaactggatcaatgattcttaaacatcttggtcttaggtcacctttccattcttttgccaatgcccagttttaatgcagtatacttgacatataacattgtatacatttaaggtgtacaatgtgatgatttgatacacttatactttgggaaatgggtacaa

SEQ ID NO: 19354 - DNA, 201 bp, Bos taurus
tagcatgtaaactcacacattgttattttattctagtgtttgggggaaaagtgctaataaaaacaggctttcccttaccatatgaataacaaaccatcagtttaaaccctttcctctcaagcattgtatgctataacaagcaaacatttggagacccattagagttgagcatactaatttagtttccttaatatattctgt

SEQ ID NO: 19355 - DNA, 201 bp, Bos taurus
ataacaatcataatagctttgccacccatatatttttgttgcatagatacctctaaaacgccatgaaaattaaaactagtacatacaaaatggcttcagtccccactagtggtaggaaagttaaaatatgcttaaccttttctggttttagtgtcttagtatctcccctggaatttcaatagaaacacttcttttcctttc

SEQ ID NO: 19356 - DNA, 201 bp, Bos taurus
actatggatgggaaggtcactgaaaaggaaaataaaattaataggaatttgaaaagataatctggcctcatcatctaaggacaatcaatataaattagtataattaagaaactatcagaagcctgataagcatcagagaatatggagcaacaaaacttcctcattgctggaggaattaacagactctaccattctggagtg

SEQ ID NO: 19357 - DNA, 201 bp, Bos taurus
atattaaaatgttcttattacttgagacggttttcagtctctaaaggaagacaatgtgggatggtggttaacaaccttttaaaaacatttacatgttcatattttaggcttcgaaaattggaaatttgtgaatgatcaagagaaagatgggacttaagttcttaagtgtggcatttctgcaaatgggtggtcttgtaaaat

SEQ ID NO: 19358 - DNA, 201 bp, Bos taurus
tttctaagctgccaggagacctgacaatgcttcaggtccttgctttctgccttattcagcagtgccctgatggtcaccactatgcttggcccttatctcccgctttcctgagctgagtacagacctgaccttgacagagatcagggagttagacaaaacaacaatctcagtctgaatggtccaggaacccagaatctcagc

SEQ ID NO: 19359 - DNA, 201 bp, Bos taurus
taagctgaagagttataatctattactagagatctcagatttaaagacaaacacaatgcttgatgtaccacaatgaaatcattctgaacattacaaagcaatcctattgtaattcaatctgttcctaattataaatagttgataacctttcactgctacaaaactatatacccagttatcaagtacatgtaggaaaatcaa

SEQ ID NO: 19360 - DNA, 201 bp, Bos taurus
aaagatcaaaaagtgaatggggcccacagaagggaagtcatagtttagagctggagcatttacaatataaaagggacctgtgttccccttactgcctggagaaggcccagagtcctagaggatgagtactagggttggctggcggaagaactctctcttttggaactgatgccttcttctgcccagtttgctctgttgctt

SEQ ID NO: 19361 - DNA, 201 bp, Bos taurus
atattttgggtaagtgaggaggcatttagacgattaaattaaaagaacaaggaccccattaaaagtatgtaatattcaaatctttagtgttttccacacacagtattattatctgagacaacatcaatgtaacagcaaagttcagtttctaaaaaaagtaagtttacaatatgccataccagctcatcttctctcttttta

SEQ ID NO: 19362 - DNA, 201 bp, Bos taurus
tacttacctcatttgctaaggcaaaagttccccagtgaattgccacagacttctttgcctgaacatcaatgtgaatctttacagcctcttctgggtctacgtgctggtacttcataaaccaccttagaaaacagtaatttattaaatatggcctttgaagtatacactaaattctaattactgcttcatcaacctttacga

SEQ ID NO: 19363 - DNA, 201 bp, Bos taurus
aagctgtggcttcattttgccagaatatttctgcaattctttaaaatatttgctttgagtttgtcaagaaccaacaggaactgtgcggtcttcagctgcaatgtaacaccactttaaactactgagtacttattatgcacctcttaattcacatatccattttgacactaaatccaacactgcattggaagattactgttt

SEQ ID NO: 19364 - DNA, 201 bp, Bos taurus
acactttgaacatgtattgcttttacattaaaacattaataattaagtattttaagttactaaaattccccacatttcaactgtcttcagcatagatttcattcctttggaaggttcttatcagtttcattactgcaaaatacatccagatccttctttctgcgtaagattctaacgcagagttgggtattgcacagtctc

SEQ ID NO: 19365 - DNA, 201 bp, Bos taurus
ttttttgaactttttatttattcaaatgttctgaatacaaatgaaccaccttggttggatatttattattgttcacctgtcttgacacagaaactgcaagcactatgataaatggactgaagggtctggtttcactgtggttccccatctgctgaaatcttattttgaaaatttctcactgccactctccctagtgaatgt

SEQ ID NO: 19366 - DNA, 201 bp, Bos taurus
tgggggctgtcaaactgtgtattccacctctctgccaatggagtgaggatacacctctggccatgcccatcatatgacaccattcatgtacatgtgattggtcaatcagaaaccttactcacattttcccatggagttgcttatagggctctgtggccatggccactctcacaatgactgctgacctgaaaaagagtcttc

SEQ ID NO: 19367 - DNA, 201 bp, Bos taurus
ttgttgaagtcaggagtaaagtaaaaatagtctaggaaaaaaaatatgaaaagagccaagcctcaaggaacaactaaatgtaaaggtcagtggataggataagctgacaaatgagcttgaggagaaacagccaaggaataaagatgaaaatcacaagattaaaatcatgcactctaggagaagagttttaaaagagataga

SEQ ID NO: 19368 - DNA, 201 bp, Bos taurus
aatgagtcagtccttcacatcaggtggccaaagtattagagcttcagctgcttgtattaggtagccttaaattttttttgagttctccactctccactggctgcacagaaaaccacaaaagggcctaaagacctaaagctattaaaataagaaaaaataattctctgtatatttaaaatatattaataatgatcagaaaaa

SEQ ID NO: 19369 - DNA, 201 bp, Bos taurus
taggtcttttaaaggtagaaggaaggactaggcaagggcaatgattagggctcaagctagaaaagtggaaaattactaaacacaggtaaaggggctgctccgtgtaattagggcatctggattcgctgagtgatgcttatcagaggcaggttttctggtgttggctggtatgcagtaaattttttggcagccttgagcttt

SEQ ID NO: 19370 - DNA, 201 bp, Bos taurus
tggggtcagctccaatctctactcatttcccagtctgggaatctacccttcagtccttagctgtaaggtcacttctttccctgctgtattgatccccagcaccccagcaccaggccataagaccaccagacaacatctttaggcttcttacacagcccccatgtgtgaggaccatgcaagatctacaggctatgtagaatc

SEQ ID NO: 19371 - DNA, 201 bp, Bos taurus
atgaagagataggaagaccaagatggcatccaagtccaatataattagcctacttatttttctcacacagcagacattaagatgttcgaaggcaggtcccactagttggtcttcaggcctcacacagctgcagaattcaagcattccagtgaagcattgaatgagtaaatctgatatagcatgtagagatagaggccctga

SEQ ID NO: 19372 - DNA, 201 bp, Bos taurus
gattgaacctgggtctcctgcattgcaggcagattctttaccaactgagccaccagggactcccataaacagtggtggatacctgcttgctctgccttccgagtctagatcttcagcctagacctttagactgtgggctcaaggcagggaccatatatcatttaggtttgtatctcccatacccagcaggtacctagtacg

SEQ ID NO: 19373 - DNA, 201 bp, Bos taurus
agttcccagagacaggggttttcacgttgttgttaccagaaatggccacaaggtggcggcactgggtcattcccatgtgtgctcaaggggcacctgggccgcagtgaatgtcttctcctaaacttacccttcaccttcccctgccccacttcccaccagtcccaagcccttgaatttagcctggcttcaatgctgtcatcc

SEQ ID NO: 19374 - DNA, 201 bp, Bos taurus
cttccttttctattccttcttccttctagaaactatcctgtcttcctttttatccacaaggttgatttcagagtggccatgttggttcaagtgcagggtttttttttttttttttttttgaaccattttgaaagtctttattgaatttgttacaatgttgcttctgcttcatgttttcattttttggccacaaggcaagtg

SEQ ID NO: 19375 - DNA, 201 bp, Bos taurus
ccaatggctgccctcaatttccatattttatataagtcagattgtggatgcccagacacaggtttgccagatgaaacagggcagcctttgacagctatatctggtatcctccataggaattatcaagtctccagaaacctacttaagcagttaaagatcattctagaactcccaatacaatgtggccttacagctccattg

SEQ ID NO: 19376 - DNA, 201 bp, Bos taurus
attatggcaaaatatacataactaagaataatagatgaatcatggctaaaacctacccccaaagaaatccaactttcctcttctccaaagtactactctggagccaaaactgaggctcccaaggaagggaaacattagagtaccaggttgacaaataaaagtaaattcattacttatatattttacattcacttcaacatt

SEQ ID NO: 19377 - DNA, 201 bp, Bos taurus
aagtccattagtatgcagtaggtaggataggtttttaaatgttttcctgtataaagcaattatctacttgaaataattaaaacattaagaattttaaaagttagctttccttaatgatatagttttaacttgaaaagatcagtttaaagccatatttatttattttaaaaaaatcactttttctaagttgactataatgtc

SEQ ID NO: 19378 - DNA, 201 bp, Bos taurus
atttcctgggagaatctgggcaagccacttaaattcctcatatgcaaaatggaaataataaccctcatactggaagggaggaaatactttagcccaggccaagcatctagctgtgtggggacacagccctacccaccagcagaaaggcaaacttggattccctcagctaccttggccacacagagaatctgaccttgccca

SEQ ID NO: 19379 - DNA, 201 bp, Bos taurus
aatatggtttttgagctgatggagagattataaagtagtaaataagcctaaagtatttaaccttagggctccagttatctgtcgttggtaggactttggaggtggtatttaacctcatccaagaagtgtaaatacttggaatccttcatatagtttaaggataaagtgagataatgctcagaagtgctgagattcctcagc

SEQ ID NO: 19380 - DNA, 201 bp, Bos taurus
ccacaggccacctattcccaagatgccccctgctgcaaagcagacatactctagcatccttagctgcttttcattttagtttggagaaacttgtgatgactagttttaattagaatttataaggaaggagtcactattgaagaaagactgagagaattggcgtttcatgcctgcatatggcagctttgtctcatgttaggt

SEQ ID NO: 19381 - DNA, 201 bp, Bos taurus
cttcttcattgactccgtccaccggggcacactcgctggcgtggccatagcagaagcagtttcctcgaaccaccatatcgtaaaccgcgtaataatacttttctctgatttccattctggaatccaaaaggttatctcccaaagtatgtagtttcacaaacttgatcctcaagttggtaatttttaagagatctacgaagg

SEQ ID NO: 19382 - DNA, 201 bp, Bos taurus
aattcatccatgcatgcatccatccaagcatttacttatctgttctttatccaacaaatacttgggaattatagtaaaccctaaccaggagctcataaagcagtggatgaaagaggtagagagagctacagttaacagtgtgaggtggcctttagaaaagaaactgaccttctttagtggaacttctaaaagaaagaagta

SEQ ID NO: 19383 - DNA, 201 bp, Bos taurus
tagtaaaaacagtgctctgccttgtacatgactatttcattaattcactgagccacccccaaccagtaagatgcagacatataactgaagctgcaggactcccagttaatgacattgtggagcataaaccacaagcaaatgctcagaacactaagaactgggttggccaaaaagttcattcagctttttctgtaacatctt

SEQ ID NO: 19384 - DNA, 201 bp, Bos taurus
gggttttagcgggaagaaaacatttttctctgtcttcaggcaaggcataatgaaaaagcagcaatttcaatacttctcttccttccaacagcagacggtactaggaacagtaccagacagggaatgcatttgaccttacatttgcccaagaggcactgaagtctccagcccagaagctccatcagctgctcccaggggcca

SEQ ID NO: 19385 - DNA, 201 bp, Bos taurus
gccttgatttactggtatcctcacattgcagtgctagtatctgacactggtttgggcttaagggaatcagaccctgcctaacggagggcactgcttccagttcattactcacctaggggaaaggagcctgtcacctcttccagcctagagtaacagagctctgccctgggattcaagaccaaggcttcagctactcatgca

SEQ ID NO: 19386 - DNA, 201 bp, Bos taurus
ttctgccacaattcaccctactcattactcatctttctttttcttaaacaaaactagaagaaacaaacaaacaaaaatcttcacaattccatctccaatgaatcaggatttctttgcagttcttatctgaatgcttgtgtgtatgtaatttcaacagaactgcaatcttgatattttaatttttaagttaacattatctca

SEQ ID NO: 19387 - DNA, 201 bp, Bos taurus
cagcctagggcgtgtcttctgcactatctcagctctttcaggagccatctgtgaaggagacacgccaaatacatattttatatgagttgttttttttttttcctttttaaaggaatatgacaactcaaccaaaagtgtgcgggatcagttaaaagaactgtcacaaccgttgaaattttcgtctactcccttaaaatttct

SEQ ID NO: 19388 - DNA, 201 bp, Bos taurus
ataaaaaaaaggaaaataatattctcatggagaaaaagttaccttcttatgtggaatcacagtttttaatttaaatggctcagaagcctagaggtggccacgaggactgatttctcaagtagtttctagaagagcagctgctgggcactttctcttttttccctgctctgaagtggtatctggtgtggtcacagtggaagt

SEQ ID NO: 19389 - DNA, 201 bp, Bos taurus
catcaatgtttatctacctatcccataattaaaatcacatgtctgaccataagctctgagtgagggtttgcttaccttaatgcttgtaaactacttggccgcttaagtgtcattggctctgtgaattgaatcagaagggagaaaagtgtcaatgtcagaatctactttaggcctttaagctgattctacaacttataaagc

SEQ ID NO: 19390 - DNA, 201 bp, Bos taurus
aagcccgtgtaccgcaacaaacagtaaagcctgccggtagcaacaaagacccagcccagctaaaaaataagtaaatcttaaaaaacaacaacaacaaaatcatagagtcagatgaaataaagatatgattgggcagaaaagctatttctcagtcaacagacactaggatgagtattaaacttttcattacctcattataag

SEQ ID NO: 19391 - DNA, 201 bp, Bos taurus
gtccatcagcagatgaatggataaagaaaatgtggtatatgtataccgtggaataatactgagccataacaagaaaatcttgccatttgtgacaacatgggttaacttggagggtattatgatagatgaaacaaaccagacacaaaagggcacatactgtattattttacttatatgtggaatctaagaagttgagctcat

SEQ ID NO: 19392 - DNA, 201 bp, Bos taurus
atttagtgtacttaccaaattgagcacattattctctaatgtcgtattcttaaattaggccagtagctaagtgtctgggtggatttgaaataaaagagctcgatttagcaagattttattgtttaatcctgcacagtgggccacactgggaggacaggatcttcattgtatcagcagaggagtttaagctgtaggtaatat

SEQ ID NO: 19393 - DNA, 201 bp, Bos taurus
cagccatatatttattcacttatttataatttaactctctcctctagaatgtaaggttaatgaggagaaggatcttgtctcttattcaccactccagtaccacctgacacagttggtgttcagtatatatttcattaataaataaatacatgaataaatgtttgactatggacagtagacagtctctgctatagactgaat

SEQ ID NO: 19394 - DNA, 201 bp, Bos taurus
catctgagctctggccatcaagaatggagagttctcagtgatcatctgggaaatttgatggagaccccaggagtctggccttagaagtaaaactgaaccagtattggaatccatgctattgtagactcaccctagcaaaatgtataaaataaatgtatagacctcagagataatggaactgatttgcaagttatttaactg

SEQ ID NO: 19395 - DNA, 201 bp, Bos taurus
attgagacatcagtgtcaggtaacagcaaagcactgacagcaaggtcgtggggagtctatgctgcaactgaagctgcagtgagtcagaaccacatgaaaagtaagatagtgagggcagaggagccattatgaaggccaacatggagaatattaatcttcagacaaggaagagagagagagggagagagggagagggacttt

SEQ ID NO: 19396 - DNA, 201 bp, Bos taurus
tctacaatgctggaatttggttggtgtgggcaggtatgtgtatttctatttgaatgattgatgtttgagactgtggggaaaggtttatcctccctatattattttaaatgaaatggaattattgacatatgatgcacaaagataccaagtgttttgtcaatctatgcatgtaactatagattatttcttatatttttgcat

SEQ ID NO: 19397 - DNA, 201 bp, Bos taurus
attcagatgctgactctgttagtaggattgccagataaaatacaggatgctcagctatacatatgagtttcaggtaaatgacacgttattttttggtatacgtatgtccatacaatatttgtacatacataaagaaaatttaaaaatataaagaaagctgagtgcagaagaattgatgcttttgaactgtggtgttggaga

SEQ ID NO: 19398 - DNA, 201 bp, Bos taurus
ccacaggaggtcaagagcagcagctagggagtatttattcacattcttgttctctcactgcccagtgatgctactccctcttccatttgataaacctacctatctggcccatccacccacaaggtagaccctctccaactcccaacagaaagtaaagggaaagaccctttgctctcaatttacctctgcaatcttcacctc

SEQ ID NO: 19399 - DNA, 201 bp, Bos taurus
aatgatgagatttaaaacttcaaaatctccttaattaggccctattctagtaccacttaataaagttgtgttggagaaacactgtcattgcacagtttccgatgacataatccgtcacagctcagtgagtcaaaacattagctaaaaaagtcttaggattaggtcacgatgttttactgaacaataaggtagaactgaatt

SEQ ID NO: 19400 - DNA, 201 bp, Bos taurus
ctttttttttcctaagtaagatctgccaaatgttcatggacaaaaacctctcattgcaaactgaactagtgaaatgacaagggtaagccacgtttctttcaatagctttatggcattaataaagctactgtttgaatgcatgttaatattgtcatgtgtaggatgaagtctcacaaattccccaaaatgtgaatgatcaat

SEQ ID NO: 19401 - DNA, 201 bp, Bos taurus
aaaagataaatactaatttcagatttctaaggcatacaacaaatagcaaagggtgaccagaataaggaaacataaagcagaggtaaaaaatgatctacaagaagagagttagggatggttaccaacaggcatgaaagatgaatgtttctttaaaagttattcttgcctccagtgctttggtcaaacaagccttctattaaa

SEQ ID NO: 19402 - DNA, 201 bp, Bos taurus
tttgcttctgtcgtggggacgttcatccaagaactagtcagttttgactgtggctgctccttattgccgaccctcatctcttactatctcctaaacttaatgcttcacttacaataaggctatttaacactggttcttagttctagcctacttatcttcagtaacacaattcctgacaataaaaggaaaaagaaagctagc

SEQ ID NO: 19403 - DNA, 201 bp, Bos taurus
attaataagagaaactctaataggggcacctacagcaagtgtaaatgcagcaaggggcatccaggaagccgctctctaattgatgagcatggagctatcaatgtgtatatcctaagtgaggagaaagggcaatgacaagcaggaatggttgaataatacaatgtgatatttggaagctgggaaggagagttattaattttg

SEQ ID NO: 19404 - DNA, 201 bp, Bos taurus
gttgtaattatttatcagtaactgtgctcctgagtattgcctcttttgccatcatctgttctgtcagctcagctgaacaatgagacattcacttggccatgatgaggggaaaatgaatgattcttattcaccgcaaaataacactggaagaattctggcagtgaggcaagattctgggctctccatttaaactttgtattt

SEQ ID NO: 19405 - DNA, 201 bp, Bos taurus
tcagtcccagtaggccatttctaggaatttcaaaacatcacataatgagcctgtcctagctttaatagtaaataggccagcttgtatgctgtgtagttctgcaagtgcttatatatattgtcatctttcttccctcatcttcatgctgtccacaccaggccatctgttccaactcccgcccgccacccccccacccccttc

SEQ ID NO: 19406 - DNA, 201 bp, Bos taurus
cagtcacaatgtctaaaacactcagggccctgggagatacagttgaattctgttggcaataatccactgtaagcctctagcttctgttagcttgtttaagtggccatattaagataaacatttcttaatgttgctttgcctttaagttcttaattaagagagatgttaattaaataatggtttccctttgttttcatggga

SEQ ID NO: 19407 - DNA, 201 bp, Bos taurus
tgttttcatctaaattagtaactataagtacttccctacattttggggaagttctagcacttccttggttatgcaattatagcaaaataggcaaaaatacggataaaaacaacttgaaatggcttgttttacccaacggcaattatttgctaatttgtctatatttacaacagacaatgagcttcttacagttaggaacca

SEQ ID NO: 19408 - DNA, 201 bp, Bos taurus
aggaggccacctagacccaaaaggcagagcctgcgggggctaccctaaattctttgaacaaaaactctttccttgaagcacatccggactaatatttccaattattggcctactgctgcccccctttctattaataatgagacaaattactgttgtttccttgttaatttttacctgtgcttctcacttatattcctgtgc

SEQ ID NO: 19409 - DNA, 201 bp, Bos taurus
aaatctccctaccaaagttagaacagcggtccaaaggctccacagaaaggcagcagaactccttattcctcctgctttccatttctagaaccatggattatctctgagggtatctgggattatttaatttacacctccatcttgttttcttaagtatttcaagtggttataaagcaacatagcagaaaattagtaaaggaa

SEQ ID NO: 19410 - DNA, 201 bp, Bos taurus
ctaatcattcattttgtaaattaatgaggcccaatatttaaaagatcaatttactaaactcctactaagagtgggagcgtgtgtggggacggatgtaaaccggcactgtcgcatagtctcagcagcacactgggacagctgatgaggctgcgctggattagtatacacatcgataccggtggaaggtctgatccgtcctcc

SEQ ID NO: 19411 - DNA, 201 bp, Bos taurus
actctaaacaggtaaagcccaagatggtctactgagtggtgtcttgtgaagggaggtgacaggcaggtattttgacaaggaatgttcacggaggtgaatacgatatcttgaagtcttcacatgagatgctgtaatagagaagttccaagaggaggtttatttgaagtctatattactaggcattcaacatcaaatttgaga

SEQ ID NO: 19412 - DNA, 201 bp, Bos taurus
cttttgaatgatagtagtttgcccttactcaattaccagtatagacatcatctcttgaattctttcccgtttttcatttgcttaatctcgttatgttaagctgcctaagcttaagtttatcctggtcccacaaaatacatagacacatacaacttagtataagaaatatacatattgcaggggaaaatacaaaaatgatgc

SEQ ID NO: 19413 - DNA, 201 bp, Bos taurus
gttatcagtcagaaaaatattaaaatgcatgttaacctgttaacaatgatcttctcaagacataggataatgggtgatctttattatacttttctacattaaaaaaaatcagtgttactagtagcagtgataatattttaaaagtagttagaataaattggataggttactgatactgaaacagaaaagaagaacacagaa

SEQ ID NO: 19414 - DNA, 201 bp, Bos taurus
aagccaaaggtgatgaggccctgagtgctggcaacaaggatgatgcgccacagtgctgccctcaaacagtgagttaggtccccagaccgtgtgctctccagcaatcgctctgtgtccttcaccaagaaaggtgatcatcaaaaggctacaaggatggtgacaaaactgttgacttaaaacctgactggggcaagggctcta

SEQ ID NO: 19415 - DNA, 201 bp, Bos taurus
tgcacacatccgcttcgagtttcggcattgttccagtaagtggatggagtgtctccgtggccttgttatgttgggtactgcttactaagctgaaacaacagtgtggcatagtctgtagaaagtgtgtcacaaaccagagacctccatgagaaagaaatggaggtgaatggaatcctgggaggtaaatggtgccattctcaa

SEQ ID NO: 19416 - DNA, 201 bp, Bos taurus
gatttaattgtggaagtagacatgggctacaatgggatatttaaaaattcttgattctgatgtgcagcacattctgtgaagcattgctctgagcttctcagtttagcttccccacaaaatttgatagattgtgttttcattttaattcatttcaagatatttaaaaatttcccttgtgatttctctcttttctccattggt

SEQ ID NO: 19417 - DNA, 201 bp, Bos taurus
aggatctcacatgcctcagtcaaaaaaccaaaacatagaaaaacagaagcaatattataacaaagtcaataaagactttaaaattggcccacatcaaaaagaaagaaagaaatagaaaatccttaaaaaaaccaaagccaaataatgttgatattccatagaatagtgtacttgatcatcagccacctggccctaacctcc

SEQ ID NO: 19418 - DNA, 201 bp, Bos taurus
ttaagcatttcattttggttgattggtgttgaccatacaattgacaaatccaataatcaaaccaagtataatggcctcccataatgagagtgagtagtgataatcaagcagatagatgattaaactacattcatggtttataaataaaaccaacaattgtaactattataaattttagtctctttcagatatcaaaaaaat

SEQ ID NO: 19419 - DNA, 201 bp, Bos taurus
cataaagtataatttacttagtagaaggcccctattcttaggatagatttatctttgcaataggttgaggctaggaaacaagtgatacattttgccttaagagaacatagagcgaagagcagagagaacattccagactttattgtatttaaaaaaaaaatcacttagtggtttccagtattgccttttgaagagtcaaca

SEQ ID NO: 19420 - DNA, 201 bp, Bos taurus
cagaatgtacgtgtttgaccttggtattttgaacactgccaagagcaatattctcttaaattttctcctcctaattagtacaagctgtctcttgctttttgtctctctacatttaagtggaaatatgagtcaaaaaaagacaaattgttctttgctcctttcctagctgccaccaagacaaatgatgctcctataggttat

SEQ ID NO: 19421 - DNA, 201 bp, Bos taurus
atgtatatggtgctgtggtgctttttatatcaactctttgtgaaagtgaatagtcttccattgatactagatgcttcatttttctatatgaatttcttcacaattcattggctattaatgcctgtttctgcctttaacatagaacattgaaaaagtctacttcaaaaaatagcatctcaaacttactacttatcaatgacc

SEQ ID NO: 19422 - DNA, 201 bp, Bos taurus
aatcaaaataagaacactgtactagaaaattttattttgtgggaatatatttaaatataaatcacttaaagatgacctgattattaaaatgtgtattatacctccaaaaacttgtatacacttgagtaggtagaaatgaaaatatggctaataatattttatcttatagttaactagataaataaatgttaagtagatata

SEQ ID NO: 19423 - DNA, 201 bp, Bos taurus
ttgaaatatttcctgaaactcttccttaagcagccatgaaagttttctttacattatcaggccacatcacttgatttatccatacttctcacagagtatattctcaattctttttcattatactggaaaactgtatctttaccactaaagtaaatacaatgtcattcatttgttaataatttaacgcaaacgtttttcaga

SEQ ID NO: 19424 - DNA, 201 bp, Bos taurus
aaggctttcaagtgtttaatgtgggtggctaggagaaaggttgttaattcttttatacttggtagcaataaattaccttgcaaagatctgttaccacttgctacccaaaatgataatatcttaaggatgtgcacagtccctcagttgtgtccgattctttgcaaccccatggactgtagcctgccaggcccctctgtgcat

SEQ ID NO: 19425 - DNA, 201 bp, Bos taurus
aattatgaactccaagccataatgattttaaatggcttggcatatggttaagatatgaaaaatggaaaacaggcacttttgccaccaagagcatatattcaagtgtattttgagcagatatactctgctgagtatatttttagtttttctagcataggtgtgtttgaagaaaaaacttcacatctcttttccacctaatca

SEQ ID NO: 19426 - DNA, 201 bp, Bos taurus
ttagttgtcctgtcttcttaggctcctccaacccgtagtaatgtctcagtctttcctttgtgtagcaatcttgacacttttaaaagagatctagtgttgtgttttgcagaaagtgcctcagtttgtgtttttttctgatgttttctcatgattagactggagttatgatttttctttggggggggttatggtttttaagaa

SEQ ID NO: 19427 - DNA, 201 bp, Bos taurus
tgagtttgaattgagatctcaaaatccgttcttttcctaatactgtagcttataatccaaaccaattgaaaattcagttgatggttgtgtggtttgttaccgtgtctaagcactgattttccagatatttaaattaaattactgatatttaaactgaattttttcagtattttttttagtggagaaaatgtcaagtcttat

SEQ ID NO: 19428 - DNA, 201 bp, Bos taurus
taaaaaagagaaaaaaaataggcatgaaaatccattgtgattgaaaatgtgttttgcagcagagagttatggttcctggggaactggcctttagtgactccttcttattaataagtatccacattgatagctgtccattcttaacccttgccatctttatcttttctatttctcccagattatttctccatctcagtcata

SEQ ID NO: 19429 - DNA, 201 bp, Bos taurus
tgtggttttgattttggggggagagatatagaagctcagtgaggaagcaaagaatccagcaggagagactgaaaattgggcaggcatttgagtagaaaagattagttagttgaagagtctgacaagtgattgggggtactgagatcagggaaaggaacttgagcttgtggttgaaaatgccttgcaaaatggatggcaagg

SEQ ID NO: 19430 - DNA, 201 bp, Bos taurus
tcgatgcaccctagacaaaacaaagaagtaaatgacactctatttatgggtcagtttattctttactgctataaatagcttgtcctttgagcattatcatgggtgtttactctatatcacatgtgagtgtgttactttttgcccttcaacatctggaaattctgataagcataagcataaatggacctccagatttgagag

SEQ ID NO: 19431 - DNA, 201 bp, Bos taurus
tctatttagagcttaatcagcaaaatgaaaatgaaatcattaaaaggtcaatagggtcagtgcagtttcacactaattgccgaaaacttttgtctctttcaaggtggagaattttagaaaagagagaaaatataggagcctctggattccaggggtctttctaactaacattcccactgactcacatcctgaaacgagatc

SEQ ID NO: 19432 - DNA, 201 bp, Bos taurus
tcatattataatctgtcacttagacaaacacccatgccttttgcaaatcagggaaagtaaattatgtacttcttgggcaactagtaataactaggcatggagttaaagaatactgatcattaagtgttgaaatttagaggaaaacaaattagaaatttgaactgaagtgtgcagaatactacaaatcttaaagaaaataaa

SEQ ID NO: 19433 - DNA, 201 bp, Bos taurus
gcctatcttgcctccatatctatgtatctacctctattttgttctgttcgggcagtttcattttttttacatttaaatctcctacccatctgaaatgtatcgtggcacatgttatggcctagggaatctacttttcctccaaatggtcggtctgctcccagcgacatttttcaattaattctccgagtcctttctgcattg

SEQ ID NO: 19434 - DNA, 201 bp, Bos taurus
tggagtgcctcagcttggacccctgcttaacctcccaacagtatcctcagaagctgagcgtgtactagtgtccccgtgtgtgcagtagtaggctcagaccccaaggccaaaacagccagtctcattttgcaaaatgacctgctatgtaacaactgtattgcacagcaaacaccaccagcctggccaagggaaaggagccca

SEQ ID NO: 19435 - DNA, 201 bp, Bos taurus
acaggtttctgactgttgaaaaaaagaaactcttgacatagttactttctttcaacattatgaaagttgaaataaaggtgaaagttctttgacaaagtcaagacttttcttccaaaattctagaataaggtatagaaattgtggtgagcaactggaaaagcctcattcattggaaaccagatccttcccatgtaagaatca

SEQ ID NO: 19436 - DNA, 201 bp, Bos taurus
acagatgacaaaaaaataaagccgactggcactttggaccagaaggaagctcggtgactccttggaagcatgggtttcctctgagagctctgggacttccagttggagtcctcagttctccatatatgggtatcaacaagtcacagcctaatggaaaggcattcttcccctccacttgtgacacaggcagtaagagccctg

SEQ ID NO: 19437 - DNA, 201 bp, Bos taurus
accaaaggcaacacagaaattttgaacagatccaggaaattcttaggacaattgaggaaatctgaatgtaggctggatagaaggtggtattatggaattaatgttaaatctcttagctgtggtaaaggtcaaatccgaagtcatcccaggaatgatcttatttttagaaaatgtcagctgaagtatttacagataaagcgt

SEQ ID NO: 19438 - DNA, 201 bp, Bos taurus
gagtgctgtagaatgccttgctgtttccaagtcatgctttctttagggaaggggagatgtccttagatttcacttacagtatagctcaatattcatggaagtatttctttttcttttaaaattgatcaggggagaaaagtttggggactcagatcacagatttttaatcaaaggaagagttgttctctggaaaatgcttgc

SEQ ID NO: 19439 - DNA, 201 bp, Bos taurus
ggataatgtagatccaaattctatcttctttcgccagcatgaccctatttgagaggttcagcactgtcgggaagagcgggaaatcagaagaacattgagactcaactcttgtccacaaaatgtttataatctacttcttccaggggttggcatactctttctataaaggatcagatagtgaatgttatacgttgctgccat

SEQ ID NO: 19440 - DNA, 201 bp, Bos taurus
atctgagaaaactggctctcacagtacaggacttgagaaagaggaggctgccctaggcgggtgaactgtgtgaggttcagaagtccctggacaaggcaagactccctggtgattagtcataaaactgacacatgattgctcctcaagacagcagctagtatctatgggggaaaacatcactattttaaatcagtgtgagtg

SEQ ID NO: 19441 - DNA, 201 bp, Bos taurus
cttagagtgacaaagggaattttatgccacggcagaactgaataatctagttgcttttctgtttgctttttccttatggcattgcagtacgtattcatttacacagatcagtcaggcctttgcctaccatagtgagtttatgcattcctaatattacctagttctgacacattgctctcgagaagggtgcattattgtctg

SEQ ID NO: 19442 - DNA, 201 bp, Bos taurus
tctgaacaatagaaggggaggcattactatgaagttttaaaactcatactactttgaaattatcacacaagaattgtcacaggggaacacagtaagactgtgatttcttcttgttttacaccacaggactgaaaagggagttgaaggagattaattacattccctgctaatcaatgcaaagacatatttttctgcttctcc

SEQ ID NO: 19443 - DNA, 201 bp, Bos taurus
gtttttataccaaatcaatgatgtaatctgtgtgcaaattgtggctgttgctgctgttccttctcctcatttctttttccccacagaatgaatcttccatgtccttaagagagaggagagtagcatcactctactatctatgggctcttgtctacaggtcagccaagtgtctacactgaggataggtaatcctgatctcac

SEQ ID NO: 19444 - DNA, 201 bp, Bos taurus
tgcctataaatgtacagttatctctctgtgccaacagttccacaactaaggattcaaccaaccacaggttgtgtagcactgcagtatgtatttattgggggaaaaaattgtgcataagtgatttgaacacacaaaattcaaacccatactgttcaactagagtttgcttctaagagagattccagagcgcttacttgagcc

SEQ ID NO: 19445 - DNA, 201 bp, Bos taurus
aggtacttactctcataggatgactgccttttgttccatcctcagtgctccacatcagaggactgaagatggtatttacccctcttaccaaacaattcctcgttatgtaactgagtgaaaagaatactgattttttgataagaacatgtaggacaaaaacattactttagtcccacattccttaactttttatagtaggcc

SEQ ID NO: 19446 - DNA, 201 bp, Bos taurus
ctctctcctgcccgactgtggcgcaccagagctgccctcgccctggggtcagcggtcagcctggtgtttactgggagaggaggccctctggggtggagctttggggagctgtgtgcccctaagcacacctaagtgtctgtaaatacaggatggagtggacgtgaggcagggaggcagcatggtggcgacgggcccagcctg

SEQ ID NO: 19447 - DNA, 201 bp, Bos taurus
acagctgtgaggatccagactccctctatgatcgtattagcacccgcctgttctcaatgttatttaagaacagacgagtgttgatgcgatcatagaggtcgtcttgcacatactgcttgaagagcatggctgccttctcagatgctttttctgctgctttctagaaagacagacagttctgtgcagaacgaagccagattt

SEQ ID NO: 19448 - DNA, 201 bp, Bos taurus
tccacttacttgtctatattctttccacaccaccctaattaagagtcttacagtgaatctgtataggctaagtaccccatcaccaccaatccagcatcacttacttctttagattgtcttgactattcttgaccctttgctcttttgtccatatatatgtaagaaacaacttgtcaagttatatgaaaaaactagttgaga

SEQ ID NO: 19449 - DNA, 201 bp, Bos taurus
aagcctggcatgctgcagtccatggggttacaaagattcagacacagcttagcaactgaacagggagctctctgaggcctcttttataagggcactaatcccgttcataagtgtaccaccttcatgatctaattgcttttcagaggccccgcctcagaataccatcaccttgagggttattatttaaacacatgaatttcg

SEQ ID NO: 19450 - DNA, 201 bp, Bos taurus
ctttaaaatgtgacacgtggaccccactgcagagctctcgattgaattggtccagggagggacccggaaaacaggtattgctaacaatgctccatgggtggtactgacatgcacaacacccaaacgtggcctccttcagagctgcccagtggcagagtaaacacacccaaatttacaccattgagggctctggagcaagtc

SEQ ID NO: 19451 - DNA, 201 bp, Bos taurus
tctctttggtggctctgaaagagaaacacagattttatggtggcaaaatggttgtcttaatattattttcttttccctttctgatcatgattatagtcctgcctttattttgtttgtctgctgaggcttattaggacctagttgtattagctcattctctagcaaggtgtcccaagagcattactggagaactcctacaag

SEQ ID NO: 19452 - DNA, 201 bp, Bos taurus
ggatagtctaaaaagaagagtagaatttaagagagataaagaataaagtatcttacataaaacttcaattgacaggtggcatttaattccttttactgtgtgactttgcttcactctgcctggttgctgaagctgtgagagatggtcaggtccagatctcaaccaggccaagtgaggtctgtagacctgagatgtgtactg

SEQ ID NO: 19453 - DNA, 201 bp, Bos taurus
cacagcagggagaccacctgggaatggtcaggtgggacagatggggatcttttccccatggtcctggcatgaggggtttaatcagaatcatgtctgtggatgagtgcagaggccctcctgcacacactgcagaaggcaccaaagtcagtgtggggtgcaaacgagcagaacagtaggggagtaagttagaaactgcaagag

SEQ ID NO: 19454 - DNA, 201 bp, Bos taurus
cacttgttaaagtttattaatacaaagaaatgaatctgcagagggaagatcaataaatataaaatacacgggaaacactgggagagtcacagaccacagcactggggagattcctcgaggatgggaggggcactctgtttgagtttgtggtccagaggtgaagtatttgtcctgccgcaagagttcaaagggcaggaattc

SEQ ID NO: 19455 - DNA, 201 bp, Bos taurus
actttagcattaataaacatatatttataaattctagactgtaaggaagttgactgttcttctctagtgaaaatcctacatgtttttttctagagcgaatgatgttttggttttcagatcttttctaggctgtattgtttattctttgtgtgtatttaactgactttcaaaatcacaacctgtactttatgatttttgaac

SEQ ID NO: 19456 - DNA, 201 bp, Bos taurus
ctacagtcataataagcaaataaaaagtttctactgctgctgcagtacagtctgtcaagcaatgtaactaaagtacatttctgtttatcatgtatactattcgccatatataaaagttggcactggatctgctaaagctccaatactttggccacctgatgcaaagagctgactctttggaaaaagaccccaatgctggga

SEQ ID NO: 19457 - DNA, 201 bp, Bos taurus
aatttcaaaaaagaatgacatgacaccaaatcatttacagtcacaaaagaatttctgcatattttgtattctttatttaattctgaggaacttgactttagtcatacaagtaaatcttaacattttggccttttggaaaagtcaaaaagaaatttagaatgttgcaggaaaaaatattagtctgtacttacgtaagaacgt

SEQ ID NO: 19458 - DNA, 201 bp, Bos taurus
tgatgtaggaaatacacaaacactagacacattgtaaacaaaaattcttttcaaggtaacattactagaagtcaccttgaatacattttggaagagaacaatcagacagcaaatgtttcaaaatgcatgaaagaaatcaaaagtggcctgcagttctgctagggaaattaagaaaaaaaacacacacaggacttctgcagg

SEQ ID NO: 19459 - DNA, 201 bp, Bos taurus
tgaaaacaggcgctgtatctgaactatgtactgccagcgttgtggccaagaatgcaaggaagcagaagacaggatttctcagattcaaatctgggtagtagtaaatcttttcttttctagatgtgtaaaaggacaggaaaaaaaagggggggtgggataaaaggttgtacttgtgtgtgctacccttgcctgtggttccag

SEQ ID NO: 19460 - DNA, 201 bp, Bos taurus
cttaaaagcaaaacaaatctcctggctaattgggaaccaagacaatgcctaaaaagaaaatgacaggccttggttaaccactagaactcctaggccttgtcccatctgctaggaaggaccagcattgatacccaagaaccactaaagatcctgccgcttgccatgcatcatcactggcctcctcagctgctaaaggccatg

SEQ ID NO: 19461 - DNA, 201 bp, Bos taurus
aatttctaacttattacacaaagcctctaaggcagcaacatcaatatcacctggaagtttcttagaaatgcaggatctcaggcccagcccagattataagaggattatttcccaacaggctttggtcaattctgaattttgctctcatacaccctagactagagtgagctgattcctcccctcatacactttaaaggaaat

SEQ ID NO: 19462 - DNA, 201 bp, Bos taurus
cctcactggtgttcccagggtgaagggggccttgatgggcctggtgtggctccaggctgaggctagagcagagtggcactgtggtagcacagagaccctataaaagccacaggactctccagggaaagctgccaggagcagacattgatactggtgggaatggaagatgttctagggctctcagcgatcccctgtctcagt

SEQ ID NO: 19463 - DNA, 201 bp, Bos taurus
tagatgcacaggttggcttctttacccacgtgcctgggctcctggtgggatagctggagcggcaaggggttggtctctcttaatgggtcggattctgcacggtcactgctctctccacaccctaccacggcaatctcctagttgctggcatgcctctagaaggcaaagtgaagggcttcctcaccctgcatgcaggaacta

SEQ ID NO: 19464 - DNA, 201 bp, Bos taurus
tgtttgcacctttataaatccatactgaatatttatctgatgtcttggatttgctttcaaataatccaatatgtggagggagactaataaattgattggaggtatagaagcagggtgatagatacgtggggttcattaagcaattctatttacttttgtatatgcttaaaattttccataataaaaagtaaacaaatgagg

SEQ ID NO: 19465 - DNA, 201 bp, Bos taurus
taagagctcaatagaagaccgagtggaagcagcggcattgcatttgcgttaggttaactatgatctgcatgaactttttcctgaaagattcttccttggcggatcaagtttattttcctttgggttataaatgatgcagtttgttagacacttgcagagtgtggaacttttacacaattttcttagtcaaaaggttagctt

SEQ ID NO: 19466 - DNA, 201 bp, Bos taurus
tttataggcaacgtccattgtcaaattctgatttgctgctgaaagttgtatctgacttatttcttgggggaaccgattttaaaggagaagcaaatctccccggcctacccaatactctacttccactttaatttaaaaaagaaaagcgttcatccctttgcaaacacccagcccttctctttgaaatggggactttccctg

SEQ ID NO: 19467 - DNA, 201 bp, Bos taurus
gtggccggagctgggattttaacccaagtcgtccagccaaacgtaagattctgtttgtgaggttaacactgaacccccagggccgaggactacgtccccttacaccgcagataaaccaactgcagtgcctcggctaagactgaaagacccggcagtggccaccctcctcaggctggatggatggatgctgcttccgccact

SEQ ID NO: 19468 - DNA, 201 bp, Bos taurus
gattatcctgtattatcagtgtgggcccattgtgatcaaaagggtctataaaatggatacaggagagaagcagaagttggagtgatgtgcttcaaagatggaggggccacaaaggaatataggtggccactaaaagctgataaatcagggaaatagattcgctctcagaacctacggaaggaaccagtcctgctcatacct

SEQ ID NO: 19469 - DNA, 201 bp, Bos taurus
cccttctccctacccttccggagccagatgcgtgttcctctcttttgaacactagttgctctttgattctctaactgtcttacggaatttatctttctctaacttgcactcagatcaatcccattccacaagtgtgtgtgtgctcagtcactcagttgtgtctgattctttgctaccccatggactgtagcctgccagtct

SEQ ID NO: 19470 - DNA, 201 bp, Bos taurus
ggctcgtacaggactgcctagcccccctcccctgcccaagctgctccctctttcaaacatcacacatggcaggcaccagaaacagagagcttctttctttccctggctgggaaaaatagtctcaaattttgtgatgtatatgaagcgcgaggtgggggggggtacttttaatttttatttttttaccctctttaaatattt

SEQ ID NO: 19471 - DNA, 201 bp, Bos taurus
tggagggagacttcttttgttcccaacctcagccccttgattcttagtcccatcttcctcctctctccaagtacctccccaggccctgttatgttgacttctgcaggctaagttgcttcaggcgtgtccaactctttgcaacctagtagggtagcctgccaggctcctctgcccagggaaatctccatgcaagaatactgg

SEQ ID NO: 19472 - DNA, 201 bp, Bos taurus
ggagtagggttttagatgaagaaatagaagatggcccaactcaacccctcatgtccttgagaaggtaacagagacctcagaaaggatgtgtgttgtccacgtgtttcaggtaatacgatgacagagtcatcacagagtcaggcactggcccagggccctgcctctctttccagtcacctcccacagggtcaccctctcacc

SEQ ID NO: 19473 - DNA, 201 bp, Bos taurus
aaggctcacggccttttgtgaagtttgcatcagcgcaagactctttttattttataaaactgcattagtgcacagaacagggcatgtcacccagggagacgtaagttgaggccacttccatacccacagaaaagtctcatgttgaggtgaaatgcatgtattttaaaacaactgtaatttacacagctattaatcttccaa

SEQ ID NO: 19474 - DNA, 201 bp, Bos taurus
gagggaagtgggtgcataacccatgcacaggaaaaccatgggcagaggcctagaggcaagagaaagctcatctctttggaagaatagaaagaagtctgtcataagacagagttactaggaacttaatgagagatagtgctggagaaataagcaggaaacagatcctaaaaaatggacttagggattccaagggaatcccta

SEQ ID NO: 19475 - DNA, 201 bp, Bos taurus
gtctctgtgacaaaaacaagatataatgaaaagaaatgtaatgacttttgttcataccaatatcaaattaataagacatggggtcgccttgccctggcctttgacctggagctaaatacttatcagcagattattctctcagaaagaatgtagataaagcagttagcagagggcccggcatgtgttttgttatcattgtag

SEQ ID NO: 19476 - DNA, 201 bp, Bos taurus
ctgagtaggttgaatttatagctatattctctgcttaaaaaatctaaaaataaggacgttggcatcaaagttggtgttctgagtcatattttaaactctgtaagcctgtggctttgcaaaatgctattcagaaaactctaaactgcatatccagtatatcttcgtcttgccaactcctccgccagcttctttcagtgattt

SEQ ID NO: 19477 - DNA, 201 bp, Bos taurus
aagatgaaagaacaaaaaagtactcagtagagtccctggccaccagtacacactacactctcagtcagcgtccaggttcttttgtctgtacagcgtggccaccggctctccgctctgagtgcagacctcgtgtttcccacgggtttccgcaggattggaaagctaggtgacctgaggcagagttggccgctttgtcatcag

SEQ ID NO: 19478 - DNA, 201 bp, Bos taurus
tggccctatcctgagtgcagcattgtggccatgagagcagggaggctgcaaagagcatcccaaagcactaggatgctgagcccagcgccttcacaacctctgcacccatcctggccatccagttatcagtgagctgtggagcccgccctacacttccgtaccaactcccacccagaatgcagcatgccagagggtctgtgg

SEQ ID NO: 19479 - DNA, 201 bp, Bos taurus
ttctgatgtcagatttggatggtggtagactagctgtagcactgacattaaaattctgcttctgtaagaaattgaatatattaggaaagaaggccaataaaccattattttttcctaataagagtagctgacccttcactaaatactgaactaaatgacagctttacaaaactatttcaagtattcattatcacagtgaaa

SEQ ID NO: 19480 - DNA, 201 bp, Bos taurus
ttaatttcatgactgcagtcaccatctgcagtgattttggaggccccccccaacccagaattaagtttctcactgtttccccatgtgtttgggtgctagagaaatctatttccttctgggcccagaaacagggaaattttaggagccgctggaggccatatcttctattaagaggactaggaagtggtcctccacagcatt

SEQ ID NO: 19481 - DNA, 201 bp, Bos taurus
tttctactctcttgttctttcatgtggtagaataagacattcaagctcagggcctggcttgggaccacgtgctgcactaataattttgtttggagcaatgatgcttagtgatgaataaagtaaggccagtcaatcctaaaggaaatcagtcctgaatattcattggaaggactgatgctgaagctgaaactccagtgcttt

SEQ ID NO: 19482 - DNA, 201 bp, Bos taurus
gactctgcctttaaaatatatccagagcctgaccacttcacaaccattgtctctgctccctcctgatgtgggcagcttcatcaccctttttcagagttgtggaaattttctcattggtttccttccttccacacttgccacccacagtctagttcgtaattctcattaacacaggaagcaagaataatccatttcaaacat

SEQ ID NO: 19483 - DNA, 201 bp, Bos taurus
agtggaataaagctgatagagagtatatgctagctgcctatcaagcacaattaaatctaaatttggaggaaaacgttcctattattgctcctttgcaggggctcaaggaatacaaaagcaaagccaactctctcgcccccatcatttgcgagatttcctcaaagattttctggtgttgtgatatcagactgtaggcagcaa

SEQ ID NO: 19484 - DNA, 201 bp, Bos taurus
catctatgttgttgaaaatgcaaaatttcatcctgtgtatatggtgaatcagttacttttcccagtgttggagaattggccttttgtagtattctagtagctctggtcatcacagctatgtgctataggggttctccctatgtgggctgtgtgggtgcttctgatgtagtgggctgactactgtgggcatgctgcttgaca

SEQ ID NO: 19485 - DNA, 201 bp, Bos taurus
catggggcaaccactttcaattctttctttttcctcatatgtattaataataaatatagaaggagagagagaactaggaaatgtctgtcatgcatgtgtgtgggctaagttgcttcagtcatgtcccagtctttgcaaccctatggactgtaacctgccagactttcctgcccatgggattcttcagacaagaatactgga

SEQ ID NO: 19486 - DNA, 201 bp, Bos taurus
ccatggactgcagcctaccaggctcttccgtccatgggattttccaggcaaaagtactggagtggggtgccattgccttctctgaggcttacagtttcctataacatagtttataaaaggtattatactctttttcgcctttgaaactgttatatagtgagttcaatccaccataatgaaccacaatgtattatatccacc

SEQ ID NO: 19487 - DNA, 201 bp, Bos taurus
cttatgattcttatcatcatttctattggtactgaaggcaattaatctggttctcctgtgaagccgtaaactccagaaaggctgtaatatgtctgcctcaacactctatttctgacatttgggacagagcccagtacgtcactcggttactgttgaatgagtgaatccagggagcctgtctgtaaacatgctaattgagat

SEQ ID NO: 19488 - DNA, 201 bp, Bos taurus
actacttttcctaaggaaatcctggttttattaaatgaacaacctggcagtataaaactctcctaatttttctcttaacgctcctgtaaaaggcattcaagtggcttgaatgaacaggtttcattttatgtcagtttttttgcttcattcaaatagaatctactttcagtgcactttgttatgaagctgtaatactattat

SEQ ID NO: 19489 - DNA, 201 bp, Bos taurus
agccttgtgattgtctatccacaaataatcctggttcgtttggtcattttttctgcttcaagttcattaacatcattgacacccctgtttatagttttcattaaatgcagcccacaggccagctggtaatgaggggaagctgttttctcctagaatgtttaattagctctttcagcctgggaaagtatgggcaaaaagaca

SEQ ID NO: 19490 - DNA, 201 bp, Bos taurus
tataaatagtgttctgttctcatagccaggatataattaatgtgaaagaaaacccattcattactcatgccaaatcaattatatcagttgtgtttcaacatgtggtagagttcattctgaataccatagtctcaggaggaatacatttgtgtagctattctgaaattggagtttcaggcataaatttgtatgttcagttta

SEQ ID NO: 19491 - DNA, 201 bp, Bos taurus
ctaacagtgcagaactggtgctactctgaaagatggaaagaaatgtgttctacttaatgagttctccatcccctctaagataaccaagagaatcagtgatgacattgaaatctagagtctatgaatgagttttatccttttaggcttctgaggcaaaattagctgaaaacacttttttttcatagaataaaatgatactag

SEQ ID NO: 19492 - DNA, 201 bp, Bos taurus
atttacatttttatatttgatcagtattgctcactgccaatccactatatgcttgtaaattcctccagggctggttttgttcaccactgggaacattatgtgtaagcttagcatatggtaagtaaatgaactcagtcagttgttgaaggaaatgagggagagatgaaggaaaataggtcatcagaggatcaagatttgagc

SEQ ID NO: 19493 - DNA, 201 bp, Bos taurus
agagagatgaaggaaacccaagaaggtgctgggaactctgagaggatttgagtactgaggcttgggctaagtatggtgttttcccctataggcatcagaattgcatttagctttaccgtgtctgcagagactggcagcaagagaatctttttcctgtcttgcagtttctatagcgggaaaaaaaaaatgtggccaaggaat

SEQ ID NO: 19494 - DNA, 201 bp, Bos taurus
gtagagaatttaaagactagtatttttcaagtttttccctttttccccctgaaataacagctgatagacaagaaactgtaatagatgcctgaagcttacacgctcacttattttaacaactttccaccttgctagactttagctgatctcttggctatccaggtgcattcatgtatgactacaagatgctcgttatttata

SEQ ID NO: 19495 - DNA, 201 bp, Bos taurus
accagaaatacattgaagaacacttcagaaaaccgcattagtcactcatgccaagccaatgtttcctctagcccaacaaacatttacaagcatagtgatgtcagggtgtttggatgtctgggtgagattccatcaatagagccaagcgaacaaagcagttcagttcatctgaatcccaactccagaaaacagaagagagaa

SEQ ID NO: 19496 - DNA, 201 bp, Bos taurus
ctgaaaactatacaaatgaaatctatcagttcttttagcagtttatatcagtttatattaactaatcttaaataataatatgagtgagatttatcagctcgtttatattcagatggcccatttgtaaatgtctttctacatgactgtgagtactaggtgagggttaacacagtgagtgatatttcaaagatcaatgaagat

SEQ ID NO: 19497 - DNA, 201 bp, Bos taurus
ctgtgaagacaatgggtagagctctgctgtagccactgccccagaatgcaagagtctttggcagccttacagccctggcctagaaataaactttctgtggcttacctggcccagacaactgttgccgtaaaggtgtctcacccacatcagcaccccgatgtcctctacagttctctgagcagcattcctgcaacctgagga

SEQ ID NO: 19498 - DNA, 201 bp, Bos taurus
gtcattagtcttcaaattgtagatggtgattactttcactaaatttctattgacgttaaaattatgccaaaaattaaaaaaaaaattatgccaataatgctaaactctaggcaagcatgctatgtgcttccatatttactggtcagtctagaactaattagaaggttattgggatacacttttgaatgaaactgccaatat

SEQ ID NO: 19499 - DNA, 201 bp, Bos taurus
atatatcaagactggcttgtcctgttagaacacaccaaaagtaagttatataatgtggagaaaaatatttagatagccaaaagcatctcactgaacaaaaatgaagaccgaggaagaaaatgtatgtagatttctcaatgccatttcagaataagtgatatttaaaaaataaagtagccaaaactctatacctaagggagt

SEQ ID NO: 19500 - DNA, 201 bp, Bos taurus
agattctgaactgtcctgacttgccaatcactattttgagttaagaattcccattgttctttcattgtggaccctgatctgtattcggccatgaaaacaggagggctcttaaccatcacttcacccagagctttgagctgggaaagttcttgacccttactgacctctctcagcttttctgttctcccttaaggccaagac

SEQ ID NO: 19501 - DNA, 201 bp, Bos taurus
tgttcatctaaatgatactggttatttgcccttttttaggttgttttgtgtatcgcaacatgtagccttggatacagaacacaattttctatacactctgtgaacgactagttccaagcccattttatctggtcatgcattttgattgtgccatcactgtgaataacaggactcacaggaggctaacaacacagggatttg

SEQ ID NO: 19502 - DNA, 201 bp, Bos taurus
ttaactatacttcaacttttttaaaaagctgtaaatcttaataataacgctgcattagtaaggagaattatatgtcccactctctaccccagggataagtagggagttgagaagaaagaggttaaagctgagaaaaaataataattaaagggatacataaatgccaccccaatgtttacctgattgaatgccacatactat

SEQ ID NO: 19503 - DNA, 201 bp, Bos taurus
gatattttgttacggcagcttagcagactaatacaatcggcaagccaaccaagatccttcttcgttcctgctctcatctatacacagataccatacagtgcccaaaaagctgaaggcccaggaaacagcacagaaaaagcaggtgcaaagtactaaaattcttaggcactgctgttaaggaaaatgccaaacatgtacttt

SEQ ID NO: 19504 - DNA, 201 bp, Bos taurus
ctatgtagagccttactactcaacctgagattcaaggaccagcagcacttgtatcctctgggagcttgtcagaaatatagaatctcaggcctcgttcctggtgtacagaatcagaacctgcatcctcataagatctccaggtgcttcctctgcacatgcgtggcatagtgctaagtgtgtcataagcagtataggccactg

SEQ ID NO: 19505 - DNA, 201 bp, Bos taurus
gagtcagacatgactgaggaacttacactctattgtatttaaaagctgctagagagtagattttaaaagttcttatcacaagaaaaagttcataaccatatttggtgacaaatgttaactagacttgtgatcatttttcaatatatacaaatatcaaataattatgttgtacacctaaaactaatataatgttttatgaca

SEQ ID NO: 19506 - DNA, 201 bp, Bos taurus
ttttgttcaggttatgtttatgactacatcagaattatattcaatctttttatttctgttttttaaaagtctctattgtttgaaaatgaactcattacaatggtatctattttaacaggagatggtcacaaatcatacttagagtcttgattttataaggcagtcatttaggaaaaaaacctactgattaatacaatattt

SEQ ID NO: 19507 - DNA, 201 bp, Bos taurus
atggcaactcaccccaatattcttgcctggaaaatcccatggactgagaagcctggcaggctacagtccatgaggtctcaaagagttggacacagctaagggactgagcacacacacatggaaaagcaaagataataatatacacaataaaaatgagaaagggaaaaacctttaaggaaagtgaatgaatcataaaacatt

SEQ ID NO: 19508 - DNA, 201 bp, Bos taurus
gaggatgtgatggggccaggcctactgcaaagtgactttaaagctgtgaagatcatcacaggagtgcactccaagtccaggagattgggtttggacaaagaaacccttctgtgggccctgacgaggctggggatggacagtgttcacagctgtagcttcagcatctttcccagggcctggaaaccagaaagagatgggaac

SEQ ID NO: 19509 - DNA, 201 bp, Bos taurus
ccagagcccctggggcttctgcctgaaggaaggaagcagtttttctgagaatctaagacttctaacccagcagggagtcatgggtgcaacatcttcaccaacatagatggggcctcatttctgccttctgctgacagcttacctattcctgggtaaatctagtggcttgttaggatgactccctctctgtcatcctcacta

SEQ ID NO: 19510 - DNA, 201 bp, Bos taurus
tatatataaacacgagcagagtagttactgggcctgcttgagatgtcaactagcacctgttccccctgagcggacacgaaggaaaaagaaagacaaaagcaaggccacttgtgccatgactctgtgagtcctgccttctccacttctgttttaccttggtgggcaggtgacaggcaggaatatgtgtctatcccagcaggt

SEQ ID NO: 19511 - DNA, 201 bp, Bos taurus
ctctacacagcaattttgggttcttacctaagactttgaccaaggtaatcccagaatcacctgagacctagcaaattctttaaatcctactatacacacacacacgcccacacaaagccccccccacacgtatacctgtgtgtgcccgttcatgtgtgggtagacaatgctttcattcctaaatttaaagcatttttctct

SEQ ID NO: 19512 - DNA, 201 bp, Bos taurus
ttagctgtgtattatgtggtgctgccaagattggagacttacatctgcaaaatgtgagcaacaatcctacattagacaggagttttaagttcaacttctgagataagaccaggaatattaatagtatgcttgtatagaatataactttgaacttccccatcaaaagtatagactaactttatttttcaccttggtggcata

SEQ ID NO: 19513 - DNA, 201 bp, Bos taurus
ccatctgggctccttcagccacactctcctttggatggtaatgtttagggatacttctttgccctaaccccatccttcaagttcaagagtaagaagcatgtcatgcaaaagtcataaatgaatcttagaaggaggttgaagaatctcattattctcagacgtttctcaggccatcaaagggtgtctcaaacaagtttgtta

SEQ ID NO: 19514 - DNA, 201 bp, Bos taurus
tatcctgacatgaggataactgggtttgtactaatctaccacagtcttggtcccttggccataacaatcttccatgtgggagtaaagagctggtctgggagggaccacaccagtgacttgagtccctagaatcatctgtttggtgcaggcctctgggccacgtctgacaaataatagctgtctggtatacaaagggctttt

SEQ ID NO: 19515 - DNA, 201 bp, Bos taurus
tgagatcctacatagtatgacaaaaatagtcacattcatttaccaagcctcactcaagttataaccatcctcaacttttcaaattatactatcctccacatttagtcaggatctcttctattaatatggtctactgcatttggtgactatttctaaaaaaaaaaatttattggggtatagttgatttacaatgttgtatta

SEQ ID NO: 19516 - DNA, 201 bp, Bos taurus
ggataagagttctataaaatgccattttcattaggtatggactattgatatttaaggaataggctttacttagcaattaggattttgtgatgataataattgaagtaaaatataatgtttggatgcaatgcagaataaaagaatataagaaatagtaaaaaacaaacaaacaaacaaaaaaacaccacttgtggttaccaa

SEQ ID NO: 19517 - DNA, 201 bp, Bos taurus
cctcctgattcagcaaatggcctttccatctgcccctttcccgcttgccgagaatctgggtaggtcaagggcacctctcctcactcactgcatgcaatcaatcttaccatttctggccctaaactatcgcactctcttctccttctctccccagtagaaccccaacagccccctaagttgacctgcatcctctgctcacag

SEQ ID NO: 19518 - DNA, 201 bp, Bos taurus
aggaaaggaagatctgggtttttaagtctctgccttcttcctccagagatgcctctaggcatcagctttctcactgaagatcaacctctctctgaggcccggtcaccccttcttccctgagcccagggttggggagggctttgctgctactaaggcgctggagactgcactgacccaggttctcctaggcctgctcccttg

SEQ ID NO: 19519 - DNA, 201 bp, Bos taurus
tctctttgccctggtttatcaaataacccttgcaagctgcatatcatggaatagggggcatgagtcatgggagatggaaagattaagtttggcagttaatgatctacctacctacataccttttcctggtgaaagcagcctcatttttccagtgttgggtcatttaaagttcaatcgctctgaatccaagactcctccttg

SEQ ID NO: 19520 - DNA, 201 bp, Bos taurus
atctttcccttccaacctcaatgttctaagagctctgagaagtccacagtggttccaggtagaagagatcggaaagaggcccaagcaggaggcacagatcaggataaagtttggtaattggggtgaacatcctgagaaccagtcaaatcaagctggtccctctgtaggcattcagatagactctggccagggggcagaaga

SEQ ID NO: 19521 - DNA, 201 bp, Bos taurus
ctgttttgtttacagcagatgctagaaaaatatagccaagaaagaaaaaagcagtcatcacttatctgcatagcctcccaccagtttctcaaggagatttgaaaaatactgcatcagccatacaaatagcaccgaaatgcaaaggggtcatcctttcttaaagatgcacaatccttgggtcatatttttttaatcttttca

SEQ ID NO: 19522 - DNA, 201 bp, Bos taurus
tgactcaggctgagagcctcgtccacagagaaacccaggaactcactagtgtacgggcccaggtgaagacagggagcaaccccagctcaacaagtttctagtcagcagactggaacacagggccccaggcagacgctggcaatgcctggccagcggctctggcgggagcagcgtacctaccccatggccttcgtgtacccg

SEQ ID NO: 19523 - DNA, 201 bp, Bos taurus
caccccagagccccatgcaggggggtctcagggagaagagtcccagggcctgcaggacagctgcctggcctcccatcccgactctgcctcttccagggccgttagttaagctctgtctcaatcccaccctgtctatcagggtgataaccacaccaacctcctcagcagggtgttctgagaaggggacaaacacctcaggcc

SEQ ID NO: 19524 - DNA, 201 bp, Bos taurus
ggatatgatcctgggtgttctgtgagaccctgggtgtcggggtgtgaccctgagtataaagtgagtttgaccctgggtgcgaagggaagaaatggcctcccgggctcccctggcagctgtgttgcctttttgccctgggggcaggcttgcccctgaggcactgggcggtggccatccacctgctggcagggaggaggaagc

SEQ ID NO: 19525 - DNA, 201 bp, Bos taurus
taccaccagctgctcctgtgggctttctctctggaatcaggctgacgcctcccttctctgaagctgggaacgactttttgcctcctggaaagatgggcctacctgatgacacctctttctccatggcacgttgtaaattcagccttctactccctcaggcagccagggacagctgtctctgctcctgaactgctctgctct

SEQ ID NO: 19526 - DNA, 201 bp, Bos taurus
tggggtggcttgaatcccagggcctgagttctggctgtagagtgagcctaagagtggagtcgcccttctgcccctaaagtgggctggtgcacttgtctttggggggttttctgattttggccccaccaccaccacccccttccctagctagtgttccctttctgtccagaaaggaacagaatgccaccttgcgtgttgttg

SEQ ID NO: 19527 - DNA, 201 bp, Bos taurus
gctgtctcttggctcatctccccctttctctgtccctgacacggccacactacctgataccctctcatcaccaggcccctggactgcccttacacaagggcgcagccagcctccagtcgaccgtgctgtgatcgaacacttgcaacaccatactgaccttcaggccctgttgtaccaggtcagggagtacccacgctgttg

SEQ ID NO: 19528 - DNA, 201 bp, Bos taurus
gcactctaggctcacttaggggctttgaaaatacagctttgcagtaacacaaaccactgttttaaatcacttctcagccagttactcttctggttaacttgagaaagcaagtgaaacaagctcagtctgagccttgtgggggagacacgtggtagaacttattttgggatgcaaaccttcgccacagcatgctggaaagac

SEQ ID NO: 19529 - DNA, 201 bp, Bos taurus
tctcattcaatttctctttctttttacatagggggaaaaaccctcaaatctttttttacttacactagtaagtaaaagtgatactctacttacaaagtccttagtggtttctgttcaactttccccagtccgtcatttttaatttatatgaaaggaaaaggaatgccatttgtaagatttcagttagcctcatctgatgaa

SEQ ID NO: 19530 - DNA, 201 bp, Bos taurus
ggcctggattctgtatttttatattatagcaagaagatttttgatttgcatatgctttaatagccatattagaacattttgtatatccaatctcttcctgctccttaatttggcacttgttctataaaacaattttgaaaatgcaaattactttacattaaaaatataaattcttatggcatattttatacagtcttaatg

SEQ ID NO: 19531 - DNA, 201 bp, Bos taurus
acttaagacgagggttaccttgaagatagtggcggagaccactctgcagaggtgatacatcatctgagatttgacaccaaatgaaccaaatgaaccaagacggagatgctttcctaggcagaagcagagcacagttgaaggctctgagatgggaactggaaatgtataatttcttcttatacattaagtagtaatttaaaa

SEQ ID NO: 19532 - DNA, 201 bp, Bos taurus
agaacaaataatcctaaaatttatatggagctgtaagagacccagaattgtcaaagcaatccttagaaagaagaacatagtggatggcagacttcagacactactacaaagctacagtaatcaaaacagcatggaattggcacaaaacacatatatatcaatgaaacagaatagagagtatagaaataaatccacacacct

SEQ ID NO: 19533 - DNA, 201 bp, Bos taurus
attttgcttctctcaaaatgcttgaattttgattggggttgcattgaatcttccatcaattttagggtatgctgaaatttttaccatgttggaagtgtatattcttcctttttaagtctttattagcctcaacaatgttttagatactgtgaaggacttttgaataccttttgttatgtttattcctgtgtatcagatgtt

SEQ ID NO: 19534 - DNA, 201 bp, Bos taurus
cttgagtcttaaagctgaggtattaactgtgctgagtgtaggaacccgtgttaagaacctgattttgtgattccacagcctggccttttctattgtgccaacccctattttgtgagtaaacatttccagccacagtgttaagtaggtgaaatttgattgtcggggcctgtgacaatggaaatgaaatgcaaaattaagagt

SEQ ID NO: 19535 - DNA, 201 bp, Bos taurus
aaaatccctttcaggataatggaagttaaaaaaaaaaaaaaaaaacatgtaaaatgcagtgtaaatatttgtgtcaaagccttgataagggcagtgacactctccactccccgctttttttagtaatagtttcctgctcctcttagcccagtagtttcagtggctaaacaggagagaaagtgacaattactttaacttaat

SEQ ID NO: 19536 - DNA, 201 bp, Bos taurus
accctgtagaatcaagtggttgatttcttcatgtgctgctgtattatttcagttgggcagcagtgggcccacatgcctcacactagaccacctcagatcaggtatgccttttcctttgggaactaagcaagaatcatgccggaagagcttgaaaacacaagctgtagctttatttgaagtgccactgtccagagagaagta

SEQ ID NO: 19537 - DNA, 201 bp, Bos taurus
aagccagtgtcagtggtgttgacatgcattgacaggacatggacaatcatttgctccaggatggaacaggtgaggtacaggtgaaatctggcatccgaatagagatctgctgtggtggaggactgctccccgaggggatccaccagattctaactgtggggtgcaggggttataggtgttcttttcagggtgtgcgggagt

SEQ ID NO: 19538 - DNA, 201 bp, Bos taurus
gtcccttagtgaaggctcttggtgacccactgcaatgtttcacatgggatttctgtttctaggagacacaagacactctcaccagtgactagagtgatcattggacaacctgactttgatctaaactgggtaaagcatatccgtggctcactcacttcctagaaggtcaagaccaatcagattcaaaacagacccaaaggc

SEQ ID NO: 19539 - DNA, 201 bp, Bos taurus
tgccaaagttaaacacctttataaaggaagagagcgtcagatcctgagctcctagaagcacttgcctttctttctccataaaactgctagagccacagatcctaagatttgaccaaattcactgctgaaggaatagaaattccttttgtccttgaaaaataattctccaactaccaaaaacattcaactgagtccttcaaa

SEQ ID NO: 19540 - DNA, 201 bp, Bos taurus
aataaagcagtgttagggatgaatcactaagatctcattaggtgggatgtcagatgacatcaacaagatggcagaataggaagccccagaccctcttcccccaacaacaatgtatagaccaattccccttgtaagaaatccagaaaatggttaagaggctcctgaatcccaggtccccaggtgagtgtgaaaccagccaca

SEQ ID NO: 19541 - DNA, 201 bp, Bos taurus
gatctggaagtccattctatatggctaagtgcaaaatattgctgaggcatgaatctgagttaccaaactgccaggtagtgtggctcagagccagttacttcgtgactagactcagcttgttgcccagtctctacttcttatagtagcccttcctgtcctttctatgttgttgtgtgtgagaaagcttggaggcatatcctt

SEQ ID NO: 19542 - DNA, 201 bp, Bos taurus
taatagactccctctgacttgaagcaactccgtgtgtctctgcttctcacactaaaggagccaagctagcatggcaacttattttataaaccgtgattctcccatttgacaacttctggtcatgcaagagctgcactcttttttgaaggaagggtgcacagaagattattgtttgatgggtattaggctgttggaatattt

SEQ ID NO: 19543 - DNA, 201 bp, Bos taurus
ttatttttggatctgtgtcagagctcatattatacaaatatgtctacgaaacatgacttggactcagatgataatagcaaagttttaagtccaaatactttaaaaactcaacttctcgagcttacatttggctttacaatggtagttagtctctgaatttaaatagaaaacagagccaaccattaactacaatggtgaaaa

SEQ ID NO: 19544 - DNA, 201 bp, Bos taurus
atctagggagagatttctctttttcagccctaccaaggcctaccaagacctaccaattatttctgcaataaaatatgcctttatcaagagatgatgctaacgggattgccctggcaggccagtggttaagacttcaccttccaatgcaagagatgcaagtctgatccctggttgccaagctaagatctcacatgcttcatg

SEQ ID NO: 19545 - DNA, 201 bp, Bos taurus
ttttatgcagtctctctagatgtatgacaaacacatcattgggtaattcttgctttgcatgccatttgtttcttcacagatttcagacaagagggtgttcactaaattatatttatgatcctgtaaaacacaagtgcagcctctgttgaaacctaggtgatatgcacaatgtggatgatggattcattgttgctatttaga

SEQ ID NO: 19546 - DNA, 201 bp, Bos taurus
ccttttgtgcagacttggttgtctggttttcattcttttgccatatgtatttatcgtttttgttactgtattacttttgccttcatcctcacatcacattgtaacattgtaagatttccatgctgctgggctgcaagaagcacagtcatgtcttctatattttaacaactggtaattaaagaaagttcagccacaaggtaa

SEQ ID NO: 19547 - DNA, 201 bp, Bos taurus
ataatgaccacatgctgttaaaactccttttagaaactagaaattggttatgtggcactttgcaattcttaagtctcttcattagtactgagtgtaatctaaccacacttgcagagctaaaactatgccttgagattggaggggtagcctgaagccaggagaattggtacttcctgattgtcagggttaaatatcgagctc

SEQ ID NO: 19548 - DNA, 201 bp, Bos taurus
gggtgccctgaaggcagctatccctgcaccttctccaggtgccctgcagagcaaagactctgttcctaaagcaggaagccccgtggaggattctatttcccggaccgtccaccctggagcaacatcagaggccaagacccttccacttcatctgggaagacagggctgtcctggccagatgtgcctcaggcctcgcacccc

SEQ ID NO: 19549 - DNA, 201 bp, Bos taurus
aaacttaaatcccctcaaaccctaaaactggcccttgggaaaacactagtaggaaatgaattaatgctttgcagttgtaactttaaactctcttttaatatttctcatacagtactggatatctatagtggagttaatagtctgtaatactatgttttatgggctctcctaggggttttttgtcttgcttttcatttacta

SEQ ID NO: 19550 - DNA, 201 bp, Bos taurus
tgcattccatggggtcacaaagagtccatcatggctgagagagtgaaccctagactgacatattaaaatagcactgcttgtattttcagtgtatcagatacacacaaaaatctagcaccaccttctgctggccagactctgttattattgtcacatatttggtataatctgctggtgacaatttggcaatatctatcacaa

SEQ ID NO: 19551 - DNA, 201 bp, Bos taurus
taaaaactttctgagcagaggaccagtaaatagatgcacagtgcaggtaggtaaaaaaaaagaaaaaaagatgtttacacaaaccgcaaaggggaggtgaagggacaaatcatgagagaatgaggctaaacagatgtattttttccccctcagtgataggcaatagcacagttcagtttcattgtaggttaatgtaatggt

SEQ ID NO: 19552 - DNA, 201 bp, Bos taurus
tcctactttgatattctgaattaacagttccagtaggattttccaagttctttcttggatgaaaatttgtacttgttataatgtttgctcatataggtagttagtgaactaggccaagattagtcaaaattatttgcaaagtggacaggcttaaagatgtgcctgaaagagatttatatgttaagtaaaagtaaacaatgc

SEQ ID NO: 19553 - DNA, 201 bp, Bos taurus
ttgccaaccacacagaactgtatagaaatcacacacctaaggcacattgtagacctacttaatcagaaaaatcctggggcaattaattatagcatgtacacgttgaaaagaggttcttcagatgttttggaatgattaagaaaaccctcgagctggtatttaataatattctcaggaaaggaaacaggattagaaggtgca

SEQ ID NO: 19554 - DNA, 201 bp, Bos taurus
cagagtgtgattttgtaggtgggccgctcagatttagtttttgctgaatgacttcataaatttttattaaacctgttttgacaaaaatcatgtcctttattctagatatactgaagcccagagaagatttactgataatgaattctgagtagaagaataagagtttgaggtatgtaagacagagaccaaaagggaaaaaag

SEQ ID NO: 19555 - DNA, 201 bp, Bos taurus
tttttttaaagaaaaatcaatatgcttggataattttcagctttacagatcattttgctttatataagttctaatgtgtctaataacagtgaaggagaaggaatataaccactattaattttaaaaattgagtacgtcatttttctaagaccttttgatataactatcattttgctaaatattccatagtatttaataatt

SEQ ID NO: 19556 - DNA, 201 bp, Bos taurus
ccaggtagttggctgcaaagtagctgtatcataaaacaatcaaaattatgactgaatatatgcagatattaagtccgaagcattcaggcacttacaggccggttatctggcaccattatattcttaaattactaagtttttagggtatattttaattatcacaggtaattaaaaattatgctatccagataagattaaaaa

SEQ ID NO: 19557 - DNA, 201 bp, Bos taurus
tttttcatctcttatacacaaaggccattttgaaaaattgaatagggtactgtcaaaacagtaaaaaataatttgagcatatgttattagagatagattgtttttgcccataacagatgtgaaaacaagcattgatatacaacatatcaaattttctctttcacattatggtactggccctcatttgggcccatagctggt

SEQ ID NO: 19558 - DNA, 201 bp, Bos taurus
acattggattgtaagaaagagatgagggcgaagaaagacatctctctcttccatcttctcttactagataagacatttctcctcctgtgggaagaaggaaacaaggaaaagaaaaaacaacaggatgtctcttcaggaatccttctcagttctacctacacaagagggaataagtgccctgtgagccctggcaacaaccgt

SEQ ID NO: 19559 - DNA, 201 bp, Bos taurus
aaagagatgcaaaaatgaggcttgaagaccataacttttaggggtggggaaggggaggaaccagaaaagaagactgaaaagcagcagggagaggcaaagatgaagaaagaaaatttggagtgtgtagcatcacaaagccaagaaagaagaggagtagtggttaaaatatgtgtaatgtgactgacaattagactaaggtga

SEQ ID NO: 19560 - DNA, 201 bp, Bos taurus
cactttgttggctctgaagaaatatccccatttatgtgaatattgtagaacctatgcaagaggaaaggaagatggaaaattattttaaatcaaggatttacctccctatctattgattctacatatacccacttctttgccagctccaacagatcagaaaaatctgagaccaccaagctacctattgagctatcacagtga

SEQ ID NO: 19561 - DNA, 201 bp, Bos taurus
atgcctatcatttcagaagatatagggacctcctgaagcccatccataaacatcagactgcagtcacctgaacaactctctcaattaccaacagattgctaagtaaatcactccattggccagatttcctaccgtatatcctatttcctttccaagtaccaatgagcatccttaaggtaaaatgaatttggtggactggga

SEQ ID NO: 19562 - DNA, 201 bp, Bos taurus
taaatcttagttcattttccttaaggtagctatgttggcaagtttcatgccatcctaaaacaaagctagtgccacaggacaaaggccctggaaaacttcccatccctcccccctcttcttaaggcagtttcagtttcagagtaaccctaggcggaggagtatggactatagtggttgacctcatagtctttgaagtccaga

SEQ ID NO: 19563 - DNA, 201 bp, Bos taurus
ctccctaaatgttaatactcttcactgtcttatcattaatcttcttgcttgttaagttgaagtatttcatccatgttcatggttttaaattgtcctctcatgctgtgttccccagtacctgtctgtggtccagacttcttaatgcctctcagattcatatttttgattgcctaaccaacttccatggaaatctcagtctgc

SEQ ID NO: 19564 - DNA, 201 bp, Bos taurus
aggtccagcataccatagtaagacccaacacagccaaataaacaatacagttgtgaattatgtgcacacactatgaagaaaatctgttcctccttccatggataaaaccattttgcaagtcagaaacattgagattcaggaaggaaagttttttcctaaaacatacagtagttggtggcaaagccacctacacacctccaa

SEQ ID NO: 19565 - DNA, 201 bp, Bos taurus
attcttttcagcttctgtttgacaagactggggacatctcactctaacccttgtgttgctcagcttgattttttataaaacagagacagtaacacgtgttgtacaggtctttgagagcactgtgtgctgagttggttcagttgtgtccagctgtttgctgcccagtggactgtagccccccaggctcctctgtccatggga

SEQ ID NO: 19566 - DNA, 201 bp, Bos taurus
ctttctcatcaatagttgctctgtaaataattgtaattttggtgtgctcataggaggaggtgagctcagggtcttctaactcggacatcttggccaccccccctcccttacctgtttattttgaagattaaaaagagagagagatgtcatggctaaagtgaggaagtctctggctggccagtgctgatttcaggggcccct

SEQ ID NO: 19567 - DNA, 201 bp, Bos taurus
catgtctccttgctctaaaaaacaacccaagatccttgtgcccttcatcttttcagattcctagattccttaagcgaggctgtctccactggagcatagcgaacacagatctgcatgccttacatcagcaatcatgccctggtggacttgacattggttgtggcagtttgataggtttagagtcactctactgtaatatcc

SEQ ID NO: 19568 - DNA, 201 bp, Bos taurus
cttgctttttttaatgtatgatctttagccaaaaagattttttctctttcaagtagtcttgggctattagttctctccaaaaggaagtttagtaataaacatatcagcatttttaactaccaagttgaagattttatttctgtttgggagtttagctaaaggtcagtgataaaactgatgaaaatgcaaaggacagctcag

SEQ ID NO: 19569 - DNA, 201 bp, Bos taurus
aattttaaaaattaacattgttatcaatcaggatgataattatatgttaccattatcatacaaccttcaaatagagaatttggataccttttaatcatctatattatatcactattaaatagattaaaatggtatcattatttattatttcaaggaagaacatataaaattttatgcattgtatccaagtggcacagtggt

SEQ ID NO: 19570 - DNA, 201 bp, Bos taurus
gtggttctctgttcagtctccccccctccaatcttgtttcaattttgttttctctttgtgcctcagtgacctttattctccttggcttatgttctctctcaaagcagaatcaaagttttccttaacaagaaacagtcttctccccaggagaaagtctggtgccagttgtttctgaaagacaacttcttttgccctttcgca

SEQ ID NO: 19571 - DNA, 201 bp, Bos taurus
cactgaacttattttatactttattaaaattatgtggccccagagaggtgtccctaatgagattttataatttcctcttgaaatgctaaaactagcacataaattcatggcccaggagtcttgagagtatggagaaggaaatctgcaggtagaaacaacactggggagtctgaaatctttttataatttcttagcatcatt

SEQ ID NO: 19572 - DNA, 201 bp, Bos taurus
ctgaaatatacaaagtaactgatactctatcacatctcaacccaggtcacattgtccctggtttatggtgagagagtccaaggccatgaaacagactttgcactttgggaaattcatctctatagggtctatagggtctctttctggatggcactcaaaaaaaaaaaaaaaaataaagtctatagtttgctaaataaatta

SEQ ID NO: 19573 - DNA, 201 bp, Bos taurus
atgtggcaaggaacaatataattaactttcaagataaagaaaaatcacttttgattttagcttagctttcagtgcttatgcaccaatttcattctattctgtagagtgggttctttataccagagatcatggataaataagtgcaatcgttggaaatgttacttcagttatttcttcatcaggttccagcaagcaagctaa

SEQ ID NO: 19574 - DNA, 201 bp, Bos taurus
taatgtttgtctctctctagatgagtccataagatccatgatgtcagggatcatgcatatttatttctcctctcatctcaccatgtatcaaattccctggcagttatcaagtacttaataatatttgtctgaatgagtaagtggaataggtttaatggaatttgatgaatgtgggaatatgaggatgtgattttgaggatg

SEQ ID NO: 19575 - DNA, 201 bp, Bos taurus
agttattggggtggagagaccctcatagcagaaaacagttatatggtgagatagacaattgcaacttctctgtgcctgacctcatcttccttcatcagaccacagatggaggaatttttaatagcatgataagcagaggagtcaagtaccaaacactacacctgacttcttctttcagatttctctggctggtctgagtta

SEQ ID NO: 19576 - DNA, 201 bp, Bos taurus
gaaatgagtcttacgcacatgagaatcactacttttaggtattctttgtgctataaatctttgggcagaagaacaaaataattcatgaaaaagttttgtacataaaatcacagactactataactttctccagtttttgtcctctgtagctcaaggttgggaattcctggtggcttagcactaaagagtcctcctgcaata

SEQ ID NO: 19577 - DNA, 201 bp, Bos taurus
acgggtacaaaattcctgacacaagctgttttaaaagtagcttaccttttgaagaggggttatagaaaatttgtgaatttttcaaggtatcagtcaaaatttgagtaattcagtcatttgaattttctaggacttagtctccactctcattaatgaactttgtgaattctttaataagccaatttggcaactttgcttgag

SEQ ID NO: 19578 - DNA, 201 bp, Bos taurus
agttaaacatcagtaaactgtatatagaagtaatcttcctcatccttttctctgttaaatactagcatattcaacagtgaaaggctaaacactttctaaggtcagaaacaaggcaacaatatctattcttacttattctgattaatatcatagccaatgaaataaggcaagaaagtgagataaaatacaaaattattggaa

SEQ ID NO: 19579 - DNA, 201 bp, Bos taurus
gtaaactccgcgagttggtgatagatagggaggcctggtgtgctgcgtccatggggtcacaaacagtcggacaggactgagcgactaaactgaactgaacagaagagaccaggaaggcctccacggaaatattatgggttaaatcggaaacaggctctgtgggcaaagaatccacatgtaatgcaggaaacacaggtgatg

SEQ ID NO: 19580 - DNA, 201 bp, Bos taurus
gactgaaaagtttatatggtggccttaatggtgttcagacatgtattcagtccagatggtctcagtaacacattactctctcaaggctgcctccttagaacagttgctagtgtgggaacagtgggcagatgtccattccaaagacgggagggagtgaggagccttcagttgtctgagtcaagctacaggtcacctggcatt

SEQ ID NO: 19581 - DNA, 201 bp, Bos taurus
caagcaagatttaatgggcaactttcactttcaatgacaaagcaagatttaaagaaagtgcaaaagaatgatgcagtcttctgtcgctattgaccatatttagcgaatctaatgtagcaccttagattagacgataagccattcttttatgccgttatgggggaaaaaatactaccaagtcaactggaacttggttccttc

SEQ ID NO: 19582 - DNA, 201 bp, Bos taurus
gtgcttgatgtatggtaaatactacaagtttagctttatagtaattattattgtaaataggaattcatgtgctactattgatcatttagggatttttctatattgtttagttatatcacaatagcatctctaaggatatgggatttgagaatggttgtttcgttagttgcttttacttccacaggtttacttccttagaac

SEQ ID NO: 19583 - DNA, 201 bp, Bos taurus
cccctcggccccagccataggtctgtgtgggtctaattctagtcctcaggcccaagggaaggaaccctcttcccttccaggcccctgggtttcaggccacgtgacaataacctcacagttaccttcttctctcttgctgaagttctccatgggtcataggctaggaagcccaggtcataactatgacctccagagaagtac

SEQ ID NO: 19584 - DNA, 201 bp, Bos taurus
atcagtagtgtgaagttgccacaagaaagtgatatgcgtgtgcgtgcgcccacacacacacacacagaggggctacatttccctaccttccttccatctaggatccagccagagccatgtgtctactctttgtagaatgaatgaacagaaatgatacagatcacttctggcccaaggaaatcaagaagaaaatgcttcctc

SEQ ID NO: 19585 - DNA, 201 bp, Bos taurus
gttgcatataatattgttaaaactttcacagcttaagtctagtgagacacttataataatttcatcatgaggcaacttttaatactctttaaaattattacagggatacatctaaatgacagggttgcactggggatcagaggatggacagtacatgatctaagcgcaaagtgaggttttttgggaaacagtggtggtact

SEQ ID NO: 19586 - DNA, 201 bp, Bos taurus
acaaataagtgacaagggctgataaatagtgggaaaaatgaagttaatgaattgtcagtgaacaagggatccaggctgataggaagatggtgatcagagtggaatgacggataaggtgttagctcaggtcctccttcaggtcctcctagaagctgggaaagattgagggcaggaggagaagggtgacagaggatgagacgg

SEQ ID NO: 19587 - DNA, 201 bp, Bos taurus
ttcaaggacatggttcacagaattttcagactctctttgatgtccgccaatgggtgttttagtcaaaacccaggggaaagaatttcagtccaagaccctgtgtctcatcaagtgtgctttctccaggaactagctgactattcagaacaccacaccaaaggaagcaggaacacatgctaataaacttaattaactcattta

SEQ ID NO: 19588 - DNA, 201 bp, Bos taurus
gaacgctgtgcagagtctctggaaagccttggcggaaagttagcacaaaacacgagggttgtgaagcaaggccagatcttccgtggccaaggactattcttcatttgaaaaacagctcctggtaccactgagacctcatagaacttgactgatcttgggccatcaactgactgtacaagtgactatgagaactgcccacta

SEQ ID NO: 19589 - DNA, 201 bp, Bos taurus
cgccaagacaacccagggccgaggacctaagggttgggctcatcagctgggcaggatcctacctcacttatgaaccatttaagaatacggtgacagctacggcaaaaggcttgggccggagacaggtaacagagcaaacctgcactggaaccctttttcctggtagccacgctgtatgagtgtgtgtgtgtgtgtgtgtgt

SEQ ID NO: 19590 - DNA, 201 bp, Bos taurus
gttcattctacttatctcaaagaaaaaacttgtattgtttttggtcatctttctccttttttgggctttgtagatttcactgaagtttggcttctttcctgtgacttctaccttgttatttctcaaggatttgaaagtttacagttgcccttcactctgttgggagtcaccatgcctgacttctgggtctgagtcagctgc

SEQ ID NO: 19591 - DNA, 201 bp, Bos taurus
aaagcccttgatgtgctgtgcttagttgctcagtcgcgtccgactctttgagacccatgaactgtagtccgcctggcttctctgtccacgggccttctccgggcaagaatccaggagtgggtcgccttgcccacctccaggggatcttcccagcccagggactaacccaggcctcccacattgcaggcagattccttatcg

SEQ ID NO: 19592 - DNA, 201 bp, Bos taurus
aaatagttatcatgggggcagtagtgggttgaagaacctcttagcccagctttgctttgtttgatggatcagcttaagttcccctgctggtttcggcctccggtccaaatgaagtggcttactgactagccctttccttggataatgagtctggcttaccaccgtgccccgtcagagccaccaggtgtggtagaagtctgg

SEQ ID NO: 19593 - DNA, 201 bp, Bos taurus
gtttcaaaatgatcagtttggaaggctatattgtggttatttggttttaaggttcatttttcaaagtaatacattcctataagaaaagttcaaatagaagtatttataataaaaaatcagtggccttttgccacactcttcacctgcacctagtcccactgttcagagacaagttactttaactgtttctgtttatagttt

SEQ ID NO: 19594 - DNA, 201 bp, Bos taurus
ttttcatgtcatcacgtttcccacaatgattttttacaaacatcaaaggaagttcctcttgttagccagaatttaagtttacattaaaggaaggggacccaaaaaaaaaaaccccacgttaaatgaaaagttaatctacagcaccactgtctacacctccttcttctcaaccacatcaagtacaggaagaggaacagacaa

SEQ ID NO: 19595 - DNA, 201 bp, Bos taurus
tctgatctgatctctccttcacacttcctcctgacctaggcaaaagctgtgcccttgttcctctcatctttctcagcaatacagaaaaagttctctttgtcggccacttatctgcagccccaaacaagtcatcttgccccttatccacacagagcataatacgataatatgaacagaatcctagcagctatgctgcccctc

SEQ ID NO: 19596 - DNA, 201 bp, Bos taurus
ctagtgactatcatgtcgacttccaagaatttaataaaatactgttgtctcctatgccagagaaacccaagaagggacaccctcgggagactgagtcttaatgcggtgaattcagaggcatgtggtaagtgatgagaacattattagtgcacttgtggccttgcaagatgcttgcttgctgtagggatcttggcttgttac

SEQ ID NO: 19597 - DNA, 201 bp, Bos taurus
actactaaaaagaccctccaaatatcatgccgttactatgacaacttcaaaaatgctttgagaaaatgtcagggattttaagattcatgataaaacaagcatcatctagtctgccagaaattactttcatttatatcaggcagcaaaaaggctaaatggctatttacaactgtgaactatcaaatcattaccttttgagag

SEQ ID NO: 19598 - DNA, 201 bp, Bos taurus
ccaggagccatctctatatggcactcatcttgagttttgttgaaggaggattttactgcttggcacaacacctcgaccagtttgtgatttgaagcaactgtgttctgttgtggggaaacaacaggtaattccttggggatcacaacagtggcctaggcttgtggggccgcccttgcaagctaaggtcaggacaatgctgtt

SEQ ID NO: 19599 - DNA, 201 bp, Bos taurus
taaattttatgttatgtgtattttactgcaattaaagaatgttaaaaaagaattcagatcttctggtgaaacagtaatgggccagaatttaggagccttgctttcaaataccggttttactttcaatgaactccaggtctcaggattctaatttagaagacaattgggtgagatgatggcccatattccctctgaaattct

SEQ ID NO: 19600 - DNA, 201 bp, Bos taurus
tatttatttatttatttgtagttgcactgtgtcttcattgctgtgggagccttcttccagtggcaacaagtaggggttactcttggttgcaacatgctggcttctcattgaagtggcttctgtggttgtggagcactggccctaggagcgtgggcttcagtagttgtggtacatgggcttagttgtcctgaggcatatggg

SEQ ID NO: 19601 - DNA, 201 bp, Bos taurus
aggctttcagaagctgttgtagaattaatgcaatcaatcatgtttttctttgaggtcaggcactattatttctaatacagccatcttcccggggctctccttggctgtgtggatagcgggtgctggcaaggcaaactgcagagtggggacccatgctcacctcctgtctctgcaaggaatatacaggcagtgttaacaggg

SEQ ID NO: 19602 - DNA, 201 bp, Bos taurus
tggtctgggcaggggcaggcatgactgaacatatgaccgcacatgtcccatgtactaggctgtagcacataacatcatcccactccatcatcacgcactccgatatctttatatgatccagaggaatgttggaattggtttcaagtcaggattaggtttattatagggcttcccaggtggtgctagtggtaaagaacgtgc

SEQ ID NO: 19603 - DNA, 201 bp, Bos taurus
tctctgatgactgacaggtcctaactcaattaggcaaacgcagcttatgactcactcctaatgttccccaggtagggccactcagagtcctgtcactgtcgtttggcattccaaaaggccttaagctctcaggaacaaaagcaatagctcccacagagaggaagagaacttttattagtcaagggtaagagtgggatgcaa

SEQ ID NO: 19604 - DNA, 201 bp, Bos taurus
aaagttaaaaaaaatgcagttagtaatatttaagaactttatgaaaaaacaaaacagaaacagacctgatatggagtcaaacttgttcttccctattatagtatcagcccatgatgaaaatttggtagaagctccaagaccaagggttcagtcactgcacctcacagtccccctgttggcagttatcccagctttgttcgt

SEQ ID NO: 19605 - DNA, 201 bp, Bos taurus
gatgcggagaacagagcttgccctgctgagttggccgaggggctcagagacggtgaccctgtcactcctgaggacaaggatggcccgagccctgatggcagctgcagagatcttgtttcatttcttttgtttcctttggtcctgttgcatcacctctgtgatgcaatatgggtcagaacttcctcctcagaggacttaccc

SEQ ID NO: 19606 - DNA, 201 bp, Bos taurus
ttccatgcactttagaaacttcactaattagagtctgagggttttttttttttctttagtttttttttttaattagaatagaaatccttacattcattgacagccttgcaataatactcaagctatattagttatgctattttatctcacgcctcagttttttcatctgagcaacttcaacatatgcaccaaacactcatt

SEQ ID NO: 19607 - DNA, 201 bp, Bos taurus
tctcagtaatcactgagcgagagtacattttaggctaatctcatggacaaagattttgattgccttttcttctttgagagaaaaatccctctataccatcgtatccctgaagttataagtgatgctataaaaagaaaaagcaaaattggtatgttggtataagtgaaattctgagtgcaatctacttcgtaagtgggaatg

SEQ ID NO: 19608 - DNA, 201 bp, Bos taurus
agaggccaaaacaaacagggccttcgccaagacagtagtcctcaggtctacttccccacctcccataacacacatgatgaatgaggttcacacattgaacccttgcgagggccacaaaaaagaataatgtcatttgcagcaacatggatggaccaagaggtcaccatactaagcgaagttaagtcagaaagagacagacag

SEQ ID NO: 19609 - DNA, 201 bp, Bos taurus
atccctgctttgagaggctgcccataccatacccctcatttccattccgtctactctaggagatataaggtctttgaagacagagacgtctctgaactgcgtaacaccatggtaaagtcacttcatattaggagttggaaggccttacagtgggctgtccaatagaactttctgtgatgattgaatgttccctgtgctgtc

SEQ ID NO: 19610 - DNA, 201 bp, Bos taurus
gactgttttacaaaagcctgggcacgtggatcagtgtctttttctttaactagttctctaccttagaaggattctttgtaattgatcatataaagtcttcatcatgaaagctactggggatcctgggccccgctgtccagtcataaacattgtggaaatcacgaagcaatctgggccctttacaacctacgtctaaacatg

SEQ ID NO: 19611 - DNA, 201 bp, Bos taurus
gagggtgtatagccaagaggttgaggtttgttctttggggttcaccacctggctttgaatcccaacctgaccctcccttcactaactctattttttcagtgaaatggaaataaaaattatacttttgtttaaggcatgtcattaaatttaaatgagatgataacacatgtaaaatgcacataataatcttggccattatta

SEQ ID NO: 19612 - DNA, 201 bp, Bos taurus
tttagaaacaaacccaaacctccatttcctcatctatttgtaaagtgggaatagtaatacttacttcacagacaggaagattaaatgagattattactaaagtgcccagaataaagtgtccaatactactggaatattggaagttctaaatgtattcagtgtttcctcaaatgtaaaaagaaaaggagttaatgaattaga

SEQ ID NO: 19613 - DNA, 201 bp, Bos taurus
gtatatatatatttttaatatatttataccacacttattttcaaaaaggatctcaggtaatgattaaaagtatatataaatgtacatgcttccttggtggctcagacagtaaagaatctgcctataatgcaagagaccagggttcaatccctggattgggaagatcctctggaggagggcatggcaacccactccagtatt

SEQ ID NO: 19614 - DNA, 201 bp, Bos taurus
agccactgagaatcaggagagctagttacaggccacaagcttcattaggtcccaggagcaaaacgcaactaggaagatctgaggttggggaaggtactcttaacaatatttccaatggccaaagagggttcaaggagagctcattggggtattaaaagagtaactgttatgttctggttttggttttaatagactttattt

SEQ ID NO: 19615 - DNA, 201 bp, Bos taurus
atgcaatatgattgcttatataatatttttgatatatacgtatgcagaaaatagctacagttattggctttatatagtagagatgatgaattttatgggttatctctgactctttatacttttaatgtttttcaaattccttaccatgaacacatattaattttattttataaatatgatgatatctttaaatatagcaca

SEQ ID NO: 19616 - DNA, 201 bp, Bos taurus
tcttttaatttggctgcattgggtcttagttgccaaatgtgagactcagttccctggccaaggattgaacccaggccccctgcgttgggagcactgagccatacccactgaactgctaggaagttcctacaagtcagttttggtaactttccttcatactgcgtgccaatcaggaaccagttctgactctaccaacagctc

SEQ ID NO: 19617 - DNA, 201 bp, Bos taurus
ttgtgtcttatataaatttcaggtctccgtgatatcagggagtgtatgccccgatgggatggtgtgttgtggagctgcgctctgccacccgcacagcattgtcagtcttcttggtttaatttgctgctgtttatgctggtttaaaatgacctcctcctaggtctctctggctccagtaaattacgcacaggttgccgaggc

SEQ ID NO: 19618 - DNA, 201 bp, Bos taurus
tattgtaaataatgctgtaacaaaattaagaatttgaaaatacttaactgaaattctaaaatgatggtcataagaggttataagtggaagttagttttatccctgctatcattactattgtttttcacaactattatagtaataaggaaaaggtgaacagagtagtttgaaactgagctttaagtgaggaaatgaagaaat

SEQ ID NO: 19619 - DNA, 201 bp, Bos taurus
ccaatattctggcctagagaattccatggactgtatagtccacggggtcacaaagagttggacacgactgagtgactttcacttcatttatataaggcagcgtctctgatggattgcaaaaatggccagaaattgctgcaccacttatatttaaagctttcaacatcacttcataccagctcccattaagaagaatctttg

SEQ ID NO: 19620 - DNA, 201 bp, Bos taurus
gaaggaggcttacagtaaggctgatggagcctaagtttcaggacctttcacttgatggggtctctcccacgtctctggggagagccccagcaatgtgttacggccatttgtgtttgcaaggttggtaaaagtaagatatttaagtgcagttgggatgactgtctcttcatcctgctttgtcctcttttggtgtcaggcagt

SEQ ID NO: 19621 - DNA, 201 bp, Bos taurus
tgcattatgccattgaatatctataatgaaccagtaaggaagagatttgctgacttctaaggaaaggcacacaagattcctctctgctcctttctcaatcctctcttcagtcattccctaaaaccgagttgctgttaagttatgccatctccacaaagaaaggtccaaatctgaacccaatttcaggtttcctgctggacc

SEQ ID NO: 19622 - DNA, 201 bp, Bos taurus
aaaagcataactgcaaattttaaaaaaatgctttgtagaggatggtttccatttgtaattattactgaaaagcatgtggtcttgtgggccctctcatagctgttcacaagggggtggacctgtgaagaggtctggacagtgtacctggttttaaaccaggccctgtggggatatgagcggacactgccatcagctgggaac

SEQ ID NO: 19623 - DNA, 201 bp, Bos taurus
atcttaaataacgacagagaagacggttcacacaaagtccgtattgggactaagtctgtcagtcaaggtgaacctgatcattcaaatggaaacagagggcgttgaaggcagagaagcaggatgtctatgacaactggtcagctctccaaatcggctttactctctgaggtatctattccatgcagcatcaggctcccaaag

SEQ ID NO: 19624 - DNA, 201 bp, Bos taurus
caatctagtgctgtctaatccttgaaaactgccctgtccagtgtaaaagccattgcctcacatggtggtggcgcatttgaaaggtggcaggtcccaatgaggtgtatcctaagtataaaatacacaggccacgtattgaggacttagtagaaaaaaatgtaaaatatttcattaataattttttaggtggattacatgtct

SEQ ID NO: 19625 - DNA, 201 bp, Bos taurus
ttatcctaataagtcatttggttctgaacctttggctatacaacccaaatgggtggacttattcagcttcttcacggaatggccccccctcagacagcccgcaaagcatctcaggagtgaagctgcagaggctccactgctcacagcatcttgcctggcctcctccacacagcatcctaataaccacctatgtgaccgaat

SEQ ID NO: 19626 - DNA, 201 bp, Bos taurus
gcccaggggtggtaggcagaggttgctctggcaacgtaagggaggccctgctctgcccagtcctgggacctagggcagccagtcctgaaggactgagatcggaaggacgaggatttggccaagaggaaaaagtgaggaaagaattacctggctggtagaatttagggtggctttttcttacttccttttatacttttctga

SEQ ID NO: 19627 - DNA, 201 bp, Bos taurus
aaattgatgttataagtgcgaacagaaacgctgagagggaaaagcttagcattaataaaatgcttcactgaagcaaaatgcttctgttttctctactctgatcttcttaataagagggcagaattaaaaactgagagttgaaagtggtctctgaattccctttatacagcttacggtcttacacacaaaagaaaaaactga

SEQ ID NO: 19628 - DNA, 201 bp, Bos taurus
cagtaattattaatcacctccctttggaggtggtgtgggagggagtgtgtttattctgtggcgctatggagaactggggacacagcctcatattttgcatgtttgattcccttttattcccacacctttctctctggtcccttcctgttcccaaaagacaaccattccattgtgcttaatgtgtgttttgggaggggggtg

SEQ ID NO: 19629 - DNA, 201 bp, Bos taurus
acagcctagcccggcagaagggcgtggaccctgtccctcaggagcaggcccgcgcatgctcagtgcctcctttccgcgccagggcctgatatgggagggcttgtagagctggagtgggtatgcagtcatgtcacctggggaactctgcaagctattgctgtctgggccccacatggagacgaaattggtttggtttggaat

SEQ ID NO: 19630 - DNA, 201 bp, Bos taurus
cgttggtggggttcgtatggcctcagtagagtcttacctgaagacagggacttttcacttcccaaccccttccccagtgagggtcactagttgtccacttgggcctgcccaacctcagggagaatcatgcttgttgctggtcccgtgagtgaacagactcgcagtcttcttagagctgaactttggctggaccagcataga

SEQ ID NO: 19631 - DNA, 201 bp, Bos taurus
tgcccgtggtcacatggttgaactccagagagaggaagaaatagcaacactgcagaggctgccaaacctaattcaggcaccacttggccttgatgccttttgtactgaaggatattaacataaagagactggctgactagcaagtgaggctgagcctgggcctcagcttggcaaatccagaaatttgatgtaacggctcac

SEQ ID NO: 19632 - DNA, 201 bp, Bos taurus
aagagctatgcctgggatcagggtgggaggtgcagggagcagagggaagaagccatctcagtctggagaaggcttcatggaggaggtggcctgggggatcaaaggtaaaggacacatcatccaggcagaaggagggagcgagtttacgcccaaggagcagcaggtgaaaaggcccagagttaggagagcaggtggccggag

SEQ ID NO: 19633 - DNA, 201 bp, Bos taurus
acatctgtggttacagagagaatgtcacagaggagctttgcagacggtggatgcagctgggagcattttatccactgtcgaggaatcacaacgggcctggattcagggtaaggttccaagagaaatgatggagacttcttgaattttatgatctacttatactcaaagagagattgaagaaaatcctacagggtggcccta

SEQ ID NO: 19634 - DNA, 201 bp, Bos taurus
gcattggctgcgtctgagttcctattgctgggggccatggcctatgaccgctatgtggcggtgtgctacccgctgcactacacggtcatcatgcatggagcgctgtgtctgggactggccgtgggctgcttgggggctggtctcacgaattcactgctggagacagtcatcacctttcggcttcccctgtgtcacagtgtt

SEQ ID NO: 19635 - DNA, 201 bp, Bos taurus
taaactttgcaatcagagttacataaaattctgtagaaatggaaataatgcatgacaccctgtgttcactgatcctatttatgggagcctttctgctttactgtggattaaaagacttgacatgatgaatctgaaaatgattgttagctgactcagaacacagcgcacaccacaacttccctctttctgttaatggctaat

SEQ ID NO: 19636 - DNA, 201 bp, Bos taurus
tttcattgtctgaagagtgagtaattagccactttatactgagttgtgtcccctcaaagttaatatatagaaaccagggccccagagtacatataaatgtaacttttcagagataagatttatggaggtaattatattaatgtgaggtatttatagtggccctaattcgaagtgaccaatgtccttataaggagatagaat

SEQ ID NO: 19637 - DNA, 201 bp, Bos taurus
caagagagttatgagaattgtttgttttgaactgatgggtaaaatacaaactttggtaggtctcaaacattatatttagtatcaataaggttatactgtacagcgaaaggaattgtattcaatccccagggataaaccataatgaaaaataacatttaaataaaggatttatgtgtgtgtaactgagtcacttttctgtac

SEQ ID NO: 19638 - DNA, 201 bp, Bos taurus
aaagcagcagtatcttgtggtaactgatggcaagagaggaaaaacagcatggaattgaacagttactgtcttctaccccttatgtagaataattttttccccttacactgtttttagcctggtcattttatgggtgtcatgagacaaatgtgaaagcaaaagagaggtatattttaaaagacccagttacatcacaattgt

SEQ ID NO: 19639 - DNA, 201 bp, Bos taurus
tcaccattttagcttctgtgggctctaatgtctgtgtcgcaactatttaactctgtcatgatacaagaaagtggctgcagaaaatagggaagcagtagtacggcactgctacgttccagtaagtgtcacttacacgcggcgggcctgcagcctgcagtctgccaactcccgctctgggccgaaagtaagactcaacagatt

SEQ ID NO: 19640 - DNA, 201 bp, Bos taurus
acacctgctgatccatgaacccattcacacacctagcttaaggtcctactgaaagaaaatgaacaacaggctgagaagattcctaagaggccttttaaacgtcagcgtcacctgtactggtcttagcatactggagggaactctgtgccttctgcgccattagggcccaatcaggagacaccgtgcagggattcaaacaga

SEQ ID NO: 19641 - DNA, 201 bp, Bos taurus
cccccgcaccctgctcagtatctgatggggctcctcctcctccaccatccccctggtgataaagggtcactctggccagccttcggcaagaatcctgtcaagtcggtttagccagaatccccccgttgccttctgatatttcttcttcgtaattttccatccacagacccctaacctgctcctcggccataaattcccact

SEQ ID NO: 19642 - DNA, 201 bp, Bos taurus
tatatggccctagagaattctcagatatgatatattctagtttacagttttatcactgtattagcaaggaacaaatatgtactaattcttacatagtcttaaaattaacatactggctcagggcctgtgattaataagactggatctgaaaacccatgccatggataattaatattgaaaagtacgatccactgaattaat

SEQ ID NO: 19643 - DNA, 201 bp, Bos taurus
aaattaatcagttgattttatgaatggatttgatataaatctccttttatttagaaaggtctgtttatttgagacattgacacaaattctggagactatactttttcagtagactttggtatatgatttcaaatttaatccatctgtacccacaaaacaaaatcatctctaagcattcttcttgagagtagacccagagtt

SEQ ID NO: 19644 - DNA, 201 bp, Bos taurus
tgttccgaggaagatggatcgttttagaaagaagccctgtagtccactgtactctcgaatagcaacagtcgtgagagtaggtcttcagaactggattccttgttgtaacccagagtgcacattgtttaaaaaatttattttgaaatgtagattacagattcacagaggagttgcacagataatatgaagatctcttatgta

SEQ ID NO: 19645 - DNA, 201 bp, Bos taurus
ttttttttcctacagcctaccacacagatgaggatcctaagacagcacctagctttcaacgtgagtaaactcaacgactgggccagtatctgtgctgtgaaataaataatattacctgcttcactcaacattttctttccaattcttagccatcagctagctaactctgatgtgtgagttttggtaggacttcagctggcc

SEQ ID NO: 19646 - DNA, 201 bp, Bos taurus
gaattcgcctacaaaggaataatttattctcaatatacccccaaaagctgggatgctgctggggactccaacctgcaaaataactgtttcttaatagctgaaatgccatactcacaatacgtaccttatgagctacatgttaaatgatgagaagttatttatcttccatacactagataggaaatgggtgaatcatttctc

SEQ ID NO: 19647 - DNA, 201 bp, Bos taurus
actatatttttctctttaagcagaaaatgttgatgcatagttatcacttaatcatgaatcagtaaatatcatatacattaagtgttgccattacacactactctttctcttgttgaatgctacaaattaccattctttcagtctacttagctatttttccattatcgtgttgactgctaggttagatgaacccatacaccc

SEQ ID NO: 19648 - DNA, 201 bp, Bos taurus
ctgtaccttggtcttggggatttgttagcaggtatgaatatttagtacagttactaaagactggctttagctattagagtgtgatctgtatttatagtacgtaatatgaatacaggataccctgtgtatactgtatgtataaacagtataatctatataaattaattataagccacatggtatttttcctcaagtcatcct

SEQ ID NO: 19649 - DNA, 201 bp, Bos taurus
gagaaagaatctgtaattacaaggtttctaaagtaagcactctaggaaaagcagggtcaggagtccagagtcagaaagaaatccatctaaagtttagtcaagttgagtagaacatgaaggctattttggtcaacatctacttagtggctacccactccaatattctggcctggagaattccatggactatccatcaggcca

SEQ ID NO: 19650 - DNA, 201 bp, Bos taurus
gtagtatcaccagatatgaaatctccatcattaatatttaaccatagcagaaaagtggcatagggtggcttgatttactggcagcatcctccctaatttcgcctgtgttttcgaaattgactttgagttaagtaatatcccatttcctggatccagaaaccacattcatgggagaaaagtcaaattgaaatggaaaatctg

SEQ ID NO: 19651 - DNA, 201 bp, Bos taurus
atgaaaatcatttgcagtctttgcatgtatctgtttttcagtttccaagtgcaggaatctttaaaatctatagcaatagatgtgtaaataagaatgacatgttattcaaaagatttccctttcatgggatgtaatccatacaagttgttttatgcaaagaaaaccataataaagaaagtgcccctattccctggggataga

SEQ ID NO: 19652 - DNA, 201 bp, Bos taurus
gctaaatattagtaactgttaaaacaggccatctcatctagaatgtaagaatgtcctggagacttccagtattggatgtttggcctagatgatttaacaagcatttatgaaagatctatcttctgctagctacgtagagctaaagaccttttgtggcctcagagtctagtgaaggacacagccacccagggaaacagtcac

SEQ ID NO: 19653 - DNA, 201 bp, Bos taurus
agagtgaatgtcaggcctccctcgccaaggagggaggggtctggagagctctgtcctttgattgatctccggtggtcatgactccttaggtcctccagcgctcccttctccccacctctggcctcacgtcccccctcaatggtgcccacggtcaagagcccactaggcgagagccatcctcttccgcttgccttacagccc

SEQ ID NO: 19654 - DNA, 201 bp, Bos taurus
ggtgtctgtcatttgtgatgaagccctggggccaggggaccccccctggtcagtcctcccattccatgcactcattcagtataaactgagcaccttctccgtctcgggcccaggcaggcaggacccccccacccccactccctggagctttatatctcgagcagaacttcatgaacttggaaatcttctcttccattggat

SEQ ID NO: 19655 - DNA, 201 bp, Bos taurus
tttccaatggacttcaaaaccatacaaacacacttacttgcacatacacacaatgaagaataagattcctgaaaattctttgcagatattttggggcaagggttggggggacttaaagtacttcccactggagatggacagagaaatgactgcattatcaagtctcttggaacaattttttgtgtggttcattcatcacac

SEQ ID NO: 19656 - DNA, 201 bp, Bos taurus
ccgtctcctgcctccggtggcaagtggggtggggcctcgggtttcagggccagcggaggggtggcggtgggggggaacaggcccagttgaacacaggtcttatacttctgaatctcacctgccccctggctgagggaggggcagcaaagtttctgggagcccaggaggtcaggcttgtccaggcatacaagggccccctca

SEQ ID NO: 19657 - DNA, 201 bp, Bos taurus
taaatagggcccacccaccaaactgcataagctgtgggtctcagcacacctgaatctgcctctggagagtgaaagcttttccagcttctaggggttaaagttcaacagggaggcctgtttggactaattagaaacaggattgtttgaatacacctcacctctcctgagaggtgagtctcctatggaggattggagatccct

SEQ ID NO: 19658 - DNA, 201 bp, Bos taurus
cctcatagaattagttttccttctcaaacttgatgctccagcagaatctaattacttgcgtttctgaggtaagccatgccatttcacacctcttggcctttaagcatgccttttcctagactaactcaccaacgtgtgactcatagctggatactagagttgcagtggtggtacgtctttccctggtctcacggagctcac

SEQ ID NO: 19659 - DNA, 201 bp, Bos taurus
ggcacccacgtccccagagccccctgacctgccctcctgtgacctgcccggcccttaatggtctgggtcttcctgtgaaccccggtttggccagggcagatgtggctctgtctccttcaaagcagctccctggtacccagcacttagtaggggcttgttgagaggacgaatgagagaggccgattgaacgggaacatcgcc

SEQ ID NO: 19660 - DNA, 201 bp, Bos taurus
aaggagacggacggctaggggactgacaacccggggtgggctccgtgtcagggggaagaggccagggaagcactgagtcagatgcaacaagaccaagcgtcggggaggtcagatctcgaaatggtgactgtggggacagagggggccactgggagaagaataaaaaggtttagagaagaatgaaggaggggagatagagac

SEQ ID NO: 19661 - DNA, 201 bp, Bos taurus
aatgaagtagaagaagctacagctgagtaaacacactgggggaggccaagtcgcttgaggtgcatcgttcccaggttcagaccctgcaaaagacttctcatggcagacaggatacatccaaacgccttcccttgttcacaaggcctgcgtccagctgcatgtgctctgcaccatgcacctggcagacaccgagctccagca

SEQ ID NO: 19662 - DNA, 201 bp, Bos taurus
tatgtatagcctcaatattacaaataaaaagcagaagattgtcaggttagatttttttttgttgtgctactgcaagaaacatgctctaaatattaaaatacgaatagggtaaaataaaaggatggaattacatataccgtatttacattagtcaaaagaaagctgggatgggtatgttaacatcaaagtagctttcagagt

SEQ ID NO: 19663 - DNA, 201 bp, Bos taurus
actggagtggggtgccattgccttctcaatcacaattcagtatctgcctactcagcagcatttctacgttaacacgtcaaaaacacgtgactctgcaccctacccttggaaagttgcttttccaacgcgccccgcctcgtcagcagtggcatccggggctgaggaacctagccccacgactcagggccttgtctcattccc

SEQ ID NO: 19664 - DNA, 201 bp, Bos taurus
catttctttttaggttcccggatgtcacaggtctttccctaatcttaacagctaggttcatcaccgccagctagcgccccaacacctaaggaagctgtacccatgtggcaccagtctctttgctgcaccggtctcacatgcctgccatctttgtgtccccagtacactgaactatgagctggatgctcgtaaatacttgtt

SEQ ID NO: 19665 - DNA, 201 bp, Bos taurus
ggcaccaacctggcctccgctgccctgagtcctgtgcaacggggtggccctttgtccagaggatgacccatatgccgttcctgtcctgcagcccaccaggtgcagagcttgtgtcaggagcagtccgagcatttccacgcaccatcttggctggagcactcacacccctttgaggctgaggtcacccactttacagaggag

SEQ ID NO: 19666 - DNA, 201 bp, Bos taurus
tctccccctctccgcctctcatctctaggggaaggaaagtggacaacagccacattacgcagggggtagccccacgtgcagctgccatcccacacacagcgtcgttgttggagcagatgaacacgcacgcatgcacgaatatttcggcacatggtcattgatctgccctgatccttatcagaaaagagtatcagacattct

SEQ ID NO: 19667 - DNA, 201 bp, Bos taurus
ttgcagttggcttgaaatcccaaaggtggggaggccttgccaagaggatcccagcagcagcgtgggaagtgaagcagtatcagggttgcctcattacccgcaaagcccctccccaccattgctgatggctactgctccggcgcgaacacatgggcttgcttaactgttcttgcagcagtttctgagctccaagggcagaac

SEQ ID NO: 19668 - DNA, 201 bp, Bos taurus
ttaggtagtgagggcagagtctcattagtggggtcagtgccctcattacagaagcccagggaagtccatttgtccctctgccatgtgaggacacggagagaaggcccatggaccaggaagacagctctcactgtacaccaagtgtgctggtaccttgatcttgcgcttcagcctccagaaccgagagaaataagtatctgt

SEQ ID NO: 19669 - DNA, 201 bp, Bos taurus
agataatttctgactctgacagaatgaactgtgttaaaaagttacaaaactagtgtcacaaaccagtgttcttattttatatgtttaagatgtaaattccggatggagggagttaatgtcctttcctatatcttttaacaagaaaaaatgaatcttttgggccttccctggtggctgagatggtaaagaacctgcctgcaa

SEQ ID NO: 19670 - DNA, 201 bp, Bos taurus
caggaggccttctgcctgtggccttgtcccagagaaaccatcctccagcgttgttttctgttcgacagacctcaggtgacttcccaagaactctgttggacgccaaaggcccgagtagagatcgtctgacatttcttctcgttttacctatggccgcctctccacaatgctcatgtgtgctcaagtccagatgaagccatt

SEQ ID NO: 19671 - DNA, 201 bp, Bos taurus
tttcacaggaggaaaatggtaaagatgacacagagcagacaaaacacaggctcttggtttaacttacacaggtcgtcaccaagatttatatgaaagtgacatcttccagggagacggtgcgctcctcctggactctgtttccatcacgtgaccgccttctcaggagcacgtctataagcccagagtgaagggaagtcttgg

SEQ ID NO: 19672 - DNA, 201 bp, Bos taurus
gagacaagcatgctgttcattttggaaaccacatcagactttctttaggacagcagcattcagtggatagagaatggaaaatatcaattaacctattaattagcccagagaaactattagccagggaggtcatcaaatcgcatctgaaaagattgcctgaccgcagagaaaccgcacaaataattccttctgccagaatcc

SEQ ID NO: 19673 - DNA, 201 bp, Bos taurus
cagccatccttctgcagagcaaacgccccgagaaggagctgggaggcctcagtaccgtttacagcctgtgcagaagtatcgggccatcatttctgaccccatcggggtcactgagttaggacccagccctcctcctctcctcgtgcctccaccactgcgccatcctccacgccccttgcagggcctcactttcccatttga

SEQ ID NO: 19674 - DNA, 201 bp, Bos taurus
cttttattttaaaaagaggacatttatttgtgccccctgagcctggcttgggagccgcccccttggctgtttgacaagaatggaagtagtttagaaagggaaatttgtgatgcgtcccactggctcctgcgtccacgccatcattcccccaccccgacccttgtgatggtctggacccgccgccaaaaccagaacggacca

SEQ ID NO: 19675 - DNA, 201 bp, Bos taurus
attaggaggtgcccccctggggcctcaaggcctgtcctgcggtcaggctggccttccccgcagttccggggaattagccaagggctggagggccagaacttggcatctgcatgcagagttcaactctgattccttcgaggtggtcagaggtcagccagacacggccctttggggcactgagagtgccctcgaatttttttt

SEQ ID NO: 19676 - DNA, 201 bp, Bos taurus
catcttttcagaacataggctgaccctcatgctgtcataggaaacttactgtacttgtatttcagaatacattaaaagcatctggagtttctctatgatatgagagcctcaccttttacacagatttctaaaaccatcccgatatgttaaaacatactatttctttgttggctgcatcatgaattaggattattctcatta

SEQ ID NO: 19677 - DNA, 201 bp, Bos taurus
ctgtttaaaatcaccgcagagattcttacactcggcagacccctgactgagacgtgatgggtgcaaggaccgtctgcagacctgagctggccggcctcacccagttagaggcgctgagaccgggtcacgtgtaaaatgggaccctgccagtctcaggcctgcagtggcgtccgtctggggcctcccgggacctcagtgtct

SEQ ID NO: 19678 - DNA, 201 bp, Bos taurus
cggcccctggagatgctcacaggtacaagtgttcactggttctggaatcattcagagacgcaagacagcacagggggatccagactgcagaacccagctccgtggatgggcctggcactgcccctcaccggctgaatgacctcggaagaacttcagctttgctagttgcctcgtctgtcaaatgtgggcgataattcgatc

SEQ ID NO: 19679 - DNA, 201 bp, Bos taurus
ttttaagattccatctccttggtgttgattttgagaagagctgtgtgttggggtccttggaggttgaggcagagtccgtgtcactgcctgtattgaccagatgggcacgctgcgctttgctctcgttaacgctcggggaggtcccgttctagttctgtgcttcgtgcttttctgctcggtctggtaatcgtcatagtaaag

SEQ ID NO: 19680 - DNA, 201 bp, Bos taurus
tgtcatgtctgtgcaggtttggggagcagagcactgactgccctttgttcctgtcttttcaaggaaagacgtgtctgtctctggagcaaggggcgggcctactttctgttcatgatgacagtgccctgaacgcaggtccccccacaacacagctccctctgtgcagggtcagctgccctctttgtctggtagcccgccggg

SEQ ID NO: 19681 - DNA, 201 bp, Bos taurus
agcctgaaatctgatttgttttttttccttttcatttctgagctggttctctttgctggacttcctgtctggtctcactcctgctgctgagagtctgggccccatcagccaggcctcctgcacaccccttcctcccctcggggttccctgctaagcccacccccaccgtccccacaagcatgcccttctctcacttgcgtt

SEQ ID NO: 19682 - DNA, 201 bp, Bos taurus
taatgtatggaaccaagttctgccccatttgagtttaaaatgatgggctcaaaaaaaggcatctcagaataaaacggaagacctattacatgaacatttcattctttttttggtttgatctccacacagttagaaagactttctgttcatctggtcccacaagcagacaagagcagttcttcaggattctttcttttgggt

SEQ ID NO: 19683 - DNA, 201 bp, Bos taurus
cacgagaagcggtgtcacccgctgcagagacactggcaggcatcagagaaggactgtcacggagaccggggtcaggcccatccctgtcattgggcaagaaacaccgacgttgcagggagcacagcagggctgctggaacgtcccgggccaccctcagaggccgcagtggggggcctggagagtagctccttggacacgagg

SEQ ID NO: 19684 - DNA, 201 bp, Bos taurus
agactctggaaataagtgacaacttcctcccccgtcggcctcccccgaggatccctgcctcaccctgcagcagtggccataccccagggctccttctggatgcccccctctagagcaccccaaattcacgttcaagctgctcccaaaggcctgccgggtttccaataaaggggccgctgtcatgcacttcctgacggtccg

SEQ ID NO: 19685 - DNA, 201 bp, Bos taurus
gggctgcccagagaggcaggttcccacgtggccatcagctcacacgctttctccttctctgtttgtccacctctccgttcggctggagtccccaagagaatgatcccgtggtgtggacacagtggccctgggtccacgtgacacctggccgaccagcccagcagggcagtgagtagaaagcggggagagggtgcaggcttg

SEQ ID NO: 19686 - DNA, 201 bp, Bos taurus
ctgtggcagtgattcttctccaatccgttcttgtaggtgttctaggcgacttccattttcaggctctcaggatttacacacgggaaaagaagctgctccacggctactacatgtatgaagtgacaatgcagcctgctggcggtacgttcagagcagggctgagtggccgtggggctgagggcgtgctgcctcagcaggcgt

SEQ ID NO: 19687 - DNA, 201 bp, Bos taurus
ccccagtgtgaccacaaaaggcaggcagcaatcctgggaagctgcctggaggaagggaccttgttctcgtgggttttcttgctctttgctctcctgagaatctgcatggggcctcggccacagtcagcactggcaacggtgtccgctgaacaaatgagcttggaaacaggtggtaggctcaggtgacgccgagttagcgca

SEQ ID NO: 19688 - DNA, 201 bp, Bos taurus
tctcccaggaataaagacagaacactcctcagttcactttatgaggcttgactcttctagaaactaaatcaagggcgaaaaagaaaagaaaggccattcaccaatataaaccatggcttagttaagcagcaaaggtgttcagggtctcatgttcagagttagctgcgacaagctgcccgcctcagcctgcagacgccccgc

SEQ ID NO: 19689 - DNA, 201 bp, Bos taurus
taatctgaaaatcagcaccacaaaatcctgggaaaaccctcaaacgggatttgaatggaatagaaactggtcacttctgagggcctgctctcctcagactcggagagaggaggatggaaggaagtggcagcggctgggggcgttgggcagacccgccaacccctagaccagagccgactctgtgcccggccctggacttca

SEQ ID NO: 19690 - DNA, 201 bp, Bos taurus
atcatatctatgaagaaaatattttagaattgatagagtttactaaatatgtgttctgttttctataggtaatgtggactgaactaccatgtaaaaattttcatcttcttctctgttgtgctattctggagtcagaaaaacaacaaataatggaaaaacattatggctttaatgaaatacttaaggtagttttttaattta

SEQ ID NO: 19691 - DNA, 201 bp, Bos taurus
tacctgagttgctgtccccattagatggggtacatgatcctgagttgagaaatgaaatttcatttccagtcacctgcctgtccatcctttactggtcaggggaatggagagagaagagaaagattgatattctaggcagcagcaaacatgccagttctcttggtagccagagccaaaggataagtttggttcaatagcttg

SEQ ID NO: 19692 - DNA, 201 bp, Bos taurus
agttccaagggctggacttctgaccaaggctttgatgagttgttgtgtctccctgccctaaatgacttgtgtaaggctgggctgtgttctgagctgggccgaagaaggtcagcacctggactttccttgaaccactgaggagagaggtgtgctttcttctgtggttggaaagtggtagcgtgtaagtctggagctgtcagg

SEQ ID NO: 19693 - DNA, 201 bp, Bos taurus
ccacatgtggccctaaccatgccagaatggctgagcatagttatctcaggggctagaagtggtgtgatggcagaaatttttagtggtgacttactgatcaccctaggggccctacaaatgaaataaataggcagctcactagaaactcagaggctgagaacagagatctgacctgagacatcatgatcatcatggcctccc

SEQ ID NO: 19694 - DNA, 201 bp, Bos taurus
acttagcaactgaacaacaagatatttaacctgagtttccgtatccttacacagtacttaggaagaacacagtagctcctggaatttaggagattaaaggtgataactaatatgaattaaaagatctggtaaattgtagccaggtcatctatttcacattccttacatttccttcccagaccttgatgaagcgtgttccag

SEQ ID NO: 19695 - DNA, 201 bp, Bos taurus
tggtaactgtcaaatgcagccaagtttgaaatataaggcaaaaatatagagcttggattatctgataactcatgggcttgagttatattttaatgtatttccttgtcccctagtcaggtgacttattcatttgccagtcaaggtgattcagtcttcggaagattcctatgatcctagaattgcttagttatttagagactg

SEQ ID NO: 19696 - DNA, 201 bp, Bos taurus
ggtaaccaaaaccatcaaagcagagaaaagcacttaggcatttaactctcaactccccatcttggcacgtataaaattatctcacgacattcttttgaaattgtcttcccttctttttacaaaagctaatcctatccccaaacctctcactacctatgtatttaatctctccctttttctcaacctataaaacactgaagc

SEQ ID NO: 19697 - DNA, 201 bp, Bos taurus
gcacctgtttccatggtaaattctaccctaggtattactcataggtcttagagcaccatcaaccttacatcccagccagtgactaagggaatatgaaaatgagaaagacagtgtctagatgtacaaagaatgctataagatatgttcaccagtgtttggaagtatgtccacaatattatttgccttttctctcaatgtcaa

SEQ ID NO: 19698 - DNA, 201 bp, Bos taurus
gtcaacacttgggcggggacgtagactatgctgttttgcagacatcggctccctggctatctgcattagaagcctcagcacaaactccaggagatatcatcagcaatgtgacagtgcccctggtgtgcactagctatggaaatactttttctcactttggcagatacagaagacatctgtgcagcaggctgagccagaaag

SEQ ID NO: 19699 - DNA, 201 bp, Bos taurus
aggcagggttaggtaacagactgggtcaaggtgttattttagactagagagagagaaagatcgcacaccagctgtattctccctgaggggaatagagaaatactgtatttctttaccaagttttctagtgtcaatcaacctgagcccatacttcccccagtaattgtagatttgctttgattctgaaaataaaaggcatct

SEQ ID NO: 19700 - DNA, 201 bp, Bos taurus
tgaattatttgaagtgaggtgaacatgagtatgcaaatagagttatttatgtgaggagagagtgtgttgtatatttgggaagaaaagtgctgacagttacttagctctccaaaatgttggactgcgcagacggactgacaaaaagaatataaagcggtatgcagcttctgggaacttcccttaagagacagtaaggacaag

SEQ ID NO: 19701 - DNA, 201 bp, Bos taurus
ataaaagttcatattacttacagctaatttgcatgctttctgtttttcatatcaggcaaatcggtatgaatatcaatttgtgtgctacagtcagtgtgtcgttgttgtttttgttcagtcacccagtcatgtacgactgcagcacaccaggcctccctgtccctcatcatcccccagtttgcccaaattcatgttcattgc

SEQ ID NO: 19702 - DNA, 201 bp, Bos taurus
atgtatttggggggttttgttgttttgtcttattttaaaacaagtactggactacgaagcctgctatactgtactttatatgacttttggaaaacttttataacaacttctatagagaggtttcaaatattttaaaaatatttgaatagtgaatatttgactgtaacgccattgtagatatataataattgacctaataga

SEQ ID NO: 19703 - DNA, 201 bp, Bos taurus
aatgcaacagaagtaatttcttactgctagcaatgaagttcaagtggacgaacaccatgaatatggatcaaataaggatattacggaaaagggaagtgatcattttatataacagtaaagctaatattttccttatctgaacttagaacatattaacagtctcctatttaatgaattggaaagaagactaagtaataaagt

SEQ ID NO: 19704 - DNA, 201 bp, Bos taurus
tttcattagttctgttctttttctctctctcattcattaatctctccatttttgctgagacattctccattatctaccacattgtagaactaaatttctccgttatcaaccatcttataaaaaaagaagtaaatcaaaaaccaaaagctaaataaaaattgacactttacttctgtctgtttccgcaaaacccttgaaaga

SEQ ID NO: 19705 - DNA, 201 bp, Bos taurus
ctttaaagaggactactttttctgcaaaaaaaaaaaaagtcaaattgagcagaacaaccacagaccaaaacctactcagcttgcctttcacctaaaagcccaaacttaaaatcataaaatgtttgaactctagtaatagaaaaaatcaatcctaaatacttaagtaacaatagacagaaaatatgcaagttccataagagc

SEQ ID NO: 19706 - DNA, 201 bp, Bos taurus
aagtgtaacttgtgcctattaaattactctatattggaaaatagagaatcagaagagcaaagagaaaagatgttatattgaaaactgaactagaattagccactacagagttcaatcattttagaatatcataaatcacagaaaaatgttgcattaaaacagaactgtaaggcaatataaatgtggaataagtagttaagt

SEQ ID NO: 19707 - DNA, 201 bp, Bos taurus
atcttccaggcaagagtactggagtggggtgccattgccttctctgattctaaaggcagatctgcttaatcaatccatgtcatttatcttcctagattgccgtacctgttagtagtagacattcattgttcagaattgtgctattgctacttctgtttctgtacatgggcttcaagttcaaaagtaaaacacaagatcaga

SEQ ID NO: 19708 - DNA, 201 bp, Bos taurus
gaaagaaggatagctgctgtgtcaactgctttcaagaattatggagggcaggccaaggaaaaggcttaagaataatgtaatagttgttctttagtttttttaaaaaatgttctaaggcactggttatcaagactttccctatgaaaacttcaaagctcagttttcagatcccagattaagatgctggataaatgcacagta

SEQ ID NO: 19709 - DNA, 201 bp, Bos taurus
gcactagtaaaaaaaaaaaaaaataggctttctataggatatgatacaatgttttacttgtctataaacattcagaagcaaatgaactttgaaaagtgaaaaccaattgctccttagaaaaaaagatcatttatcatttttattgatctcagttttctttttcctattttggttaaaatatagaagaaatctaactaatta

SEQ ID NO: 19710 - DNA, 201 bp, Bos taurus
tacactgagataacattcctacccagaggccctctcttccgttcaagcctgttctcctgcattctggtccttttattaccccttatgacatggcacagcactctatgtcaagcctccatgtttgcacactactctgttgacctaatccttgactgctggaaaacacatctcttgcatgttaactattcaaatctcatctcc

SEQ ID NO: 19711 - DNA, 201 bp, Bos taurus
ccggatctgtgaggtaagaagctgaggttcgggggatatttattaactgatatagacatacagcttatatggagccagaaatatatggaattaacaatttgtaaactgaaatttaatttcagattttattttctttttacagtattttccttaaacataggctgccttgctgtataatgggtagatttgtacatgtatgtg

SEQ ID NO: 19712 - DNA, 201 bp, Bos taurus
actctatatccttaattaacgtttaattaagcagttgtttcctgatcctcaccgacgccgtccccgcttcgaattccctggatccaccggggctggacccaggcagttcactctaggactgagaacaaattgatttctgaacattctgatgcatttgtaagtaaacattcttcagggtaccatgttctattcccactgtga

SEQ ID NO: 19713 - DNA, 201 bp, Bos taurus
cagcattctagacaatatcccaggaatcagtagaaaagagctggattccaggacctgcttgggagtgtggtgaggtgctagtgatctaatcgacacattccgggttagggtcttgaagggttggcccttaggaataacagtgaaccagaagtggtccttcattggaatgagattcaagctttcaattccctcagtctcaga

SEQ ID NO: 19714 - DNA, 201 bp, Bos taurus
gggatcaaacccacatctcttatgtctcctgaattggcaggcaggttctttaccagtgggaaacccattgagtgcacatataaatcaaataaacaacccaatccaaaaaaagaaaaatcatcaagcaaagtacaacatccctacttatccacaaagacagttcattttaatagatcctgtgacccactcaggtttcctgag

SEQ ID NO: 19715 - DNA, 201 bp, Bos taurus
agtagattagattattagatttagattagattcaatttagaccctattagatttttcaatattgacaccctactattgaaaatgagaaattagctttcatataattcaacactcaggcacatgcacacacacacacgcttttccactcatcttcccacgatcattttttgggttagatcagtattcagtattatattatca

SEQ ID NO: 19716 - DNA, 201 bp, Bos taurus
gagcacacaggcacacaccgatgtcgaaggactagagtcagaactaggacttaagcccaggttgttttcaatatgatgtgcacatgaagagccttgctgcgggagtgctgacagcagcgtagaagtgaaactcaccaaatgacaacagacaaatgaatgaaataatataccagctcaatgggatttgatgctgtcattaac

SEQ ID NO: 19717 - DNA, 201 bp, Bos taurus
catttaaaatgttcacctgatcctgtttgatttccccagtgttctaaattgcttcttttgtcttcaaatttccatctttctcctaaagcctttcctctttttgggtttccctgtgtgaatttcccctacctttataaaactccatgcccctaacccagttattggcactgtgtatcccctcccaacaggacctcttcactt

SEQ ID NO: 19718 - DNA, 201 bp, Bos taurus
ttttggaatacttgtagatgatgtagtatatttttatatagtatctttcatgatatttgatgacaattattgacacttaaactgataactgaattaacgatatggcaggcttatccttactttatgaacttgtgactaagaagcaatttgtatgacattactttgatactacagagatgtctatttcctcttcaaacatga

SEQ ID NO: 19719 - DNA, 201 bp, Bos taurus
tgggatgggcccctaaaaagggaataagggtgggaatcaaggatgaaggaaggagattaaacaaaactaagaaagggcccttgctaagaaattgatgatgggaacctcccacgagtatctaaactttctccaccataaatccaaaatcccaaacccagtatagattgtaccacattccagcaaacaacccgaaatggtctg

SEQ ID NO: 19720 - DNA, 201 bp, Bos taurus
aaattacatcttctgtgagattctctaaaaagtatgcggtttatacacacatctttacactcatgaatttcactggtgtgagttaacaaattgacaaatagataatgaataaaagaactagagaatatatttcgaactaaaaggagtattccattcagcacctcttgttatttttaaaccgtgttttactaccgttaaagt

SEQ ID NO: 19721 - DNA, 201 bp, Bos taurus
gcatttcatttcagttctgctgagaattttcaagtccctgctatttgcagtgtgctgatcctggaactgggaaaataaaagtgataactggacccgtccttacagtgagagagacacgcacagaagtagtttgataaaatgcggttccctgtcatagaagtgcatttaaaaggctgggagaaccagtggaaagaacaattg

SEQ ID NO: 19722 - DNA, 201 bp, Bos taurus
tcatcaaaattacagaaaatctatatcattaaataccttgagcataaaagtggtatcagagttgggactgagaggggccataagtgggaaactgaaattcggaagatgcagaacaggaaattttttgacaaaaatgtccctagaattccttgaaaaatgacagaagactggatgtagggctttggaggggacagattatct

SEQ ID NO: 19723 - DNA, 201 bp, Bos taurus
ctttgcgatcccatgaatcacagcacaccgggcctccctgtctcaagcacattgagggtactgaattgaatgtacacagtaagtaaatcttaattgctcatatagttgaaaataattttatcatattgaaagaagttctcaaaattgcctaaaggcacagttttataagctgttgatcaatatctatactacttaataaca

SEQ ID NO: 19724 - DNA, 201 bp, Bos taurus
tctggttttctcaacaaagtgggcatgtggctcagtcctgttggactgttttgtgacggtcccagtgttcatggccactgcagcggtgggcccagatgccttcgggtcagacactgcttgtccttccgctccctgggttcgcatcaccatggaagctagttcaggcctagtgttcttccgctgaggcagtatgaaggccca

SEQ ID NO: 19725 - DNA, 201 bp, Bos taurus
cccatggactgcggcccactaggctcctctgtccatgggattttccaggcaagagtgctggagtggggtgccattgccttctccatgtaacagcctaagggttatgtaattactggatttgaaatcatctatattttgggtctctgcaaaacttatacataggcaaaataaattgcatagacagaaggataaagcagatgt

SEQ ID NO: 19726 - DNA, 201 bp, Bos taurus
ttgacttgcaaatgtttaaattctcaactctgaggtataaaatgcaacaatcaaggtgtaaaaattcctaaattattagatcagactatcacacagggtagcaaaacactaaactagtatgggtataaagaaagagggagtatgaagagtctagggacactgttttccaaatttcaactcccccacattaccaccaccatc

SEQ ID NO: 19727 - DNA, 201 bp, Bos taurus
agattttatctgaaaaatctgcactccccccaaaaaacatgtagcttaaaacccttttctctatgtaaaattcttagagcataggcagaacattctgatataaattataccaatattattttggacatgtctctcaaggcaaaagaaatgaaaacaaacagaaacaaatagtgacctaattagacttttgcttagtgaaag

SEQ ID NO: 19728 - DNA, 201 bp, Bos taurus
acatttaccccatgactctaaaatgttatcacaaagaaaatgggtccaaaacttataactgtctctgacctattctttaagcctggcctcatttacctactgcttttgatgtctagcaggcatctcagaaaagaagccttagtcacatcctccccgttcctctccaggttgtttctgtctcagtggatgactctgcattta

SEQ ID NO: 19729 - DNA, 201 bp, Bos taurus
cataatatgtgtcttgtagctcaccaatttacactgtagcagcagcttgcacatttatgtccaaatactcaagattgctttgtatgtttgactaaacccctaatgagccatttcaagtagtaaacaatacattttatactactttattttgaaaaaaactaaataagaatttatgaattaaatgatgttttgttatttatt

SEQ ID NO: 19730 - DNA, 201 bp, Bos taurus
aacatcaattgtacacactttaattttttactacagcccctctcttatgaaaaaatatctaacttattactttagaaacaggatagagaagttaatttcccaaagtttaggtcaattcaagctttactggttctttgctacctgttctcaaagcagtccacagtctttctctagtcaatttctaagtcttctgacctattt

SEQ ID NO: 19731 - DNA, 201 bp, Bos taurus
gcttccaaaatgggtatatattactaactcatgtattctcaccaacatttagaaagtgactccagggactgtgctctgagaaatcagatactttctgggacttgtagccatgggagagagatttttaatgctttctggtgagaaaagccatttggaatcattgttggaaagaagatgcaattgtgaaaagctacagttggg

SEQ ID NO: 19732 - DNA, 201 bp, Bos taurus
ctcctgagagaccgcaggatgcagcagaaaaggaacagcaactgacattggaaaacctggatctgaagcctttaacctttctgattctgatcatttataccgctgcagtattaatagcacggctgtggtattagcaaatgaaggaacgccaggtggaaaccagtttgacagcactatgcaagtgttggttattctaaagcc

SEQ ID NO: 19733 - DNA, 201 bp, Bos taurus
tgcagactatgaagcaagatgcctagtttgtttaaaggctcagcaaagaagaccattttggctaaaagagagcctggagaagtgtggagaaatgacatcatagatgtaacagggggccataccatcgcctcggagcaaccagaactctattttttgaatgcattataaacccactggagggtgaagggctttgaataaaat

SEQ ID NO: 19734 - DNA, 201 bp, Bos taurus
tagagatcaaaataatgaacatagcccgcaagggcttctgaagtttggctcctatctatgtctttagcttaacctcactctattccttttcttgatccctgtattccaggggcactgactgactgattttccagtgggttcacaagaatctcacagtactgttccctcttctagtaatattcttctccagttcccctgctt

SEQ ID NO: 19735 - DNA, 201 bp, Bos taurus
agcatttgggtggaagggcttattttcagcttcagctgaactgctgattggtcatgtattcagttgaaaacttactaacttaaaaaatcatttagtgagattatgtgataaaatgaaacagttcctgatctcaagtaacttgcagttgtgtgtggggtgcgtacatgtaatttttttgccaactaaaggcagcagtagcca

SEQ ID NO: 19736 - DNA, 201 bp, Bos taurus
catgatggtcaagaaaggggagaaaatgggtaaagggaagatttgagaaatgtggatatagagtggaggacagaacagagcaataactgatgtgtgttcacgtgtgtatgatgtgtgtgtgtgtgctgtgcttagtcacccagtcctgtatgactttttgcgaccccatagactatagcccaccaggctcctcagtccatg

SEQ ID NO: 19737 - DNA, 201 bp, Bos taurus
actaggcagaggccgatgtcttcctcagctgtcttctccacaaattcttccagcagctttggcaggtactaatgtgtttacttaggtgtgcctggttcccggaactaatagtgatttgaaattgttcagcacattgttatgtcaaatataatgagcaaaatttcaagaacaacttccattatccaggagttgataaggtct

SEQ ID NO: 19738 - DNA, 201 bp, Bos taurus
gtctaagcagttaaaaccagaaagcttaagatgcagttacattcttaactagttcaactgtttgtgtggaaaagacatgctttctattcagaaggcatagcgcagaatatagttataaaaatattagtcccatacctctcgaatagcagtacaaaactcactctgaagcacttttttgagggattgtagcttgtgcactgg

SEQ ID NO: 19739 - DNA, 201 bp, Bos taurus
agaaaatctataggttgcccaaggcttgaattgggaaatacataaagtaataagctctgcttgccttggaaagggaaaagggaagagagaaaaagtttaacgtatcacaaattttatgaaaagtatggcactcatgggattttcatttgcagtcaacttttgcgctcatttccttttcatgaggttgaaacccacaaaata

SEQ ID NO: 19740 - DNA, 201 bp, Bos taurus
aggtacttttttttaacatgcaggatctcagtttctcactgactatgagataaaggttgtttaagtctccaagtcttaaaagggcttataagtgttaaagatatcaattattcactcattgtgtgtatagtataaagaaaatgatgaaagagatgggagacatacagtaaattattacaaaactatttctttagagttgta

SEQ ID NO: 19741 - DNA, 201 bp, Bos taurus
cccaacttcagtgaaatcctccctttgaacagttctgtcatctctactccttttatcagaaaaaatgcttttgtgttgggccatttttggggctgatgactgtgggagatgttgactccatttccctttcagcatttcagtaccatttttatatccagttataagaaagagttaaagctttgaggcctcatggaatttcag

SEQ ID NO: 19742 - DNA, 201 bp, Bos taurus
ctgaaatgatatactttaaattcttaaacagatctgtaatctctcaaaattaaattttaacaagtaatgttatgacaattagtcaggtgattgattcaaggtagtcaaagcatgaacatttctatttgcaaaactgttcactccaatatacaagtagagttagtatatctttccaaggtccttaaaactgctactgtttac

SEQ ID NO: 19743 - DNA, 201 bp, Bos taurus
acattctttccccttctaatttgccctttcttagtctttgaaaagttatactttcctcaagctcacaaaaattttcagagctttctacttttaagcacattaaatttaaatatatttttaactttaaaaatccaaaccatccaaaacatgacctttctcaattaattagctttctttttcatcaaaaaacagaaactacca

SEQ ID NO: 19744 - DNA, 201 bp, Bos taurus
atgccaactgtggagaaaactgggaacatatcctgtacgtgataaccatatgctctgctaaaacttaggagctctaaaattagagagataatgaatagatattggacttctagtatttgtctttagctctttcctaatctttctacatacagtaacttattgtgttgccatctcctattttcaggggtagtattccaaaat

SEQ ID NO: 19745 - DNA, 201 bp, Bos taurus
gaaaagtttcttagtagggttacagctctcatttttgttacaaaaacaactttctattttagaaagtagggctagaataatgaatgaataatgaatgtactttttattttgagttttctgagcttctgtttctttttgtgttatcttggaaaaattttgtctttggaattacaaatattttctgaccttaaataacttgat

SEQ ID NO: 19746 - DNA, 201 bp, Bos taurus
ttcacttaaccttactgtcatccattcccccagatgagttacacctctgggaacatcattctcactctcttaagttaggctaatgggattaattaatgatgaacacaggcacaatttcaagtgggtgtggtgagggagagaggaacaaaaggatctgaagaatatgctaagagaaaagatcaacaatgccaggaactaaat

SEQ ID NO: 19747 - DNA, 201 bp, Bos taurus
taacttttccttttttcttaggtttggccttgtgggcttaatgagggcatttggataatagattttatagatttgtgagaaacctggagatggtctatgcttggccccttgtctccagctgaggtgtagagaaccagagatgtgaaggtcacccagaaaatggaatccctagaactagaagacatatttgtgactgtcgag

SEQ ID NO: 19748 - DNA, 201 bp, Bos taurus
ccttaaaattgaatattgaacatcctggttttctgcatttctctagccgcccctggcgaggggagttcctcactggccgcttctctccgtgggtttcagctgcctttcaggcagtcctctttgctgtgctcactccaatctcaaaactcctgccatctgcttaggcaaaggcctccagacctattctactggaaggaaagc

SEQ ID NO: 19749 - DNA, 201 bp, Bos taurus
cttcccctggttcatttcaacattcctgacccatgtgatgccttcagagtttgcacttccattccagaccatgtgaactacattcttctactcataacatcgacagaccatagatttttatatcatctgaaattcaaaacttctccagtcttttccataataaaatatttcaaatacctcatcagaatcctatctctctca

SEQ ID NO: 19750 - DNA, 201 bp, Bos taurus
caccagcaaagttatttccctttgtatgtatactcaactaattttgcagagtctcatgaagacagggatcactgagaataaaacagaacaggcagttgagcggggtgaggggtggagatgacaagggtatctgctgcttttcatataagctataatttgaggtcagcaaaaaccagagtttgactttatcttttcccctat

SEQ ID NO: 19751 - DNA, 201 bp, Bos taurus
actaatttggggtggtttgttacatagcaaaaagataataggacattttgcactcatctgataggtgaaagtttaaaagaacaataacacccaaggcctgaagggatattggggaaaagctctaacaggtgttaggtacttggtttttccaaacaagtataaacatctggcccaaactagaaaacacacccctccattgac

SEQ ID NO: 19752 - DNA, 201 bp, Bos taurus
gttcctaattctaactaagctataattattacactagttaatatgtgatataagttctaattaatctttttattagaaaatattgtacagttttatttgattttatttgcatttagtgaatcaaaatagtaactctgttattctctttaaggcagttcatttgaaatcatttgttggtaaatattttccattctagttgaa

SEQ ID NO: 19753 - DNA, 201 bp, Bos taurus
cccaagtttgggtcctcacttctcgaaacccatataatgagtgaagttatgtctgaaggactgtttgacaggtgatattatttattataaagatgtctaaagggttgtttctagagagatatttttattttcccaagtaactatagagaataagttatagaattggcatacaatgacaaatcagaatggcagttgtgtaca

SEQ ID NO: 19754 - DNA, 201 bp, Bos taurus
taataaggaatgatcttataaagtcaggttgaagttactggtggtaagaaatagaatttgcatccacattgtagtctgtgttgtatcagtctttccatatgtattcagttcagttcagttcagtcgctcagtcatgtccgactctttgcaaccccaggaaccggagcacgccaggcctccttgtccatcaccaactgccag

SEQ ID NO: 19755 - DNA, 201 bp, Bos taurus
atcccaccttcccattcttgggcagggccctatgccattcacaaattttagctttcttcaatatgcctgtcatctgaccccatcaaatcctcccgtccctcggcctcagcatgttttctctgatgctcccttccatatctacatttttcctctccaactaacacatcacagcccattctttcactactccttggccaatcc

SEQ ID NO: 19756 - DNA, 201 bp, Bos taurus
cacttcttacttttcattttttctttccgttccactcacacttacctattttaagtcaaaattttctgttttcctctagtcttttgctctcaagtacatcatgcttgctgttctaaatgacacacatagaagtcaatcagatcatcctgttacttcaatgctccttcctctcctatgtctccatcacctacaaaataaaaa

SEQ ID NO: 19757 - DNA, 201 bp, Bos taurus
acaatacaaaatggtacttttaaaatcctcacttccccactccatatatatgcttaaaaatagaagctatataaaaaatacaagttatgcaaaatacatgcgtccagatttatagtggaattctggagtgatcctgttgtaaactgaaaagttataagctggcctccctgtgctagttgctgataacccgcttcatctgtc

SEQ ID NO: 19758 - DNA, 201 bp, Bos taurus
ctcgaccgtcagtcctctgtccttaccacgttctggttttgctttcacagcattcttaatcacagtcttccaactcgcttggggaatactaactccatttctttaatcttctaacctcatctctctcctggctttaatttctgactttaaccaacattttgactttatcaattctcagggcactttttagttcttaaaata

SEQ ID NO: 19759 - DNA, 201 bp, Bos taurus
catgaactggagcccaccaggccactctgtctatggagttttccaggcaagaatactggagtgggttgacatttcctactctaggtcccttttaaaataatgggcctaaaaagagtaatgatatgtgagaatacttttttgttagactggcattactatggatgtggaaacatttttcaatatttagttaatcttaaattt

SEQ ID NO: 19760 - DNA, 201 bp, Bos taurus
tatacagaaggagagtttgggctgtgctggttgcctagagaaactggaatatttttaccttttgagtctagagatgaagtgatgagaaaataatgtgctgttaaatgtaaaattcccaagttgcttgggtaggtataaatacaaaagtgtcagacacgcagaataagtaacagtggccacctgcagcttaaagagaatgct

SEQ ID NO: 19761 - DNA, 201 bp, Bos taurus
taatgactgactttcttggaaatctggaagcttgtcagtacacagactcctaattctttcacctgtttaagaagcaaccagaaaataattttatagttcccctagtagacatctgtgtaaaatgctgaattgcccattcaattcagatttttttaaagtattttattcatcccagcaactagagagaataaatattttttc

SEQ ID NO: 19762 - DNA, 201 bp, Bos taurus
cttccaaaatgccccagactactgctggaacaacactgggccttcttaacttttcagacaggagccacccacatagatgtggaagccaacctggggcctgatacctcatgtgagtcttcccatcagtgcaggtggataagtcattcctggatggctagtggttgatacacttgatccaagatgtctctcagggccttcctt

SEQ ID NO: 19763 - DNA, 201 bp, Bos taurus
caaggagttggacatgactgaatgattaacacttcactttaaaagatttaattggattttttctgaaaatttggtatttcctcaaattccaatttttaaagtatactattaaaggagacaaatgtatcgtggatatatcctttcaagatcagtcaaaatagaaatagttggttttcatttattgactaaagtttacattca

SEQ ID NO: 19764 - DNA, 201 bp, Bos taurus
cgctgtatgtgaggaagcgctcaacgaagtgtcacccaaatgccaagtgaaccttccccagtcttcacggcaggtgtctcctcacatggccacccagcctattctgatgtgctgacagacctttcacttcagtctgactaaccgtactaattggtctggtcctaccgaacatgcgtgggccacccggccctcacatcatct

SEQ ID NO: 19765 - DNA, 201 bp, Bos taurus
cttaatctccagataagttcaccttatttagtcctccacagcaatgctacaaagtaatgtttattcctttctactctagatgagagaagactgaggcctacagagaaagtggtttacctttggtccactatctagtgagtgtaagtcagaaataaattgagatcgtctgtctccagtgactgttcttttgatttttagata

SEQ ID NO: 19766 - DNA, 201 bp, Bos taurus
gtgcaagagaagtaattgcttctattgtacctttgatcttttgtcctggttagtatttcactctccagtaaattaaatgatatacgtcctggaataaattgtaataaccggtataataatacctttttaatcctgagttacacaatctttactgttcaataagtcaaattaatggaatttatctaaaggatccaactcaat

SEQ ID NO: 19767 - DNA, 201 bp, Bos taurus
aaactccaatactttggccacctcgtgtgaagtgttgactcattggaaaagaccctcatgctcgcataggttgaaggcagtataagaagtggacgacaggatgaaatggttggatggcctcacctattcaatcaatatgagtttgagaaagctccaggagttggtgatggacaggaaagcctggcattttgcagtccatgg

SEQ ID NO: 19768 - DNA, 201 bp, Bos taurus
tctctattgcttagtgaataaatggaatctactctaacaccacagtaatcctttctccaaggcacttaccaaattttgcttgttcttctccagctttttcaacttcttccaaagctagctctacttcttgagctttcatctaaacattaaaaaaagttatttcagtatgcctttacatcagaatataagcactaaaaataa

SEQ ID NO: 19769 - DNA, 201 bp, Bos taurus
gtgcaaagcccggagaagcagaaacatgtagtagctacaagtgtggaagctgacaccttgctgcctgtatgtgtagcccagttctgctactttattgtttatctggcctcagtttcctaatttgtaaaagaatattacctggtttatggagagtctagcaaaaattaatagattattatagtgaaagtcttagagcaaggc

SEQ ID NO: 19770 - DNA, 201 bp, Bos taurus
acactaaaattaagaaattttattcactgaaagacaccactaagagaataaaatggcaagccacagagaggaaaaagatgttcacaatacagttatccaatatataacaaagaatatataaagaaccttacaagtcaataaggaaagtcaagaaaacacagtaggcaaataggcaaagggcttaaataggcacttcataag

SEQ ID NO: 19771 - DNA, 201 bp, Bos taurus
aacaaagagaagcacagtattctgaatgagtccctctctgatacattcaaagtttaaggaagtgcaatcagaaaatatcccatacacacaaacaagttcatagagaggacagcttacaaaaccagagcaatctgaggtatcaacatagagcagttaagtctaatagctcaatcccctcaattccacaaagtgtggaatgta

SEQ ID NO: 19772 - DNA, 201 bp, Bos taurus
cccctcccagaattcaatgcaaatgaacttatttggtcaaagagggttataaacacatcataaaatctgacctttccaagaggggattatctataaataactgtggtgctaggcataagcctggtggaggggctgagaggagggtaatttcctctactccctgggcatctcgctgagatgcaaatggctgaagggctttgc

SEQ ID NO: 19773 - DNA, 201 bp, Bos taurus
acagtgacagcaagtgacagcctccgccacccacagctttgacctgccccaagatgcatccttattttggcagtcccttctcccccatttcattcttcccggcctttactcgtgactccctgagatgacgttctctagtaaactaccttcatgaaagataagtctcagactgctttctcgtgggaacccaggcaaagacag

SEQ ID NO: 19774 - DNA, 201 bp, Bos taurus
gtagaagaaattttggtggccagcacatgagtggagggtggggtggggttgtggaaccaagggtacaggaggatttcccaacagggctgcgacccacccgaggtgtacctccatggagctggcctgtagcatcaggggagagaggggtgagcaaacgcctccctgtccaattatgcatgctctactttcccagtgaatcag

SEQ ID NO: 19775 - DNA, 201 bp, Bos taurus
ctgaagctctaagcatgcccaaattactggaagaaatgaaaaactgaaatggatgggactcatgggggatcatgtagaagacacttgcaatggaaagcacctactactcagcacagttcacaaaactcaattatgaacaactggttgtgctgaatgaggtcagtcccaccactgactgatctgatgagaggtcattagaaa

SEQ ID NO: 19776 - DNA, 201 bp, Bos taurus
gaaagaagttagataggcctgttggctaagcttttccaacagcagttgccatttttcccagggaaaaataaaagtgttgcccttaaacaaccagcctccggtatctaggggtgtgtgtggtggccatgcacacacgtcctgttccctctgaggccatatgagtaacttgcaaagattcttgtgtttaaaggctttctccta

SEQ ID NO: 19777 - DNA, 201 bp, Bos taurus
gacccactcaagatgaaaaccaaaaccctgcatggcctccatcacatttctggagttatcctgcaaactaccccttcccttcactctctgacttcaggcccctgcctgatacacactttcttccctcttttccagcttacctttcagatctaaattccagcaacaactgcttgccttcccctttaaggtaaatcccctacc

SEQ ID NO: 19778 - DNA, 201 bp, Bos taurus
ctaggacaagcggtctcacctgagctcatttcgcccctggagattcacagtcaggttttaggttgtcaataaccactcccacccaccaatctgcgtctccctccagaacattttttttctttttggctgttctgggtcttcattgctttgtgtgggctttctctagttgtggtgtgtgggcttctcattgcagtggcttct

SEQ ID NO: 19779 - DNA, 201 bp, Bos taurus
actaagggatggattgaaagtgctgaacacagtgactgacaggtggcacctaattcctttttccctttagggatgctcttcaacccatttcccttcccacgccttcccaatccagggctttgcagatgggcttcccctgcctggaacccaatgtctccttttcatcttggctgcactctctcaggtactgtgctcctctcc

SEQ ID NO: 19780 - DNA, 201 bp, Bos taurus
tgatagagattcatgtacctgaagttcccactgatacaaagatgttcggagggatggagattattagtaaacccagcaatctgattacatttgtgtattttacaaggctccctacaacaagtcttctcctccttactattcctgccttggagtttctcttctgattaatttatttcaaatattttatcaactattatgcat

SEQ ID NO: 19781 - DNA, 201 bp, Bos taurus
cagagaggctctgttggcctcccagcgtaaagctgcaatgcaaccatatccccaatgtgccctgtctcttcactgctttattttccttctttgcatgtattgatttctaacatatagtgtgcctacttgttgggtttattgactgtttcctccagtcaatattcacagagctggaatataaactctgcaagagcaagacat

SEQ ID NO: 19782 - DNA, 201 bp, Bos taurus
catctacagagaaggaaaagctcttggttctgaggttataaaactgataaaatagaaacctagggccacccctagggtgacctcttaagagaaggcctgccgggcaacaaagcaaacccctggaaaacagggctaagaggtggagaaagaccaagttcccaggacttcaattgtgcccccaagcacagggccactaattcc

SEQ ID NO: 19783 - DNA, 201 bp, Bos taurus
atggaagaggtaggatgactgccaacatttcacctgtgaactacaaggggagacaggagtctgatccccagaatcacactgcattaaacacccaaatcccaccaggccagtccatgggcacatcagacctccaaggacaaaaggaggggtcccgaagggggaccagccaccacacactgtgctggctgggctttgcctgat

SEQ ID NO: 19784 - DNA, 201 bp, Bos taurus
ttctggaatcttggggaatgaacagaatgtgttgctatttacttttaataacaaaaccgcctagcacctgtctacacttgtctctcagtcaaagaaaatgattattgctgttacaggggaacggctggctctaagggctgccagacacacgtgcgcaggggaactcaggtggaccctccgtggagttaggagacacttgat

SEQ ID NO: 19785 - DNA, 201 bp, Bos taurus
acaaagtaaaatgtaggcttccctagcattcttattcgtaaaacactcaattaccctcccctcagggatgatcatagctaccagtatcctatatatataacaagtgcaagcatttgtatatcacatgtgtacacttgggcagacacacacacatacacactgttccttttaaaaactaataaatggtactatactaaaaat

SEQ ID NO: 19786 - DNA, 201 bp, Bos taurus
gaagcagaatcaactaactaccaaagacatatgatttaaaatcagaattctggaaagttacttggtttctttgggcttcattttttcctctatagaatgggcagaaaatgataacgtacatgacagggttactgtgagaactgctctaacattgctgcttcatctctcatctctccaccaggtatactctgcccaaaacta

SEQ ID NO: 19787 - DNA, 201 bp, Bos taurus
aaagatactaaactgtaaattacatataaagataacccactctaggccctggaatactaagacagaatcacatgatttggggctggtgcatgaaagtttcttccttacaagaaactgaaatagggttgaacacacgatagatactctacaaatttgtgttgattagttattgctggacccaaatctgtatacagaccaaaa

SEQ ID NO: 19788 - DNA, 201 bp, Bos taurus
gtttagctttcatcctgtccatttttcagaaacaaagaccctgcaaccttttaagccactaactcctttaaatataataacttggcagtgtccccttcttcagtcagaatctctgttgtcttgcagtcaaccaaaccaggagccttggacaagagactatggctgagagcacgtggcggtgccctccttgcgatgaagact

SEQ ID NO: 19789 - DNA, 201 bp, Bos taurus
gagaaaaagttgacatgagccagagcatttagccggcagtgggctaagagaagacagcattggatttagagtcgaaacacttaggttctagactcacaacgaactcactggctagccacatgaccttggacaagtctcttcatttctctacacccatttcctcttctgaaggagagggttgggctgatgacccctaggaaa

SEQ ID NO: 19790 - DNA, 201 bp, Bos taurus
cagcctgggttcccatattcattaagcagtcacctggttctacctcccttcccttagtcttagaatgttttttactttcgccactgtggatacttgtaagttgtgcaattctggcccctggttatacaacatcacgtctacaggaagcctcctgccgtgtgtctcgttcacctttggtctgtgaatgtcattcccagggaa

SEQ ID NO: 19791 - DNA, 201 bp, Bos taurus
gtgggatagggagggggtagttggtgggaaaggaattgaaagaggggagagcagacctcctggagtgtctggagactcagaaaaagggtactgtggccccacagcccttgacattgctcgaggactccttgctgatgactttgaggaaaggtctagcgtccagagtccctggaggttgagttcccttcttaggaaattgcc

SEQ ID NO: 19792 - DNA, 201 bp, Bos taurus
ccaagggccccctccctcccaaggagaaaatcccacaagtggggaacatctggatcaaaccgcaaccatgaaagcacaacatcaaacgagggcttcggagtgaccctgcccacaggccctgctccaagagaaactgcagatcttcctgctctaagcttttaagtgtcactgaaccactcaagtttgggatctccccttatt

SEQ ID NO: 19793 - DNA, 201 bp, Bos taurus
cgtaagtgttaaaaaaaaaggagcctcaagctttctccttatttattaccccttcttattgcccgccttccctgccatctttacaaggttctgaaaaaggatgaacacctaccaggagtccatagacaggtctggtggtccccaacccctctgtgggcatgattttccttgccctgcccccacgtattaccatgttggaga

SEQ ID NO: 19794 - DNA, 201 bp, Bos taurus
ttggtgttgagcgctgccacttggccctgccaccccgagatccaattattcccaccatatttaggtttcccagctcagtgactgtaatgcccactgtaaggtctggcctacagagaagagtgatcacagattccaaggattctggggctccctttacaaatttctcacagtagtgttgaaagatgtgtcttctggggacta

SEQ ID NO: 19795 - DNA, 201 bp, Bos taurus
gtctgattatgtaatcgagatactgagatacgaaaattcactcactcctttcgtacctaaggctagctcttacaaaatctttcctcttccagaatttgttagggtctttggctgggccctgggatgcacaccaaagggggtaggttctagaggtaccaaaggagagactggggctcagagaaaacatccttgattggatcc

SEQ ID NO: 19796 - DNA, 201 bp, Bos taurus
ccagagtcatccacatcacaagctctgttttctgcttcagacatgacagtcactgttcttaggttgtccttcttaagactctgatcccagctactgagcccctcctggccagggcccaggcttgatccagacacacaggtatgcaggtatgcacagactcccctgggcagccagaggttatgtggacacacagacagacct

SEQ ID NO: 19797 - DNA, 201 bp, Bos taurus
gccccccatgacagggtcctatcttattggttacttgtaaggacagggctacataatctgatcaacattccttggcagaagcagggatagaacatttagcatgctggcggaggccctgtggctgctctggtggaccacaagctacgggtcaaaattcctgtataattgtttttcctgcagattctgatataaaccattggg

SEQ ID NO: 19798 - DNA, 201 bp, Bos taurus
tgggaaaacatcaagtccatgtttagaaagttctagctgcaagctcagtccctctgcaaaatacttagccttcagccagagtaacaagctcagtgtcctttgcatggcctggtgaaaagagcagttgtgtaatccttgctttgggggaccctcctccccaatacactccaagtacatgacatggactttttgatggattcc

SEQ ID NO: 19799 - DNA, 201 bp, Bos taurus
ctacccagcttcttctgggcttgttgcctggggccagggtctcagaggagcatcttgtgctgtcctttcaggatgtggatgctgcctacttgaacaaggtggacctggaggccaaggccaactctctgaccgatgagatcaacttcctccagatgctctttgaggcagtaagatcatgcatgtgtttgtccccctctatgt

SEQ ID NO: 19800 - DNA, 201 bp, Bos taurus
agtgactaacactttcactttttttcaagattaaaaggtgggtactaacccagtgattaaaaaggccattcattcatctgggcctcagacctagaagacagtaaggactggtgggactgtggctctcatgtgagccccagggattcccttctgaagaccatagttgctactcacctctggccagttgttgccatgccggct

SEQ ID NO: 19801 - DNA, 201 bp, Bos taurus
agggccagatggcttctctgatgagttccaccaaacgtttaaagaattaatatcagtccttcataaattcttccaaaaaataggagaaaagggcacacttcccaactcattctgtaaggccagtattgccttgatacaaaaccagacagagacatttaaagaaaagaaacctatggactaatatcccttatgaatatagac

SEQ ID NO: 19802 - DNA, 201 bp, Bos taurus
ccccatagatgaaaggcaaactcttccctgcctccaggtcactgtttggcttgggcttgctgtcctcatcgtcctcccgatgactgccatcggccttgggcggcttcttgagcttgctctcggcgatgcgcctctcgatgtttgccagtgactcaggggtgaaaggcttgaaactatcagggcctggtggtgcgagcagcc

SEQ ID NO: 19803 - DNA, 201 bp, Bos taurus
gccttgctggggggatccccctgaagcacactgtgaaaagcgaaacttcagaataccccaaaacagaatctaaattggccaaagaataagaatttgagggaaaaaaaaagagagagagaagatattcacagggcttgttgaggcatgggaaatccaggcctgtctggcagaagagctcaatgatgggacgtttccgtcatg

SEQ ID NO: 19804 - DNA, 201 bp, Bos taurus
ggctcgcatcgccgaggacgagacggtggtggtgagcccaaacatcgtcaccattgacctgaacacttttgagttctccaagcctgtccagaggggccgagtccagagtcggggcaactttgactggagcctgaccttcggctgggaggttttaccggcacgagagaagcagaggcgcaaggatgagacctaccccatcaa

SEQ ID NO: 19805 - DNA, 201 bp, Bos taurus
agtatttttatgatgtatggcaaaatgcctcttagctcagatcatctgaacggaggatcactgcacgggtctgcaggcctggccccgttggatacccttgacgtgggctgtccgtccagtcccacactccaaacgttgggagtgtcagtctccaagaggctgatggcctggggtcaaaactcctcctcactcgactcctag

SEQ ID NO: 19806 - DNA, 201 bp, Bos taurus
atgtattattggactttgttatatctatcttgtgatttaacatttttattttgaattacataaaggccttaatttggccctggcatggtctgtcataataatatcaattcaaaaagaactaaggtcaagtcccagcggaagaagctctgtttagactggcatcactccattccttgatggccaattactactccacttagt

SEQ ID NO: 19807 - DNA, 201 bp, Bos taurus
gtttttctcctaagcctattccattatctctctttgatcatcagcttactcttcaataaaaatggggattgtaataactaattgttatttgtgcttcatacagtaattcaaagataagctctcttattatttatccctgaaaaaaacagaagtaatctgccccctcgtcacacaggtggtcaggctttactatgtgtttac

SEQ ID NO: 19808 - DNA, 201 bp, Bos taurus
ttcagggattgaactgaatcccaggccacagcaatgaaaggctagaatcctcatcgctatgccaccagggaactcccaataataatactctttttggggggagtgggatgaggggcctgtgctttgtggcttgtgggatcttggttccctgaccagtgattaaacttgccctttgcagggaaagcatggagtcctaaccac

SEQ ID NO: 19809 - DNA, 201 bp, Bos taurus
ataggttctttttcatatgcaaaatgggtggagtcatttgtaagagtggtggtttagtcactctatcctgtctgacttgctgccccatggactgtagcctacctaacttatttttaaagatagctgctgctttgggtttaccataaagtcaacgtgttctacatttctagaagactaaattcagctctggtcttaatattc

SEQ ID NO: 19810 - DNA, 201 bp, Bos taurus
tatataatttaaatgcctctcaccctcttttagttactcaggacagttacacaccctcctatgaagacataggtctccttattaaaatttcattttaatgcatgacatatataaaaaggtttatagtatgtatgtaggttttaaaactttctagaatgtgtacttgtgaactcatccccaactcaagagctagaacgtgtg

SEQ ID NO: 19811 - DNA, 201 bp, Bos taurus
cgattgcaggcctgagtgatcctggctttgcttctgcagtgcttcccatgtgtcctgtactcagtgaggatggggagtgagcacctggagtcccagcaacattgtacagctaagctaggccttctttcaggaccttctccccaccccatagctgcctctgtgcccctctcacctttaaggccccacagatctctactgtgt

SEQ ID NO: 19812 - DNA, 201 bp, Bos taurus
ctctacttcttctctaactccccctgatttataatctccccaattaactaatttatcccccacttctccccatacactcttacaccccaggtcccctctaatttttcccctgactctaaactcgcttctcatcactgagctgaccacagtttaccattggttactccctgaacccctaatcgctccctcagcctccagttc

SEQ ID NO: 19813 - DNA, 201 bp, Bos taurus
gagaaggtgagttctttgcttgcagaaataagagggcaagaaggcatcttgagtttccatcagaagactgtagggttctcaattgagttaactgtgggggaaaaaagtcattttgggctatgaactgaccctgtggcactgaaagggatcttgagttcctaaattcatgcttcagttaccgagcggcacaaagtgacaagg

SEQ ID NO: 19814 - DNA, 201 bp, Bos taurus
gcggccggccgggcagggccttgcggggcggtccggccatcgcgggcctctccctgactcgggcggggcagacctcctggattggagccggggcgtttggggataatgagcaccaggccagcctgccctggacttggccatcctagcgtctactctctatttcacctttcgtcatctcttctactctgtctctgtcagtcg

SEQ ID NO: 19815 - DNA, 201 bp, Bos taurus
tctaggctgtgcgcaggtggcttcttcctcctgggagaccttctccaccctcctggctggcttctggccccggcctactcttcctccaagatgcctttcccgatgacccaagactgcccctcctgggcgttcctagagtactccagactttccttatcacagagctgtcacaacatggtgttgtctctgctctggcctgcc

SEQ ID NO: 19816 - DNA, 201 bp, Bos taurus
gaatgaatgaatgaatgagttagacagggagcgggcactgatgcctgccagtctagacctaactggaaccaagcctgcaagatgctggtgctgccattgtcctctcgacagggactgagggaagacagggtggcccagcagcatcaaagaaggctggtgctcggctgtgatcctactctgaagtggtcctgagagtcccag

SEQ ID NO: 19817 - DNA, 201 bp, Bos taurus
catttagcctgcagtacacacctcctgtggtggcctgtgtctgcattcatctggcttgcaagtggtccaactgggagatcccagtctcaactgatgggaaacactggtgggagtatgttgacgccactgtgaccttggaacttttagatggtaagttttagaggaagggaccttgaaaagcacttgctcttgatctgtcac

SEQ ID NO: 19818 - DNA, 201 bp, Bos taurus
cagggaggcctggcatgctgcggttcatggggttgcaaagagacatgactgagcgactgaactaaactgaagaaccagtaatggtaatacaaagggcaaacttatataacaggcctatacaaagtagaagactatatatgagaagacagataacagcactcacatttattatttaggttctaatagcttctttcagtcttc

SEQ ID NO: 19819 - DNA, 201 bp, Bos taurus
gaaagaggactcttgctttgagctcctccacagagctgttggacactttgaattaaggaaaaatggcaccatgccacgagaagtggccaaagaccagcagctgtgtgaaaagctgactgttctatgctcagccccagggactctaaaaacactttctcgctatgctgtgcgccggagcctgggactccagtatctgccaga

SEQ ID NO: 19820 - DNA, 201 bp, Bos taurus
agagacgagtagcaggtggctcacggcagggaggagctaggcccatcgtgagcatcccagctgcccaggctgaaggaagtaatcctaagttgaggactcaaagccaggggggtcaccttggcctccccctcctccagtgctgctccctaggactgtggctgctttctgcccctagaaggggacatcttcatcttgtacagc

SEQ ID NO: 19821 - DNA, 201 bp, Bos taurus
gggagataatgttagcccttactttgtggagttgaagtgaggattaaatgagataattcctcgaaagtgcttggcattgggtttgcaacaaagtgataatattgtgttctcttgttgctgttgttcagttgctaagtcgtgtctgactctttgtgactctgtggactgcagcacaataggcttccctggccttcaccatct

SEQ ID NO: 19822 - DNA, 201 bp, Bos taurus
tgggcagccgctgctccttggacgtggggttgctcctctaggcctctgcccctgacctcgggcatggggtatacaatgtggtctcctctaaacagactctcacatatgtaccacctggcccttttttaactgtggatgctccacagttacatgtaaaatgttaattcaaattgcatcactcctttgttttaatccctttag

SEQ ID NO: 19823 - DNA, 201 bp, Bos taurus
tttgtgaacctctgctgaggagtagtaccccgactccacccgccccacccccattcccagatgacaccccagaacctatgaaggcaggctggggtccaaacttgtgtggggaggaaatgacaagtaaactgaagaaaatgttctcgacctcaatagaaatccaagaaataagagttatactaatcattagtacaataaaat

SEQ ID NO: 19824 - DNA, 201 bp, Bos taurus
ggacaactgggcctctgagccaggtttcatatgaacatcatcatgtctgggataatagaaaaccatgaaatgtttgagggtgagacgagatataatcagataggcctttgaaataaggaaaaaaacaaaaccttcttacttctgggtagtgtttcatggtatagaggtatcctagtttatttaactgtttacttacaaaat

SEQ ID NO: 19825 - DNA, 201 bp, Bos taurus
tcagagatttcgtggcgtcaaggggggccccacataattgccacttccctggactgctactcacaggatgggcttcatcttgcaactctggccaggagctagggcttcaggtgccctgtctcttgctaagtgggagtgaggaacaatgggcatccatcctggaatcaggtccttcccctccatcttattggcccaacttgg

SEQ ID NO: 19826 - DNA, 201 bp, Bos taurus
cctggcacattgaccaaccctccccacaccggccactggtcttgggatgaacaggagcacaggaaggctcagcttcaggaaaatctttcactctggctgccctgggccatctcaggcacgcagggctttcctcaaaatttttaatgtttctggggagtcctgggacccaccaggactggcagtgccacttgggtggaacat

SEQ ID NO: 19827 - DNA, 201 bp, Bos taurus
tgtctaagcatgacatattagaacttaagattcaacattggcgtagttactgaccataagactaagggtgttacagactacagggaggcggaaaaaaaaaccccaaacaaaaaccattgaagttggggtcaggaaatgttgtggctagggttcagtgggtcaccacaccaatactgaaatccctcaggataatgagaagga

SEQ ID NO: 19828 - DNA, 201 bp, Bos taurus
acacactgtgcacaaggatcgtgtagctctaccctttcctgggtgagcagaaaacccatctcagagccttttcttatctctcctatcccagagagttggactgataattagccaaaatattttaagtgaatttccttagtacggtatccaaaagatagtaggatctcaacaaatgttatttttttttttgttttgattgta

SEQ ID NO: 19829 - DNA, 201 bp, Bos taurus
gctatttataggtctacctacacagacttcctctcatcaaaactgatgtaggttctgccgttgtttatcttttgccattgtcagcggcagagaacaatgcaggagaccagcaagccgcatggtggcaaggtgattacatccaacctttccaacatgaaaagtgagtgttggttgctcagtcgtgtctgactcttcacgtag

SEQ ID NO: 19830 - DNA, 201 bp, Bos taurus
ttctcacttttatgttctttcaattgtagttctggggttcccccaaacctccaaaagacttatgtgcctaaggccggagccagatgtgcttgtgactgtttactgaagctgtgtcaccgtgtggaatatcacccctggagttgtcacatgatcacgtgaccaacaaatgggaaaacatgattgattccaccacagaatttg

SEQ ID NO: 19831 - DNA, 201 bp, Bos taurus
gattactattaacacaaatagtttaactgataagagaaagtgatgggaatcgatttccaaattgttttcttggacactttgttttcgaaggcttgattacgcaatacggatctgtgttttccaggcaaggtctttttggttgagcatcagtgaatcatttccttcatattcagatgaaagatatgcctggttaggtcaggt

SEQ ID NO: 19832 - DNA, 201 bp, Bos taurus
tttagagggggccaaaaggtgatgggggcttcagcctttttaatgcacttcaacttttgcaaagaaaacacaggctgtagacattgctgctgtgtgaaggtactaaaagcaattagtcatggcccgagctccagcactgccaccctggctggaagaatcagcttggagctgccaggttggctttagatcaggagttcaagg

SEQ ID NO: 19833 - DNA, 201 bp, Bos taurus
tgcatattgtatgattccaattacatgacagtctggaaaaggcaaaactatacagagatagtgaaaaaaaaaatcagtattttagcaggggttagaaaggtaggcagttaggagaaatgactatgtgaagaacggaagattttcagagtggtaataatattctgtatgacactataacggtagatccatgatatgcacggt

SEQ ID NO: 19834 - DNA, 201 bp, Bos taurus
gagaggcaatcccaaatgtgctttttgaggaagttggtctcacttggtgtttaggtcaattatctaaccttgaatttttaaaattgttatgggtttaaggtcctacatttgttgtgttatttatctcatctcttttgatcactgaaaaagaaaagtaagccccaaactgcttattgtagtatcattacagtttatagtagt

SEQ ID NO: 19835 - DNA, 201 bp, Bos taurus
ttgattcaaagatgagcctaaaaaaaaaaatgagcctgactgctgacatttggctatagaaatcactagcatgaaccgtgtataaataaaagttctggaggcttctgtttctagtaatggcagactggataatttcaatgaaccttctgtaaaggacataaagttctggataaacagattttaaaactctgtttgaaaaca

SEQ ID NO: 19836 - DNA, 201 bp, Bos taurus
gactaataaatatgaatttccagagcctaataaggtttctgattttgctttctacatatttggccacttataaaaacatctatagaatttcctgataccaagttccaattcatatcattttttcaatttacatttttatttttttgacaatctctgctgtacagtcatgtgtactatataaagtgtacactataaagtggc

SEQ ID NO: 19837 - DNA, 201 bp, Bos taurus
gccatccatcccaattgtgacagagtaggatccagtgtttctttctctctgtctgtctccctctcacacacagaaaatggctcaatgacaagtaggtggcgtctcaaagaaatatggctaaaacaaaatacttgagttcaattgttcttagtcatttctctcttaaagagcatacataccctaggagggcctgttaaaaat

SEQ ID NO: 19838 - DNA, 201 bp, Bos taurus
ggcacagcagttgctcaatgtttgtgagatggatggatggatgaatgaatgaataagtgattaagagatgagaggcctacaaataggttccattttggaatgtttatcctgcaaagatgaggaagcatcagggcaggtggtaggcagaaacagagcagagacgggggagtgggggaagacaggcctggctctggagagtgt

SEQ ID NO: 19839 - DNA, 201 bp, Bos taurus
gtctaggtcatttatttttagatttaaactaaactgttagtgcacagagacaaaggtaaatatcaaatgtatgggtatatactcaagtcaaaggagatgagtcaaatttgcaaatgacatagattgagaaaggtagctaatatggcaaaaaacagaaccaagattcaaaactactcagactgtaggaacaagaggattgaa

SEQ ID NO: 19840 - DNA, 201 bp, Bos taurus
atcccaaggctgtgcactgtgaacccagtgttattagcaattaggccagtcactttttgggatcagtctcttcagtgtacacccagagatgcttacacatgtgacctgtgtttcccagggcccttccagtttgtgtgtccaggatagcttatcttactttgacaggattctggtaggcaatgttacaggaaggtgtttgtc

SEQ ID NO: 19841 - DNA, 201 bp, Bos taurus
taattctgttccctgtgctcttggcataacttttcacagaactatcttgaggtcttgggttaaacatcacttctatatagaattctactctggccacccagtctaagtagccagactttttattaatctcataacatcacctagtttgtttcttttctagcactttttacaatttttgattgtacacttgattattaatgg

SEQ ID NO: 19842 - DNA, 201 bp, Bos taurus
acttggcaatgagtgagccttagctaaaaatagaatgaattggcactaaacactgctacgatatgctgtatctaagcattaatatgtgcaataaatctgatatgattaggatatttaaatggaatttatttgtcttggcatgtatagatatttttatatattccaaactctaactagcactgcccatgcagaaaaaaatga

SEQ ID NO: 19843 - DNA, 201 bp, Bos taurus
aagagggaagaccgaagtctaatcttggattaacaacccatcatttatacatgctcaattcattaaaagtaagccactagattcaacctacaattaaggaaagaagaacacaaggacttgaataccaggagaagggtcactgggaccatgtcagacactgctgattgcacacacagttacaatcatattcttatatgacat

SEQ ID NO: 19844 - DNA, 201 bp, Bos taurus
acttgagaaactaggaaagaaaccttatcaaatatcaaatgttatttactagtgagaaaacataattccctcctggttccccagagtttaggccatcctgtcatcactccatcccacaagatccaatttggtatcaccattacccttccagaaattggaggtttgagtgtgtatttagatggtgacaaagccagtacatta

SEQ ID NO: 19845 - DNA, 201 bp, Bos taurus
tattggctaaactagccaacttggcccaggacgatttgatacctaagccaagcaggctcaatcatatgctcccctaggaatctgaaacttagaaacaactgtttaatctctgcatgtggctagaactgtgactgtcaattgggaagggcaaggtggtcatactctatcattgagtacatagagagatcccattaggaaaga

SEQ ID NO: 19846 - DNA, 201 bp, Bos taurus
cttagggtgatgtatggaggcacctggataaatctccagcctgcagtaagtagccaaagggtagcatttgctgagttgtgtgttgcaaacacatggtgaaaaattataattttatcaggagatttgaaggaaggcctgggaatatattcaataattttgagaaaccgctataaagtcttcacttgctatgttcctgaagat

SEQ ID NO: 19847 - DNA, 201 bp, Bos taurus
gagtttgagtgaactctgggagttggtgatggacagggaggcctggagtgctgcaattcatggagttgcaaagagtcggacatgactgagcgactgaactgaactgaactgaatgtatatacagtgacaaagacccttctttaaggctctctcttgctttaatgcagtggaactcaggggaacaatttctaccaccttccc

SEQ ID NO: 19848 - DNA, 201 bp, Bos taurus
ccttcaaagctgatatacattgttcatttccattgcactcgagaaaagactgtatagtattgagagagttaattagattgtattcactttaagactgtgtattattggaaaacaatctggaaacttaatgtacttgatttttgaggcctgaatatcttaggagataattggttgattttttttcagaaatgcttgaattta

SEQ ID NO: 19849 - DNA, 201 bp, Bos taurus
tgtagagtttatactctagatgaagaaagagacggtgaaattaaaattgcaattccttccttaaaactccctgagttccttacctttttttcttccatagcatttatccacatctaagactttattttttgttaaatttcatccacagaatactggttacatgagaacaagcaagaatttctgtacgttttgctaagggac

SEQ ID NO: 19850 - DNA, 201 bp, Bos taurus
gaaacatcttggacacaagttttcagaggagatccagacagatataagcagaattttgaagctaaccttttaaaacaagcttgagctatattataacaaactccccaaatcttagttctctatttttaaatcatgtttgtgtgtctatatcaagtaatatttttctgaacacatttcagctagtatacaaccatcaaatgt

SEQ ID NO: 19851 - DNA, 201 bp, Bos taurus
tttgttcaacttaatcaagaaggaactatcatagtgaagccagggagatgaggatgagcacaaaatgtgagcagggcaggaggtcttattatattaacagcgagaacatacagtaataagagagtgaagataacacttcaacatttaacttgcatttgcattgtacaatgatgacataaatcaaagcatagaataattaca

SEQ ID NO: 19852 - DNA, 201 bp, Bos taurus
aatctaatatttcattgaactaatgcttatacaggcatttacattgaaagagaacaaaatttagaaatatggataaaacattaatatgtattagcaagtggtggcatctgttttagaaagaaaaaagatttggcaggatttcaggaatctattctgattaatcctcaacacagctcatacaaggtcatgttaaaaatattt

SEQ ID NO: 19853 - DNA, 201 bp, Bos taurus
attcagtcaacttctttgaataaaattttaagaggagttagaacattggccttctcttgataaagaggtttatagtagctatatccctcactaaactttgtcttctctctgccctggtatcattgaaatcgtttcttgtgctcaacgtaagacatatttttaaagatcactctatttgtcttttaatattaccctctcacc

SEQ ID NO: 19854 - DNA, 201 bp, Bos taurus
tgatgacctagaatgtgtgtatcatttaacttcatcaatagaagattccttctcttccaggatgtagttagaacatttgacattaggcctattcctttcaatagacatatttttggctgaaagtaagagagatatactaatgaagctgaccttaacaataagtaataggcttaaaagaaaaatttactgagggcttactga

SEQ ID NO: 19855 - DNA, 201 bp, Bos taurus
aaagggagcaagactagctccagggtagagactgccatcgccagagcacctgtcgttgcacacactcagaagggaacaagcctaagtgtagggtgaagaacgcttagtacatgaagaatgaataatgatgctgcacataaggaaccactttcaagaacaaaatactaaccatttcacccaattttacaaagacaaagttaa

SEQ ID NO: 19856 - DNA, 201 bp, Bos taurus
gttggtgatggacagggaggcctggcgtgctgcgattcatggggtcacaaagagtcggacatgactgagtgactgaactgaactgaactgaatgggtttggtgtgacttttggcaacctgtgtattgaagctcagctatgttcctgtgttgttggtgaatttgcatggtatgtctttctctggaacttgttggcccttggc

SEQ ID NO: 19857 - DNA, 201 bp, Bos taurus
tcagtgtttgtttcctataatataacatgtccgctctgtaattagatacatcaaaatagctagctagatccttatttggcaattcattgttctaacttgggctgattcctggtttattgtatccattcagcagatatttttctcaaagctgcactctgatacaacacccagcctgttttcccagccacccacctctcttcc

SEQ ID NO: 19858 - DNA, 201 bp, Bos taurus
tttttctgagattttatcttgtaccttcatctgagacataactttctgctttttcattctgattaactttctgtaatgtggtttttgttttagctgctgttggactgttggtcttcttgcttcttctgtctgctctctggtgaataaggctaagaggctgtgtaagcttcctgatgggagggcctggcagtgggaaaaact

SEQ ID NO: 19859 - DNA, 201 bp, Bos taurus
tgtaatgtctctgcttttgaatatgctatctaggttggtcataactttccttccaaggagtggaagaagtcagtaacaaaaagctgtttcatatgagtctatatgtatgaaatatccagaatagacaaatctgcagagaggagcttggtagtaggcagggactgagcagcagaagaaatggagatggactgctaatgggta

SEQ ID NO: 19860 - DNA, 201 bp, Bos taurus
gaacctgggtctgcccaccagtgggccagcaataaccctgggacccctgaaacttctaaactagcagtcttgggatcctgcccaacacatcagtaaccagtagcttttacacaaggcagggcctggcaaccaaagggacaaagccagccatacctaatgaactgcctacagtagtcaacttgccacgacagactcatgaag

SEQ ID NO: 19861 - DNA, 201 bp, Bos taurus
aagaaattgaagatctcaggtatagtttatattctgcaatatataatgcacatatttgggttttgcagtaaagtattattgctactatttatttgttgggtttattttatgtagggcttcccaggtggtgctagtaataacccacctgccactgcaggagacatgaaatgtgggtttgatccctggatcgggaagatcctt

SEQ ID NO: 19862 - DNA, 201 bp, Bos taurus
gatagctgggcccccgactgagcagttgaaatttactcctgtagacacttcaagataaagataaggcaggagcagagaggagctggaccctgtttcagtataaggaggccacataattatcatccttggggttaaggagacctctcagatcatacatacacagaaaggatcttgaggggtcagagaatggaggggatgcca

SEQ ID NO: 19863 - DNA, 201 bp, Bos taurus
catctggatgtcctggtgccttgataactaaccagtacacagctttgatggtgggcaggtcgagggtgccctctggtggccattcaacatcaaaggatgggtattcgagctcacgtaagttatggcgcttccagggagtcatcttgactctgtaatctcctatgaagcccttttcaaagttaccatgcaatctaaaatcgc

SEQ ID NO: 19864 - DNA, 201 bp, Bos taurus
atgctgcctggagtccctgggcatggtgataaatttctaatctcctgtagggaatatgggaatcaaatggggggaaaggaagttttccgcatttgaaaaagctgggtacaataacatggttgataggtggttgatggattcagatattttcattttcatagggaagaactacaaatattggtcctggggccatattagtta

SEQ ID NO: 19865 - DNA, 201 bp, Bos taurus
ccccaataagtactccccaggtgagcgctgaggagctcagaggcatgcaagaaagcacaggagggtacagagagagtacggagagatataggacctggagcctttgcctttactaggtctacaggtagagtgcttcagtgttcctgggctagggttgaactgatctattcaaactaaaataacaaggctttgataaaccca

SEQ ID NO: 19866 - DNA, 201 bp, Bos taurus
aaagagcccattcaggagaaagctcccaaatataactgctgccagtgtccatgtccctagagagagcaccaagaccagcaggtaggtatggcccaggctcctattgaattactgcttttgctgggtcttggtgctcatgagattttgtgtgtgtcctttaagagtgaagtttgtgtttcacccagtcctttggaattctct

SEQ ID NO: 19867 - DNA, 201 bp, Bos taurus
agcaatatccctttttgttatactaattcagctcctacaatcttttatcttcctcctctaatctattacacttcagcattgcaccaaataccagcattttgtgtttatgtctcactgtgtgttctgtgtgtgttcaacctagttttgaccataaaattagtgtgtgtgtgtgttagctgctcagttgtgtttgactctttg

SEQ ID NO: 19868 - DNA, 201 bp, Bos taurus
ttctgtattctctttgaaggcttcgaaacttccaatgtcaataattatagtaggtgttggaccagcagaatttgatggtgagtaacaaaatttctatagcgttaattgggaatttattaactgtaactcatcatgtacttacatatctatcactcttttgtttgcatatagggatatgagtgtgcatgtggatttgtatac

SEQ ID NO: 19869 - DNA, 201 bp, Bos taurus
ctccccctggcaaccctgctcagcggaagacacctgtactctgttcccatgggcagcctggagaggttggcacttggaggcccagagaacgtcagctcccgtctatgagctatgtccacgtgtaaaccaagatttggggaagggacagggtgagttgggaggctgacactttcttaggccgtctcctctggttcctcaggt

SEQ ID NO: 19870 - DNA, 201 bp, Bos taurus
tatattatgtgacttttaatgaaataaatttttttaaaaaaatgggttgctaggtcttatccgccttttaatggataaaactacagagggcttgaaatcaatggagactgttttggagcttgggtgccacaatcttcaaagcaaaactggagtatctttttattacgctattgcttattatgtacttctacctgtaaactt

SEQ ID NO: 19871 - DNA, 201 bp, Bos taurus
agtttgtgctttcctaatacttccataccgaaaattggatacctttaaaattggggttggttcaggcaattgagtcaccacagaattggtaagcctgcccgttgcgagttcactccccttcctaaccctcccacttcaatgtcttccaactcccctcccaaagattactttcctgatgcattagcaggaggagtttcgatc

SEQ ID NO: 19872 - DNA, 201 bp, Bos taurus
ggacactttagtttacttattttaagaacacttgaagataaagcttaaaaattggtttggatttccttgacatcacagttcctaggccgtaacaagatgtcctcttgtaaaacagattacgctaactgaatcttccaagtggttgtcaggacaaccttttccttcttctcagctaggattcaactgagtgttaacctggat

SEQ ID NO: 19873 - DNA, 201 bp, Bos taurus
acttcagatgagttatcaaaaatttttccccaggggatttggacttagaattcagctttccgtaattccataatagtgagactaaagggaaacattggggagaaaaaaaaagaatcattcttttcagcatttgcaaactagataaatggcttgatgagatctgaatattatgtattaaaatcagcatggtgatgaggatat

SEQ ID NO: 19874 - DNA, 201 bp, Bos taurus
attttcctgttgcttatttcctataatgtgacagatgtttcctttccttctattaaaaattcattttctgtatcatggtcaactagtttataaagtgagaatagtgtcaaatgactgtgctctttgtagagggcagaaatttctagatctggaggtagaagccatgaggtgtgaaacgaaaaactcatcagaggtcttttt

SEQ ID NO: 19875 - DNA, 201 bp, Bos taurus
aaattttaggggagaaagtatacttctgatttaaataatctaatcccttacttaaagtattaagtaatttgcagaagtgaaatacaagtatgactgaaaacatgattacggtctcgatcaggtcaatatttttcaataataccatgataacatcaagctattaacttataatactaattcatacagaaggcttcttatcag

SEQ ID NO: 19876 - DNA, 201 bp, Bos taurus
ggagagtagttaaatattctggaacaagattttttacaggagttacaggaatactttgtaagaggtgccacccccacaaaacagggtagctcacatttcacagaaagacagagagggcatcaaggggagatgaaaacacatcactctttctaatccaacacctgttactgcaatctggtatctgaagctgccttactagat

SEQ ID NO: 19877 - DNA, 201 bp, Bos taurus
tacacattacataacgcagagaatatacaacaatttcaaactactgtactgacttctcaatgctcttaatcataacttacaaatgaatttcatttatagggaaaaaaacagcatgatgttcacaaaaatatgtttggctaacaatgataaggagaaaacatacaggttacagaacctagggggaaaatattctaattcgaa

SEQ ID NO: 19878 - DNA, 201 bp, Bos taurus
cttcttccaggggccttctaggaaacacaacacaccaatgccacttaaatctcaaccctcaactacagaagatttagactccagacccttgtgaagatagtataatggccaacattttgtggagagacttcttttttaacttccgcccagagccaattctgagactgcatctactttactattaacacagtcaagtttctt

SEQ ID NO: 19879 - DNA, 201 bp, Bos taurus
atcccctcctcctattgtgccccccaggttcctcccttctggcaaccacctgtttactctctgtgtctatgaacttattttcattttgctttttgtcaattcattttgtttttcacacttgtgagattctgtgagtgccctttaggagcagagttgctatttcctgtagctctccacctttctacctctcctgaacttaag

SEQ ID NO: 19880 - DNA, 201 bp, Bos taurus
actacagcagcttaattactgtcgtaatgcattcagtgtttggagacaatatgaaacccttattatacactttacaattaatttgcaattaatttagatacgcagttgtgctgtacagaataaaatgcacaagtataaatataaatgatgaataataagccataatgaacgatcaggatctggaatcctctaaaggacaac

SEQ ID NO: 19881 - DNA, 201 bp, Bos taurus
aataagtttgcaacttccaagcttcactagttctggatggtcaaaggtagaggcaatttcaccacctatgaacaaaaatattcattaattaaatgcacaataggtttgaaatttccgctttcttacaagcaaaaatgaacagaaaacatattaagttgactgcttactatatgccaagcactctgaagcactttatacaaa

SEQ ID NO: 19882 - DNA, 201 bp, Bos taurus
atatcggggatatccattgggtaagttctgagcagcaaaccctggagctgagtttgcgtttattggtttcagaaagaatgcaggggtagggcacagagaagaaaatgaatgaggatacaatcagaactgagaggtttaaggaggtgtttctggtaagatacataagaaactagagcaaaacagaacctccctccactttta

SEQ ID NO: 19883 - DNA, 201 bp, Bos taurus
gctatttcctccctcatccatcttggccatgctatgtcccctctccttcttgctaacagctcttacactcaattactgggcaagcaccaatactcagaaataaaacattttatcagattgtagcctgtggcaagtaagaaaaatagccacaaagtgaaaaatgaaaaaaaatcattcaattagttgaaaatagataaaatt

SEQ ID NO: 19884 - DNA, 201 bp, Bos taurus
agaggccctgcatcctagtaataacggggaaggaagggaaggtgggcccagggaaagatgtgaattctgttttgatggccagcagaggaaaattttgtatgagttgcttctgttctgtctttgtaatatgaggccaggtcatctactgagagcacatgtcaaataccagtggttgggcatgtttactgggagtttgaaaag

SEQ ID NO: 19885 - DNA, 201 bp, Bos taurus
aaactctaaggtcttcctcaagctttctggactctgttgtttcttgagatggtggaagtttctgggcaggggattacctacagaagtttcaaaaaactattgttgactcatcttttggggaagtagggcttagagacaaattttgtttgatttagagaaataaagcaaagtggtggttcttgcacccatttatggtatagc

SEQ ID NO: 19886 - DNA, 201 bp, Bos taurus
gtcatcaacatacaaagcaacaaaaggaatttgcatgacagtcactgattcaagattggcacaagcctggtaccactgacttttttgacctcgaggcctgagggaccttagtcccccaaccagtgtttaagtctgtgtcccctgcattggaagattggagtcttaaccatggggccctgggccacaagggaagtcccccat

SEQ ID NO: 19887 - DNA, 201 bp, Bos taurus
accccctcctccaccaaatgagcagttgtcagtgaacaaccattagaggtcctgctcagccattggtcagtgctgcagtgggcccctcccccagcaagcagctgtcaaggagaaactgttactgggcacattcagccagcagtgggggagtggtggtcctcaggtggagagtgaggtaagaggtggatcctggccttctcc

SEQ ID NO: 19888 - DNA, 201 bp, Bos taurus
ttatatcaaataccaacatgcatttgggttaagggaaagagattaaatcagaacttcctatctggtgatttaaagcaattggtattctttctagctctgtggtcattcaatgcaatgtaagatagtagtttgctgagaaggtaggaaatccttatttgagtttgtgtgcaaataaacagacattaaataaaaaatacaaaa

SEQ ID NO: 19889 - DNA, 201 bp, Bos taurus
ttagatccctcttcacccctgaaacgatgacgacaggcttccttctcacctctggcattcccacccccatcggccccaccctggcctgtttcaacagcatttcctcaaagcctccttccctaacctattggatattaggtccccagttatactcatatcacctggccctttaccctcacagcacaattttaatgtctcatt

SEQ ID NO: 19890 - DNA, 201 bp, Bos taurus
gccctcctcccgggcggcgacaatctcgcctcctaccaacaaaatctccacaaacccacgtgccccgcgccccccaccacgaaaacctaaaggctgcgcgaggggccgagagcgagccgggagacacaagtcacagagcaaaccccgaactgcccacgcgcttccacgccgatacctgatgctcactaactggggttttcc

SEQ ID NO: 19891 - DNA, 201 bp, Bos taurus
aactagtacatttcattaggaaggcaacacgacaatctctcaaactttgtcccaatgatttcacttccagaaatataggaaatcctcaaatatgtaggtgcgaatgttcattgcattgattactataagaaaaatactggaacaatttaagtatgtccagcagaatgtctgaaaaaaattatggtacatttatacttaagc

SEQ ID NO: 19892 - DNA, 201 bp, Bos taurus
tccactttcattaacagcctcggtttttattattactctgtgagacaggcattattgcatctatttaacagatgagtaaatgcataaccagtgaagtctagtaactgaccccaagtctcagaactttgctctgagttggatttgtgcttcaactatctagttccaaagcctatgcatctcactgcactttctccctctgct

SEQ ID NO: 19893 - DNA, 201 bp, Bos taurus
ccagagaggagcggctgcacccatcacgtcgcactgtaggctcaacgagtccgacttccaggagccctacatcttcaaccacaccttcactctggctcaggaggtactcatctcagtctttctcttttgcatcttatctacttggaacctgaatagttcttaaaatttcttcagaggacatctaagatctttaacagatga

SEQ ID NO: 19894 - DNA, 201 bp, Bos taurus
aaacatagcatctcatctcaccttatacctggcgcttcaggatatcactgacaattgtgattacacccaaatggaaagtaatatgtttgtttagtttatctatatttaatatatatgaataaagtataatttcataactatgtatgttgtgtcagactttttctaaaatgggggctgggttaaatgaaacacagactaata

SEQ ID NO: 19895 - DNA, 201 bp, Bos taurus
aaaatcccatgtaatctttcactctaaaaagagaagaaatgagcaataaaagaacatttcacaagatatatgttctaattgtatttttaattgaatctttcattaggacattgggggaagagactggaggaggcagtatgcatgaatatcaaattactaaagtaaccaagagggtaaatggatcaaatcccagaaaaatta

SEQ ID NO: 19896 - DNA, 201 bp, Bos taurus
aattcgctatgaaacatttttacatttgtgtttacctttcaatcataacttgaaactaatacagccatgttctaggttagctgaaagacccatctggatttgattgtaggcctcaacttggaatctgcatttatagatatccatacattggcaacaagtggtattacttgaattgccatgagctagggaggagagatggaa

SEQ ID NO: 19897 - DNA, 201 bp, Bos taurus
aagcacatctttggagtccaggaaaagtacctcctttaggtaacaaaggcaaaaatcagtgttttcatgacctgttttaaaataaggctacctaaaatctaagatggcaatggcttcttcttactgcctgggcctgctctcttcttgaagcagtgaatgcctccgctgagtaaaggactttgaagtaataagaattgccag

SEQ ID NO: 19898 - DNA, 201 bp, Bos taurus
ccataacatcgcagaaaatttcagaggtgagagaaaaagctattattttcctaataatcataattctgttgctagctatggaattgttgactttggagcactcctcaattaaattaacccgtgagtcaaaaagtatcatcttggtagctatgtggtattcttcaaatctcaaatcccttgcttaaggttgcttttctgaaa

SEQ ID NO: 19899 - DNA, 201 bp, Bos taurus
ggtggcctctcctgcttctcactttctctgcggcttccgaggcacctccagcaatctcaaggaatcagatggggcagtcgctggtctcggtctccccagcggacagtggccccagccagatgttgcaccggaagccttcacacccctctcccattaggcagtaatggcgcccgggctgcagggggaggggcgccgggcagc

SEQ ID NO: 19900 - DNA, 201 bp, Bos taurus
ctagaaaagatctgtatgagccccaacaggtcttcatgtgattaaaaatgctgctgatgagagttttgtatacacatgggcacttgggttgccaaggaggacccccaaggaaagttccaactataaaaaggttccaggctccttgagagagaaaaaaggaaactgagggcctgacaatcagagccccacaccccagacacc

SEQ ID NO: 19901 - DNA, 201 bp, Bos taurus
aacagaacaaggacattttcatttattttaaatacattctatcaatgttagtgtaattccaaattagatcatttgccacaatcaagcactctaaccagcataagtattttacttatctgttcttccaacttttttctaaaagttggctgagtgagtgaagtcgctcagtcgtgtccgactctttgcgaccccatggactgt

SEQ ID NO: 19902 - DNA, 201 bp, Bos taurus
ctgtcatttgccttccagggggccagtctttcttcagcaggaaggattccattcgcaccatctatacttccctgcacaacgagctgaagaaggtggtgaccggccgtggtgcctttgggggcactgctcctcacgtggaagagctcctttcccacctgtcagagcagctctgcttctttgttcaggctcgcacagagattg

SEQ ID NO: 19903 - DNA, 201 bp, Bos taurus
gctcactgcatcacaggcctcatggaacagccagcgccccttcctcttgagagagcaggaggttttctttttgagtcacagctccgtgtggtttggattcgggctctggatcaggccggcttcaggcctcagacagtgccactgctgtttggctctgtcatcgtttgtgtgaataaacgtggatttgtgtggattatggaa

SEQ ID NO: 19904 - DNA, 201 bp, Bos taurus
tcaattaatattcatggggctcctgctaggtgacaggcacgatgtcaagcatttggaatataatagaaccaaatggagcaggcccccctcctgacacttaggtcctggaggaggctcttccacgtctggttagacatttgttggctcctccccacaggccacactgaatgacaccccagactccactttctctgccttcct

SEQ ID NO: 19905 - DNA, 201 bp, Bos taurus
agttttctattgagcattattttatgtatgcagtttcttcaactagctataaacacctttgagagcccttccgaagacttctgtccattcagcaaggacacagttatgaacatacacatagtagattcttaatatgctgtgttgtccagtgaagcaaaaggctgacccctctgtgagaaggtatgggtttccgcccatttc

SEQ ID NO: 19906 - DNA, 201 bp, Bos taurus
tttaatgagaagccacaataatgaaaatacataaaaatctatttccataatttgtacattacagaaactaagattaatagcaaaagtaaatggccaccaccagatctgcttactttgaagaatggttccataatggtattctaagaaactgattagaaaagttaaggcctgaccagtgccataactgataataataatagt

SEQ ID NO: 19907 - DNA, 201 bp, Bos taurus
agggatcttcagcacctagcttttcttttgttgtaaaaagctcaatgcaatcttttaatttcacaaagggttttttaggaggtttgtattccacactttcgtgtttttcaaaatcctaaagagaagtatttcttgagttaagaaaacaaatgaaacaaaactaattttagtgatatcatattactatgaatagtcatgaaa

SEQ ID NO: 19908 - DNA, 201 bp, Bos taurus
cagttttgtcctctatgtaagggctttttggaatgtgtttattgacaccatgactggcaatctcaacacattttaaacagtgactatatctatattctctttattgaatatgtacctctgcagtcaaaacacaaactgtgcattacatgagagaatgctattctggtttcaaatggtatctataaaatttccagaaacata

SEQ ID NO: 19909 - DNA, 201 bp, Bos taurus
ataaagcaagtcacaagctttggttttccagtgcatgtaagagttttgtgtatactatagtgtggtctagtaagtgtgcagtagcattacatctaaataacgtacatacctgaattaaagaatgctttatggttaaaacatgctaaacatcatgtgcaccttcagcaagctataatctttttgctggtgggagagtcttgc

SEQ ID NO: 19910 - DNA, 201 bp, Bos taurus
agtgcaaaaggaatgatttcactttgattgcattgcccctctccccacactggcacagcaccaaactgagaggagcctcccttggccttcagtttctccattgggcaaaagaaagcccaacctacgtagacattcttcttcacaccattgtcagatgctccccaaaagggccacttggatcttgcctctaaggcatcactg

SEQ ID NO: 19911 - DNA, 201 bp, Bos taurus
aaccaaactgctgggagttagaagatgtgtgtagtagccagtgtttgggccacaaaataggatgcacggattgaacagcaaggctctgagagtgaccgatctttgagactacaattggacacactctgtggtcctggcttgggcacaatggtgagggcactgatgagaagctagggtcttaaagattttggatatgaaact

SEQ ID NO: 19912 - DNA, 201 bp, Bos taurus
cagttctctggctgatttcccctggcagtccctcctatcaggctctgtgttggcagagttgtgcatggaagcagtttcagagataaccagcttctactaatcgtgctgtttcctaccctttacaccttaggtgcatcacactaataaaaggctttgtacttctcagccttctctgcatcttctggaaatatactagctcct

SEQ ID NO: 19913 - DNA, 201 bp, Bos taurus
ttgatactgaaatttgttaattgcttcagtttgctagatatctattgtgactatgtttccaatagtaatcaaatatttgttgctgtttgttagatttcttgtgtttcctttggatgtcttacagaaggaactggtgtgccaattgtcattcttttgataaatgcagaaagaatgaatgacctaaacatgtggtattccaag

SEQ ID NO: 19914 - DNA, 201 bp, Bos taurus
aaacagcagaatgggaactgcttcttttactaagggcaaactaaggttgaaataaagataacctttctattaatactaaaccagaaaagactattaatagatttacagttgagtggtatggcttggtcatagttgtttctttaatactcaaaaggttgaagctgactattcctaaccatggtctccattttctgtataaag

SEQ ID NO: 19915 - DNA, 201 bp, Bos taurus
acctgctgcctcccgaggagatcctccaagaccagcaggtaggtctggcccaggctcctgcgaagtcactgctttggccctgagaccttgtgtgcaggttccaagagtggcatctctgcctccctcagccctgtggagcttctgcgcttaggacctgctggccttcagagcaaatgctctgggggtgggggtggggggctc

SEQ ID NO: 19916 - DNA, 201 bp, Bos taurus
aaattcagcttttctttcaaaatttttcagaatgtcctaaagtggaagtgatttttctactccagccccaagctcctcaatacttctttcaggtaaaagtaaaatgaaaagtaatcactaccttattcaaagttttatgtcacattgttattttcttatatacttaattattaaaactattagatctgtgtattagccata

SEQ ID NO: 19917 - DNA, 201 bp, Bos taurus
aggcattgcttgtggaatgtgaaacagtacaaatcctctggaaaacattttggctgtctcttataaagttaaacatatatttaacatatgactcagccatccaactcctgagtatttaacctggagaaagaagagtttatatttatggaaattcctgtacatgaatacatggatatttataacagctttagggttccaaat

SEQ ID NO: 19918 - DNA, 201 bp, Bos taurus
tggctgtctcctgtgcttttcctcacaagagaacacgatgagactgttctcccaacacaatctgtaaaattcatcctatcctggccaagatgggagggacaatcagcaagcagtgatcattaatgaaaagtaaaaaatatagatgagaatctatcatacagttggccttactgcacatacactccatttcgcctctcttga

SEQ ID NO: 19919 - DNA, 201 bp, Bos taurus
agtaagggatgctgtatgtgttaaagctatttcaaaactgactgagataaccggcaggtaatattcatatatgtacagacataagcaaagctattatgccggtgtggaactacccagtttgttgacctaaaataactaacaaacattcactaattgaaaaaacgaggggaacaacaaacaaaatcttacaactaatagctt

SEQ ID NO: 19920 - DNA, 201 bp, Bos taurus
attttggtagaccccgggagttggtgatggacagggaggcctgtcatgctgcagttcatggggttgcaaagagtcagacatgactgagcaactgaactgacctgaacgtaaggttggcccgttggtttgtgtaagcttctcatagggtgagatttgtgctgtttttgtttgtttgtttgtttgtttgtttgtttgttttcc

SEQ ID NO: 19921 - DNA, 201 bp, Bos taurus
ggacaggaatgaagaataggttagggtttattctcagaattgtttaaagagccagctgacagtgtgttgcaccggtcttcaaggctcagctgtatggcacttgggagggttacctgctctgtgggcaccaaacatttcctgtcctgactcctttggactgcccctgtcacctccccaccccatacctttgaaacccagtct

SEQ ID NO: 19922 - DNA, 201 bp, Bos taurus
acttgtgcagccagagcttcaagtcagaggctgcctatcgctaccatgtcagccagcacaagtgcaacagtggccttgacacacggcctggttttggactccagaacccagctctccagaagcggaagctgccggcagaggagttcctgagtgaggaactggcgctgcagggccaacccgggaacagcaagtatagctgca

SEQ ID NO: 19923 - DNA, 201 bp, Bos taurus
atcccccttcttggggtccttgttgaagttctttctaactattgccatgttctgatcctattgcaaggactcactgccctcagtggcctccaggcaccctcgctcatggcttcattgagctcctaccacaggtggtggatctccagcagcagcttctgcgtcaacaatgagacattctccagctccatctgctccttagga

SEQ ID NO: 19924 - DNA, 201 bp, Bos taurus
cttctgagggtttaaagatgaagaatgagttagtaccagtagctaagtagcacctcagtcttattagcttattaaagaagaaataaggagttctctgtccgtgtgtttatctattgaatctcttgacagtacagctttcccactacaaaaagcagggtaaagatcccacagtgtcagacctggtctgatactagctgcttc

SEQ ID NO: 19925 - DNA, 201 bp, Bos taurus
gtgcagagacccccggccccactcctaggctgcctcagaccccaggctggtggtggggctgcagctggtccccactgaggactgagtccctccccttctcgcaggcgcggcatccacgacatgtttcccctgcacttagctgttctctttggattctctgactgttgtcgtaagcttctttcctcaggtatgagctgactg

SEQ ID NO: 19926 - DNA, 201 bp, Bos taurus
atgtaaaaacaaaataataggggaaaaaattgtagaaaaaagttactggagaaaacatatattgaatgtcacagtgcttgtgttaggatgatttctttatatttttgaaacgttttataatcatttttattactatatagtgaaaagaatcccaatattaattggaaaaaacaatcatacccaacaaaccatacaaaaatt

SEQ ID NO: 19927 - DNA, 201 bp, Bos taurus
gtgtcccagaaatagactcgagtgtatgtgggaatttagtatatgatgacatttcaaagaaatggaaaaagaaagattattcagtaaatggtgctggatgaagaagtaacaacccctgatactaagataaattcaagatgggtcaaagaatttaaaagtaagcaaaatttgtactagcagaaaacatgaatgaatgtttta

SEQ ID NO: 19928 - DNA, 201 bp, Bos taurus
aggcgggtgtccagcaaggtcaggctgatgatggccaggtttccagacacggtcatgaggtaggcaagcagcaggagcaggaaaactgccacctgaagcccttggtgtctgcaggccttggaggaagaactcagtcaccaaggtctgattggccattgtagatttcatgtccttgccagaaacatgcaagcccgggcagat

SEQ ID NO: 19929 - DNA, 201 bp, Bos taurus
tttattttctctagatataaatcaccctgtgtttctcctccctttcatggccaaatgtttccaacatgttgtttcttgtttttttttcatgtctcaacttatctctatccatatataacttgaatctggttttccctcttatctctctctcaaaaacttttttctgaagtttccaatggccactgtgtagctgaaaattaa

SEQ ID NO: 19930 - DNA, 201 bp, Bos taurus
attttgctctacaaatgaggaagctgaagcccaggttgggaaggaaattactcaagccaaacaacagaacccaggtgtagtggccttggaaatgggctactgggatcttctgtaaaagagcctatggtagtgggcatcgctgaccaccatggatgccatgttacttgtgtggtgctcctagttaatgactaagcacaagac

SEQ ID NO: 19931 - DNA, 201 bp, Bos taurus
gagaacagacaccaggcgaaaccaatgcatttccctgaaataggcttggggccattgagttgcatttggggaggggattgtgggcatccagagcatggtccagaagtggtagtgcaatatcaaagtggacacattctctcggtccactgattcttcagcccatgagctctctaaaactcgggattcctcttgcctgggtct

SEQ ID NO: 19932 - DNA, 201 bp, Bos taurus
gctgagacttcatgcaaacatattctcctttcaggttgcatcttcacatagtttctctaagtgttcaaggttaaagagtacaactttctgtatgtggtcacttttttccacacgtggtggcagtgcttctgtttcagcaggttttcatacacacctttttctctttttttcctgtcaacagcagtctccaaactttcacaa

SEQ ID NO: 19933 - DNA, 201 bp, Bos taurus
ccgagcctgaggtgttcttgctgcctggggcccggggttggggtaaagataaagcgacttttcacgttccactttacacactccaaaatcctgtttcgtccagtgatgttgagaggcccgacagccctttggaatactgagcccagcctttgagtattctcaagtaaatgtgttcatttagcaaatgtttactgagcgcct

SEQ ID NO: 19934 - DNA, 201 bp, Bos taurus
agcactgaggcagaaagtacattgagggggccaggatcgagtgtgcccaggtgttccctataaaggagcagcatgtgctctgggccccagattggcaaactctggtgctttccatcatctcccatgaacgcgagggttttccaggtgcagccagcattgcagcatcccatggaccccgagcctcttgtaagactgacatct

SEQ ID NO: 19935 - DNA, 201 bp, Bos taurus
atgatgcgggcggggaccacgctggtggagtgcaagagtggatacggcctcaatctggagacggagctcaagatgctgcgggtgattgagcgcgcccggcgggagttggacatcggcatctcggccacctactgcggagcccactccgtgccaaagtaacctcaacagaagggactggagtttaattcgggcagttgaaaa

SEQ ID NO: 19936 - DNA, 201 bp, Bos taurus
agcctgggggtcctggcacctgtgggccctgctgctgacctctctctgcaggggctctgattcctccctcccctggtttctgtctgtgtcccttcattgccggccgcttataaacaccatgttcctgtgtttatctggaattactcaactgtaaaatgctctccacaccaggaagtgtggcaatcctcatccatttgttta

SEQ ID NO: 19937 - DNA, 201 bp, Bos taurus
ttacaaggtacctcttaagcatttcacaaaaattaacatataagaaggcaactgtgctttcctctttgttttgtcctttcttcttgaattaaaaaatttcgttttaaattgcttttttgaaatcactcctggcatatttgagagacacaaaataatccagcaatgaaaggatgctaaaggttttagaatcccagaagctgg

SEQ ID NO: 19938 - DNA, 201 bp, Bos taurus
tttgggtccttcttagaacttgctttgttagaatcagaaaaaacactggaaacatataggtacattctgaatataagctaatgaggttatgaggaaaaaaaccccaaatactaaccaaggtagtgtcagttttactagaagacacaaatacgtattgggaacctttatcacagagaaagatcaggttgagattaaggttag

SEQ ID NO: 19939 - DNA, 201 bp, Bos taurus
actctggcagcatagctgcattctctcaggacattctctctctttaaatgtctatctccaaattttcccttttcataaagactccagtcctactgaattagggcccagccttatgtcatcactttaatgatagaccctgtctgcaaaagaggttgcatctgaggtactgggggttagcatctcaacatgtgaacttggggg

SEQ ID NO: 19940 - DNA, 201 bp, Bos taurus
ctgtgtacattttctacctagggattttagatgagcattgtcagaatttagtaaaaagccccatcaaatctgtaggattttgttgaacttaaagcaattcatttagaaggttacatttttattgtctatttttcagagctacagaaagttctttttttcccatttctactttgatagatgttccacacttaaacttttatg

SEQ ID NO: 19941 - DNA, 201 bp, Bos taurus
aagaacgatgcagagaacagaatttatgatctgacagtgaaatgctttttcattaccatcattgctttattgtacactagtcctaccagcgttttgtcatgtccttttgaaaatttgcaacttttccaaggttaattgtgagtttgttggagcacatgtaaatcaccaattctttttcttcagttgagagataaactctgg

SEQ ID NO: 19942 - DNA, 201 bp, Bos taurus
cttagaacagtgcttgacatatcattgtaataggcacagtataagagggtgttttcataaccatgggcagagccctatgctggccccaaggatataacaccgaaagagaagagtgtagtccctgcctcttagtaacctgatgcttattgggtgggtactccattacccaccaaaccatctaggccaggaacctggaagtta

SEQ ID NO: 19943 - DNA, 201 bp, Bos taurus
gagttttgtcctatacactgtctgctatatcttctgcaccaccaccccacccccaccaatgccaacaatgccactaatcctctttcaaaaggcctgtagtgttcctagctgtaattttgcaaactcagaggatgtgctttacattatacttgaggcaggtgccagatggcacatttcccattcttatcccccaggcctcag

SEQ ID NO: 19944 - DNA, 201 bp, Bos taurus
agtagtattccatttaatgcagacttttcatggatcccttccatcacaattattcctggttgtttgctcaaaataatgtatttccttttctcatctcaaacttactaagtcagaatttttaagtatagggtctaagaatatacattttacaaagcttccttagtttgttatgtactctataaagtatgagaaccactgatc

SEQ ID NO: 19945 - DNA, 201 bp, Bos taurus
tgaaaacttaagtgcttcaaaaacacatttcaaaaaaatcattagttaacagtgcagttattagaaatcatacagattaaaaaagtaatcctctatatgcataactgactcactatgttgtatacctgaaactgctgctgctgctgctgctaagtcacttcagtcatgtccgactctgtgcgaccccatagacggcagccc

SEQ ID NO: 19946 - DNA, 201 bp, Bos taurus
gcttaggcagagttagaggaaaggatatgtaggttttaaatcggattttaatgtctcttgcaccttcccatcaaaatcagtagcagatgttcatagaaaataacttggcatggcaataaatgttttcataattccagtagcaacattttccaactgctttcagaaatgcagtattaaatagaaaaaggaaagtgaattttt

SEQ ID NO: 19947 - DNA, 201 bp, Bos taurus
actaagcacagcagcacaggaacaggcccccacattaactaggggtttctggaagatctcatttgttctcagagagccaactttaagagcttgtcatgtgccaagccctgtattaatactggaaatagagatgcacatggccagtccctgctctaaagaagctcatatagaaaagtcatgtaagcagaaaagttctatata

SEQ ID NO: 19948 - DNA, 201 bp, Bos taurus
caacgcagcagcagcaggctagaagggctgaagtggaggggcatatctgctcttgaggttccagataaagatgtataagaatttcacaatgggttagctcacctctccctgccaagaatatacagtaggttttcagaacttagctgtgagaggactggagacagctcttgcacaggttctgtcctggctctaaacaaacct

SEQ ID NO: 19949 - DNA, 201 bp, Bos taurus
ttaagtagcttcatgtggctagaaaagcacaaatggtcagttagaattttccccaggactaggtcagagcctcttggtagcagctctttgcaaagttgacaattcagagtggtacgaaaacctgggtgtgcatggatctgccacttcctaacagctgaccttaagcaaacagctcaacttcccagtgactcaatctcatct

SEQ ID NO: 19950 - DNA, 201 bp, Bos taurus
ttaaacttggggaatgcttttgattaaaggatattaaagagttatgtccaccagatacagtgcaggagccctgactgcttcctagactaaaaacaaagaatagctaaaaagggcctttggaggcacctcaggaaatttgagtatagaccatctattcgatggtattatttagttggtattaaggtttttggatatgtgtga

SEQ ID NO: 19951 - DNA, 201 bp, Bos taurus
gaatgtttcgacccacaatcctcttcccctcctctgattttctaggccattgttgtgtacctactcaggctttcaattacctgctctcttgtattgttactcataggtgtatcatggcctcatctcaacctgacaaaaatggccaaggatgagctatacaaaattcttcatatctgacagtattttccaccatgcagggta

SEQ ID NO: 19952 - DNA, 201 bp, Bos taurus
gggcctagaaagtgtatttcatttagagagaaaatattagctgctcgctggttcgaagaggtgaaaacattcttcaattaactgtatcagcactaaagccgatgcatccatctccatctgtctgtatcttacaccatattctcaatgagtttgaaactcaggaaacaagaatgctttaagtgctgggcacctaaacaccat

SEQ ID NO: 19953 - DNA, 201 bp, Bos taurus
cccatggacagaggagcctggcgggctagtccatagggtcacaaagagtcggacacaactgagagccgaagagaagagttgtaggcagaaaggaagagggcagagagagctttttctgcttttgcgccttcttaattggattcagctcaaaccaatatgttagagagacatatttgggggtgacatattctggtttccttc

SEQ ID NO: 19954 - DNA, 201 bp, Bos taurus
tttgcttttatagacatcaatcatcaatcaccatattccctttcctctttctggcaagctgactcattacagaacctcgggggaattcacaggcttttggccctccctgaccttataggagaaggcgatggcacccactccagtactcttgcctggcaaatcttgcccggcaaatcccatggacggaggagcctggtgggc

SEQ ID NO: 19955 - DNA, 201 bp, Bos taurus
catgagctccatggggatgcccaccagtccctcggcaaaggcgtgcatgggtactgctccagggccgggcactggtcggcctcctggctcaccaccagggtgcaagcgatctcggtagcacccctgcaatataccatgcggttgtcccaatgaggttgcagattacacacagagcgtcatgacgggaacgcttggcctcct

SEQ ID NO: 19956 - DNA, 201 bp, Bos taurus
gagagtgaaaggaggcattgttaatgattacgccccaatgacagatgcaaaccaggactatcataggcaaacctagaggtaaggtcactctgtgtcctgccgtttcagatgcccttcttggatgatctacaactttgtgaaaagggcactgatattatagccagtagaaatccagtttaattgagtcaaagcatggaaaaa

SEQ ID NO: 19957 - DNA, 201 bp, Bos taurus
cttcctcactttggatagccaggtttaatttcattaaaatagactttattttttagatcaactttaaatttacaaaaaagtaagaagctagtagagagaactcccatatattctgcagccaatttcccctaatattagtgtcatgtataagtactgaagatgtgttaaaattaatgaactgatgttgatacactttcacaa

SEQ ID NO: 19958 - DNA, 201 bp, Bos taurus
taggggaggcagtctctctgccttagaaggattgaactgaggattgctagactgagactgcagctaggattaacgggagagagtgcggtggttgattaaggttgtctgcgtcagttgctggaaaggagagtggtggttgtacttttgttacatatttgcaaactctgcctgaggagttgtaatatgttcatcagttcagtt

SEQ ID NO: 19959 - DNA, 201 bp, Bos taurus
catagcttgcttcatacaaaaactttcttaattgagagattggcttcataaatatatctaagtaatccttcttgaaccatccaagttttaatttaagactgttctacagctggagaaaatatgaaacccaattagggagctgtagaagtcattagatttcccctctcagatatgtcatgaggccaaacatagccaggatac

SEQ ID NO: 19960 - DNA, 201 bp, Bos taurus
ttgaccaaaattcggtggaaatgtgttttcttgtgattcgttgggtcctggaagctatatggactgctctctctgacgggagtgatgacacctattcacaaatcagttacagagtcactctgctgtacagcagaaattaacaattatttatgaagtaaatcaactatacttcaatttttttaacaaaatataaatcagtta

SEQ ID NO: 19961 - DNA, 201 bp, Bos taurus
ggtttttctctccttcctatctctcatccacttagcaaaatgcctgacccagtggaagaggtggtgaataaggaggttcagagagtatgagaacaaagcacccaagaaggggactcagaaacaaaataatgatcatgttggttcatagaccctgcttgttgatcatactaacttccatatggagccaaatctctctatcat

SEQ ID NO: 19962 - DNA, 201 bp, Bos taurus
agtgagaaggtttcgtgggggttttatttggtctatttccaaagggccaagatgtgggaagccttgggttatcatctaagacccagacatatttctggtggttcatgctccaatgaagcattctggccctaaatttaggcaagggtcaagcctgggtgggtgacccacaactctctctctcatccaagtacaaaggctctc

SEQ ID NO: 19963 - DNA, 201 bp, Bos taurus
acctgaaatctggactcggagagggatgaggctgcccctcccgaggggcgggaaggaaagtttgggagggacgggcggcctcgagcgtggtggcccccgggtcgcagctccactccgaagcccaacaggtaaaaccttcccgagaagcttccggggaaacgggcatctctcggtggagtcgtgatcctccatgccctggcc

SEQ ID NO: 19964 - DNA, 201 bp, Bos taurus
tctctggagaacagagcaaccattcagaataatttacaaaacactttacgactgcccgttcactgttgactcgctcagtcctggtgaggaaactgttaaattcctgagacctgagacagaggcatcatttacaaacccagtctgggaagacccaccctctctatcttgggagccttgatatggctcccaggtgaaagtgag

SEQ ID NO: 19965 - DNA, 201 bp, Bos taurus
tcagccagccctccttggacaggggctccctcctgtcccattagagcccagaatactgagtgagtgtatctgggtggttttctgcatctctttctagagaaaaaatgttatatgaagtgaactctgttcagccttagaaagaaaggaagttctacatgctccatgctccatgctacgacgtggatgaacctcagtgtgcta

SEQ ID NO: 19966 - DNA, 201 bp, Bos taurus
caatgaatgcatgtgtttaagaaggtaagaaggaaagaaaaataacttaaaaattattgaagtgtagtttatgtacaatgtaatgttaatttcatatgtacggcaaaaccactcagttatacagatatgtatacatgtatactagaaaagaaccattcttaaagcctggagaattgcaacaaacatccagggttttggttt

SEQ ID NO: 19967 - DNA, 201 bp, Bos taurus
tatgtgatggcaagtacctgacagagcttggttctatcacagttcttttgactccccagtccagccttgtaactgctacgtcacacgacttctctccgacgccaagcatctgtgcatgtgaatgttatgtgatgtcctttgccgacataaaaaagaaaaagtgaaagagagtgttagtcgctcagtcgtgtcaaactcttt

SEQ ID NO: 19968 - DNA, 201 bp, Bos taurus
ataggagggcatcttctgtgtactttgttatggacacaacatagcacccagcaaagagctggttcaatgatcatgattggaataagcatctgttggtgctgttgggccttccgtgagaaaacaggaaaagtgaaggctgtcctggtgttttagggggccatgtgcaacacagaacctcaacagctggactcctcactgtcc

SEQ ID NO: 19969 - DNA, 201 bp, Bos taurus
tttccaacaatgactctggggcttggccatgtggactagctttggtctgtagagaatcggcagcacaatgtaaaagtggctgcttggtaagtacttgcacattgggtttgctgactgggagtgctcttggtaactaggtatcatattatgaggaagctcaagcagccatatggataggcccatgtagagaagaaccagagc

SEQ ID NO: 19970 - DNA, 201 bp, Bos taurus
ccttgaaactggccttttgtcagtgatttgcacattagtaaggcattgctatggggatgtttacagcaagactgttgttctgcagaagacacggagggcgcaagtcacaaaagagaggaaaactgccgagaaaagaaaatccctattcggataattagctcgtagaggatattttactggacagtcattcctcatgtgaag

SEQ ID NO: 19971 - DNA, 201 bp, Bos taurus
aaaatcctcgtgaaggagaattgaggcttcaggcaatggccccagtgagcttctagataaaagccagtggttgacgtcaccttggatctatcatttgtcctggaatgctggccaagagcaggtgaggcagaactgtggtagtctactcacagaatcatgataaggaataacttaataaattattgctgtgttaagccacca

SEQ ID NO: 19972 - DNA, 201 bp, Bos taurus
catttttctaaaacatgctctcctgtcctctttgcctagctggctcctgctgctccttcggatcccaagcctgggcttatacccctacttggtgctgccatagcttcttgggtctgccttctcagctcttgtccaagacttacattttattggctgacagtttgagctcaagagagtcgagaccatgtctgttttttctct

SEQ ID NO: 19973 - DNA, 201 bp, Bos taurus
gacaattagaatcccttttaaataacttcttcccctaatcctttttctctctggttcaaaaaattgttgtgtgttttatgagaaggcccaagacttctactatacatggttataaaagaacaacttgtcattgtactgaatttataattctgactatttgaaaaggcccttttcttttcccacaccaaaatgacctctgaa

SEQ ID NO: 19974 - DNA, 201 bp, Bos taurus
tctccttgcacttcaaaggactctcaagagtcttctccagcaccataattcataaacatcaattctttggttctcagccttctttgtggtccagctctcacatctgtacatgactcttggaatagcagctagtagctacaccaatttccattcccaccaacagtgtaaaagggttttgtctttgccgcatccctccacatc

SEQ ID NO: 19975 - DNA, 201 bp, Bos taurus
ttgtcccctgatcctgttgaaaggagccaagctccaggtggaactgcagctcgggcttgctgatatagcacgagtggagttttccataggaaattaaccaagtaacactcacattctttcccttctctcctttccactcttctcttccctctttaatgaaacagcttaagctcagcacttgaactctctcacaggggtgaa

SEQ ID NO: 19976 - DNA, 201 bp, Bos taurus
ctgaccaaaataagcacactttcctgatggctcagatggtaaagaatctgcctgcaatgcaggagacccaggttcagtctctgggttgggatccaaaatggtgattcttgaaatgtagtctctgaaccaccccagatccactgaattagaaactctgggagtagggtccacaatatttgtttaaacaaaccctccagaggg

SEQ ID NO: 19977 - DNA, 201 bp, Bos taurus
gttagagatggagtgcctttgtttctttgtttgcatttttttcctttttgtgtgaaccagtaaaaatcaataaacggccagcaaatgaaagccctgcccacaccagagcttgctgtgtgttgctgtaggaccaagtgggcttccttctaggttggggaacagtggttggttcaggcggagggaacccgagcctgggtctct

SEQ ID NO: 19978 - DNA, 201 bp, Bos taurus
gaaggtcccagcagtccttgagtcttcactgagtgtgtttaatgccggttccctatgtgttgaaagcagcagctatggaccctgttctcagttggccgatgttacggtagtcccagtgcacagcttcgtggctgagacaggcgaggtgtccagtgagagatgttggatggatgatggatgagtggatggatcagagtaaac

SEQ ID NO: 19979 - DNA, 201 bp, Bos taurus
attcgttgccatggcaatggctacttgacctctgaccaaatgtctgggcaggtgagcaaacaggaggaaccgaggatgactcagggcgtccctgcctggggtgattgggggatgactcaggtgttaaaggaaaaggacaggcaggaggccagccttacatgacgggcatttctgtgaagattttgcctttcctgaaaagat

SEQ ID NO: 19980 - DNA, 201 bp, Bos taurus
aacagactctagcaatgagccgagatggctccagaccctaccaccaggttcggccacctcagctatgttaccacagggcctcgtgggagggcaaagccccttcatttacattgtagtctccaaggggatttctgaggtttagcttcttccaatcctggtatcttggcatagatggaggcctctgggaggtcaagagaaatc

SEQ ID NO: 19981 - DNA, 201 bp, Bos taurus
tgcctgtggctgccggctgctgctgtatcccaccggaggccccggggatccgggagctgttggccacgccacgtgaaggggcctcaggagcctagccctggtgctgctgaccatccatagccatgtgacagcaaacgccacatctcatgggcatgatgttttcaggtcaaagcaaggtgaggtggccacacaggctaccag

SEQ ID NO: 19982 - DNA, 201 bp, Bos taurus
aagaaaagagagagagagagtgaagagaaggcttcaacatgtaagatgcttatccaaagtggatttggtctggaaaggcctgtaaaaccttccacatgactggcacagtgcagggataaatgaaactctcaaatcctaccaagtatgccctcattcaacctggatccttggagtggcctccaaagtgtccacagctcaaga

SEQ ID NO: 19983 - DNA, 201 bp, Bos taurus
ggttttcatttcacacgtccaacaccatttcagtgctgtagaaatgaaaaaaccattcaaccctccttttctacccactgctacccacagcttgggcctcgccttctctccctagagctgcttcccaggggtctttcctcttaccttccttcccttgattcagtccacacatccagggaccagggtaaagcccggcgccaa

SEQ ID NO: 19984 - DNA, 201 bp, Bos taurus
aaattatctttgacgtgtgtttcctcctacgatcatgattacagtatgagtcaccatctgagcaagaaatggccttaagaaaaataaataaatgaaaaacaaagtatggtctcactgtctttagtcctctgtccagaaagtatacaagggactgctgctgctgctgctaagttgcttcattcgtgtctgactccgcgtgac

SEQ ID NO: 19985 - DNA, 201 bp, Bos taurus
attcctggtccaaactgagacaacaaaattaatatttaatcacacagtggacttaggtcacccactctttctgaatttggatcttgggcccagtaggattgtcaactagaagtcctaaatcattttcagatttcccttccagcaggtctattatggaagcagctgtcaatacatataagaccaggataaggaggccatttc

SEQ ID NO: 19986 - DNA, 201 bp, Bos taurus
gtgtgttgggaggagcagaccatgtagacagtagagattagggtggcctggcagagcagcagttcgtgcaatactctgaactggtgtctgaggatgggccgagcctcagaggggagcactgccttcttcatgaatctggaaaagcaggactgtgctcctgagcttcactggacgtccctaggcccagaggacggcagggat

SEQ ID NO: 19987 - DNA, 201 bp, Bos taurus
ctccatgaggacatggattttgtttgtttgtggccatatccccagtgctcaagggcaaaggatgctgaagaataagcccaggttatccagaaaaccaagaatgcttctctttgccaagagaagcaagagctgttaggaacaaacgatggcctttgcaggttggcttgctccttagcacttctgccagcagagggaagggag

SEQ ID NO: 19988 - DNA, 201 bp, Bos taurus
ttcctttgaagtcagcttccaggccagccatcaccttaagatctgacgcctgaggactctgaataattccctcccgtgggttttataaaactcttcttcgtgtaagcctgggcctttggaactcagcttggtttcctcactcccctgagaatttgcctgaactgaagcttggcagtcaccggcccatgccgcagagtcgtg

SEQ ID NO: 19989 - DNA, 201 bp, Bos taurus
ttttaaagcatttggacagaaactcccgttctcactataaaagttttctaaccacaccataatctccagtttgctctggctgtcactttttactatccataaaataaatacctctggtctctttttcggtcttttttattttggggggtgcagctcatattccccaaatccttcattacagctactctcttgaatcactta

SEQ ID NO: 19990 - DNA, 201 bp, Bos taurus
gggtaggggtgctgactgtcagatatttattctgctctctgtccccaaccagcaaacgatcgcctgtgccacccctgttttgcttccaggcctctccacccgaaacccacttgctcccatcaaaacctggagtcatctttgattcattccacttctcaccttcacagcccaaacatccccccaagatgcagaggctcggcc

SEQ ID NO: 19991 - DNA, 201 bp, Bos taurus
tttaggtgtcaaagtttaatgccaacccttttagctcgaaagctgctcctctcttcctgtgacgtgcagctctgttctagaactcgctgaaaacaagggggtcatttttattttttgcggccgactgtccttgcttcctcctactccccgctagtccaaccctcgcctcagatccgggtaaagttatggcaagaatttggg

SEQ ID NO: 19992 - DNA, 201 bp, Bos taurus
ttcccttctaatttggcaaggatgaaagctttagcctgtcacaggccaagactgtgtcaaatggggtgaacttctaatgaatatacactactgagactaacaaacttaattacaccacaggcctcttctgaaatggacacttccaattccatacaccacaaatattggccccgaatcaaggatgaagtctgagccgatgtt

SEQ ID NO: 19993 - DNA, 201 bp, Bos taurus
gtcctggagaagtcagggaatttgccttccttggcaaaggtggagaagcaggaacacccccatctgtcagggattttgcaggcttagcctggctggacacatacacaaccctgggaggagccccctctcatatcactacccttttgatacctgcagtctgtgttgagattctactttgcttactgaacagatagactgtac

SEQ ID NO: 19994 - DNA, 201 bp, Bos taurus
cattttcaatctgtcttggctatacttctggaaatgcttttgccttatagactgctattctgcccaggttctcttggcctctgaccatatccttgtccattcctagatttgcttttactgcctgcttctgagtgctgatagcacatggcccaggcctggctcctcaaatgagccagagctatgcagtaatcatttagagct

SEQ ID NO: 19995 - DNA, 201 bp, Bos taurus
cccagagacagagccctaggtgctatggatgccaagcaggagcatcttcagtggcactttctagtctaagaggactcaagtgtagggctgcatccggcaacggccaggaggtaagatagtttgggtgtgccaagacaacatgggcatggagggggcgagcagtctttcttaggatacatcaggaatcatttttccatttct

SEQ ID NO: 19996 - DNA, 201 bp, Bos taurus
ggagaattccatggattgtatagtccatgagttgcaaagagctggacacaattgagcagctttcactttatgacattatatgtggccatgaattatttgacgttgatgtgagctgctgatcagtttcacaaacattctggagaagagagaactagagaagaaacaaagataggcatggaaactgagaggcaccgcagtgca

SEQ ID NO: 19997 - DNA, 201 bp, Bos taurus
aaaactgtgcagaccagaaggaagtgagggaggagccatgggatatctgagggaagagcaactaggcagtgggaacagcaagcacaaaggctaagaggccgggtggtgtttagcatctctgaggaacagcagggaggttaggtgattgaagtccagagagtagaagagaggagtagtttatgagatctgaaagatagtggt

SEQ ID NO: 19998 - DNA, 201 bp, Bos taurus
cacagcttcttccacctacactttcagcagacccagatgcaggtgagggctggactgagaaagggggtgagcaacccccaacacgtgtccagcctccctcatgctggccactcgccactgtctcacacacatatgttctggctgtcactctgcctgagctttcctgtttattattttgtgtctccaggcagcgacattgct

SEQ ID NO: 19999 - DNA, 201 bp, Bos taurus
gttaactatggctaaaagagatatgagtgcatgacaggttgacaaaggatggggtctcttttgagctagtaagctagaagtgggcttcccagaattccccatgtatctccaggatacactgaccatcaaaggcacatgtatgagactgagaagtggaaggggaaaaaatggcagctctttttttcttttcttaccccatga

SEQ ID NO: 20000 - DNA, 201 bp, Bos taurus
atactggtcactgtaaggctaagtactcaaaaagcataaccctttgccatgtgacttgtgcctactgtctttaagattcagattatgggcacgaacagtatgtctcacttggccttggtgcctgtgcctcttggctctctaatgtcacccccacctgggtgtgcaagctctcaataaagacagctccctggctctcatgtg

SEQ ID NO: 20001 - DNA, 201 bp, Bos taurus
cccgtgcttgtcacgaatcactgtgcggagacattgtgctgcaggaaaagtgctgtgtgaacccaagtcacagacgtgtcagctcaagtcacacctgagatgcaggggagccttaagacacagattgtaggatgctttaagacggcaaaagcagaagctccaagcacatatcaggatataggaaattaacagatacacact

SEQ ID NO: 20002 - DNA, 201 bp, Bos taurus
ctaccctttatcctatcaagctgaggtcacagagctggtaattgacagaggcaggatttaaacccaaagtcaaccatggtgatctcaggacacacacttctgttctggatggccgaccacagaatagcaaacccagaaaaactcctgaaatctttaggtcacctctgttcatagtggaggattattctcaaacctggagag

SEQ ID NO: 20003 - DNA, 201 bp, Bos taurus
cccgtgtgtggctcctgccggcacttacctgcctcagcccgcggaccatctcacctcttctgtgtctctatgagcttggtattttttgatcccacatataactacagtcttgcagtattactttctgcatcttgcttagtttgcctaatataatgccctcaaggtccatccatggcacacgttgcaggatctcatttttta

SEQ ID NO: 20004 - DNA, 201 bp, Bos taurus
ggaggatgtataatcagggaggatttggacagggaacatgaggaaggaacgcagaggagaggagcacccaagcaaaggctgggaggtaggcctgtactttggtgccatgttcctcccccaaaccactcttctgattcagccaagtgcaccagcagagcagctgacctggccagtccatagggttcccatcggggggcaggt

SEQ ID NO: 20005 - DNA, 201 bp, Bos taurus
gctggtggggacctgctcatgctgggaactcagtaataatcacagtaacagccatggcgattgctaactcttatcaggagctgcatgcctgggcctctttctagagctcagcatgtatttaattaatcctcacaactaacctaggagatgggcatctgcctccattttatatgtggggaaactgaggccccgggaggttga

SEQ ID NO: 20006 - DNA, 201 bp, Bos taurus
gcccactggtgaatggagccaggtcttggccctccggtgagcagggctctgtcaagaggtggctgtgggctcagaaagtctgggaaacctgtgtgctgattggtgggcctgtgttcccaacctgttgactgtctggcctgaggatttctagtagcagggtgagatcaggtctcagtgccaaggacccaggatacctgcctg

SEQ ID NO: 20007 - DNA, 201 bp, Bos taurus
atatttcacactttacacaaaaattaactaacagttcctagaacaggtcgtggtagcatctgtgtctcaaagtctggctggtacgagcaggcagctggccacagggatgagcccaccacatccgtccccagaaacctaggcgctgcttattttaccgcttgccgagaatcactgctttgcctgggccacaagctgggccta

SEQ ID NO: 20008 - DNA, 201 bp, Bos taurus
tttccagtgacacctaggacatttcttgaaggcaggtattttttaccttcagccccttgatccttgtgcatattaaatacccaggagtactgcttttcatggtgttgttacattagatggccacaagggagcagcagttcttcatgtcccactcctttttttcccctgtaatttccttgttattttatgttggaatattgt

SEQ ID NO: 20009 - DNA, 201 bp, Bos taurus
agactctacaccagcatggaccttttaaattgtagtaattaccataaaacagttctttaattgccagtattattgctgttagttaaatgaatagttgggactgtgataaaatgttccatggcattagaagtccagaatattcagttcctttccattaaaaaaaaaaaaatcctgcctgaaaagttgattgtaagacttaaa

SEQ ID NO: 20010 - DNA, 201 bp, Bos taurus
gaactgggtaaatggtaaatgcacctcatggagaattttactattagtagtaaaaagagctcttgggttgaatattctgttttctaaacaatcatagttagaaatcaaaaagaaaaaagaagtcatttctaaaatgctttcctgggatgtctttttttctttctgtagacttctggtttgatcgctcatctactagatatt

SEQ ID NO: 20011 - DNA, 201 bp, Bos taurus
tatgggggtgccaatggaaaatacaaccattcagtaaattttttgccaatgtaataaaagaatatttattttgtatatttttttgactgccagttatatagaactttttttcccatatatcaggcatttgtgtttcctcctttttgaagtatctgttcatgttagatatttagttagcttagtagcacagttgtgtccgat

SEQ ID NO: 20012 - DNA, 201 bp, Bos taurus
tgaactcttagaatttatccatctattacactcaaggccacagctctggagtgtgatggggcattcacaacttagcatataagaatagcaccccaacaaccatttacataggctcacgggccctgatgagacttgctactacttaataaatacatctctgcatttactgtgcaaaacttgtcagaacttccccttactgat

SEQ ID NO: 20013 - DNA, 201 bp, Bos taurus
cacgtcaaacccttggatctgtgtatcaggagaactaggagacacgggagtaatgcagattcccaaaaacctccttgaaatgacttttgaagtaggttcagctaattgctttcttagcacaaagtgtcatacatagttctacacaacaatgccagtttcagtttttcatttttccccgagtcaaataatacaaagggtaat

SEQ ID NO: 20014 - DNA, 201 bp, Bos taurus
tggccatggagaccctcactcccatcccctcaggttgttcctgtatagccaagaacagtcctctccccagatccactctcctaactgcattaggagcactcggcccccaccagcactggtagcctcctgtctcaggctggggtgcccagggctgattccagaggcagctttgatggtggcagtgctcaggactccggagct

SEQ ID NO: 20015 - DNA, 201 bp, Bos taurus
gtcatacagttggaatcatatagtatgtagcctttttaggttagttaatgtgcatttaaatttgttccatttttatggtttgatactttttttttttagcactcaagtgatattgtgttgtccgaatataccataattatatatccattcatctactgaagaacaccttggttgttttcaaattttggcaattatgaataa

SEQ ID NO: 20016 - DNA, 201 bp, Bos taurus
gtatgtgtagttggccagtggcttcttgattagtttaaaaagtcagtttaaagtgaagaatcacaaaataaataatgcacactaaaatgttttattgtaccctaaagtttcacagatacccccatttaccaattctcttaatgtcataccaagtctttttctttgagtaagagtctgctgattagaattggcaaaaaacac

SEQ ID NO: 20017 - DNA, 201 bp, Bos taurus
ggatatcacttctggaagaacttcattctttaacctctttctttttctttaacttcttccttttgctggctcttgtcagttcagttctattttaaaacacggatactggtggccaccatgaagatcacttggaaaaaacctttcctttattccttttcatgcggtagctactactgcatctgtttatgtccttcacagcca

SEQ ID NO: 20018 - DNA, 201 bp, Bos taurus
ttatagaaataattaaatgtaatggagccatagaagtgtcatgaattctgtattttaattttggcaaagcatctgatagtctcattgtattcacatggacgcagatgatgaaatactggctgtgtggtattacttggattgagtgttgataatatgtgcctgtgttccagcatgaaagttggtttcatatttcttatccag

SEQ ID NO: 20019 - DNA, 201 bp, Bos taurus
ttcatgttatttactaaatagaaagagagtatatatatctaaatgggcatctgccaaacaatattagacagtgactactttgcacaagacaaagtgagtgcatccacacacacacacacacacacaaatccaggaatcagaactcaagacagcatctaaaaatagggtccacgtgaccagattctacaaatagtaggcaga

SEQ ID NO: 20020 - DNA, 201 bp, Bos taurus
cagcaactgaagaacaatagttctgaaagctaggcatctaagtttaaagtgtcagcagaattggttccgtctgagggctatgaggaagaatgttccaaacgtttcttcttggcttgccattttctttgtatcttccctctgtgcatatttctgcttgcatatttctcccttttataaagataccagccatatcggatgatg

SEQ ID NO: 20021 - DNA, 201 bp, Bos taurus
aggaaaacacagcaagagtgaggttagagggagcagaaactactttagccagatgtatctgaagaaggttatttcaagacatggccttttagttaagaggtaaatcatgaagtaacaatgacctagttaagccaatcacaaaattctcagaaagcatttattctacataagtatccttccaaagctaacaaattttggcca

SEQ ID NO: 20022 - DNA, 201 bp, Bos taurus
gaagagcaatcatgaaagggattttaataaatttaagaatgttgacactaccaaaacttagtatctttagaaatgttctctcagtgtccccttctctactgcaaagctttcaggtctttcagataagtctgtctccctgaacataagaggcccttttttgggggggcctgttgatgttgacccctatttggcctgagacag

SEQ ID NO: 20023 - DNA, 201 bp, Bos taurus
ccctgtacttcaagacactccccctaaagaaaaaaaaaaaaagaacctccaggaagtctgcaggtgcaagtgtgttttcagagaaattaatgaaggattgtccttttatgctgtgtattcaaatacgtttgcactggtgtagtgctgaccttaagtacacagaacatgaacatagccttttcttggtacttgtgatggcgt

SEQ ID NO: 20024 - DNA, 201 bp, Bos taurus
tgaaaaacaatattttaaagtggtgagggaacaataaaaccacgtaggataaaaaaaaaactcatctttaataccaaatcccacttaattacgtcattttttaaaaataacctctctcttaaataagcctgagaatctagttaacctgatttgggggaaaaataagtcttcttcaaattgctataatttgatgcttttctc

SEQ ID NO: 20025 - DNA, 201 bp, Bos taurus
ctcactactggaaaaactaaaatatacagaagctaattttgaatcgaatatgtgttttgcaggtttatcatgtataaggctttagtgaaaggcatggagtcagataatatgttaagacatgatttctgtccctaaagagctcaactaagttatttatgtattcagtactaaatccattccaaaaaagaataaaaaggttgt

SEQ ID NO: 20026 - DNA, 201 bp, Bos taurus
gggaaaaaaagcttccgcttcctctctcctcccggcaaaaaaaaaaaaaaaaaaaaggaaagatccatacgcaccactgacaagaaaataaaaccggccccagagaacaaggcaagccggtgaaccctgacagtccacgcagtgagagcctccacttggcaggcgaagaggccgctggctcccgcccggccccgcagccgc

SEQ ID NO: 20027 - DNA, 201 bp, Bos taurus
tgatttactttgtggtatagcagaaaccaacaaaaacattgtaaagcaagcaaactccagtaaaaaaaaaaaaaaacaaaacttaagaaaacaatgccaatagattgctggatgcaccgctgccacacactttcaatttataaaaagaatgcagtatctgtaaagcacaataaagcaaagcaccatgacacaggtatgcct

SEQ ID NO: 20028 - DNA, 201 bp, Bos taurus
aataaaaatcccactctgttccctggccggagatcctccagggctggtattgctcaagtcttagttcacagacatgtcactgtattcattcgctccatacgtatgtgtgcaggttggcctcatacacgagagtcccagttaacagaaacttgatgtttatggcaaaaagaacacatgttcattgtgaaaatttggagcttc

SEQ ID NO: 20029 - DNA, 201 bp, Bos taurus
aactgcttaggggagactaaggtcatttcaaccatcactctgagtggagccatgcagtgtagtgggaaacaaggtggaccaaggcaccattaagggctcccaatcggttcctttttctagctgataacctcagcaagactacctctctgagcttcctttcctccatctgtcatggaggcagtgataaccttccattcagat

SEQ ID NO: 20030 - DNA, 201 bp, Bos taurus
gtgctgcgattcatggggtcgcaaagagtcggacgcgactgagcgactgatctaatctgatctgattcaggactttcccagtaatttagtagatagggattggcctgccaatgtaggggacatgggtttgatccctggtccaggaagactccacgtaccccagaacaactaagcccgtgtggcacaactactgggctcgca

SEQ ID NO: 20031 - DNA, 201 bp, Bos taurus
atctttggttgagttttcatcagtgagaacttgcaagcatttttgttccacagtggaaacactacattgaatgtgatgggagtcctgatccttcaatagctcaagaaattaatacttttattaccttgtggaaagaggaaaccaatgagactttagaggaagtgattgagaagagtaaactagtgctaaatgtaagtattt

SEQ ID NO: 20032 - DNA, 201 bp, Bos taurus
tccttacttcacagttgtggccattcactttggctggatgaaacactagccatctcttgcttggatggggccttccttacttcacagttgtggccattcatagggtggagtttctgaatgacagtcttgtctatggcatcacggtatcaaaggtcgcaaaaacaaggcctctctttttgccactgtctcaatcagtcatga

SEQ ID NO: 20033 - DNA, 201 bp, Bos taurus
tttatacacacaggcagagaattttttcacacagttggtgagaccacattgatccagcaatttgaatattattattatccgtggtctctctcattaaatagttaagaaaacatagtaaaattgttaaggatacacatttagaatgctatatagctctagctctattcaagttggcaagtgattaacactgcttaaaaattc

SEQ ID NO: 20034 - DNA, 201 bp, Bos taurus
tttcctcatgtctagcaattcctcataattaactagaaggttggggccacactgacaccattacccctctgaatatctggctctaatttatgagccatattctgcctaatatgccagaatgcttttgaatgttctctcattgcttattttttcttggagtcatagatttgtaaatcagttacatgcaacaatgaaaagatg

SEQ ID NO: 20035 - DNA, 201 bp, Bos taurus
agtattctaggtttttttggcaatcagcagatcagatagaagagtctagtagtataacgaggatgtgtaatctgacatgattagacaaggctctttagtaccagaacattcataattgagacaaagaaagagtattaataacactttcctaacacggcagttagccattttatatttcctttctttaatcttagtgttttt

SEQ ID NO: 20036 - DNA, 201 bp, Bos taurus
aataaataacaacaacaagagagtaaatcctaagagttctcatcacagggaaaatattttttctatttctttctttctttttttacttatatgacatgatagatgttcactaattgcctggagaaatgtcaataacctcagatatgcagatgacaccacccttatggcagaaagtgaaaaactaaagagcctcttgattaa

SEQ ID NO: 20037 - DNA, 201 bp, Bos taurus
taaagagagctgactcagccaggagtactgcctttttgactccttccctcatttttcttccttctggctagaaagtggccatgataactggagctccagccgctctattaggtcatgaggtaaccttgtaatgaaaaccatgtattaagagaagagcaggaagaagcagctttaaggcctgatgataacagaacttctatt

SEQ ID NO: 20038 - DNA, 201 bp, Bos taurus
tcctataaagggaagcaaatagtctagagcaacatatcagtaaattcctggtagcctatgacctaaggaaaagaaaagaataacagccaagcaaacaatccccagttccctctgtgggaaagatcagaggtgagattcattctgagaaaaagggatgtgatgacctcaggtacttccttatgaatttagaagaggacactg

SEQ ID NO: 20039 - DNA, 201 bp, Bos taurus
tggccctcggtccacttgattgccaggccttgtcttgtgtagaagttggtgccagatcataaggtggcttgctacagagccctatcatgtctcagaactaatgctggcccactggtggttggagctgggttctgtggcagaagctgtgggaccagggatcctggatttaattttgtcctggtggtggatgggtccagttct

SEQ ID NO: 20040 - DNA, 201 bp, Bos taurus
attatgaaaggagtcaaagttagagggcttaatcaagtgaaatttctctggataagagagagagaggtgatggagaaaaggccagtttttggattcagtttagttcagttgctcagtcatgtctggctcttcacaaccccatggactgcagcatgccaggcctccctgtccatcaccaactcccagagtttattcaaactc

SEQ ID NO: 20041 - DNA, 201 bp, Bos taurus
agttcaacaggttcaaacctgggtaataatctttcccctcagacaaccttctcctcttgtgttacatatcattgtaagagccacaagaaccgaaaccaccagcacatcttagagggacagaaatctgacaactggtacagaattcacactaaatcagcatggacactgcatcgtagacctccactgcttacaccacttttc

SEQ ID NO: 20042 - DNA, 201 bp, Bos taurus
aggtgataaggaagggtacagcatagttcatataagtgtcagaagtccaaaggcccatacaaactaaaacttagggggaatatcacaggaggatagaaatatacatggacaggatgcatgttgcaatattgcttataacaatgaaaaccttggatgcacttaaatggcacttaatatataatttaaatctattaagttaca

SEQ ID NO: 20043 - DNA, 201 bp, Bos taurus
gacttgtagatgccttgaccttagcccagtgaaactgattttggacttttgacccctagaacagtaagccaatacattttagttgtttgaaggcactaaacttaaagtaatttgttacagtgtgtgtgttggtcactcaattgtgtccgactctttgtgaccccatggactgtagcccatcaggctcctctgtccatggga

SEQ ID NO: 20044 - DNA, 201 bp, Bos taurus
gaatgctagctgtcctggtatctatcatagggaaatggcatcgaatacttgacttgactgagttttcccttgcagaacctgtagtttaaaagacagtgatcgcaactagaataacacaatcagttctaagcggactgtgaaaatcttgttcagtagtataaatcagattgttcaaaaataggagattccagttgaattcat

SEQ ID NO: 20045 - DNA, 201 bp, Bos taurus
ctcagttactcctgccacctaattctcaagtccaagtgcctttgtgggttcagagtgtatgtaatttgtgctcagatagttgtctacaaggttttgacatcactttgctcttaagttgttggtcgtcgcattttaggtgacagtgattagtggcctcaaagggacctgaaaatcaaggtgtaatttgtcctttgaatgtga

SEQ ID NO: 20046 - DNA, 201 bp, Bos taurus
aactccccactcattggccaatgtttttaccatcctttacttaagctttgaagctcaagaatctctttcccaaaaccatataaatacaaaacaagtggaatggtctaggagaggacatggaagggccagctgttttggcctagtcaaatagaggtgaccttttaacaggtcttggtaaaggtaaggccatggaaaagtatc

SEQ ID NO: 20047 - DNA, 201 bp, Bos taurus
gactggaatcaagatgttcttggcaataaggatcaatgaattctgaaataaattaccaaaagaagttgcaaaaggttctgaagatagaatttcacctttttgggatagtttatcattgttcctgagcagaacaaaccatgcatctttttcagttctaggattctgtatcacaaagatcttctgaatattaatttatttgct

SEQ ID NO: 20048 - DNA, 201 bp, Bos taurus
tttaaaaaattgctaagtgcatttattcatccctttgaattatcttcaaagatggttacaatctaaactttcaaatttaatttacagtcatactgattcacctgcattttccatcaataatttacttgaatttctttcatggacacacacacacacacacagagtcatatgcttgactcctcaaaacttagtttaaaaagt

SEQ ID NO: 20049 - DNA, 201 bp, Bos taurus
gcagagataaagatgaaggtttgcatctgataccctacagaaaacttagtttctcctcattcactagatatttcttttccaattaatgcaggaaggacatgaaaacaatttatgttattatctggaagctaatatttgctaggatgtgttccatgtattctacaagtattatttttaatgctcacaaaatccttgcctgtc

SEQ ID NO: 20050 - DNA, 201 bp, Bos taurus
gacacgactgagcgactgatctgatctgaaaatctctagatatttttcacaaactgaagttttcatattcaattctcactttgggccagcaaccacttaccccaataacaggcagagaattcatatgtgtagctgcctaagagaaggataaatatctggataatccattatgttttgttataaagcttctttcagtggcca

SEQ ID NO: 20051 - DNA, 201 bp, Bos taurus
ttctgagccaatctctgggcctcataactatgtgtgaaatgcttttagacaaatgaaacatgaaaagacagtttgggccatctgtccagtgccagaccaatagagtaaaatgattgggaggggtgggctggagcagtaaggggctagtggtgtcctgaaagacaagggtagatgaggcccaggtggagctagctggctcac

SEQ ID NO: 20052 - DNA, 201 bp, Bos taurus
catctaaagggagtttcgttgaccaagggaccagatgctacagaacagaatggccatactttctacccttatgtgtgtgtggactgtggcccacaaggctcctctgtgcatgggatttcccaggtgagaatactggagtgtgtagccttcccttctccaggggatcttcgtggccccgggactgaacccagatctcctgca

SEQ ID NO: 20053 - DNA, 201 bp, Bos taurus
taagtgttagcaagatgaaggaggagaatatcctgaggggcataacatctcactctaacacacagagctgtgatccaagtactaactcaatctgagggtgccaggatagactcaaagaaaggtctttgagtcctcacatacagtcctctgtgagtctctaagaagggacctgcatggcaagggatgtagcagtggctgtct

SEQ ID NO: 20054 - DNA, 201 bp, Bos taurus
tcttggagggactactccaacaggaaagtgggaacctaaaagtaaaaagagtagtaagttctataaaacatcttcacatgacaccatctctctcactgatttattcagtttctgagacttttaaaattagaatgcaaatttattgtttgaaaagagatagggaaacataataacccttcattagtcattttatctataagc

SEQ ID NO: 20055 - DNA, 201 bp, Bos taurus
aagttagcaatcttccttatatatgtgctcaactgttgttgactcaaaaaaaaatttaactgtatcatagatctttgtccaaaatataggaatatattttcaaaatgccacaagctcataattcagctaatatttacatattttagaagctgatttcctctcactagcttttaatatagttgaatattaaaatgattcata

SEQ ID NO: 20056 - DNA, 201 bp, Bos taurus
aaacaatgctgttctgcacccttcaagacaatacaaggtttctactccaggagaaataagggagccagggatatgttcagatggagaccaggcaacactagaacaggtgaataccagacaagcaaaactagaataacaccagagtagtaccttagataccactctgttagtagcttaaatggagaactgtgaagtaactgg

SEQ ID NO: 20057 - DNA, 201 bp, Bos taurus
ggacctttcctcaggcatctctctttgagaattttagagatacagacatataagtcagcaattatgttatggaggtatgaagaaacttaaatcttccatccgtatatttatgatttgtcattttccgtatgcagatgtttcagtttctaagaactattgttttctttcactgatgaaagatctgatgtccaggcagtttaa

SEQ ID NO: 20058 - DNA, 201 bp, Bos taurus
tgtattataaaatgaaccacccacttgacagatttggaatctaactaataatcagcatattgtgcccagactcttatcttcttgttcactagtgctttgccagacaggcttaataaaaactagattaacaacagaagatagtcaccaaatattccaacatttgtattgtcttagagatgaaagtagtgcgtccatattcca

SEQ ID NO: 20059 - DNA, 201 bp, Bos taurus
ctggactggcaactcctttttcccttttctttgcttttgttttcatttgtttgtattgcctttagaatatggagcatatatattttttaatctctccaatgttagccctgaggatgctctgggggcaaatctaattaatgaaaataaacaaaggagacaagtctggtgaaatagatgggtgatcaatttgagtacacaatt

SEQ ID NO: 20060 - DNA, 201 bp, Bos taurus
cgtttgggaagagtgtgtactctgctgttattggttggagaaatctaaataacaattatatggcatggtttaataatatagttcagatcatctatgttcacactgactttttatctctatgatctgtcaattgctgttggaggggtattgatatcgtcaaataaaatggttgattcttctatttcttcttttatttttcat

SEQ ID NO: 20061 - DNA, 201 bp, Bos taurus
actataataatagagaaaacccaaaatagccttaccttacataagcatcacaatttgggacacaggtctggagttggcaccttcaccaaatcccccccccttttttttttgtctctcaaggataatttctctgatacagcttccattatctctgacaggacctagaacactatttttctttccaggcgttttcactatttc

SEQ ID NO: 20062 - DNA, 201 bp, Bos taurus
ccctcataataatatcctaaagtgggcaggtgtggtagattggttgcataaatagactaaattcctcatctcttcaggcatccaggtccctgggccacacaatgttgctattcttctaatagactgagtctgtgtcctagcactttaattctgcagtcacacatatgactttctttggccaatagcattttagctaatctg

SEQ ID NO: 20063 - DNA, 201 bp, Bos taurus
ccatctcatcctctctcaccatgttctccccctgccctcaatctttcccagcatcaggatctttcccaatgaatttttcaggtaagagctgtcatcagcaatatctccagatgctaggacaggagtgtctctgttttaaagaagccctgggcagtgagccatggcatccacctcagagagtcatcaaccatctcacttctc

SEQ ID NO: 20064 - DNA, 201 bp, Bos taurus
ctcaatatcatcattaaaaaatgccgtattacaaggacttatcatgggaatattacacacagacaaggaacaccaccaaatacaaaaccacaggccattacagctgggaacacccatagaaaacccttatgtcttatcccctcactagtaacttaatttattagttgattttttggccccactgcacagcatgtggtatct

SEQ ID NO: 20065 - DNA, 201 bp, Bos taurus
tagtctttctgagttacagaagaaccacagttatactctgaactttcccatctccatgaattttcctcctagacttggttttactttctcagtcagtcccatcttgcttcaaaaccatccatcacaacccagctcaattgttacttcctttgcatatctttctccaaatcccttaactggaagtgctctatttcctgacat

SEQ ID NO: 20066 - DNA, 201 bp, Bos taurus
tttcttatgttgtccttcaatgagagcctggggcatacataagcttaaatagtcaagtagtgaatgtattctgtcagtacattacatcctgctgttccaaaaaacacaaggatggagctggagaaattgtgttaagtgggccttaaattctctctagtatcgtatgtcttaatatttgctttcgttagaggagtttaacat

SEQ ID NO: 20067 - DNA, 201 bp, Bos taurus
tcagatgaccagagaagggactcagccatacatattcatgtatttattctcccccaaacttctcttccatccaggctgccacataacattgagcagagtttcatgtgagaagcacgcacattttccttcagtttgctacggctccatttctgtgcagatttcttacatttttgggcatactgacctcatcagtaacattct

SEQ ID NO: 20068 - DNA, 201 bp, Bos taurus
ggaagaagaaaaatcatatctgagagcagtcaagttctagtcacgttctggggcacaacacattttctatcaatgtgaagagtcagtcgtgctgggtacattcagggaaggaagctaataaactgcacagtgggctgtgatgaccagttaatctgtttagcgtgtttactctttaattcaagccgagagggtagcctcatc

SEQ ID NO: 20069 - DNA, 201 bp, Bos taurus
gtcttttttcccccaattcaatcaagcacatctcagaaaccttatttctgttttggtcaagtaacaagttgtaggtctttgtgtgtatgtgttagtctgtatgtctgtgtgtgtctgtatgtccgtataaaatgttactttcatttttcaacctctactatctcctcatcataagactttagtaggaaacaaagactgact

SEQ ID NO: 20070 - DNA, 201 bp, Bos taurus
cccctacattggcaggtggattttaaaccattggacaccagggaagtcccatctcctttctttacctacaatagtgcaatgatttggctctagagtcagaagactgggttcaaagtttacctctgtccttgcaagctgtatggcttctatctgatggaagcaataacagtacccaccacacaggttgttgtaataattaaa

SEQ ID NO: 20071 - DNA, 201 bp, Bos taurus
ttaaaaactgaggcttcatacgtggaacagaagacatccagctggggatagcttttatgcaatagactcatgattactgactcgagtatggggcctctcacagccgtcctgtcttaaagagacaccacttccactcattggcgctgccttctcttccttaggctggaatctgaggcctgggacccccacccctttccacag

SEQ ID NO: 20072 - DNA, 201 bp, Bos taurus
cgtttctcccccagcacttttttgatcatctgtttctttagccacaagctggtgaccccatttaatggtgaactacctggccaataatcttgctttcctgtggggctgagaagtttccatctagaggctgcccagaactatacaagaagcccaggctttggagggaggcctattaggatttgaatccagttcagccgtata

SEQ ID NO: 20073 - DNA, 201 bp, Bos taurus
ccggtcctcgtcaccccctgctgtgcgtgcccctccatccttatgaccacggtcttcatcatctcttgcctgaactgttgcaaggcctcttgagcatttccagctcttccacttctgccccttctgacctgcccctctgtctcctccagccctaaagctaaggaccaccaatggcactccgcccccttctgttcgactctg

SEQ ID NO: 20074 - DNA, 201 bp, Bos taurus
cacagacgtccccaaactcagaacccaggcctgcctgcccagggttctggaaagatggaacaacacatggaaaggagctgtttagctggggatccttctgttcagctcctgagcccaggccagccttcatagctttgagcgggtggcttaaccctttcctcctcggcttcccagtctgtaggttggggctaacacctcctc

SEQ ID NO: 20075 - DNA, 201 bp, Bos taurus
gcagctgaaaaaagcacaggtctgtgtgaagggtgtgaagggacaggagagcatgtgctcctcatgtcaggaacgagtaaccacagtggaaggccagtccaagtctcgacatcagctctgtgacaatgtcccacagcaacaatgcttgaacacacagacgggggcccagtactgtaggagcagggccgtctggacacgtgc

SEQ ID NO: 20076 - DNA, 201 bp, Bos taurus
ttctaggtttgtcaatgactctgaaatttccaacttatgctgcaagaggtcaaaagcccttggagagaagtcaatgggtaggtacgactatttcaatatactcaaaaaacagaagttaaaattttttactattagctccctagactgcaaaaatgtgtgcatcttttctcttgactcagaagtgaaggagcagtatgcctc

SEQ ID NO: 20077 - DNA, 201 bp, Bos taurus
atttgtttcccaagtattcagatttctttttaaagtaatttctttgtctggcatctttagcctgagtattgtgaaagtctgttgaaacacacaaggaccatttatgatggttttccttattgtttgtttcttagattaattgctccttaagaaattataataatctaatcattattgggttaatcatctcatctgttgagg

SEQ ID NO: 20078 - DNA, 201 bp, Bos taurus
gcgcccatcccccatctgcggaaaaagtgtcttccacaaagctggtgcttggtgccaaaaagactggggacactgcctcaaacagagaccaggctgaaccgtatactttcactaagaagaaaagactgatcaagcaaattagcagagcaaataacacatgggtggtactattttgatgcagaaggcaccgtcttgagcaca

SEQ ID NO: 20079 - DNA, 201 bp, Bos taurus
agatgaactatgaaagcaaaggtccacatactctttttacaaagggccacagagtaaatattttagactggcaaatctcgtacagtctttgttgtatatctgtttttgttagcttgtgggccatgattcatttgacctgtgggccttagtttgctaagctttgaaaagccttgatttcagggcttccctggtggctcaatg

SEQ ID NO: 20080 - DNA, 201 bp, Bos taurus
ttaggggatatcaatggctggatggccactcaggggtaattcagagacagagactacagtaataaacccctctctctctacatggagatacacagattccggggcccatttgttttattttactcccacccacatttaatatttctatgtgctctgctgaatataggccagattgtatccatgtatttacttctggtccca

SEQ ID NO: 20081 - DNA, 201 bp, Bos taurus
attcaaattatttgggattcagctttaatattttaaaactgggggaaagaggaggggtgtccatgaaagaagacagatcaatgcacgatatctcattcacgctgcggtaggaccttcagctctacaaaccctaatgaaataatgggtgtgaccttcactccagcgctgaggagagggcacatattgacaactgagatttat

SEQ ID NO: 20082 - DNA, 201 bp, Bos taurus
gaatgatttaaccaaatggcctgtcttgttgggtacacatgggctgttgtgttgaacaactctgggagacaccatagatgttatattcatattatgctgtcacctgaatgatgaaaaatatttgccaaagatgataatttggagtttagagaagatgaccctaagcaatttctttttttttttttctgatagtaatcagat

SEQ ID NO: 20083 - DNA, 201 bp, Bos taurus
ctataagaaaggcttcaattatttttaagaaagcaggggataatatattgatatacatttctgtttaaattgctgttattttgtaaattcttcagtactgaaaaagtaactttctagcacctgagtttcccacaaatacaaacagtaattgtatcaagcatattaaaaaaagctaaaaataataattgtatatacttatac

SEQ ID NO: 20084 - DNA, 201 bp, Bos taurus
ctactgggtggatacaggagcaagcatgcctggtaagagctgcagctttgcaattaacctgaggggcagctatggattctactggagttcctcaggcaggcggccagaatgagtgtcacccatgggtgacaaccttaagactgaatgtagagtgtctatgttcatcatgtatattttatgtatgatagtttatgtctgctt

SEQ ID NO: 20085 - DNA, 201 bp, Bos taurus
aggactccatgttctcactgctgatggcccaagttcaatacctgtttggggaagtaagacccacaagccatgaggtgaggccaaaaaacccccctttttttggggaggaatcaaatcttttacatgtataataaaaataaggcagtgacagcgcacaagtgcacaaggcggcttcgatggcgcataagcgtggccgagagg

SEQ ID NO: 20086 - DNA, 201 bp, Bos taurus
ttttctaacataagcccattcaggtttaccagagaagtacaaagtcagttgcaaaagaatcaacaaaatagccatgtaaacatcttgcctttgccactctgcttgtatctctagttctctttctgtggaacaccttattgactgaggaccattcacatagtccttcacatattcagtttattgctttaattctcttacctt

SEQ ID NO: 20087 - DNA, 201 bp, Bos taurus
ctgcaacattctcaacccctttccccacctgtcttgtgcaaatgtcaaaaatagaatctctgcccaaagcaaaggagagcaggaagttattgtcggttcacggtctctggccccagcttgcccactccggttcttccatggaaatcagattttgcagcagtgtttgttgtgagactaaagtatccctattttttttttcta

SEQ ID NO: 20088 - DNA, 201 bp, Bos taurus
gcctatggggtcgcacagagtcggacacgactgaggtgacttagcagtagcaggggacttccctagtggtccactgtttaacactttgagctcccaacgcaggggggcctggatttgatctctggtcacggaactagatcccatatgctgcaactaaagatcctacatactccaacaaaagtttaagatcccacaggccac

SEQ ID NO: 20089 - DNA, 201 bp, Bos taurus
gcagaatatcatgtccaagctggtttcagttaccaggtcaacaggcatctccatcactctgagagtatagcaaattctgaagaatcttcattctgttttcaaaagtggctgcaccaatttacaatcccaccaacaacgtatgagggttgtcttttctccacatccttaccaatgcttgctacttcttgcatttttgatcaa

SEQ ID NO: 20090 - DNA, 201 bp, Bos taurus
tacagtctagagattctgttgttgttttaatgaaagcacagacttactctgttcagttctctatgctagaagtctgaccagggtctccttgggccaacatcctggtgtccacagagctgcgttctttctgaaggcacgagaaggactcctttcccagcgtttcccggttcctatgtggcctcattccttggctcagagcct

SEQ ID NO: 20091 - DNA, 201 bp, Bos taurus
tggccctggagaggtccaagtccactcccacattcaccacagcctctgtgtcacattcattccttcctgacttcttttttttatctttatgcgggagttgcttttgagctctgtggaagttctggcctttcaaggttgcactttacactgtaagaaatttttataatatggaatctatatctttagtaaatacagggctat

SEQ ID NO: 20092 - DNA, 201 bp, Bos taurus
agggcaacccgagacagtggccccaacggagctgcggggactcggggttgggtctgcactgactcactgcacactgcaggcctcggctgaggtggcatcacgaagacgccctgccgagatgctccgagcctcggagagattcaagatgtggagcgagttgctgggtatggtggaaggtactgagtgaccagggcccagatg

SEQ ID NO: 20093 - DNA, 201 bp, Bos taurus
taggaatgattgtgttggggcaaaggttcctttttagcacctggctaaatcctggctctggatgtttctgcggtgtgtcctgattcagtgtagtgggcagcggcagggtcaggggatgaggaacatgggccatcggaggggtgctgagctcagcagaagtgccttcagtgtgggcaaaggtcagaggtcagatgatagatg

SEQ ID NO: 20094 - DNA, 201 bp, Bos taurus
acatgagggaccagcgggagtggatggggacgggtcttcttaacgcatatgatgtccagggctcagtgggttattgatcagagtcgagtgtggcctgcagtgggaaggtgtgttcagggtgagtcagaaaggggtcaagacagaggctgcagtcggggcactctgctcctcctctgaaaagagaagaaagggaaccgggcc

SEQ ID NO: 20095 - DNA, 201 bp, Bos taurus
atccatggcaggtggacaaatgactactgaacagtgaacaaatacaggcataaatacagctacagacatcttgccaataaaaggtacatgtttaggggtcacatgcctgagagtcttggtttcacaagaaccatgctgtgaccttctcctcttcatatgcactgctctgccctctgtctcctgacccctcactcccaaacc

SEQ ID NO: 20096 - DNA, 201 bp, Bos taurus
tctcaaccattctttacatcctcctgtgatgaagaggaggaggaggacagtgatagatatatttatggagctcttggcatataacaagccttaaattaagtgtattacatagattttctactttgacccaatgggctagttaatatttatttctcatcttaaaggtaagaaaactaaagcttatggagtcttacttcatac

SEQ ID NO: 20097 - DNA, 201 bp, Bos taurus
tggccatacccttccctccagatgccagcctctcctctgctcaagtgggcagccggcccctcctgtatcaccagttttcctctcttgagtcattcctatcggcacacaagcaaggtgtaacctctcccatcttaaaataaaaactcctccctccaactgttgttcatttagtttccatccctgggtcgggaagatctcctg

SEQ ID NO: 20098 - DNA, 201 bp, Bos taurus
cagggttgcgtcaaaagttcaggaagaaggatgacaggatgaagaggagaggaagccacgcagacagcattatgatccggcccgagacccggcatctggatttccaaactgcaggaaaccagaggggcagtgaccagagttggtcctccctctcaccaggccaaagggaccagggagtgggcagggtgctgccaaaggacg

SEQ ID NO: 20099 - DNA, 201 bp, Bos taurus
gatctgacttggacgtcgaatcttgacagagatgatcaagttaaaacaagggtgagtcccaatcctgtatgagtggtgtccttacgaaaaggggaaatgtgggccaagacagacaggcgtagagggaagacgatgtgaaagcacttggggagggcgctatgtgaaggttatagagatttgttacaaggttataacaggtta

SEQ ID NO: 20100 - DNA, 201 bp, Bos taurus
ttgtgctcagatgggaggatttcctctgatggaattcacagcttgactgccgagcagggaggtgccataggtgagtcccaggtgagaggatcccgggacacggtctcccacacctctcttggaacaaccctcagctttggcctgcctacccctgtgggaccccagagcccctgacctggtactccgggaatctctatctgc

SEQ ID NO: 20101 - DNA, 201 bp, Bos taurus
ttttattaatagaagcatatgcagcagatcaaaggagacgatggccccaccgcgccctgcacgggacagagcgcagctggactcctgcctcatcctcttatgtacactctggagggccactgacggataggaggctatgcggagggccagaagcaggacggcgcaccgcctgcgacctgattcaccgatgcgccaagacat

SEQ ID NO: 20102 - DNA, 201 bp, Bos taurus
gaagacaagcccatggcctgagaccctacacgctctctaattggtgagaacggggtgttggtgggaatgacattccgacactaactctgaacatccgacggtgggggaagggcagtggccagatatcggcagaaccccgggctcatcctagctctgactagctttctcagacttagagactgagtcaccctcctgcccttc

SEQ ID NO: 20103 - DNA, 201 bp, Bos taurus
gcctgagaggacattctggacaccaacatccctccccagccctcactgacgcttggtgaacgactgccaacgaggtcaaccctgcgctctggctggctcagaggctggccttgcacacatcctgctggcctccagttttgttttgttttgtttttaatgtgggtaaacatggaccacagacccacaccaggcacctactct

SEQ ID NO: 20104 - DNA, 201 bp, Bos taurus
gggaggaaccatcaagagagacactgctctgcacacgaacctcgtgatcttgctctgctgctgtggcctctggtggccttgggttttcaagcgttcgggagcttgggttccgtgggcattctgaggaaagtcagctccacgccatggaggtctagacttgccgggccttggatgcgggggtctggcgcccccgcaacatcc

SEQ ID NO: 20105 - DNA, 201 bp, Bos taurus
ccccaagctgggagcccacctctctgcctccccagagtgagctggggcatcaccagccatgtcagcgctgcggctgggagaagggtctgcggccgatgcctgacgactggtctgatagtcagaccccacttcccttggggaaggcagtaggaggtgacagtagcagagctgggccccccaccaccacggctcaaatccccc

SEQ ID NO: 20106 - DNA, 201 bp, Bos taurus
aaatctctctgatccaaaatctgtcgtcttaactgcaacaggagaccactgtctttgtccgcctgaacacaagctcacagggcgtctcactgctgggaacaaaggttgccgcgaaggccagtatttatccaaacgacacatgcagggccttcaacgccacgtgatacaccacattctgatcaatatccacaaaacacaagc

SEQ ID NO: 20107 - DNA, 201 bp, Bos taurus
gggcccgggccactgctccttcctcactctcagcccaaaacaaccggactccagagaaaagtcacctgcgtgcctgctccactgccacctccttccttccccagcccttctcagaaccacacggccaacagcagaggccctctcaaggccatcctggcacatcttcctcttggcccgaaatccagtgagaggagcagcagt

SEQ ID NO: 20108 - DNA, 201 bp, Bos taurus
ttctggcctttctcacgctttgtcaccccattttcagaatgtcccgctgggtgagatactgtctccccgccaccctcctttgtctttgggggaggatcccggagaccctcggttcacctggcccaggtttgctgtctgccaggagatagctctctgaatgggtctgcctctcaaatcgccggcatccggagctgataggag

SEQ ID NO: 20109 - DNA, 201 bp, Bos taurus
cagcgaccaagcaagaggccacagggtcagagcagaagcgccagaagaagggagagttggaatcagtgtgaaccaagaataaagaagcccgcagcaaattcaggtaggaaacctataagatgggccagaggttgccagcctctagcatagaaggaaaactctctgtgggccaaggcaatttgaagcctcaggcagagagca

SEQ ID NO: 20110 - DNA, 201 bp, Bos taurus
ggctcggagaccgtcccgggagggtgtgcagcgcctcctcgtccgccagggggcggcagcgcaccgcgcggctgggccggagcgccgctgatcccgctgaagtgaggtgactttctctctgacaaaagggggttagagggacttcctaacacttcagtgggcacggctcggagttcccaatgcaggggccccgggttcgat

SEQ ID NO: 20111 - DNA, 201 bp, Bos taurus
tgcagaagtctccagaagggaaagaggaaacaggagaattttatgatccccaggaactccctcccctgagcaaacatgaggtgaggggaggggcagtgcgctgtctgtggggggcagggaggatgagtgggtaaaaaatgcacgcttcacagggttaactgtggttaatctcggacagggaaacttggaatgatttttatt

SEQ ID NO: 20112 - DNA, 201 bp, Bos taurus
attgtatgttaggtatatgtttaattttttgaaatattgtcaagccattttttttaagtgttattttacatttctgcctgcaggatataggaattcagttgatatatcattctccctaatacatggtatggtcagtctttaattgtaggtatttttataggtgtgtagtggtatgtcatggtttttatttgtgtttcccta

SEQ ID NO: 20113 - DNA, 201 bp, Bos taurus
ctggcttcttgctgtgatccccatacctgtagaatattcctcttttatcttaagaatccgttatgtgtgaccacagccagttagtttcatgtaacttccagaactgaaaaatccacacatccaaatttctgttagcttgatttgtctctctcacttgagaaaaaaataaaatattgtctctgctgcccgtttgccagttag

SEQ ID NO: 20114 - DNA, 201 bp, Bos taurus
ggtatatatacatgtaagttttttgttacttgggaattgaataaacaagattattcgaaagaatactttagtggtgtctaatactaattaagattattgggaaagaaacctaagggaatcaaaagaacaaagccagatgtatgttatagcaagataggcaggaaggatgaattctttaaaaagtaaattattaatgaccta

SEQ ID NO: 20115 - DNA, 201 bp, Bos taurus
ttgggctacaagaaagagctgatataccctaggtaattactgtttgagttggaaaactgacataaaaaagcatgaagacaatctgataaatggtggtaaggggaaggtcaaatttcttatagtaaaatggaatctggaaacatgctagctcactgctgtatggctgggaatgaaaaagtggactctcaggcctctgttctt

SEQ ID NO: 20116 - DNA, 201 bp, Bos taurus
ggtgttttagggccgtagtcctggaatctcaaattatccaccacaatgggagaaccaaggtagaaggacctcctccctggcctgcaggaggaagaggccccgtgcagggcggtggctcaaccagctcttctggtggtcctccgggccctgctgggtccaccttccccaccagataatggtccctgctgcctgcctgtggat

SEQ ID NO: 20117 - DNA, 201 bp, Bos taurus
tgcctggggggctggtgagcagagcaggtgcagagtgtttggccagaaaagaacccacgagtacaccgctgatgggttgtacttatgggcagaaatcccacaaacatccctcttctctgcgggccccttggcccccgtccaggggaagaaggctgtcatcacgcctccgtcgtacatgaaaacactcaagcctgctgcctc

SEQ ID NO: 20118 - DNA, 201 bp, Bos taurus
ccttcactgagccatttccctacttcagctgctgaaacaactcaaccccagagcaggtccagctctcgggactgggccccactctgtacacagcccggtcgctctacctgtcctcctggctcaacactaccagctgtgtcccctgcaaacagcctgaccttccccaagctctggaccgtggccgtggctggctttacagcc

SEQ ID NO: 20119 - DNA, 201 bp, Bos taurus
attgccggggcagaaagagccaaccacggctgtgcccaaatccccatcagggtgagggaagaaataaggtgggagaggaaacggggcagcagtggggccgaggagcagagatggatgaaccgggcagctcggggagacggaaaggcaaacccaggagcaacgtctgtcgggcagggatgaatcacggtcccccaccagctg

SEQ ID NO: 20120 - DNA, 201 bp, Bos taurus
gacccctcctttggacccacccagttgcccacccggccaggtcctcttcccctcttgctcaacctccagctcatgtgtcactgcccgaggacgtttcttctaccctctggccatcgaagtgggtgggaccttcatgacaccctgtgtcttccttgaaagcacttaagtagctcatgattccatgtcaattaggtggttatt

SEQ ID NO: 20121 - DNA, 201 bp, Bos taurus
gcacttcccaggagtttgactttggattttgagcccctttccatcccatcagggaaacagagtgtgtgtctctttgggagttggggcatacatgtgttgatggggccttgaagtctgtttcttcccaggcccgcaccccatttctccagatcagctttgtgagggtccctgggtcctgctaagcaccctttcatttctggt

SEQ ID NO: 20122 - DNA, 201 bp, Bos taurus
attaggctagcctaaatagactagcctaagtctattcccctcatgtccacaagcctctggaaaactaaggcaccaatgtttatggccattgtctttcccaaaatattctatgcagtttaggggctctgtgaccttaacccacatgaccttaacccctgctccccaccactggccgatacagctgggtattcttgttacaaa

SEQ ID NO: 20123 - DNA, 201 bp, Bos taurus
ttcaggcagctggcacagccgttgtggctgccctgctgtcacaggatcagttctcggttttctcttaaaggtggcaaccttctcacttgacaaccttccccgaaggccaggccaccccgcagttgggtctgtcctctcgctctcctgcacgtgggtttgctctctgcacaccggggcctttctcgaatctggcttctctcc

SEQ ID NO: 20124 - DNA, 201 bp, Bos taurus
gagtatcacattccatttagagcacaggctaaggctcctgacaagttaactaatagtgacatttcaggaaatgaaggtgtctatccttggggaaaactgccgttcttaactatttgttgtatgcctaaggtggtgagctccctgtcattggaggtatgccctcaggagttgtgtgatcttttagaaaggggtcttggttag

SEQ ID NO: 20125 - DNA, 201 bp, Bos taurus
atcaccaatgggctccggctgccaaaatctctcagttcacagaggctgggatgttgggtgtggtgcccagagcaagagtgagactggccctgggccctgccctggtcacactgctcagccccataaccagccctggcataaatctccaaggatcagaggaaagagagcaggctggggggcctggcaagggcagcgagggcg

SEQ ID NO: 20126 - DNA, 201 bp, Bos taurus
gccctgaatctttactttcggaagactcaggatcttggggaagagtcccaaggagaggacaggggaggctcagagcccctatggagacaaatagtcggccactgactccctgtgtagccttgagtatatctcttcacctccccaagtctcagctgtatgtgtactcagtcattcagtaatgtccgactctgtgcaaccccg

SEQ ID NO: 20127 - DNA, 201 bp, Bos taurus
aaaatggtgaaatagttatctttaaactggttttgcatcactgtattctcaccaataaacattgttctggtaactaaaggtggccccttcttgatcagccgcctctggattcttctctttggctcagatcctctggactttctccatctacctggaatcagtggccattctgccccagctcttcatgatcagcaagactgg

SEQ ID NO: 20128 - DNA, 201 bp, Bos taurus
tgattttcagctggggatactgctgcttacaacaaaagacagtatttcccacgtctttgtgtattgatagagccatatgactgagttcaggccaatgagacgtaagtaaaagtgttgtgttgggagagggcttcataggagctgactcagctggaaaggaccctttttggcccttttatcttgcatttttatttccccaac

SEQ ID NO: 20129 - DNA, 201 bp, Bos taurus
tccttgtgggccacgttccctgttggctgttgcctggagacttccctcagttccacgtccgtgtgtttcttcataaggcagctcaaatcctggcagccgcttccctcagagcgagcaaggaggggccggagagcaggagcttgaccgaggccggggctttgtaatctcctcacacaagtgacatcccgtcacttcttgcca

SEQ ID NO: 20130 - DNA, 201 bp, Bos taurus
acagatgctgcagacagtgcaggcgccaggggctgactcaggtctgaaggccatcctgccaggaaacaggctgcctgctgaggagtgggctccccgtgacaggttacagctgtacaacgaacggatgctccctcctcccgaccaagccttcccccagcccgttctccccaacccggtctccctgtccttgagtctgtggac

SEQ ID NO: 20131 - DNA, 201 bp, Bos taurus
gccatgtgccttgaagactcttagttccccaaccaggaattgaaccgtggacccccagcagtgaatgcttggagtcctaaccactggaccccacagggaattcccagggccacagttttcctagaggtgtgtttcctgctcggtgaggtaaggcagtctcccagcatcgctcaaaggattgtgcactgtacagactcactc

SEQ ID NO: 20132 - DNA, 201 bp, Bos taurus
atggaggaagagggcatttcaggcagggcaaacagcctacacagaggcccaaaggagcatatttagtataaggagaagatggcacagtgttgtgcttttataaagctggtgtcagggtacagggccaacagctgtcttacagacctgtaagtgacgtgtcagactcagattacatttcagaactggagatagtcttagaaa

SEQ ID NO: 20133 - DNA, 201 bp, Bos taurus
ttagggctaatggccaaaaactgaggctcctgtcctcatgtctttgacaccctctgcaaagcaccagagacgagagatgccggtgtgagtggctttccctgggcttgcagtgggctgggacgggccatgccttcctgagcgccccctttcacctcagttgcagcctccgaacagacaaatcatgaatgagatggaatgttg

SEQ ID NO: 20134 - DNA, 201 bp, Bos taurus
ggaagatttgttgaggaaagcttgaaattattaggaaaaatgatgtgtctccagtccctgtggagtgtcgtgtcctctggccacagggtagtatggttttcccctgcctggagcccagatctcctcatgagaagatcagtgtccagcctggcctggtgctggtcattgcctgcctgtcttatcaggcggcactcagccagg

SEQ ID NO: 20135 - DNA, 201 bp, Bos taurus
ccaaggctcgctctaggtggttcctctggtgggtccagtagtgtttgtcttcatggagaaccagagaagtttgaggaggagagagaggctgcaggcacctgtgtaggaaaatgggcctggaagaaggggcccccacagaggctagcgtccctcagagggcagaattcagccacaggctactacctcacctctcagaaatgc

SEQ ID NO: 20136 - DNA, 201 bp, Bos taurus
gacatggggcatgggcctgaattcgggagcctgtgcagaccttgttgatatcaaccaggtcccctggggatgggtggctgttcaccacgcttttatcaggcgacacctggccaggatgtgcgggtggctggggacccactcatctgtgaggggcctggcaagtggcagcctctgcagacgtcagagccgggagagggggct

SEQ ID NO: 20137 - DNA, 201 bp, Bos taurus
cctgacctatctggtgacgtcctgcaactccctgaaggccccaggctcagctgcgttcttatgaattcactcagctgtttgctgtgctgtccactccccccacaaatagggcccgacctgggactctggttgggacagaaaggctgagcctccgaggaggaggcagcagcttacccagcagagaagtgagcagggtcagcc

SEQ ID NO: 20138 - DNA, 201 bp, Bos taurus
agggctgcccacattctccaaggctcctgcaaggtgggtgcctctatgggtggctcccagatctgagttccacggaagatgattcagggctggcccagccctcacttggttctgaaccatttatggtttataaaacaccttccctagtgtcagtaatgcctaacacggcccccggcatcactgacaccccagtgagcccag

SEQ ID NO: 20139 - DNA, 201 bp, Bos taurus
cttgccttctccggaacagagattttcaaatcttgattcttgctgtgtgaccttgggcaaattcctctcctttctgggcctcagttttatcggctataaagtgagggattatctagaatctagcagaatccgatagagcaaaggtggcaaattgttggccgaaggtcggcatcctgcccacgtcagagtctgttctgggtt

SEQ ID NO: 20140 - DNA, 201 bp, Bos taurus
ggtcctcacaggctttgctctcaggagcaaaagcataataaacaccttttccaaagccccactgcttgacccttcagaccggtcttagccagtttcctccaggtccctgggtcgtcatagcaccattttttttttaatcaatagatcccaaatgtgatttgttagaacaattattaactcacatctttactatttgaggca

SEQ ID NO: 20141 - DNA, 201 bp, Bos taurus
ggtcctgtggcctagagctggcttaggagcatctgctggtcatgtgaacaaatcacggagcgcacagatacgggtacttagggcagctctgtcttgctcatagtgtggccccaggtcagcgtcccctggggacttgttagatatgcagactctgggcctcagaaactctggaatgtagcctggcaagctaggctgcaacaa

SEQ ID NO: 20142 - DNA, 201 bp, Bos taurus
tgatgggggtatggaaatgtacattcatgcagagagaactgctttgaggcttttcataaaagtcaaactaattcaaaaatagccaaagccccagagtatgtgacactaagtgctcaaatactagttaatgtggcaaagaacctcagcacagtttccatcattgatagacaaccttccgaggcgttgtgtgtgtgtgtgacc

SEQ ID NO: 20143 - DNA, 201 bp, Bos taurus
ctggcaggctcacccatctggtgctgaccttcagtgtcctagatgtgacacttggttcccagggctcctaccattacaactgctcccctggccattttgaggtggcttattacttttacaatcctcttccccactcgacctcaggaatttattcctggctcctgtagagtgaaaccagaagccacacccatggtgcaatgg

SEQ ID NO: 20144 - DNA, 201 bp, Bos taurus
ttgaggctaaaaataataaagttccagttccccaatagtgtgagttaagaatgacatttccattcaaatgagttttcattcttctcccaaatagtgaatttggagtacagacctaatctctcatctgttcttctgtgcttcgttcctttcccacgtaataaatatcatcagcctcatggccagtttctttaaagctctcag

SEQ ID NO: 20145 - DNA, 201 bp, Bos taurus
ctcacctggccagtgctctaatatttcccatgcactagactgagactggacagaggcctggttcagcacccagcactcatcggcaacaaggcctttcccacaacgtcaaaaggcaacatactctacccgataaggcgagttcacatgcgcctagaacatctgggttgggccctggcacacccccaccccacgcaccaatct

SEQ ID NO: 20146 - DNA, 201 bp, Bos taurus
tcagtttctcaaacagggcaacacatccctacccaccccgtcatggggctgctgtgaggatcaaatgagacaaacagccggccgcctccatcgggtcctcatgcgttgagggattgactattacagtgatcacggtgaacatgaagtgtccttggctggattctgagctgctagaaagtgggcccatgccccccaccttgc

SEQ ID NO: 20147 - DNA, 201 bp, Bos taurus
agcctcagagtgcagagctgggctgcccacgggctttgaggccagggactacagaccattcgccccagagttctggcctccacacgctgcccagtgatgttcgtgcccagaatttcaccaaaatgcactgaggaccctggagtcatcagcgagaaggagggttccctggggcggcccgtttggtccctcgcccgagtcacc

SEQ ID NO: 20148 - DNA, 201 bp, Bos taurus
tccccgagctgtcagaagtgctggcatagcaggcaggaggtgtgactggagtctcccgggaatcatctacctcctggtctggggcatcagctggggccctctctggggctcctggctttccagcaggttggttgtgtgcagaagacacacggtctcccgttgtagccctgttctgacaccgaggccctcgggctaggccag

SEQ ID NO: 20149 - DNA, 201 bp, Bos taurus
ttggtggattttttttttttttccttttgacacttgaaatatttcattccactctttccgtgtttgcatggtttctgaagacaagtatgtgtaggccatatttttttttgtggttgcaagtgtcataaaatttttgttgaaaactgggcaattctcaaatcatcttggccctcctttccattttgtttgtttagaggctct

SEQ ID NO: 20150 - DNA, 201 bp, Bos taurus
ctcggccgcccgtcaacaggaggatggagaggtgggcagggttcccgggaatgagaaggaacacgtgaccagtgtgcgcagcgccacgactctccaaaccgcagtgccgagcagaagaagccaggcccaaggagtgcacaccgtagccccgtttctcaggaggaggaggtctaaatgcacgcagctaatctctgctggttg

SEQ ID NO: 20151 - DNA, 201 bp, Bos taurus
gtctctggcaccaacccagccaacctgagccacttgggctgtatctctgtgctgggtaccagctttcatctggtcacacctgagcccctgcgggcaaccatctggcctctctggggccattcaggtctccacatgacctgagcagcaaaaccacgacccacaaaaccatccctgcaccaacagcaacatctttccatcgac

SEQ ID NO: 20152 - DNA, 201 bp, Bos taurus
gtgaaggaacaatgcaaagccccggcccttggccgttgcgccgcctccttctcctgcgctccctttcctgtcttctccctccagagttgggcttcggggcgcctggcctcataagtcacaggattaggagtgggggcttaggaaccgttttggattgtgtttttgtatgtgatgctgctgctgctgctaagtcgcttcagt

SEQ ID NO: 20153 - DNA, 201 bp, Bos taurus
gacttggggtttcagcagcagcctcctgggagtagcggtggcggcatcaagagtaacaggcttactgagggctgggcctgcttctctgtacttcactcttaactcatttaaccctcttgaggttactttccccattttgcagatgaggagaccaagggccagagaagttatgtgcccatgaccacacagctgttaaatgac

SEQ ID NO: 20154 - DNA, 201 bp, Bos taurus
cctgcgttctcaccaccgtctccctccttccacagtgctgcccttcccagcaccagctggaggctcttatcttggaaagtcttttttttttttttttaacaccgtgggccagttgataaacagtttccgagacactatctgttagtggcaagtagctcatcagaatacagcatgcagctgagagtctgttggtgggttaaa

SEQ ID NO: 20155 - DNA, 201 bp, Bos taurus
gtggagctgtgccctccccatccccctcctgcatccttgcgtgcccatcagacagtccagacgtgtccccaccggaggggctgccccgggccagcggggatgaagcgtgtgtccgctgctacttccgtcttcctccgatacacagaggacacggcaacgcagagggagtcccggccgggtcagctctggttcctgagacga

SEQ ID NO: 20156 - DNA, 201 bp, Bos taurus
tcagtgtgaccctctgtctccgcagggtccattgccagctggtccggctcttcgcacgaggaatcgaagaaagccccaagcaggagtcccgcggctgagcaccggccgtgggaaccgtgtctcagacaatgacgacagaccaattatgttgcgatacattcaaatttagaaatttatttttgatagttgaatattgatttt

SEQ ID NO: 20157 - DNA, 201 bp, Bos taurus
atggcacagccctttacaatgaacagttccttgacagtagtggctgatgttcatcttgcagtcagcgtttgccaggccctcttcctaccaccctgcacacgtttgtctccctggtggtttatttcatttttaaaagtctttgttgaatttgttacaatattgctcctgttttatgttttttggccaagaggcatgtggggt

SEQ ID NO: 20158 - DNA, 201 bp, Bos taurus
gtccttcctcttgtcccgccgtcgtctccaaaccacgctctgatgcggcacttcctgtactgtctccagccacccccactgccctggctgtttggactcccgcgtcttaccccaggccatcaaaactgccaatgtggtttctacctccagttttacccttttcaataattttctttaccaggcagccgtgaaggatttttg

SEQ ID NO: 20159 - DNA, 201 bp, Bos taurus
actttgttaaggacactgagatattcagccagagcctacctgcgcaagcaggcagaggctaatcctcacctcagactcagtatgaaaggaagcgtggctgtcatggccacctgtatctctgcccttgatagacgtcagggtcagccaggttcctgccccccgggaggggtccatgctctgagcatctttcctgatgctggg

SEQ ID NO: 20160 - DNA, 201 bp, Bos taurus
tatgatttttagtagtgttaaaactgtgatttctttttgctgccttatttcactggctggatcctccagtacatttctgaatagaagtgagggtagcttgcctttttctcaatatgtatcaggtagaataccactaatgttttgtcattgtctattaatcttatacttgtgttcatttcttagatgatttccattagactc

SEQ ID NO: 20161 - DNA, 201 bp, Bos taurus
ggctctgttcaggaggatgggcctctgagttttgggcccaggagaccccaagggccggctcttggccggcagagctgagaggtgctctggatgacccgaagcctcacctgcttctcaaatgtgggctgtggaccagaagcctgccctccccagggagcatgttgatcaagaccttccctcccaccgagaggtccactccag

SEQ ID NO: 20162 - DNA, 201 bp, Bos taurus
ctaagttaacatggctcctctgactttctctggttgagtgctgctatggcatctctttctccctccgtctagtctaccgtgccttcgtattcctcacagacgacatagggttggaccttgtgtttttgatccactctgaccatctctgtctttgaactaatgtatttagaccattcgcatctacagtgattattagtgtag

SEQ ID NO: 20163 - DNA, 201 bp, Bos taurus
ggggcagccggtgcagcggcaggcatggccgcagggagctctgagacgagagaaaagatctgggggctcaggcggttttctggggtgaggggtggcctccgttgttgggacagagagggaaggggataaaggaaagggcattttctactctcaaaacagaggctgggcgcacatctgcttgtaggggcccacacctgctgg

SEQ ID NO: 20164 - DNA, 201 bp, Bos taurus
aagcacggcctgggctggatggggaggggttgcaggtggctctttgcagaagttgctagaagccctgcagccagatgtcagggcggagtgggaggggggcggtgtgggaggcggccagacagtggggcccctcaggctccgcccacaggagacagcctgggtgcgtccctcgtcccatctctgcaggacctgttttttaag

SEQ ID NO: 20165 - DNA, 201 bp, Bos taurus
ggatagtggtggggctctgcagcatccctgggggcaggaaatttctgggcttgacctctgtgtcgtggggtggccacccctccccacacacggatttgtgtgccctgagtgcctagtccaggacagtacacgagaagcctttatgtctccttgcttcaggtggatcagccccggcagctgcttggcctctggctcccccct

SEQ ID NO: 20166 - DNA, 201 bp, Bos taurus
cacccggagaccctccaccccaacaaaacccaggagcctgtagcccgggatctaactccctggagaccctaaagggccaggacacgttcagactctcaggtggagatctgaccatcttctgctaaaggtcccgcctaggctcgtggtcagggggcagaagtcccagaacactgacccgcgggggcccacgaagcgggacaa

SEQ ID NO: 20167 - DNA, 201 bp, Bos taurus
gggcccagcctcctgcccacagtactgtggggcccagcctcctgcctcagcaaatcactgagattatctccccttcaggaagattaccctttccctttaaaagctgtcatggccaagtagaatctttggatttggtcttgggacatgagtctactccacagatcttctccgcaattgctggcttttctaattagaacacct

SEQ ID NO: 20168 - DNA, 201 bp, Bos taurus
caaacagagcccagtcctgggcccccgagcctggctggcaccgctgcccagcgtcctcgaggaagccaggagacaaaaccttgtctctcacccctcccccagtctgtccagggcaccagatcaaattcaagaaccaccctcgtcctcagacccgcgcttcctcatggacattctgatctgctggcatccagtctgaaagtc

SEQ ID NO: 20169 - DNA, 201 bp, Bos taurus
ggacaacatttcctgtccaaagtcagataccaggcaagtcttttctttcttggatgtggatttttgttcttaaaccactgttggctcacaggctggaactgaccttgggctgtagtctgccaaccctgacctcaagcttccttggcagttggtccctcctggggatttaccctaaaggaatgaaaacctacattcacacca

SEQ ID NO: 20170 - DNA, 201 bp, Bos taurus
aatttacaaattaagagctgaaagtaatgattgcaaagatgttcaaaggacttgggagaagattagatgagcagagtgataagttagatgtgtttaaaaaagagttaaagaatataaagcagaatgaaatacataatacaaaaactgaagtaaaaagacactaaaataactcaacagtcaactgacacagaacaaatcagt

SEQ ID NO: 20171 - DNA, 201 bp, Bos taurus
ctgttttttttattttattttatttttaaactttacataattgtattagttttgccaaatatcaaaatgaatcaataattacatgctttttaaaggttttatacctgttagaagttaattttctttcttgggagggcatattctattttagagttaaacaaatgtgttttatgtcttatcatttattgtttaccactttct

SEQ ID NO: 20172 - DNA, 201 bp, Bos taurus
aggggcagggtcctggttttaggagttggcaagtggcttaaaaacaaattaataagaggcaacagaccagatgttccataaaagtggagtggagatttgagcagggtatgtttgtaggtttatgagaagggtggtaaagatttgggcccaaacagactgcagggctaactcccgagtgaagtagcaaacaccatctctgga

SEQ ID NO: 20173 - DNA, 201 bp, Bos taurus
aaaaaatgggccaaagaactaaatagacatttctcccaggtttatttgtgataggcatataattcttcgaaattcttatcacagattccaccgagagtgaattttgctaagagctgggcctaccaggctcctttcattgcatgaattaccttgtaaaaatttcttgcaaatgaattgctgcattatttgctgtgcatattc

SEQ ID NO: 20174 - DNA, 201 bp, Bos taurus
gagaaaaggagtactgaaagcatttcagctcatgacactggtgtttgctcaattctggctctatcttgaagtttaacttcagctttggaaatggatgcagccttggaaatggaaatggaaattttatcgcaagatacttttgtgtaatgtgtgaattagagatggtttagttggcaatgatttcagaaatacatgtttagc

SEQ ID NO: 20175 - DNA, 201 bp, Bos taurus
gatttatacagagagctgccagagaactggtacctgttagctttgcaataatacagctgtaaaagcccaaagtgcctcttccatctacccgggattttctttgttctcctttttctttctcttggaccaggatgaaattgtatgttaaagagaaaaagacaatgttaatggcaacactatacaatgctgagaaatagttct

SEQ ID NO: 20176 - DNA, 201 bp, Bos taurus
atgaaccaataaaatgttgcccacttaggagtggagaaaaatacagcaaaggattggggaagagatcttaaatctgaaaagattttgtactcagtttgacgcaaaagtccctttgaactctaactgtgtttcagttggaaacttgaaatacaggtgaagcattaggagtgttgtttttgcagaagatatcgtgagtagtaa

SEQ ID NO: 20177 - DNA, 201 bp, Bos taurus
tgagctgaggagtggagttaaaagacagtagatttatggaagctatgtcacaatgaggaacaaaccagaggtgagaattggtcaaaagaaagggaagactcggctattaaccattctaagacttacaggaaagagaggaaatgattgcttgatggaaaggtaatatctgagggaaaactttcagtttatatttgttgaatt

SEQ ID NO: 20178 - DNA, 201 bp, Bos taurus
ctgaagccatgattatagttgctttagttgatccaaacgtcagttgaattcataatagctcctaagccataaactggtctctgggtatccctacattcatcgactggtgagtcatctacatttatattgactacaggatgattgtaccctcacagggcaggtaactgcttccatattttgccctgggctacccctatgagt

SEQ ID NO: 20179 - DNA, 201 bp, Bos taurus
aaagctttggggaaagaaaccagacgtgcagactgacaccagcttgtaaaggactcttacagctttgcccaagaattggtcttcatcctgaagaaaatgggaatctgtcgaggcttagatgtaggcaaggagtgaaatctgatttgtgtttgagagatgtctttgtgccgctgtgaggatggatagcaggatgcaggaaga

SEQ ID NO: 20180 - DNA, 201 bp, Bos taurus
aatatatctgcctactcctgaagttttcctcctgtcctgatcctcctaacatttaataagatatcaaaccaaatgtgtcatcaccattaaaaatacacatgagcaagggaaagggacttctggtcctctttcttccacaactttatcatctgaagggtaaggccaacaaatgtatgacttcttgtatcaagaaatggactt

SEQ ID NO: 20181 - DNA, 201 bp, Bos taurus
actaaagaccaagggactagtgattaaaaaaagacgactagcctctaactcatgtttattagttggattgcgatgcacctgaacgatggtggagagaatacaggagatagtgttggggagttggctccaccaggagtatgttggcatagttatatgaagaagggctttgggacaggacagcaagcaagtacctagagagaa

SEQ ID NO: 20182 - DNA, 201 bp, Bos taurus
cacggctgagccgctggggagcctgttattttatacatatcacacctgttacaaacttcaaatctgaaaatgttgctataatcatggcctctgttctccggcgccaaatggcaacagagttttgggtgaagtggaaaagagtagcttttattgctttgccaggcagagggggccacagtgagttaattccctgaagactgc

SEQ ID NO: 20183 - DNA, 201 bp, Bos taurus
atggtccaattgaggtcagaaaaagagagagatctttatttctatcagtaaaccacagtggtgtgtgtgtttacatctatgctattgtgatgatgaattaacatcatttttatcacctggccacttcacaatacacaagaatttaggggtgagttggtcaatatcaccatgacttccattccagagttcatggctgtgtgt

SEQ ID NO: 20184 - DNA, 201 bp, Bos taurus
cattatttaaaaagcaagccggggacttccctggtggcccagtggttaagatttcatcttccaatgcaaggagtacaggtttgatccctggtcagagaactaaggtcccacacacctccaggccgaaaaactaaaacataaatcagaaacaatactgtaacagattcaataaaaacttggaaagaaatggtctacatcaaa

SEQ ID NO: 20185 - DNA, 201 bp, Bos taurus
ttccacaggactaggggaaatagaaactccactcttggagggcacacgcaggatcttgtgtgcaccaggtcacaggagaaaaagcattgacgtcataaagagaccgcgcaagacccacctgctagtattgaaaggtctgctgccgagggtgggttggggggcggtgctggctaacacaaaagaccctcaacagccaaagca

SEQ ID NO: 20186 - DNA, 201 bp, Bos taurus
agggccacacggaatcctgctcttgccccttgcagccaagtccccgtgcagagagcagtgtccctggaacaccaaccaggaagatctctgcctctgaattcgatcggccgcttagacccatcgttatcaaggattctgagggaactgtgagcttcctctctgactcagacaagaaggaacagatgcctctaacctccccac

SEQ ID NO: 20187 - DNA, 201 bp, Bos taurus
caattactctaaacaggccatgttgctgaccctttgtcctgagacagggttggggaggagggataagaacagctgtctgctgcaccttcggaggcaggcacattctgtcagagcctcaactgctgcaggcctgaactgggtggcttcagggattgggatgccactttctgtgtggtagacctaactgagcttcagctatcc

SEQ ID NO: 20188 - DNA, 201 bp, Bos taurus
gttaaagctgccacaatcagaatgggtgaggctgtgttgcagttacaaacagtccaaagtctcagtggcttaaaatcagaaaggtttgtttctcgccatgctcttggccatttacggactcagaccagtgagactttcacgtttgtaatgtttctaggcaacatgaaaggagaagggaaggcagagaatcaatcacacttg

SEQ ID NO: 20189 - DNA, 201 bp, Bos taurus
agccatcgaatcagggagcagggagaaaatgttttgaggtttggatctcctccaaatccctgtttaccacatcagagtaggtggccattaagtccctactcggttccatttacctctcacgagttcctctacctacaataggacaatttcccaggtatgcttagaaaccatcctgtggaggtgagcagcttccagtttctg

SEQ ID NO: 20190 - DNA, 201 bp, Bos taurus
aaaggaaaacaaaacaaaacaaaacagaggaagcatctactccttttattctttcttctttattttactcccttctatatgcaggtgctttcctaaaccacgaggatgagagagacacgccaggaatgacagagcagtgaactggaaatattgtggtccttgtgcacacacgccttagatgactttcctctgaacccatat

SEQ ID NO: 20191 - DNA, 201 bp, Bos taurus
ttttggccttaccatttttagagccagtgctcttgatctcttcaatgatcttcaagagatttgctagtgccaacatgacactcttttaccaaaatacaactatcctggaaggacatagtttttgaaactctacccttttccatcaaattcttactgtcctcagatcagcttctcagctacttgacagaaggattcatgtga

SEQ ID NO: 20192 - DNA, 201 bp, Bos taurus
cagagggacaaaacccagctccacccaccagtgtgaaggcaccaatccctcacacaaggaagcctacatagcctcttggaccagcctcagccaacaggaagcagagaccagaaggaagagaaccacagacaccagaagaaagaagacctcaatcctggagcctctggaatggagactatatgcagaaaaagagacaaaata

SEQ ID NO: 20193 - DNA, 201 bp, Bos taurus
ggatttgatttcacagaacagaatatatccattagagaataaaaacagcagtgtatacaactgtaaattatgtgttgtatatatgttgtcctctgttttgtacaacaaaatgaggtgaaataattttagggcagggattctcctattctttctttttgcttaattaattagaagtgatgttacttattatttctcttcaaa

SEQ ID NO: 20194 - DNA, 201 bp, Bos taurus
aaggatctgtgaggatggtaacagagagcatcaatacagtaaagaatgtgaaaaaaataagttaccaatggctttgagctgcttcctgttaccctattaacatgtggacaattttaagacagaaatccaaaatttagtggccggggaaatctttatgaatgaccgtgttaggatctcttctatctcaaggattttggaaga

SEQ ID NO: 20195 - DNA, 201 bp, Bos taurus
ccctttgtgttatagccacagtacatttgtactacctttggtacaaaataccaatatttttctgcataacatacttgattttatggtttaaattgccacaaactagatatcattcttctcaaaacatacacattcatttaactatctatataaatgattttatttagaaaaccctatgaaattaatatgaatttaaaataa

SEQ ID NO: 20196 - DNA, 201 bp, Bos taurus
agtctcttattttttccccttttctcacaatttgcatcaacaacaacaaagatgacatgctaagaactgtgtaaaatcatatttgttgagtgaaatggaaacaattgaggaaaacagaaatcttctccttagttattttaccttgcaacatatattatagagattctgaaaagattttcacaatattatatattccataaa

SEQ ID NO: 20197 - DNA, 201 bp, Bos taurus
gctattattttttgaaatattgatttatttggctgtgttgggtcttagttacggcacgtgggatatttgtcatgtcatgtggggtttttccttgtggtcactgactctctagttgtggtgcttgagctccagagcatgtgggcttcagtagttgtggtgggaggcttagttgctgtgaaacatgtgggatcttagttaccc

SEQ ID NO: 20198 - DNA, 201 bp, Bos taurus
gtgcgcatgtgcacccacatccatctagctatcgatctgcacactagacttctaaaattagcattccttcagtttatttggtcatatctactttgaaatgcctaacaaaattaaaagaatgtgtgattttaaaatatattaaaatatgcattttataatattttaagaatttattgactgtgtagatcacaacaaactgtg

SEQ ID NO: 20199 - DNA, 201 bp, Bos taurus
acaggttaaaaatggtataggccaaaatatagacttttggaatttttgctgcctcaatagatttagtatattttttaccagctttataaaggaaggaaatgattaattacctgtaggccacttagttaatcattgtcatcattcaaaacacagtgaaacaaaagaatacctaaattaacaaacttactaaatatatgagtt

SEQ ID NO: 20200 - DNA, 201 bp, Bos taurus
agtaatttctaccaaatgaagatgaccacagttggactcaacgtcaacttgggtaaagtcagcaggagttccctgggctgcacgcatgcttatactttgttcccagtttgtctccaggcatactgatatagattgtgccagcatcaaggacaagccttcaggaaggcctgtggagcagatgcacacaggatatttcacttc

SEQ ID NO: 20201 - DNA, 201 bp, Bos taurus
taaaattgagtaaagacacaatcatttccagtattacaactgaaattatttttgaaagtcagtttgtcatctttccaaatgaattctttctcacaactcatacaattttttaatcaaataatcagtctatttaaaattttctcttacaaaataagatgcatacaagcatcactttttgataccgattttacaagacacaaa

SEQ ID NO: 20202 - DNA, 201 bp, Bos taurus
tagtccttggttgtttcagtagtttaagggaaaactgtaaactatggaaggggacacagatcatttccaaacatctagatctctctgacacaaggagaatgctgcaatttgagaatgtatggatgaaaatgttgatatataggcttccttaagcaaatgagtaataaatcaaggaaagtgacataaggctgcttataatta

SEQ ID NO: 20203 - DNA, 201 bp, Bos taurus
aattttttttccttgtaggcaattaagtgttagcttgaatttcaatttattattttgaagctttgtcagggaatgtctggggttccctacccactgacaagtatttagccttaatactaagccatgacttttacggagggttactgaattctactccagcacaatgaaactcaatttcattatagctatgtgaaagtctgg

SEQ ID NO: 20204 - DNA, 201 bp, Bos taurus
tgaataaccataaagtcagactaagtcatatataagtactttgcttcaaaacacattggtaagctgaccaaacctctttgcttatttcatgaggttgtaagtcaatctttttataataaagacaattatattttatccacaaccctaataaacatttttatgcaagtactttattttatatttttctttaataatgaatac

SEQ ID NO: 20205 - DNA, 201 bp, Bos taurus
aacagattttgtggacaagtctgggcatagtgttattggccacagatacggcgtatgtctctggattacctggctctagtgcccagggtgagagcattcacggcttccacaggactgtagtagactaaagtggttccttatatgtacacaattttattttgggacatttattgaacagtcacagctgcctgatacagttgt

SEQ ID NO: 20206 - DNA, 201 bp, Bos taurus
ggaaatgaatctctgtgtatttgaattagtacattcatttccacttaaaaattctatattttgtcatgtggaagaaatgttagttgaagctaaaaattcacattatctgagaaaccgtttctgcaattaaataaatgatagtttaacaaatattaaatacatgtatttttttctcaacccagtttccacctttgtattgat

SEQ ID NO: 20207 - DNA, 201 bp, Bos taurus
agaagaaacaggaaacacttgtgtatttgaaagaagcattgacacctatgatgcttggaattagattctatgacatgtaagaacaatggatccagaaaacgtttatgaaacttttattgcaacatgttttcaccttgtcagtttaaatttttaatgcacactgacatcaaccacttgctctattgtatacatacctcataa

SEQ ID NO: 20208 - DNA, 201 bp, Bos taurus
aaatagtattcaaaagaaattggccttggatattactatttcaatcaactaaacatgtctgatttatattctgtttactttacattgacaatagataggggaaaaaaagataaatcttggctgtgtaagctttattttaaaaatgaccatgtaccaaggatttctgtcactaaatcattgatttatctggattgggaggca

SEQ ID NO: 20209 - DNA, 201 bp, Bos taurus
agactacatgttatgaaccagttccttaaaatctctctctctccctctgtatctctcactctttcatattcctcatgtattttattagggcatgatggctcagccaagttgatatatacattaaccatcacattgatggaaacattaaccttcaagagggcagtggctgaaagaggctgctagtggtcaacttgtaaggaa

SEQ ID NO: 20210 - DNA, 201 bp, Bos taurus
gatatgttaaatatatcagtccaacagtgttactctatgcaaagtagagtttattctcctgtgctcaaataaattacagaagcattagaaaactgtattggaatattgcttacatttctgtgaacaaatggtttattttaatatgggacaggcagaattagtgaagacatattggcaattttcatagacataagacacaca

SEQ ID NO: 20211 - DNA, 201 bp, Bos taurus
ctgccatgtattttgtttctaacatgttaacattctttcagtcattaactcttgagccagcaatttgtttttaagctcaggggaggcctgggaacctagtttttctacaaacaaaaagcagatggaggacaagaggaggagtctgtcctgggaaggccacataggattctgcttgtttacgttatttagaattgacattct

SEQ ID NO: 20212 - DNA, 201 bp, Bos taurus
tgacactgctatggaggaacagcttgattttttcattcgtaataaacatcaatccctttgtctagtacattaactcctctcagttcagtagcaaagcttcgaatagcaagtggacctcttaggtttcaaaaaaataaacccataattatatttcctgatgaaagcatttctttttgggtcctagagaataaatagagtgat

SEQ ID NO: 20213 - DNA, 201 bp, Bos taurus
gcctgagaatcgttccaccgaggaattgagaagtgctccttctaggtccctaaccagttaatcaaatgtatttcccactgtccacaagttaatgtgcggcgtgccaggtgagtcagtcataaagaatccacctgccaatgcaggagatgtgggtccaatcccagggtaaggaagagcccctggaggaggaaatggcaaccc

SEQ ID NO: 20214 - DNA, 201 bp, Bos taurus
caaatcaggtagcgcagcatccagataattaatgagcaagaaataaaatttcaatcaatgagactgtccttcttttgtctccatggcctctctcccatgacatcttacctaattgtgcccccttcatgaaccaaatgaggaaatgaacgaaaactaaggaagaagaggaaatgattttttattctctcaaaagaatatgaa

SEQ ID NO: 20215 - DNA, 201 bp, Bos taurus
tataacccagtttacttatctaattccagttggcatttgagtttgtgtaactaagacttcacaacctaaaactctggcccctatttacctttaatttaatttttgaaatgtcaaatcttctcttggaacaaaggaaactctaagacttcacaacctaaaactctggcccctatttacctttcttaggcttgatggtagatg

SEQ ID NO: 20216 - DNA, 201 bp, Bos taurus
agatgactgattcatcgcagtccccataattgtccttcttcctatgctgctgggattcttcatgctacagtggtaagccaatctgcactgctagaactcatcatccagatactagaaactttcactaagttcacataaacaaaagatatgatttttttttaatttggtgatcatctttttatctttttccagttcctacca

SEQ ID NO: 20217 - DNA, 201 bp, Bos taurus
ggaagtaggcaactctagttaaagattgcatcacattcccaaaagtgagattaggattgcagtgtattgtgcagtaaaatggagtgtgtatctctaccttagacaggtttcaagcagtaccaagctggggatgggactggcgacctgagagcaatagtataaaggctttctaataaaattttgttccatagaatattcaca

SEQ ID NO: 20218 - DNA, 201 bp, Bos taurus
ttattaacaagtgtgtatggagggggaaaaaaaagactaagtataagtattaagttagagtattaaaataatttaaaggatttgtaactatacctatactaatatggaattgtaagacatttctatcttatttaagtcaaagtctttagggaaataaatactgcctgaaatatgtaatcggtgaggagtacaattccagtt

SEQ ID NO: 20219 - DNA, 201 bp, Bos taurus
tcaaaagaaaatattttgtaagatatataagatattcttagttttttggtaaaagcatgttgaaactttaaaaagccaatttgctttattaaatagtgagttctcccttagtaacagttagcaatacttgcgacattttagtgtttattctgtttgagtgacttaattgtaattgaagtcattttacagttaagcctcaaa

SEQ ID NO: 20220 - DNA, 201 bp, Bos taurus
gcatgtatctttttcacttagaagactttttaaaacacatatgctggggtctgtggttcagtagattgtcaaataggcctgagaatttgcatttttgacagatttacagaggatgcccttgctgttggaactgcactttgagaaccattgctttggactaggagttggttactatggccaatgagccaaatttggcctgtt

SEQ ID NO: 20221 - DNA, 201 bp, Bos taurus
acaaatacacttaaagtctactgaggccagcaaatatgtttttcttatcaagagttatcaccaatcattactacagcgagttgttcagagttgcactggtcgacatctgttgaatagtttgattaactttaattgatttgaacatagtattaattgaggttcaggtactgtgctggatgtttttgatactttagccactca

SEQ ID NO: 20222 - DNA, 201 bp, Bos taurus
aaacctttgaagagtttggaggataggaatgatgccagtgtgctgtggagaaataaatgccacggctaatttaaaaagaggaaggaaatagaatccttcacctatttatcatttatatgtttattttttgtcctactaatttcatatagggtttgaggggatttatacaaaagtgtaggttagatggtaaagaatctgcct

SEQ ID NO: 20223 - DNA, 201 bp, Bos taurus
atgcagtatcacctgattcactttaacttcagaactgaatgtggcatttctctttaagtattgttgctttataattttctgtcaactatttttttttcttttggggggccagaaggataaatgccttttcctaagtggtctctgagtttattctcaaattacttagcaaacatttcacactttaagattatcttttaaata

SEQ ID NO: 20224 - DNA, 201 bp, Bos taurus
acattgcccagatgggcataagaggagtcaactcctttatagtagatgaaatcaatgtctgctttgatgttaaccatttaaataatatttattcctgcctcttgttaacatacataaaagtcattacccaataagccaacctgcttttaacatatgccttattgccatataacttgtttctcagttcagttcagttcagtc

SEQ ID NO: 20225 - DNA, 201 bp, Bos taurus
ctatttgtttacaaaactgtagaggtctattatagaatgatcaatgatatctatttttttaattactacaaacaattctgatgattagatataaaaatatctgagtacttctgagtactgacaaaatttgttcttgacaaggtttattcttttggatttctgttctcctatttcactaaactgtgttctattctgctattg

SEQ ID NO: 20226 - DNA, 201 bp, Bos taurus
ttcaagagcaagaatggagaggattcatgctggcttcctgacatctgaatttctttatgcctggataacaaattctgataacaacccacacttcctttgtcacttgtactttttttttttttaagaaaagaaaacatgaaaaggaatagaaaaacattgtttccttgattttatcctggaatttggcagcactgacagacg

SEQ ID NO: 20227 - DNA, 201 bp, Bos taurus
attttattttattgggtaaagagaaaatcatgtaagcaagaacattccatgatcttcttagttcgatcatgacagtcaatcaaagaattctcaaagtctctaaaagcaatcaaaattttttcatgtcactatgtaaattaaaattttcccaaaacactgtaagtgaactgctaagattttaggcaaaaactgtggtttttg

SEQ ID NO: 20228 - DNA, 201 bp, Bos taurus
tacagttagccttcactaatttgatgactcaaattagtcattgtgagatataattaaatagtatggatgattcagaatctaaaggacagagatttatacattggtccatcagctatttcctagaacatgtgtacagtaaaaaggtttacaaagaaatcaaagaactgaaagaaaatgtagttgaacatatgtattattggt

SEQ ID NO: 20229 - DNA, 201 bp, Bos taurus
tctatgtttactgcagcattattcacaataggcaagatatggaacaatgtaagtgctcatcagttgatgaatggatgaaagaaaatttagagatgagaaagaaggaaatcctgacactcgtggcaacatggatggacctggatcttgagggcatcgtgctaagtgaagtaagtcagaaagagaaaggcaaatactatatga

SEQ ID NO: 20230 - DNA, 201 bp, Bos taurus
tcttctccaactaactgtgacaccttgtgagccattccctaaggttatgctccaattagagaggactaattagaaaaactgcaccagaaaactgtgcaaatgtctgctgcttcacatattttttgaactgttgaactatacaaagaaacaaagataaacgtttgttttttggtaagtgttcaagtttcattttagatactc

SEQ ID NO: 20231 - DNA, 201 bp, Bos taurus
aagatatcactgcacacaaattagaatgaccaaaatccagaacacagacaacatcaagtgacggtgagaatgtggacaacagtaattctctctatgtattcttagtgggattgcaaaatgatacagccactttggaagagtttgatggtttcttacaaaacacactctttccatacaattcagtgttccttctcctcagac

SEQ ID NO: 20232 - DNA, 201 bp, Bos taurus
tcatagaagttaaacactctgtctcccttgagactgtgaaattgttcacaggttcacaaaagtccctgatgttctaatagctgagtgtcctgaggaacttgattactctgactcacgtttggccagaatgattcagcattaggaaatttattcgctgggtcaggactgttctgtgcatttgaaacattaaacagaagattt

SEQ ID NO: 20233 - DNA, 201 bp, Bos taurus
actgctaataagctgattgcccttgaaaacagcagacacctctttagtgctcttgggactattataggagtagtttgtcaagaatttggcccaagagatctaacatgccctaaaaaatatttaccatatgactttcatgtgtatttgtggaaaagaatgagtggttgacttaacgttaaagttaactacataaaattagat

SEQ ID NO: 20234 - DNA, 201 bp, Bos taurus
ttagaatttattgctttctgagatgtttgcctttccttattaatttatgacaatgagtgccattctgagagagacagagaagacatatcccagtggcttattcagcaaaatgctagaagagaacactttttaaagttagacaaggtaaaataggctggaaaaatttattttttttttacaggaatcctttcaaacttctaa

SEQ ID NO: 20235 - DNA, 201 bp, Bos taurus
ctgagtaaagaaagagggttggttgtctgtcttactcttgcttctgtaataggcttgtcctgtcctcagtgattcttttgagggcctctgggagcccttctctggagcaaggattgccaaactttttctatgaagcacccaataggaaatattttagactttgctggccatgccttcttttgtcctaactgttctgacttt

SEQ ID NO: 20236 - DNA, 201 bp, Bos taurus
gtaaaatttaattacaaaattttaaaatggtgttttattaaatgtattactcatgttataagaaagattaagaaaaacaaagcatttatgcagatttgccctcagttttctagaaatgttgcttttattttgcatttggttttgggtggttctttgttttgtatttgtgaagttggctgtctagaaatgacaagctttgtc

SEQ ID NO: 20237 - DNA, 201 bp, Bos taurus
tatgtttgatctacagtgatgttgatgagaaaggcctgcaggccaggatgggacccagaaaaccagcagcagacagtgactcagcctgtggctccatcttccatagggacctgtgagtagtgaataaggccgtcactggtttcagtggctcattatgcaaaaatggataaagacctaaacaacaaattttttttttttaag

SEQ ID NO: 20238 - DNA, 201 bp, Bos taurus
agacaggcaaacatctgaccctggtgattcttcgctaacgtgactcctgctggctctgttcacagccttgggtttcgggtctggtggcctctgctcgttgagtttgttcttcaactctgtacttagagttccatagggaattactcctttttttccttagacactcctggccctgcctcggagacactgcctcctcaccgt

SEQ ID NO: 20239 - DNA, 201 bp, Bos taurus
ccgtttcttttcttcacagccaggtaccttcaaaggcctacgtgtgcttgctgtctgccacctctctctctcatgccccttaagcccactccagtttccttcacaaatccacgaagcagtctacccaaagttaccagtgtcattaattcgaggggctaatgtctagtcttcatcttacccgatctctcagcagcatttaac

SEQ ID NO: 20240 - DNA, 201 bp, Bos taurus
gtgccacactggtttccagtggccctggtgacaactgacagctgcagacaccctctagttttcacagcttagggctccacggagctcatcagtgtcaagctcagtggcctgctccagcagcttttgccactgacgcgatgacagccatcactgcggtggatccctggagagggggacattgctgcatgctcacccactccc

SEQ ID NO: 20241 - DNA, 201 bp, Bos taurus
gcctcggaaagcgtactcccttaagaagatcgggcgggaggggtggactccgctcccagccgagagccagctggaagccgagccagtttccgcagcccgaacccggggccccctcccgggagggaagactgagtcaggacgctgcgctccctcctgggaccagcgctctcagaaatcacatgctgatttctggaaatcctg

SEQ ID NO: 20242 - DNA, 201 bp, Bos taurus
gtacttttttgagtacatatgttatataatattaacatctactccagaagagaataagaatttgaattccttactttctagtatcatttttgtcccaagatgatattttaattctataggaataacagacctaagaactctatttgtgccactcttggcatttctgtttttttagaaatctttctaattactgggtgtcag

SEQ ID NO: 20243 - DNA, 201 bp, Bos taurus
aagataaatcttgaatatagaatatagaataaatcttgaatctagaataaaataaattttattctaagataaatcttgcttgtcatgaagctgaaactagtttccttagtatacaaatccagcatttacaaagacggtaccactgagaagctggtagaggggttacagccaagcacgcaaagtgttttaactttacaaata

SEQ ID NO: 20244 - DNA, 201 bp, Bos taurus
gcatagcagagagaagatagccagagagaaataagtcttttcactgagaaaaagaaaatcagtataaaactttttctgtgaaaaaggcctcagcaacaactgcattaaagtgacccccagcatcagaacactttttccatggtgggggaatcccaagattagaggaaggcagttctgacctcccattatggtagacctgtt

SEQ ID NO: 20245 - DNA, 201 bp, Bos taurus
cagtggcacattatgtatatgaggagacgtatgaaaaatactgaggccaaaagcctcacctaagacttcttaaatcaaagtatctggggagtgagaaccaagcatcagattctaacatgtggccacagttgagaatcactatcttagatgggaggctctccaaagggtcgcactaggtcttaggcataaatattcataaca

SEQ ID NO: 20246 - DNA, 201 bp, Bos taurus
ccttctctccccactgctgtcggggttgctcactcctgagacccaggccacttcctcatctaatggcagccccctctcaccgcctctcactctcgccaccatctttctgcttgagcaaacccgtcccacatgattcctcagatcccacagacaggatagaggcaacagaacgctttttcctaaatgaaatcctacaggaac

SEQ ID NO: 20247 - DNA, 201 bp, Bos taurus
gcattttatgtttatttgatccctctaggctctttatattggacgtaggaaattagcaaggtcctcttttaaaggaaaatgttttcttgctaactctacattgctttccaatttaggcccttgtcattgtgcttccacaaatgacacaatttcacagagcatgggtggactctagagaccgagaaggctcatgaaaacatt

SEQ ID NO: 20248 - DNA, 201 bp, Bos taurus
aaagcttctttaagcgcatgtgtgccttatgggagaaaaggccaaagcaagggaagtgtgatttaataggaagagcctggctttgggatcttattggtccagtctcaaggtctgacttggccacttgctaacaataggccctttgcaaatggcttaactctgagcctgagttctcctcctgaaatgaggttagctgggggc

SEQ ID NO: 20249 - DNA, 201 bp, Bos taurus
tgcaatgctccctgactttgtaaacaaccagtatgttaactacaacaaaataaaatggggtattctttaccagacctgcacaagcactttccagcagaactttccacaatgatggaaacatttagaattcccccaaagaagtataatttgttcaaaataattaggagaagagagagatgatgtgagaagaaggggtttgga

SEQ ID NO: 20250 - DNA, 201 bp, Bos taurus
catacactggaatctaaggtttttagaagaatgatgtgtctgtgtgatgtggtgaaggaagatactgtcacctgggattgaggcctcaatctatcaacaaacagctgtgtggttcacctctcagaacccaatctcagttcagctcagttcagttcagtcgctcagtcgtgtctgactctttgcgaccccatgaactgcagc

SEQ ID NO: 20251 - DNA, 201 bp, Bos taurus
cactgtgaggctgcaatttttttgtagaaagcactgtaaggagagaacacttctttgggggtattcagtagtagcaatgcagagttcaaggccatgacctctacagcctgactgctgcacctaaaatttctactctgctacttattacctgagtgaccatgggccacagaccttaacgtcccttaatctgtaaaatgggaa

SEQ ID NO: 20252 - DNA, 201 bp, Bos taurus
gacagggaggcctggcttgctgcagtccatggggtcgcaaagagtcagacatgactgagcaactcaacagcgagcagcatggctagagagctagagagacacaggagaaggccagaaaatgatcatcaccttagtttcctttttctcctatatgctgcacattcagtaggttttactttgtatgcctcaaacaattgtctt

SEQ ID NO: 20253 - DNA, 201 bp, Bos taurus
ttctttgtgtgtgtgttttcagaattcctttctatctgtgcaggattagtggtttcccagctttgtaagattttatcatcctttttgtcccgttccctttttgacttcctaaagcatctctgaaataagtctggctttccctgccccactgctggctgtttgccagtactgtactggatttggatttcatatttcttctgt

SEQ ID NO: 20254 - DNA, 201 bp, Bos taurus
aggccaaccagaatcagaagtccaagaagcagaacaaaataagggtctggaatgagcagaagtatttctggaccccacattttcaacttcctgcatgcctcctttaaaccaccctccaccagaggccaatgaagtgcctgttgtgctgtgaggtgggaaggttgccaagggcgtggacttgtgcagctgacattgagaaga

SEQ ID NO: 20255 - DNA, 201 bp, Bos taurus
tgcagacaataatgtcagcctcataataaatgacagggcagaggcaccttagaagtctgaagatgtccctccacctgaccaacaagctgagcggccctttcgggacagtgaccctgttttataaggcagcacgtggtcatcagtccatcatgctgggggagttgctgagcttttttcacaactgaaagaaccagcagaaca

SEQ ID NO: 20256 - DNA, 201 bp, Bos taurus
gtatctaataaagtctaattctctaaccgttttctttggaactccttctgaaggaagaactgttgttgatgtctgtaagggaggaatgcagggggccacgcaaaggctgtgaattcagacgcatcctgctgtgtgcatgctggctccattctccctttgttcctacctccacacggcggcaggtggccaacagtagctccc

SEQ ID NO: 20257 - DNA, 201 bp, Bos taurus
actctttacccaaatgcagacctgcatataatcctacatattcagatggacattatgttgtatgtttgaatgccatgcaactaatcatctgtcacagaagaaaaaaaaggctgggcaacttagctgtaggaaatagtttgcagatggaaattgttaagccagggaaagccaagtatgggttttagaaagtttaagtccact

SEQ ID NO: 20258 - DNA, 201 bp, Bos taurus
ggattgaaaatcactagactagattctataattctttcatgctctgaatttctgactttattatttgaatagatactatgaatcaaagctgcttttaagcgatgatattatgacttaaaagagaaaggaaacttgtaattttattatatggggtagctatagttcacaaagattttcaagtgtctattataaaaatcataa

SEQ ID NO: 20259 - DNA, 201 bp, Bos taurus
ttagtcaactgagaattggtgaggtcctcctctaattaatgtcttcccaccgatgtttgccctaatcttcccttttattacatttattacaatgcttcagcgggatatctgtgtggcaaggaagatctattaaataaggttactgtcggctagtgaaatagcaataaaggtcctaattctgtatttgtttctttgttaatt

SEQ ID NO: 20260 - DNA, 201 bp, Bos taurus
tttgaagcaaattttttactttctccacttctttctccagagaatctggaaactaatgaaaaagagaatgcatccttaaggagaaatgcatactgtcaaaacactgctctctggacttcctttgcaggtacttctgaggttagtgaggttagtgggctttcctagtggctcagatggtaaaaaaaaaaaaatccacctgca

SEQ ID NO: 20261 - DNA, 201 bp, Bos taurus
tcagaggatgctgattagagaatttgaattactctgtcttacttttaactgtataccttgggaagagttgcatctctagggttcaacttctttatccataaaatggtctgaaattaacagcctctcagacagcaccgaggggccctgtctctggtattcatacctttggtagtcccctctccttgaatgtgggctggactg

SEQ ID NO: 20262 - DNA, 201 bp, Bos taurus
ggaagcaggaagacctgctgatttaaccccaacttccctttctgtaatccacagtaaatagggaggatgtgagcaggctaactgttttaatcaggcctggatcctttgaaatctgtttcatatacagctttaagaactcaggttatgaacatcctgatgtaaaatcagatggcagttcttccaaaatgtgggccctaaaga

SEQ ID NO: 20263 - DNA, 201 bp, Bos taurus
tatgctattcatatttaaactatggctctgaaatacgtaggatacacacgaacattcacatgacacttaacaactaagagactccatttcttttttccttcttttattgaccattccgtaaaaaatttaaaaagtcaacggaaacactctcccaaaagaaaaataataattgaagacagctgaaaagcaggagcaagctat

SEQ ID NO: 20264 - DNA, 201 bp, Bos taurus
cttgggtcttgaagatcccctgggggaggaaatggcaatccacttcagtattcttgcccagaaaatcccatggacagaggggcctggtgggctatagaccgcagggtcaacagagaattggacatgagcgtgttggataaaacctaaaagatgatgctgtgaaagtgctgcactcaatatgccagcaaatttggaacactc

SEQ ID NO: 20265 - DNA, 201 bp, Bos taurus
gcagctcccccatctcacaaaaatcttgactagtgaaaaagaaaagtagaggtccgaaagggaagccattaccccagatagagacatttttataagaagatcactgattgcttactcacgtcaatacaagactgtaaaaaaagacatttgtaatttccaggcactgaggtgctgagggagtagagtggttcccctagggac

SEQ ID NO: 20266 - DNA, 201 bp, Bos taurus
ccctgaaatggtacttcctcatctgaaaagtgagaattaattctggcttgattcacctgtctcacaagtttgtgagaatgagcgataactctcaccatgctcagaacactttttgtgtttcttggctcctatttaataaatcaatcccaaagaaatgaggtcagtacctcctattacatttctctattttttgacaagcat

SEQ ID NO: 20267 - DNA, 201 bp, Bos taurus
cacggtttcttcttcagcataggaagtcatctcatttaaaatttcaagtgacttgactacagtaatagagctcttaggatacaaatcagacagaagtagggaaagataggtaggaatccatctctcctttgagcctggcacagattagcacaacaaccagattcctaacaggtttttctagatttcactccccactccacc

SEQ ID NO: 20268 - DNA, 201 bp, Bos taurus
tgaaaattgtttccaatcattttgtcaataaaaaagttctgtactccccaattgtgacttacataactatatatagatagtccaaagcaaaaatgtcaaccataccgtccttttatctattttttaaaagtaccaatctcaatgtttattttgtactcaaaggatagctttcgatgcaaataattccaaaagcatgagaac

SEQ ID NO: 20269 - DNA, 201 bp, Bos taurus
attaaagcagtgaagggggaaataaagttctaggaattaaaacaggactgcagttttaataagaatgttcaaggaaggccttttatgtgtatgtttagtcactcagtcctttaggatagactagttggaatattcattggaaggactgaggcagaaactccaatactttggccatctgatgcaaagaactgactcactaga

SEQ ID NO: 20270 - DNA, 201 bp, Bos taurus
agcatgcttatttacatagttatctgtgtggctgtcattttgacttaaatctgggaacattttatgtctgaattggatttaatcttgtaaacctgaaatccggtttccattccattgtgaacaatcatatgcttttcatagtgttttcatttctggttttagtctccagcgctgagataaacctattatccacagaacatt

SEQ ID NO: 20271 - DNA, 201 bp, Bos taurus
actgaccctcagatggttatgtattttaaggagaaaattttatgaacccagtttcttgcatttttccatacttaaaagagcactaaaaacattagctaagatacctgttccttgaaaaagcagtaactttttaccaagatatgttcttcattgcacatatataccggcctccccattcacctttctggaacagtcttcaga

SEQ ID NO: 20272 - DNA, 201 bp, Bos taurus
gtgttgatattgtaggttacggggcgcctggttatagcagagtgaaggttagagcctgtgaggttcagaattaagttttcagagcccaggttctttctacatctattgtgttaacagggacaagaacaaaaaaaaacttaaaaaaaatacctcagtgagactgtcctgttaactttgaaactgaatgtcattttaaacaaa

SEQ ID NO: 20273 - DNA, 201 bp, Bos taurus
aagtacgtcatttagaggcctccacactgatggaattctagtagtgacctgagaatactcctcttccctattctgcctccaggcccaaggctttggcttttaacaattaagagtcacaaaggactttgtgcccaataagaatacatattattttcaagctcatatggaagagtcacaatgtaatgaccataattgaggcct

SEQ ID NO: 20274 - DNA, 201 bp, Bos taurus
ttttccaaacttagaaaatgagtctatatgttcttatactttccttgtaatatactctttcattttaatagtattcaaagtctatccaataggcctggactcaacttgaataaaaatatatagagtttcacatgaataggtaaatagtattttcattaaaaatgagcacatataaagacccaatttttttcctccccatcc

SEQ ID NO: 20275 - DNA, 201 bp, Bos taurus
ctgtgcatagttatttaatgttctagatttccactatttctgaggatacagtcctgaatattgctttggttctgcaatcaagttctgtgtaaggaatgctatgtgttggtagtaaaaatttatgttattaatgccagttttagaatgctaaaaagttaattttagaaaaacttaaaaaattttaaatctatttatggctgt

SEQ ID NO: 20276 - DNA, 201 bp, Bos taurus
gattatgaaacagtaatgaaatagcagtgtttagaatatataggctctacaaaataactaatcaattcctattatatccatctctttcatattttttccaagaagaaattgaatcagctgatcagataatttcaagatccattttttaaaaaatttccattgtacacactcattaagtttgttaatatcacacatgacttt

SEQ ID NO: 20277 - DNA, 201 bp, Bos taurus
cacacccagacaacttctacttcagagcgctttgagatttagggcttagcacacctccattttctgcccctgagcacccaaatgtattatttgcgtgtagtctcacttcctttctcctcttctcagagtgatgtctcttctccttgccctgattctctgacaccacctctttttgtgttctcttatattgatatattgtgc

SEQ ID NO: 20278 - DNA, 201 bp, Bos taurus
gtgggcaatcttgacatttatgggctttgtcaaccctccttctcaaagctctggtttatttagttttggtttagcccagggtaactcatttccaggcctctgatgactggctcagcagtttcccttcccatagctcagctttcttctttctgatggaaagaaatgccctcaaggccaatatgtatttcaactcatgttact

SEQ ID NO: 20279 - DNA, 201 bp, Bos taurus
gccctccgggcccaccgggcccaagagggccgcctggggacacagggaaggatggcccccgcggaatgccaggcatgcccgtgagttgcttttttggatccgttgttctcactggttttgtttcctttgaagtgctgagaattgggatggagttggggacgaggggctggtggaggtcaggtgagtggagtcggttgaggg

SEQ ID NO: 20280 - DNA, 201 bp, Bos taurus
aacttagactttatgcctactactcaatttagagtgagtagtgatgatctcttgttttaagagcaatgatgagattatattcccattagcaagttcttgccgaagttatacagactgtgctgtttgctatatgttcaccaaaatccatttcttacctactttgcagacagacagcctacatctgccagcctcccccgtact

SEQ ID NO: 20281 - DNA, 201 bp, Bos taurus
aaatttcaaataatactggagaatggtgtggctgggatgatttgactgtatagctgtgtctgggtagcttcgggggccaaggctttgtggttagaaggaaatggggattaatagataacttgggacaacacctctgctcaatgattcatcatcagatgagctttgaataactgatccattaattggttatttttgttgaaa

SEQ ID NO: 20282 - DNA, 201 bp, Bos taurus
cagagcctggaagtggcacccagaagggcccacggttgcccttagtggaagctccttaatggctccccagacacagagcagtaagccagagactcacccaaagccaggccagtgagctaggccccagtcgggccgccggcctctcggcagtgcccgtccgagcagacactcccacgctgcagccacacaccgagccgcctg

SEQ ID NO: 20283 - DNA, 201 bp, Bos taurus
taggtggctgcgttttacattttgcggcaaacctcacctttggaaacactgtttctaacgaaatcacccagcgtcttactctatttgcgtgactgttttccctccccgtggcgtgcggggtgtttcgttcgctgattgtccttagcattgttgcaagtcttctgacaaggtgcatttaaaaggggcttttctagaaagcat

SEQ ID NO: 20284 - DNA, 201 bp, Bos taurus
catttattcaaaaggctcactgacctataaaacacagatattcttccttttgtgctatataatatgaaatgctatagttttatattatgtcatctaaatagttggttttaagcttactgacttggccctcagtatgagatattagaacctaatgtttgattgccagctctgccatgaaacttttctgattttcagtttcct

SEQ ID NO: 20285 - DNA, 201 bp, Bos taurus
tttaaaagaattatcctcctgcctggagatcatgcttacatgtggccatctctctctttctgaaggtctgttccctcttccacttcctaacttgacatctggtaagaaagaattttgcttagcaactgaaataaaacccccaaaacccagaagtgacacttagttaaaattaaaagtttaataaaaacatcaaaaattatg

SEQ ID NO: 20286 - DNA, 201 bp, Bos taurus
acaaagactcagattagtgtgacctacctagtattctggacatcaggggagaaaaggattagggacgagggaaggctgggcagaaggaaaggggagaggaggaggaggaaagaaagagaactgtatttaactgtggttagcactttatattcttagggcaaattctgagtatccccaagcctgtaaataacaggataatgt

SEQ ID NO: 20287 - DNA, 201 bp, Bos taurus
tattaacccattattaaacccattattaaagccatttcctacttgtacccattattaaaatgaaattgaattataatactacataccatttagcttgaatataacagatgatgatgctttattgtatctacatatgaaaaaatctctatggtacaaaaccagaactagtctctgctgttagccgtcaggatgccattatac

SEQ ID NO: 20288 - DNA, 201 bp, Bos taurus
gagttagaaaacagaaaaatagttctaaaataatctatatcattaatatcaaatttgaaaaactattacctagcataacttttaaaatgataaaggcacaaacacattagaaatcaaaaaggacagaataaaacaaagcaattttaaaagttctattttacccaactatgtgcaaatatatttgaaatcttgatacaagtg

SEQ ID NO: 20289 - DNA, 201 bp, Bos taurus
gaaaggcttggcaaaagcaagccacctagagggaaaagggtaatgcaaatgaattgtttggggaaaacatggggaagggaaagactggctccctcagtctgagttgtgaaaggttcgtcattattcttgtctctgaagtctcctccgccaaccctgcttcattcttctgaatctggggctagaggttactcttcaaagcaa

SEQ ID NO: 20290 - DNA, 201 bp, Bos taurus
ttgcttaccattgctgtctatacactagatcatcaaaatatcaatattattgggtactggaatttgagcatttgttatagtgggggtagtttatccattcctactttgaaaccacctaaaaatccaatggggtagttatccttacttaccagagtaacaaactgagactcacagagtaaattagagtacagagatatatat

SEQ ID NO: 20291 - DNA, 201 bp, Bos taurus
cagggcctgaaaaatgtatggctatcctcaaaattctgatgcatggccataacaaggggagttgataggtgtgtataagaattatagacatgatctgaagcgagtttatttcaaacaatagacatgctgtccatattttggggtgaaaactggcatgcccatgagattgaacagaattaacatggtgggaaacttgcttac

SEQ ID NO: 20292 - DNA, 201 bp, Bos taurus
cagctatgttcttcacctactgttagagactgttagttgaagtattgctgccttcgtgtaaaactggtcaagttagaagtctgccacagtgcgggcctctctgaggctgcttttgctctcagcatattcagagcattaccagtgcttatctgaggacaggtttagctgggggatgtggcctccagtctcctgcaagctggc

SEQ ID NO: 20293 - DNA, 201 bp, Bos taurus
tccaaatagtattgtttctcaagttgaaattcctagaattagccagcattatatatctggcatttccagtactttatatccagttgttaaaggagactaacagcataaacagcaaaacagcacttaagatttttctttcacaaatacattgtacatttttggtctcaagaagcctaaaacaacatttgtatatggatcatc

SEQ ID NO: 20294 - DNA, 201 bp, Bos taurus
agtgagcggtctaagagatgagaggaaacaaagtggaacctgcaatgccttttatgacctcgcctcaggagcgaggtcttattggatagaaaggtcggccgttaactctattcatttgggagtagacaacacaagaatgtgaaccccaggaatccaggggcattgggggtcatcttagaggccggctatcacagaagtctt

SEQ ID NO: 20295 - DNA, 201 bp, Bos taurus
agtatgaaaatattttatgtgatttttttcttcctttgtcattgtagggacatgttaaattggctaaatttggactttatcacatgacagcatatggtgatgatgttgatttcccaattgggtaagaatatgttttgggttttttttttcttgagttctatcttaaactttctaatcttttattaagggtttatttgttaa

SEQ ID NO: 20296 - DNA, 201 bp, Bos taurus
agaaggtaataaaactaaatctcaggacataaaattttaacatatcattgacaactctctgtctggttcatctttcagggggagaacaaagacaaaacatatgtgtactaattctagttcactgctctgtgtgttgtgctgtaactctgtggtgtgatcatcaggcctaaagtaaccatccttaatatccagtggaatttg

SEQ ID NO: 20297 - DNA, 201 bp, Bos taurus
ccagcagctggactgatctgagccacggcacacttccccacagacatcagggtgagactttgacatggcattagcatatctacattgcagttgacaggaaagttatgctggtgacagtttttgttcctttgcagtttgatttagttcagtatggatttgagacagttcctaaagcagtgttttttcactagttaagtctat

SEQ ID NO: 20298 - DNA, 201 bp, Bos taurus
ggaaaatatcaatatcaatgatactaaagaaggtttaaattttataaaggaagttttacttttatgcctctaagtggaaattgtacagtgaatagtgaaattgtgtataaaactgtctaataaaagaaaaactatattctgaattttttagtattataattattttcttcataaagcaaagttgtataatttttcctaagt

SEQ ID NO: 20299 - DNA, 201 bp, Bos taurus
taccctggttaagaaaataagtcgtcctatccattccttcagcctttgatgacttatttgactgcataatcagtgtagcactgatgattgtttgggagaaatgcttcggagtcttaactttgccttcctggaaaagcagagaaagatggaggagcagagatgtgaactgaatagggtggtaggtagtgagagagggtgaag

SEQ ID NO: 20300 - DNA, 201 bp, Bos taurus
acaggcagactcagaaagagtcacagagtcatatacttatggtagtttgagttacttttatgggatatttcttccaggtttcccttggccaatcattttactttgctgattcagagtccatagttagtatatctcaggatccacccatgtgtatgcacacatctcttagccaacatagattctacaaaagaggcctgtggg

SEQ ID NO: 20301 - DNA, 201 bp, Bos taurus
tttcactttctgtcttgccatggaataaatcattcagcctctctgactcagtttcttgacctttcaaggctgagattcaggacaggctctgcattttcaggatctgtattactattccttcagaggatattattaaattcaaaattacagtatccatggcaaccataactaggtcagtctgcacttgaagtaacaaataac

SEQ ID NO: 20302 - DNA, 201 bp, Bos taurus
tgaatatgtggccactattattgttctttcaccaatttttccccctgtttttctaacctttctccttttggtttcatccttattcaggatcctgttttttcctaggcctcaattcttatctaaactggaaagtataccatttctgaattgactgaaactcattaacacattttttctcctaatttatctgcatttaaaatc

SEQ ID NO: 20303 - DNA, 201 bp, Bos taurus
cttcactactgcatattaacttattttggtctgctaatatttgtatgatttgtatgattttccatgtagaatatccatgtggagaaaaaggtcgaagtcgcgtgtgtgcatgatacaagagaactgtgttattctttctatcaggaaaagacttagttttgccctccttatgctccctccatctcccttagtctgggacta

SEQ ID NO: 20304 - DNA, 201 bp, Bos taurus
aactagtattggtgtacaaggaagagagagttggagaaaaacaagatccagacgtatagagattaacgagagaaaaaaactatctttgccatcgcatattccttcagctggcttatttgttcatgcactttatttattcattccatgaataatattctcaagtttacagatgtattgtgtcctcctagagctacagtaatt

SEQ ID NO: 20305 - DNA, 201 bp, Bos taurus
atgtgctggtgatagaacaccaggctgagtgatgccaacctcgtgcctagccctgtctcctctgatttaaaggtaatgatgtccctaggatttccttactgctttcctgtgtctcattactactcctggggaaggggaatcatggctgtattcctgatgagtccttcaagctaatcccatcttcactgtagccagtaaaaa

SEQ ID NO: 20306 - DNA, 201 bp, Bos taurus
ggaaatagctggtgtaaagagtgagtgttaaagcaagtttggcaggtgtcagtcatttctatatgctgaatcttaaaattttatcagatgaatcagactgtggctcatgcataactgcttttattttccctacattttttttttttttttgcctttagtttcaaagatattctttatttcactttttttggtggggggaag

SEQ ID NO: 20307 - DNA, 201 bp, Bos taurus
gactgagcaagttaactttcacttttcaaggcttaatggggtcatgggggtgctcaggaatcaggatgttgtcattttttcttgacttgggataggtgaattcatgttttccttctttgaaatttttctcaaataaaagtttttagaactattgagagaaaattgatatagcaatgattgagttcattgcctactcttgaa

SEQ ID NO: 20308 - DNA, 201 bp, Bos taurus
ctatcatatatctcctgttagaatctgcttctcagtgactactggtttatatcttaattatttcaatactttttgaaggctttgctgagacaaatactctatacacttgcttagttgaataaattagcaaaacccaaggtaagacatagatgcctgaagttcagtctggaaaacttttaatccattaaaagtcaccataat

SEQ ID NO: 20309 - DNA, 201 bp, Bos taurus
tgagtacatttctttcttagtgtccccctggttgaccgcgaggacacagggtttgatagagtcaagggcttctggccaccaaggaggacttctgctctgcgacaaaggtacatgatccttggcctgcgcaagcactctttaacaagagaccagtatcactcctctccacttcattctaacagcatatccttgagcagaaag

SEQ ID NO: 20310 - DNA, 201 bp, Bos taurus
gggtggggacaatggtttcttccgtgccacatccccagtgcctgcagtaatgtttattatattgtgggcattcaataaataattctttagtgaatgcatggttaaataagaggcctacaatgttatctatggaaggcaagatattaaaacaacagttgtgttaggtgacagatggaaattgggaaactatattctacctct

SEQ ID NO: 20311 - DNA, 201 bp, Bos taurus
ggccagacattctaggatatggggtcatggccctaatctgggcactgtggctgtagctcccatccagactgggtgactcatttacagcccgcatgtctctattccatgtctttaaagagggacaaccataaggcatctttgtttacactccactggcaaaaagggaattaatcagcatacagtttttttcaagcctcagct

SEQ ID NO: 20312 - DNA, 201 bp, Bos taurus
aaaccctgtaaacaatactgtagcattctacatggtccaatcgcaactctcagaccctccagggcccccataactgcctgaattacatggggagatgtctcgaacacattgggccatacatagttaagaacacctatattcgttatgaacttgactatatcttgtaactttattgtttattttgtgtttaatgcacagctg

SEQ ID NO: 20313 - DNA, 201 bp, Bos taurus
agtaaataggatctgtctgtaagtttaggacctgaggttctaagagcccatcacgatctatgtccagcctggccctccactctcctgtcgtctagaccccaagggagtgatccagaacagaggatgttctggtgtcacctgtctggtgtctctgctccctcctgtccaggttagtcatccaagttctgaaactggcctctt

SEQ ID NO: 20314 - DNA, 201 bp, Bos taurus
tagaatgtcaaaatcaaaaaaaggtattttcaaagttatgatttcactttcataaatatatggatattttagagcgtacgtaatgcatgggcacatattatttgtgcaaatacaaagcaaatgccaaaccccaaatctttatagtcattattctggtgaatagcactggatagaggggccagcagttttcatttttatttc

SEQ ID NO: 20315 - DNA, 201 bp, Bos taurus
atcttgcacaaaggtaacatttttctcaaaaataaaatttcacaaatagtcttgagtcaagctttttatttttcttcacaattttagagggaaatattgctaaaattattaagcatttcctgtcttactaaacaaagataataatatctctggtacttaaaagtcattgttaaaagctgcagttataatatgaccactgaa

SEQ ID NO: 20316 - DNA, 201 bp, Bos taurus
tgattatgcaaagatccttgtgtgtgaatgtatatgtgtgtgtgtgtaattatatataagtgaaatgaatgacaacagtgatacaaggaatgtaaggaaggatttaggaatatgttgttattatagggtatttgcagtagctatgaagaggtacagtgttatttgaaagtagacttggattagttgtaaatgtttgctgca

SEQ ID NO: 20317 - DNA, 201 bp, Bos taurus
taaaaggggagtagaaaaatgaatgtgactcttcagttgtgtttctcatagttaaatacatatatttcagtatctttaaaagagtcaaagccataacgcagatgactattccaaaaattttaaactttgctagagaaagataaattagcgtaggtatttctgctcgttgttatttgcctcctcccgactgcccctgaagta

SEQ ID NO: 20318 - DNA, 201 bp, Bos taurus
tggtagtcaacctaatctttaggtacgctcattactggtttgccttctctcatgtgagcttatcttgtattatatttttcacggtattttgtgtggatatcatttgacttcttaataattgaatctccatattaatgcccaaagcctccactccccagaatgctgggtaaatctaattcagatgattcaactgacacaatg

SEQ ID NO: 20319 - DNA, 201 bp, Bos taurus
actacccgggatggggaccatgggtgggcacatgggcatagaaaatgtgtgcgcatctacagctgagtaatgaacttgaaagaattgtgtgtggacataggttgattttttttttttttttgtattaacttacaagtttaggattgaagattaagaggcacacattatgtttttcaggtttgctattttaaatgcacagat

SEQ ID NO: 20320 - DNA, 201 bp, Bos taurus
tagaattgtgttttgggggtgaggtgttgctgtggtgaaaatttctggaataagattgggttgtagaagagctgttgtgcttcgtggtggccctgatacaatttaatagatactggcaagacttttgggtagacaaaacttttcctgtatttaatgatctctagtcggggagtatactctgtttgaataaggttgtttaaa

SEQ ID NO: 20321 - DNA, 201 bp, Bos taurus
caacatggactgttggatccatgaatcttcttgaatcttttaatgtctccttatcagaaagtgtccatattttcaaccttacataccatatcaaccccttaaaataccccttctttatcatctttactataaaatattattccagtctgccagaaaatccatggcaatgtgcttccacaaagcccagaggattcaggcatg

SEQ ID NO: 20322 - DNA, 201 bp, Bos taurus
tcatgagcagatgtaagttcctaatatgactcctgcagcagtccttgtgatcaaccatctccaatgcctgtcagtgtctgtattccttatgggccccttataagacctcactcatttgtggcttaccaaaaccccactatttttatttaaattgagcagtctggccccagcctggggatcccaaaacactgcacccatgga

SEQ ID NO: 20323 - DNA, 201 bp, Bos taurus
tactggtggttggatggtgccaggttttgtattcaagcggtttcctttgtgggagttctcactaattgatacttcctagggttagttctctggtagtcttggatattggaatcagtgctcctactccaaaggctcaggcttgatctctgatcaggaatgaagatcccataagtggtttgttatggtattaagtgagattaa

SEQ ID NO: 20324 - DNA, 201 bp, Bos taurus
tgtgcttttgattattacagttgagagaaataaatgattttaaaaggcagatttatggtggctctattgccaagaatttaggcttgtagcaattgttgaattttttaatctattgtctactaatatattccaaatagacaataaatttacatatatagttagacacacacacatctatctatctatatctatatacgtata

SEQ ID NO: 20325 - DNA, 201 bp, Bos taurus
tctgcattcaaaccctggctctgtgtgactttgggcaaattatttaaggtctctgggctttagcttccattatatgaaatgataatattgttagtatagtagtgagtataaagcccttagaacaatgcatggcacatagtgtcccatcagttcagttgagttcagttcagtcgctcggtcttgtccaactttttgcaaccc

SEQ ID NO: 20326 - DNA, 201 bp, Bos taurus
agggagatccaggagacagagcaaagctgtaaaatatcaaataattcagaaccagtgcttagtgacggaatcaaatgtttttcaagatatacagttcttccaaataaagtattgtctatatgatcttattaaaggaaaaccatgctaaatttttttattaaagaaaaaccataaatcagttgccttattggatactcccat

SEQ ID NO: 20327 - DNA, 201 bp, Bos taurus
cactaatatgttgtatgtcaatgatacttgaattaaaaaaaaaaaaaagaaaaattggaggagctaaaagtgaggctatcaaaaacttcaggtttggttataggcagaatactaatttttttgataaatgaaatccttatgaggtcacaagttctgaaatgttgccaataattttattttgaatggacatttcagtttaag

SEQ ID NO: 20328 - DNA, 201 bp, Bos taurus
tggatgtgcctggtagtttgtattcaagaacccttccttcctccttgaggctgactgtgtgtgtgggtgagcaagtcaataaaggcttcatgctgctctctgctcctcagatttagggccactcagactattgtacagggttcttcatgctgtgaatgacggctcaatgtagaacttgattttagatctcagactacttgt

SEQ ID NO: 20329 - DNA, 201 bp, Bos taurus
agtgatctaaaaagagactgtggccatatgatacaaaagataatccccctaccttgatttagtgctagtattggtgggcatatttttagtattagcatccgcaactcaagttctcctaaggcccgaatgagaggctccagcactccctattgggatgattttatggaacagaaatttctgatttaatctattattttcaac

SEQ ID NO: 20330 - DNA, 201 bp, Bos taurus
ccctgggtgtatgtatatatagtgtgtgtatatatatatatatacacgcacacatatgcatagtatatatacactccacatctttatctatttgtcaatcggtgggcacttaagttgctttgataccttggctattacaaataatgctacagtaagtcttggtgttcatgtatctttttgaattaattgttttctttgagt

SEQ ID NO: 20331 - DNA, 201 bp, Bos taurus
tttctctgtactcaatcataaacccgagcctgggtcaggagctcacagccgctcatgaagtttcagatatttgtgtgggagtgaagtttacttcctcctaggatcctgcaaaggagaaggcagtggcaccccactccagtactcttgcctggagaatcccatgggcagaggagcctggtgggctgcagtccatggggtcgc

SEQ ID NO: 20332 - DNA, 201 bp, Bos taurus
gctgcggcggccccatgtagatgcctaaacctcacaggcaccccaccgtgcagagcaaccccccatacagctgcttatcttagcactgagttccatctcataggccagcttacatttatacacgtagtagtactaaaaaataaaattcaaagttccataaatgaataattcagcaaactcattctgtctttaatatctgga

SEQ ID NO: 20333 - DNA, 201 bp, Bos taurus
ttaaacaatggtgaaaagatgaagacctgaggcagtacatccctccctcctgtagggattctgtcggtggaatcacacctccgtggggcccttgttgcagtggtcgtctctggtgctgattcagtgagggggtccttttccactggtctttgaggtctttgtgggacaggacctgaatgaggtttcattccaggtcttgac

SEQ ID NO: 20334 - DNA, 201 bp, Bos taurus
cctagacaagcaggagattggcttacctgtcatcaagttttcaagaaagatttttgctactgagcggagctcaaggagggagggctgtgtgggccccaggcgtttcctgtacagcggcagagctaatgacgctgcaaattctgttagtctgtttgtattgaatgaggggccctcccgcttgttccaagaaggcaaggtgct

SEQ ID NO: 20335 - DNA, 201 bp, Bos taurus
cttcctgccagggcagaaatgtgggtgcagctttgctctctgagcctggcaggtggtaaaggggatggtgccttggcccttttgaagtttccccaaggtccctctgccttgcagttcccttcctctgggtgggcatccctgttctaggtggccacccagtacccctgcccagacctggtgtctccgagcttcctcagagat

SEQ ID NO: 20336 - DNA, 201 bp, Bos taurus
agtttctctcagagaatcaaccaatctagttgagattgcttgctctccatgttggctgggcacaccaacatcctggaatttctttttcatcatcttgatggatatcttcttctccttcctgtattagatactctattacctatgttcattcacattcagttttttagtttcagtggaggcatcccccagcagctttctgag

SEQ ID NO: 20337 - DNA, 201 bp, Bos taurus
ttgcaggaacaccaatgtccacctcctgtggcccccctgtaagaaactgtccactatggtcaattcaacttctaaaaagatgtgaggagagagaatcaaacgtgttttgaggcctttgaaccacaggtattttgctgtcatacttggtgtctctattgagcatctgttctgcacaatctgaggaatatgaatctgttgtca

SEQ ID NO: 20338 - DNA, 201 bp, Bos taurus
gactcaaggccccaaacgatggtacttatctacagtttcttgcagacaaagaatacaaatagcaacaacattaaagtattctttgtcatcaaaggctgcaagggttccagagagatcaggagtgagctctaatggtcttctctccataaggccatatcaggacacgctttctgtcttagatcaggaactgctaacagatgt

SEQ ID NO: 20339 - DNA, 201 bp, Bos taurus
ccctgaatagacagcttctctagctttaggcagataatagagaaaacaagtaactggcaagcatgctgtttctatgcaaactagccaatccagggctcataagctaatctcctctgggcctcacacacttgtagctacttctgctctaatcaccctagggcctggtaccagagaactaaagacagtaccctataccccaga

SEQ ID NO: 20340 - DNA, 201 bp, Bos taurus
ctacactttgagaaagattagtttaaaatgtaaggtccccatatgatcttctttgtttttttgtcttgatatttcaagccctagaacaaattcagtccagaggccagtggagaacatgtccaaggctagggaagcacagtaaatagggcttgtgggtcatgtattgaacacagatgatggaagccctaactatttggaagt

SEQ ID NO: 20341 - DNA, 201 bp, Bos taurus
attactgactggatattggcgcttagtgccgtaatgtttcattttcaccgattctgacattgatgttgacctagtcattcctagagccattgatattcacctgttcatgttcacgttcaatagttctcttaaagaacaggaggtataactacaaaataatatatcttttcacccaaagattttcagagtcccaaattttgt

SEQ ID NO: 20342 - DNA, 201 bp, Bos taurus
gaagtgatggagcttttactttattctctggaatatttgtgtttggagtccaaagagtccatataaggagcctggctacttcttaagtctgactacttgttaagtcaacattctgggaggatgcaaagccatgtggtggggccgtatttaggacctacagccagcagtcctcatctttcagttattccctcccaggcacca

SEQ ID NO: 20343 - DNA, 201 bp, Bos taurus
tgaatcaggctgaggtatagagccaatagctatgagccaggccatggggaaagaccatctctcttttgtacagggcacatgaggtactaagatccatacttggaactactggtaactctgtgggccaccatgaaggtatagctcatacgaattattcggatcagaggaaagaatttctgacagttgaagagaaaaagaaaa

SEQ ID NO: 20344 - DNA, 201 bp, Bos taurus
ctcctggatttttccccttcaggttactacaggttgaccaaattcttctactgaagaataggccaatctattgtaggccctttccatacaactgtactatataggttctagaaattaacacttctccttgccccttcagatacagttgtcataacatctatccaatgtcacgaggcctaggatacatcattcctggttagt

SEQ ID NO: 20345 - DNA, 201 bp, Bos taurus
aaatgataagataccattgtcatacatcactcagtatagaaattgttaatgcctcatttatcatttattattaatatgatcttattaatatactatgactatattatttaataaaatgttatgactactacgctctctattttaccaataggaatagcaagttttgatagcattaacttcttgtgaaagttaacatagata

SEQ ID NO: 20346 - DNA, 201 bp, Bos taurus
acatagaaaccctatctgcattgccatatgcttgaggacccacactctggtttccttccagctgcctctgtccatgaactgaggcatccctgggcctgccgggatgtgtgcactcagaccccatacaccttctggaccatgatattgaacaaatcctatgtgctggacttttgtatccaaatggcccttagtctgtccaca

SEQ ID NO: 20347 - DNA, 201 bp, Bos taurus
gggaataaactagttgacttctgacatatttataagagatatgtactcatttcacttggccatcaagaaatttagtaaagaatcactaagcttgaaagcatcagtgaaaatagagaaaattaaagtaaaagctatcatccactcagtaatctagctctctttcacctcattattattgctcttttatatttcctgtcagtt

SEQ ID NO: 20348 - DNA, 201 bp, Bos taurus
agcaaatctcttaaccttgtcctggtttcttttccaccaaattaagataataacttattttgagaatgttatggaataatatacatatggttccacagatcacagttcccagatcatggtatgtagtctgcaatgttggttcccttccttattagcttattcctttcatccctggacagtgtcagcacatagagtgttaaa

SEQ ID NO: 20349 - DNA, 201 bp, Bos taurus
gagctctccatgaatgggagtaatgtgttattagtcattacaagacttgccttaattatggaaacattgtcagctctcaccaagtaaatgatgaatgaatgaacgaatgaatgaacaaatgaaattgtctacccttatccataaattactctttctgaaatcctagccacaatgttcctgtatctttttatgactccatgt

SEQ ID NO: 20350 - DNA, 201 bp, Bos taurus
ttttagaatttattgtattcttaaagattgcaaaagtatagggcataaagaactgagaaatatatcaatccttagttaagagttttttgccagatgatcctacctgaggtaaagttttctgaagtgagaatatgtttcacctctgtggtaacttataactaataccgaacacaaaatcccaggaagtaatgtggtttttat

SEQ ID NO: 20351 - DNA, 201 bp, Bos taurus
tgttaacatcgcctcaaattagaaatccatgagctgtttgcatagtgtatggtagtagaagtacagttctgaacaattattatgtcccatactgtgtgctatttgttagggagttgagaagacagtttcacccttcgaggaagacagaaccatagaattatgatttgcattctgaaatataacagtggacataggtatagt

SEQ ID NO: 20352 - DNA, 201 bp, Bos taurus
ttagaaagttgcagatattttatgtgagagattgatgtcttaaacctgatactattatattttagctattttccccaaattttttgtgccccccaaaatatagatggaattcaaattgtgtttcttgtcttgcaagaatcaagtattgcccaggtggaaaacaaaatctagcagagtattgtaattatagacatgaaatgc

SEQ ID NO: 20353 - DNA, 201 bp, Bos taurus
gaactatataattttaatttagttttatcccatggggaagatttttcacatttgagttacatactgtatagaaaaaagtaacaccagtatttttaaaaccgatacagcccagaacatgattacaaaggaaaagcaaaaacatatcacacctttcaatgcagttttagctagctgtatttcactagaggaaaacagaaattt

SEQ ID NO: 20354 - DNA, 201 bp, Bos taurus
agaaatgaaattaatgagggttttattgttgttactttgtatttcaaaactttagagaaaagtaatcactcttttcatggaaataactggagaactttgagcattttagttgtatagaatcatacagtaccacctggattctttgtaaggtcaggcaaatcagctcatcattatcctttcagccctttaatcttgtctgcc

SEQ ID NO: 20355 - DNA, 201 bp, Bos taurus
tttctcagcgcatctcactgtacagaaacaagaaactagtctgttttgaatacaagtatgaaagacccaaaagcaagtcaatgaggtagaaaggaggatatagtatatgcggttaatataagtatcggatgagtcaatttaataacctcttttatcaataaaaatttctatgcttcccaggtggcagtagtgaaacataag

SEQ ID NO: 20356 - DNA, 201 bp, Bos taurus
tcctttcattcaaaatgcacactgataactaagttgacagtttctatttatagcagtaattccttagtcatcatacagcaaatactataaccaagtaaagatgctttccattccaagtggaaaatgtgtactttttttttggggggggggggggggcgcgggttaaaacatttccaaaatcttggctggaaataagaagaa

SEQ ID NO: 20357 - DNA, 201 bp, Bos taurus
ctctattaccatctgaaccaccaggaagcccctctctattactacgagtactaaatatagacagacagaaataataacccaaagtccaacagacttagtaaagaaagaaggaaaagagagaagcaatggaattgctagaagccctctgagtacctggggcctcctctgctgaggcttggctcaaggggcactgagaaattc

SEQ ID NO: 20358 - DNA, 201 bp, Bos taurus
gatgtatctattaaactaagggtaggatatgacagaaggaaacccaccatggcgctgccatttactaaaaggatggtttcaggcaagttacctaatccttttgtgctttacttggctatataaagtactgaataagactaccatgtacttcacaggaaagctgctgtgttatatgagttaatatacatacatcagtagaac

SEQ ID NO: 20359 - DNA, 201 bp, Bos taurus
tatttcattcagttattagatcctttaagtttattgaacatctatgtgagagactatactaggtactgggactacagtaagggggaaaaaaggccctatctttagggagtgtataggtaaggaaagtgtataggtctgttccatgtcttgtttggagtcctatcctgacaacaccatccttggatgattttattggggcca

SEQ ID NO: 20360 - DNA, 201 bp, Bos taurus
gaaattttattaagtttttacatagttctggagattcaaaacaaacttcatttattcataaatgtagtagaataaccaaacactggattattttgttaatgatgtaactaatgtagagtactttaaaaggtgaggaaatatacttaacttccaattgctgtttataatagtcaaagatgtttaattttttaaatgacacaa

SEQ ID NO: 20361 - DNA, 201 bp, Bos taurus
attgagccttcaaatgtggactgtaaagggcatactgatgctattatagagagaactgggaaagcataaaaataatgctgaatggtaatgcagaaatgtacagaagacattctgagtttaataagcaaattctagctagcattttctagaatatattggatgaagataaacttttatagaaatattattgataaataaaat

SEQ ID NO: 20362 - DNA, 201 bp, Bos taurus
agggcaaacatctaattgccaaatgtatgttattattatcctgtcaattaccctctgtctctttgaagatccctaccccattccattcagttcaggatgatgtataagcctcaactgcctgacttgcccttgtgtctcatatttttatggggctcccatacgtatgaaattaaactcttttttatcctattaatctgtctt

SEQ ID NO: 20363 - DNA, 201 bp, Bos taurus
tcttctgctgtcctttcctacagaaaaatggaaaataaacaaaaaatcataataaggactaaaagttgattcaggtaatacctttagaatttgatagtctggcaatttctgtgataactgttgcctagttagaccaacttcccacaataactctctaggaggtagtgactgattgaagtacaatgatttgttttattaaat

SEQ ID NO: 20364 - DNA, 201 bp, Bos taurus
gcagtggttaaaactaatgtacagtcagtatgagaagcagcagtctaagaattacctgcagaatctcctgaacaagcatttcttctgtaataaatacatacgtagctccaagcctatttctccaggcatcttcacttatccctgaatataaggtttcctacaggcaggcctgcttatcttttgcttatctcaccttacttt

SEQ ID NO: 20365 - DNA, 201 bp, Bos taurus
gagagttcaataattctgactctaataattcagggtttaccaaaatgtgataaagatcaagataatactgatcttggagggaatgagaaagaaaattcttcgcaaacttacaagtaagactggtcttcccaaactcaatctccacacaaactagaatgaacatgaaataaccaatgcttacatctacataataagcagatt

SEQ ID NO: 20366 - DNA, 201 bp, Bos taurus
agatggcatccaagtactgcgtttcggactcttttgttgactatgatggccactccatttcttctaagggattcctgcctagagtagtggacagaatggtcatctgattaaattcatccattccagtccattttagttcactgattccttaaatgttgatgtttacccatggtatctcctgtttgaccacttccaatttgc

SEQ ID NO: 20367 - DNA, 201 bp, Bos taurus
tgctaaggaaaattgaagaatccaatctaagaattttggaattaacagatgcttttaatcacagtaaaaatatcctattaaagcagagaggaatataaattatgagactaagccctggaataaagcatcaaataccacagccacataaatcattcttttacatttacatcttctttgaaccagactattcagatttagcct

SEQ ID NO: 20368 - DNA, 201 bp, Bos taurus
atatatacatatttattttacaatataaatactgaatataaacaaaataatatagtcacacaatgaagttttgtgcaggctgaaccaagcctagaatgtgaaagattgtactgaatatttaaataatgtacacacaacatattatctgcctctgcaaagagaatacactaagctccatgaaacaactgaacttcagggcct

SEQ ID NO: 20369 - DNA, 201 bp, Bos taurus
agtaactatggtgtatttttatctgttatattaacagtaaaatactagagagagatgggggagtgacagagaaaaagggatgaaggagggaaagctgaggatgggagagaaagagagagaaggaatgtactaagacccttcataacaaggataacagcttaaaatactttctgaagcaaatttatcccaggaagagtagat

SEQ ID NO: 20370 - DNA, 201 bp, Bos taurus
atctgacatttcttaacagggcaggggaaaggctcctctgatgattcctgctcaccatgacaaccacaaatctgcagatcacaggtgaggagggtagcctatctctgaacaaagcaatctgtgtgggaagtgagttgaggagagagctgagaagagcagtggaagagatgaggaatgggttggaaagaggatgcagagaca

SEQ ID NO: 20371 - DNA, 201 bp, Bos taurus
atagtcattgaaacagttaagaaatagaagttactccataaatgtttcttgagaaaaataaaatcagcctatatgtaattttatataactttaaatcccataaaaagaattttatggaatttcacttaaagagtgcttaaaatacaggaaatgaaaaatatgaaacaggatggcagaattaaatcctagttataatttaaa

SEQ ID NO: 20372 - DNA, 201 bp, Bos taurus
aatttgccttagtaaatgtcaatagacacatctccaaagagtaagttcaaaagactatttaaatatggacagtaaagactttttttttataactctgaaacacagtcatttaaaaataagcctatgtttgtattaagctaagcctgaaagatgatgctgtgaaagtgttacattcaatatgccagtaaatttggaaaactc

SEQ ID NO: 20373 - DNA, 201 bp, Bos taurus
agttaatctgacctagacacaaaagaaaattatgtacctcagatgagcagctaagcataaagtaatacaataacaatttctgttatagaactgtttacaggacagttaacatttcttccttgcagtgaaacctgatttgtattcctatcctgaatggcttaaaagtaagaactaatgttaaaagaggatcatctcatccat

SEQ ID NO: 20374 - DNA, 201 bp, Bos taurus
gttagagaactagaacaactttagcacagttagcactggttatcaagattacacaagcttaggtaaatagatggatgaacaaaacaaaaggcaagactatcgagtaatttgcatatgaacatgaatccagagccaagtttaaaaataaaagataagcctgtcaagggaaacaaagagtttgattcaaccactattaactgg

SEQ ID NO: 20375 - DNA, 201 bp, Bos taurus
acaaaaacatttcttccttagaataagcatctctccttcagcttttttttccaggaaaacacagacctgaatgagctgttgaattctctgaagtaccgatgtgaaagtctcagcttttaattctccagtacatatcctttcatgagcgtcaccagagcctagctctgtaggatgtgcagcaaacatctctcattttgggga

SEQ ID NO: 20376 - DNA, 201 bp, Bos taurus
gactgactagatacacagtcctaaaaaaaaattatatttactcactttccaaaagaaggactgagttcttttaaatcttccaatgatggctcctggtccaaaagtttcttaaacagagccagtgggaaagggaggtagacaacattaaaattatatagggagagtccacacagcatcccaaagaggaaatacatcttcttc

SEQ ID NO: 20377 - DNA, 201 bp, Bos taurus
ggatcagctggaaggacatttgagaagagggaggcattttgcacttccgttgctttcccctgtcatcctcttccaagacctacttctgcctaatcctcacgcttctgagttcaaagcccatctccatgctcctcagcaggacagcccttagataggaataacgggaagtatacggtatatcatgtatcatttagcttgatt

SEQ ID NO: 20378 - DNA, 201 bp, Bos taurus
aaatatgagtggatcacattgcttgagtaaaggctggtctgcttctaggttgctcatatttccaggtcatagccctactggtacgatctcaaaaacttggtgttttcaactggtaaactcacagctccaaactttgtctccctgttaatgagctgctactgctgctaagtcacgtcagttgtgtctgactctgcgacccca

SEQ ID NO: 20379 - DNA, 201 bp, Bos taurus
aagtgtctaataaaggtttgttgaatgaatggatgaatgagaggcccaaacaagccagtgagatcttctgttagtttcctcactattagcagagtggtcacgatggcgacgttacagaatcggtagaaggaactttatgtgtctttggtaaatcttcttaagtgtgagcagatacctaggtatcctgctcaacccaggcac

SEQ ID NO: 20380 - DNA, 201 bp, Bos taurus
taaccccctgagcatcccagcttgtaccatataatgacctagataccaatttttcttcttttttcctttgtggaatgtcatgactcttgaattgataatggccatgatttaaatgttcttggtttccatgagtatcttgcagtaggatttaaaaaatattttttatagagttattttgaggatgattctgcagttttttat

SEQ ID NO: 20381 - DNA, 201 bp, Bos taurus
caattctaccaagactctgtctgcccttgctcacaataatatttatattttcagaaatgctatagaagattttgattcttgcatcatttagaacttacacagtataaatgtgagaagacataaatggggcagaattgaagaatgaaaggcctgagagaggctttgccaatctgcatggtcgacttcccataatttgaccca

SEQ ID NO: 20382 - DNA, 201 bp, Bos taurus
gaatagaagatgcaactctcttgcatagaagatcctactcagaataggagtagtttgtaagcagtcacggggtttcagccttgcaaagatctcagttccacatagatttctcacaggtaaaggaaagcaatggtgaaatcctatcctaattttattttgtttgataaaaatcctaatttaataaaagttgaacaaactttg

SEQ ID NO: 20383 - DNA, 201 bp, Bos taurus
tgttctttccaccttacaaaggtgccctaagtcagagcacatttttaaagtcataaattgctgtgcagaggtaaacagtgattcctaggtttacttccttgtttcaggtgtttggagtctggggctcaaggagatgaaggataagccactaagtgctgagagaatgttgtatgtccctgaccctcccagtgaaggtgcatc

SEQ ID NO: 20384 - DNA, 201 bp, Bos taurus
caacaacttccatttacagaagcccttcccttcatcaggcatcatgaaggagcagagcgaccacactgaagtcatgaagaccacacatgaaggagcagagtgacacactgaagcgacacactgaagtttcctgccccaggaaactcacaatttagcaacaagtacataaaaaaacaaccatgaagtgatgaaaaatgacat

SEQ ID NO: 20385 - DNA, 201 bp, Bos taurus
cactgtaaattagttataagaattagtaagtatagtacttttaaaactagttgattgtttaaaaattaaatagtgaaattacatatttttcttaaaactgactcctaaatactgaatttaaaattctctactcgtcctgcttcttagtttgtattccatgattaagttggtagttcattttagtaacatgaactaaagttt

SEQ ID NO: 20386 - DNA, 201 bp, Bos taurus
ctatacagaactattcacccctatattttcagtttacaatttccttccttggaaataataaggggctctcatttgcatctgtgagtcactatgaggactgtatcatagtgaatctaatttttaagaaagaatactttgttgccagacacataaaaatcacacgtatttctacttggcctgtttctagcaagttttgttttt

SEQ ID NO: 20387 - DNA, 201 bp, Bos taurus
acccagctggctaacctggagagctgcttgggaggtgggtaatctgccgctttaagatcgttaagcctttaaagttgctgacagagtagaaggggttaagattcttgtgaagggcgtgtctgtgtaaataatggttatcactaggcagccggggcaactcctgatacccaaggcaggtcatattctcactactgctctgtt

SEQ ID NO: 20388 - DNA, 201 bp, Bos taurus
tattttagtgaaaaatctcattttctctttcggatgtgtgaaattaccttagcatgactgatctagtaacgtctatgtcagtcaagatcagaaaatactcggaagaagtattggcagctatcagtctactttaaattagttaggattttgactgacttatgaagtattaagatggctatttttctatgatattgctaagct

SEQ ID NO: 20389 - DNA, 201 bp, Bos taurus
attgatgtcttagtaagcttgccattttttggtttattttttctcctttttgtttgtgtttctttttctttgttttttaagggttacttggaacagattttagagtttgtcttgatttgcctatagtatttttgagtatctctttgtataactttaatggatactctaggtatcatatacacataatttatcacaggcaag

SEQ ID NO: 20390 - DNA, 201 bp, Bos taurus
gtttttcatgattacttttactgtagagatgtcttttcattcactgcatgtaaactgagaaagcttttctctatcacaagatccttgagatccttaaagcgttatctatcagttctgtttatatatttaatacttaacagataaattatctgcacattggtttattttatgatgtgtagtaaaaaaatcaaagaaaatttt

SEQ ID NO: 20391 - DNA, 201 bp, Bos taurus
aatgctggctgggaaccctacgagccaggccagaaatctccctgtgggtaatctggtccaagtgagttaaagtgttagaacagacaagtattgctataagatcctttaaaggccagctgaactttgtaagcacagcacaaagcaactgttgatggcctggcttgtggaatgtagggtgtgtgtgagcccaaggcccgggcg

SEQ ID NO: 20392 - DNA, 201 bp, Bos taurus
ttgcaatggttcagtacaattttaattttaactataaaataaaatatcagaaaattaaaaaaaaatcaaagtgttggttacagtgttcatgaagctgtccgtttttcctgatcatctgaaaggaagattcaaattcttagcaggatgataggaaaatgaggctggaactcaggtaaactctccaatctcaaagtgtggata

SEQ ID NO: 20393 - DNA, 201 bp, Bos taurus
gttttatataaaaattgactgaacttaaagatatggcctgggaaaccactaaaaggttttgaaactaaggcatgcgagtctaattgataatgatcaggaaattgactctattttaatagctgctgaattccactaatctattcatctgaagtgaggtgattagaaagaaataattagaattttcagtttgtaaacaattct

SEQ ID NO: 20394 - DNA, 201 bp, Bos taurus
cgaccttgactttgtagccaaagctttgtaacctactagttcagtattgttatcaattccagaagtaggaagggtcttttcccacagccctcccccacatcgtatctctgttaggatctctgttagggcctcctgacaccttggctcactgtggagagaattttcccagcaggcagaggtagagccagttacacaccaggt

SEQ ID NO: 20395 - DNA, 201 bp, Bos taurus
ttcagtgccaaaaatgtcacccttaatatatccgtatgtctctggtcttcttatgctggtctcttttgaaacagcttcccatttcttcttaacagttcatctgcactactttccctaagacccagatgctttccccttgctaaagcatttcctgatctatatgtcatatcattcttattatcacttattatttcatttcct

SEQ ID NO: 20396 - DNA, 201 bp, Bos taurus
tgcagtggttttcacatgaaatattcacataacggattgacagagtccagagagtgttaccaaaaatatctgtagtacttacacatttaaaagtcaagattttgcctcagaagcagcttcaaaattaattttatgcatataacatttttttcaacctataacatgctttctgtaaaggaaatggcttataaaatttaatat

SEQ ID NO: 20397 - DNA, 201 bp, Bos taurus
gttgtcctgttccttgaactacattttcttattactaagctaatagagctgggtttagttctcttgctttattctatacctcataaatctcctaaattgctttgagatatttttagactatgatatgccttaagtagaattttcaagcatacatcttacttagtcagctttggggcttctaaacgatatattttatagtct

SEQ ID NO: 20398 - DNA, 201 bp, Bos taurus
tacagcttaatgatggaaggtggacacaggtcttctagagctttttaaagtatcaggaaaccatgtactgggggctggcataggctgatttgtttcactgatgccatataatctctgagcactctgggagatgttctctagtgctaaaagatggtggttgcatgtgtgataacaggatgctagttaactaggaaatgaaga

SEQ ID NO: 20399 - DNA, 201 bp, Bos taurus
tcattcacttcttactgtccagtatattcattcttcttttggtaaaacagtaggaagttctccctttaagtaagtactcttccccaattttcactatcagttagtagatgacaccaccatcaactctaggtatgggtccaaattaagttaggacaattgatataatgttccagagacaataactgattcatgaagcagggt

SEQ ID NO: 20400 - DNA, 201 bp, Bos taurus
atgagtacaactttttctttagagtcatcatgcagtgtttctttctgtatcttatatcacttagcattctgctctccagatttatctatattgtcacaaatggcaggatattctttaaggctgaatattagtccatcatattctacattttctctatccattcattaactaatagacacttaagttgtttctgtaccttga

SEQ ID NO: 20401 - DNA, 201 bp, Bos taurus
cagaaaacaattggtaatgccttcattttaatgagaaagttcttctgatactgcagagttatggggctaaaaaacagtagaaggtaagcaagacataccagttcgttcatgcaaataaaaatcacccaacctggccagcatctctctttcctatagacctgcctcttgcagagagtaaaggcaggtggatgatgctgtggt

SEQ ID NO: 20402 - DNA, 201 bp, Bos taurus
tatttatcttcatacacctataattcagtataaaatctaccttaaacacacagtaggtatttgtagactgcagaaatgaacttaagagaaaaagttaacagttcaatagaaaccatgttttatttggattactggtacttttaacaacaaaaaccccacaagcacggatgatgatgccatttccataggttattataattc

SEQ ID NO: 20403 - DNA, 201 bp, Bos taurus
tttcggtttgcagtccctccacccactacctagattctctttttctgagatatgtttagatgttggagagaatcacatgattttctccagaaatcatccttggccaaatcgagttattttaaatcatttacccacagcagatattgcagaaactctcagagcatgtgcagcctgcactgaccagatctctccaccctttac

SEQ ID NO: 20404 - DNA, 201 bp, Bos taurus
tacaagctaaaaggtttccaaaaacctgcacggtaatacatgtgtgaggagtcatctctaacagataaaacagtgaaactcatcaaaaagcaacttccgtgtattcaaaaatattattggcaacaataatactccctcaaacctacattactgtatttttcattcagttatgttatttcacatctttgtgactcactgatc

SEQ ID NO: 20405 - DNA, 201 bp, Bos taurus
cctccatttttctaatttcccaatgtacaaatatttgtgttatccttcacttttacctctatctcacaatccaaataatttccaagtcacatcaattctatatgtgtcataaatgtctctcaaatctgcctctttctcttcattctttgctggtaatatgtcagttccagttttcactgtatctgacttaaaactgtgcca

SEQ ID NO: 20406 - DNA, 201 bp, Bos taurus
aatgtttttcttcttcaaaaatgaaaaacttaaagattgatgttagaccaaaacactgttttaaagtatcttaacagcaccaacaaaaatttatctggggcgaatattatcccgagatctttccgataagtgactatccttgattatatattttatttgcataaagaatattcttggcactgagttccacataatgcttcc

SEQ ID NO: 20407 - DNA, 201 bp, Bos taurus
tacatctaaacagctttgccattccaattaaatatatgctaatatgtaaaatggatagtcaaaactcttcaaataaaaaactccaagctgtgagttatgactctgcttgtagtagtattacaaaattgatttttcttctgcataaagcttacttttacatgacccaatttcagagagcatccaaatttatggttcaatctg

SEQ ID NO: 20408 - DNA, 201 bp, Bos taurus
cattaacaatggaaaagagttttaaaactccccaatacctgtcagttgctgttattaataagaaaagcatttccttaatccttcaccccaagggcagttttattatagtttcaaagtgaagatcgagaattctgcttgagatgtaataacttcataagaaaaatggattttaaaagaaatggaaattaagtgtagcattat

SEQ ID NO: 20409 - DNA, 201 bp, Bos taurus
gggagcagtttgcctgtgggatgggaaggacaggtgtccacaacagatggcgtgctcactgggagtcgtctccagatgaagggccttttctttccctccagctccgcggactcccaatctcttcctccagttctttccctctagtcaccattatggcctttccccagccccaagccctcaagcttctcactgacaatataa

SEQ ID NO: 20410 - DNA, 201 bp, Bos taurus
gctgaccacagactatgctctgacttccatgtaagacccaggccctgccaacacaggctaacaggagaaaaccacagcataaagctgataagccaaaggggacaccagcagggtcagggccaagcagcattaaaccagcctcctggaaggaagggaatcgcaaggaaacttgaaacttgcccatcttgactttggcacaag

SEQ ID NO: 20411 - DNA, 201 bp, Bos taurus
taggaagtctaagaagtcacttattacccaaagaatttttgagatgcctgaaaaaaattggagcttccttctctttgagaaacaacccaaaatagctaatttgcacatcttgtcacatcttaaattgttcttgtcaccctaaaccaagacatttgaaataaaaagtcaacataaaacagctctaagttcagtgtaagaata

SEQ ID NO: 20412 - DNA, 201 bp, Bos taurus
gtgacagaaagaggacacaggctcttagggaataagtcccttggccctggagatttttcaccctttggggaggagagcttggttggtgccctctaaaacgcagactcagggacttgcctggtggtccagcagttaagactcctggcttctactgcaggaggcacaggttcaatccctggttggggaagtaagattgcatat

SEQ ID NO: 20413 - DNA, 201 bp, Bos taurus
ctttttcatccttggagaaagtttctacactattaatgggaatctaaattgatcttctaaccttcctagatgtctaggaacaagctttttgtagaaggatagtgattatagaacctttctcaattttgctagtcagacaccttgaagaaatcaattagtaggcaaattattaactaattgagcatttagagtgttcttact

SEQ ID NO: 20414 - DNA, 201 bp, Bos taurus
cagctctaggggtctcagatatactagctctcctgatgtctgattctgtgtagattgggagatgttcccagaggtacagtccatcagctccaagtatcctgtaaactcccaactctctaagttaaaccacttcttgactaagacacctagggtggtttgtgtttctggattgaaccccagctgatactgaagtctggaaag

SEQ ID NO: 20415 - DNA, 201 bp, Bos taurus
gttaatatatcttggacctagccaaatgatactgtgtcccgttctccatttcctctagtacgctgctgcccaaagctaaccctgatgtttcctgtgacatcaacctaaaggaatcaagtgggtttactttgcagaagaaagagtcagaactgtcacttcacctcttatacatacaaacctcctatctacaaaggaagagaa

SEQ ID NO: 20416 - DNA, 201 bp, Bos taurus
gagtttgctcagactcatgtccactgagttagtgatgccatccaatcatctcatcctctgtcagcttcttctcctcctcccctcagtctttagtgattatcttagtgatggtctagtggtagttcatggggatcacaaggagtcagacacgatttattgactgaacaacaagtaatagtaaattctttttttaatgctggt

SEQ ID NO: 20417 - DNA, 201 bp, Bos taurus
tcaaaatgacacatggtgacacagagttctaccggagcagggggcccttggctaattggcagggctggccactagaaagcacacttcactcttcagaagccgcaaggtcacttgagcagcacccaaagaaacatttcaagtgggcaagagtcacaaaactccttgcgtacagcttacatgacaatctcctcctcacttgtt

SEQ ID NO: 20418 - DNA, 201 bp, Bos taurus
tcagtttgcaagttaaagagaagacataaaactccatggacacagtactggtgtgaaaaatattggcttacagaaacaaacaaacaaacaaaaaatgcccgctgaatcttcctttgttgcattcctaaaattatgcacttccttgacatcttgtatccaacttctttagttgtactctgtcctcagccatcattagggaaa

SEQ ID NO: 20419 - DNA, 201 bp, Bos taurus
aatgtaaagcagggtgacatcccggcatcctttgcggaggtagcaggccacgccctcctgaccctactgcacaatgaataatgcaaaagagggaaatgttattgttcaataaatcattctcctgcactaggaagctggggcagaatttgcctcacaagcctcaagactcaatgactctggatgtcaaatggaggcaactga

SEQ ID NO: 20420 - DNA, 201 bp, Bos taurus
ttgtcccacccagcaccactgagtagatggacgagggaccaggttagctggcccccagccactaccacaaaccaggaccaagcagatgaatccagggcctaagccaaatagaactgccccctgggaaaccaaaccaagaggcaaagaaggaacatcaactgggatggggcactggggctgagcgctgatcatgtatcagga

SEQ ID NO: 20421 - DNA, 201 bp, Bos taurus
tgtgtggtattttaacctcctaccagggatcgaacccacaccccttgcactggaaggcaaaatcttaaccactggaccgccaaggaagtctcatagatctggttcttaataggagactccttctccctctttgatgctgctgactgaaaaggggaggaggaacaggaggaagaaagaagagaagaaaaaggggaagaaacg

SEQ ID NO: 20422 - DNA, 201 bp, Bos taurus
cagactgctcttactagatgaccaactaaaatagctggaagacaatactttagaaatggatagttgtaagattataaaaatgcaaaaaatcccttttttttgtcttctccccaacactgagtgtcttcgcaaatgtcacccactcagaaaacatttcctctccatttaagatttggttgcattccgggttgtgtgctccct

SEQ ID NO: 20423 - DNA, 201 bp, Bos taurus
tttatcatctgagccaccagggaagcccataaaaggttcaggaaaccggtatttctcattctcctcagctctgtgttgtagatgcaaaatttcagaagtcgggggcttcctgcctccactcagagggtaaccctctgtcaagagcaggtttgagtaacctctatgacttgttttctgtagtggctgtaccaacttgcattc

SEQ ID NO: 20424 - DNA, 201 bp, Bos taurus
atacatccctgtgcttcagggcttaactaaattcctatcttcttcagaactctttcactgataatctcagaccacagagatgttcactgtggttgcctgttgtccctacagagcaagactggaagcctttggagaccggaagctccaagagaccagttccatcctttctgacgtctgatccagtcctcagaactatattcc

SEQ ID NO: 20425 - DNA, 201 bp, Bos taurus
cttcttatttttccatcacagtgacaactaatatcgactgaaatctgacaggacatttaaatgctaagtacattcatttcatgttaaatttccataacgtcttggttgctgaattatgtactatatttgtactgattttctgaaagctaagcattgctggcctacccaagataatttgcaggccgttggtcaattaaagag

SEQ ID NO: 20426 - DNA, 201 bp, Bos taurus
gacagagagagtgggagagagttttgataacctctggagggcagcatgggttgtgatgcaactatcaaagtcactgcagtatcaaaaatatttaaacattccaatttttaaccaggatggcactgacagaagtgttctttatatttaatattagatatgctgtaagtaattaataatttttaattacttacagcatatcta

SEQ ID NO: 20427 - DNA, 201 bp, Bos taurus
tcctcctcatgacctacccatatgcatatttcaccttataaatgtctctccaatctgtgctctgctttcttgtattccaaaagggcctttataaataccaattcttcacattgacttctcctttcccccttcactccattaacttctcttcaaccagtaaagattgccaaaaaaaaaaaaaaaaagattgccctggaatct

SEQ ID NO: 20428 - DNA, 201 bp, Bos taurus
agcacaaagatgtcccaaagtaatcttatctgagtatttcaaacaactatatcatttctacctcaaaatcttcacatcttttttcatctccttgatttccattaactatacaagcattaccctagatatcttcaaaagtttaaataaacccttgacattaacatctgattttctctcctgtaaaaactgattcaactatat

SEQ ID NO: 20429 - DNA, 201 bp, Bos taurus
aatgaatcatcctttatacatcttgagtaaaattgtttctatcattcttcacaattgttatattattgtctgagtctagtggttgtgattcctctttgctgatagtgaggtcatcacccaagaatgcctgtgcttatgagaaattcagctattacccaggaaaatcacaaagctgctgcttttatattgctctatttctgg

SEQ ID NO: 20430 - DNA, 201 bp, Bos taurus
agtggaaatgaacatctttggaaaactgctgtgtcactggcacctctcgagttcttaatattctttgttttatgtatctctgccctaaacatatgaggcaggggttttattataaagtgactcttagtgttttctttcatatcgcatccttaactatggttgcactagcattcagaacgtgatctgtttgccaccagaatt

SEQ ID NO: 20431 - DNA, 201 bp, Bos taurus
gtatcaggaatcttaagtaaatttaatttaaaatgtaataagaagacacttgtgttgtttaataacaaaataattcattaacagggcctgctttttcaatttgtgtataaaactctttataacttgacttttaaggtaaatgacaacacgtattttacaaattggaagaatttaagtatacccagggaattctgagtatgt

SEQ ID NO: 20432 - DNA, 201 bp, Bos taurus
cctagtgatttagttttaatatttacaaactttttttttttgtgtatgtgtttgttggatgttagattttctttgttttccttaaaaatcaagcatttcactaagatattcacagtgtggttttgatttcattatttaattagtcatgtaaatcaaggaatgatttcatccatagagtcattgctttcaactcagaaaata

SEQ ID NO: 20433 - DNA, 201 bp, Bos taurus
ccatggattatagaaatgcataactacctagatttttatttaaaatgcggtttaatgtcactggtactgtgttgttatactacactgaattttttccttacctgtcttcattattaaatttaaagtggtataaccttcacccatctcctatgacaattagctttgtttggcatggaaagaagtaaagattttgaaggacag

SEQ ID NO: 20434 - DNA, 201 bp, Bos taurus
tccaacctggggatcttgcaaagggactgagaacctccagggaatttgactttggaggccagtaggattttattacaaatcttccacaggactggggaaatagactctatcaggacacaagcaaaatcttgtgtcctgtacaaacaggacctaggagaaaggagcagtgattcccaaaacagatagagccaaacttgcttg

SEQ ID NO: 20435 - DNA, 201 bp, Bos taurus
gcagtttatgtaggggagatgtgcaaagtgagacccgtcttgccaaaagatgtggtaagaatgatgccaggtttataattttacattgtaggcagtaagatccttttagggcagggacagaaaaaaagactaaaaattttgtcatatggagggatttcctgaattagcagccttttgccagaatagtaataagaaataata

SEQ ID NO: 20436 - DNA, 201 bp, Bos taurus
atgattttaaaattatttgaagtgttcactaagtatagtttctctggaagaatatagtttacatgagtggatatattgctgtctggacaatgtgaaggaacaacaacacttcttgtgacttcacgtgtgaatcttcaaatgtagagtataggaggtgcaaacggcagtaagtgctgccagagagggcccaaggagatagca

SEQ ID NO: 20437 - DNA, 201 bp, Bos taurus
gtcatgtgttacttatttatactctatgaggtatatgttatataaaaagtgctatttagtagattagaagatatgtaaatgtacctaaaatgtgactcctatgtttgatatattcaaagactgacaatcacactaatttacatcagacaaaaaatatacctaccacggtagagcaaaagtgttttctaccatccttagaaa

SEQ ID NO: 20438 - DNA, 201 bp, Bos taurus
caaaatctgccccctaagagaggtactggatagggagggtaaaactatgcacattcatgttcctttttctatgcaagacattacccaatgtacggagcaattgggttcatgttctgagaatccccaaaaatgtagggatgaatttgagcaccttagccttaacttctccctcacctggatatactggccatcctcacccaa

SEQ ID NO: 20439 - DNA, 201 bp, Bos taurus
gctactaagcataaaaaaagtaatttatccagaagtctagtgaaaggaagcagagagtagaaatattttaagaaaaatctttatatcaacaatttctaaagcaatgccagtatactaactgaaggagggtttgctatattgtgtggactaggactgtgtgctacctgccaggctgtaaatgaccagctagttctggtttga

SEQ ID NO: 20440 - DNA, 201 bp, Bos taurus
agatactgaggaaataaagatacgtgaaatcaagtactgctttttagaaacttcaaattctaacaggagatgatgggtggatagatggatagacagataaaagaaatagcagcataatgggtggtttaatatgataggggaaggaaggagtaggtgccttattctgccagagacacatggaaattgaataaattccaagta

SEQ ID NO: 20441 - DNA, 201 bp, Bos taurus
cttataacagcacctccaagaacaactaaattgtatggcacagatggaaaagaggagaccgtgaaaggagtttaggtgtaggccaaaaatgtgttctggtatgtggaaactcatggaatgttccaaatagaatgaggtcaccagtttcaaatattcagaggattatggtagatgaagactgaaaattatgatttggccaca

SEQ ID NO: 20442 - DNA, 201 bp, Bos taurus
gaagccaactactcaataatatgcattaaaaacaagtgtcactctatagcagtttccctttcaggtcagcaaagaggtaaaatagtttaaaatacagatggctttagctggacttaaatgtttattaaaatagcattactttgactttcatattatgctatgtggaatgctttattggtcttatagtccctcctaaagcca

SEQ ID NO: 20443 - DNA, 201 bp, Bos taurus
ggtaaatccctatcagatcctggatccttttagttcggagatttcagaattctttcgactcatttctttttccgggttcggtccggaaaccagccagaatcggagggggtccacgatctgacccgatccgactgaggaaccatactagatccactgtgaagcccaggtgaacaaaattttgttttaagcctgaataggcgt

SEQ ID NO: 20444 - DNA, 201 bp, Bos taurus
agatgcagtttctttccatcttgcagttccagtttcccctaagatcttggcatgctttcaattcctcaaggagataaggaaagaaaaataaacagcactatagaaaaatatgaattagtcctggaaatggcaggtatctctaggccttacatcacattagccagatggtcacatgcctatgtttaatttcaagggaggtgg

SEQ ID NO: 20445 - DNA, 201 bp, Bos taurus
aaacttgtgtcaactaatattacacttgcatgatcatagggcacacgaaatattagaaaagcaagatggggccagattatataaggatttatatgccagtttacaaaaaaaacaaaaaaaaaaaaccagactttaacttatgcgccatggcaggttattgtacatttttcagctttagaaagactaatctgacagcaacag

SEQ ID NO: 20446 - DNA, 201 bp, Bos taurus
tcagtaatatggtccctgtttgtccctatagatatgattttctcaatgacccagtatctctctcctagacttgctagcctaaaaatttctgaaccacttccaaagtttacttcttgcattttgagaaactgttattttctatcttatatttttgctttcatttttggaactagtttaattactccagttataaataattgg

SEQ ID NO: 20447 - DNA, 201 bp, Bos taurus
tctctatctagtagcagtgattttggagcccagaaaaataaagtctgatgcattaaaaaatgaaggataaaaatgaagaatacaattctcaacaaactggacataaagaaaacaaacttcattaaaataaaggtcttacatgacaggtgaaaaagtgaaagtgactcagtcatgaccaactctttgcaacctcatggactg

SEQ ID NO: 20448 - DNA, 201 bp, Bos taurus
tggctattaaagacaatctagtaacaggacaatttatgaagagtggttgataagctctgttcctgtgtgtaatgaaggtagaagaaatagctattcaccactattaatttaagcattgagcacttgatatcagagtttgactataagtaatacatcatggattctaaaggtgtttctcaataggattttcatgcaaccagt

SEQ ID NO: 20449 - DNA, 201 bp, Bos taurus
agatgtatccaactttgaagtcagatgatggagttgcatgacctatccaagattctactgaccctatgatttcatgagaaaagaagggttctcagcttttaagttcccattctaaagcttattcaaagcaaagaaacagatttgaatgcaattcagggtgataaaatattcttatgtttaactttatgcacaatactgttt

SEQ ID NO: 20450 - DNA, 201 bp, Bos taurus
ttgataggtgctgaggtttccctactttatgcttatccacacggtaaacatgtgtttgcatcacttttaccagaggtatggcctgaaaaaaatatttacactgatttttctcaatccttcctatatattatgtttctcttcacccctccccatccatcaagcagctgtccctattaccaacatattaaaaatacaaaataa

SEQ ID NO: 20451 - DNA, 201 bp, Bos taurus
attttctggcaccaaaagtaaagcaaagttccctttccaccaacctggcttctttaatggcttttgagtggctagcagctgcaccctgttttctttaacatgtcacagcaaagtgaagactccaaaagaaatactattaaagtatatgcttgttgcagtgccttttagaatcctaagggccaaattagttttgatttggaa

SEQ ID NO: 20452 - DNA, 201 bp, Bos taurus
cgtggagattgtaggtgattaaatttttggaaaactttatattactgtttgtgaaaggctttcttgcttttggaaatgatagcaggctaggccctgtcttataaattttacaaaagaaactgtgaagtctaatcatctaaaaaaaattttttttaagccattctatatctaaatgcaaaagtctcaaactgagatgttaag

SEQ ID NO: 20453 - DNA, 201 bp, Bos taurus
ttctttgtttatattcacatttctcatttcaaatatagtgcaccaaaaaataatgtgtcagtcttcttccttttgctctcaaataaattattttcatttctccttccctcctagcctgccttcttcccttccttgatcttttctttctctcttactttgaaaatgtgtgcccacacttttcttattatttgttaaagttat

SEQ ID NO: 20454 - DNA, 201 bp, Bos taurus
catatatttttagtgtatgctttcttatagaaggggcatgactagaaatattgtatttccattagtagcaaatatcagtgagaattatctattccatcaatactttgcattaagctaggaaaaacagaagaacttcttaaagacacaaatatatgtgtgtgtgtgtgtgtgtgtgtgtgtgtgagagagagagagagaaaa

SEQ ID NO: 20455 - DNA, 201 bp, Bos taurus
gaggatttgctgataagattagggtgtgttcaggacctgtatcctttaatttggcctcaggtggtggtctcttgaaaagcttctcttgttccttaaatctagaatgaagaatgctaacatcttcaatttgttggtggttttagttttgtaaaaggctcaaagattgttatttgtatcccttgaggcagaaccaggacactg

SEQ ID NO: 20456 - DNA, 201 bp, Bos taurus
gtcatccaaaaaggcaaaactgtcttaagtggataaagtgatgtttatatgcagttaaaacaagcaatcactcagggtttgaacagttttaaaagtcaaagcacagcatagatgaacagtgaatatgtggtcctgatggggcatcacttggacatcttagtctctgaaagtgtctccccagtgtctagggtcttcaacaac

SEQ ID NO: 20457 - DNA, 201 bp, Bos taurus
agaaagagcaattgaaagggtatcactcagaaatggatgtcatacttaataagacttttgttccttgcttttatgaaaggatgagtatgttgtttctattaggatatccatgttgtgttaaaggggggaatttgggtgtttgtttgtttgttttatattgctgtttggaagtttaagtaagggaagaaaggcatgtgagtg

SEQ ID NO: 20458 - DNA, 201 bp, Bos taurus
gatgtcattttcagcattgtctttgaatgctcttttttggttttctttgttttagaaaatgtcatgtaccatgagctgcagctttgctctagttttacttcctgtcatagtcacagttgacagagctggtctctttcccaccagtctgagttcaactatactgctgacttcctcacagagtgtggaaaatttattgcaaag

SEQ ID NO: 20459 - DNA, 201 bp, Bos taurus
gtgttttttaaccacttgtgaaaagaaaatttgcaacttgtatttcaaacgaaaaatgtataacctaaatttgaatttcaaaaattcctatgtcctttagatcaaacagcagtgtctagatgattagaggttactctcatctctgtgactgtatttataacacctttgaaaaaacactcatccaatcttgtggaaacaatc

SEQ ID NO: 20460 - DNA, 201 bp, Bos taurus
tcacagaggaattaagtgacctaaatacaaggtgtcaagctacaatttaaagacaacttttttcccagcccctacacttgcaggccacttttctttgattgctattgttttgaaaattaatgataagatgagcatgaatcctaaaagatggtgccgtaaaagtgctgctctcaatgtgtcagcaaatttggaaaactctgc

SEQ ID NO: 20461 - DNA, 201 bp, Bos taurus
tggttttgaaaataaagattaaatcagccatactcaacccaaaataaaagttatgtctttttagctatggtatatattccaggacctgaattatactttatgaattacaatgaattttaaaagcaatatatgtcccatggatataacaagtaaggggattttcaatatttccaatttatgcttttatttgttacttatttt

SEQ ID NO: 20462 - DNA, 201 bp, Bos taurus
aaatcccacatgctgcagagcaactaagcctgcaccacaactactgagcctgtgctgtagaggccagaagctgcaactactgagttcttgcgccctagagcgtgtgctctacaacaagagaagccactgcagtgagaagcctgtgcaccacagctagagagtggcccctgctcactgcaactagagaaagtccattggcag

SEQ ID NO: 20463 - DNA, 201 bp, Bos taurus
gtgtaattatctaatgtctagcgaaactatgtgttcattttagagtctcacaatcaaaatttgaaatggaaagggccctgtggaagggtatggtaaagttgttatctattgggagagctagacatgacgcctaggatggggagaaagaagtaggagatttcagagtctgtaaaaagaaacagaaacataatgttttttaaa

SEQ ID NO: 20464 - DNA, 201 bp, Bos taurus
acaccatcgaatgcattaaaattgtttaatagacttatatgtcatatatacatatatcactttgattttcaggtggtgagagtgctgttttgagcaaggaagtgaagggaagtcaacgaaaacaggagcattccttttggataagacttttccattccttactttgactaaaaatcaggatcaaaaagacataacaatcaa

SEQ ID NO: 20465 - DNA, 201 bp, Bos taurus
aattctagatttaaatcatacagaagcttgctcttaacttaagaaaacttctcagtttaatgaatgttatattaataaatagagactccagtggtttaaagccctactttagagatactgtcctcaataaaaataatctatccaaataatagatagataggtagagttatagagatgagcatttttactgacctcaataaa

SEQ ID NO: 20466 - DNA, 201 bp, Bos taurus
aatcactagatggagtccaaaaatcttagtcaatttgttttcacaatttgggttatacttctctgtaaagtaagaacaactttaagaaccatttaacatacattaaatggttatgaggatgaaatgacatgacacattctgaagcacagaatacgagccagaactgagtaaagaaccatagttgggatttttttcctgtga

SEQ ID NO: 20467 - DNA, 201 bp, Bos taurus
acttaattaattttagaagtcacttcctccaggaagccttccttgcttggaggaggtattctcatacaacttttaaacgaacctcttgaaagcaagacagctcatttaatgggaagtcaccaaatgcaccaatctgccaacattttgtttttgttttagaagcaattttcttgactatatccattgactgactttagactg

SEQ ID NO: 20468 - DNA, 201 bp, Bos taurus
agctccaagcttgaaggcaaagaggtggttgccttggtggctatgggtttgaagggcttccaagtaaaggttagaaaggatttctcaatttgtggcccatatgcaatctacatcagaatcactaagattatttaaaatgcagatttctggttccacttcagaatgacttaatgaatatatctagaattgcagcccagaaat

SEQ ID NO: 20469 - DNA, 201 bp, Bos taurus
atttgcagcaacatatatgagcctagagattatcatactaagtgaagtaaatcagacaaagacaaatatcatgatatcacttatatgtgaaatattggggaaaaaatatacaaatgaacttatttccaaaataggaagagattcacagacataaaaaacaaaaatgccaaagggaaaaggaggatggggaagggataattg

SEQ ID NO: 20470 - DNA, 201 bp, Bos taurus
agatgtaaaattaatattaaatcatgcatgtttatttttcctttgctctatggagtccttaactaggaggtgttttccagttattaaacacaagggctccgtctagtggccaaactgtatatagtgtttttcaacctatgggtcttagggaaaacaatgtttctgatggaataaaattgaatataaagtaccagagtgatg

SEQ ID NO: 20471 - DNA, 201 bp, Bos taurus
aggatcttcccaacccagggatggaacccacatctcctgtgcgtcctgctttggcagatgtgtcctttactactagtaccacatcagaagctcagacagacgtgtgtcttatgtcagtttcactgctctttggtgtgtctcggcactagaaaccaacctcctgattttcactgcacgactcttaactgcagagtgggaata

SEQ ID NO: 20472 - DNA, 201 bp, Bos taurus
ccatgacactgggtgacgcttttatccctcacaaccattaaagtaataaattatatcaccattttagaaaggaggaaatttacctcatcacaagaaggtaataataaaaggagagagtggagattccaaaagagcttttctgactccaaaccctgttgtgcttttaccctacaccactttttcataaaagttctgaacaga

SEQ ID NO: 20473 - DNA, 201 bp, Bos taurus
ggttgtgagaggggagttgtcttctaagtgttttgcaagagaacattttttcaacctttgatttaaatcagaacaggtttgcagtattttctttaattttctgttataaaaatgtttattattataaattttagaaaactttcaggaaatacaaagatgaatggcaatcacaccaaacccagaacctgccaatctcttact

SEQ ID NO: 20474 - DNA, 201 bp, Bos taurus
cgcctctctttgttccttggctacatcatcttgccctgacctcagcttgggatgctcttctgtcatccttccttggccagatctttcttattatttaggtcttggcttaaagtatatctcctctaagaaacctgatttgaccacttaatctaaagaggccatttagactaacttgctgttcgttcccttcatcctatttta

SEQ ID NO: 20475 - DNA, 201 bp, Bos taurus
gtattctataaatcagttgtccccatcctttttggcacagggatgggtttcatgaaaggcagtttttccacagatggggcagcgtgcgggggggcggggtggggggtgttgtcttaggataagtcaggcacattacatttattgtgcactttatttctattatcactatatcaaccctgcctcagatcgtcaggcgttaga

SEQ ID NO: 20476 - DNA, 201 bp, Bos taurus
tcatttaagcccttaggccagttataaggaaatctatttcaaacttgctattacagataattaatactttatgctgaatcactctgtatcagaattcataatctgtgaccatacagccctttgctttacatgccatctccattactttttaaaatttttttattgaagaacaattagtatacaatattatataagttacaa

SEQ ID NO: 20477 - DNA, 201 bp, Bos taurus
taattctttattattggcatataggaatgctgtttatttgtccataaaattgctttttctgaaatgcgaaacataaaattaccactcaaaacctacaaaaatagaaaaggtatacactttactcaataatgtccaaaacagccagaaaagatttgcatcactatgaaaggcgacagagaaactatggcattttcttccttg

SEQ ID NO: 20478 - DNA, 201 bp, Bos taurus
cagtaaaaatgcctaattttattactgtagttttgacccataaaatataaacttataacactaaccactggaccaccagggaaaaaaatcacaatgaacataactctgtggaccccaagtacacttagctgagtttttcaatgtagcttggtaatacttttacttgtcctctcattctgagattactgctccaacctacac

SEQ ID NO: 20479 - DNA, 201 bp, Bos taurus
agaattctttataattttgtctaattctattatgtggcttaattttttaaatgctttgaaaagcattttttacttttttaaatgctctttttaaaaattgtgttaaataactcatataaaactttacaccttgtgtatttttaagcagacaatttcagtggtgttaagtacattcacattgttgtacaatcaataccacca

SEQ ID NO: 20480 - DNA, 201 bp, Bos taurus
aaaaagatctaatatttgtaatctccaaaggctgaggaccctgtatttaggcatgtctgtaactgtatagaagtgtaccagttgggaagatctgtacttaatgtaaaaaaccaaatgccaatagcaatggaaagaaatttagtaaactctttccttatgtttgtgtttagctttctatttcaatcgttatctagaaacttc

SEQ ID NO: 20481 - DNA, 201 bp, Bos taurus
tattccaatattcaatagaaaattagaatcttttcaacttatggtgctgaaactgttgtatatccataagcaaaaaatgaagcttcattctcatgtcatatcattaaaacaaaataatgacataaaaaaatcaatggggcttccctggtgactcagtggtaaaaaatcacgccagtgcaagagacgtgggttcagtccccg

SEQ ID NO: 20482 - DNA, 201 bp, Bos taurus
ctgggactggaaagccagggatggagactgactgctaactggcccagaatttctttttgagatgatggaatgttctggaattagatcatgatgatggttgcacaacattgtaatgtactaaaacacactgaattgtacattttaaaatcgtgaattttatttcagtagaaaaaattatgagaataaaagagttaaataact

SEQ ID NO: 20483 - DNA, 201 bp, Bos taurus
ataatcaggccttgaactcaggaaggttggtacaaaggattgtactcttaactattacattattgtcatgtaattttgaaagaatgataaatcataactataggaagatactgtttacattttggagtggtaaatagtctaatcaatcttggaaattaaaaacttgggccctgccaaagtcaccataaataaaactaaaag

SEQ ID NO: 20484 - DNA, 201 bp, Bos taurus
gtatcgcaacagcaaatcatctgatctcttcctttagataagcagggccagagttaagacaaagaatcttgttcgtcatggaataacaaaatgctagaaccagagatgcctcccaggtcatctgggccacaagacacaaataagaaaactaagacccagaaagaagaaataaccttgccaaggtcacatgggcagtagtaa

SEQ ID NO: 20485 - DNA, 201 bp, Bos taurus
tcactccaaaacaggagagggttacaaatgtgacaaggccctctaggaagctgaggattgaaaagtgtcaattggattaggagtgagggccactgttgagtttgacagtaggtgctaattaactgctcacattatcacttcctgagtttagctctttgtgtgaaccagcaggctgccatgcacatggcgtctctcaggccc

SEQ ID NO: 20486 - DNA, 201 bp, Bos taurus
atcttgttattgtgaatagtgctgctatgaacacggggcgcatgtgtatttttgaattatcatcttgtctggatgcatatgctttttttgatactttgttaggcatgttccttgtagctactacatggctgaactttgcttttctgccacaactgacagtttctgctttttaaaggttatgtttagcttatcacatctaat

SEQ ID NO: 20487 - DNA, 201 bp, Bos taurus
tttgcatcacaatcagaagtacacacttcaaagcacagttttataaacggcaggtatggcaacatgggacactggatggggagtttctagtgttatgttatatccagtgaagagtcaaagttatgcctgatgcatttcattaagaggacccctctccctctcatcaaagtattttcaactgggcctccctctaccactcag

SEQ ID NO: 20488 - DNA, 201 bp, Bos taurus
tgggtctgaactttgttttttaagggagaaacatcctctcctgattaaaatatttataaatccttcatcttcccctcacatgcccaaattctctctccttctccaaatcctctgaaatgtgtccctagcctgctttggagctggctcttatttttaattatttacactttgaatctttactctaagaaaaaaggctaatgg

SEQ ID NO: 20489 - DNA, 201 bp, Bos taurus
cagccaagacggacagaccaaaaggacttcttgtggcccctcctcacaagcgggtaacatgccagtgtctcaagtaactcagattatgtcctgtgagtgttgggacacaagggaagagggggccttaaggagccctgtaacttcagaaactggaaaccactctaggattcaccctggtgatcacacaaaataaccatgggg

SEQ ID NO: 20490 - DNA, 201 bp, Bos taurus
agccctaacattctttgctttcaagtttgggcatttagtgcctaaatacagtgtaatagggatatctatggtcaaatgattaagcaacggtgcaacaacgttcagagaatgtgtccagctgccatgccagcagtcgatccaaccacacaccttccttatttgattattatttcacagtgagcagctgcagaggagaagaca

SEQ ID NO: 20491 - DNA, 201 bp, Bos taurus
caccctgaattaaatccaggttctaacagtgaaaatggagcaggatacaggtactgagtgagtgagcaattaattgcatctccattttgagtctccatcccagaaacaagaaagtcattcatggactagaaaaggtaattaattacaatatttccaaagtgtcttctgctccccacaccaaaagcgtctactacatataaa

SEQ ID NO: 20492 - DNA, 201 bp, Bos taurus
catgaatatgaaaatgcaaaccaaggcatgcaaagatttatactcaacggtagaaacatcaatattgctgaaaagctacatccatcagctcagcctgctgtagcatatttagtcccaagactgagaaggctgaaccctaggcaatttatctgcatgtgtgtcgggctaaccacacaaattttgcagatgaagctagaagtt

SEQ ID NO: 20493 - DNA, 201 bp, Bos taurus
ctagaaaattgatctccacttttatcattatcacatactgaggaaattattttaagagagagtgacagtgggaaaatggagataaacagtcttggtcttcgggtcctactcacttcatctgctgtcccgggtacactgtgttctggagaagtgcttctgaattttaacatatataaaatatcactcaatacaaattacaac

SEQ ID NO: 20494 - DNA, 201 bp, Bos taurus
tgtaagggcaatacctcctggagttgtacaactcagagcttctgtttcttcagtgagattatgcccagttggcttattccttaaaatgttactaatctttagcaatgaaggtgactttggtcttttttttaaattgaagtatatagttgctgtataatattatgtaagttaagggtgtataatatgctggacaagggaatg

SEQ ID NO: 20495 - DNA, 201 bp, Bos taurus
ctctcagcccccgtcctctctccccagggagggggagcgactctgaatccgacctgccccatcggaagctgcctgatgtgaagaaggatgacatgtctgcgaggcggacgtcccacggtgagccgaaatcagcagtgccttttaaccagtacctccccaacaagagcaaccagacagcctacgtccccgcacctctgagaa

SEQ ID NO: 20496 - DNA, 201 bp, Bos taurus
taatagaagcccttattttgatgttaccttattttggcaaagtacccttgctcagtctactttctgagccatcccaaattcgccatcacctctaggcctcaggtctcaagttaaactctgattggtagacaggtgagggggtctctgggtttggtgcctgctgtccatcctggcctttgagcctggaggtgctaacgtggc

SEQ ID NO: 20497 - DNA, 201 bp, Bos taurus
agtgaagccagtggagaaaagtgatgttctctgaatcgatatttccctcttgccctttgtaataaaatttctaaaacaggagtgtgttttaggtcctgtcttctatcagggcattcaaaagaggcgctgactccttctttccacttaagatcttatcaggtgagaaaaccccttccattgcatcaccccagagaagagcct

SEQ ID NO: 20498 - DNA, 201 bp, Bos taurus
acttaaattaggtggagtggctgtttgttgttgcttggtcgcgaagtcccactctgcaacccagtggactgtagctaaatttagtctaaactgcctttaaatgttggtaaaaggaggtgaaatagtgtaatttgtaattcattattctctgttgaaatttatgtgctcttctctcatccctctgtgataagaatcgcctgt

SEQ ID NO: 20499 - DNA, 201 bp, Bos taurus
gcctcggttctttgggtgtgggtaccctattaggcgtggtctcagcattcctcatctacactaacacggaagcactcttagggcgatccatccagccagaacaagtacaacggcttactgagctcctggagaacgatccgtcagtaaggtcagcttattccagtgatgctgttaaagtttagagaaatagaaatgcttgtt

SEQ ID NO: 20500 - DNA, 201 bp, Bos taurus
tttgggcacctcccgaattctcctggacaggactcctgttgggagacaactcatgcaagtggtcatcaatgtgcctggccaaggtggctggttttgatcaatggttcactaacattcagttcagttcagttcagtctctcagtcgtgtccgattctttgcaaccccatgcatcgcagcctgccaggccttcctgtccatca

SEQ ID NO: 20501 - DNA, 201 bp, Bos taurus
atagcattatatgtaaatgagaccctcagaaatagtaggttgaaaacaatgataaagaaaacagtgaggactcactttgctggcatatttttcagcaatcacaccatcaccttacttcttaggtactgattattttttaaaccagatttataaatattcattggcagggggaaaccttagttgacctacctagttttaaaa

SEQ ID NO: 20502 - DNA, 201 bp, Bos taurus
gttaaatggaacctctttcttcctgctcctaagccattctattctaactccagcttgcctcctaggcttttagcagctttatatcatctaattgaagcagcgatgatctgttgcctacatagcccctcaaagtttgcaatgcttgttgctttgaacctgtgactagatctggcatcttttggcttctcctcagttgcgctt

SEQ ID NO: 20503 - DNA, 201 bp, Bos taurus
cttctgtgtttttactcaaggtggttcattgcaattatgatatagttcttgaggctagctattgggtgactctcagggccttcataaattaaactgtgaagctgacaaatcttatatgtcaactatgattcttcttccaggttggaagagtaatccagggccaaaattaaaacagaggtagccataatttttgaaaggtaa

SEQ ID NO: 20504 - DNA, 201 bp, Bos taurus
gaaactctctttcccagtccttcctcatcatatcatttagccatcaaccatcaactgaaaatacaagaactgcatggcatctactttctcacagaagtgtctgtcttcctggagaaggagaagtgagactctggtgtctgtcctgcttcagtgtgggaaactgcaacatctgcccctagacacaggagttgggtccccccg

SEQ ID NO: 20505 - DNA, 201 bp, Bos taurus
agagcttccgaatttgagatggaattcataaaaatggaatacgaacctatatttcgtgacattcccaatagagtctcccaccacatcactgtgcaatataagcacctgtacaactatcaatagcacatgggttaagaagctagaactagctgtcatctggatcaaggaccagtggaaaggatttctagcataccttgagct

SEQ ID NO: 20506 - DNA, 201 bp, Bos taurus
ttcaccaccaattcatcatctccaattgattcatcatcattagatgatgatgatgaattcccttctgtatgatctcaggtggccttggcctgcaaaggctcggagtgaggcttgggttcctagacagagattgggctaggtcacagtggtgaaagcatcagatcctagccactagaccagtggtcagtgacaagggaactg

SEQ ID NO: 20507 - DNA, 201 bp, Bos taurus
atttaatcttcttcttaacaataattatctgtcaatatcttacacttgtatttgtttttacgtccattaactatatctcactctatattataaatgtcttttgagaattcttacttcttttttctattctagcaacaaagaaagagtctagcacattaaaggcaatcaagatttaatcactttcggattgcagaatatcta

SEQ ID NO: 20508 - DNA, 201 bp, Bos taurus
gtctactgatttttagtgaaccacattgaacttatttcataaacttgtcacacagctatttaacttatttaacatgaaagaagaaacatttaatatatcttcttaattaacatgaagaaactatcaagatggtaaaccttattcaaatattatttgttgaaatgagtaattcataagcaataaaaataaacatgagaataa

SEQ ID NO: 20509 - DNA, 201 bp, Bos taurus
agaattgtaaataagttcatttgcaacattttttttagattccacacataagcaatatgccccacataatatgatatctatcacacacaaacattgtaatatatttgtctttctctgtctgactttgcctgatttgcttcacttaattgccaggtccatctatgatgctgcatatggcattatttcattctttttatggct

SEQ ID NO: 20510 - DNA, 201 bp, Bos taurus
agaaccctgagaaaaagttgaaatctgggaatgtggcattactaatagaggcatgtggacattgcctactttggtcagaacagaaggattcctaccactttagtctctatggaatacagtttaaaaattgggatccttgacagtaaggtaatcttcaagttacatatgctatgtgctgacttcatgtttcttatatatttt

SEQ ID NO: 20511 - DNA, 201 bp, Bos taurus
ggggtcacaaagagtcagacacgacttagcaactgaacaacaacaacaaagtactgaggcttggcttggctttttaaaaacagtaggtagtgtgaagctgttcttcagacaaacaattccagttttaaaatcttcagttcagttcagtcgctcagtcatgtccaactctttgcaaccccatgaatcgcagcacgccaggcc

SEQ ID NO: 20512 - DNA, 201 bp, Bos taurus
agatttaattatgtaaaatacatgaggctttaaataaaaatatcacagtaaaactactgtgagaatgtttttcacattcaaaaggagaaatttcaaaaatcattaccaagtattgatttgatatctagtccatgttcaacaccaggctagaaaaaaagagatgtgctctaatctctcagagaacttatcaacaaatatgag

SEQ ID NO: 20513 - DNA, 201 bp, Bos taurus
attccagtggtttctaaatctatatatgtatataaatatcaggttttcccagcagctcctcttagtttgtcaagagcatatttaacacatacaaaactcagttcaaactctatcccatacaatttgtctgttccacatttttaaatggtgactatccatgcatttgcataggtataaaacctacgagctattcattttcat

SEQ ID NO: 20514 - DNA, 201 bp, Bos taurus
cataaattgtctagtagatagcgtcagcagcagaaaaataaagattaagtcaggatttcatatgtgcccttcaaacctaattactaaaagctgaataaacataatgctatgggaaggggcagggaccctaaatacaaaaccttacctaaatattttaatatttttgtggtggtttcagttatgcttttgctatgcaaagta

SEQ ID NO: 20515 - DNA, 201 bp, Bos taurus
agtaagaagagacaaaaatggctatcaggaagtttgaaacttaaggttagacctcatggaagagataatgaatggactggaagtgaaaaaaaacaatcaaggctatagtttctgtagagcaaaagaatatagaagcaagaaaaaaagaaaaggagaagcaaacaaatgtgggagcaaaggtgagtaagagaacctgaatgc

SEQ ID NO: 20516 - DNA, 201 bp, Bos taurus
cactttaaaagggagagaatacaaatgagtagaacagaaacaacaaaacactctcaacaactacagttatgacaatctgaaggttttcagaaagaattgtcactaaggaaatgacaggaacaaatgtacactcataagtcacctgcacagagtaagaaatcagtttaaagaacacagatgtctgattaaaacttaatctaa

SEQ ID NO: 20517 - DNA, 201 bp, Bos taurus
caactctgggggacctcagaaggctgagtcaggagagaggggaggctggatgctccactgactcatgcctcttccagaacatcagccccatcacagctgccgaacgaggaggagatgctgaatatcatagctttcaagcagaggcctgatacaagaagcttgccctgcctccacctgagacaagaacttctcaaaggctca

SEQ ID NO: 20518 - DNA, 201 bp, Bos taurus
aaacaatgacatgtatcaactttattgaggaaaaaattatgttttctaacatgaaatttaaactagagagtgaaatgtatagattccctcacaaaagatcatttgtactcacatgaaatattttaaagctcaatatctttaagatggaaatacttccttgtaaggacttaagtcagatgttctagtggcattccattattt

SEQ ID NO: 20519 - DNA, 201 bp, Bos taurus
taaggtcaaagaaaaaaatgtttttgtggaaatgattaaatgaatagcctggaaaggcaaacagtaggggctggaaaaggggaagtgtcaatgaatacttttttggaaaggagtgagttggggtaactgctaggcctacaggtgatggtatgagagtaggattaaatggatgagtgatactgaagaagatatcatttgcat

SEQ ID NO: 20520 - DNA, 201 bp, Bos taurus
agtttatgtgtatccctttacactgatactgtaccaatgaaatacaccagccaggaagcataatggaaacaagagaccttctagtaatggaaacaagagaccttccacctcaaaacctccatcccttgcagatactgaactaaaatttctagcaagatacagtttgtttttgttttactttagattgcacagatagctaaa

SEQ ID NO: 20521 - DNA, 201 bp, Bos taurus
gatagataagatttaaaaataggaaatgattgtgaaggttgttctcgattagggaaatctgagattgatggtgtatgcaaaattgtgagttgaactccacggaaaatagtgaggtaaatgcagctgaggtctaattccatcaaaattctgggtctagatcttcttcatttttcttctgtttgccaggcaaactccatggta

SEQ ID NO: 20522 - DNA, 201 bp, Bos taurus
agaaattcagaacacagattcttgttttgaaatcttaaggtttccaattagaattctggtttcaaagaggttactttcacgttctttttctttaatctaatggagtctaacatttcacagactaaatgggcattcttaaactaacctggcataatttaaatcattttgaacatttgttaacttgaaaagtaagattaatat

SEQ ID NO: 20523 - DNA, 201 bp, Bos taurus
aactttatacctaatcattttttaaaaaattatataccataaaactagtcatttaaagggttcatatcacaaatattatagtcagttcagtccttcagtcgcatctgactctttgtgacccatggactatagcactgagggattctctgtccatcaccaacttccaaagcttactcaaactcatatccatcaaatcggtga

SEQ ID NO: 20524 - DNA, 201 bp, Bos taurus
caggtgctgagatttttaaattgtacagtctcagttttgtatggtgagagtctcctgcagttcatggccttggaacacaaggtcacactccagttgtcatgttagtgtcctgtgtgcccatgtgacttccttagatgactcccattggtagaaacctacagctctcaatgtttttgttcacccagaagatcacttcattcc

SEQ ID NO: 20525 - DNA, 201 bp, Bos taurus
aatttttactaactttgtgatttcttccttggttcctgctttctttggtagagaacattattacattattctcaaatggacctgaagaaagctaaatcttgtaactattcacaagctatgtcaatactatcttttgaatattaaatgtagttaaattgtatctatctgaatttcccttaaatggagcttcttgcacttgag

SEQ ID NO: 20526 - DNA, 201 bp, Bos taurus
gttacagatttccacttctatgtattatcctaccttcagcctcctaacagatattaaatatagttagtaattggacaggtcatatgcaaaccgtctaaagtggcctgataaaatatgtagaacatctttttcctccagacaacatttctacattttgagaacagaaagttctccaaaacacataccaagtgatgtgtagcc

SEQ ID NO: 20527 - DNA, 201 bp, Bos taurus
aaattataaatacatacctgcttgcttggtggtggcaaatggggacctttttcttggttttcatgtgtggacactgaagccatgatgaccttgtcttcgcttctcttctagttgagtggactcagcttccttgttgacccactatctaaggaaagtataagagtcactgtgcagtgatagaacatttatgtcaaccataaa

SEQ ID NO: 20528 - DNA, 201 bp, Bos taurus
gtggaaaatcagagttacttcttttccttggctagctcaacttttatttttctctactcctcccaaagcaaatatcatttctatggcttcttttcaggcctaaataaattgtggagaggagggaaaagaggtttatggagaaggtaaggagaaagcagaaagaaaagaggaaaaaaactctggaaggaaagagaaagagtt

SEQ ID NO: 20529 - DNA, 201 bp, Bos taurus
ttttgttgtgtggaagagtaaccaaagcctgagttacatagctcattttccagggctggtttttccaccactttatcctggagttagggaaatagtacttagagaaagaggttccattcaacattctttggctcctaggcaatgctctgggccacccccattcatggatgactttcacctcaacatcaaagtagtgcttct

SEQ ID NO: 20530 - DNA, 201 bp, Bos taurus
tgatttttcctaatatggcctgtgtcctctctcaccatcaccctttgctcctctttatcattttaattgcatttctctgaaccttgtccaattccaaactctttttctcaaggaacaaggccaggaacagcatatacattccaggtaggaacaccggatagctctggacatgttttcagtctggcttcttgtaaccttccc

SEQ ID NO: 20531 - DNA, 201 bp, Bos taurus
tgaagcaggtgaagtttgctctcaggattttgcactttttattttaaacaatatcatactactccccttgtaggtcaccattagtcactgatagtccttgcgacacaatgaccatcatgtcccacttttagacaactctcttctttaaatgtttctaagaagacttgctgaattttaagtcaacatatatataacatctat

SEQ ID NO: 20532 - DNA, 201 bp, Bos taurus
ttaccaccccagccagttttgggccactgtacagcaaaggacacgtgttgcttctctacaatcatcactaccagcatgaattccttctgcagcctcagtatcctcagcacctccactttcttaggccctatcacttgtctctaccaagcaacagtattaggtgagttgtggtctcaccaagtagagaatttctctttactt

SEQ ID NO: 20533 - DNA, 201 bp, Bos taurus
tgcacactgtctctctccatgccagcttgttgtctcgacaaatttattttcaatggcggtaggacatatgcttataatttcaggagtggagccacttgagataaggtggaacttgtcactggaaaatgagctccagggaagttgtttcctggccccgtatttcaagataggcttgttattctgctaaaagcgcccgaatca

SEQ ID NO: 20534 - DNA, 201 bp, Bos taurus
gcacctcccccacccccccataacacataacttagactctgtttcttgttttcaggccctgagccagctacactgtcttgtcaccaccattatcagcagaaaggaggagacaggcacagggtggcggcctggctgacccaagactgaggttagaatcagctgaagtcaggcagaaactgggagttagcaattttagagggg

SEQ ID NO: 20535 - DNA, 201 bp, Bos taurus
gggaaccaaggagaacctagcgaaagcttcaggaagaagggggcagaggggcaacaacgatgacgatgaattctgcaccaagcacatcagcttagaagcaaaagccttctgagctcacctttcaccatataggattaaaagaacacatgctgtggctcagaaggtaaagactctgcctgcaatgcaggagacctgggttca

SEQ ID NO: 20536 - DNA, 201 bp, Bos taurus
gatcattacaattcaacatgaaaatggcttcagcaaagccatggcctgaaaacaaatggctaactttacctagagaaactaaaggaacttactatatcttgacgtttccacagtaacaaatggcccactgaaaatcacagaagttccttgtaagtgatagataattcatgattttcacaaatgatttttctgtccctctaa

SEQ ID NO: 20537 - DNA, 201 bp, Bos taurus
tatatataatttaaagttatgctaaggttttagcatttttgtctttagtttaacagtataaatgaaagcaatcctgtttaatttactttctcagtgacatcgcaataggactctgtattatggttttagtgaaattagtagaaaagtgtaaacattatttgagttagctctcagacccagcgtttaacttaaagttgactg

SEQ ID NO: 20538 - DNA, 201 bp, Bos taurus
gccgggctattctctcctgcgctgtggagactgaagctcctgaagaaggaagggggtagaaggatgctgcctggtgaatgctgcttggataccagcaagaattgaagcttggcttcttttcaccctttaaaatgtggatgggctcacgtcttacctgcctgctatgctcaggaatgactctcaccactggacagccccgtc

SEQ ID NO: 20539 - DNA, 201 bp, Bos taurus
gttgggtcatgggtggtgatccatgagccagacgagaccccatccatctctgacacccatcgtgcaggggtgggtgaggcgtgaagagtctggtgggaggtgtcatatttaggatggtggccttttagtcaagtagttgcacagggaagaatttttaacatcttacataaaattgagcactgtatttcattaaagctagct

SEQ ID NO: 20540 - DNA, 201 bp, Bos taurus
aagactagtctgtgattgcgctccctcccggcgcatgcgtagtcagtgaccccctgcgggctccgactgccggcgcttttcgttcgtccctcccctcactatccctttccccggtgcgtctcggtgcgcatgcgatgtgctccgttaggcagctcggagctgcgatggggatcccgggcgccggaggagactcctgctccc

SEQ ID NO: 20541 - DNA, 201 bp, Bos taurus
ttacaatctcagttaaacttttactaagaatgtttacaacacagggattctcaaacttgttaaacttagcaaggattgtttttcagaagaaaagaaaaaattcagtacattttatatcccatagcgttgattctgcagaatatagctggtgttctgtttaaaaagaaaagaaaagtttaagtacaaatgggtatatgaatg

SEQ ID NO: 20542 - DNA, 201 bp, Bos taurus
tcatgcttgtgactcttcctaaaaagccataatgccatttttctggctttccaaggccagcataaacctcaccctaaagacatgactattcccacaaagtgtgttagtgccttcctgcagcaattacatctggcagccccgctaattatcgtctcctggagagcaggaactgggtccaccctccctagagttcccaacact

SEQ ID NO: 20543 - DNA, 201 bp, Bos taurus
ttagtagtgggtaattattttgtgattcactggtttgtggtttttttttttaatacaacactaatatattggtgatactagttcagattttttaaatggtttgaatctgtgtattatactttggtaaagatactgataaaaatattgggacaataggcttttggaaacagaaatgctaactcatcctaaaggttaattgtt

SEQ ID NO: 20544 - DNA, 201 bp, Bos taurus
tattataaacatattaactgtttccatctcaagaggtattttattgaagtgtactatgctttataatagtatttttaaaaacttcttttaccctttctgtagattttatcattttgaatatgtctttgaaagttactcttccgagttgccatgcttattgaatattttctctataagcactagtaccccatacgacagttt

SEQ ID NO: 20545 - DNA, 201 bp, Bos taurus
agattttttacataaaaactcaactaatcctctcagtcattaagtctcctctactagtttcctgttatttcactgcccacccagtttttgaacccaggcatcatcactgagtcctctctccctgaaaactcctatctctcatttaagcacaaagtcctactgatgctacttctaataatatgtaacatgtgttacgccctt

SEQ ID NO: 20546 - DNA, 201 bp, Bos taurus
aaagctctatctcatctcatttgtccccaggccaaacctttagaaattacacatcttcaagccaaacgctttctgtcctttagattcctgcaagagttaggaaaggcccatgggatcctcagaattataaatcataaacagccaaaagcacagtgagaggagacatgaagttcatgccccaagagtgaatcctgctgtaca

SEQ ID NO: 20547 - DNA, 201 bp, Bos taurus
gaaaacacccaggtgtaggaatttgcaaactggtcacatttcatgggttctctaagcttccccctgagaatgtgagaaaggaagtgaatagaggtgggttgagggttgaaacctaagttttcaacttgggatgaaagaggagttgtagggacttacttggcggtccagtggtgaagacttctcacttccactgcacctggt

SEQ ID NO: 20548 - DNA, 201 bp, Bos taurus
accacctcactgcccaaggccatagtcctgccctcagaactaacctaggcacttccttcaaattccagcacatcttgactagctcccgttcttggttcttactggccatactgctacacattttatagactcagaaaggaaagttggccttagtcacttctcttcagatggagaagaggaaagggcagtgatggccaaaga

SEQ ID NO: 20549 - DNA, 201 bp, Bos taurus
ttaattatcaatgaaaacatggaacagcaaagtaatcctcattaaaaaagaaatctgccttcaagagttcagatccctccaccacattcttgtgtttctgcacaggatcacgagtagatgttgtaaggtcatgtaatacttgagagagaagacaagcctgcattaagatgaagagatgtaggttgaagacgtggctatggt

SEQ ID NO: 20550 - DNA, 201 bp, Bos taurus
ttttctcctatgagcaacccttcctcaaggcagtgaggccagagcccactgtgatggacggaagggaaaggagccctaagagagaaaaaggaagaaatccatatttgaaaatattatttggccacatattttatttgcatggaggctcatttctgttaatgtattttaggctgtctgatagcgtgactggttttcttatgt

SEQ ID NO: 20551 - DNA, 201 bp, Bos taurus
cacaaggaaaatgacttagggaagtggaattagaaggaaatgtgtctttctcttggtcatgttatcttttcaacagaagccttgaccattctgaaatggatattgacagtaaattgttactgggaggtgatggtcaaaaggaaacttaggcggtttttaacaccatctgtcatcatgactcaaaaggaaatgccagccaca

SEQ ID NO: 20552 - DNA, 201 bp, Bos taurus
ggacaactggtaattggtcattttattgaaaaagtcaattaaagcagggaaacaataacaaaaaatacatatcctaagcattttctcttaaaacagaaaacaggattgccaatctttttgatgtatgacacaaggcacatggccaggggtaatactacttacactaagagaacctcccttgcagctaggtatgaccacatg

SEQ ID NO: 20553 - DNA, 201 bp, Bos taurus
acagtgctactcctggatctaaattacaaaaaaaggttacactcatatgctccctggcataaaagttcttttgataatatttcaaggttctttttttttttcccccaaacagttggctaaaaacaaaatgttatctgtcttacagttaaaaacacagacgaggtgagatcatttgtgaagcagcttaaagtaaaggaagca

SEQ ID NO: 20554 - DNA, 201 bp, Bos taurus
gctctgtggctgttcagcagtggagaggggccaggtattggtagtgatggtctcctgggatgacttgtgggctctggctgctgccaggccctgctgggacaggtgaccctgcaacaaagaaatggcgtgttttgagtcgctgtggctttggaccttggcagatgtgggattggcaccccagcagcctgcctatagcctcta

SEQ ID NO: 20555 - DNA, 201 bp, Bos taurus
tgcagtttaatttttgcctttgctgtatttgacattttgaggatctgtgaaggacctgggtggtatttcctgcaaatctgaaaggctatttatatcttgcatcaagtacagaaacagtgatagtgaaaccattgttctctcttctatttacagcctggtctgcctacagtaccattaaagatgaggagtatcaaggtgggc

SEQ ID NO: 20556 - DNA, 201 bp, Bos taurus
attcagtgatattgtcgttggtttcagtgggtatattacaaatctaataaatgccaatttgagcatttaatcaatagttattggacatctattggatactactatactaaaggcatatagataataccatggggcattttacaagattgtaaagtgtattttatttgcttttaaatgcttgcactaaaataggagagagtg

SEQ ID NO: 20557 - DNA, 201 bp, Bos taurus
tggtccctggtggtttagtagctaagattcagcattctttctgacacagcctgacgtctctctggctgagaatcaaaatcctgcttcaagtctctgcaagcctaggcctctgagatcaggatttcctttggcttttatgcttcatcttcatatcaacttgtcagagaaaataaaaattacagagatatctagtaacaggag

SEQ ID NO: 20558 - DNA, 201 bp, Bos taurus
cactgtggagacaaatcccctggcagtggcacttctgagatcacactgtgaagcagcagcaatgaggcgatgatgtagaagcaatatgcgtgagaaaatcactgcttttaaaaatataacttctttaaggatatcatctattttgttctctatggcttctatgtttagattcatatgtttagtgtaattttctaaataagg

SEQ ID NO: 20559 - DNA, 201 bp, Bos taurus
tgaatgactcaactgaattgacttagaagatgatataaaatatgggggaaaatgaaactagattagtggagtttgctggatgacaagctgatttaaaaaatggtctctgagcatatgagagttgaatgaagatttgaaggagatggccttctagataggaggagaaaggacacagcaagcagagggagcagccagggcaga

SEQ ID NO: 20560 - DNA, 201 bp, Bos taurus
catactgaacatgtaggcaagagctcaaagctgttttcttgttttagaaatgccttcaaattgatgtgcacaacatcctcaaaaaaaaaaaagtttctgagtccatgacctgttcttcaaatgtatgcttgaaaggaacttattctgatgtgatatgtaagtgctacattatatgaagtcatggaaagataccccatcaca

SEQ ID NO: 20561 - DNA, 201 bp, Bos taurus
taaataggacacatttagatgtaagaattaaaaacctgaatggaaaattaagagtccttaatgcatttagattccagaaggccaagaaaaagctagaaaaaccatgttagggaaggaggacatttgaatgtcaaaattaggttgtctgtatctcaatttattttttcatggaaaagtatcttattaacagctcatagtatc

SEQ ID NO: 20562 - DNA, 201 bp, Bos taurus
ttacctttccatatctttctaaagaaagaccacaccccttatactgtccttcttaatttaaatacagtttttctctaatgctacctccaaattcccagacatagggaataacctctggcacctttgaagatttattttataaattactttctatcaactgatacagtattggcaggcaactttttgtaacaaattataccc

SEQ ID NO: 20563 - DNA, 201 bp, Bos taurus
gtggatgggctcaacccctggtcagggaactgagatcctgcaagccacatgccccggcaataaaaagaagaatatctgttttttcacctttctcctaatagacaagtattctatgttacctactttccgatggtttcttctccagaaacatttttttctttcttctccatattactccttgcctccaggggcacatatgac

SEQ ID NO: 20564 - DNA, 201 bp, Bos taurus
attggttttggcaacagattactggtgatcaaaaaaatcattgttagtaaatcagtgttaacaaaaaccagaacaaagtaagtagaagagaaaatggacattattttttaaacaagataaaattgaatacacatattattattttgatccttcctggaaacaccactgtatgggagaaatggattttacaagccatcaacc

SEQ ID NO: 20565 - DNA, 201 bp, Bos taurus
ccttattgtctttcaacagcttgactctggaagttacagggatcatttggggagttgactcctgcttatgttccaccaaaaagcctgtggtcttgggccaattgttacacctgtccatgttctaattcttcatttataaattgtgacatagtagctctttacttaagtaattattgtatgcattaaacatgaattcacatg

SEQ ID NO: 20566 - DNA, 201 bp, Bos taurus
cagaagttgctagtcctattaaggcccaggcttggtgtccagaatattactttcactgcatcctattaatcaaatccattcacagtttctcaaagagtataaatttctggggccatctttggagatgagcaaccacacattttaataacatttattgaagtgtgttcatgaaaatttaagctccataacattttatttttt

SEQ ID NO: 20567 - DNA, 201 bp, Bos taurus
tgtctggccttttatcaatttctattgattaacgagtccaagaaggctggtaggtaatagctctacatttattgactgctgaacaaaatcacttaacctcacagagcaagtatccttgtttatgaaatggagataataatagggtttgtttattcataaattggccccaatgcataaggacaaggagaaagcaaagggaga

SEQ ID NO: 20568 - DNA, 201 bp, Bos taurus
acatttcttctctggtctttttttgttttttctccccacttctgacatgacccctccaaaagcaggtactctaaaatatttaatatatgttcttaacttatatgtatctttgtaaaataagtaatgacaatttgcatgtttgtatgtttacaaataatgctaaggccttgcattattttttcctatttgatatgttcagca

SEQ ID NO: 20569 - DNA, 201 bp, Bos taurus
ctaaaaaaaaaaaaaaaaaattcttcctcttacccatagtttgaggctgtctttagcataaaagatatggttgtaattagagtgatgtacagcacaagtatcaaattatgattattagtggataagggattcgcatgtagtattttttgtgttgttaaaaatgaaaattatatgaactgtctttgatagaacataatagaa

SEQ ID NO: 20570 - DNA, 201 bp, Bos taurus
cttagaatcatgtattttgagtcccccaactatcttcttcagtattgtgttgtgtatcataggaattttgcctttccatataaactttagagtttgttgacatctataaagtgcttagtagtatggcggtttagtcactaagtcacgtccagctctttgtgaccccatagacggcagcccaccagccttctctctccatgg

SEQ ID NO: 20571 - DNA, 201 bp, Bos taurus
agcgatttaccctttgcatattaagacatagaaatgtaatgaccaactgtcagatcaatcagcacagatttaaatattcaatattgaaattccaaacagtcctggttaaactctcaaattcatacttcaaaagactatttaaaataacacaatcagcataatatggggcaacattataaccagatttatcaatcagttaaa

SEQ ID NO: 20572 - DNA, 201 bp, Bos taurus
ccattgttgggttagtgttattccttaactgttctccttaccctgccactccttctctgatccatcatcaacaacaccacaggaataacttaaatgattatgttacccttggccaaaaatcttcagtgattctcattgatcttgagaataaacaatgcagaatcaatttgctctaatgaaaataatcataatgctttgtaa

SEQ ID NO: 20573 - DNA, 201 bp, Bos taurus
aatttaattaactaagcaccttctgtaggaatctcatgaagtataaagggagatacttggcaagattcatgactcaagcaatttggattaagaatgatagcaatacaataacattaaaatttcattcttaattttaacacaaatcttgataagaagcatatttttcaatgaggcatgaaaatgacaccacccttatagcag

SEQ ID NO: 20574 - DNA, 201 bp, Bos taurus
gatgctacagcaagctcagataaatgctctgctctgcttctgtccttcctccctctccaggggctgacgcaggctttgtgagggtcaaggtactctcttcttttcttcctcctttctgttgaaatacttgacataattgggaatgatatgtttactctttttgttcaatatcagtttaaactgatatttaagttagtgcat

SEQ ID NO: 20575 - DNA, 201 bp, Bos taurus
ccatgtgtagagtcatctcttgtgtgttggaagaggatgtttttactataagcaggtatagacaagggtttatttatgggctcacaatctgttccattgggcttgcattgtagctcagctggtaaagaatttgcctgtaatgtgggagacctgggcttgatccctgtgttgcgaagatcccctggaaaagggaaaggctac

SEQ ID NO: 20576 - DNA, 201 bp, Bos taurus
gaattttgtttatgtggtttatagagttactttcttggatttttaattcttgtttgtcttgttggtgtgggaatgccttctaagagttctccagccacatgtggtatagtcttacctggcttcaccacacagaacttatggccctgaggctgcactgccatatgaactttcctacagtccctagcaacaaagatatatgtg

SEQ ID NO: 20577 - DNA, 201 bp, Bos taurus
caataccatgaaataactcttcataagagagtgagaaggattgttgcagatgcagtggttaagggctattaactgggataagagagaactctgagaatccaagaaggggaagtgcctcctgaggtgaaatgagaggataaaaactgtgaaagtcacagtagtgcctagggtgaagaatttctaagaatagagatatataat

SEQ ID NO: 20578 - DNA, 201 bp, Bos taurus
attcatcaaactacttctgtatataaatacacatgcttgttcatccatcatagcattgagtgtgtgtcagagaagtcaattttgactctttccagaatgccctttcctaaatggatatgcaatatcattattgctgtaatcagcaatgcttttttttcttcacaacggtttcagtctccttccttcagattctctgtgctc

SEQ ID NO: 20579 - DNA, 201 bp, Bos taurus
atagattctcttcagaaatgactgtgattatagataatgcaaagtacctggaggttacaagaggttttcccaagaaaattttaacgtgccctgttttggccaaattcaacaggatgcatttacaattagacaatttaactaatttgttaactgcatggattattcttttcttagagttcccttatattgtcaattttggat

SEQ ID NO: 20580 - DNA, 201 bp, Bos taurus
gtttcctaaatcggaaataaatactgtcctaatctgctttagcttatatatatatatatatatatatatatatatatatatatatatatatatatatatataataccttacacggagttgcttaaacaacagagatttatttccttgcatctctaagctccccatcaagatactggctgactcacttcctggtgagagctt

SEQ ID NO: 20581 - DNA, 201 bp, Bos taurus
tgaaaagatattttctggagagaactgaccactggaattacttatttctccttcttaccctatacttttctgaatccccagggtaccatacttctaggggcattcagtaggaaaccatgaaattgaaggacaaatagaacaggggaaatctgaataatgagagacataagaccagcgataagaagaagaggaaggagttca

SEQ ID NO: 20582 - DNA, 201 bp, Bos taurus
tggcagtatctcccatcttcatttccaccctacagaggacaacccaccagtatatttcagacatgctggtaacttacttatcagtgcatagctcagtggtggtaaacgttctctgagctctgtcagtcatatgtaattgaaaacttgctgactgagtaaaattctttgaatctgctccaaattttctatattaacacttta

SEQ ID NO: 20583 - DNA, 201 bp, Bos taurus
cagatttgatttaaaacacaagtaattgttatatttatcagtaagttcaaataatcttttaaaacttgtatttcaaaaatacttctgcagactacagagggcaagggtaataaaatcctacacaatttgcagtgcagccaaggaggaggtgcaaacagaaaacctcctataggcttttacaatttgtcttcagagactata

SEQ ID NO: 20584 - DNA, 201 bp, Bos taurus
taccctccatgcatagacgcaagactttttctgcctgtggcagatctgccccagtgagagttgagcgtgaaggtagcacagctgcttagcctgtgggacacagactgccttcaccataggaattatgaccctatcaaagtatttttttttcccagactcttgtagccagagatcagaaggcctctttagctagtctttttc

SEQ ID NO: 20585 - DNA, 201 bp, Bos taurus
catgcaatatacagtggtgcgacaagtaaaagatgatagctataagcattcccatccataaatgggagtcacaaaggagtcagtggtctgtagcagttttgaaacctatctgggcaaatgttggctgtttccttgattaggtttcagtacctaggaagaactgtccatgcctctcagctctatctctgggtccttgatctt

SEQ ID NO: 20586 - DNA, 201 bp, Bos taurus
aagcagactaacccactttgaagtggtattgacccatcttggttccctctttgatggttcctggggctcgattggttgtgccctatataaatgaggcatgaactcaagatcaaccaggaaagggggcatgttttcctgccagaggttttcactcctgtccatgatttctcttatgcaaatgagacataagcctgagaccaa

SEQ ID NO: 20587 - DNA, 201 bp, Bos taurus
tatgtagtgccaattaaagcaaacatttgcatactgagttttatatgatgagtatataataggagagagagaaatcctctctcaccaagcccaatattaatgtgaagaacagaggaaaacaacctgaagaagaagaaactaagactgtgagtgagaagaataaaaaataggaagttatgctatcatgggataaacatataa

SEQ ID NO: 20588 - DNA, 201 bp, Bos taurus
cactgcaaggaatagacaacacagcaataaataaaatacacttaaaaaaaaagttttattttgagtttttctaaatcaatcagtcatgagtttgctgatgtcatgaaaatgaagtaaaagtcaaagttgctcatctgtgtccgactctttgcaaccccatggactctacagtccatggcattttccaggccagaatactag

SEQ ID NO: 20589 - DNA, 201 bp, Bos taurus
tttataagacagattgcagtaccacacacccatgatctgaaaaacataaatagaacttctttcttaataaacacaatttaaaaaggacataacatgaccactgcttttatgatctgaaatattccagcctgtacctaatatcataaaatgagtagtatattacaatgtaaaaattaacacccacaacgcccaactttatac

SEQ ID NO: 20590 - DNA, 201 bp, Bos taurus
attataatacagaatagctttaagcagaggcctctgggtgttctgcttacactagtagagatacaggtaaattataatctcccttgctgcagaattcatacgttaaacagtagtcatttctataacacaagtattggaattaaaatgagatttcacaacatgatcatttttggtatatcaggtttattatactgtgtggtg

SEQ ID NO: 20591 - DNA, 201 bp, Bos taurus
attggttttctgtatgcttaaattttgtgcagtttaattaatacctaaaaatgcaagccctgtgtcttaaaaatctcaataataggaaatttaaatgtagcagggaaataattaggagctcaacattttctcattactttaaaatgaatttcatgtcaaagtttagacacatatcagaaaagacacaataacatctcattt

SEQ ID NO: 20592 - DNA, 201 bp, Bos taurus
ggcaaaataactcaatgcactgtaagaacatagatctcacctacagagtaagaatggaaagctaactgaggagtgacagaagacatccctgaggaaatgaggatccttctaaaaccaaaagattacttagtgacgtttggtaaatgacagtgggtcattaagcaggtagaggaaaagatacattttgcttgttttaaattt

SEQ ID NO: 20593 - DNA, 201 bp, Bos taurus
atgccctaagcacatacaggcacaaaggatggactctagcatgcaaaagaaggtcataaaattattttttggaggaagtgttcctcacactgaaccacatcattagtgtaattgtactttgaaaatgatttttaccaaaataaagtagctggtccaaaagtatgggttctttgtagattcctacttcttatctcctttaat

SEQ ID NO: 20594 - DNA, 201 bp, Bos taurus
gataagttcacctccatgataacaaattttaagtcaccaaagctaataacaactatacttcctgttttgtttttttacaatctctctgatcttggccctatcaatatttttggacattcatatgtttcccctttgaggcttgtcacctctccattgattctttcaaccagaattgactgattctctgacaaccttcttaca

SEQ ID NO: 20595 - DNA, 201 bp, Bos taurus
acatattccgcatgcccactagtgccagtgagtgagtggaactctacacagatccagataatttaattgggacaataatactatgaagtaagtgctattaataattccattttatacgtacaaggtgcctaagttcttacaagcagccagaaagaaagaatctggaagttcagcatgggtgtatctggtaacacagctaag

SEQ ID NO: 20596 - DNA, 201 bp, Bos taurus
gttaaacttttgataagccaccattccattttctacagcaaatgtaccagttttcattctcaccagcaatatacaatccattttgagttattttttttttttgtgagtggtataaaatatgggttcagtttcatttttttatatatgaatatccagttaccccaagcatcatttattgaagagattgtcttttctaaaccg

SEQ ID NO: 20597 - DNA, 201 bp, Bos taurus
aaataaggtgatattttagaaaaatatttgacttagagagcatagtgaatatttatgtggcagagcctgatttgggcctcccaaggccaatttcagaaagcgttcactgctcagatgcagatgagtgattaggtaacagactccaatagtctacaccctcaggttctgccttggtttccaagcagaggtgcttcttttctt

SEQ ID NO: 20598 - DNA, 201 bp, Bos taurus
aggaggtctatataactgaatttcatggacgaacaagaatatattcttttttatgggaaattcttataccttggagtccaattgcaagggactgcatttcaactcttattactggggaaaaaataaaagatggattactctctgatctaacaaaactcaaatggctagcagattgagctctgatacctttgctccattttc

SEQ ID NO: 20599 - DNA, 201 bp, Bos taurus
accagtctggagagttctgcctctttctttggtctctcgttgccttccatgtataggggctagtttgcaaactaagtgacacaggccttctatacttcccgtgtctgtcttcatacttgttcctctgcttaaaaaggctgcctcagatctttgtaagcctggcctctccttttcattcatgtcacagctaaatgatacttc

SEQ ID NO: 20600 - DNA, 201 bp, Bos taurus
agctgatagaatggaccacagtggagacagagacccaatttcctatctgcaataacagactactctccagaggaaagcctaagcaatttagcagctgcttagcaccttttgaagtcgctgtagtagtacccaagacatccacccatgataaaatgtcacccctcccctgccatcactgttaatctcccagccctgattaac

SEQ ID NO: 20601 - DNA, 201 bp, Bos taurus
acagtatttttaactatagtcaccatttggtacattatattcccaggacttaataactggaaatttttaccttttgaccctcttcactcatctgccatcccttacctctggcaactaccagtttcttatcagtgggttttgtttttgctttagattctacatataagtgaaatcacactgcattcatctttctctacctaa

SEQ ID NO: 20602 - DNA, 201 bp, Bos taurus
gagacagacttagtgattgatcaacaacaacaaaacctgtagcctggaggcatcaaccttcagcacagcaggatctcctggcctgcaggttaaagcggatggtagcatttctgcttcgctatgctaggttggagggctgagcatttgcatttctaaaaagttccctggtgaaatctgttctgctagacctaggcctttgtt

SEQ ID NO: 20603 - DNA, 201 bp, Bos taurus
ggcccagaccactggccgttgaatgactaatcagtgttgtgcattggtccactccctggatgactctcggcaccaggccctctgggagggctacatggacaccctcccaccctccttggctgcctcctgtgtctctatcatgactggggccaccaccacacactgacaataaagttgccatgactttggaaaaaaaaaaga

SEQ ID NO: 20604 - DNA, 201 bp, Bos taurus
tcattatgaccttccttcttaaaattgtttttgctacatcccatagattttgtagaactgtgttttcattttcaattgcttgtggtgttttctttttttttaattattattgttgactaaccagtagattaaaatgtgctaaattgtaagaattcacaagtattcatgacataaaatatatttttcaaaggtcatatttct

SEQ ID NO: 20605 - DNA, 201 bp, Bos taurus
ctcctcagttacaactaacttccattggccaaagagatcagtaggacctcagaagcctttattgccaagtacctcaatggccctagccaacactggagaaggcaatggcaccccactccagtactcttgcctggaaaatcccatggactgggggcctggaaggctgcagtgcatggggtcgctaagagttgcacacaactg

SEQ ID NO: 20606 - DNA, 201 bp, Bos taurus
cccagctggtaatattttattataataatacaaaattaagtctacagaattaaaataattaaatgaaatttactttgactaaattctacatcaaatcatgttagagcctcccaaatgattcgttatactctggaatttattctgtatttattttcccaaattcagttctgagtggtgattccgtatatatgcctccttgtg

SEQ ID NO: 20607 - DNA, 201 bp, Bos taurus
ataccactagattgccttatttttcaaatggtcttttatattggtgtgacttaataaacagtaaaggtcaggcagatggtccctctccctcacatattcaatttcaccagatacagagctcttctggcagaagtagtctgaatatttttctgatatttacaccgccatacttacctacagaaaaataccaggtatacatct

SEQ ID NO: 20608 - DNA, 201 bp, Bos taurus
accaagtaaatcaaaatgattgaccaaaggaaactcagaagtgctgcataaaagtaattcaaactgtaatgagggcacgactcagcaactctctcactctttgagtccacccacgtgtccaacccctggtactgtcctttttttcctcttaataaatactttttacttgcttcactactttgcgtctttatgaaaattctt

SEQ ID NO: 20609 - DNA, 201 bp, Bos taurus
ttcagggaatgagagttgcatgtaagctaagccatgtaacaaagacaagtttacaaactggacttagaaacaactcagacttggataagtacacctccatttcatactattatcaagcatctaaatgagcagagaaaatgatgtgcttgaaatgagatcaggaaaatgttgtgccggtgagtgagcaggggggctgcctgg

SEQ ID NO: 20610 - DNA, 201 bp, Bos taurus
ttacaatgagaggactctaggtgagcttctggatgggaacgggtcaccagaaagaccaagccatgattaaaagcttgtagttttcagccccagaccttcacattgcagagaggggagaggggctagctgctgctgctaagtcacttcagtcatgtccaactctgtgtgaccctatagactgcagcccaccaggctcccctg

SEQ ID NO: 20611 - DNA, 201 bp, Bos taurus
acttaggatttaccaaaacaaatctgatgggacattttcagtttggcctcccagaggtcttcaaattgtagtctcattcagtaatgaattcctcacaagcgcatttgtcccagcacaccccggcccccaccagccctcacagaactcctcacacaggagtgtggtgacggaggggctgtgtgtcaggagtgcctcattaca

SEQ ID NO: 20612 - DNA, 201 bp, Bos taurus
ctagcactaccaaaggaagaagcacactatacttccaatctgggattccgaacgaacctgtgttgttaggttgctggcagcgcttccatccataaagtttggggcacagctacgacaaggactcccttttgggactctggtcctgtatggaagaagccaagagagatgctgctgaagctagagttccacctcattcccaaa

SEQ ID NO: 20613 - DNA, 201 bp, Bos taurus
aggtagctgaatcccatatgtttatgtgtactgctgtaatttctctagtatatgattgtagcactttaacactttgctttcccagaggacatgtagtctgtggtctggtaatttgatatatgatgtaatcacaggaaatattgcagttaatcaaatgtcctaaacccacccacaccttcaaatcctgtctgataaatgagt

SEQ ID NO: 20614 - DNA, 201 bp, Bos taurus
acaggccttgtcttcagattagctttcagaatggctgcaccaattccccatcacaaccaggtatcacaaattctatctttttgcatgtctttcttaaaagtaggcaaaaatctttcctagaggccctctggtacatttaacgacatgtttcagtggttggcattgaatcacagggccatgtaaaaattattcaaagataag

SEQ ID NO: 20615 - DNA, 201 bp, Bos taurus
agcttaattctccacaaggccagtcaactccttgggggtgtggaggcgggaatcacttgcctgcttaaaaactgccatgaatatcagtttcctggaaaagagagtttgaacctcttttcttggcatagtatacgatgttcacccaataccccaagcaccatatcttttgccaattcatttctccagcaagtagaccttgag

SEQ ID NO: 20616 - DNA, 201 bp, Bos taurus
gctatttattacattaatataagtaaaactttctatactgatattctaacaaatgccctgagaatataactcctttagattcagtaagcctggggaaaacaaaataaaacaaaattcttgcaactatgcaaaccagaggctgcttaatttggtaaacaacaaaggtacctgagtatgcagcaccgattgacttcagaaatt

SEQ ID NO: 20617 - DNA, 201 bp, Bos taurus
aacaacactggcagtacaaattttgaaaagcaaagtttaaattctgcatactcagaatattttacagataatggtctatctacttactgtttcaaccacatgcctctgtttattcaaagtgccattaaaaatgttcagtgttcattcctgaaaccaaccctggacttctggatccaacagtagagtcaattaaatgattgc

SEQ ID NO: 20618 - DNA, 201 bp, Bos taurus
gcttgtagtggaaaagacaatcaaaaggtgagaaaagacatgagcaggaaataagaaggaagatgcagagattatgaacacatggattcatagatattttcataataaaaagaagcatcttagattcaatcactgctttgtagaaagttatgtagcaaatactaaatgtagtattttcaggcttttgcagaagctttcctt

SEQ ID NO: 20619 - DNA, 201 bp, Bos taurus
agtatgtgatgagaacttcaaaatttggaattgtgtctaactgctccatctcttaagcgggtggaaactctgagatggctcaatctcagcttccttttgtgagatggtataattttgcctcccctcttatcatataggctttcttctgctacccctgcctgctttgcaacatcctagctttatcatcatgtgggcttgggc

SEQ ID NO: 20620 - DNA, 201 bp, Bos taurus
atagccttttctccttcgttgaatagacgtaaatcagtgattagttccatgataaaagtactttttaatgtatgctcattaaaggttctggatcagatcaaatcagatcagatcagtcgctcagtcgtgtccgactctttgcgaccccatgaatcgcagcacgccaggcctccctgtccatcaccaactcccggagttcac

SEQ ID NO: 20621 - DNA, 201 bp, Bos taurus
aaggataggagaggagcgaagagatgaagagaggaaaagaaaggaaaagaaactgttaagtgggagagggaaggaaaaaataaacttaagggggaggggcaggaagagaaggcacttccagagttgcttatgactagagagagatgacagagaaggtgatggcaccccactccagtactcttgcctggaaaatcccatgga

SEQ ID NO: 20622 - DNA, 201 bp, Bos taurus
tgtcctgtattttgagttacagcaatcattcagaaaatatctatagagtacttaatacatgccaaatactgtgcttaggtggcactagtggtgaagaagtagcctgccaatgcaggagatgtaagagatgtgggtttgatccctgggtagggaagatcccctggagaagggcatgacaagcccctccagtattcttgcctg

SEQ ID NO: 20623 - DNA, 201 bp, Bos taurus
actaacataaaaattcttgagttaaaaattatcttaaagaagatttcaaaatacttagaatctaatgaaaatgttttatttgtcaaaatttgtgaggcatagctagctaaaataatacttaatagacagtttgtagatttaaagtatatttattagaaaataagaaaatcttaaaagggacacaacttaagctaaatattt

SEQ ID NO: 20624 - DNA, 201 bp, Bos taurus
gaatcctcaagccagggatttattgaaaggtgtctttcctctgccagctttaagctggtctaaccagccctccagaatcttagctgggtgcctttgaatttctttaagcatcaatttttctcttcccacacagagtggcctccagtggggacactcctctctctcctctggacagtacaaaataagcttgtagctattttg

SEQ ID NO: 20625 - DNA, 201 bp, Bos taurus
tagctaccaattggtttagcaactaaaaacaaggaataattttttgctgagtgagtgaatgaatgaatggcctgtcctactgagatttctatgttagcttctccttcagtggatggtttaggggtggtattgcctgaagactagttgggacacagctcagagtgactgacaaacaacaaaagcaaagtaatgaatgaattt

SEQ ID NO: 20626 - DNA, 201 bp, Bos taurus
cagtcctggtataacccagcctagcaccggacatggatggccactgccctttctgaagcactgtttccacttgccctctgagacgcctctctcttggttcgtcacctacctggccggctgctgcttcctggtgcctgtggccttacttcgccccctcacctttccacactggatcacccccaggccaacactgccttccta

SEQ ID NO: 20627 - DNA, 201 bp, Bos taurus
tcctatctgcccatcactgttcacaactccatggaaaagctgtcagtctgctaaattggacccacttcttacaaactgattattgacctttccattgtgatgaacccagcttatctgtctctgcaagaaagaaggagctgttgagtcacaactgcaattatgagtcagaacattccagccccagggggagagacaagagaa

SEQ ID NO: 20628 - DNA, 201 bp, Bos taurus
aagcagctaaaagggtgaaatcccaggagatatcaggattacagccctgtcctagatcagacttggccccggggacatagctgagaaaacactagacaccaactctcatgaccttgattcatggaaaaagccaaatctgcttacagtcaaggaagccactttgcaccttagttctggcaatgtttctcagggactatcaag

SEQ ID NO: 20629 - DNA, 201 bp, Bos taurus
tatctaaacctgggaagacttccgcatctttccccaagacaaactcatgtatgttaagaatgaaatttattcctggaattctactattgttctctaccactgttctctttttatccccgccattgtccttttttcctctgtcttgcccttctgaaattgcctcttgatacaggaccctcctcctgcatactctgaaaccca

SEQ ID NO: 20630 - DNA, 201 bp, Bos taurus
tctgtattgtaactcttttgatcaataatggcagcaaaatgttacctgaaaaggagcaaggtagcattaaaatccgtgggatttaaacttgtaattccttggtaggtaagagtgtcaactaggataacagcctttgactagtaaattcatgcatttttctttaaattactaagtggcctcattggtcagtttctgagagag

SEQ ID NO: 20631 - DNA, 201 bp, Bos taurus
aattacttcctaggcagttctggccctgggcgaagacagtgtgagtccacagaatgtgaccggactcctaaccacctcctcccctccctgttgccacctcacagtcagggcctgtccaccagtcccgccccttccagtcctcaggtaactttataaggatgtgttatctgcttcaagaggtgtccctgacttttattctta

SEQ ID NO: 20632 - DNA, 201 bp, Bos taurus
atagtggcattgagaaaaagatgtagtagaggtatgtaaaaacactgttttcctttatcactattcttcaaaacaagttttgaaaaatctgtgcacatcaaaggtaatttaaaggccctttcccttaccattagaaatctaggtgtaaaggtatgaagaacagtgaaacgagtcaaagactcggatctggctctatactgc

SEQ ID NO: 20633 - DNA, 201 bp, Bos taurus
tatccttaagaattctactttgtatagtttttgactaagtactacggttttcacctacatttccaaatatttctggctgcttctatatatttggaactatgtacataacacctgaaagaatatgggccccttggaggggtggcagtggaagcccctgcagtaaagatctttctttaaaaagcagattgtgttattggtttg

SEQ ID NO: 20634 - DNA, 201 bp, Bos taurus
ctcatctgctctagggagtagtgcagaaggagccctttgaaaagcatccagatttatgtataaaagacttgtttgttaattttagagcaattggtctgagtggcaaaggcctgctgaagtattctcctgggaaggaggctaatgggtgctttcatcatgccctcgctctgccttgctaaaacccacaggtgccactatttc

SEQ ID NO: 20635 - DNA, 201 bp, Bos taurus
agctgatgggcattaactggcagcacccagcaccatatttgcaccggaactgatgaatggtatcgaccaactagaaaggcaaagtgaagggatgtgttgatctgttatctttgagaatcagagagcccccttttcagtacatctttcttttctcctaagttgttttctgtttgtagctcttattaaaggtgctggaagttc

SEQ ID NO: 20636 - DNA, 201 bp, Bos taurus
caaaggctggtgtagaaacaggggcctaatcagagtctgttactgggagcagtccaagaggaaagagaacaggaagggggttatggtggatgctgagcaaagtggcctgattgatgcctcttagagggctgggggctacggcacaggccactggagggtggggcgccccatcatttcctggaagggcctttggaggaccgt

SEQ ID NO: 20637 - DNA, 201 bp, Bos taurus
cttttccccaggcctagaacagtgcctgactcttggtacatgctcaaaaaatatctgtgaacagaagtttctgacttccaggagtttaaaacccagaagaggggacagagcatggccagaaatacctatgacaaaggcagagctgtggcttgtctccaggcaggcagaaatggtgtggaggagaaagagagagattctatc

SEQ ID NO: 20638 - DNA, 201 bp, Bos taurus
gcccagactctcctgaagctatgttttatttggcccacagaatggtggtgctttttttacttgaattcattttcaacattgaaaactggaaattttcatgcgaaaattccagatggccttttttttttttaagaagttggagctcaaggaacagtgagcccactttctgcaaggcccaggcacttactccaatcccccagg

SEQ ID NO: 20639 - DNA, 201 bp, Bos taurus
aaggtcactgcagcagagccaggaagctgaaagcaagaagccatccgtgtaccaggcgtcgcacaggaggagttagaaccgcacttctcttccaaagagagtgaaaactgagaacagaatgaaatggggaggaggaagtgtgcggagttacgggaaagaaaacagtgagcatctcaagcccaggagagtcagtgcagtgaa

SEQ ID NO: 20640 - DNA, 201 bp, Bos taurus
actaccatggttgtagtgaggttgaacctctttttgggtggccattgggcatttgttttcatttccctgtgaatgacctcttcacctccttgccttctcctcctctgcccccccacttgggctatttctctctgtcctgttgacattcatcctttttatatgtggaaataatctcctctcagtctgccttgtatctttact

SEQ ID NO: 20641 - DNA, 201 bp, Bos taurus
caggttagactcaaatcccactgtcaacctcagtagtcaccagagtttcctgaaaacaaagctatatcaagtcatatcatttcaaatgtttctggttttagtgctataatagataactgtgatgtctgcatgctgctgttgctgctgctaagttgcttcaatcctgcccgactttgtgcaaccccataggcggcagcccac

SEQ ID NO: 20642 - DNA, 201 bp, Bos taurus
aagagaatcaaatagtaaatcccataattctaccatcacatattgctattattatcatttgcatcagtttgatagggccaccgtaacaaaataccacaggcggagtggcgtaaataacagaagttaattttctcagagtcctggaggttcgaagtccaagatcaaggtgctggcagggttgttttttctgaggcctctctc

SEQ ID NO: 20643 - DNA, 201 bp, Bos taurus
ttttgaaatgtatatccctgttgtaagtgagatcatggagaatttgacttgaaacttctagaaccatctggctactaaagagctgcccattctccaatccgatctagggacaggcaagtagaaagtttctttggtcagtatacactaaatcccaaactctggacaataaaaggaacaaaatcaggttttagaactgttgtg

SEQ ID NO: 20644 - DNA, 201 bp, Bos taurus
attcatgcatacctatgtatgacacagtacagagtaatgccacaataaaattaaaataaaactggaattctggagaaattctagctgctctcaaaagtgggtacatccaacttccttccaaagtgcacagtatggaaatagagagaaagtaaagaaacatgataaacactatatcaagcaggtagtacagtcaacatcaag

SEQ ID NO: 20645 - DNA, 201 bp, Bos taurus
aagctttctgtcagtttcacaaacacagtttatttttctagagttttccctccccaccccataataattattcttgagtcattatgccatctaatgctaagaaggttctgtttgtttctaacatcggagtgaaatttttgtatccctttaatagtattcctagatttcttcttggctatatttctgagaagctgagtgtac

SEQ ID NO: 20646 - DNA, 201 bp, Bos taurus
ggctcccctcactcgtctcctgatcccttccttaaatagtttcctcttagttttgagaatgcccttaggatgttgagaatgccattcctcagtgacacggttatcagtgtgaggcaggtacacagcatcaaaaccaagaatgaaaggtagtgaaggttaggaaactccattcacttatcttgctctgcttactggtggcag

SEQ ID NO: 20647 - DNA, 201 bp, Bos taurus
acacttttagaaatcttttatgttatttttgaaagggacctaagatgaaatacctagactaaaaggaaatatataaggtacaaagttctagttagagttatgagcctgcgcagaaatagaaatgatagatgtgtgaaaaggagaaagagtgatgtgtgagttcagaacttttaatcagtggattccacacttcagcatttc

SEQ ID NO: 20648 - DNA, 201 bp, Bos taurus
gatgtagttaaaacaccacttagctgtaattttgtaattctcctgggtggggaagtggcggatggtggcagtgaaaccaaagcccagatttgagcaactgcgggctgttgactttaggctagtctttcatgaagggaaccctcaaaacaccacggccctttagcaaacagtgtgcatttcatctaagcctggctggctttg

SEQ ID NO: 20649 - DNA, 201 bp, Bos taurus
agtgaagaaaggtctcagattgcaaaggagggaaaaaaaagcatttggggaagagactagggatttgggaggattgttttataattaaaggatcaaaagaaaaaaggatgtaggagactgggtataatagcgagacagaagagcttgcaaagggcttggggtgactgaaatgagaagtcttgggcagaggtggggaactcg

SEQ ID NO: 20650 - DNA, 201 bp, Bos taurus
aattgttcttcctgtattgtctttctgaaacatgcaaaacttactatgttgctgctttgctgatttaaaaaaagttactgatgtcttccctttgcctaccgaagtcactgcaatctggcctgactctagacttccagcctcttcccctgtacatttataactctgtccacatggaatttctctccattctctgcacacccc

SEQ ID NO: 20651 - DNA, 201 bp, Bos taurus
gaattcaggattaaaattgctcctttcagattgtcaaactgatttatattttaaccgttgagcagctgaaatggcaactaaatagaatttgaatatactagcttcttatatttttctctttgcagatgataacttggcaaagtattaaatttttgaattgcagtatgtgtacctccttttgttagcattaagactttgtat

SEQ ID NO: 20652 - DNA, 201 bp, Bos taurus
acctgtttctgtttgtagcttccctcttctttctcctccatctagagagcagtgatcagttcgacaataaagaaaggctggcacgaggtgtgtgcggtgcgtgggtgtaatgtgtgggtctgtcagtatgtggcttcacagcaggaatgggactggatctacattagagatgagtaccctttctcaagtctccagaatgga

SEQ ID NO: 20653 - DNA, 201 bp, Bos taurus
taacatgaactaaaatcttgaaagaaaacttacatggatgaaattatcaactctccacatctgtttcctggatttctaatctaatcattcaatggtttaacgtgaaacacaagccttatctctagtttagtttgtatcctgaagtatacttcttcagctgtctgggatttacacaactttggtgctaccgtagtggtatat

SEQ ID NO: 20654 - DNA, 201 bp, Bos taurus
ttatattcaataaaaaagaaaacacaggagtatttcttccatagaggcagtgacagaaaaacatttggatcttttaatcaaaaggatatgaagcacttaatcttggacattcattatctctgcagaagttctggtgggcttgagacccaaggatggtgggcttgggagacatgcatggggctgaggctaaaaacccagcag

SEQ ID NO: 20655 - DNA, 201 bp, Bos taurus
tggaatcttcctggggccagggatcgaaaccatgtcccctgcattggcggggaggactcctatccactgtaccaccagggaagtcctactataacactgtttaatggctattagttcagttcagttgctcagtcgtgtccgactctttgcgaccccatgaatcgcagaacgccaggcctccctgtccatcaccaactcccg

SEQ ID NO: 20656 - DNA, 201 bp, Bos taurus
aaggctagttttctattcctggctctctggattggcagtcatttggtcatgtggtaaatctgtgtctcgtttgtctgaggtataagctacctgtatatcatagagatgcctctttatcttcagggtccctgcctgctaaccattcaatttgaattctgctgctgatggctcagcagtcattgaatgccactgatacgtggc

SEQ ID NO: 20657 - DNA, 201 bp, Bos taurus
tttttattttcttcatattcagttgcagatatggcagtcttctcaatttcatgagaatattttgttgaccttaacatttatcggttttgtgaattaggaatgatagcatgacatattattaatgaaatcttgggatgcatttcaacagtctagcaaaatgtcatctttcacccagcagaagactgactcaagagaaatgct

SEQ ID NO: 20658 - DNA, 201 bp, Bos taurus
tttggacaaatgtaaaatgacatgtacccatatgccctgaaaatgctttgtgctctgccttttcatcactctccactgcctggcccccaaacctttggctgtacagtatacttgaaatttgctatgagaatagatctgtgttctcaccaagaaaaaactgatcttttactgtcttcatagtttcacctctttcagaatgtc

SEQ ID NO: 20659 - DNA, 201 bp, Bos taurus
gtcatatattatggccactaatattcttcagagggtttagagaataacagcccatccttcccctgaaagctcactctcttcttcaggggtacagacaggaattagagagggaaaaagagggcctctgcctggtaggacaaaacagcagccttaaccttggctactcaagtggtatgagatgccacattctcaaacccttcc

SEQ ID NO: 20660 - DNA, 201 bp, Bos taurus
tggcaggctgcagtctatagggttacaaagagtcaggcatgacttaagtgactgaacacacacacatgcatgatgtaggctataaaaattaaaaagtaacctccaagtcacatttcctagcttgatgtcaggaaaagggacaacagcaagcagtctaggctttgagaactttcccaatcagaacacccttattttcaaacg

SEQ ID NO: 20661 - DNA, 201 bp, Bos taurus
agtactcttcttctcttcatactctttttctttgcttcttcacagtgaactctcttcatgtcttcgtcctttatgaatgaaagcaacaccaaacctaagggcatcttataatcagaagtgcttctgaccaaaaattcaagaagggaaccagcatggatcccagagccttgagctgcacactgcaggcttacaagccctatg

SEQ ID NO: 20662 - DNA, 201 bp, Bos taurus
tttatattagaaacagtagaatcagtgtagcaaatgtgctacttcctacatcatactgtgcaagattaggttacatttacaaaatcaggccattttaaaacagcaaataacattacaggtgtgttatacaatgaaaactgtgactatggtaacgtaagggattgcaagggctttcccccgctcccaatgcagggggcctgg

SEQ ID NO: 20663 - DNA, 201 bp, Bos taurus
tgtggcacccggtctatgccacagcctggcctaaccagccttcaaggacagagcatcaaacaaaccataagtcctttggagtctagagaggagtgcaaacgtgtgaactgcatctatagcatggccaccattgcccacgattggggaaatagagggtgcacagagatgaggtcccccaacccaaagtggggcaagtcacgg

SEQ ID NO: 20664 - DNA, 201 bp, Bos taurus
ctcatggaccactgaggactttgggttggggtgcctgggagggggccaggcaagtgcagtgaccaggacagacttcagcgaggaatggcctgggaccctgggctggctggctgactcagctcagattcgcataagtgaaaaacagatactcatagaaggctgggtcgcaatctgaatatacccgtaaggacagcctgccgt

SEQ ID NO: 20665 - DNA, 201 bp, Bos taurus
atggtggcatctgagcagaactgacactgctgatcagggaatgtgtgccaacaggtaaatattttccccatggatatatcaatgatgagtatacacagctagagcaattgtctaacacaggaactcatgctaagtggatcttcaacaaggaaagcaatgtgttttttactgcttttattttgcatttttataattctatgc

SEQ ID NO: 20666 - DNA, 201 bp, Bos taurus
ccagtgtagtagtttctaagtaaaaacttggaatgtgaaagttggaaaaattaaaatgaggtgaactcaggaaggcattttactatagaaataccctaaacgtccacagtaaattgtggaaaccctttattccactagaggtttaacaagcatgtcctcctcaaaatgcctgtttattcttgtattaaaaataaacacttc

SEQ ID NO: 20667 - DNA, 201 bp, Bos taurus
ctaccagagtagccctaaagacatgagactcagaggcaattgaggcttacatactattctaagctaagaaggaggtagggtgtgggccctcaaagtggagaaagacaagtcgtaggatgaagaagagagtaaatgtttactctgacgtgcagataagtccttctgttattaaaaagttatctctggtaattactcttttgc

SEQ ID NO: 20668 - DNA, 201 bp, Bos taurus
tacaacaacctaatttgaaactattaatctctctgtttacaaatgacaaagctatttgtttctgctccagaagagagcagagttgggaaagaaaatgcatgtgagtcttgattaaccaagtgtttattacttgagaaacttgctgatcattgtggtacccacagcaagcagttgccttaccagtggaaaagatgcactaat

SEQ ID NO: 20669 - DNA, 201 bp, Bos taurus
ccagtttttcttttgagttttgtatctgagacacggctaaaaattttaaatgaaggctaaaagatctgtattcacgtctgtctttgtttatgtgtgtgtgcgtgtatattatttttgtgtaatattttaaaaagagttatatttagttgagttaaagaaaagtaatgtttatataaattaaattttcctaaacttctcaga

SEQ ID NO: 20670 - DNA, 201 bp, Bos taurus
tgggcttgcagccaccaaaagtggcagtttgtctacccaacactttatttagcttcctgctagcacgggtctttagtcgagataaaggggaagggagaaggggaaggaccgacttaattccaggcagaagccgctctctgggaccgccttcccctcccgcccccaaccaaccacaggataatcagcccatttttttgttcc

SEQ ID NO: 20671 - DNA, 201 bp, Bos taurus
gtgctggacaaggccaccgttgggtgttcaaactaaaactaggctgtccaagaaccacaggtgactacttaaatttaaattaatacaaacttgaaattgctctaattaaaagtccagctcctcggctgcacattcaagtgctcagtagctagtggctgctgtactggatcgttcagaaacagaacatttccattactgtag

SEQ ID NO: 20672 - DNA, 201 bp, Bos taurus
gtaaagatgtagagaaatgtcatggaatccaagaaggaagtgtatcctggatccttaggactcaggaagcccattttctagatctgaaataccttaggaaccagagcagcttgcagtctcgccatttctttctctttctccatctctatctctttcatttctttgaggataatggggtcttttgtctccacttcccttggt

SEQ ID NO: 20673 - DNA, 201 bp, Bos taurus
ccaaactcccctgagggtagcgcaaccttgcttctaaccttagcaccctcagctttcacactaccaaagcaatgtagctccctacactacatttatacacaggccatgcttctatgctttcatgtaaagtattacctcaatccacgcacagccaaggcccaaaccacctttaaggttaagacctttcagaacagcagcgtt

SEQ ID NO: 20674 - DNA, 201 bp, Bos taurus
aagctttctcctgtaaaaaaattagtaaacagaagcctcagttaaatataatccggagaccaggagggggagctctcacatcctgtgacaataggcaagcccaacaagaggaagaaagacctttctttcatatgggaaagactcagaatatgaaaagccctgggtgccttgtttaatgattgccctccaaactgccttttc

SEQ ID NO: 20675 - DNA, 201 bp, Bos taurus
attttgataaaacattcaataatattattttacattgggttaatccagtctgtgttattcttttgataatcctacatagatactgtctgaaaggtttgtcggtctaaataatctatgacttttcttttcctggattatgggataagcatatttcacatgaaatacctttgtttccatgatttcatagcatcttgtttttaa

SEQ ID NO: 20676 - DNA, 201 bp, Bos taurus
ttagcaacttatatgatgttggccatcaaccaattgcaaaaaatgctagaaaggccccggaggtctccttaaccccaagggtagagggggctggaagggggagtgggtctgagaaggagttataggtggtaggaggcttagcatatcactatttatccagcagtatggaaacatttcgagattcaggaaagggttgtaaac

SEQ ID NO: 20677 - DNA, 201 bp, Bos taurus
cccagcagtgaaagcaccagctcctaaccgctggaccacagggaattcccaggagcaagtctcttgaaacaaagacactactagccaagacttgtaaacgaggccagcatgagttttggtttggcctaaggttaatgagggagaaggaaatggcaacccactccagtgttcttccctggagaatcccaggggcgggggagc

SEQ ID NO: 20678 - DNA, 201 bp, Bos taurus
cactccgaggcagccgggaagggcgggcccgaggagcggggagggtggggtgcaagccgggggcgtaaccaccgtctccaatagcgctctgcctggggccgcgcgtctcctccgggtcacgcccactcggaagcgccgcgccttccgattggctgaagggggctagccgtaggaccgcgcccgcctggttcccgccccctc

SEQ ID NO: 20679 - DNA, 201 bp, Bos taurus
atacattcacaattgatatgaaagttttccattgaaaatacaaaatcttactgaaatatatatttcttctaatggttgatttggctttgtgcagtgaaatatagcccatctatttttccaacctaacatagccagctttaacattcttcagctcagatcagtccttagaaactagtattctcttacccttcaaaaagaccc

SEQ ID NO: 20680 - DNA, 201 bp, Bos taurus
gcttcccaggcccttactgacagcagagggttaagcaggtcaggtcacactcaaccaccagggaccagccaggttttttgctcaggggagctctgctctaagaaccagcaaaggcccaagaagaaaagaatactgctgaaggctctgtccctcaggaaaacaggctgaaagaagttgagctgaaagaagtgaccttccggt

SEQ ID NO: 20681 - DNA, 201 bp, Bos taurus
tgacggcatcagaacttgagagagatgaagttgccacgtgtggtttcaggtcagcaacgtttttaggagggtagacggggggagtagaaacagaatgatatgcgtgcctgtgaagaagaaagaagggtaattgggtatttaatttcaatcatagtctctgttcattttcttcatcttctattactttaatgttgggaaatt

SEQ ID NO: 20682 - DNA, 201 bp, Bos taurus
atattatgcgcacatcttgcgcctccaaattctcggaaaattccttggaggagggagacaaaacaacaacacaggttaacttaaaacattctaagtcagacgaactcaaatctgattcatgtgtagaaagagtaacttaaaagaaggcacataaaacctacccagcaattttaccgcttaaagtaaaatacaaaatctcct

SEQ ID NO: 20683 - DNA, 201 bp, Bos taurus
atgctacagtatttttttagtctaaagcccaaaatctggtcataaatctatctattctcagacgtttttaagacataaaggccccaaattataaacaaaactcttagctcaacatcctcataatgcaaaatcataagagcttaagtttaaaacttcctctttgacataatcaatggaatagaactcttctaagcaaaaaac

SEQ ID NO: 20684 - DNA, 201 bp, Bos taurus
acaactgagccactttcacttcacttcttcttatacctcagggcctatcggataaattttgaactttgaatacaaggcactttatcctctgaccattgcccgcctactttgtggcctcatttgtagcaagtactcatttgtggtcatgaaaatgcagcactcaggtttccttctgcaggaagtataactgactgatggccc

SEQ ID NO: 20685 - DNA, 201 bp, Bos taurus
cagatatcacctttctcagttgctccactggtcatgctgcaaaatatcaaactgtgtatctaatctccatttcttattctataacctaaagaaagcaaatatttttcccactaatcttgtaatgtgagaacactgtcattttttcctcattgcttcaccttttgcctccctttcatctccataaatgtatcagctctgctt

SEQ ID NO: 20686 - DNA, 201 bp, Bos taurus
tccccatccaccaagggctcctgtaaggtcatattcagcaaaaggtcaagtctttccatgtcaagtgaattattgaacacgtgtggtactaaagggctagcgggctgaaaatactctgctgtttttcttaattagttgtggtggtttaggtttcttaaagcaggtcgtttatatcatggaaattcaggatggctcacacac

SEQ ID NO: 20687 - DNA, 201 bp, Bos taurus
tctgttcacttcttcctgatatactttcctctccttctttccctaggagtaaacactagcctggattttgtgattatcagtgtcatatgtgatggaggtccctgtctgcttccaaatcaaagcccagtagaaagtggctttagctctgctcactgctttgcatctcaagtccatagaaattacatcagacacctgttaggc

SEQ ID NO: 20688 - DNA, 201 bp, Bos taurus
cttatattttgttttcaactctgttccaaatactcattgttcaaagtatctatctaatcataatagattgctaatttggtgctttaactagttaacagaatatatggggcctttggatcacaaaggagatttaatgttcagatgccaaaagttttaggtattttgccaaataaataagtggtcaatctatgacaagcaata

SEQ ID NO: 20689 - DNA, 201 bp, Bos taurus
gaatgagtacaaattaaatcattaattaggtctcatctagaatctaaacaaaggattaggggaacaaacggaggttttaggacctgagtgactggagaactgaaacagactaaacaatcattctgactctttggtgagttcaacgtaccttctagtaatgaagattggctacaacagatcaagattgagcttaatgtttct

SEQ ID NO: 20690 - DNA, 201 bp, Bos taurus
gctggtttgatatattttaactattttaaaaattagttttatttctggaaattgtagtcactcttgcctcctagaacttaattattgtgtccatggggaagctttccagtatctgcaactcgattttcttctataaagcctgttttgttttttttttaacagtacacccaattgcaatgttctaaaacagagcatattaaa

SEQ ID NO: 20691 - DNA, 201 bp, Bos taurus
agtatcttgcttgtttgggaagaacagtggtttgcattgcctcagacgtaacacattatttcaaagcaaaggcgataaggcctcatcttgtgaaccctacggaataagatgagggaaattgcaggcagccgttttgacttttcgcctctagtggacttcccacatggccaccatgtaaatcaaattgcattgttttgggaa

SEQ ID NO: 20692 - DNA, 201 bp, Bos taurus
atgatacggccttcctatggggactactggggcaaagctgactctgcagttctcttaccgtatagaatgatttgaccaggtactccaggtagaatgccttgcccagctgattcaccgtcaggttccctcgcaaaatttcatctttaaggagccttggctataaaatcacaacagaacaaaagccgtccttcagtgactgac

SEQ ID NO: 20693 - DNA, 201 bp, Bos taurus
attcatgctcacaggctcagagaaaagagattgtttagatgtgcaggccttgttaaccatgagcaaagtgaaatgagttggcatgacaacctgcaaacatactctagcaaaatagtaacagtaaaaaagtaaataattaaaaacaaaggaaggaagatgaaaacaaatgaaactagcctgtcaaatatagattgaaaaaat

SEQ ID NO: 20694 - DNA, 201 bp, Bos taurus
ttctcttgagggaaacctgggagaagaatggctgagtaatttgcaaagtgcatttttaactgtataagaaattgaccaactcttttccaaatgatttgtaccattttatattctcattagtatatatgagagtttcagttgcttcacagtttggctactgtttggtaatgtcagtcattttttcttttttaaattttggtt

SEQ ID NO: 20695 - DNA, 201 bp, Bos taurus
ataatctacatataaagaaagaacctcacaaatcctgaagctatttagattttctatattttttttttcctctctgtgtctccctccagctgaaacagccacccaaagatataataaaatcacctgtgtaatttattttctcagtctagtggaaagtcaagtcctgaatgacgctgtatgacaccatcagtgtatttccag

SEQ ID NO: 20696 - DNA, 201 bp, Bos taurus
agccaatgcactcctcatcttcaaggctttcatctcttttgcaaaagttcttaaagtaccactgcactgtactttcattagcagttcctgggccaaatgctttatggatgctgtgagttgcctttgctgctgtatgacccattttgaatccgaataagaaaatcacttgaatttgcttttggcctaacatcattcccttag

SEQ ID NO: 20697 - DNA, 201 bp, Bos taurus
tgacttcttagtgcataatatatcactccaaagtcaactgaatgagtctgtccttgtaagtaactcaatgggagacatttcaaagcttgccttaatcacgtccattcgaaaaaactgagtaaaaacctgacatgcgtgttgttctcctcacttatgcatatctaccgggttggccaaaaagtttttctgtgttacagaaaa

SEQ ID NO: 20698 - DNA, 201 bp, Bos taurus
attatatctgcttcctcaatgtaatcataatcagactgtaataagaatcatgatgtgaaataagtacaaggttaatttcatcaatcctccacagttatgggttatgcattgattcatagcgcagcctatatacccagagttatataagccaataaacaaatgaaagagagatatcgatcactcgttcaaaacagcttcttt

SEQ ID NO: 20699 - DNA, 201 bp, Bos taurus
ggcagaagaggcctttcaaagatgtcgtgtaactgggaaaaacaacttttaaaaaatatgatatggctgtgaactgctcagcagtagctaatagaacacccggagttcctctgtaaggaaggtgaccggctttttatccagcaaaagttttaggcaaatccacacgttatcagaagtgatgccagtgccacactggtcaga

SEQ ID NO: 20700 - DNA, 201 bp, Bos taurus
taaaactcccagcagcaattgctctgtactgcactgcccatgcccagaatataaagaacatgctgcatcctcagcacatcagcggggccaggaactcacagacaacatttacagaaggcaggatgcagcccgaaaggactggagggtaacacaaggaccggatacccatcccctacccagcaggacagtaccatgagtttc

SEQ ID NO: 20701 - DNA, 201 bp, Bos taurus
acatatgcttgtttcaaataaaagaatacagaaaggagatcagctccatgccttaaaacagagaaagaaaaaatgtcaacatatataaaacaattaaaggaaattaaacatgtactgaatcactactataagcaaagaaagcatttgccccttacaacttcccagaggttaaaaaaataagtcctatcaaaaatatgacaa

SEQ ID NO: 20702 - DNA, 201 bp, Bos taurus
agccccaaactcttggtgactgctaacaaagtttctttcttctcctttgaattgactctttcagtaggcttgcatgccttgtatgtggtgctgtagaagggagataagagaactccaaaatttctaaattttagtttatcatacagttttaaaattcatttgcaatataaattgattgacatttgctttatttggagaagt

SEQ ID NO: 20703 - DNA, 201 bp, Bos taurus
taagtaccaaccgttctttcaatgaccatctctcgaggacttagatattctatattaggccataggtttacagagatattgaataagaaatagtctttgccctcaaagggaaaatagtaatgtaagtatcagtaatggagagacagacaaaaagcaattaataataataataatgaaaatacgaggatagtaggtctgtac

SEQ ID NO: 20704 - DNA, 201 bp, Bos taurus
atgttatgcaaagtactttaaaaaattgtataattctgaatctcatatttaagtttcctttgatgttaaatatcttgttggttgacattaaaatatttagttcttttcatggtttcatttttacaataacatgagatggatttacaatatcttaactgtatatttttaaaagtatatttgtgatccttaagtcaactggct

SEQ ID NO: 20705 - DNA, 201 bp, Bos taurus
cccccaacccatcccttctctggtgaaggtgagactgtcccctccctgtctagagaaaccaccctttgcagatccaagcagtagctcagtttgaatgatgggtggctcttggcatttctgaggtgatacgtttcactaagtgaatagtcctttgggtacagcctcccaaagtgcctttttttatacccaggaaagtgtttt

SEQ ID NO: 20706 - DNA, 201 bp, Bos taurus
aaatttgctttaaaacaattttaaggcaagttaacaaatatttgcattgtctaccaagtgcccagtcatatgggtaagcccaaggtgggtccctgccccaaagagaaggcaggctagcatgatggtcagcctacacacacgacacaattcaggagctgtctgctactaggtgcgtagagaaagtctcacacttcagcctta

SEQ ID NO: 20707 - DNA, 201 bp, Bos taurus
gtataaccagagtgaaacagagacgataataggagttattaaatatgaaaagatgactgtgagcctttctgataatcaaaaatatacaatcacatagaagtgctgtcttttcctatcatagtggccaagactaacagcgctggatcactgaaaaagcaagagggttccagaaaaacatctacttctgctttattgactatg

SEQ ID NO: 20708 - DNA, 201 bp, Bos taurus
agtatgttgaatcatctcagacttccatataatgagggcctcctactttgaaatgtcacctttccctcaaatttctgtccttggtcctcaggattgttactttgctgaacttggccagcagaactcaggcttcattttttttaaattaatttattctttattgaaggataattgcttcacaatcaggcttcatttttttct

SEQ ID NO: 20709 - DNA, 201 bp, Bos taurus
gtttttcataccttgattattaaaagcatggttgctcaaaaaaaaattgactgtaacttaggaaaagaaaaggaagtagattaagacatagcctagcaaaataaatgtctaaatttaaatacctccactgcagggggaacaccttttgaattaaaggagttatatctgggcacaactggtgaacatcttttgtgttggtaa

SEQ ID NO: 20710 - DNA, 201 bp, Bos taurus
gatttccttccttcggcctatctctttcattttagtttacataaaagaaaatatatacacatgaatattaactttgaggaaattctagaaattctgcactacttgagggtggccagagaggaaagagattgaaatacccttctccagatccagaatatcttcaggagttggatcttctcaactctggggaaaaaactggta

SEQ ID NO: 20711 - DNA, 201 bp, Bos taurus
aaacaagagaacatcaactgatagcccttgaagttgatctctgaactccccctggttcaggatcccatctccaccagacctacagggcaccaggccctctactcagcatcaatccctctcccgctgaattggtttctgcctgagctcatctccccctgtgcaggtcagctcaccccggggcagggatgacagctgcactga

SEQ ID NO: 20712 - DNA, 201 bp, Bos taurus
aagaagcgccaacttttgggcatgagagagctgcaatccctgcctccagctgggttcaggttaggaagggtcttggactggggtcagaacagttggacttcgagtcctaccttggccagctattctgtctttctctctcccagcctcagtttctcctccaggaaatggacatcataaataggcaggtgatacagcaactga

SEQ ID NO: 20713 - DNA, 201 bp, Bos taurus
tagcttggaggagctcagcagcgggaccccagctcctcctgggcacaagtcgccgggtccactgcgcaaactccggcctcctcgaaactctcctcctggcggaacagctcccggcaacgtccccgggctggggcggggcaagcgtccggccctaccctctgactggcaggaggacgggccaaccggaggggcgccccgggt

SEQ ID NO: 20714 - DNA, 201 bp, Bos taurus
tttacagtactggccaaccttggcattgtttttctgggagggtccaagtccagttcacggtgtggctctgtagctgtcagttctgagaagcagccgtgccttgggtgctcagaacctgggcctacccaggcccggtgcagacaggtaggcgcagcaactttgtgagttacgccctcttggagccagtgggtcgctgggcgt

SEQ ID NO: 20715 - DNA, 201 bp, Bos taurus
gcagaagtctgcatgatgcaagtttccttcccacccctgtttcgggctcccctcccaagaggcaaacgcgacccagcttcttaagactccttccagagacactctgtatatcctgcacggtcacctcccacgtgtgctcacccctcttccaccccgaggagcattattacacactctggcctgtgctttgcttatttcagt

SEQ ID NO: 20716 - DNA, 201 bp, Bos taurus
ccctctgctggcttctcactgaggggcgggggaggtagccacactatcatgctggcccccagggaggaccagtgtttgtgctctgggccgagcctgaaccctgatacggtcctgccatccccttggcagagcagagacaagcaaatgctcatgcagagaaataggcaggccatggctgtccctagcttggtctggttgagt

SEQ ID NO: 20717 - DNA, 201 bp, Bos taurus
ccacggctgagtccttaacctctctgggcctccgtttcctccactgaccaggatatggcctgtcagtctgagtcctccacctggcccctcctcacctctcgcaggtcagcacttcggggaagctgctcgccccgaggaagctgcgacccaggaacctgtcgtcgctggcggctgagtggacgctggaagaggagctgcagt

SEQ ID NO: 20718 - DNA, 201 bp, Bos taurus
cttttagtgataccaacatgaccatgtaaactgcctcaaaattttgttttgtattaagtgtgtgttcaaagagtatttgtaaaaccaaggcttttaaatacgtgtagaggcataccagagataccagagagttaatgtggctttggttccaggccatcaagataaagtgtgttccatgaattttttggtttgtcagtgcat

SEQ ID NO: 20719 - DNA, 201 bp, Bos taurus
gcaggatctagcaagccctccctcctcctcctctccaagcctcactgccctggtgttcctgcacagcttcaccctgtcctgcccagcactggccttgctgagtctgtatcactctatctctcctgcagccctggatacaccttagaaccacctggtaactttaaaaatcccactttctcctgcaagatgagtcaaatagga

SEQ ID NO: 20720 - DNA, 201 bp, Bos taurus
agctttcatctgtacaacttggccccaagatgtttttcatggactagcgtacgtgactaacaggagagaagtacagcaaaggacagaaggcgggacaagcattcagtgaactgaacagaggccaggtctctccctgtaaaggcaaagttgccccccacttcccaggccccttcaccaccctcccgtcaccccactctcggt

SEQ ID NO: 20721 - DNA, 201 bp, Bos taurus
agtgcagtgtacaaatacagtggaaagagaacacaggcccaggaatccaaacatccaggctaattctagtccgttcttgcctgtgcaaccttaggcaagtattccaacctttctgggccttggcctcctcgtttggcaaaagagagttataactccttccttgtcagccttgctgatttgggttgagagtctacaagagga

SEQ ID NO: 20722 - DNA, 201 bp, Bos taurus
agaaggctaccaggatatggcaagtttccagtctttttgtaggtggtggtcacctggatatatacactggcaaaaactcatcaagctgagctgaacatctgagatttctatatggaatatatgtatgttacctcaattaaagattaaaaagaaattaactatttgaacctccccccagaggaccatgtacatctgtgtatc

SEQ ID NO: 20723 - DNA, 201 bp, Bos taurus
gagtgatgtggctttgaaccaggagactggtgaaataatctaagccaagaataatggtgtctggatggaaaaggaatagcagaccccaaaagtgtctaggggatgatcccagcagaacctcaccaagggaagcagagaaagaacgcagtggtgacatcagtggtgaccacgtgactgagcaggagctggtggtaccattct

SEQ ID NO: 20724 - DNA, 201 bp, Bos taurus
cgtgggtgagagtgagtgaaggggagaaaagagaggatgttggtccagccaacaaggcagagttagaagggtggcctcgtgggcaagtctggccaggccaagagcccagggggagagatagctcctaaactgttttgaatccacttctggtctcaaagccagagttcctgcagctgctctgtacttccgcctgtctggccc

SEQ ID NO: 20725 - DNA, 201 bp, Bos taurus
ggaatacgacctcgctgtctttttcttcttccttttgcattttcccaagtaaatgtcttgaaccactgattagatctatgtgcccacaataacataagcaagcatgaagcttaaatctgatttaaagcagtattgtacagactgttactccattaaagtccttcagagtctagattaaaatagaacagtatgaagagcgtg

SEQ ID NO: 20726 - DNA, 201 bp, Bos taurus
tgtgcagcagcgtagccaacggtaagcactgatgatgacagtgatcatctgacggtggccgtgctcagtcagtgcttctcttcatctggcctttgctccatgctgtgaggcatacagcgtgtgagtggttatgacagtgcactcggtctctccctgatgcctggaggcctcatgcccctgccgccccccaccctcccgggt

SEQ ID NO: 20727 - DNA, 201 bp, Bos taurus
gctcccgctgccctgggcccgctgcacagggcccccgatgctcgataatcatgttaactgcggctcttggcggggctgggaggcggggtcattggattaccggccctctgaaaaggtcagcaggccgagcaaattctctgtcttgtccaattcagggccgattgatgcagcctcttcctggacctgaccaccctccacagc

SEQ ID NO: 20728 - DNA, 201 bp, Bos taurus
ccagggttctgagccacgcggtgaccagtgaactgtatttaaccagggatgtcaaatcaccaccttctgaaatgttccagaatcactgtgcacctcccacgaggctacctactgggccctccttggaggcctcctccccacccccgccccaggacaatgggcgtctggggaccctggtccaggaaggcttcccggagcact

SEQ ID NO: 20729 - DNA, 201 bp, Bos taurus
tttcattcaaattcatattgaacatgaacattcatacttgaatattgacaaattgaatattggctactggcaaagcaggagggtcaggcagaggaactgatacaaactaagacccaaggctccttgaaggagccccagtcagggtcaccccaactggtcagccagtcccacttgctagagccaggctttgggaagggccag

SEQ ID NO: 20730 - DNA, 201 bp, Bos taurus
caagccagcgctgatgacgacagtatttggaggtgtccttacgagccctagtcctttgtgcgagcagctctagaggccagtgacttccactgtccacatgcgtaactacagtttcacgcacttgctctcactcggaagctccctagacagcactacaaggcaactcaccctgcgggggccagcgcggctctgccgggcggc

SEQ ID NO: 20731 - DNA, 201 bp, Bos taurus
catccaacctggccaacgggacgccttgggaggaagccggggagtcagataggagtgcagagaactgcgactccagcctgaaccgcacttacgccatctcgtcctcactcatcagcttctacatcccggtggccatcatgatcgtgacctacacgcgtatctaccgcatcgcccaggtgcagatccgtaggatctcctcac

SEQ ID NO: 20732 - DNA, 201 bp, Bos taurus
caaattgctggccctgaaaccacacgctgagcagcaagaatccgtggcaagtcttgtctgtggtttactgagtggcgggctcacgttcagggaccagaggtaatggggtggggcctctgaatgtggacggctctggaaagacctctgccttgaaacctctgtgagtcctcttttacaaagaaattccacagcattgcatag

SEQ ID NO: 20733 - DNA, 201 bp, Bos taurus
aaggaagtcagtccgcaacacctgagcaggagccattcacacacacgtgtcagggatcaaccggagggcaggcgacagcacccaggccagaaaatgaagtcacaggcagcacctgatcagtatctaaacacccatcgaggatgagcaaggaacaaggaatgggaagacagagaggagagagagagagacaagagggagatt

SEQ ID NO: 20734 - DNA, 201 bp, Bos taurus
ctcctagtggaagctggccgagggccctagtggagctgtgcccaccgaaggaggtcagagacacgcgccgccggcctctgaggtggaggaacgggcctcaggtcagagacagcggggtgtccagaagccggaaaaggcaaggagactctctccgagaccctccagagggagcagccctccgggcccctgggtctcagcccc

SEQ ID NO: 20735 - DNA, 201 bp, Bos taurus
cagcgacgcaggagacagacagcagcagggctggatgcccagactctatttgtccaaaatataaattacagtcaccttcaaggggtagattacacacgaacgggtgcagagctcacacagactcagactcgtttacacgcagagcactcgtccacccgaacgacagtgacagttcccatcagtcggtgcggctgcaaagca

SEQ ID NO: 20736 - DNA, 201 bp, Bos taurus
cacgagctccacgctgggcaggcatcaaggaaccagaaacacatgtccggccaactcagtgtccccgtactcctatgtcctgcatccaatcctcgggctgatctcccctctgctccgtgagggccccgccgtgggccggcctgggggtccaggcttcctagaggagcgggtgtgccgggagggggcctctctcctgaaggc

SEQ ID NO: 20737 - DNA, 201 bp, Bos taurus
tgccagcagtattaaacatcagcactcacgtattcctttaagcagggctggctcttaatgaccaggaggcactgtaaggccactaactacgacagaaggcacttgctacagcctcctggggcttgcttcttttatcttaacctgacaatgactacaaaacactctaacctatggtgggttgaattctggccccatacacat

SEQ ID NO: 20738 - DNA, 201 bp, Bos taurus
tagttcatggggtcacaaagagttggaaacgactcagcgactgaacaatagcaacaagaggttaggtggcttagaatgacagactgggccccagttcaggagctttgggtgccaagctgaggaatttaggcttcatttgctgaacatgggatccattgcctggccaggtggcaactattaatatttacaaaattaggcaat

SEQ ID NO: 20739 - DNA, 201 bp, Bos taurus
cacgcctcccaagccagggccggatgagcttccggggtcctggcaatggggtcctctttcacccatccactgcccagggacccccccccccaccccgagtacaaggccacatctggacgaccagcactcacacttgacaggactttaagtggcaatgatatccaagaaaaaaaaaaaaaacctagcctaagccctttgaca

SEQ ID NO: 20740 - DNA, 201 bp, Bos taurus
ttcttcccccaggccctttgcccacttatccatgccagtggaagagtagttaactgtcctcatttgtgaaataggatatgaaacctgaatgtcttagtacatatctttggggtctgaatctaaggccggctttggggtcagataccttatttgacagtgaccccaagtagcacaaaggtcaaagaggtgagcatgagactg

SEQ ID NO: 20741 - DNA, 201 bp, Bos taurus
aggagccaagacttggcccagtgggagccagtatagggtgatgagaagaggcacctgagagagatgactttgccgtaatgccgaggaggaagactagagctgggggccagtttaaaaagaagaacagcatcaacagcagacttcagaggcatcccagagccaaagtcatgaaatctaacccaatcaagtatcggtactcct

SEQ ID NO: 20742 - DNA, 201 bp, Bos taurus
gttgtgtgtggcagggcgcatggagtggagtggggtgtcacaggccccctggagtggatggcatgcttgggggggatgggtagctgcaggggcatgacaggaatgctgctgctcagagcagaggcctcaagggaggcagaaacaatccagtgcttcccatagtctgggtcgctgattcaatctgggtctgcaccaagggct

SEQ ID NO: 20743 - DNA, 201 bp, Bos taurus
tctttctctccagtagaggaagagcagggaccctgtggggcagtgagagggagatgcaggtgatggtttcatgggatgaccttggcaggcacactggcaccgttttgatagactagatgacattgtactaccctgccagctaggcccgttcatacctttaattcttgggcagagctgcttttatttttctcttcgcctcct

SEQ ID NO: 20744 - DNA, 201 bp, Bos taurus
tggccccattacaaaattccccagagactattggatgaggggttgtaaataacttgtgaacatgcctagaactgatatttatgtcccttttgcacaaattctatatgtgttggctttctaggccaaaaacttggagaaaaggaaggataaagggtttgatacctgaagcccaaacagttactctaagacatccacccgagc

SEQ ID NO: 20745 - DNA, 201 bp, Bos taurus
taagtaacacagaaccaaaataacgatgtgctcccaataccaaattcaatcagcaattattgacttctggatctaaagggactcagagatgatccatttatcacaacaggttcagtggtttgccccaaagtcccatagttcacttttgaatctttttcagctctataaattactaaattacataaatcctgcattcaatat

SEQ ID NO: 20746 - DNA, 201 bp, Bos taurus
gtctagagttatagcatctttaataatgtagagtctgaccaggggatccatttcataacaaaggagctgtgggagtggccccatgaccaaggacctgacactgatgacacacaagataccattctgagtctgccatccaatcacacatggacatgacctcctgcaggctcagctgaggccagctcagaggcagtctgctga

SEQ ID NO: 20747 - DNA, 201 bp, Bos taurus
gttcagtccctggccaccaaagctttaggtacattcacagcaaagatcaattctcctctttgaatctcttgtctctgtgtttacatgtttgtggcttatttatttcatttacacataaggcctaatatcagtttcccatcttttcctgtagatgatactcaagaaatatgcttggatttgtattgcttcccgcctctagga

SEQ ID NO: 20748 - DNA, 201 bp, Bos taurus
ataatgagaggccagtccaagtttacatagtaaatagcaaaactggatcttgagcctcggatttctgaatgtaagagaaatgtatttttcgctacataccggtttaattgattggccaccatatgttaagtgtctggatacttccctgatggtccagtgaaattcaccgtgtaatgcagaggatgtgggttctctccctgg

SEQ ID NO: 20749 - DNA, 201 bp, Bos taurus
ccatctctaagggattttccccacccaggaactgaaccaggtttcttgcatttcaggcagatttattaccatctgagtaagaattcctgtatcccaatattaaaacacagggcaaactcactattgtacatctctgaagcctagaagaagtgacggcctattctgaacaaaataggatgtcctgagttactgcgaccaaca

SEQ ID NO: 20750 - DNA, 201 bp, Bos taurus
tagacgtgcagttgcaaggtcagaaagtgggcatagcttcaactccactagaaaggaaggccaagtgttttctgaagagtttatcccaatatatacacttttttcagtgaatgaaactttcttcatggtaactttttttagtcattttaacaggcatataaagatatttctttctggtttcagtttgcattttcttcagta

SEQ ID NO: 20751 - DNA, 201 bp, Bos taurus
cattgctgggcacaagctctgggacgtcatgggaatgaaagcaaaatcacattcctgaggagggttcacacagtctgtgcactagatatgggatactcacgcaacttactctctaaattaacccagcgaaggaggtgttttcatgaagatgattataggaatggtgggaatttttcctttacaaatgaaggaacaggtcca

SEQ ID NO: 20752 - DNA, 201 bp, Bos taurus
cctggaaatggcaacccaccctagtattcctgcctggaaaatcccacgaacagaggagcctggagggctacagtccatggggtcaccgagagtcggacataactgagagactgatcacacagagtatgcgtgaaaaccgcaattccagactcatacttcaaggtccatttgttatgttggataaacaactatagaaaacat

SEQ ID NO: 20753 - DNA, 201 bp, Bos taurus
cagcagtttattcaaattagatttctgttgtacaaacatgaaattctgctaagtttcattttctgtctcagtgagtttttttgagtcactttgggcatttgttttatgtgattttagcgctaaactctttaaatcaacgcgtcttcaatcttgccttgttttctcaaattgtgtattaaatttgtgaggaggggtgcttgg

SEQ ID NO: 20754 - DNA, 201 bp, Bos taurus
ttcagcctttacctgcccactgacctatggataggttcctatccttttaagcactcctatgaagtttaaaaaaggctgaacaaacagtatggtgaacacacaatggcttgtttacgaggacacactgtctaagttggagatgtgcatttgaccctttaaacatggtccagaaacactaagactatttgtcaaagaagttag

SEQ ID NO: 20755 - DNA, 201 bp, Bos taurus
tgactttaagtaagagagatttctcctaggttatctgggtgggtctcactaactcagttaacaagtgttaacggcagagctgaggcttcccttaagaaaatattcaacttgcagggtatttctagctcctgtctgagagttccagcctgccctggtcacttgtcctacagatttgaggcttgcttacccagccgccacaat

SEQ ID NO: 20756 - DNA, 201 bp, Bos taurus
ccaccagggaagcccaaaagaaatcaaaagaacataaagataaatagtggagcttgcttgcttttcaccccatttattctgttggtgacttttcaatggtgattttttttttccttaccctgtatatttttatgtcagactctgatttctgaagctttatttttagtcctcataaggaacagcattgattttcatgctatg

SEQ ID NO: 20757 - DNA, 201 bp, Bos taurus
ccaaggaattctcagaatgctttctagttaatgacaagttctggtccactttcttcaaaagacacctccaaaccacacctcccactgacaaaaaaaaaaagggggggggggagaagaagaagaaagaagcactatgtaattaaatgattcattcaagagagctgcatctccagaggagggatgtcatctgttatctgcaga

SEQ ID NO: 20758 - DNA, 201 bp, Bos taurus
ggttttccttcctacattatgctacaagatttaaatataaaaacttcatttgtgagcactcttttacttattagtctcacagatctaatgaaaagtgtctcactgcagaaaaagtggcattttcgatacataattgcaaaaagcataggcagacttggcttaggcaccaaaactaaggtggagcgtggtggtgccgggggc

SEQ ID NO: 20759 - DNA, 201 bp, Bos taurus
tttaccacctgctagattagtggttcctcttccttcacatgttcacttaaccagtctcctatagggttttctttagctcttaactgaactaatagcattttatattttgtgtcaagtgttgccagagtctttattatcagtttgtcaccactttggtcaggaggggagattttaggggcacccacaacatcatccattaca

SEQ ID NO: 20760 - DNA, 201 bp, Bos taurus
tagtccatggggttacaaagagttggatacgactgagcgactttcacttcacacattgtttaaatactgcatctttgttatgtatattgaaattggaacccgtaatgcctccagctctgatcttctttcttagcattgctttggctattctgagtcttttgtgttccatataaattttagaattgtcttttctatttcctt

SEQ ID NO: 20761 - DNA, 201 bp, Bos taurus
ctgcttgaggattcaaaagaaatgtaaatgagtagttggaaaaatttaagtgccagagaaagaaaatatgtggaagaacttattctattttatgggtgttgatatgaatgccaggtgcctcttcataaccagatagcctactgccttaaggtgttttaaatagctttaaagggatttattttcacatcaatatgatattga

SEQ ID NO: 20762 - DNA, 201 bp, Bos taurus
cattgtagggggacgttttcataatgctcggaagtggcaaagtcagccaacagaggcagatggaaaattctccacttgggctgttagaactgcttcgtgcgaacaagctactgcagcagatgatttcttatgtagatatatgcagtgatgtaagaagtaagatggttttagggcatttatttcaaaccttatttcctgggg

SEQ ID NO: 20763 - DNA, 201 bp, Bos taurus
tatgaagatgttgacttttccaacatcttgacaaatgaaagaatatatcagttggcactccagcagtagaaacattctcataatcagttgtaatgataaatggccaaagtctgaaataggcattgattgaattgaaaggctctccgttgtgtccaactttttgcgaccccatggactatacagcccatggaattctccagg

SEQ ID NO: 20764 - DNA, 201 bp, Bos taurus
tttttccattcttgattggtcatttcaccagtgcgtttttcagtctttgggaactgctgaggggaccaagtatccctatgttttgctataataaaaatactataactagagaacagtggaaattactttctgaatgtcaacttattgtttacaataattacttaatcaaatgaatgatattgactatgccttacatgccag

SEQ ID NO: 20765 - DNA, 201 bp, Bos taurus
aatgtgccaaatggtttgtttacaaaagaatcattcttcatcaagaacctaaatcaaatcctctgactccagtatggtaaaacaaactacctttccccccgcaaactacctcccccccaaaagataaataaagctattttaccaaagcatttcagattttattcccattttcatgatacaaaaacatccagataaactcaa

SEQ ID NO: 20766 - DNA, 201 bp, Bos taurus
acaggttcttggggccgagtgttgggaagaacaatatgaggaaacaggacaaggaagtgatgactggagctaaaacacaaggcatctaatttggctcagagacaagcttcacttagtagctgtaagtcaaagacaggattgatgttgagcctttaagcctaagtcaagcttatttaacaagcctcctaatcagaggcaaag

SEQ ID NO: 20767 - DNA, 201 bp, Bos taurus
tttctttgtgcaaccctctgcctctgcccgttgccggttaggatttcagcatgcaaatttaggggacaccgacattcagaccatagcaccttcccttagcttctgtgaggccacttttacttcagatgtctctgctcatttcttcttaatatctttgtgggctctatttcttctaccctactcttatctgtccatcagaac

SEQ ID NO: 20768 - DNA, 201 bp, Bos taurus
attggataatgggccccagaaataaatatccatctggaatttgaaaatgtaaccttatttggaattaacacccttcagatataattaagaatctctggacaagatcattctggattattgtggccctaaattcagtgttgactatcctttaagagctggaaaaaagagaagagacagagacacagaggctgtgtgaaggca

SEQ ID NO: 20769 - DNA, 201 bp, Bos taurus
gaactcaatttccattgatggagcagccacagcatgctggcagtatctttggcattggtggagaaaggtcaagagagagggagatgacaagttcactgccgctggagctcttgagtctactagaagcttgacaaatgacagccaggcaaaccagttaagtgcattctctaaagccaagtcttagaataaataggaaagctg

SEQ ID NO: 20770 - DNA, 201 bp, Bos taurus
ccctcccccatcccttccccttggcaaccacaagtctgttctctgtatctgtcaatctgtttctgtttcatgtgtgtatgtgactctttgcgacactatgaactatagactgccaggctcctctgtccatgggattccccaggcaagaataccggagtggattgccatgccctcctccaggggatcctcctgacccaggta

SEQ ID NO: 20771 - DNA, 201 bp, Bos taurus
tggcaagtctgtgtaataaatagcctaccacatgttaaaagaataaattcacaggatctgggcatttaaaagaaactttaggattcacccagagaatccagggacttcattttagagatgagaaaactgaggcccagagaaattagaagacttattcaagacctccctggaaagtagttatagaatcagggctggaaccca

SEQ ID NO: 20772 - DNA, 201 bp, Bos taurus
gagcaagagaatgctccggttccttcagcccctcataaaggcaccaatcccatcatgggagctccacatcccatggcctcatttaaattcaatgatttccataaagccacacctccaaacaccatgacattgaaggttaggacttggacataaggatgcacgtattaggccatagcaaaggcgcattgccgccatactgca

SEQ ID NO: 20773 - DNA, 201 bp, Bos taurus
cacgctatgcagtgtggccaaaaagaggaaagactttggttcttcacttttgtattctccacaccctcaatggtccttggcctatagcatgctatattcagtcattcaatcttgtccgactcattgtgactccattaacggtagccttcaggctcctctctgggattttccaggccagaatcctggagtgggttgccattt

SEQ ID NO: 20774 - DNA, 201 bp, Bos taurus
ttggaaaacctgtgctgtgcgtacttcagagaaagtaatgtgtgatctagagcagatgctctcagactccttaagtcagatgaataaaatgagcagcagctccaccatggaagtgtgagggttctgggagactgggaggtgagcacttagagtagtcgtctggatgtccccagatattaaccaagtccacactattgaaca

SEQ ID NO: 20775 - DNA, 201 bp, Bos taurus
gaatccggatgtgtctgcatgctgagtgagggaagagaaggataagcgagatgccaattcatctgtaacatgtgtcaagatcttcagattctcagacacttgcaccactattcatttttgacctttgaattattattgactcaagctttgcctattggattgtttgattgtccagtttctttttcggctcttagtgtcctt

SEQ ID NO: 20776 - DNA, 201 bp, Bos taurus
tcctgtaaaaggaataccagatatggggatgaaagcaaggcttagggggtctgtcaaaaaacatgtctgcctagtgcctgtcctttggtgttaaagcaaccgaaattaatggttttacactgtggtaggttgagttctctgaaagcagcttctgaggtgtatcaaatgtttagtatgtgttcactgtgacaagaagaagga

SEQ ID NO: 20777 - DNA, 201 bp, Bos taurus
tggactttcccctaaaatcactgagactctaattcagactaatggtgtgcccaaattacccatctcagtaggtttgcttgattccctgcagatgtttctcatttcagtttccagaaacatcgctgctgggtgatttatttgctgaaatgcatgatcactctcttgcttttctgctgatgaatgatttattatcatccatta

SEQ ID NO: 20778 - DNA, 201 bp, Bos taurus
agtgatctcaaggactcagtttctacagggtatttacagacgggattcctctctcaccattaagaatccagttctaaaataatggtgtgaaaccggacgcttccgaggctctacactagtctaacaatttttcctttgtaattcatttccgcactagtaatgagagaatggatgaataaaatatattgaagatgtcttgga

SEQ ID NO: 20779 - DNA, 201 bp, Bos taurus
gagtcagagccccagacctgctttgagattttgactgtgcttcctggtggcaccctccccattattgtctttccatgtgcctctcatctccttccacacacccgttccatcacatcccctttcggtccctccaacatcatccacttaactgtccagaatgattttttacactcccatcaaggttgaagacatctgatcctt

SEQ ID NO: 20780 - DNA, 201 bp, Bos taurus
actcccttgtcacagaggagttattacctgtcgtggcaaatagtagggccaggtccttcctgaagggagtatgaggatgctattgggtagtggaggggggggaggtgaacagcttgcatggcctgggttaccggtgggctccataagaaaatgtctgagcacagttcctcccaagagagcaaacaagtgcgtaagtatgat

SEQ ID NO: 20781 - DNA, 201 bp, Bos taurus
catcttttaatttcatggctgcagtcaccatctgcagtgattttatcttaggggttcataaatgactggaggaatatatgaacaaataaatgggaagtttagggtttcctgtgtctacagtctctttgctcttcagcaaagaatcatacagcaagataatgcatcttgctcttcttcctgttcttcacaaggccttgccca

SEQ ID NO: 20782 - DNA, 201 bp, Bos taurus
aaaatgtgctgagtgtgcttccaaagagaaaaggcgccagagggcctttggtggggcgtgctgagccttgtaatcacaaacagatgacggagattcctggttctgcttccagctagcgagggccctgagcaccaactcacaatcagcctggtataatcgtcgtggtttaccttacaaaaatgtcaaactgtcatggattct

SEQ ID NO: 20783 - DNA, 201 bp, Bos taurus
tgccccagctaattatagtcaccgattacctaacagcaagccccgctgtcacctgctttggcctgacggattaggccatctgggccacgtggccggggtccgagagccatgagaggtcacagagaggggcaaatggctctgaatgggaagaaatgtgtttacagccctgacagctgactgggccattaaaggggctttagc

SEQ ID NO: 20784 - DNA, 201 bp, Bos taurus
tagagggaaactgaaggcctcagatcaaagggagaaaagcaggaggcaacaggcattgctgacaagttgccttcttgcattgctgcaagaaggacaagtatgaaggcctgaaaccacagaaaggagcagaggtttgtgtaggaactggagagtgagtgcagtggacatggaaagcctacccccacccctcgctaattctcc

SEQ ID NO: 20785 - DNA, 201 bp, Bos taurus
atattttcaaaattactcaacccaagaatcattttctcttacagcactgattgataagaaacatatctcagatggccccttaatcactcaaaatgactccaatactactccacctacctgactttgcttatacttttcttccctacttggttctgagttttttcctctgtgccctgactttagacccttgatttagaggcc

SEQ ID NO: 20786 - DNA, 201 bp, Bos taurus
aaaacactttagaggcaaatatgtcaccatttgacaaagcttttttttctttttttgattgtgccagggcttacaggatcttatttcccaaccgtggattgaaattgttggtaaaagcccagagttctaaccactggacaatcaaggaattttcactggtaaagatttgggaaactctcatatcatttcttttcacgctat

SEQ ID NO: 20787 - DNA, 201 bp, Bos taurus
actgtgttcctcaattcagttagaaatccagttgactagtgaacactgccactattgaataattcagatattgtagaagagtctagctttaacatctagacataccttagggaagttgcattatatagcaatgggtagattgtctaaaaaccaaaggttttactggctgatgttagaatgacagctttaatgtttgtattt

SEQ ID NO: 20788 - DNA, 201 bp, Bos taurus
taagacacaccctgacctcattaaaaatcaacaagacatcagagggcaattgtgcccactgatgaagtccctaatagtcagcctcttgagccccaaagcagggcagaggaaggctaaaagtgaatctgaaaaaatagataactaatcagagcctactgtatagctcagggaaccctactcaatgctctgcagagacctaag

SEQ ID NO: 20789 - DNA, 201 bp, Bos taurus
gataaagaaagactgatttctagaaagtgcatttgaaaatgcactggctctagtctgcatactttatttgtgacagtaaatattcctctcttaggtttaaatcaacttgttggatttctgtcccttgagccccaggtattcacaatctcaactaaagtataaaccttgcatcagagacctgggcttgttaacacaaagatc

SEQ ID NO: 20790 - DNA, 201 bp, Bos taurus
gctctgaagcttggaagatccagcataactattttcaggcaggagaaagtcagcaggcaggaagcctcaaggttctgaggcagtccctctggaatccaaagatagaaggactgagaaggaggagaagggggtttcaagagaggatgggactcctaagtcacccttccaggtagattctgccagagaaggacaggttaaatg

SEQ ID NO: 20791 - DNA, 201 bp, Bos taurus
tcatgaaaccaaatcagttgactttaagctagaaacctagcgtatgtgccaaaaaaggtctccgcctgccctgctagtgccaatggccaagatttctcaccccagttttcttgtcatcagcactgatctaagaaatcagagctttgagacattttcatttagatgaacatgagtatttataattttcctgggcctcctcca

SEQ ID NO: 20792 - DNA, 201 bp, Bos taurus
tgtgtcgcagtgctcacattatctctgctttttcttcttaataaacccgctcccttctgaaatgctctatatctggaaatgcttttccaacccatgctcagactccctcagtattggcaattccaataaccagctctgcatgactttgagacaagccctctacaccctgtaagtcttttccatagtacatccaaagcagaa

SEQ ID NO: 20793 - DNA, 201 bp, Bos taurus
ctgtgtattccctctggtgtctcctcttagaaggacactaacccttttgcattggggccccatcacataacctcttcatgacctctttagaggccctatctccaaatacagtcacactgagggtcagggcttcaacttataaatgtggggacagttcagtccatagcacaactatggaatatttaattacctattttaagc

SEQ ID NO: 20794 - DNA, 201 bp, Bos taurus
gatcttaatcatttcattgcataggtaacgcatgaacaaaatatgaaagagtataatgaagcatgtaataaataccaccttccttcccagtacctctcccgaggcaatctcccacctccctacaagcgcctaccatatactcttgactattacagtcatctttttataacaaccatcctgcttgagccttttctttccctt

SEQ ID NO: 20795 - DNA, 201 bp, Bos taurus
tgtcatcactttacgtcaacacactaaatgcctaacctgtgctgttaccctttaacaggagccaaaggtgacaaggaagaatataggccacaccacaaacgacgtaagtgtctaaatatagcgtagttcagttccttagactatctttggaaaagacattgtttagataatgctaagactacagtttgctccagtagtgat

SEQ ID NO: 20796 - DNA, 201 bp, Bos taurus
ttccctgggggccggagcccaacacttcagtaatttaggggctttcccgaaggtttgtgagtgcggcagggtgcatgttacatctgcagcctttaccagcaccagggactgtccagctggccctgccgccctctggccttctcaaaagggacctggtgaccctcccacctgagcaaagcccccagaagtgtgggtctcccc

SEQ ID NO: 20797 - DNA, 201 bp, Bos taurus
aatgcttcctcttcatttcttcctcttcccccttttcctttcttattttttatttttctctgcctctgccccctttcttccttcttcccaactcatgagcaagtgataagaagcggagtataagtaattctggaacttccctggtggtccagtggctcagactccacgctcccaatgcaggggacccaggtttgacccctg

SEQ ID NO: 20798 - DNA, 201 bp, Bos taurus
aacactgttgtttaaatttaaatgcttaacaagtcctcagcagcatgatcttggtccaagcatgttggttaaggtgagttccagtcttaggcacatgcctgacacagcgggcctctccatcacaggaccttggcttggaacccgacattccacttcctcattccgagttctccactggaagcctaacctcagacaacatca

SEQ ID NO: 20799 - DNA, 201 bp, Bos taurus
ataacagagtggcagccccctctgctccgaggtcttatctactctgatggcccagatgggctagatgccagtccatcacattgaggccacctgtattccacgaccaccctctgagtgactgtttcccaagacaacctgggacttggcttgagcacccccccaccccccctgctgcacacagacctctgctccttggccatc

SEQ ID NO: 20800 - DNA, 201 bp, Bos taurus
ccggcgtcctcagggtatctggctccgctctgctctccggggtccctgcaggggtgcatccgggtcctcccagagacgaccagagcgggcatccgaggggtatgccgaccacagccctgcggacccaggagggagaatggggaacttggagccacacagaggtgagggccccggtcaggggtctccatcccaggtgagggg

SEQ ID NO: 20801 - DNA, 201 bp, Bos taurus
tggggatccactctgtctgccttggttagcccagggccagcctttgatcctggagacggctccctggaagccctgaggccacctgggtctggtttagggcaggctcattgcaactagaaactgatggggtcctgtgcatgacagcagcaaccaagtgccacagcagctctggaaagcccacgagtgtgtgccaggggaagg

SEQ ID NO: 20802 - DNA, 201 bp, Bos taurus
acacacacacacacacacatatacatatacacacacacatatataatgcttcgtgaattttcatgtcatcctttcacagtggccatgctagtcttcttagcgtggtttcaattttagtacacatgctgctgaagtgaacacttcaacttcttcaatgaacttaaactagggtgaacacgtatcaccttgtggcctctttgt

SEQ ID NO: 20803 - DNA, 201 bp, Bos taurus
attctcattggcactagctcactcttccagaaaagagcccaagcaaacgctacacaggacgcgattcttgagaaaacctccgggaccagtctggcccttgactttccccagcaccagctcacacccatccacaccagggattctatttcactgttagaccacctatagccaagtctgcgcctggggcaggctggcctgtca

SEQ ID NO: 20804 - DNA, 201 bp, Bos taurus
aatatgtttgaaattagctccatatacttttcccgagtaacaagaacatcacgtgctttgctgacttgaaaggaccctgaatctggagaagccggggctttagctgtcccatcagtgttttgacctaaggtgacacatgtgacatctctgtgtttcattttctcccctgtagagcattacactagattaccctggtgtcct

SEQ ID NO: 20805 - DNA, 201 bp, Bos taurus
tgtacggtccacgagcccttggagattccatgtgagctctctgttggggtcggtgttgccgcagtggagcaaggattctcttttctcctatgaatgaagatgcagaagcaaggttttcaaggcagagaagaccacaagaatggaactggtctcccaattgtttgaaatattggccaaaaacattgagattttcatagatta

SEQ ID NO: 20806 - DNA, 201 bp, Bos taurus
tgctccaaggtctcagtagccctgagctcttccgaggagtgggccatggggtcaagagtgtgcacttggagccacctggcctgaacttgaatcccagctctgctgctgtgtgacctcgggcaagtgactcagtcaccctgaactcaggttccttatttgtcagataaggatgcggacagggccagccccacagggatgctg

SEQ ID NO: 20807 - DNA, 201 bp, Bos taurus
cgccaggcctgctggtaaattccgtacttttttcacagctgcgctgaagtgtaattgacttacaacaaactggacacgttactgacttggagggattcttaaccccatgtggccatcaagtgtcgaattgatgtgcctcaaatgtatagtgtgtgacatgcaatgttgggtactggtagggtttcaggggggttcaggggg

SEQ ID NO: 20808 - DNA, 201 bp, Bos taurus
aaataggaaaaaaagtgcccccgggggaggaagagcagaagtcctattccacagagagaaagaaactgccctggcaatttccaaaccaagaagctggcgtcccggggtgatacagatagaaagccaggccagaggctgtctccgtccatggagcccgcatgcaggtcagcacgcgcgccacgtccccctccacgaacgtgg

SEQ ID NO: 20809 - DNA, 201 bp, Bos taurus
ttcattacactgccccaaagctttggcttattagccactgaggccaaagtcctctgagtctagaaacaccattccgactctcttccagaactggaacacaaattttgggtgtctctgtgtatatccaggcttctctggaggttcagtgacaaaaaacctgcctgccaatgcagaagatgtgggttcgatccctgggtcagg

SEQ ID NO: 20810 - DNA, 201 bp, Bos taurus
agcacgtttgccgtcgccacaggctcaagtctgaggacttgatgaaggcaacggggaggctctgacatggatttcttggaggtggagacctcggtgcacccgcggggtcctgttggccagcacactctctgctccttatgcaaagccagggcaaaaggtgaacggctaacatgtcctaaagggcagtcctgctgtaatgcc

SEQ ID NO: 20811 - DNA, 201 bp, Bos taurus
ctcctgcacgtcgatgctggcaacccactggaggaaggagaaaacaggtttggtcaagaagcagtcaggcatgacagattcatgctggagttggagacaggttagaggcttaagcgaaaacccactagcgaaaggacctagcaattgacctctagcatccttgcaaggctttccggctttggccagcataccccttcctga

SEQ ID NO: 20812 - DNA, 201 bp, Bos taurus
gggcttggtgtaactcagtttctgctgtggaaacatcacttttgcaactcagagttaaaacccacgtcctcaagacccaacccaaaggaaaggccacgactaggaagcggaatgagcgagcacagatgcccatttgcctcactccaacccgtacccggataggggtggctcagcctttccacctggggcgtggccgtaaag

SEQ ID NO: 20813 - DNA, 201 bp, Bos taurus
gaatcccggaagcaaaatgtatgaacttcctgcacactgtggcagaactgttatttttaggcattttacagctcaactaacagtattattaccttttcaatatttgtatatttgcaatactcttaggaaaactactgagcccttaaatccttgttaattggagcctaacaacttattgaccagagatgtattcatacgtct

SEQ ID NO: 20814 - DNA, 201 bp, Bos taurus
accagtgccctcgtaagggccctgtgccctgagtgctgggaggtcaagggcccacgtcctgtcgggcttgcctggctgggaaccacctccccattgtgtactgacaagaacagtgccgagctgggccggcccaagacctggaggtaaacggagaaaatttgggtttgcccagacttcccaggggtgggacctgctcttctg

SEQ ID NO: 20815 - DNA, 201 bp, Bos taurus
gccctaatgagggctctggctcttcctcggagaagcctcgagtgttggagagctgggagcagaggagggatgccacttgactcacctgccagcagcgtgctgttggccgttacgtggagtgcaccggccgggagaggctggggaggtcgccaggtcacctgccagcagcgtgccgttggccgttacgtggagtgcaccggc

SEQ ID NO: 20816 - DNA, 201 bp, Bos taurus
ttgtggcatgattccacgctcctggtgggaaatcccctctccatcttggaaagttgttttcctaccttcggatggcctgttcatctgtcagctgtcctcctggtcttgcccctgcagatcacacctgaaatgggatttctcaggctgccaggcctccctcctcgggcctccacacaggtccccctcacccctccagagatc

SEQ ID NO: 20817 - DNA, 201 bp, Bos taurus
gattcttgttcctaattgcacttggccggctcacctcccattcggctgggtgtcacctcctatttgcgctgcgtaaatggattctaatagctttcttctcttccatcactcaaagaatggccttggtagccaaaaaggaaattagtttcaggtgaaagcctatttttgccctggggaagaccaaactgttaattacctaga

SEQ ID NO: 20818 - DNA, 201 bp, Bos taurus
gagctgctgcccccgccaccccaaactcttgtttaaacaattaggggaaacccttttcaggcaattaggaaaaggcatttgcagccaatcaggcccctccaactgtattgttctgcccagcggaaggtttccagaatgctggggggtggggtggggggaacccgtgccttaatatgcaagtcagcaaggccaggatgtgag

SEQ ID NO: 20819 - DNA, 201 bp, Bos taurus
gaagtcagtttgtattattggactgtttggtgccatttactattttaacttaacgaggatgtagttgcatattacaaggacacaaaagtggcctggaccatgggacctgttcttagctcctccactaattacgtggcaagcctggcaagagctgggggttaagggcagaggtgctggactgtgggcagtgccagtcacgtc

SEQ ID NO: 20820 - DNA, 201 bp, Bos taurus
catggccactttggtgcacggccgtgaactccctcgaacggtgggtgttttactcgtgtgtgcgaatgtgcgagaagtccagagaggtcaagtggcccacacagatgacccagcgagtcggaggcatgtggggtgatagaatttagggctctgacttctgtagggacgcaggcattcagcgccgcttgtgtaccggaaacc

SEQ ID NO: 20821 - DNA, 201 bp, Bos taurus
gcacagagcagaagtgctaaagcctaccttgtacattaaaaaaaacccaacacagtcaatgcctattaaactcctccctctgacaggaccacgtgacgcccggggggtggtggacgctccccagcagctctcatcccagtcagcgataacggagcccccagagccctgtccaccctcccaggcaacggtgagccctttcca

SEQ ID NO: 20822 - DNA, 201 bp, Bos taurus
gtcctgaggggccacctgagaacagctctcgggcacgccggtcccctgggtgtgggccaccagaacgtcctaacaaacgaagaggccaggccacatgctcgtcccggccctggcgttggcgttggaatcccacctccttcgtgatcttgagagagttcctctctgtcccttcacctcgtcgtttttacctcgaagtaacta

SEQ ID NO: 20823 - DNA, 201 bp, Bos taurus
tggctgcggggagacagttcactccaggacaggcatgttttcaagaaaaagaaaaacacaggcagggagccatcctgggaactaattagatccggaaggcggcccctggggctgcaaagcagccccttgtgggtggtgggtggggcttgggggtgtgggcgagaggccgcagaggggcccctgggaccgtgcacccactct

SEQ ID NO: 20824 - DNA, 201 bp, Bos taurus
acttttcttgtattgagctcaacaacatccttagtttaaccgttgaattttctgaaagaaacagcctgtttggaactccattttaggaggtcttctcagagtacatttttacttaaccaggttagttataagtatattaataactagtcacaaaactctctgctcaaactattgttcacaaagaaggatgccgagtatcct

SEQ ID NO: 20825 - DNA, 201 bp, Bos taurus
acgcagtgggtggcctgctgacaaaagccctgttctgaagacaagcagagccagaggggaggaagggaggggctgggccctgggttgtgcggggggctggtgctgggaatggcacctcattactaagcaccatgttcagggaaagcttctctgggagagtgacaggagaccaaacacccaaggaggtgacagaggcccccg

SEQ ID NO: 20826 - DNA, 201 bp, Bos taurus
gcagattctttaccatgtgagccaccaggggtatttattgtgttggccaaaaaatttgttctgtaacatcttaggggaaaaccccaaacgaactttttggcccactcaattctattaactaaacacttgacaagcctcacttactattagttgttgtggaagtcaggccacaggagatagcacctccctcgtgcttttgcc

SEQ ID NO: 20827 - DNA, 201 bp, Bos taurus
tgtggccagtgcccttgtccccatgatgagccactgctgacccccacctccataggagaccctccaacagtagtggtcggcctggttcagtctcctgtggagtcattgctcctttcccctggatcttggagtacgcatgattttgtctgtgccctccatcagtggggtctctgtttcccagtcctgtgggagtcctgtaat

SEQ ID NO: 20828 - DNA, 201 bp, Bos taurus
gcgtgggcagcgtgtctatccagggctgcccgcctctgccctctcagggggagacaggctttaccaccgggagcttgtcttgacaaagtctggtgagtcctacttttgaagaaaggcctggcctagaggagtgtcacgacacacttccctgaacaccctgatgtagactgctgcaccaatctgaagctgacagcccaactt

SEQ ID NO: 20829 - DNA, 201 bp, Bos taurus
ctggccgcaggttcttcttccgtagtggcaacatcgagcacccagaggacaagctgttcaacacgtctgtggaggtgttgccctttgatgtgagtgtggtagggggtgggtgtgcactgaggcctgcccctcccacagccaccggcttcagccccttgattttgcccccagaacccccagtcagacaaggaggccctgcag

SEQ ID NO: 20830 - DNA, 201 bp, Bos taurus
ggtcagaacgctggtgggaggtggactcgggcactgaaaaagaggccttgcatacagatgggctgacctgtctgattgtgttaagagtacttgttacacttctgtaacctgaatactcaaggccattaaccggtggagggaagttaggggggtgtgtgttgtgtgtaggggacagctcagcttgtcctttattcagctggg

SEQ ID NO: 20831 - DNA, 201 bp, Bos taurus
gctcctgctagtaggagacgagctgtgtccaccaagcggacggccgggtgcgggcagcaagcctcttcctcggcctcagccctccttcttcctggccttttattctctctcttcctagtgagaaggcagagaaagaccacactgtggggagactggctccacgcgccagcaaggccaaaacaccaaaggggcgggtaaggg

SEQ ID NO: 20832 - DNA, 201 bp, Bos taurus
tgaagctgaggctatgtgccgactactggctgttgccagggaagcaggactgggccctctgagcctttattttgccatccatggaaagggaacagtaacactgacttgggagttggtgctatacttcagaaagctaaaggttatgaagtctccagcactgggctggggccagaggacccaaccagcctttcagcagggaag

SEQ ID NO: 20833 - DNA, 201 bp, Bos taurus
aaaggataaggctcaattctaattttttctcctttcttcactggcaacatattaaactgttattcttggtgtacagctttcaggacaatgtgaaaacctcccatttaattctttgtcctttcctccattttatgggaggggtttcaaatttatctcccaagttaaaaaaataaaggactattcttccactttatcatgtag

SEQ ID NO: 20834 - DNA, 201 bp, Bos taurus
gccacctgctttctctctcagaaacacttctgtgtggtcttcatgactcagtggcatcaacccttcatcacgtttcctttatctttcacactccttttttcggccgcaccatacagcttgtgggatctcaattccctgaccaggggctgaacccaggccacagaaatgaaagcaccaaatcctaaccagggaacttccact

SEQ ID NO: 20835 - DNA, 201 bp, Bos taurus
cgcagcgcgtttctgtgcgaatctgagcaaggctgggcttgtgggaaatcgaataccagagacatgatttgggtgcgtataggggctcagtaggctgtgttttggtttgcagcagggaatgtctgacattttctcttgaatctcgcccccaaggtcatggagttttaatcccactcatcttttaagaatttgttattaccg

SEQ ID NO: 20836 - DNA, 201 bp, Bos taurus
cttgggaacatgcagagattctgacactgcctattctgaatgagtggtggctttgaggagattaaccaatgtgttccagtcagatgaagagtctgtccctagtcagacccacatcatgcacaacagggcttgcttaggatggtccctctggtccttctgcctctctcctggccaatcacacctgacttgagggtggcagga

SEQ ID NO: 20837 - DNA, 201 bp, Bos taurus
tcaaaattgtagctttgtgacatcaggtcccagtgaatgctcccaccatgctttccttcaagaaaacagtgtattgatggcacctggcctttggaatctgcctgttattcttccatcagaccacccaaacagaaatttggtttcaattctgattgctaatctttgatttttttctctctgattcctttctctctattccaa

SEQ ID NO: 20838 - DNA, 201 bp, Bos taurus
tccaaggacaaaggagaagccacaataagacagtagagagggtgcaatcatgtttaaaatcaaacctcatacccgccaaagactcttggagggcccagacaaaaccttgtgtgcaccaggacccagggaaagaagcagtgatcgcacaggagactaagccagacctgcctgttagtgtctgagggtcccctgtggaagcac

SEQ ID NO: 20839 - DNA, 201 bp, Bos taurus
attgcatgatcagtacctaatgtggcctataacaattaaaaatggcctgtcctggaacagacgcacaggcaacctgacatgaaaccacacaccaagacaggcacccagggaacagcagaaatttagggtagatgcagggaggaagctgctggcccatgccaccatggcccctgcccgttcatggtgagaagcagcagagct

SEQ ID NO: 20840 - DNA, 201 bp, Bos taurus
ctgggccctccagctgtcaaaaggcaggaagatgaatatttacgctgactctaggtactgtacatgtacttggggctttatataaagggagaggtcttctgatggccagtggaaaggacagtaaaaacaaggaagaaatcttgactctgttagatgctgtatgggaacttgaagaggtagtggtgatgcattgtcagggtc

SEQ ID NO: 20841 - DNA, 201 bp, Bos taurus
tcccagataacccagcatggtctccccatgttcagggccataatcttaatcacacctgtgacgtcccttttgtgacgtaaggaaagctgtcccgagggcttgtggacatctctcggggccttactgccatcagcgtcacagttgttaacgtgcctccctgctgggtaaagcagaccacaggaaggtttagacaggcctggc

SEQ ID NO: 20842 - DNA, 201 bp, Bos taurus
gcagctgtgacccttgactgggtttccggcagccattcgccatggtgactgtgtgtaaacagtcgtcggctctcggaaacccatcctctgttgactcatcggcaaggccagagttcatcacccttgaagtagttttgacatcatacccggattgtgacatcttgaaaaacaagactgcttctcctggtcccagatcagact

SEQ ID NO: 20843 - DNA, 201 bp, Bos taurus
caacacccaatgtctgtagctcctgtggggacacagcatggaccctgagtgtctggtcagttttgcaccaggagtccttggtctccatggtcatgaaggtcgagatgagcatctggtcacctggcccttcgctgggcacagagcatccagtgtggccggccttctggcggtgaggctgaggccgtggccacggggctgctg

SEQ ID NO: 20844 - DNA, 201 bp, Bos taurus
gccctgggaggggccgtgtctcataactttttttttttttttttaatctctttagtctttctttatcagcttcagcgtgttcctgggtgaggcaagacccggtggctggggcctcaccggcagcgcagaagttcatctggggctgctgccctcttcaaggaccggatggggcaatgggggttcaggctggttgccctcctt

SEQ ID NO: 20845 - DNA, 201 bp, Bos taurus
gagcaaccagtatatatcatctcacggtttctctgggtcagggatatgcctcttcctcaaagtctcacacaggccacaatcaagatgttggccagacctgcggtttcatgtgaaagctcaactgtgggaggagctacttcccaattcactcatgtggttgttggctggttgatggctccttgctggccattaactgggggt

SEQ ID NO: 20846 - DNA, 201 bp, Bos taurus
ggccccaagggctgccacacaccagctgggcctcacaccagcgacacagccctgggcatgacacgccccccaccacggcggtttcctcatctgtaacacaaggggtgaggactgggcccacttccctgagttgcagaggggactattttacaagatcattttggaaaaacacattagacatgatgccagtattctagggca

SEQ ID NO: 20847 - DNA, 201 bp, Bos taurus
ttcttaaccctttcttaactctttctcaaccctgggcctcgcagaagaaccatcctcaaagtcccaaccactcacatttactgagtaactactgtgtacctctgtgtactgggcccagcagaggttgggcagcatacgaattctggaaaattcatgccttttgaaaattaatccctatgcctttccagcctgcctaaggga

SEQ ID NO: 20848 - DNA, 201 bp, Bos taurus
gggccaagatggggggcggattccaccttgtatcccgggttgccagcccatccctggccctggaggcagggctactaaggcacccagttaggcctgacccctccctctttcggcagacccagctagcctggaggaattcaagagaaggatcctggattcccagcgggcccctgccagcaacgtcttggtctcagccaggtg

SEQ ID NO: 20849 - DNA, 201 bp, Bos taurus
agggctgacccacaaagacttgagggtgtaggtggtccaggcttgctttccgagttcacctcccttctcaaaacacagggcctgcttgggcagcattcccagagcagaagacagtccctggagaggaggagaaccaactgaggttgatgctaaagttgagataaggctcagtggccattgcatctgaatagtgtagccata

SEQ ID NO: 20850 - DNA, 201 bp, Bos taurus
ccatgagtgaagaatctgttccaggcctccctcctaggctggtaactgcacatctctcttcatctttattttgtcttcccttcactcccatctgtttccaaattttcctttcttatgacacaagtcctattggactgggaccgatgctttgtcattgtttagtcactcagttgtgtcctaccctttgtaaccccatggact

SEQ ID NO: 20851 - DNA, 201 bp, Bos taurus
ttccacagtggttgcaacaatattcccaccaacagcgtgtatgtgcatccacccaatttctgcctgtgtcttgacatggccttctcatctgtgtgtctccacattttcccttttttgggggggtttcaaatctcattctgccttcttataaggacatttgtgattgcattttgggcctgcttggaggatccaagataaact

SEQ ID NO: 20852 - DNA, 201 bp, Bos taurus
gccttaaacagggaagaaattctgaactatgtgacagcatggaaaaacctcgaggacatgatgctgagtgagataggccagcctcaaaaggacatatgtgatgtggctccactcacacgaggtccctaaagtagtcagattcatagagatagaaggtagagagaagggtgccagggcctggggttggagctggggcgtttg

SEQ ID NO: 20853 - DNA, 201 bp, Bos taurus
tttatgtaatgtatatttactcagctactgttcctaactaaactaagtctggggtgttgaggagtatgcatgataataataaatgcctcaaggcactcacagtctagagaggatagtaggtatataattaaacaaaaattacaaattattgcaagagaaacacttctttatatgtgggaatatttttaaatgattcattaa

SEQ ID NO: 20854 - DNA, 201 bp, Bos taurus
ttaaagatgttcagtgtgtggagtgacatgagcaggagggagaatgaggagatatggcgtcagaggatactgaaaaacaagttggcctccctgttgctgccgaaacttcaagtcacagggttctctaatccacacaaattgttgcaaagatgtcctgtatgtgtaaatgaatctcttctgttgattgagctctggcctctg

SEQ ID NO: 20855 - DNA, 201 bp, Bos taurus
atgagtacactgcacttattatccaggacgccagaaccagacatccacagagccatgggttcatgatgactgtgtagtgcaaagggtggcagatggccacgtaacgatcataggccatcacagccaggaggaagtcatctaatgctccaaagagaatgtaaaaatacatctgagtgatgcagccttcataggttatgactt

SEQ ID NO: 20856 - DNA, 201 bp, Bos taurus
taggctggcgacgtagagtcaggaggcatgacatgctgacaggtgttaagccaggagactggaggagctctccaaggggacaagagaaccaagaggcccctgaagactgagcctggggccaccccagcatctaaggtggccgagaaggagtggaaaggagaggccagggaggtgggtggagagcagggcaacactgactcc

SEQ ID NO: 20857 - DNA, 201 bp, Bos taurus
tctggtgggcccactaagtaagaggccgagcagcttccccagggtctagctagggaagacagggcagaggggctagcaatccccgatgttgccgggacacgccgggccgcgaggccagcagtgagcagggctgtggaagcagggtgcaaaggggtggttactgcttatgggtagcgtgggtgagaggatgccagagccaga

SEQ ID NO: 20858 - DNA, 201 bp, Bos taurus
taggctctgctcctctctgtgaagctgggcccctccttagaccaggggttctcaactcaggaagattctgcccccacgaggacacagccatgtccagagatctttctggccatcacacctagtaaggaggtttgctactggcatctagtgggcagaggccagggctgccgctccaacaccccacagggcacaagatggccc

SEQ ID NO: 20859 - DNA, 201 bp, Bos taurus
gccaccccgccccctccaggcacctgctaaggcggcagcacagcagtggcgggttgtgtttctttaacccctggggcctgttgacacagattagtatcgctggtcaggggtcaatagggaaggctcttgaggtcaagacctgaacaactggagttgtaatgagccacgtggggaagaggcccaggcagaggagagggccga

SEQ ID NO: 20860 - DNA, 201 bp, Bos taurus
caagccaacaatgcttcccagagttggagtggaagcccccaccccaacgttgacattgggggggcatggcggggtggcggcttcccaagggtctcagcccgtaactttctcgaaggccctggagggcgcggtcactgggccggagcgacctctgacagtcaaagtgagctatttcgaagtctacttcttggtgttccccag

SEQ ID NO: 20861 - DNA, 201 bp, Bos taurus
ctatttcctcctccaggggatcttccagacgcagagactgaacccaggtctcccacattgtaggaggattctctaccaactgagctaccaggaagtccgactgttaaactatagtgcttatgtgtagctaacaggtatataatctcactctgcccacctgtgaatggctgcaacaaaaagaaaaaattaacacaccccttc

SEQ ID NO: 20862 - DNA, 201 bp, Bos taurus
aagtgaggtatacacaaatatttactgaacagtttattagtatagaaaatgttaaaaggctcttgtactcttcactccaacaaaagagcttggtaagaaaaataaatagatatactggactagagatattcgagaactgccacagctgttatgaaaatccaaataccaaactgtcatttctcagtggccccttaacacaga

SEQ ID NO: 20863 - DNA, 201 bp, Bos taurus
acagagaaacagaggccaagccagagagtccagtgggagattacagggttcggttccccctgcctcacagcggggaaaattgggtaccagaaaaacaccagggccaacaagatctgtgacagaggaggaccagaccccagacctcgagattcttcaaactcttcctgatttagcaaattatttatttatttatttttggct

SEQ ID NO: 20864 - DNA, 201 bp, Bos taurus
tgccacaacgaagatcaaagatcccacatgccccaacaaagacccagcacagccaaataaatgaacaaatattttttaaaagactgtactctagaatacaatttgggaaaatacagtctgtggacaaaattctgcttgctgtttgaaagtgaaagtgaatgttgctcagtggtgtccgactctttgtgaccctgtggacta

SEQ ID NO: 20865 - DNA, 201 bp, Bos taurus
tgagctccaggagttggtgatggacagggaggcctggcgtactgcaattcatggggtcgcaaagagtcagacatgactgagcaactgaactgaactgaaggatagcttctcttattttggccaattttaatgaaacttcacatggggttacaagagttaaacatgatttagcaactaaatcaccaccaaacagatgaatct

SEQ ID NO: 20866 - DNA, 201 bp, Bos taurus
acatgtgtttctccctcactgctccaaggaataaacccaatttgttaaactggtggtctttgggtacagggaattaatagcagtaaaattctcaaaaggtcccaaaccaccaattttctccctgtcccccaaagtgacccctgaagcctgtgcccacaccacatacacttgataatcctccttgaggattctgaccacaag

SEQ ID NO: 20867 - DNA, 201 bp, Bos taurus
tccagtgattaagactttaccttccagttcaggagggcaggtttgatccctggtcgggtcgggcagctaagatctcacatacctcctggccaaaacccaacaacagagaagcaacacttgtaacaaattcaataaagactttaaaaatggtccacatcaaaaaatgtcttaaaaaaacactgacaatattcacttgaggcc

SEQ ID NO: 20868 - DNA, 201 bp, Bos taurus
gcccattggctgaggttggattcctgaaatcgatgcggcggtgcgtgaaaaaggtcgtcatgggggaaattgatcttccgtggctggctcaggaatttcacgctaggagccagggacgccctggcacaaaatggaggcattcgctatgaggctcctgggcgagggatgaagggagggaggccttgaaggctggacagtgca

SEQ ID NO: 20869 - DNA, 201 bp, Bos taurus
cccctcctctaccgtccctccagattgggcctcggatgacgctggagctcatcaagatccaagagggggtcggagagggcaacgtgctgttccacaggctcggtgaggacggggccaggggcacagtggggcctgcagcctggtcatgggcgggctaacctggaccttggggatgaagagctcagtggccacctcttcctg

SEQ ID NO: 20870 - DNA, 201 bp, Bos taurus
cttggggacaggggcccagccccagctcctcgctctgggtgggtccctctcctcaccctggctcccccacccaggtgctggccagtctccggagcgttcgcagcaacttctccctcctgaccaatgtgcccattcccagcaacaagtaagtggaggctgggccccagggcctgtgatcatgaggctcaacacacctgggtc

SEQ ID NO: 20871 - DNA, 201 bp, Bos taurus
ggaaatgaagctttcaacaaaatatgaatgaactcatactacccttttatcgatttggaacactcccccctcccccatgccggaaagcagtgtgcacacttgaggtcttctctccgtaagccggccaaggtcgacaggttccaagagccttggaagagatgacctcactctctcactctcgagggctggggttttaaacgc

SEQ ID NO: 20872 - DNA, 201 bp, Bos taurus
gtattcaggaccagagcagctggcttctgataggctgatttggatgacagatctgggttcacacagagacaagcgaggcccgttcagcaaaaacgcattggctccagtttttcatttttatttatttaaatatttttgccacgccttgtggtttatgagatcttagttccccgaccaggccttgaaccctggccctcggtg

SEQ ID NO: 20873 - DNA, 201 bp, Bos taurus
caagattattcattgcagccttgtttgtagaagcaaaagattttactcacaacccaagttaaaaacaacccgataagcaagaggtggactattcatactctaggatactgggcaactttttaaaaaatgtaagaatggaaattcccagtcagtccaatgtttagaactccatgctttcactctgagggcccaggttcaatc

SEQ ID NO: 20874 - DNA, 201 bp, Bos taurus
taacttttgacagatgccaccgggaaattgccccagccctggcactgctttgatgggggtgaaacagaagcacgcctctgtactagtccttggggggagcgggactgagggcaggtcaaatgcacaaccacgtgttttgagaacaagatccatattgctccccactccccacctgggggcagcatcagacccacaggttaa

SEQ ID NO: 20875 - DNA, 201 bp, Bos taurus
gggccaggtctggggtcagcgtcatctgcctggcacccagtctccagcctggcatgggagtcgcccgggtgagatgttgtgagaaagagtgctgattgctatcatccaaccccaggccagtcagcgtgggcatgggcctggctgttagccaagtggggctccagaccacaagaaggttaacttgggtggccttcttgagcc

SEQ ID NO: 20876 - DNA, 201 bp, Bos taurus
agcctagggatgtaggcacccctctggggactggattcatttcctacatgtccaggtctaaaggattttctaggaaaatgaatatttgccagggcccccccgcgtggaggagattctggggaatcgcaagaaaggcacaactcgcacccctcggctgctggctccagagccccacacctgaatggggcggaggcgggcggg

SEQ ID NO: 20877 - DNA, 201 bp, Bos taurus
aaagttcattcagtttaaaaagtaaagctaaaagacacagttttatatttttaccaagaactttattgaacatcataatcacagtttgtttcactaccttcggccattttcaggcaacttcataattccatcttcccaaaacttatcttttttggcaaagaactgttccaggtgccttttatagtcttccagggaattgaa

SEQ ID NO: 20878 - DNA, 201 bp, Bos taurus
cgtagtcgcaataggagttacgagaagagagctctgtgtcgaggtggagggtcccccaccatcgcctacagagtggtcctaggccgggggtcccgggatcggagagaactgggttctagggagcctctagaacagcgtccggatcttaccttaatttaggggccggcttgagtggagtgttgcatgtaaagggatcgaatg

SEQ ID NO: 20879 - DNA, 201 bp, Bos taurus
cagcagcagcagcagccttataatggtccgcctctggcctcactgctccctcatccctccaaagctccagtcatcctaaactaacccaagtcacctgtaacgggcactgttggtggccttgtccagccacctttagctgctggagcacccatcccccagtttcggtttctgtgggtgttgcctgctaacagctcacagctt

SEQ ID NO: 20880 - DNA, 201 bp, Bos taurus
tgtcatctgccaggaaggccgcctgggtaggttatctcctcctgggaccagccttcaaggacagaatgtgagcctggctgtagggccaccagggtccccgttgctctgctcagctgcctctgagccaccttttcaagttcacctccattccctccccggccacgggtcccctgggaggccctggagatgcccagaggcctc

SEQ ID NO: 20881 - DNA, 201 bp, Bos taurus
caaggtgggccgtttcggtcaatggatccctaaacttactagctccagccttgctgttcctccaacattccaggcatggaccagcctcatggcctttgcatggattgttccctctgcccagaatggtcttcatggaagtctcttttgtttcttgttgtattctcagacccccaaacagggcccagcacacaataagagttc

SEQ ID NO: 20882 - DNA, 201 bp, Bos taurus
aggccactagggccccgctccccaccccggtcagcctagacctgcctgcacctgcccccccaaagcttgtccaccagccttctgactgcccttccttccatggggcctggtctgggggtctagacgtgcagaggagcccgtttctccagaacgatgctgccccttggtctccagctcagcttgggctcaggccaccagtga

SEQ ID NO: 20883 - DNA, 201 bp, Bos taurus
cattctgtgttttatgtggtaaccttagcctggacgagcctggggaggcaggcaggaaggcttccaggaggaagaggcagtggtgctaagagcccatggtgcggccacctttccttcccctcccccacccagcgtgccctcttggctgtgctcacaagagactggaggtggagacgatccccatgccagggttgaagatgt

SEQ ID NO: 20884 - DNA, 201 bp, Bos taurus
gctgaggtctttgacatcctccccctgaggctgttatctttgactctgggactggaggggaactggggctggaggttaggggattgggccctcaagttttgggggtctcttttgggatttaaggaggaagaggggactaatggctggggtttcagaagggcccccagtttgcaaaattgcaatgctttatatgtttctggg

SEQ ID NO: 20885 - DNA, 201 bp, Bos taurus
gagtcacctgctgtcactgcccatctagtgtgccagataagggtgcgtgcctcagcacccacttagagctgtcctccccttgagcctaccctcgatgatccgcgaacctgggtgtgtggcctctccggctgcagcctgaccagtctgggggctgtttgcctttggccttcaggcctgtttgcctgtcagcctgcctttctc

SEQ ID NO: 20886 - DNA, 201 bp, Bos taurus
ctcacctggggccaggggagcaggcactcagcagccattctgtcctccctcctgggcaaaagcaggttcctgggcaggcagggctgggagaggaaaaatgtagagtgaagactggatctggcctgtcccagaccccagagtcctctccaccacttgaggtcacacatacaacacagaggagagtcatggaagccagtgatg

SEQ ID NO: 20887 - DNA, 201 bp, Bos taurus
ccctggtcccctggcctggggacagctttggagttggttaatccaggctggaggggccaggaggtcttgatctgggcagtgtgatcctgttatgatactgtcaggggccttgggagaaacgtagaaaatccacttggcaggactgaccagcttgtgtctgggtcttggttcacaacagcctgacccacctgctggtcatgt

SEQ ID NO: 20888 - DNA, 201 bp, Bos taurus
ctaaagcaccagtgcccaccccgcccccggggtcctctcacagggacttcctttctttccgggtgacctctcagcctggggcggccagcttcagatccctcagcttcctgcccccatatacctgtcacctcttccaccccgaggttaattgctttgcccccagattgcattttccacctctccctttttttcaccctggca

SEQ ID NO: 20889 - DNA, 201 bp, Bos taurus
tgtgtgtgtgcgcgcgcgcgagtgcaagtgtgagagatctgtcgaagcgttcacttcccttatgtatgagatggatcaataatagttctcacctcctatattatgaggaataaattaagaaatgtgaggtgtttacacacgggaggcggcccagtgactccactcctgggtctatccaagagaaatgattacttggctcca

SEQ ID NO: 20890 - DNA, 201 bp, Bos taurus
ttggtttgcctgtgtgtaatttaggcagttccctgcacggaggccttcatctgtgactgatgttgtggctttttatgtgtcctggcagtgtttccctcaagagcatgtggggaagtggggcaggccaaatgatgaccttagaaaaacatacatctgcctccagaagatgatgcttttggtgtgtgctgctgctaagtcact

SEQ ID NO: 20891 - DNA, 201 bp, Bos taurus
gtgtttggtggttgttaatatacaagtggtatttaaaactgtaagactggttttttagaaaaggaagaagaccaaagactaagttctgggcgcaataatggttagcagtagaggagatgagaaaggaccagtgaaggaaatggtgaaggaacagtcaacaaagcaagaggaaaaccaagcaaatgtgatatccagaaaacg

SEQ ID NO: 20892 - DNA, 201 bp, Bos taurus
acccccaatcctaggctgccagattcagtcacctgctggcggcttccggacagcccgcagcctcaccttgaatagggggaaacaggctcagcgccctgaagagatgatcgaggtcacagttcgtcagagacacgcttggactgaggggaggtggggagcagggactaccgggtggtcccaggatcctgttggggcctctgg

SEQ ID NO: 20893 - DNA, 201 bp, Bos taurus
tctgaccccagtctccccttctcctcctagagctcacagttctggccacagtgggagattggagtgtgagaaagactctcacaggcctgcctcactgcccacctaggcagattccagaccaatgacatggtcctgtgacagctcacctcagctcctaccaaggatctagagcggtcagcaagctgtgcccatccagggccc

SEQ ID NO: 20894 - DNA, 201 bp, Bos taurus
tttgctattatcaaatgtgtcctggatttaagtgtatccaggatttaattcatttttatattttaaaagaacacacgattgtattcaaattttccatcacgatggcccttaaacagtatttccatgtcttttacccatacacagtgagtacgctcttaaaatggtatattctgcagtctaaattatgcagattttgctttc

SEQ ID NO: 20895 - DNA, 201 bp, Bos taurus
ttttgtttcccacttctcagtatcattttccacaaatttggttacatgcatctacttctctttttgagtcttttcatggtattcccctttatagaattatccataatcctcttccatttttcgttcggaatgctattcatgtttcagtgacgtatccttgtgctccttctactgtgtaactcccagtcatacagaacccac

SEQ ID NO: 20896 - DNA, 201 bp, Bos taurus
gtcagtgttctgcatatgttctcagtccatagctgaaaggggccagaaccatttcatagtctcctctagattccccactccaaatcttcctgcctgttactcagtacgctggtgggtaagactcctctctggtcccttggtccatgtttctgggtcccactgttcatggataggggctgagtttttgttgttgggataggg

SEQ ID NO: 20897 - DNA, 201 bp, Bos taurus
agtactgaattctgtgtctcatcattaaacaccgatgctattctgatggttattacttagatcatagccaactgccctttcctgctggagtgaatctgtcggctagtggtacaggggaggctgggttctagtccagtcactgatttccggtctcttctggctctaagttacaaaccgcctccccgtcgcttctgacaccca

SEQ ID NO: 20898 - DNA, 201 bp, Bos taurus
gaaactttcatcatgatggtatgaggaggaaaatggtttcagaaacagaaaatatcactcaacaacatggaccagacaagcaacaaggatatactgtgtagcacagggaatacagctttattctgtagtaactttaaactgagtttaagttataaaaacactacttttttttggaatcactattttgtacgcctgaaacta

SEQ ID NO: 20899 - DNA, 201 bp, Bos taurus
ctcaatgcctttgattttgtttaattaccaatgaaaaagtagatactcattctttgttatctccctgctgtcttacaatgacatttactttgatatcatgtaattctgaaagtatcatcagtacagtagtcatcattactgtaacacactatctgacaatattctacttattttgtttccctgaactgtcaccagagacgt

SEQ ID NO: 20900 - DNA, 201 bp, Bos taurus
tctttcagtagaataattgtttattttatgtgattcagatacggatttgtaggacatgatttattggaaaaagttacacaagctatttaaaggggcacacgattggtctactttggctgaaatgattctctgttcaagtaatgttacatcaacactgcttaaaagtctgtatgctaaatccaaaccagaagacacctttat

SEQ ID NO: 20901 - DNA, 201 bp, Bos taurus
tctcaatgacctcccccattacttgggccctttgggctcttcagagctggcagaactctgatggggacagcacatgagtgtgatgtgggctgtaagctagaaagcttgggcctgggccctccagtgatatcgtgatgtctgagaacatgcctccctgcaacctgagctgttcagggcaccacataacacaaggggcagaca

SEQ ID NO: 20902 - DNA, 201 bp, Bos taurus
ctaatcacaccagcacctccaaaaatctttaaagcctaaatctctctttctcaactaatgaaatataacttcgctttagaaaaaaaaaaaagactattaaatttattccactgagataaatctgaaggaaaactgacttaccttcctcagtcaaatgtaactgctaatatgccctcctgaaaaacaacactgaaaactgcc

SEQ ID NO: 20903 - DNA, 201 bp, Bos taurus
tcaagtataggcaacatggtaccaatttatgaactgatttcctcaaggaatggtgccaaaatgagggttaaatgttggtctctggtgttggccatttggacgtttgacattggttttagattatctagcaggagcaaatgctgttgggcacatacattacctcaacctcagtcatcagggccaccttattcatgtgccatt

SEQ ID NO: 20904 - DNA, 201 bp, Bos taurus
ttaaatctcctgaatcatgtgtgtatggccattgtgtgagagagaaagaatgacaggaaaatgagagatagagaaagagagttagttagttagttttagaagtgggaaaacagagaagcaatgggccagagactatatatatgaaccatagctgaagttccaagctaataagccagacagattggacagagcccgtccaca

SEQ ID NO: 20905 - DNA, 201 bp, Bos taurus
acatgcttatgtttagttatgtttggtgatttaagcattttttctgcatatttgattagatttcatgtgatgaaaaaacaatttagtatgtttatcatgatgttttcttttaagtatgtatatggatttttatcattgaaaccttctacttctctccctggaaaacattttaaagattattaaatctagttttcagccttt

SEQ ID NO: 20906 - DNA, 201 bp, Bos taurus
taatatgactttctatttactttctgttcacactcaatgatatattatttgtttggaatgataaacagccaatactttaaaagtactatgtgtcagtaatgtaagatactgaaagagaaatatactgaacaaataacatagcacctcaatatatttattctcatgacatctagggacctttatcaaggtttctagatgaat

SEQ ID NO: 20907 - DNA, 201 bp, Bos taurus
gaattatcagaattatatatgccagtactgatgtgcattaaaaactacacttcctgacactgttatagaatctttgtttttgtattgcaagttgtttcatatttttcatattgggataggactaaaattttataaacattttccttcaaaatataagaatataacttatagccattttaatatatgtttaaacactgaaaa

SEQ ID NO: 20908 - DNA, 201 bp, Bos taurus
tccaatagcaacagcatcaattctttagaatacataccaaaaatgatttttaaaggagaaatattctatcactgacattgtttagagttacaagtgtctgatgtaataacaagtaaatgatcttttagtcatttacactactgctttaaattatctactatttaaaatgcactccttcactacctgtaaccaaggcaacag

SEQ ID NO: 20909 - DNA, 201 bp, Bos taurus
tctttaagtatattcaaagtgtcttctcagttcacagcagaattaaatcagaaagcaataacagaaagatctctggaacatacccaaacattcagaagctgtgtaaacccatttctagtatccatggattgaagaagaaattaaaggggaaactagaaagcattttgaattgaacaaaaatgaaaacagtatcaaatttta

SEQ ID NO: 20910 - DNA, 201 bp, Bos taurus
ctagttttgaactgtcttagcagaactcaagtgggaccctgtaacttatgaatgttttgaagataaaaacatcccctcatttacagaccttcatggttcaatgatctccatagtcaggaacttcgttcagctttcatattcagaatgtgtaaatgcaggatgttaccccattatttcattgcttcccccaacgttagtatt

SEQ ID NO: 20911 - DNA, 201 bp, Bos taurus
ccctgaagaaataaaaagtcttatggggtcataaaaaatagaattacaaaaatcaatagtttatagggatggctttccgttcacgaagtgtaactacttatgcaagaccccaaaaggtcttttctagatagacatcctccccaagtctcctgtttttctctccctctccctcttttatactctgcccactccacccccttt

SEQ ID NO: 20912 - DNA, 201 bp, Bos taurus
taaagaaggtgaatttgttttctcactggaacattttatgaatcaacagtattgatgtgtaggaataggcatagttcgagatcattataacttggtcttatacaccactgccgaagtcttccaactcatcttgatggaatagattagagaatgcaaaaaatctctctctaagctgtaagatgtaaaaataagatattacaa

SEQ ID NO: 20913 - DNA, 201 bp, Bos taurus
ctatagctgtaattttcataaactaaagttaaaatgaactttaaggttttaaaattatagaattttagtactagaaggaaatcgacggtttgatcaactgattctaaaagttctctgggtcttggatccacttaataatctgataaaagctacatttcctctctttagaaagataaaatccatggtataattttggtattc

SEQ ID NO: 20914 - DNA, 201 bp, Bos taurus
gtgcttttttcttttttttccttcccctgccatgtatgtcttcctttttctttaatatgaaaacattcactttaagaagtatttccaaatagcctcttgagtcttaaggtccatggcaggtttgtgttatctttggagacaaattgtctgctgtgttcatggtggaagcccatcagccaaggcctggcatgctgggggcag

SEQ ID NO: 20915 - DNA, 201 bp, Bos taurus
taaagaatgtccatctcatggtgatgaccttggcataagagggcaagtaaaaacacacgatgccttttaaatacttctattggccaaaacaagttacatgctcaatcccaacatcactaggataagaacatatactccaatcatagagggaggtgtcactgaaaagtaatgtggccaaggatgaagaggtacagtcctctt

SEQ ID NO: 20916 - DNA, 201 bp, Bos taurus
aggttaggttacaagccagactcacagaataaaatggaaaacttctacgtctatgcattagacgcatcagtcatctattctctgaatatcctttacacctcgttataacaccactgtgcgtgtgtgtgcgctaagttgcttcagtcgtgtctgactctgtgacatgccataaaccgtagcctgctaggctaatgttagaac

SEQ ID NO: 20917 - DNA, 201 bp, Bos taurus
tcccagttctgatcccaaaaataacttctataaatgttcactgaccaaatagcggctgtaaaggaaaaagactggaatgtcaaaatgtgtcatgttcgaataaagatacatgttgtctcttaagaactacttccaacgacactcttaaactggacaaattctgccaatccaggacacatgctatccctcaaatttgctcga

SEQ ID NO: 20918 - DNA, 201 bp, Bos taurus
aaggtctatgtaaaataaatatggagacttactgcaactgtaattaaccgtggaattgaggtcagaatcgctaaaacatactaccaatattctctttgcaatatgaagcaatgtcacttggaagagatggtgtggtctgtatgtagtgggatggacgtggggaaggagttcacagaaggttgagacgatcctctgtagact

SEQ ID NO: 20919 - DNA, 201 bp, Bos taurus
acaacagaggttcaacaaacggttgttaattgaaataggtcaaaacttggggcacacagcattcacactaaattaactagtgatctgagaggctgaagggcagccaggggattgtatcctgtgagtcccagacagttgatatgagtctagaggcttgaggtgagagattaataaactgagaaagggatccatacctgagga

SEQ ID NO: 20920 - DNA, 201 bp, Bos taurus
tgccactcccatcactcttggcctctgttttccaaaattctacccatctctcaagggtctcaaatcccattatctcctggaatcttgggagactcacctcatcctcctctaaacccttgccgtctagatcattctggaagacataatccaccaaccacttattgctccagcagatcgaaagcgcctgcaatgccggggcct

SEQ ID NO: 20921 - DNA, 201 bp, Bos taurus
gcagaaaatttggctacatttgcctttttaaaaataattgttgttgagttttcctcctgtcattaaaaaaaaaaatcgaattatggaggaattcagttcagttcagttcagttcagtcgctcagtcatgtccagctctttaccactccatgaatcgcagcacgccaggactccctgtccatcaccaactcccggagttcac

SEQ ID NO: 20922 - DNA, 201 bp, Bos taurus
taaggaaagtttcctaatgaatacactcattaaatgttggagtgggaatgtatatagtaggctatgaagtctcctactgtagaggcctttgaaaatatttaaaaaatcaaatagaatgggacttccctggtggtacagtgaatagaaatccacctgccaatgcagggaacacacatttgatccctggcctgggaagaacat

SEQ ID NO: 20923 - DNA, 201 bp, Bos taurus
gagttccagggcttgctgatagatacgtggtgattaacaattctcattgtgcccgtgtgccttgtgccctctctttgttgttctgcagttgggtatcaaaactgtgctatctatgttctttgaagactaagcaggttggacgtgcgattcagatgaaaaacaattactctgtgttagcttgcttttggcaagagtgtatta

SEQ ID NO: 20924 - DNA, 201 bp, Bos taurus
tccatgttctgcctacttgcagatgagacctggcaatcctgcttctagcctgaatagatctatattttaattacttccatattctaaatcctatctagggcctcttgccaggaccctagatcttttcataaaggaaagttttgttaaagttaattctcttttgtacatttgttttcctttgtgtttctctgggcgcaccac

SEQ ID NO: 20925 - DNA, 201 bp, Bos taurus
tttctttgaaggttagtgttttttgtgttctaaaggatctttacttatcctagggtcataaagacattctcctttgctttagaatatgtggctgttagggctggcctttaatccatattacactaacttttgtgtatgatttcaggagtggtatgtaagaatttccagtagtttcagctctttatgttgaaaagactctcc

SEQ ID NO: 20926 - DNA, 201 bp, Bos taurus
agactaagtgctatctttcaatatttcccacaaactttatttgtgaattaggcaaggtgttcaaaaaaggaagaacttgacaataaagataaaattttatgcacatcttgtgcacagatgtctgggggttcactttcaggagatgtcctatgctatgttatgacctttttcagatgtttacttgctaggaggatttcaaag

SEQ ID NO: 20927 - DNA, 201 bp, Bos taurus
caaacggctctgctctatgggcaagtgaaactgagattaatatgcgttgaaaaataaaatgcccttaccacatttttgtctgacctttgcacagttaagtaaaaatatttcctcactgggagtttttggcttcatgtcaggtttgcagaagggtaaaaaaaaaaaaaaagtccttgcagcataaggaggaagagattctgg

SEQ ID NO: 20928 - DNA, 201 bp, Bos taurus
cagcactgctcttcagaggtgggccctctaacacaagcgggcataacagttctgaactgggacaggcgtttccaccaccagcgctgcccaaccgctgcctatcagtagcggccaagaagatgcagaagcttgcactagctctgacaactctcacaaggaagaaaggaagttgagccgattctccccaagtttatcccccaa

SEQ ID NO: 20929 - DNA, 201 bp, Bos taurus
aataatttccaagcctccgttaagcatataagtccatcaattttttatgcatcttcgtaacaacaaaacattgccaagttttacatttgaatcaatttccatcatttgaaaaaataattgtagtgaaaagttctgcctttgctctctgaaatgcctttaggaatgcttttattttccatttgcaaagatgtcctccatttt

SEQ ID NO: 20930 - DNA, 201 bp, Bos taurus
ctgggagatagtggaggacagggaagcctggcatgctgcagtccacggggtcacaaagagtcagatgcaacttatcaactgaacaactataaccgtacacggtgtaaacagcaaagcctacatatagtatgaaaaagtatgagttttagcaaaaaagatctgattttaaactgtagtactgctacatactagcagtgtgtc

SEQ ID NO: 20931 - DNA, 201 bp, Bos taurus
ccttcctgggccccagtaagtttcctaggtacgttgtttactcagaaggctatttcctttctaatatcaaaaatgcaatcaataattattagattttgtagagggcctagcaactggctgcccaaggaatgttgcattcattaacactttcccttgtgtttaagtacttctgaagtactgtaggtttttgtgataaccttc

SEQ ID NO: 20932 - DNA, 201 bp, Bos taurus
agtagaagactgggccctcaggtctttgtgtgataaggtagcctgctgaggagacattgtgcttccagaaacattgtgcttccagcgactgtcataaacatggtctcacagttcccgaggaggccggcatttttgttgctgtatataaccgaagatggcaagttggttatttccatactagtttttttttttctttccgac

SEQ ID NO: 20933 - DNA, 201 bp, Bos taurus
aaagtaacatcccattcctttggaaggctttgctttgcactctttgaaaaaaatacctgtggattgtacttgaaagaaagtatctccctgtggattgatcgtgaaaaatgactttgtatttcatgctccgttattagtgtcactacctcagaaaatgtcagagtggtttctcctgccacatctgactgggagaatctgggt

SEQ ID NO: 20934 - DNA, 201 bp, Bos taurus
aagacaattttcacaatgaaaacaatgtaaagaaggaaaaaaaaaaaaaaaccaaattgttttatccccttaaaagcaacatgctatcactccatagtttttcaaaaacatgttcaattatgattaaaaatctctgctttttctattttgggcacttataaatggaagtgcttgaattttatgaattcctttcatatcagg

SEQ ID NO: 20935 - DNA, 201 bp, Bos taurus
ttgctggcccttcagacccaggttgtcatactcaaggcggtgaaaaggaatctgagcagcatagttgctcgaattcttgaggcttattttcaacaggcccatccagtccaccctgctgctgcctgctattctctagttggtcaggacagctggttccgggtcctctctttcctctttacaggcccgtaggctgaccagtac

SEQ ID NO: 20936 - DNA, 201 bp, Bos taurus
aagcggggaactgcggcggccgcggcggcagcagtccgggtgtgtgaaaggttttacccaggcggcaaaaggtcctctggcggcgggctcctgtctgcctgcagacaggccgggccgggtggactggcggccccgggccggggagcctggcgcgctgcaggccgaccgccgagcgggatcctggtgtccggggctgtggga

SEQ ID NO: 20937 - DNA, 201 bp, Bos taurus
aatagcttatctaatacttggacagcataacccttttctcgattaacatgttaactagtcaaaagcctgcagacacattggatgagtgctgaattttccttaatattgcagattaaaacttggccagaacaaataaaatattaccacaagaatcctactttgacattattgtaaatttttgtgaatgccagcccgatagtg

SEQ ID NO: 20938 - DNA, 201 bp, Bos taurus
tcctcttctcagctttttaaaaacattacatatacataaaaatttaaacatgcatttaagtcaaataactgtgatgaaattaataacaacagcatgactacggaagtgcagaagctttgagtcaatgacccaaccagcagcaagggtataatttaaaggcagaaatttccagtgcatgcaccgttagccacagtgaacctg

SEQ ID NO: 20939 - DNA, 201 bp, Bos taurus
acactgccttgcctacagagaggatccatgagaaaacttttgttgtgggtggtgggtgaatttgggtgatgaacaagatgcagggtgcattaagcagtgagttgtaaatgcacttggatgtggatctcacatatggatcacacatgactcattctttgatccgtttcaagtagatttagagggctcagggcagatttttta

SEQ ID NO: 20940 - DNA, 201 bp, Bos taurus
tctaccaaacatgatgaaagcccatcgaaatccatgagtgtaagtgcgaatacagtcactgctccctttcccacctttactaagtcgtgtgggtttacacggagctgagaccacatttcactgattgcttgctacagcccagcctgctccagaagcacatgctttcttttattcactgaatcattaaaacaccccaacaaa

SEQ ID NO: 20941 - DNA, 201 bp, Bos taurus
acagttgagtgtatctctatgaggaagcccaggtggaaacagaataagccttcagctgacccagtggattgtgaaataatactatgtatatcatttgaggcgccaggttttgggatgatctgttatatagcaatagttaacagatacggtactattttttcattacctaccttctaaaactgtccatatataatcattcct

SEQ ID NO: 20942 - DNA, 201 bp, Bos taurus
tgtgttgtacaccagaaactaattataatcaactactttgattaaataaataaattggagccaacagaacttttgcatttagttcttcacactggccacttctctggaatagtgagcaagagatcaagatgatggagttttgctgacaactgttgtgtatacatgttgtatttctctaacaattagctttagtgaccttgc

SEQ ID NO: 20943 - DNA, 201 bp, Bos taurus
acttaaaattactacctttcatcagggccactttgagataaattttgactgtgagatctttcacataatgtgggttccagctaaaaacctaggtgagagccaacttaatgtggtaaatcctttggagggatttttccctttagtaaatggtaatttttgaggcagattatattttttatagcaccatgggggtgtatttgt

SEQ ID NO: 20944 - DNA, 201 bp, Bos taurus
ggccttttgcaggaaacatcctgtgtttcccagtagcacacttctctcacatcactgaaggtatatgctctggggattccctccttgagagctgtgtgaaccgtttagttgcctgttgccaggccctgccttctgcagaggctgctggtcactaactggcaggactggatgacaaggtgactggctgtggaaactcctggc

SEQ ID NO: 20945 - DNA, 201 bp, Bos taurus
ataattaatttagcaaatatactgagtgtgtgctatatatcaagcactattcttagaagataattaaatagtgatcaagactaagttggtcaaagaaaccgggaggcattctacttgagttaataacacaaaggaagtgactgacagttgaagaatacaaagaaggctcctatccttgagaaacttgaagcctagatggcc

SEQ ID NO: 20946 - DNA, 201 bp, Bos taurus
gtttgattttaccttatcaagagtaaatctgagcattcttttcatgtgtttaaagactattgtcatttctacaaaaaacccagaaactgggcagaagaccaaaacagacatttctccaaagaggacatacagatggccaataaacgcatgaaatgatgctcaacattaatcattattaagttcagttcaattgctcagttg

SEQ ID NO: 20947 - DNA, 201 bp, Bos taurus
agtcctcatttgtattgttggtggaattgtaaattgatacagccactaggtagaacagtatgaaggttccttaaaaaactaaaactagaactccctaatgactcagccatctgattactgggcctataacataagtgatacattgtctagatatttattttatctcctaaagtatacttgaaaaaataaagactattaatt

SEQ ID NO: 20948 - DNA, 201 bp, Bos taurus
gatcacaaagagtcagacactaatgagtgagagacactttcactttcaaatacacacacaaaatggagtattattcaaccataaaataacaaaattttgcgatattcaacaacatggatcaatcgacagggtattatgataagtgaaataagtcagacagagaaagacaaatactctatgttatcacttatgtatggaatt

SEQ ID NO: 20949 - DNA, 201 bp, Bos taurus
tttcattttatataagaatattcaacccagctgcaccagattcttctctagagcatctacatccacgattgtcccctaataatcagttgtcatctaatcacgaagttctgttcagctccttgaagccccatgaactgtaactaccagcctcctctgtccatggatttccaaggcaagaatactggagtgggttgccatttc

SEQ ID NO: 20950 - DNA, 201 bp, Bos taurus
tgttgtactagaataaatacagaagctgatttaaatgtaaattagaaggctggtgagaaagagaggaacataaaagatgatagaagagaaaatataaagacgtagttgttatggtttaaatctataaatgggcatgttcttttttaagtgtgacacccaaacctagaatacacagaaaagaagatgagtgtatctaacaaa

SEQ ID NO: 20951 - DNA, 201 bp, Bos taurus
tgaagccttaactctcaaggagatggcatttgaagatggggcctttgggagatgattggtttagatgagaccatgagggtggggccctcacaatggaatctttactacacctataagaacaggaagagacactggagttctctctcttcaccagatgaagacagtgaaaaggccaccacctccaagccaggaagagagcat

SEQ ID NO: 20952 - DNA, 201 bp, Bos taurus
aatagaggctggcctctttcattccctctctttttaggggtgagaatcagtgtctttgcatgagtatgtcttcatgccaaaatgtttttctttgtggcaaccagatgtggccgtcttgatcttcttcctcctcctcctgtttttcccttttctgttccgctttcgctttagccaagccaaggcaagatggaaagcatagca

SEQ ID NO: 20953 - DNA, 201 bp, Bos taurus
agctaagaacggattttacagatgaatatcagcagtcaatttgatgagagggaacaataactttgaaccactattaaggaaaatattattccccctcaaagtctaataattcaattagacttgtgttacaaatatttgtactcattattatattttgaatttcatgaatcaaaatttatggaaaagtgttcgttatataac

SEQ ID NO: 20954 - DNA, 201 bp, Bos taurus
aagaatgtagaaatttaaacaaaatttttgcatacgtgtaaaatatattgaggcataatcaaagaagcttacgcagcatatcaaagaagcttatgtggaaggagaagaaggaaaagagaagtttcaagaacaaaaaaatgaagaagacagagaagaagggaagaacaagaaaggaaagtgtgacagatgaggtagaggaag

SEQ ID NO: 20955 - DNA, 201 bp, Bos taurus
cagggtcattatttaacatgtcttcttaaaatgaccaatgaaattgcagtgcaggcatccattttctcacctgaagactatgtataaagcacattgttgggattataaaggcaactccgtgatgccctctgctttcaaggaatttatattctacatggccagataagtcatgtatataaatatataaaactacaaagttag

SEQ ID NO: 20956 - DNA, 201 bp, Bos taurus
gaaggagttcagaaagattcaaaacagagaacacaaaataaactacaaaagtatgaaaacacctgatgcactcaggatcaataagggaaaccctctctatcacacacgttcttttcatatcatagccagatgtccttgggaccctaaaataccttcaacagataaactcctcaagttcccattaatctattgttctttttc

SEQ ID NO: 20957 - DNA, 201 bp, Bos taurus
gaaattcccaaggaaagataaaatattttttatttctatagtcttaaacttgtacacagtactaggcgtataactgtactcaatatatcttttcttgcatgaagtcattaatgaggtagaataggaacctagtcttttctatccagtgtgctgttctcttttgtttttaagctgtgctaaacacatgatacagttatcaat

SEQ ID NO: 20958 - DNA, 201 bp, Bos taurus
catggaaactccaatagatgggaagggataaagaacaacataaatatgtggataactgtaaaagaccacttttctctatttctttaaaatacatataactgtataaagcaaaaattataacaatttattctgaggcttataacctatgtaaatgaatttcataggacacagcataaaatttagtagaaaataaatgaaaaa

SEQ ID NO: 20959 - DNA, 201 bp, Bos taurus
ctgctctagaacacctgaaatgttcctaccaccaccatccaacagaaacataaaatacctttcactttcaagagggcaataatgagatgatgttgttgaactgagaagtctatgttgttttaaatatagtttttattagtctaaaagaaattaatgctgttagtaggaaaattataaagttcagataagtatgcaataaaa

SEQ ID NO: 20960 - DNA, 201 bp, Bos taurus
ggtcttgatatgagtcaggtagtcctaaagataaagtatccatgcatttattcatcttctccctcctttttttctttcttccttcctccttccctccctctttccaattattattttttgagtaactatcacatacataacagcttctaaaacctggagatgcagtagtaaagaagtaaaccctcatagggtccctcctct

SEQ ID NO: 20961 - DNA, 201 bp, Bos taurus
aggataggaaaattcaggcctcaatgatttctccttcagagagaaaaaaaatgaggttttgcagagagaaggatgataaaaagaccttgacatttttcaatgcattcctgttttggagttggccctttgtttccagtgttcccttattcttttgatggttgtgcagtctgtactgatatccactgtgtcacccttgatatt

SEQ ID NO: 20962 - DNA, 201 bp, Bos taurus
acattcaacaactcctgtcagtctaccaaattaactcctactactcagtgttatttcccttaagatatcaaccccctttggcaacttcagtcataaaaacgatgtggtaatcagacatctaagatagttcctccatactcaaccatagtggtaataaaaatagtttagtctctcagtcgtgtatggctccttctgacctca

SEQ ID NO: 20963 - DNA, 201 bp, Bos taurus
attggggttacaaagagtcggacatgactataactttcacattcacaagttgggaaaaaaagtttaagggatatatcatgaaaaatctcattatctggcccctgcattcaatatggagacaaatagaatgaaccagaggaaaagttccccttaaaatgaagatcagagcagaaaattttgcatttagaatacatcctacaa

SEQ ID NO: 20964 - DNA, 201 bp, Bos taurus
gtataagcaaattcaaaggagtcttatttctgtccctggacatctggctccaaagagcaaaggcttaggaacaacaccattcatgacgggcaagcaaaatgacaggattagcaggagcccttgggcccacagtatgaaattaaatgagggataatggatctgaagtcttggatgccaacaaagagaacacaaaatgataga

SEQ ID NO: 20965 - DNA, 201 bp, Bos taurus
tagaatcaaaagattagagtggcagagtttgcctgaatttggtatcaaaaatggtaaaaaatagaagatagggggaaaccgtaaatctggctaagagcatggttgctacagggcagcacctggtgggtgtgattctggtgcccctggaagaccattcaataatgaagaaacagcaaacatttggaggtaggagggaagggt

SEQ ID NO: 20966 - DNA, 201 bp, Bos taurus
ccccagccttcttcatgtcactgtacaaaggaaatataactgaacagttttttggtgaaagatattttggcaagagctaacaggctgtgagctccacctattccaggcctctcccaacagctccaagagtcaacaagatcagtatctggacatacctataatccactcaagaaatactgattggctgcccattgaaatcac

SEQ ID NO: 20967 - DNA, 201 bp, Bos taurus
cttaacaaaggctcagcagaataaagctcatggagaaatccgcaagcacacaagtcttcaaatctaagacagacacatttcttcagatgcttaggtctctgaagtcagcacgcattacacagtcaatgtctacacacaatactgtttttcccttggcagcctcttcctcttgtatacacacatacacacacacacacatgc

SEQ ID NO: 20968 - DNA, 201 bp, Bos taurus
gtgaaccaggccacgtgctatcactcgtattggaggatctagtttaacagtctgacaatgaaccttgatctggaaaattttgctttttctaggcacctacatggccctatggtggtcccactatagggaatgaatgggttggctgcttgccagaaaaacaccaggcgatgctgctgctgctgctaagtcacttcagtcgtg

SEQ ID NO: 20969 - DNA, 201 bp, Bos taurus
ctaattggaaagcatattaatggtaacagagctaactgatgcccttcataaaagatgatcttccacatgggtggcttaggattaagaaccacattactgatcatgctctcagtttggtcttggtttgaaatggagagcacttacatttatgcagcaggaactagatatgagataggttctgaagtatatgaagtacattag

SEQ ID NO: 20970 - DNA, 201 bp, Bos taurus
ctgccgtctatgaggttgcacagagtcggacacgactgaagcgacttagcagaagcagctactatgtattgcaacacacagtatcctagatatgatttcagagcttttaagactactaccctaaggcttccctggtggctcagttgataaggaatccacctgcaatgcaggagacccaggttctattcatgggtcaggaag

SEQ ID NO: 20971 - DNA, 201 bp, Bos taurus
actttgtatccctttaacatagaatatctgaaatccgtatgtctctggtctaggtgccttatagaataccatgcaactgaagcattaagacacaatattacgtttttgaactcttaggaaagggagatatttccctgaatacattctggtgactgctttcatcaattaactgtacctgaccctccctgagaaaaagtcagg

SEQ ID NO: 20972 - DNA, 201 bp, Bos taurus
aactgacacaaatgactggtaaacacaatccggttaggaaatgtttatacttttatgcaaagtggctaccgttaagctgctaagtataaggttcaagctctaaattcaacatctcatcagcaattaaataggagagaagtatatactaaaaaagataaaatattatataatttctacggcttcacatttctgaaacagttt

SEQ ID NO: 20973 - DNA, 201 bp, Bos taurus
ttttccttcaaaagaaaacgctgtcgaagaaatgaagaagggcatttaggtccattaatcaaatcaggtatttaggtccattaatcaaatcaggaacattgtaaacaacctgtcactaggaggccctccaggagatgccaagttttactccccatctttaagctggcaatgcccaatttacaaagtcagattccaaaaaaa

SEQ ID NO: 20974 - DNA, 201 bp, Bos taurus
gtggtgaagagtgttgagaagaacctgagggaaggctctagggaagttgttgcagagcagagaggggaagtggggcctgttactccctgaactcaagcccggtggaagtggtcaggcaaccctcaactccataaaaacaaatacagatggggccatggagtggaggtcaggggaagaggtgagctccccatcactagagct

SEQ ID NO: 20975 - DNA, 201 bp, Bos taurus
tcccgtgggggtagatggggttcagtcattccagaggtgtccagatgttcccgcaccccgtgtccctgcagtggcagccaacacggccccaatgttcgcgtccaacatgtcaacggtgagcctgcctgaagatctgccagtgggtgagtacaagttcctgtgcccatatcgtgccaaaccctcacccataagagggcccgg

SEQ ID NO: 20976 - DNA, 201 bp, Bos taurus
caagtagccagggaaactgacccatcagcacataaggctttggtgtgtctaggctcagaaggggaggtagactctggggcagggcttcccatctgaacccgggagggctccaggcatgcttggtaaatgcaggtggaatgaatgaaactctgtgcacgtgtctaggtcaagagggcactgcaaagccagtcccacgtggcc

SEQ ID NO: 20977 - DNA, 201 bp, Bos taurus
ggaccacaggctgtgagggccaggggtctggtggtaccagggaggagcagagggaaaagtggaggggggttgtcaggaacctctcaggaagatgttgggttccaacacggccacctcttcagcagcccttttggaagtgattctgggccagcctacttggatctccctagggcctgtagggtagcaatgggcactgagtaa

SEQ ID NO: 20978 - DNA, 201 bp, Bos taurus
caagaatgccacaatctccacacttgaacagaactctatgggcatgtatcacagcattttccacacaacattctaattattgctttacctatttatttcccccagtcaactctcaatcacttcagtattccatattcttggcataaaattgacacaagatataaatgtatatttaatgaatcaattagtttcttattctca

SEQ ID NO: 20979 - DNA, 201 bp, Bos taurus
aggtctgcactgtaattctcccatccaagtactaaccaggcccgaccctgcttagcttccgagatcagacgagatcgggcgcgttcagggtggtatggccatagacagcactgtaattctcttggtgctttccagatgctccgcacagcattcctatttgtcacagacacagcgagtgtcattggttctgctggatcatga

SEQ ID NO: 20980 - DNA, 201 bp, Bos taurus
aagccatgcataagaagtgagccactttcctttttttaacctcctgaaataccacggcagttctgagtttagttggccttggcctgcagtgccttgaagcaggattctggtaccagagcctaaagccaggtaccccagagactaaagtcaggccaagggcactgaatactagccaccagaccagcagagccagtggccagt

SEQ ID NO: 20981 - DNA, 201 bp, Bos taurus
aatatgtaaatacattttcctgaaaagagtatgacttttaggaatagtataatgtcaaatggattttttcccagctttcagcccacagagtttctggcccgaaatatgaacttgtccatatagcagcctgtaaacgtggggcacagagcttcccaaggagcacatcttgtcctgcatctttcagccctgaaacttggggtg

SEQ ID NO: 20982 - DNA, 201 bp, Bos taurus
acatgaggtgcctctcgggcagccaggcccttcacgctacagaggtcaccttacccctgggtgaccacatggaaccgtctgtaagcagagcccaggctgggagccagggcctccatcagctgagaggtccgaatttcagcctaaaacacatagacccctgagcctgcagaattcccttccaacctccccccgcccacatag

SEQ ID NO: 20983 - DNA, 201 bp, Bos taurus
aggtggtctgacagcaggcacagcctgagcgtccactttgtgccagcctctggaatgctggagatatctcagcaggcctctgttcagggaacttagctcaatggaaagccattccagatgggacaagtggtgctcagaaggacgtgcatggggctctcaagatggatagcctggggcctgaccaggtctcgggggtcagga

SEQ ID NO: 20984 - DNA, 201 bp, Bos taurus
gtgtatcatgtattcttactgaactttcttattgaactgaatatcttttcagaaactgaggatgtagacagctcctggaaagctcctagagagcaaagaccatgactaccacatgctttactgttcatcatctggttccctacacaaggagagactcaaatacataatcattttcaccaagaatgtgctctaagtacagct

SEQ ID NO: 20985 - DNA, 201 bp, Bos taurus
gggtataggatgggaacaatataaagttttaagttgcatatgagccatgagagcagggagcaagtaataggggtcttagagacctgggcaatttgttaccgtgtcagagtgaacataaggtacatagggtaagatcaggaaggtggtatgtatgcttagagaggtggaaggctgttgaggagcatgccttacatggggacc

SEQ ID NO: 20986 - DNA, 201 bp, Bos taurus
aacactgcaggtccccacgaggccacctgtgggccgctgtaccctgcacatctcacagacaaaccctccaccctcgggaactgcaagcaccataccagtcagtcaccgaggttccagtgagggcctgaggtaggaggtgggtgggtcccagggctggacagtgggtgtttgtcaagcagagtaaaattgaagctttgtttt

SEQ ID NO: 20987 - DNA, 201 bp, Bos taurus
agatgcttaatagatctggacatcttactggacgaagaaccaaaaaattttcaagagtaaagcaatgttttacagaccagagtaaaaagtgaaactgcctctttaattatcagaatatataaagtctgatactggtgaagtaacaggacaattgacaaaagtaacaaaaaagaagtgcgggatcaggcacgtatgtgtgaa

SEQ ID NO: 20988 - DNA, 201 bp, Bos taurus
tgctgatgtcctaaatgtctagttatttacaagcatatggctttccattcctgtgtattaagggtcctagagtcttggtcaggtatagactcagtacttacataagagggaaattaagtcggggagtggggaggagtctgtcacttgtacccccttacacttgggcaaactgaaagggagtaaggacagtggtcaactcct

SEQ ID NO: 20989 - DNA, 201 bp, Bos taurus
ttccttacacacctgccactttccctacagcagctgctgtccctgttgcacccagagttcaaagcagaaaccagctagaagcagactcttaacaacacaagcaaggggggtgctgcttttcctgcttttgcctcacttacaccatctggaagacacgacagaatgaccagggaggcccagtggaaacaaggggtcttatat

SEQ ID NO: 20990 - DNA, 201 bp, Bos taurus
ggtggcccaattcctggaaatctctgctccttccccaaattagaataatcttcccattcgttagcctatgaagttactcagctaataaaaataaccaccaccacacctcagggccactcttgccttcccagaccatatacactgtggagtattttctcccagcgcctcgtacttccccagaccctgacctcatgctctggg

SEQ ID NO: 20991 - DNA, 201 bp, Bos taurus
tctttgattcatggccctaacattccaggttcctatgcagtactgttctttgcagcattggattttaccttcatcaccagacgcttccatatctgagcattgtttctgctttggcccagccgtttccttctttctggggctattagtagttcttccctgctctcccccagtaacatattggacatcttctaacctggggga

SEQ ID NO: 20992 - DNA, 201 bp, Bos taurus
tgtttttctcttgctgagggctaccttattgagccccatattataaaattaattgctctgtgccaagtttttcttgatgagtggtaccaaaacattacagtatcttttgaaaactccatagaaatattattaccaaaaactgatcactgaatttctaccagtgcttggcatttggtaaagcctactggctgttatcattaa

SEQ ID NO: 20993 - DNA, 201 bp, Bos taurus
gaaaatgtgttggctaacatcttaggcaccaccgtggaggtaattgcaacctcaaggaaagaaagattggctacaaaaaaatacatgggtgaatgcagacggtagtcaccacacaccaaaaggataatcatggtgttgccaatcagagatatcatgtacataagcaggaatgcagaaaaaagaagaatttctacttctttc

SEQ ID NO: 20994 - DNA, 201 bp, Bos taurus
tcgagaaatcaaccacttcttttgtgaggcaccatcgcttgttcgccttgcctgtacagacaccatgatttttgaatttttcatgtacatctgctgtgtcctgatgcttttgatcccagtgtctttcattttggcttcctacggtctcatcctgatcactgtgctccgcatgcattctgctgcagccaggaagaaagcttt

SEQ ID NO: 20995 - DNA, 201 bp, Bos taurus
agaaggcagaatacatgtgaagtgtagtattagagaaggatgatggcaggaagcgaggatgttaacgaaaagatttagaactgtgcaacctgagactgagtcagagaatggagttagggtaaaggcgtaggtgcactaaaatgtgattgtatcagcacaaaggcatgttttattcacccaggaagaatgattgtgaggaaa

SEQ ID NO: 20996 - DNA, 201 bp, Bos taurus
aggcaaaacaaatgaagaagagggaaccactctggaagtgacaggtgtaacagattaaaaccttgtagttaacattgactaagggttggaggcggccaatggacctcgagaacaagtataagcttgtacttctctgaaactgaactgaccccacactgccctcaagagctccagagaacttcctagatttatttttgctat

SEQ ID NO: 20997 - DNA, 201 bp, Bos taurus
atgcaattgtgatggatgacaacagtgtaaaagtgagtgtacatgatggtgacaacagtgactgataaaagtgctaaaatttgtaactactttccaattatatttaaccccaggtatgtactattttcatattttatctaatggatcgtttttaatatctcatgtttctttaaatctgttctacagaaaagatgcatgttc

SEQ ID NO: 20998 - DNA, 201 bp, Bos taurus
taatgagtgggtttaatagcttttggtgtgagggctgttttttactatggattcttgctcctcttttctaagtatatgctggccattgtcctcttgataaaaggtgtcactcatgttgtggtgaccaaagcctgcactggatatggagcagggcctcctcttttttctgtggttgtcacttccctgtcagaagcagaggct

SEQ ID NO: 20999 - DNA, 201 bp, Bos taurus
tataagatttgaaacagccaatgtgataaatgcaataaacactggtcattattttttctgttggtaatgagggtaattgcctttcatgttcctaatatttttgatttagaaaaaaaaatcaccccatttatcattcatctttctatccttcacacatataagcatgctgctttattaattatactaagaaagattgataat

SEQ ID NO: 21000 - DNA, 201 bp, Bos taurus
aagtttctggtgtgggagctccttattcccatctctttgcagctaacagttttcccctccctgggcccactttccgaatcccatgttccagcatccagcctccttcacaccagcagaaacagattcaggctgggtgtgcagggttgaggcgtagaccatccatgtaggttttagggttgctatgttttcttccaggtcact

SEQ ID NO: 21001 - DNA, 201 bp, Bos taurus
tgatggatctccctggttttgcagaaggggaaggtcatggtgactggtgtgagcataaagccatccactgatcccaggaaccagcagccagacaccaagatgtgacacactctatggctcatgagaatagaataacggagtggatgacagatggccacatagcgatcataggccatggcagccagaagaaaaaattctgaa

SEQ ID NO: 21002 - DNA, 201 bp, Bos taurus
taataagacttagctatagggaaaccatttaaacgaggtgacagttatgaagatgagaacaacatactttcagaaacccatgtaaaaaacgattataagccctgaacacaatgaatgtatctgggactcctgagggacaaagtgacaagagaaacatggccatgcatggctctgctagctgataaagcacactttgtctgc

SEQ ID NO: 21003 - DNA, 201 bp, Bos taurus
gtccacacagccgctgggctggtgggagcccgaggtcctgattagagtggcttcctggaggaggcagtgctggccaccgctggacaatcagcctgaggccggagcttggaggaacaaagtccaaggaccgcaaacactcctgtgaagccctgacccgagagacacagggcacccaggccagacctcggcccggagcagatg

SEQ ID NO: 21004 - DNA, 201 bp, Bos taurus
caaaaaatatcagaaatgtatgtgaatccaaatgtagacaacaaagaggtgaaaggttgatgtctggatgtacgaaagtcaaggatgatgttagtgcttacgatgagtgtgtctaactagaggatttatttctcacgattccctactaattaatgattgaaactgtgcacacttgaaaatcgattctgggacaggggtaaa

SEQ ID NO: 21005 - DNA, 201 bp, Bos taurus
acccccacacccctgacttgctctgtgggcagttgtatgaggaggcacatgtgagcagggctggcttcctagagaccctgctgtgggtggcccaggaaacgtccagagaagcaggaataactctaagtgtaagtcacatccaaatgtgcaagaatccaccttcctagttggcctgtatatatgtgccaagaatcaggctgg

SEQ ID NO: 21006 - DNA, 201 bp, Bos taurus
ctgcacatgttccaaagcaccgtatgctggccatccttcgcttgaagcccttcggtcttccccttaggactcatcagccctgacccttacctactgtcatcctcaatcttaggcccttctcatatccatttgtcctccaggcatgtggaatatttgtggttccctgaacatgacctgatgttttatgctcctgtgctccac

SEQ ID NO: 21007 - DNA, 201 bp, Bos taurus
ggcccataacaaccccaattctacattcccgcagatagagactgccggcttctcatttctggtgaggccatttgtcttgggcctaatcttgttcacgcagtgtgggaggctccaactgatcccaaatttccccaaatgcctcaaagtgtggaggatagagacccttcttcgcctcggaaggggccccagctggaattcctg

SEQ ID NO: 21008 - DNA, 201 bp, Bos taurus
aagtcctttcacagcacagcagccaacaaattgggaagcattgttcctaaaggcaaggggtgggccatgagttgtaactccaactctgttagaggccagcgatgtttgtctgcttcttgcctctgctgatgacatttgggggaaaaacaagtatggaagggaggacaagtcacaagatagcttttataaaatgcctattat

SEQ ID NO: 21009 - DNA, 201 bp, Bos taurus
aagcaccactcaccccaagctgagaagcggtacccagtgattcacgcacaaccaacccacctgctccccctgggtgcctagggctgatgggtctgacccatggatggaacgccttgaatccagagccagttgccagagaagcagaaaaccctctgacaggcggtttgtggccacctggggccctcccgggtctgtttgcca

SEQ ID NO: 21010 - DNA, 201 bp, Bos taurus
attctgctctccatagcctacaatttaagacagccatgccctggcaccatctgcctttccaaccacccctctgaccttctcactctccagtcaaaccagacgtcttctccagcacgggtcccttcacttatatcagcccctctttgtgcaggtactcccatgccccacaccctacctttccttcgggacccagggccagct

SEQ ID NO: 21011 - DNA, 201 bp, Bos taurus
agccccttggagcaggatgtctgaatggaccacaggtgggcatctcaggccacgggggcaacatctatagaggcctgaaagagcaaagagcaggggtccagggccactgggccgtgtgtccggaagcctgccctgagctactagctcaaggaaggacaagagttcaacatgttgaagctagcaagttccttttaatgactc

SEQ ID NO: 21012 - DNA, 201 bp, Bos taurus
gaagctggtggctggatacagatcctggagtcaacaaccaaggtctggggacctccttctgagtgccagacacatgcacatgtggcctggtcttggctccggacccagccgcaaggacaacaggagctaagccaccacttgagaacacccactccagctctctgaaatggcgcccctgctgtctgatccaggcctttccct

SEQ ID NO: 21013 - DNA, 201 bp, Bos taurus
gccaatgcatactgttgacccatgctgccacacctatagtcttggtgagccctgaaaaggagcaacttgccatattataaaatgtttctgtctttcaaacatggaatgaaacccagcaggccaaactgtttcctctcttcgcagcctctaggaataccctcttcccctccctgacatttttaatataaaaatacaatgtca

SEQ ID NO: 21014 - DNA, 201 bp, Bos taurus
acacttgttacaggtatcaggaggctagtgcttgccacgtgttgtactgagtgctgggacggatgacattgagtttggatggtctcctggaagcagagaggaccccacagggtctttaccttggggtgacatggtaagatgggaaacggagcagccccaggggcagtggcttcagtgagttctctgcagaatggtttccca

SEQ ID NO: 21015 - DNA, 201 bp, Bos taurus
tatgattttatttgcatgcaattctgggaaaggcaaaactgtagttacaaaatgcagatcaggggtgactgaaaatcaaggtacaagggaggggatcgacggcacaagggctcaagggaaccttttttggtgataaaaatgttctgtatcttgattgtggtgtggttacatgactatatataattaccaaagttaatcaaa

SEQ ID NO: 21016 - DNA, 201 bp, Bos taurus
cacaagagactttgcagatgtaataaagttcaggatttggagatgaggttacatggctgggtccagtgtaatcataaggccccttgtaagtaagggaggaaggcaggagtgtcagagacagaaggggtgggatgacagaaacagaggtcagagaaaggcagagaggagttggaaagtgctacacggccagctttgcagatg

SEQ ID NO: 21017 - DNA, 201 bp, Bos taurus
gggcaggctttgtgagacatagaaggtgtcttcttctccctaggctggccaagcaggtatgagcagaaattcctgagttctccccgatgtcaaggcccctgacatctatcacctgtacatagaatattcatgtcccttaagggacttaccgctccctggggcacattcttagatcctaattagaggaaggagtgtgagctg

SEQ ID NO: 21018 - DNA, 201 bp, Bos taurus
tgaaggacaggggagcctggagtgctgtggtccaaggggtcacaaagagttgaacatgatttagcaatctgggaagatcctcactggaggccaaatcttaatccatcagtctttgtttgcaaatgttagtgagcaggagagttagagagcagcagagagctcaataaaaattcagagtcctgggccccccatcccagaggt

SEQ ID NO: 21019 - DNA, 201 bp, Bos taurus
acaagacccaaaaatttacgagaatggaaggagtcagattttaatactctgtggacagctatgtaggacctacgtaaaagcttttcatctgaaaaagctagctttattggaaatgctgactaaatattaacagaagtgataaggctgggtgaagagtggcttttctctgggctgttactggtgggaggatatccacatgaa

SEQ ID NO: 21020 - DNA, 201 bp, Bos taurus
ttggcctggcttaccctctcgtcatgtgcccccaccccaccctagccttcccttcctttccggagaaactcaatccccaaggcctagttcccatagcagtattgcagtcctttgtcttcctcaccggctgaaacgggtccgtgctggtcttcttggccttcagcacttgtgctgggtctcagagcttcctcctgtgtgtga

SEQ ID NO: 21021 - DNA, 201 bp, Bos taurus
acttgtgccctgtggtttgaatggaagcaaccttatagctctggccatggttgctcagatgaggtctgatgcccctgccaaactgcaaataagctggatgcggagaagccaatacttttctgaggaggactggcatgaaattctaccccggataattcattctgggtgatggcagatatggtagtttctcttaagaaatct

SEQ ID NO: 21022 - DNA, 201 bp, Bos taurus
gaatgagtggtggtttgccttctgtctcctgtggatgtggccaggaaggctctggaagagccaagcagtcctggctcaggaggaagttcacagtttctgggggctttaggaatggttctgcagctcctatgctgacctttttctcagaataaggcccagtgaaggggaggggagggtacctggtggtgaagaaatacttcc

SEQ ID NO: 21023 - DNA, 201 bp, Bos taurus
aaggccgctctgtgacctcatattgtgtgtctcacctttccttgaccccctatagtctataaattcattattcttcttactgtttccagaactaagcacttggcctaaggcctactaggtatttgccatgtgtaaattgaaaccaagtcttatttcgtagaaactaggattaggttctctgatagctcagttggtaaagaa

SEQ ID NO: 21024 - DNA, 201 bp, Bos taurus
tcagtaatgctcacattcacatcagagcccctctccctcctgagagcctgctctcctaacagaagtctcaaggagcccaaaggcctgcaggaaggaccaggcagagccctgagagatcattatgcttctgatactgtctcctccctgctgagtcttaatggggaaggctaacggggtctgcttagctgtgtgcacacatgt

SEQ ID NO: 21025 - DNA, 201 bp, Bos taurus
ttcgctcgcttatgggaaacccaaatgaactttctggccaacccaataccttggcggttgacatcaggagggtgaccacacaccctgtgcacaacaccttagagaaactggggaccccaggccagacagggtcatagactgagcccatgtgaacaatgaactcggaaaggaagtcctatgagggcacttgggatggctggt

SEQ ID NO: 21026 - DNA, 201 bp, Bos taurus
cagagcagtggtgcttaagagagagtgattttgcccctaggggacggtggccgatgtctggacacagtttgattgaaacagatgggggagtggggaggggctactgacatttaatggggagaggccaggaatgtagctaaacatcctaactgcacaggacagcctctcacaggaagtttccagcccaaatagttaacagtg

SEQ ID NO: 21027 - DNA, 201 bp, Bos taurus
gaaaagcactaaattccttaacttgagatatttagttttccttaattaacagcactcttttgatgttctgattatctgaacatcgttgtaaaaccttctatgtatcctgatttcccatgttatggagcagtctctcagaattgtctgagattctgtgtctgggcttaagtcctcagttttgtctgccaaataagatgtaac

SEQ ID NO: 21028 - DNA, 201 bp, Bos taurus
attgggggttagctagctatatggaccagaattcccaaagccaaagatcttggaaaataagaaaggataccaaatggcctgtagtgttccctaccaacaacgataacaacttccccattcgagcttcccttgactaatggaagcagtttgctcttgattctgccagaataccaacccccacccccaccattctggccagcc

SEQ ID NO: 21029 - DNA, 201 bp, Bos taurus
tgagtatatcaagggctgaagtgattaacatctgctgcatgcctataatccatgtgaaacaaactaacgggatatttttggcttctttttcttccctttcgtgcctagacaactcttattcttattcagaactcagtttagaagttcaaagtcattcattcattcatttaattaacaaatattttaaaagagaaattaaga

SEQ ID NO: 21030 - DNA, 201 bp, Bos taurus
ccccaggccagcctgcagggaggattagggctggcagcccaattgtcccctgatgccccctccccatttgtctaatccgagtgtatatgtgtaccttgatggggtgccagtgggagcttggtggccagggacctggggtgttcagtgccaggcctgctggcagccacctttaccacggagcagctttgaggatttatttct

SEQ ID NO: 21031 - DNA, 201 bp, Bos taurus
ggcccagggtggtcgggtcccccactaagggaagagtgtttcctgacctgggtcaggggagtggctctgatgctgtagaggggtggggcagggagtatcaagcaggccctgggccctgacatgcagttggcaggtggctggcctcttctaaggcctgaaggctggctctggcaggagatgagtgggtggctgcagttgaga

SEQ ID NO: 21032 - DNA, 201 bp, Bos taurus
aggcccacccctgccctggttcttcactccttctcagtctccctcagctcactgccctccactctgggctgatgtgtaatgtcgtaaatgctaaatcccaatctggggaggaggcgagctgacggcctgtgggtgagtgggctgcagtgcatacagccctcttcctttcctccctgcagcaacctccccttggtctcctcg

SEQ ID NO: 21033 - DNA, 201 bp, Bos taurus
tttcaaaaaagaaatgaaagtagacctctggatttggactttatgcatttcttttcctttctggttaaggaactctaataatgaagggacttccttccccgttatatttcaggaaaaccagtgcagccagttaagcgagagcttctccggcatagggactacaaggtggacctggaatccaaactcgggaagacaattgtc

SEQ ID NO: 21034 - DNA, 201 bp, Bos taurus
gactcttaggtttctgtctctgcctctgcccgtacttctctctcccagtttctctcctgcggggtccttcttaccagaactgcctctcgccccagcatcaattctggcctctctctgcctctctgcggcagagccccctccccaagatagggcccgggtgctgcacctcccgtcctgactcagagtccagtttcccggtga

SEQ ID NO: 21035 - DNA, 201 bp, Bos taurus
acaagatatcaattaatcacaaaaatgacaagcaagatcaacactcctatggtgcactccccactccctgcgcatgatcaaaggactttgcaaacactcagtgggcacagcaggcccaagaggtgagggaagttgtcgaccccatcttacggataaggaaacggaatctcagagaaatgaggtaagatgctggctcaccca

SEQ ID NO: 21036 - DNA, 201 bp, Bos taurus
ggaagatagcagacgtcaatactggggtcagggcagtcagtggtcagagctgactagccctggaactggcattgggagctgccctggcccgtccttagaaactaggagtccagcaggtctaactgggattgggctgccgatgacacgagcagccttgcccagaccacttcccacacgtctgttcagtctcccagtgtgtat

SEQ ID NO: 21037 - DNA, 201 bp, Bos taurus
caggatatccaatggaagagactagctggtgatgttgggaaagagaacaaggataaggctgataatagctgacatttatcaattcctttctgtgtgcaggagtaagcacttcatgtgtgcttgcccagtgaatcttcacatcagcgctgttaggaagggacccgtattatcccatttcacagacaaggaattaaggctcaa

SEQ ID NO: 21038 - DNA, 201 bp, Bos taurus
gaatgctgagctgtttcttgtctgataagggctggggtccttggtcttgggccaacagagtgagggtatattggggccactgctctctgtccagtgtggcattggttagcagcatgtatgtgttaccattggtccttttcagcctgaagtggcccagctcttggctcagccaacagtggaccagaccattgtttcctgagt

SEQ ID NO: 21039 - DNA, 201 bp, Bos taurus
ttcattggtaaggacaattttaattttagctgcaacagctcatatttttatttcccctgctgggataggagaaaacctaatatattcccaagctgaacttcaattatctgcattttgaacactgcaccaccatagttccagtgctaagtttctgaattctttttgaaagggcttctctaatgcactatggaaatttgtttc

SEQ ID NO: 21040 - DNA, 201 bp, Bos taurus
ttggggttcagcgttggtgtccagggtcttgcttgaatgccctcttctccccgcttgtaacagttctcatactgacaacttgagcttccccactcaactgagtgtttctgaaccctgaaattctttgtgtaattagcctctgattgctaaagattatcccatgtagagaatggaaccaaagcagttgtaaaatgagagctg

SEQ ID NO: 21041 - DNA, 201 bp, Bos taurus
agctaaatattataatgaatgatctcatactatcattttctttggacctgagtcgtgcttgtcccagtggtacccagagctacctcccaggcccctgctgttttcattcaggccagtacctgcaggtagtgttaaggggacaaggagagcaaaaattagtcccttgacacaacctggccgctcagcttcttcaaggaggct

SEQ ID NO: 21042 - DNA, 201 bp, Bos taurus
aatgtgagtgagcctcatccaataaattgcggacttgactagaacagaaaagactgggtgggaagggacgccctctgcccggctgcaggagcagggccaccactttctttctgagaagaaaacaggggctcttctggcgtctccagcctgctagctttggaaatggagtttacagcatcagttctcctgattcttgggcct

SEQ ID NO: 21043 - DNA, 201 bp, Bos taurus
tgttttaattatttattaattccacaaaacattattatagacttcttatttatcaggtgttgggtttacagtgatgaaagagatagatgctatttttacccacatagagcttactgtcagtggtgataccatggtgtcatcccttatcttcatcagcaacctcatttatttgtgttttcagttgacttttttcaaccttat

SEQ ID NO: 21044 - DNA, 201 bp, Bos taurus
gactatggctagggaggaggcccaagccacctggacagactgtccagggaatgttctgggtttgccacagccaggcacagagtgcagttcacactatgatcctaggccctggatacctaaaattctgccagggctgcccctcaagcttacatgcttgggcccccagcctcccacaaaatggattttgcatgttactcttga

SEQ ID NO: 21045 - DNA, 201 bp, Bos taurus
agctgaagaatcatggtggtagtcatctctcagcatctctgcatttgtttattttaaagagatatctcacaaatgtatgtgatacatgggtattttctctcaaatgttttccggaaggagccataaaccatatggaaaataatagaaacaaaagacttctttttgatgcattgaatcagtgtagtctcttgaggagtggtg

SEQ ID NO: 21046 - DNA, 201 bp, Bos taurus
ccctttatagacatagagtcatacagtccttaccgagaccctttaggataacaaaagggtctgatattcaaatgagagtgattttcaaatgaatttcaaagggaagtgaggtggagtggtagggattcccaccctcacaccacctgcccccacagcccttactcttccctctcagccttgcatttcctgtgggaagtttct

SEQ ID NO: 21047 - DNA, 201 bp, Bos taurus
ttcatgcctacgttattattattagccccattttatggatgaagaaatttgactcaggtcaggtaattttcctaaagaaagagatacaaccagaaaatagctgtatctggataccaaatgaggtaacactccagatgccactgttaaccactatgctaaacatacaatgatacaatattatacctttaataaagagctggt

SEQ ID NO: 21048 - DNA, 201 bp, Bos taurus
ttcatagtatatcaattaggaagtgtaaagaacatgaaattatgtgcagaggtaggtacatgggagggttttgggtctaggcctgcaatggcacacttcatttttgctcattccctgtaccactcattggtagatctcagccatgagtcacacgtagcagcaaaaggaagctgctaaatgcctggccaggaagaagaggag

SEQ ID NO: 21049 - DNA, 201 bp, Bos taurus
ctataaaactcctcctttcaaagtgaatcctcaactaaaaatcatcctcttccgattgcctttatctatacttcccagagtgtatataaggtgctgaatgttcaatgctgcatgcttcattgggccaacagaacctgtgaaatcaatctgttcagttaccaaatgacaaatacttgatgatggaatggtttcactcatttc

SEQ ID NO: 21050 - DNA, 201 bp, Bos taurus
tattgacccataactggctacccgtctgatgcacaggggcagtcgtgaagaacttggtagctgttgtagctattctgttttactgaagaaagccatgactattaactatttcttagactgtcaaatgtgggaaaggaaaaagggaccatattgaagaaagagtagcatgtctttaggctctagaatgtggggaagcttctt

SEQ ID NO: 21051 - DNA, 201 bp, Bos taurus
ctcttgggtttgaaaggggattattcacatcaaaagataattccctattcttcactctagtgggttcttagaagatgagacctgtttgctaactggcatccgtagtcaccagggaagagccatattctgatctttgaactttatctgtactttgcctgaaagcatgattgtttgaatggtttgatctgcccagtgtactac

SEQ ID NO: 21052 - DNA, 201 bp, Bos taurus
aggtttctcacgaggcaggtcaggtggtctggtattctcatctctttcagaattttccacagtttattgtgatccatacagtcaaaggctttagtagtaccgaaaggataggagagaaaccttcttgtcccaaagttagtctctggacttcctaggaagttgtcaggcaggaaaagcagcagttgatatgtatcttgtcat

SEQ ID NO: 21053 - DNA, 201 bp, Bos taurus
attcatctatcacctgaccgacattaggacaggtacttcacagtagtgtttgggtctcagggggcttgcttcagtactgagtcagtacctaataactctcattaaatttgtaaatgtctacagatcccttcaaggaaggcttggatgaatatttataatatacaccaaaggttgttgagattgtcctcagatggaagggag

SEQ ID NO: 21054 - DNA, 201 bp, Bos taurus
gcgttttgcttacacaatgcttaaaaggaatcttgagtcctaaaaggaatcttataaggagtgttctattattatccactgttattgatgaaagacctgacgtaaattaagtaacttgtgcaaggtcacaaaattagtattttgaagagctggaatgaaatctaggagtttggatccagaatatgttttcttaaccactgt

SEQ ID NO: 21055 - DNA, 201 bp, Bos taurus
agaatactggagtggattaaactatccacataatctaaagaggcccaccaggcaatgtgctttcttcatggcaagagatgagagatgcagtgatttatttcttacttaagagagaatggccctccaccatcaagaccccttgaattctaaatgttacagatgtgagtggcctctacaccacaatagagcatctttcacact

SEQ ID NO: 21056 - DNA, 201 bp, Bos taurus
aactcctgcaattagttgaataaaataaaagagatggaattacatttgctctccaggtttgtaaagccctatccattgaacagaactgagaggagttacatagagatgtaaacacatacattaatttaggtattgccagggctactgtgttgttcaactccactgtacagccttcacgtaatgcttgtggctcagggtggt

SEQ ID NO: 21057 - DNA, 201 bp, Bos taurus
caattcctaaagtcctgaatttaggagtgaaatcatgaggacaaataaaagagtctaaagaattaaggaagatatagcccaagaaagacattgtgaatggcattcaagtgtttggaatttattctcaaggctatgggaatcaatgaagttttcaagaaatgtacatctgaagagaaatgttacagcttccatgtggcaaag

SEQ ID NO: 21058 - DNA, 201 bp, Bos taurus
taatatccaatcacatggatgtgtaaaataacagctactgaggcaactgcccgtttcatatcattcaggctacattccataaaatgatgcgtgagaggccgttccaaatctaatgccaaggaaacaaaaaattttgctaccccttaccaacatctattcctcctgactaaaagactaacagatccatcacctttctctttg

SEQ ID NO: 21059 - DNA, 201 bp, Bos taurus
ggaaaactccatggacagagagcctggtggggtcacaaagagtcagacacaactgtgcaaccaacacaacacacactgactaacccctccttgccacttctactgcctgctctctggccatccctactttttatctggatctcctaacttgccttccatccttcagtccccctctccaaattcacccttcgtatgccacca

SEQ ID NO: 21060 - DNA, 201 bp, Bos taurus
aacatggatgcacctagagatgatcatactaagtgaagtcaaaaagagaaaaacaaataccatatgatatcacttacatgtggaatctaaaatacggcacgaatttatctacaaaacaggaacaaagaacagacttgtgtttgccaaggggaagaggggtggagaaaggatggattaggaggttgggattagcagatgcaa

SEQ ID NO: 21061 - DNA, 201 bp, Bos taurus
aattcctattttcccactgtctctgaactcaccacaacagagtctgagaacagactcagaaaagtaatagattggttggaaaatccaaccagaacagtgaggagagcaacacttcaaaatctccaaagattctggttgggtgtgagcataaaagagcaacagaaaaacaagtgccacagcgtacagtttaaggtttaagtt

SEQ ID NO: 21062 - DNA, 201 bp, Bos taurus
tttctttaatgtccctccccacgccctgccaagattatccagtcattcagaatgtctgcctaaaacaccattctaaatccacatcaagacctaagaaaacgtaagtttcccagagcctggatcacagctgtcatcacaccattccctgctcagaaacctttgtgtgaccacttgttgccaaaggaacaaaacccattctcc

SEQ ID NO: 21063 - DNA, 201 bp, Bos taurus
gataggccttgaggctaagttatgtgtgggaaaaggggccatgaaggtgttattctacccaacagattagtaaaagcagagagtgaactagaaaagaaaggaggaatcagaagtggggttgtaagtgactggcacagtcagcaaaatcagtcttgctcatttaggttgtctcattactataatacaataccagcccccttt

SEQ ID NO: 21064 - DNA, 201 bp, Bos taurus
gacctcgtcaccatccacaagtccaatgtccacacagatgccagagtgatgcttccaaagcacaaatctgaaaagtcctgacacttcatgcagcagacaacgttcctcaaaaccgaaccctgccttcctctctagactgacccttgtctctctttcaggagccgcctggaattggtgttctaggcatactggcagctcagt

SEQ ID NO: 21065 - DNA, 201 bp, Bos taurus
atcaaagtgtagcctgagaccacatatgagccctacctgggaattggttagaaatgcaatttctcagcctccccaaagacttaagaaccagaactcctgcggaaggagtccaacaatccattttaacaaggtgactgtgtgatcctggggcttcccttgtggctcagctggtaaagaatccacctgcaatgcgagagacct

SEQ ID NO: 21066 - DNA, 201 bp, Bos taurus
gttgtttcgatgcctcttaggaaaggttgtctgcccatgtgtcccttcatactatgaagagattatggaacaagggaaagtgcttgttcagcccttgacacgcaaagagcatccccacctatctcattccagacgccactgcatagcttttggctgagcagggaccagctcacatatggttctcttcaatctcaatatctt

SEQ ID NO: 21067 - DNA, 201 bp, Bos taurus
cttatctatataccagtgctccagggaacctttgcaggccattctacctgttctcggttcaacttctcctctctgttctgaactcttcagttcccttcctattgctttcaggccaaattcctaagtctctgtttgcccctgtcatagtgagacctgaattgaatgaactgtctgcttcatcttggtttatctctggttagt

SEQ ID NO: 21068 - DNA, 201 bp, Bos taurus
tttcctcaattaaaaaatcttacgtttccagcttttcctttcattccctttttatcattattgtaatgcatcgtgatgaggcttcattcttcttctaatgcacgtaatttccattcctttagccagcttaaacaaattgaggtttctaaattaatcaacccatgtagtcatcagtggggctgtatttttcttaattcgtta

SEQ ID NO: 21069 - DNA, 201 bp, Bos taurus
tataaaattggtagttgatgggatttttacataaatctatttgagtgactctgaagtctgaagtgaaactgaaactgtgtgacaaaagaaacaactattacagaactaagagtgacttacaaaggtaaagttttctagaatatttattttgttactctgaaatccacatagtattgtgtgcctgctcaatacgctctgttt

SEQ ID NO: 21070 - DNA, 201 bp, Bos taurus
aagtcttcctccacatcagacatgaagagaaacctgagcttggtgaggggatggagaactgatgagagtggagtggggatggaaggcctcccttgggggcggctatttgagctgagagccgaatgtagggaggtcagcagccacgcggcgccctagagaagagcactccaggcagagcaaacagcaagtgtaaaggccctg

SEQ ID NO: 21071 - DNA, 201 bp, Bos taurus
ttatgtcagtgtggacttgggaccactctcttctttttaaaatgtatgatgcaacatatataagctgttcacacaactcaacatcaaaaaaaaagcctgattaaaaaatgggcagaactaaacagacatttttcaaaagaataaatgcagatggccaacaggcacatgagaagatgctcaacattgctaattatcagggaa

SEQ ID NO: 21072 - DNA, 201 bp, Bos taurus
tatctttagatgattttctttttcttctacttttttgtatttttatgataaaagtttattagttttatataaagatattcttcattatgagcaagaaatcgaagctcagaaatgtccagtaaatttcctaattccatttatcttgtaaatggtggagcaaggattccagtgcaagtctttctgactcaaataattttttat

SEQ ID NO: 21073 - DNA, 201 bp, Bos taurus
ctgaaatcacaaactgattttcttcgagttactgagagtccatgtggttcgggtggctctggagaccgtgtgttaccagatgtggccaatcccaggatctcgcacaccatgccaactacaatggagtatgtgaccaagccggaccaatcaaaatcagcctccttggccaggaactatccaaggagcctctccaccccactc

SEQ ID NO: 21074 - DNA, 201 bp, Bos taurus
ttgtgctaaaagagacagaccaggaaaggcacagagatccctgaaaaggctaaagcaattcttgcttatgcttttggcaaaataagatctgcactggcaaggtcagtattcccaggagtctcggctttgcagatggttctgccctaagctataaactgaataaggttgttattaatcttaagagtttccaataaggctgtt

SEQ ID NO: 21075 - DNA, 201 bp, Bos taurus
ttttccctttttaaaatattcctctccaagtaaaagatagccccttcaaggcaaaaataatagtgatacaatttttaaatcctatttcttccatactaaaatgtgggaggaaatggatgtcactttgcttatttttccccatggctcgtacctctaggaaggatttcccatagaggtatttgtcaaatgattaatacctcc

SEQ ID NO: 21076 - DNA, 201 bp, Bos taurus
actggaggaccaagcaacaggcatgaggtggcttacgctcaaaaaccccaactctctgatgccatttagggagaaatttttataggtaaaatttggggtgggggctatagtgtgtgtgattctcttctgattgtttggtgggtgagataacagagtggttccaggaactttgtgctcagcctgaagttaccatcctccacc

SEQ ID NO: 21077 - DNA, 201 bp, Bos taurus
aagcaagaaacttttatattttttaaacaaagaaacaataaatttatgagcaattgacaagacaaagaaacttaggttttgggtgctcaattagtgaatcttctaaagagagtctgggctttgggtagtaaattaaagaggtgacaagttttatttatacaggcagtttggtgccaattctctgtctctggtgataaggcc

SEQ ID NO: 21078 - DNA, 201 bp, Bos taurus
cacaagagagtcagacatgacttagcgactaaacaacaacaaatcaggacatctacagttgtaattatattttcttggaatacactttctggcactcatggacaacaaaggcctcttgcagacagcccactgctagctgctggccaaagccagctacaaaaggccagtattttgtatatccagacatcccagtgcctcata

SEQ ID NO: 21079 - DNA, 201 bp, Bos taurus
gtcccatcctctagacaaagtaccccatgactctgaatgaaggagatgtaactagcttttggtgtggaggctatcaattagcgagaagagttgcatttgtatcatatcctaaaatagagactcttagtaaaaaatatggctttcaattctacaaacatttattttttactttgccacaaaaaaagattcgatagtctgaga

SEQ ID NO: 21080 - DNA, 201 bp, Bos taurus
taggcctaaaatgttttcgtctagtttctgaacgttggctctaatttttgctcttgggtctgagcagcagcagagtttaatctactttcttacaacagtccttcatcattaaatattttctcctttgtggtaaacatcctgatttattcaaaattacctcaaaagccatgtgttttaaagcccctctccatctttgttgct

SEQ ID NO: 21081 - DNA, 201 bp, Bos taurus
aaacccaagtctctcacattgcaggtggattctttaccatctgagctgccttgttcttttctctctctttctctgtctacctaccatttcccaaattcttttctctggcgcagagtgctagaaagagtattagatgggaagcaagaatgccttgggtctgcacattgctcaaccaccaacctaactctctggtcctttctt

SEQ ID NO: 21082 - DNA, 201 bp, Bos taurus
caggtctcctatgtagcttcttctccaatatcttctttctcttcctcctctcatgcctctgacacataaccaaaatgatcagtcaaggaaggcacacccaaattaccttaatatccctggtctaaccaagctaacatcttccttgtcagtgttactcaggactgtctgagcacctcagcttccacaatagacctggtcaac

SEQ ID NO: 21083 - DNA, 201 bp, Bos taurus
cagaaatgtatcagcttatgtgaaatggtgatgcgtgaactttggatacctgtctgttttgtgtatttagaattaactctagctggagaatgctgaaatatgtgcttcttctctaatataccaaagtttatggtgcttaagagatcctgttagatgttcactgaatacaagatagtttagtctgtctacatggtcataaga

SEQ ID NO: 21084 - DNA, 201 bp, Bos taurus
tctttgacagctcctctaattctaaaattctttaaaaaatgctgttctgtgaagttttccctcattcccttaaccaaatcagcttctttctcactcatatccccagtctacattgtccatacttccattatcatttatcatatggcattactattgcaatttatcactttgtttattttatttcagcttatcatgttattt

SEQ ID NO: 21085 - DNA, 201 bp, Bos taurus
tatgtcaggtagtatttatccttcagagcaagacttgtccaggtgtctcatcatttagagtccatgttcaagtcttcccagttttcaaatgatacgattatacatttatgcttattcactgacttaaaatcatctcaagtacatatctcatatgtctacataccctcttacaatgccttatagagtgccaaacacaggaaa

SEQ ID NO: 21086 - DNA, 201 bp, Bos taurus
atgctgcagtccatgggatcgcaaagaatcagaaatgactgggtgactgagtaattacaacaatagaaataaggggaaagatcctttagagaatgaagtccgcatggccttgtacctgattgagttatagggtgaaaaagaagaggagtctatcttagggtcctggcagggaacagatgtgtgatttgaggggatttaagc

SEQ ID NO: 21087 - DNA, 201 bp, Bos taurus
cctctgcccaggccaggagccaatgcctccgtttccaggggcagtcaaggaaacgtgagtggaggcagggtaggattctaagagtgggcttgtgctctgggactgggtggccaaggccactcttccacccaggatccagccttgaaaatgtcaagtttgtgtttctgggttgcagattgacactggggaatatcttgtgtt

SEQ ID NO: 21088 - DNA, 201 bp, Bos taurus
aaactgatggtgaaaggtacaaattatggggacccaatcaattttttagagggaagctttagggaaaacctttcaatgaacaagtaaagttgattcttgaggcataaacagaagatggacaggtaaagaggtgggtaggggttaggactacacactaagctttgttattcacaagaaactgcaaacagccagcattgttgg

SEQ ID NO: 21089 - DNA, 201 bp, Bos taurus
cttgtccttacagccacagaaagctttgccttagggagaccagtctaatggcacagctttcagtggggaggagaggtggatcagtctaacacaaagcacccgcagttccacaacaacttaggcagagtgttgggagaagacacataatctgttttcctttattggcattttttgtttaagtatgaaaataacatacttatt

SEQ ID NO: 21090 - DNA, 201 bp, Bos taurus
ctatttacgtgttcatggttctgcagtgtggtcagagctcgatggagttgagtcatctctgctgtacacagtactaactgaggcagcttcactagggctgggggctccaagatgggtttatttagatgtctggtgttgcaggaggggaggctaaaatggcgacaagtcagctggtttctgtttctgtggcctcgcatcctt

SEQ ID NO: 21091 - DNA, 201 bp, Bos taurus
agtctgtgggccctgggcagagcctgggtacgacactagtccctgctctgccagtccacgtggtggtcatgagggtctcccaagaccatggttcctggcccctacttcagagactaggatataagctctgtgaagtcagggactgtgtctggtttgttcaccatggaacctcctttgcctaacatagggcctaccatgctg

SEQ ID NO: 21092 - DNA, 201 bp, Bos taurus
ccctttttccctctcaagcctcatctctcgccatcttcctgtctcaaacctaacactccagctactccaaactgcacacaccatgttgctcccaacctccgagctcgagttgttggcccgtgttgttttctccaccatgttgcttcctggtccctacctgccttacccctatttattttaaaactcaactcataccaaaac

SEQ ID NO: 21093 - DNA, 201 bp, Bos taurus
gagctgggagaatgtgctggcatggccagcccaccagttcctaagcactcttacctcttcatcattctcggtgaagtggggcccatccactttattcacagccatgattatggccaccacatccttcccattcattatgggagaagccaagatgttcttagtctggtactctgtgagggtgtccacaaagtcacagaaatg

SEQ ID NO: 21094 - DNA, 201 bp, Bos taurus
tcatgttaagattttttgattgctggtatttaaaggaatcaagcctgaaaccaaagccaaaggaatctgctttcttgctcaaaggtttggttgatttagtcgattaggtgatattttatacactttattgacacaaaatgtcttgtttactctgaactttagagtctaactgaggcatatttgtattgcttattgatgaat

SEQ ID NO: 21095 - DNA, 201 bp, Bos taurus
gttccagtccctggagaaaggaaggtccctctggcagaagctggcgggtaggggtctttctcaacaaagtgatgaatctcttttcccgtcatcctatccacagctctcaagatcttgctttgttaacatcctggttcccactgagatcctccaagacacccttgggatggagcccttccttttccagataagaccctggga

SEQ ID NO: 21096 - DNA, 201 bp, Bos taurus
cactacatccccacgggattcatgagacgattatttctactttccagattcgacaacttcagagatcagaggcccgggatgagactgcccaggaaataaccggttaaggtgggaactcacatcagaccaacttattacccgacccttccaaactacggtgtgctgccggttaaggtagttgtggtcgtggcgcggggccta

SEQ ID NO: 21097 - DNA, 201 bp, Bos taurus
ggaagaagtccatgcatcataggatattctcacgagagtgaagagacaacctagagaatggcagaaaatgtttgcgaaccataggcctgcaatgggtttaggatctggaatatctaaaggatgccaacaccaccattcacagtggtccaaaaacctgaacaggcctttctctcaagaaaacatacaaatggccaacggcac

SEQ ID NO: 21098 - DNA, 201 bp, Bos taurus
ggactgcagcactccaggcttccctattcctcaccatctcctggagtttgcccaatgagtgcaactgtctggtgggcaaaatctctacagatcaacaagtcctcactccagtctatgaacaggctttccggacagacggcaactcttaaaaggtggtagaagaagggggttcctccatctccctctctctctcttcttgcc

SEQ ID NO: 21099 - DNA, 201 bp, Bos taurus
ctttctgcctgttgctggattctcacctgcacgggtctgtctcttccacctctgccttccggacactgtttcctctccgctgcttcagagacctctgcctcggcctccacactatctcctctcccgggttctgctggatgaggactcagcccgccactgctggctgacgcttttcttctgcccctctgctcagctgccttc

SEQ ID NO: 21100 - DNA, 201 bp, Bos taurus
ccctgcctaccctccagcctcatctctcaacacttcctataccgttcctccccacccaacacaacacacattctaataaactgacccacagtaactgctgtgggccaccaggatctcttgaacctatggctgcctttgtgtatcctcttctccccaccaagttctctatggacttgaacttctcattcttaccctccatta

SEQ ID NO: 21101 - DNA, 201 bp, Bos taurus
ggtcttgtgaactgtcatggcgcctctgggtgtgtcatttcatttgctgattgaggatcaaggtctagtcttgtctgccatcttggtcccatttggccacaccccctcccccacccatgactatcttctgattagtcagtggtgaggtaatgggatggttctagggaacttgactctcagccttaagataccatcctcctc

SEQ ID NO: 21102 - DNA, 201 bp, Bos taurus
tctcctgaagatagacttgcatctgcattctccctgcctcccctcccccgccacctcccatctcttaccatcaaaaccttttttccaagaccttgttcaagagcttttttttcctccttaagagaaaagatgtcttaagatgtcttaggagaggttaattcattaccctgggggggttggtctgtccagaatttgaagtaa

SEQ ID NO: 21103 - DNA, 201 bp, Bos taurus
gcttattacccaagaagccctagacactggaatgtgctggaggggagaaggagagatcttggtgacagtggagtttggcaattcagcgtagtttggtgcaatgcatttcatttgctattaaactgccctgcttatgttttttttgcctatgtcatattccatttttatccctgaaaatatttatatataatgagcatacca

SEQ ID NO: 21104 - DNA, 201 bp, Bos taurus
cacatacctttgtgccttgggacctccttccgtgtctctgtcaaactctgcctgcaaaagaggatctttcattagtctttattcttgagcatgactgccagcctgtggttccctctccccgaaggatttgcattttaacatctcttggggaaaatattcattgttaaagaaagaattaatgataggtgaggaagggacttc

SEQ ID NO: 21105 - DNA, 201 bp, Bos taurus
ctgatggtaacagtcattggatgtttgccataggctcatccacagactgttggagtggcaagaaaccatgggtcttgtctagctcaaaccccatcctttacgtataaggcagctgaggtccagagaggtctcttgactctgatatcttctccattcctgttccaaggccatcatcttcaaggtgaccttgaaaggagaggg

SEQ ID NO: 21106 - DNA, 201 bp, Bos taurus
ttctgggccttcacagccagatgcagaagaaacaaggaaatgcatcaggatgggtggagataagtacaagctgggagtggaagaagttactcccagggttccaaggcaaaacactggtatagcatactcaagcatttaaagtctagctcagaaatgtagactgcagagcaacccaccacatctgtttacacatctgtgctg

SEQ ID NO: 21107 - DNA, 201 bp, Bos taurus
gtaaagcaccaaatgcagccttgattttaacctcccttttcctcacttgctctcctgcaatggccaagtaagatcacagccggttaagtacatctttgcttcaggaggtctgcttgtcgcttttgaaaaaggtaaactatagtccttgaggctgctttattgctcagagactgactacaagtttgcttgatggcgaagcag

SEQ ID NO: 21108 - DNA, 201 bp, Bos taurus
atttgtagggatttgaggggatcagtaggtagtatctaccttttcctctaagtctaagccaattctgagatggatgcaagaatcagaaaaattactgatgaaagtcaggttgggggatttgactgagagataaggaagcaatggatgtcctaatactgtatccaagaacagagcattctcagaccaggagaggatgtccaa

SEQ ID NO: 21109 - DNA, 201 bp, Bos taurus
gggaagaaacaaactcctcccatgaggccaataatgatgacactcaagattgtggatggcgagcttgttccaaaggtaccgttgggcatgcaggctgcctcgcagtaaatcacgctgcaccaggcctcgcagcacattactggctggcttggtgtgttctctgggggaacaaggacaacagatccaggaagtgaaaagcag

SEQ ID NO: 21110 - DNA, 201 bp, Bos taurus
tgtatataaccccagttccaccatctcagggatgtttagcgtaatgggtccttggccaagttattttatatatgtgtacttccatgtccttatgcagaaacatatggattattcttatatcacctattcacaaagcttttgtagttctcacaatactttgggaaaatactttgtagctcccaagatatttttgcagtttat

SEQ ID NO: 21111 - DNA, 201 bp, Bos taurus
gttagaggtttgaggagtttggaacctatgtttataggccaaagattgaggcaacagtggaaagctgggaaggagtgaggagaatatcagattaatggggtaggaatttataacatgaataggttctaatctattaggggatggaggcagacagaagtggagctcataaagagagctctaactagcctggagggagactgg

SEQ ID NO: 21112 - DNA, 201 bp, Bos taurus
actgtttcccataaaaaaataaaataaaataaagatgtatacaaagcaatgcatagcacgagcatctactactctttctttgtgactaatacccctgtatctcactctgtctgcctttagccactcattcaagagcttcgctttgtttgttttggccacattgcacagcatgtgggatctcagttccccgaccagggattg

SEQ ID NO: 21113 - DNA, 201 bp, Bos taurus
agatgctatgttacaagagttggagcacagcatctctggagcaacacagtagaacctgctgtctaagttattcagaggaggttttacattttaagtctcagaagtggatgagtgggaaactccatgtggcaaacaaggacacgtgcagcctcctcactctcacagacattagctctgggccgtctgccacacacacgtcac

SEQ ID NO: 21114 - DNA, 201 bp, Bos taurus
caccaaaggtgactgtaattctttttactagaaatgcttctctttctttcattggtaacactaacactttgagatactgatataatcattatcgattttgctatcattcatcatgacggccttaagagaggtcagttccctatttctttacaatagcaaagtcaagaaaaacaacactgcagattatcatcctttttatac

SEQ ID NO: 21115 - DNA, 201 bp, Bos taurus
ctttaccatgttggcaatagatccttgtgtgcaatcttaggactgtgaaaatcctcagaatcagaatccattttttccctccatattttatctttctacaaattcctttttatacctaatggtttgccagccttctgggaaactaattttattggcaaaagtctggactgaataaaagacatcttttaggttataaataaa

SEQ ID NO: 21116 - DNA, 201 bp, Bos taurus
tactggacacataaggaggccaatgtaagcagggagtgatgccatcttagttacatgacagaagatctcttggactacacctggataaggaagtgtcagggttacaagagtgcctccagagtggccaggaaactgctacaatagacccagcatggatgatggtcgttttcaaagcacagttccctctctgaaagcaatgaa

SEQ ID NO: 21117 - DNA, 201 bp, Bos taurus
ttagatatacaaatataataatttgatcagagttaagatctctgagacaaaagggaacagtcaagagcatagtggattacagtaagaaaatccatcttgatttgttaatgtattagagggctcattgatataagaggtgttaaggggtagagaatgccatacaaagaagagactggttagacagatgagtgctggacttcc

SEQ ID NO: 21118 - DNA, 201 bp, Bos taurus
tgaattcaaactctctgataaatgaaaagcaaaatattttttaaaagagccccaaattaaaccattgaggattatttaccataagttacacaacacattccgcaatctactcttgaataagatacactgcatcacaaaatactgtaaacagtgaaacagtaatagctgggtgtcttaatttgtgaccttaagttaatttct

SEQ ID NO: 21119 - DNA, 201 bp, Bos taurus
ctaagaagaacatagaaaacctggaaatatggaaggaaggtgaatagggaggcttgttggcgggggtggggggagagtagagtgctagtaagcaggctttcacggtttgtttcaaaatgcacattctgcttacctcttgtggggggtagtatcgctttataaagttaagaagacaaaatgtgtaaatactgggaagaagaa

SEQ ID NO: 21120 - DNA, 201 bp, Bos taurus
tgtcaaatgcatcaaaggcggtatgtcaaagccaaaacaataggcagccatcaagtgagagactcttgccattttacagatgagcaaacagaggcccagaaaggagatgaacttgttccccaagttggcactggggctggtggctgccttccacttaactagaactgacacttggtaggtagcctgtgggccagatcaagc

SEQ ID NO: 21121 - DNA, 201 bp, Bos taurus
agtcacttgctcttttcttatctccccgtcttcttcttccctcccctccctccccacttctttactttctacttttcccagaaactgcctctttttttagcagtaattataaaatctcatattcttcaatgtcaaagaggtttgagaagctttcttatacaatcctctcactagttttgagaaatctgtgtgctggaaggg

SEQ ID NO: 21122 - DNA, 201 bp, Bos taurus
tgggccccagggccaaggtgaagagaggctctaggaagctgagaggaacccaaagtcaaagtatatgcaacacggacacatgactcaggggcttaacacggctagtcctggcaaggcccttggcagtctggtcccccaccaccacctccaactctggcacacccgtctcagttgtactggcttttctggactttctctaag

SEQ ID NO: 21123 - DNA, 201 bp, Bos taurus
aagcaggatgatgagggctgagcagcttgtctgtgaccccttgaaagaaccccagagagaaaggaaatctggctttgaagacaaagttttttatcttttgaaagctgcattcctatacacctgcctcctgtgggctcaggtgtcttgcctgacccagtgcctggtttggggtttttttttttactttgtatttggtattgg

SEQ ID NO: 21124 - DNA, 201 bp, Bos taurus
ctggaatgaatagacctctagctttgctcccgaggagcaccatggagagacagggacagatgtaccaacaactagaccatggggccagtgggaaccaacacgaggcactcagggtcagctggcagcctagtggaacacggacacacacagccgtggccagcctgccccattccaatcctggctccacagctctcctgcagc

SEQ ID NO: 21125 - DNA, 201 bp, Bos taurus
aaatcaagacaataggttaaggggaacagatgaaggggggagctcatcaccataacaacaagcccaacaactctgaaagatggaattttgtttttcttttcgcctgtcattcttcctggtactgtcactctccttgctcctgttggaagacaagttgtgagttcttcactcccaccagcaagctgcctggctctgggaagt

SEQ ID NO: 21126 - DNA, 201 bp, Bos taurus
tagggaggacggtacccaataaataaataaataagaaaggactgtccccggaagggaagggtgtcaagtgaatacaggcatggaggtgccgatgaaaagagcctgggccttgttcactcagctgtcgttctcagtcagagtccgctcccaggaagactgctgctgaccagaggcgagccgaccactgggagctggcagctc

SEQ ID NO: 21127 - DNA, 201 bp, Bos taurus
taagatcttttatcaatttacttatttatgttacataaataaatagcacagtcagctctgacagtcatcttgcaattggtcatgcagtggcctgatcagcgtcatcttgattgccttaagtatagtcagtctttagttccagggttggtttgttcccacttctttgaggccaattcttgaaattgtggcagcttatgtcat

SEQ ID NO: 21128 - DNA, 201 bp, Bos taurus
gacaaggaaaccccagaacagtgggcagggctccccttgccctgcctttctgcaatgctgccttggggtgcttgccacagtaggtttgatgaggcctaggggagctaggaggaaagagaaagaaagagactcaaacccaactctatgaagctaaaaagtcaccagggcctttttctcccttaaggtttgaggtctccctcc

SEQ ID NO: 21129 - DNA, 201 bp, Bos taurus
tcaatgagcagacaaaattgttgtcatttaactgtggaacctattttcaccctcaccccctagaaggagaaaaatctctctaggtgcttttgagagttaccggccagtcctcaggaaggcaggactacctgtgacttcccggtgctgatgctgaacctggggaaacaacacagaccctcaggagtcctagtcactcataca

SEQ ID NO: 21130 - DNA, 201 bp, Bos taurus
gactgccatgaccccggcccctggtgtgcctcctgccacagagtgcatgccaaatggttgagtcaagagtcgacttagaatgtgaccattggatgagaaagctggaggaacaggatcccctggccacttgtccggctccatcttcctgacccactccagcccagatgtggaatttctgtgggtgtgccagaaatctgcatg

SEQ ID NO: 21131 - DNA, 201 bp, Bos taurus
taatgcacagctctgagatctgcactgactatcagcccctctgactgtgaactcgggtggcacacacttgtgcactattctcctctctgtctcccaagcaccgtctgcacttagtgctttatctgtgtccttcctgagccccaagcctctggggctggggctggccgcatagctggcagtgtgaaggggtggacagaacag

SEQ ID NO: 21132 - DNA, 201 bp, Bos taurus
tagaaaatgggaggagaagaggcatgggcttcataaagctctcaatctggacagccatggactcctgcatcaacaatctggtacctaaagctcctcccaacatccttgtctggcctctgcttccacagtaccagcacatgggggctcagtactgccctagacaacccttttactccctagtcagcactgcctgtgataaga

SEQ ID NO: 21133 - DNA, 201 bp, Bos taurus
gcataccaaaggtgctcaatagatgaccctcactgactgtatgaaggggatttgcaatgatgtgcagacaatgctgataatacagtgttaaaaaaaaaaataaagctgtggaatgtgcagtatagtctcagctatgtaaaaataccggagaaggcaatggcaccccactccagtactcttgcctggaaaatcccatggaca

SEQ ID NO: 21134 - DNA, 201 bp, Bos taurus
caaaggctgtccgggtgtctaagaaagtaaagggtggaggctttttgggttaaaggcagggtttatgcttactgttttttgggtgatttaaaagagcatgtattcctttatttattcactcatcgacaaatacgtatctactatgcaccaggcattgcagtaagtactgggattatggatcaaggcagacttggctgctaa

SEQ ID NO: 21135 - DNA, 201 bp, Bos taurus
tttcacacattctgaatgatttctgtaaaaaatgtctctcatcctagctcctagggcttcccagaaaaaaaggaattcttcgaaggcctgagagctccacctgtagccaagaggacttaatctcctctggggcagtgattgctagcattgtagctaaatgcatctgaggctggcctctgaccaccctgagtaagctggatg

SEQ ID NO: 21136 - DNA, 201 bp, Bos taurus
gaagagggagagggcccagcagtaccgtatgagatggaggtggtgcatctgggactgagcacaagtaggactagtgagtacaagtaaacttcaacaagtagcccagaagtctatgttatctgtcagtgttgcactaggaccccttcctcagcttatacctctggccacatgggatttcctttttttttgtcctctggccat

SEQ ID NO: 21137 - DNA, 201 bp, Bos taurus
ttctgtatccccaggattaaagttgtacatcacaacacatttatttaccccctccccacttcacacttttcctgacatctcctgtatctgaggaaatgtgtctaactcaagggatgactactggaaagtccttgttctcaacagagtttgctttcatgcctacaggttctgtctcagacgttgggggcgaaatgaattcca

SEQ ID NO: 21138 - DNA, 201 bp, Bos taurus
actctcttctgagcctctgatacttcctttctgtcctggctgatctcccagctagtgaaggggcttctagggtgaaggaacctttcctctttcacagctctctcccagaggtgcaggtcccatcccaattccattattttccctttttgttctacccggttatatggcgatctttcttgcacctttgattgtatgaaattt

SEQ ID NO: 21139 - DNA, 201 bp, Bos taurus
atattctcatagcataactataccctttagcagacatggccatctttcaatcttgccagcccatttccagtcaataagtgaccggatctctgttgtaagaacaggacacttctaggtttgatagccaggttgtctgcaggttcctgcactttgtctctgaatttgccctcagaattctttcctattttgaaatcaaagcaa

SEQ ID NO: 21140 - DNA, 201 bp, Bos taurus
gtttatttttatgcccactttatactcagcattttggaatacttccccaatcttcaagaaacatactgtgttgagatgctcaaaaaccttttaaacttcagctgtctttccttttactcataaaagatgtgccaaggtcttatgggctttaaaaaattaaagcctaaacaattccaaaggatttctataaatgcaaatgct

SEQ ID NO: 21141 - DNA, 201 bp, Bos taurus
attaaagtcagacaccaagtgagagtttgaacttatttctttataattcttaagaatgcattggttgggatacactgcatctccctggtccctgcattcagttatttttctcactggcttattcttcagtttcttatgagctttgtttctataactcatcaatggacacatgcagataaatctaggaattaggaagcatca

SEQ ID NO: 21142 - DNA, 201 bp, Bos taurus
accaaatcatatcttccctctgtctcaaccctgctcttcctgttagattttaaaaggccaaggctttagtttatgaggctctttctagtcttcaggtctactcccctgccaccacattttacctcattctttctgtcccctctttctgtgactcctttcatttcctctaaacctgtatacccacaactctagactttgcca

SEQ ID NO: 21143 - DNA, 201 bp, Bos taurus
atgcaaagatcgtttcattaggaaaatctcctttgtaaaaagagtgataaagggagagagctttgattgcaaaaaacaggaaacgagggccaagagcttacccatcagaacacatggcaattagacatttgaagacagaaagtggaggggactaagggcagcaaaggacaagaataaatcaggaaaataagtgaggcccag

SEQ ID NO: 21144 - DNA, 201 bp, Bos taurus
atggagttatttcatatgttcatttatcccctgcatttcatgtaaactacgcttggaactggaggctttatcagttcaggttcaaattggaggcttatttggaaggtggtccacagattgcttattgctctattttagaagatatgtagtgtcagtttgtctgtctttttgttaagattgctcatcaggtttttgattatc

SEQ ID NO: 21145 - DNA, 201 bp, Bos taurus
gaaggacacagatgtcaatggatcattgtactgctgtgggtaaatgctgtgatggaggtgctcacgaagtgtgcacatcagagaagggcccctagacccaaaaaagacatctgaccaaaaccaaaggactggagagagaggcagaagggttaggaagagccttgttggccaagggagggacattagtgaaaactgaaaagg

SEQ ID NO: 21146 - DNA, 201 bp, Bos taurus
gtggcatcaagaaaatatgaacaagcatactaatttttggtccattaagatcgtatctgatattttcattttcctggcccatgtggtcaatgaaagtatgccaactctcaactttcatgtcgtacagagagtcaaggaatctttgctgatgctctgggcctctgtgcagggagtcatgtcttcatgacacagctgaggagc

SEQ ID NO: 21147 - DNA, 201 bp, Bos taurus
tttcatcatcacgctccagggtcaccctggccagctcttgtgctgggacaggagattacaccgtctctgttcaaagagggggaaatgtgcctgtgccttacgtcaatgcactcagcaaggagaagcacatcctgtttatcttgttgttacctgtagtttattttgggtgattggagggaaagggtaaaataatgaccggta

SEQ ID NO: 21148 - DNA, 201 bp, Bos taurus
ggtccagaggtggaaacttaggaattggacttggcagagaaagccactcccttcccagatcagatgattgcttcttttggcctctcattacttcccaccaattacaagattgttccaacattatagacaatagttttaagttccttatttttggccatgcagcatggcttatgggatcttagttccctgaccagggtttga

SEQ ID NO: 21149 - DNA, 201 bp, Bos taurus
tgaataggtaggcctggtgtgctgcagtccatggggttgcaaagagtcggacacgactgagcggctgaactgaacctggaaggaaccaactcagctgggagctggtagatgtggcctcttgctccccagccagcatggcctgagaattaaggtatgtgagtaggaagatcaacagagatgcagtgaggagaggggatggga

SEQ ID NO: 21150 - DNA, 201 bp, Bos taurus
caacctcatcccttgaagaaagaaaatgcttttctgttagaaaaaactgatgtcagacattgtgaatcaaagaattaccagggcaacaaccctttacaagatgagttatataatacaaaactgaacaatttaaactctagagcaaaagagaaaacaatgatcagaatgaaatctaaacaatatattctctacctactttct

SEQ ID NO: 21151 - DNA, 201 bp, Bos taurus
tcacccctggcaacacaggaagaagctgagtgaaacggcaaatacagcgataagccctgtagcctcaccagcatgttttcctttgctgtaaacagagaagtgggtaggccttctccagagacccaagttggggctgacctggacttctctgctctgagctcaggtcccctgtgtgagagaagctgcaggggatggggcttc

SEQ ID NO: 21152 - DNA, 201 bp, Bos taurus
ttacagcttttaaaagtcttacagggcccacaagccccaggctgggagctcttgcttcacacaacccttatgtcttatccctaaagtcctgagtccttgaatcacctgagatgagccatgtaaggcccaccctgacccttttcgctgtgtgtgtgtctgtgtctgggttcggggatggggcagggatgggaccagggtgag

SEQ ID NO: 21153 - DNA, 201 bp, Bos taurus
gagaagacaaaaagctttccccacccttaaccctgatggattggacacagctgcatggaatgctgcatcattgaggcttctgggccctttatctggattcagtgagaaagagtgccatgacttattatcaatcactatcaccaatatcaatggaagggacagcagaggcccatgtagcaggtatctaccatccttgacact

SEQ ID NO: 21154 - DNA, 201 bp, Bos taurus
taagatctcctctcagaatagagcagcataactgtttaaaaagtgtttttagttgtaaagaagttcaggcatagtaagatatgtatctgtctgaaaatatgtatttgtctgggttggctaaaagtttatttgggtttttcgaaaaacccaaatggatgttttggccaaccaaatatatagcccacttctccatcttctgtc

SEQ ID NO: 21155 - DNA, 201 bp, Bos taurus
tagtgccagactactgttggcaggcagagctgggtccttgagtctggctgcagggctcagggatcctacagctagtatcagatcactgagggtgggataatgaggagggggctggttcctagcacacatttgggtatgaggcctggggtatcctgaagcttttttttggcctgctagtggaaagggccagggcccagctgg

SEQ ID NO: 21156 - DNA, 201 bp, Bos taurus
gtggccattatgttttctaaatcaaaccaaaaatgtaaatgctagggccacaagaacactaatgagggaaaaataccacagagtatttgaagtaggcatccttttccaaagttcaactatttattattactatatgcatatactttcagtataaaagagctagaaatctagttgtaaaatatattcaaactattaaaaata

SEQ ID NO: 21157 - DNA, 201 bp, Bos taurus
acaccatgttgtctaccagaggtccgtcactggggatcttggaagccttcaggcactctccacaggatgaaggagtttctgctgatttaaagaagcaaggggcccagtgtatttttgaaatccaagattaacatgcatagctcaggcacaaagtgaaaagttgaaacgtctagttgtgacattaagcctgcctcacccacg

SEQ ID NO: 21158 - DNA, 201 bp, Bos taurus
tggggtaaactccagacatattgtgaagtaactttggtctccaaggcttccatttctctaatctgaggtcttcttcccctttcaatgcctttctttcctcactcaggagtcttggatttgactgctgtaggtccaccagaccaatgctcacacactgcagcacacatagaaaatgacaagcgagaatgtcattggcaggtc

SEQ ID NO: 21159 - DNA, 201 bp, Bos taurus
cgatttcttttcagttttactgaaattatcctttgataaaaatggggtggtagaggaacaatccactctgctcaaaatcaatggcttactttacttaagagcagactgttttcagaatggaaaatagttcttcaaatatttgttcattttcagaggagccatgataacagtctccatttattccatcctcacgtcctacct

SEQ ID NO: 21160 - DNA, 201 bp, Bos taurus
tgcagaagacagtatttggaacaacagcgtatattatggggcctaagatagactcagtacaaaaactttaggattaaattagaatgtgctgctgttggaattgggagctttctggccttgagtattctagcagaggctgtgtgaccatctatagaggagacttctgctttgaatgggtcagactacatgacttcttcagtc

SEQ ID NO: 21161 - DNA, 201 bp, Bos taurus
actgtgcaccagtaaactcacaagcttctctcttactcctttgtagcacaactgattatattagaaaaaaacatccctcccaccaaaaatgagataaagaggacccaaaggaaggaagagatcagagaatccattctgccaccaaagatgtgtagaacttgctgttttattacacactagaagagaattaaaagagagagg

SEQ ID NO: 21162 - DNA, 201 bp, Bos taurus
gatgacgttatcttccccttgagggaaacatgggtgaaaacaaacagtaaaagattgtatccggcaaaattatctggctttgacttgaaaggataagtgtgtacccatatatgccatatacactcccaagaggacataagtttaaaaagggaaactttccaaaatggatcacacctaagccccaaaccattttctatgagg

SEQ ID NO: 21163 - DNA, 201 bp, Bos taurus
atctaggaaaatcaccatattcaaagttgctaatcatgaagtaagcttgaggcatagtggggagactgggattagaggaggcgagaaagcaccggacccagagggcacagtgaaatgtggatgacaagcccaggggtttggactatatcttacatatagggagcaaggaaaagtttctctgcacagaaatggtacagaagt

SEQ ID NO: 21164 - DNA, 201 bp, Bos taurus
actctcctggggctgatgggccagtgggtggaaggcattccaacagaaagtgatgtctcttggtaaacccaacccatctttcccagtttccagagttctgcagactggagctggcccacccagacaggcaccacaaaattctatacactctattagaaattcaagtgtagacagtatccttaagtagaccaagctattaga

SEQ ID NO: 21165 - DNA, 201 bp, Bos taurus
ggaaccttaaagtattagaatggaaaacctcgaatacaatcatgtctttaaacagattgcttggttggacttactgaatgtctgtacactggaggtggggcaaggagtcaggggtattcattagtggtagagttggggccacagacttcctcagacattattccacagcaatgcaccaaattcatccttttataactgaac

SEQ ID NO: 21166 - DNA, 201 bp, Bos taurus
ggacccaaggaataaactcactactaaaaaattaacctgctgtctaaaatgccacttccaacttctaagcgaaagtgacagggtctgcagagtttttattgtataatgaaacaattgttaaacttccccatgcaattctgatgcaaacgatataatgctgggggaataggtattgtctcaatcaaatcaagtctaatttct

SEQ ID NO: 21167 - DNA, 201 bp, Bos taurus
gaacagtgtaagaacatttgaggccacaggagaaagaagaggatatagagggaagacagacagcgcttacaaaacaacaaatataagcgttaacaactattggggcacagacaacaaaacctatgctaacagccgacagagtccatggcccaagtgctccatcaacgtgcactcccaggctggccaccattgctcttgcct

SEQ ID NO: 21168 - DNA, 201 bp, Bos taurus
ggtgcacaccaggccccagggttttcaatgtggcttaacagcaattatatgaatgttaggaaggggggaagtgttaaagtccctacatttacattttttcttggttttacctcttaaagggatagaatacatctcctaaccaagtaagccacgaaaaacccaccccaagagggacacaggatatcctgagaaagcaagcca

SEQ ID NO: 21169 - DNA, 201 bp, Bos taurus
tgtgtggtcttaaaacatttgccaaaatgtttacagagatgctttctctggatagtggaataagaagttgatttctcttttgttttctatcttttccagaggtttaccataagcacatagtttgataattttttaaaagctgttttcatttagtggttaaataatgcaaataatatacagttatattagatatgttgaatt

SEQ ID NO: 21170 - DNA, 201 bp, Bos taurus
ggtgtgtgtgtgtagctgcagtgccatcacagatggccctcgtaagatctgtaatgcaggcgatgcctttacctgagtgtgtgtggctcataaaaataacagatggctgtcaggccacactgggaaattgctttctcccacatctgcaggatgtttccgcagtcactgtgctccctaaccatgtctgctaataataatact

SEQ ID NO: 21171 - DNA, 201 bp, Bos taurus
ctctgtatcgttccaattttagtatatgtgctgccgaagcgagcactgcttttactgttgtttgagttacaaatgtttctctcagttcttataactttgtcttcaaagtttgtgactttatagaaatgtccaggcaaatacagcaatactttacagatcctgaactcctgtcatatgtaaaaaggtctttcctatttcaaa

SEQ ID NO: 21172 - DNA, 201 bp, Bos taurus
tcagtttatagaggagaaaggactcacccacaatttctcatcatcaagggtgtgcagggcccatgttctcatcctaaattttctaacttcttggccttttgtgccaagcactggggtcccacttcctgggactgtcactaaaggttaccaaatttatggtaatcagattgtgatgagcccctggtgaaaggccagtactag

SEQ ID NO: 21173 - DNA, 201 bp, Bos taurus
ttggggatttcctgggttcaagaaccccaaacatctcagcaacccagtgggctggaaacacaagcatcatcgtgacacttgggggtatttttcatagccatctatgtcacagtttcctagtaccaaatcacagggtctgagggccaaagaacttaggtagagatgtccccaaagcagtcaggggcacgtttgaggtcatct

SEQ ID NO: 21174 - DNA, 201 bp, Bos taurus
ggcctaataggatgtgagaagtctgctgtggatagttcttgaataggttcttattgctaaaaaagagtcacacagaaagaaatagttgcctcttttttaccggatagtatcacaatggcagctgtggcaccaggtgatgtgaaaggagctcatgtagagggtggagagtgcaaagatgctctagaatgtcataattcaggt

SEQ ID NO: 21175 - DNA, 201 bp, Bos taurus
ttgatttgttcttgaggatttatacctttctactctcttaactcatattctagtgggaatttaggagaaagtggagataaatatgtatatcaatccatctcatttaattggaggttgagctgatattctctttttatgtttcaaaagttaaacaactgtctgttgtcattggttatgtgggtctttcaggctttcattaac

SEQ ID NO: 21176 - DNA, 201 bp, Bos taurus
ccctctgcttcaagcacttgaaaaagggaaatactttcttcataatgatggtagtagctgactcctttccccggagcaacaaaaatcaccagtgactaccgggatacctggtctagagatgcattaggtggattaatagtgcttaatggtgagtgaaaggaacaagttctctgttttaaaacatgcagtgctctgagaaag

SEQ ID NO: 21177 - DNA, 201 bp, Bos taurus
ccaggtagaactggttctagaaacaaaattcacaggactctcccatagaggtagcaaaaggagagcgtgtagagatgacaagggccaggtggcctattaaagctatttatgatgctgaggggaagaagccctggagactgtcaggcagggacccaaggaccagagctgtgggccccaggccgtgctctgctggaagcgcaa

SEQ ID NO: 21178 - DNA, 201 bp, Bos taurus
agatgcttccctcattccctccactactgttggactccagaaccttcttgcactctgctgccagcttgattttgatcatattacaaacttccttaaagcatagggaatggtatccagtcacttgggataaataataatggaaaaggatattttaaaaaattgcatatatgtgtataactgggtcacttggctgtatagcag

SEQ ID NO: 21179 - DNA, 201 bp, Bos taurus
tcagcattgtgggcttatttagctaaggtaccaaggatcagagcaaggggagcactgtaattcagagaattacattggaaaagtccagaaggtggttatatgtcactcttattcagtgttgttccctcaacctggttcagacagtgaggatatggttcttaagtggtcagcaaaagctgttagacactaacgttaaaagcc

SEQ ID NO: 21180 - DNA, 201 bp, Bos taurus
ggaagtttttatattggtcttttcaaatttctcctgtgtaaaaaaaattaagttacttttgcttgttagtctcatcatccttgaagatcaatctgtgtctggaatctcctggtaagttttttatctataatctcagtgatagctaaagcttagtatcatgaagttctcaacagagctaaaaaatcataaggctagttataa

SEQ ID NO: 21181 - DNA, 201 bp, Bos taurus
ggaagtagatataagcataaagagaagctcagagaaaagagggctgtaaatacagtagcactgatgtgcaatgcacgggagtttcacacataaatgaaggcgacaccaccaacagtcttaggaattatagtcagatgttggtttcagaagccaggtaatcctgaatctgcctcctttgattcctgaattttacattatagt

SEQ ID NO: 21182 - DNA, 201 bp, Bos taurus
ggctgtcactcactctggggacattcaattacgggaaagcggcaatggccatattgactcattagcatcaacaccacacctggtcctgccgagcagtctacgcgctggtgctgggactcaagccaaacaacttaaagggccaaacacagccccgcccatcagcagacacgcccctagacacatgagggctccatgtgtggg

SEQ ID NO: 21183 - DNA, 201 bp, Bos taurus
atagaatatataaattatatatgtaaatatgtagcatgagattgtacatttttttacttttttaaaagttgtgttcttaaaatattgtgtaggactcaccgctcttagctgttagaatgttgttaaatgctatggaaatacttttacagcctgcatttaagaccagaacagtctgaaggaatcagatggaatttacaatat

SEQ ID NO: 21184 - DNA, 201 bp, Bos taurus
aacgacattgcaggcaacataaagtaaaaatactgtaccttgggacatccccagccttttcttctgctcattccccgaaaggctggcatccaggcatggagtggcaccctcaggttccacttccagccaattcattctaggttggattgaataagttttctctagagatatacccatacttgaatgaacatttccagagac

SEQ ID NO: 21185 - DNA, 201 bp, Bos taurus
caaattatatataatagggccaattagtagagaaggagcctgaacatctttagagaagatgtgagaaggtatggttggcttaagattaaaactaattgtcgtacttcatttgttctcatttctttttctctgcaactttaaataaagtacccgtaaatttcagattaaaacaaagaaaaagccaaggtaaagttatgacaa

SEQ ID NO: 21186 - DNA, 201 bp, Bos taurus
catttggactaaaatgtgagtaaaccaatcccagataaatgacacaatatatctatctttcttatttaaaatagtcattgctgggtttctgggtcctgcaatgaaaagaattctgatgtgtaaagtgcaggaattatccatttatatgtcggggttttttttaatcctattttaaaactttcccaatcacctacaataaat

SEQ ID NO: 21187 - DNA, 201 bp, Bos taurus
gtcattgcaatttcacactacatctcaaataacaccacatttttttcatagaatgttcacatctctaatttcctaaaagcctcacaaccactgtgagtatagtaggtggggtggctaatattaaccacagtttagaagagatgaaatggaagcttaaagaaattagagtgtgaaaattctcaaaaactctgtcatgagtcc

SEQ ID NO: 21188 - DNA, 201 bp, Bos taurus
ggcagcgtgaggcctgtcctgttcactgaggatgtttttcattatttattgccttcatccatcagttgcccatagcacagccctaatgacaaccaactgcatctccagatatggccacatgtccactagggagtaaaatcacacctaactggaaaccattgacctgtgtcatcaacacttaatatgtcatttaatccccca

SEQ ID NO: 21189 - DNA, 201 bp, Bos taurus
aaatgttattaaattgttaatactgagttattttcaaaagcatgggcaagtttaaactattgcctgtaaactattaagggatgataactcctcctcctccctccctactctccatccccagctagtgataccaggaaacgggtgcaagtcagaaattgatcagacttataagatatgagtactcctggatgagaactgtag

SEQ ID NO: 21190 - DNA, 201 bp, Bos taurus
aaacaggccttcactagctgtggtcagcagagccctccttctgaagggtttggaatctgtgagaagattctcccactactttccaggccaagtgtgagagctgaagaaagaagcacaaacaacctattcaagtaaacaggcagacagattacagcccatcctgagtatgtaatcttttaaagttactaaaattcataggca

SEQ ID NO: 21191 - DNA, 201 bp, Bos taurus
ccttctccaagggttctttctgaccaagggaacttggatctcgtgcattgcaggcagattctttaccatctaagccaccaaggaagcctgatacttgttacagatgccattaactaaaaatagtttcctcataatatacatatgagaggatatattgtttactacactgtaatgatactcattttcaatctgctttgcaat

SEQ ID NO: 21192 - DNA, 201 bp, Bos taurus
cacacacacacattccataagatattatggaaaaacccaaatggactgtttggccaaccctatggatggattcccaagtaggatatgttggcccactaatagtttggtttcttttctaacatacactgcttcagtgtgtgttcattgtttacttagaaaggtggttgagttggcagttggaaggggaaaagagggatggcc

SEQ ID NO: 21193 - DNA, 201 bp, Bos taurus
gaggcttttattcacagtgtaatattctacattccatcagtagtttgggaattggagggactgactgactcgtactgtgtgtgaagttggaacaaaatagacttaactatggtctttcagttgtgtctgttttagccgcagtcatctttaggtgtcctggtaattttgtaaacccaccatgaagttttccatgtcacagtt

SEQ ID NO: 21194 - DNA, 201 bp, Bos taurus
agaagacagtgcctcagggtttggccttgtctttctgcaggagagctggtggaataaaggagagctcagtagattcatatgtgagaagtacttaaaaacagtgttaattttcccctaagtcactgtttacaaaactagtagaataaataagagaaaaatatcaatttatcattctcaaaactatattcttaaaaatgactg

SEQ ID NO: 21195 - DNA, 201 bp, Bos taurus
ttatctcattgaaggaaaaaatatgtgatatagtctaggaaatatgctggcagattatgagaagtccaaatgttttacaatatgctgaacaaaatcatctcgattttttttaaagtagggtttattcatcaataaatgtataaaagcaaataaacaaaaaggaatacttgttcctcacattaatgtagaatgtttccattt

SEQ ID NO: 21196 - DNA, 201 bp, Bos taurus
ggctgacctagactggcccgtgagtgtccaggagtctcttgtggaggcgtgggatggcagtggcccactgtagggtctgaggcaccgagtgcctcagtgtgtacacaggatctttgaaggagttcaccattatcttcatacctccaccatagtttggcctcaggtcaaacaacagggagggaacatacccttcaacagaaa

SEQ ID NO: 21197 - DNA, 201 bp, Bos taurus
tgtgtaggcttctgcttcattgttaactatagaaagcattgtcaaattggtgtggcttagaacatagcagagggagtgtccttggaaatatcaaaggacatttccttttccttcaggaacctctcattttaccatatctctgatttacttgcaatttcaattcttaagtgtgattgtgtgatgaatcagagtaatagtctc

SEQ ID NO: 21198 - DNA, 201 bp, Bos taurus
tatcaagaggagatagggtgagtccccagcaccatgaatactttatggtacttagtaggtaaatatgaactgaatgattgaatgaaattggggaatgattttcctaaatttattattgtttcaatctgctttaaaaatgctgtgatcaaaatctgcataatgaacaagataattctccttttaaattctaagatgtatgca

SEQ ID NO: 21199 - DNA, 201 bp, Bos taurus
gatcacagtaactactttttaaaaatactaacttcagcctatttttggtataaagtttggttttacttgtgtttagaagtccaacatagtcacagtttggtgctttattgaatctttgaacaggaatttttcatggaaaatgtggtttctactacctggttttactggagaaacagaattgtcctggacttaaatactaca

SEQ ID NO: 21200 - DNA, 201 bp, Bos taurus
tttatgcagtcattgaatgcattcaaggccatattatcccttcattagaggttgagtgttcagttctatttagaaggaggaaagcaacagaatacaatcacaatcaaagggcccaatcagcataaatttaacttaaagagtagtttgcctttttataacatgaggtcaggcagcatactatactttccatactataagttt

SEQ ID NO: 21201 - DNA, 201 bp, Bos taurus
cactgcttcctggctactgggatttgctgcataagaagtctacaattctacaaagaacctggttccctatagaactcctctttttttctggctctaaccaatagactctaggaggaaaaaggcagagtagctgttaggaaaaaaaaaaaattgaggagatttcagaaatgggagggatcccttgttccgaaatcttacata

SEQ ID NO: 21202 - DNA, 201 bp, Bos taurus
cacagctaaagaattcttaaaatgagtgtaaactaattgagtaaacatgctaattatgctaattaaaatacattcatactaaagtgtaaatgacttctaactcttccattaaagaaaaataaaacagggacaacagcaggctgcaccagaagagatggtggaatatagagaaaaaaaagctaaagacccagaagataaatt

SEQ ID NO: 21203 - DNA, 201 bp, Bos taurus
ttgctgcaaaatttttgtatttatacacttaaatcaaaataattcatgaaaaaaatgaatcattttgaaaattgaggggttaagtttgtcaaaagaaagaacgtgagtaacctgtattatacaagtatctgttgtgacacactttgcaggtgactcttcagtgagtggttatgaagtcctcacattttagaaaccattaac

SEQ ID NO: 21204 - DNA, 201 bp, Bos taurus
tggagaatttgactgagttgtcccacatcagagcaggtccacagtccttgggcagaggctggctgggtgctagagaaatgctctgggtagtacctgctgggggagctgctgaactaacaggaagcagtagcccacagaccaccaggaagcaagctggggagccacaggatctagactttctttctgatgaatttccatcag

SEQ ID NO: 21205 - DNA, 201 bp, Bos taurus
tttataaagcatagaaatccatcccagagaaaatgggtgtggcccaaggcataggacaaataaaatatagagtcagaaagagagctgaactgtatgtattgaaaccttagtcaagagttatctttttgtccacatgcttttatctgtctttccagtaaactctctcaaggatttttaagataggtcttgctttccctactg

SEQ ID NO: 21206 - DNA, 201 bp, Bos taurus
aaaaaaataaatgttgtctttatgggctgttacaccttattgccataattaccttcctactcctgtcttatttctgcatccttgactccaaaacaacttttttaaagacatcaatgatttccacactggaaatccaaagaacacttttaagcaaaattatcttattggagtatagttgatttacaatggtgtgttaatttg

SEQ ID NO: 21207 - DNA, 201 bp, Bos taurus
ctgaaactagtctattaattatttcctagggtctgagcagtagattttaaaatggattattcagagaactagatttttttttcttttccctcatgtgccttgctacttttaatttttcttggctggtggggttggaggcactaaaccaccactgttgtcttaaccaaagcaataatatttatacccatttttaatacggag

SEQ ID NO: 21208 - DNA, 201 bp, Bos taurus
gccccatttctcagtccttacattaaagctgacttacccagaaatgtgcctacatttactagttttttttgtttttttttttttggtagctggttaaatatgtccccaagtggaggcaagatgtttggagagattttgaaaataagtgaaatataagtgattctgactcaagtcactgaaatgcaatcattgtatttagtt

SEQ ID NO: 21209 - DNA, 201 bp, Bos taurus
tcactctatgctttgaagtggcctctagcacatggcgggggagaggggaaatcagaggatgtaatcagctaaatccagtttgacgaaacatgatcagagatcaggcttagagattgaaaaagggaggtttggaggagaaaatgcaggaatacaggtaaagagctcccctctggaggtgttcagaaacaagctctaagtcgt

SEQ ID NO: 21210 - DNA, 201 bp, Bos taurus
cacaagctgttgcctccaaaatctccttataaatgagccacaaagcctccataggtctttctcctagtgagtggaaataaataacgcagaatatagcgaacgcatgccgtgagcagcaggctgagggaaacggtctcctgtccatctctaaaggagcgttgtattcagtttttaaatgattcatctcttccctctccatca

SEQ ID NO: 21211 - DNA, 201 bp, Bos taurus
aggtcccagtggttaagattccacctgccaatgcaggggacatgggttcgatccctagtctgggaagattccacatgccccagagcaactgggcctgcgcgccacaagtaccaaacctgctctctgagcccacgagttgcaactacttaaacttgcacacccagaacctgtgctcctcaacaagagaggccaccacattgg

SEQ ID NO: 21212 - DNA, 201 bp, Bos taurus
ttctttctcttcagtgccactaaatgctatcaacatttcatatctttctgctatcactgtcccatcctaataaatcttctcaggtctctgaataatcattcgcttcatactgtaccaggaagtgttttctcattatgtagttttgaaagcaacagagtaagtcattgtagattttagagcagaacaaaccactcagatttt

SEQ ID NO: 21213 - DNA, 201 bp, Bos taurus
actaatgtatgatggggtggtgctagccatctttgcaccgagagttactcctcctttcaaggccccttgttggtgtatcttgcccacaggtatagggctggtgaagggggcctgatcactttcatgatttcatgattcatgactcgacagactgccaaaacaccccaagaaatatgtaactcgtctattctaagtcctgcc

SEQ ID NO: 21214 - DNA, 201 bp, Bos taurus
tgttgttaaattctggactgaaaaccaagagaaaatatcacattagcaaaataacaagccttcagtgcgtaaccctgaaagaaaaggttactatggtttcgaagcatttcatacactcttccagttagttttttgaaaacagtggagctttttggagctttttttttggtttatttttaactttgagacattttcctctgg

SEQ ID NO: 21215 - DNA, 201 bp, Bos taurus
atgaaagcctcatatctgcccctagaattactgcagtggatccatggaataatatatatgaaaatacttcacttttgtccagtagatgaagttgtcctaacgtttagagctcaaggaaacatgacgctgctgttgagtccaagagaaaactgagaaaagggagaatgtgggtcccttctgtctcgttggcttccttttcca

SEQ ID NO: 21216 - DNA, 201 bp, Bos taurus
tttgggtttgtcattattcaccacaggacaagtgatataatatatctgatcatcttcacttacgcggtctatgacttcacaggacctaggtaaacagaacagtgacagaaagtctacacttttctacctggtagaataaggcatgcctttcttttgtttgtttgggtaacttcattattggtgtctgtattcacccttctg

SEQ ID NO: 21217 - DNA, 201 bp, Bos taurus
tggtatctatgcaaataatttctctctattttttcttcttgtattattgcagcctctgcatgttttccctagtccttaggcttttgctctttaaatcactcacctcccttccttccatcatcagtccagctaaaagctgtattctcctgtaaccttgtaaattggaaggccaatgcctaccaccatactttacatctaagg

SEQ ID NO: 21218 - DNA, 201 bp, Bos taurus
tatcaacgcagaaactacctcttctagacatcctgttatataagaactattcttaagccctgaccaattaagccattttctatgtcttgttttgatacccaccaccaaaagcttccctggtggctcagaggttaaagtgtctgcctccaatgcgggagacctgggttcaatccctgggtcgggaagatcccctggagaagg

SEQ ID NO: 21219 - DNA, 201 bp, Bos taurus
ttatttaaacgttaaatactttctgtgtttaaggtgctgactgggcaacatacagcaggaaatgtaaactgaggaaaatctagtgcctcctcccaaagaccattggaggcaaagtaaaaaatgatagtagatgacacagaatatgttcagtaaccaaaaggttcaaaggagagagagaagaccatgggttagataaatcaa

SEQ ID NO: 21220 - DNA, 201 bp, Bos taurus
gaatttctgactcacctctttgatgtcaaaggaggtgtattttgcattgtaattagagctctactaagttatagcttcccttaggaagagattgtatgaccaacactcaggtattaaaaatacaaaatagaacagttaccctcatttgatggattatatgcagtacacacaatttagctctaacttttctctaaacatcct

SEQ ID NO: 21221 - DNA, 201 bp, Bos taurus
tgctgatgactggggtgggttgttcagtcttatcatcacgcctgacctagttgtgcagctgctcctgtttaattaatagacatttacataagctcttttctcccagcaagctttataatggtcgtgttggttatctcctttcgctctgtgaagtatcagcagtgctatttccatttccatatcaaaatacagagagattaa

SEQ ID NO: 21222 - DNA, 201 bp, Bos taurus
tattaaaaccagctgtctctggctttccagattctaggcttcatgtcttgcaaccatccaagtccatagtttagctttgtgagcccatgcctcgaatttgatcctccatgtcctatgactctatatatgacaggaggaagccagtagggaaatggaaaatagcctttattccagggtcttcgagcagagatggactgagaa

SEQ ID NO: 21223 - DNA, 201 bp, Bos taurus
ggatatttcaacttgcattctatcaattcagcaacagagaagtcattgcaaaggtaaaactaacatgacagacgatatttgtatactctcagtttttcacggaacttgactactccacagacatttgattgaaagcctgctcatgctggtggttgaaatccaatttgcagtaagtcacttgttcactgtcaaggttaacag

SEQ ID NO: 21224 - DNA, 201 bp, Bos taurus
ggcctaagatgtgaattctattagcttggtagactctgtggcgatgatccactcactacctgtgcttggatgtggcagcctggcagcattagtggtctccgatcttcaccctcccttaggccccggtcctttgccgtgtgactttgcatgtggaggtgaagtatatatccttgcttcttgattaaggccttcggctggcag

SEQ ID NO: 21225 - DNA, 201 bp, Bos taurus
gcctttgctctagcagacctcgccacctggaacatctttttctcaggttttctaaaaactgactcttcttcactcaggactttactcaaaaatcatctcctaaacagggccgtcctatctaaaagagcactgcacagccctttcactgtattttcttacactgctttacttttctaatgatcccttctgcttgatattatg

SEQ ID NO: 21226 - DNA, 201 bp, Bos taurus
cacccccctcaaaactatggggccaaaaacttgtgacactatttttttcatgtataagccactaacgtggatatgtattcctcggaggcgggcagatacctgtgactggccgaggtttaggagagtttgcacgtcaaggagtttcctggttccctgtctagtaatctgctctgctgcccgggagagtaaaccacagttaat

SEQ ID NO: 21227 - DNA, 201 bp, Bos taurus
ccaagattttcattctgaggagaaatgagggaattgttagcagctgaatcctctttgaaagagcaagccacacagatttatagagctttaggggatcgtacgaggagcaaaacaattgtcactcaggtcccctttcctggcagcccctcaaagcttaccaagtgagaacaagagtgcccagctgccctgaacagccagaga

SEQ ID NO: 21228 - DNA, 201 bp, Bos taurus
tgtactgcaatactcttaggcattatggtggcaaatattgtgatgactacaagatgcattaactaagattatacatgtcaggttgaactctttcttcaatatatcaccttggtgactccaaggttattaaaactgctgagaccaggagtgttaacagttggtgatagggtttcagggataattctgttattgttgactgaa

SEQ ID NO: 21229 - DNA, 201 bp, Bos taurus
gctcggtggccgcgtaaacacgctgtaaccaagttctgggctaatttttacagagtttcgtttgctccccagaagaaccgacggtactcaatggtctcctgcgggcctgcccccacaagagcctgggggctcctttcccctaagccagcactggcagcgcggggggcggggaagagggggtggggaagggtgggagggcag

SEQ ID NO: 21230 - DNA, 201 bp, Bos taurus
aacaccctgggctctttgctcttaattttttttatcatttactttgattagtcttggattgttttttctactgatatatctcttcctctttttgtgtaatgtaacattatatatatataaataaaatatataaacttagatacgcattatacgtatattatatatatatattaaatcccagaagtttaacaacttcttaaa

SEQ ID NO: 21231 - DNA, 201 bp, Bos taurus
actcctaaccatcttacttttggaaaggagttttcccaagtttcagctgtccaggggcattactgaaagtgagcaaaataaatatggatacgattagagcaatttgtacctacttactttaacaagttccatcttattttaaagtatttactatctttaatggattgtaagattgttgaatgaaaggaaccatgttttaga

SEQ ID NO: 21232 - DNA, 201 bp, Bos taurus
tttttgttgataaaacaaaaatgcaaaaaagcaagagaaagcaaatacaaggcgtagcttttttctctctcagattccccagagagaatcccaccagcgatgccacatttaccggtcaccgccctgtagtaacactgtctcctagagtctcgtacgaaaatgatttctcgagaactttccatgaggctaagcgctggcctt

SEQ ID NO: 21233 - DNA, 201 bp, Bos taurus
cccttcataatgacatcagatcctcgtgactgactagcagaaaaccttttgtaaaatgagtgcttaatggtatccactcctccttcaccaaaaccttatacattgatggtcccccactgcatctttggaacagttcctcagaactatttgaggtgctgcctcccaggcttcagtcttcctgttgccccaaagaaaacttgc

SEQ ID NO: 21234 - DNA, 201 bp, Bos taurus
gataattataaatatctataataatgtgatgtgagcaaactctaaaagagcataaagttcccttttgaaattgctttcatgtattgtactataatatactcaagtacctaaacggtagtttgggggtaaattaaggttatatacattttctagaagtaaaacatcttttgatatcaaacctagtaaactagttaaagctga

SEQ ID NO: 21235 - DNA, 201 bp, Bos taurus
gcttccaacattctgtgacttagaatagttacaccatacatgtagctcacaaatatgcaggtaggctaggtacttcttttgaccttaattgggcctctcatgggtcctttctcaagaagtctcttacagtcttgactggcttatttacatgttcatcagctggtgtagagtggcctcaaatgggacaactgaggagattca

SEQ ID NO: 21236 - DNA, 201 bp, Bos taurus
aaagaggaaactggaggaaaagggatataaaaaatggagtattcattcttccaccatcctccttgggatgttagtttaggcccttgactaaaagtcactgctcctttcaggacatctggattcctgtaagtattctatcctcccatccttaaaattgagtggtgacagtttagccatggttccccccaactctgctctcaa

SEQ ID NO: 21237 - DNA, 201 bp, Bos taurus
tgaaatcaagttgtcagccaggcctgtgatctcatctaaagtttcaggttctctttcaagctcactggctgttggcagaacacagttccttgaagctacaagactgaggccctcagctcctacccaagtttgactgttccctgtctccacaacttggcattttacttcttcaagaccaaggggaaaaagacacttatttta

SEQ ID NO: 21238 - DNA, 201 bp, Bos taurus
tattattcagttctctttgttagtactccacacagaggtttcctatacaattgatacatgtttactcacaagcacactgatatttaagccctctctagctatgactttaaatttagttaaactgcatttagttcttgattgaaggctctggagataagatcatatctgtcaacttgactgcatcctcaagacctccagaag

SEQ ID NO: 21239 - DNA, 201 bp, Bos taurus
gaacttagtttctctatttcaatagaatctcaatttcctgacttttcaatgtttatgctgcttaacacctgctgtatttttaaagaaatggccactaacacattttactaagacataacttagggcgagtctgtctcctagttaaagaaaataacttgacactacctaactgaataaacagaacaatatggccgctcccat

SEQ ID NO: 21240 - DNA, 201 bp, Bos taurus
aggtaaaaacttttttacatatcagttgggttgatgtttgcataattcagaacatggactcagtttaatcatatcccaacatataactgtgcaagaagctctaagaactcaattcatatgtgagataatatctatgcccaagctacaaagagctgaaatgactgaaatgtcaatttacctatgtctaataacttgttttta

SEQ ID NO: 21241 - DNA, 201 bp, Bos taurus
ggccccagctttccctactccaaagcactgcgcctgctctcgcagtagacaccagggatttattgtctagctggactggagtaagggacagggtctgggtagggccacagtaaaatccagcctttttctacagaggctccaggagaccaccctgcttccaaaagttaattctggcctccaacccagctaggcttaaccctg

SEQ ID NO: 21242 - DNA, 201 bp, Bos taurus
aggtctaacctgtcaacactgcattaatttcaatgatgaagatagtgatcactcatggatttcctagatatagattacttgagtgttgactccaggagagggaaatcatttaaatccaggaagtcacaaagacatagtatgattaaagatattcatgacataaagcatttttttttgaaagaaatgatttaaagggaattt

SEQ ID NO: 21243 - DNA, 201 bp, Bos taurus
tgaccaaattcctggtgactagttcactagctaggtccttcaggggagtcagatcagcacaaaagaaacatgtcacttttaaatacagttgataacggtacctatccacctccttaaactcttctgttgaaattagttctaaaaagacaacatgccaatcctgaaatgctcccagttgctgcagaatatcatatgttttta

SEQ ID NO: 21244 - DNA, 201 bp, Bos taurus
attagaacctatattctcatgaaggaatttctggctgtattctgttgtgctgtgaaaacatatacacaagacacgaccccggataggcaggggtagcagtatatcttgggtctgtgcttttctatgcttctgtttaaaatcatctcaggtatatttttccctgagggaggaaaaaaaggtgatctgtatcactaggtgata

SEQ ID NO: 21245 - DNA, 201 bp, Bos taurus
attatatgtacttcctctgagtcttcacgataatttcctcttcctttcaaccatggtaatttccccagaggcctcataagacatctagtgtaatctgatggttgacaaaatacagtaggcaaggctagcattttccctacttgtctatttcaggactagttgaaacctcatcttaaatccacagctagtggatcgatgtat

SEQ ID NO: 21246 - DNA, 201 bp, Bos taurus
cggccctataaacaaaaccgtgataagaaaagggcaatttagtagctagaatagtggatttccaccctcttccctttggcctcactccagagtggatgaatgtaaggagccaactgtttgaaatggctcttcactaagaactctaatgaaagacattagagaacaattgttgtagaactccaccaggttatgaactatggc

SEQ ID NO: 21247 - DNA, 201 bp, Bos taurus
caccacaagacaaaggtgattaatagaataagtcagaacctaaaaaaaaaaaagaaaaattactcaagaactttgaggaactccacatgcctataaaaatttggatgtggcagcagatggcatctcttttgcatgagaggcatgacagcctgaactaggaaatactgagaattgagcttgggcttcaagcccacaatatta

SEQ ID NO: 21248 - DNA, 201 bp, Bos taurus
aggtatttttagtcaactatatatgcaagcattttattaaatgttggaatttgaactgaggcatagttttagtcattaggaagctcatagtccaattgagggagtgagatttaaaaagctgatggtcatctaccatccactttataataataaaacctctgattttccgctgggcatttggtctttcagatcacaaactat

SEQ ID NO: 21249 - DNA, 201 bp, Bos taurus
ttgtgtttttagaaaatatttcttttcacaaactagatttcagccatattataactattaacgagtacatattcatatttggagcattgtctgtctcattttctgagtatttgaaatgcaaagcaagcagaaagaggatggtaagaaggtcttgcaggcccaaatcttcctctacctcatattaatactacagagaggaaa

SEQ ID NO: 21250 - DNA, 201 bp, Bos taurus
gtagaacattctatccttattaacaatgagaaagaccaagactgttggtagaaatattcaatggcatgtgtggcttctgtttacacaccattgaccaaaacaaatcacatgaccaaacctgacaaagtgttaggagagtatactcctttggacaagaggcactgcaagtcccatggcaatgggtaggggcacataaccatc

SEQ ID NO: 21251 - DNA, 201 bp, Bos taurus
tatacccacttcattcaaaagcaatcagctagagccttattatttccattttatgaacagaagtatcaaagaacccttgctcccccagtcaagtcagtaagtgctggcaaattaccaaaatctaaatttaataaaattgtattagtcactttccaaggtgtcacctcagagtaatgctgagatcaaaaccgtgatttgaac

SEQ ID NO: 21252 - DNA, 201 bp, Bos taurus
ctcctgcctcctttctctaaccatcttctagagcaaaaaccaccaaattaacttcttaaaaacatcatctctatcatgtctcaaattcaaacaaactaaccactggtgcctttcactttacttacagggtcaagtttagatttctcactctggcattcaaatccacctaatattggattctctaccatctctaccaggagt

SEQ ID NO: 21253 - DNA, 201 bp, Bos taurus
taaaaaattttttgcccaagcatgaccctctgtccaagctccctaacctttaacttctatcccacaatcatatgctgttattctttctccagtatcctttttatttctttcatttttatattattatctgcatccatattgtatagatttatagtgatttgtttacaagtatatctcatccaataaactacgggtccctgg

SEQ ID NO: 21254 - DNA, 201 bp, Bos taurus
tagtttacttttgtctttatattctggaatggatcccattcagattacatccttcaagaattacatcagccccagttcaaagttgttcacctccaaaccagataaatccacacattactttctaagtgagggcattcaccagactagtgtaatactgtcttccatgtcctgggacggctggaaattatcttagttccctga

SEQ ID NO: 21255 - DNA, 201 bp, Bos taurus
atttccattttaagttactgtatccagtatgagcagtatcattcaggaactgtcatgggccaggatagttactcttttcatgggctataccatctaaatcctggatggtatcatgatgtttgtaatttactttaaagtaattgagcgcggataatgtgacactatgtgtgaatatatatgtgtgttgatttaggctatgtc

SEQ ID NO: 21256 - DNA, 201 bp, Bos taurus
ctgctcttcacaagctgaaaaatctttagaaggcagtgagtccatacaggcacaggaggtgccgttgaaacggagactgcccaccggtgaaggttctgagtgcggttcacaaataccctttccaccctggcgctgatgcttatgactctgctacttccaggcccttcagtacccgtggagtgggtgctgccctaaggacta

SEQ ID NO: 21257 - DNA, 201 bp, Bos taurus
tgtacaaggcaggaatatttgctctgtatggtctatgcaatctcttgtgtattccttaatttttataataacatgtgttctaaagggctgattcttgctgctgtttgacagaaaacaacaaaattctgtaaagcatgtatccttcacttaaaactaaataaattaaaagttttaaattgatttattttcggctgttcagtt

SEQ ID NO: 21258 - DNA, 201 bp, Bos taurus
ggaagacataagagaatttatagtatgctttaactggggattgggggtggggggaacacctcctcccagtctaataaaatttggtagctcggggtcacttcctaataggtgctatttcctctattttaataaaggtattttaacacctgaattctatgccagataccattgtcattttttccactgactgactcaactcaa

SEQ ID NO: 21259 - DNA, 201 bp, Bos taurus
tagcaccttgttcttggacttctcagtctccagaactgtgagaaaataattctcagttgtttaagccatccagtctatgatatttccttatggcagcccaggcagactaatacagttattaaaaccaaaccttgctcaagcactgcattaccctgcagagtagaaagagaatagccatagtcaaacaggtgggtgagtcaa

SEQ ID NO: 21260 - DNA, 201 bp, Bos taurus
taagggcatatcatagtttaattaacagcatttttcttttactggtacatcataaaattgatgacatcttaaatcgagtgtaatatggtagttcatttagggagagttactggcagaataactctgcgtgtctaaaagtatcattatttcaccctcactcatgaattctgatcatggaagtttaatttgacaatcatcttc

SEQ ID NO: 21261 - DNA, 201 bp, Bos taurus
gttttaacctacaagtataagctatatggcagagtagaaaaagaatataaaaagaaatttggagtcacgagctatggctctaaaagggacagtaaagcatttaaccctgagactaatccagatacttaatttctttggcacaggtgtcaaatcgcttcagtcgtgtctgactctttgcgacattatggactgtagcccacg

SEQ ID NO: 21262 - DNA, 201 bp, Bos taurus
ttcttgcctgcagaatcccagggacaggggagcctggtgggctgccgtctatggggtctcacagagtcggacacgactgaaatgacttagcagcagcagtgccgtataatgcacaaggacttttggactctttttttttggctgaaagatctcattgctgaatgtgctgatacagggaactttcccatggctacaggaaga

SEQ ID NO: 21263 - DNA, 201 bp, Bos taurus
ggcatccatattttttcacactcctacatgatttaaatgtacattatattataaatatcatattttattatatattatataatatacattatattatagcttgagaattgtgattcctttcacctttagacagagatattaaagtattttcctatctcccaaatatctctggattttttttctttttcttttttaaattat

SEQ ID NO: 21264 - DNA, 201 bp, Bos taurus
agtttgtcattagatccaagtcacattggtaagattactttggccaccaacatataaatactgtcaatgtagatggttttgggggggcagcctccttctccctagatcatacacatggccattcacccagcagattgcctttctttctaagcacaatggtttctctttctttttcctgtaagggcttgatccaaggttgtt

SEQ ID NO: 21265 - DNA, 201 bp, Bos taurus
atcaacatgtgggcttctcaggggtgccgagtgtcctgacccatttcaactgttctccctacagtgaaagatgtgctctcatgagagggagagagcaccacggggcctttttatgactttcatctccaaagtcacacaccacaacttctgctttatactgttggttagaagcaatttattaaatccatcctcaaggagagg

SEQ ID NO: 21266 - DNA, 201 bp, Bos taurus
agggttcagggttgttagtttttataggggtgggtaattttatagtctaatgagtgggaggaatattccagctattttgaggaaggaatggggatttcccagaattgggccactgtccactttttgacctttatgattggccttggaacagtcatggtgcccatgggtgtgtcatttagcttgctgatgtgttacaatgag

SEQ ID NO: 21267 - DNA, 201 bp, Bos taurus
ttcagaacatttataacatgctaagtatggcagcagccctgggccttcagagacacctctgtttttaattctctctcctacgttttgttgactttatatcgtttaatgaggactaagatcctcattggtttaactcttaggacgattccaaggatctttttctttggaatgagtaggaagaaataaaacaatttgcatcaa

SEQ ID NO: 21268 - DNA, 201 bp, Bos taurus
ttggccaccagctagctgaggtcacaatgaagagactgcaacaaagccttgcaggtaaaccttcaatattagggaaagcaaggacttatctcccatacccgtctctggcctctcctccaaggtttttaggtgcctgcaggcacacacaggcactcacccccagtgacctgtgcctttacctcctcacctcagggtttaaag

SEQ ID NO: 21269 - DNA, 201 bp, Bos taurus
ggtcataagttttgcagctactgtctgggactcttagagtacttacttgctctttgaatgctccctcttggaacctagcacatgctccaggtagatagccgctctggtagatagccctggctgaatccccagccaagagctagcattaactgccagccttgtgaatgaactactttgggtgtccagcttggggagttccaa

SEQ ID NO: 21270 - DNA, 201 bp, Bos taurus
gttggcaaggctcagcggctgggcctccaagtggcaggtggtcatctggctcatcacctttcccaacagagcccccacggcgaaccccacatgggcctgcgggtaccccagggtctttcctcttctgcctcagccccttggcaagctgccccatctctttctctatggccagaggtcttctggcagtgctggcgtccagac

SEQ ID NO: 21271 - DNA, 201 bp, Bos taurus
gaaggccatcttgttgtacttgactttatcaggcaatatgtaagacagtgtcaaaaatcatatagcatcagttctcccgattaaaattccacttgggttttttataagggattcaagcttattttaaaatttatacggaggagtctagtacgcatagctaagcacaccttaaaaaaggacttctcctgccagatattaaga

SEQ ID NO: 21272 - DNA, 201 bp, Bos taurus
tccggttagcatcacactacaggtaaccttggtctgtttgaccagggaggcaggcctagaggaaaaccatcagagccagttagctaccgatgcatcaacatgttcatcgcttcagattaccaggtgtccaccacctgcctatcacaggggtgggagctctattcctgcacagctggctgtaagaaaaacttacatgttagc

SEQ ID NO: 21273 - DNA, 201 bp, Bos taurus
attgattacaaatggaggtcaggccttctggcatgagatatttttgctaatttatttcttaacacattaacacgtttctttgctcctgagtcttatttagtaaagcttctgattgggccgatgaaccagagcttgctcatttgagtttgagcagagtctgatgctttcccatatttccgtcaactaagtttaataaaatcc

SEQ ID NO: 21274 - DNA, 201 bp, Bos taurus
tctcctgcattggcaggcagtttctttaccagtgagtagtgtagaaaaaatgagaagaaaattgctcacggtagatatggtagttaagaaattttaaaacgtctttaaactttgggtggagagatatgtttgaatcaaagttaactagctaggataaggatgactgtacttaggactccaagttttgttgaattttctaaa

SEQ ID NO: 21275 - DNA, 201 bp, Bos taurus
catgttggaacactggtaacccaggcccagtcatttcctactctcataatttgtcttcttttccctcttcttttaaaaattctatcaggtgcataacaaagtagcaaactattttacagtgattgtgagttccatgaactttcaacaattttagccctgttctgtcacttgtacttttcttcatgggaagttgaacatgta

SEQ ID NO: 21276 - DNA, 201 bp, Bos taurus
gctcccctcctgaagttacttgctaattacaacttgcgtcacctccaaactcaaagtctgagcaagaggcccctgtcatgggcctgaattccagcttgcagggaagtctgcatagttggctatgttttacgtttttttttttttttttttttaacttttttaactttaacttggcatgagaagaggctcctactcttacca

SEQ ID NO: 21277 - DNA, 201 bp, Bos taurus
cagagaaggcattctctttgtgggtttggtttctgaatcctcagcttgtgaaagaggctgtacagggagaaattaatacatgtaaactgttctaagagttcgaactctagggagaaagatggcccacagataggagggctaaatcagcaaggagacttttgacatacaaattgaatgcctccctgatggggaggggtagtg

SEQ ID NO: 21278 - DNA, 201 bp, Bos taurus
aaagcagatgaaggatcgaggcccaaaactctgctgaaaccaggaagagcaaactaatcatcatacccagaagcctgccaaagaagggtgggaaaaccaatgctctctttggacaggactgaggccgctgattccagggcagaggtcgtttgctctcagccctagtttgaaacaacatgtagacagaaggtagaagagaac

SEQ ID NO: 21279 - DNA, 201 bp, Bos taurus
caccagccctgccaccagctgtccagtgtcacagacccatttctccatggtcccacaatctttactcttcctctcctcacccatctatactcttgactaaatggttttgctgctgagcttggtcagaggaccacaataatagtgtcccctcctcagcccctaccataacctctcctctgctaggggaatgtacccatagaa

SEQ ID NO: 21280 - DNA, 201 bp, Bos taurus
ccaatacagagccacgggttcaatccctggttagggaactaagatcccacacgtcacagggtgctgccttctaaagaaaaaaaaaaaggtattaccattaataattattgggggaatgctcttagaaattaaaagatttttgctcagaagctactagttcaatttctgatactttgttcacagacatgcacagtaaaaatg

SEQ ID NO: 21281 - DNA, 201 bp, Bos taurus
ccgtgagatctttgaacactgaagggtctgatagaaggctcagggtgcttctgaacgttcaccaagtataattctcccttcacctgacaagtgatagggcagataaagtgcgtttgtttcttctggagtcatggttcatcagagcctttactatgttgccccaagagaactctgttccctgtccagagagggaaggaaaaa

SEQ ID NO: 21282 - DNA, 201 bp, Bos taurus
ttctctatgatccaatgaatatttgcaatttgatatctggttcctcttccttttttaaaccctgctgtacatctggaagttctcagttcacatactgctgaagtgtaccttgaaggatttttgagcattatcttgctggcttgtgaaatgagtacaactgtatggtatcttgaacattccttggcattgcccttctttggg

SEQ ID NO: 21283 - DNA, 201 bp, Bos taurus
ttgctatagaaaggagaaaacattctaggaaaaacctcataagcatttcagtcagagaagttgggaggggctttttattggatttgaatttattttggatgattttgaggaggatttagggaagtagaggactgttattaaagtgagataagtcagaaagacagatactgtatgatatcactcatatgtggaatctaaaga

SEQ ID NO: 21284 - DNA, 201 bp, Bos taurus
ccatgtatctgcagtcagctggcagtttgactacagcaacagggtgactcaactctgtgctgtctttatccagcaggccagcccaggcttgtttgtatggcggcagcaagtttcaaagaaagaacttgaatcatgtacgccccttggggccaaggcttagaattggcacgtttccactgttggtcagagcaaatcacaaga

SEQ ID NO: 21285 - DNA, 201 bp, Bos taurus
gaccatattttttacttcatgtataacttttttttggatactaaatgcatgttgttgatcataagaaactttttcaattttgcttgtcatgcaaaggagaaggggaaccatattttttatttcatgtattttttttattcgataaattttagtataagataaacccagtagttcatagagaaagaagatgcagtggttagc

SEQ ID NO: 21286 - DNA, 201 bp, Bos taurus
atctacttaaaactggtcaacattatggaatgcatttgtgtccacaccccactcccaaccaccccaccaatttcatatgttggagttttagccccctggtttgactgtatttgaagatggagctgtggaaggtggttagttttaatgccccatcatggcattagtttctgtacaagaagagaacattgatagagatgactc

SEQ ID NO: 21287 - DNA, 201 bp, Bos taurus
ctgctttggattttactctattatctgtaaaaattgagatgtataaattattaaagatattaagcattatccattcttcttttattcatttctctgatttatatgaagttaaacttgctggaagctgatttggtcatactaaaacaatatgtaatcttttcaagttttcttagaaggatttcttaccttgtgggttctcaa

SEQ ID NO: 21288 - DNA, 201 bp, Bos taurus
atatgctttctactacatcagaaagtgtcactgtcatgtagcaccatgatcaaacaccttggttttcgagacacctctaaacacatctgtactacagctacactcatggactgcaaggaatggacatatactggcctgtgggaaaagggtaaattttccataatttttaaggtaaagcagctgattcaattaaataccact

SEQ ID NO: 21289 - DNA, 201 bp, Bos taurus
aacaaagtagaattggtaacaaaactactaaataaatcacccaggcatggcaatgttctgggattgcttatatttatctttgttcctcattccatttttacttcctagtggaacactcaatatcccaatcacaggattgccatctttcaaacacctcttgtatataccaaatctaaaataagaacctaaataagtaaattc

SEQ ID NO: 21290 - DNA, 201 bp, Bos taurus
agaacaccaaacattctcatgacttttttagttattatttttagggtaagtcacttaggaagttttgttttatcgtaccctttcctgtgatgtctctagcgctctgagaacctagttctgttattgttgcctgagttgcacagaatccctcactaacaggtggtactcaagcctgacttcactgagttcaatctagatttt

SEQ ID NO: 21291 - DNA, 201 bp, Bos taurus
cccttgcgatagacagagagaaacgtgctcaagtctcagacgacggaggcagaagtgacgatgaccagacccagatctcttgaagatatgcttcggactcggagtcaacgggcctgtggaaggctggcacgtggagaaagaggcaaagaagagtcactaaggaggaggctgggaacttccacctgagcaactgggtagacg

SEQ ID NO: 21292 - DNA, 201 bp, Bos taurus
ttactattaaagacaattgagattaaagggaagaaggaaaggagacagctgggtataattgtctatattgatcaaggtggtttgttcctgattctcacttccacctattatgcagagcactggttcaggaaaacactcctctccagagtttgcatattcttttccagtcaaaactagaacattattcgttactcactaaac

SEQ ID NO: 21293 - DNA, 201 bp, Bos taurus
ctgtggggtgtagcccaacaccccagtggacaagcctgccaggaggctgggggagactcctgtgagctccaggatgtcaggaaataaggatggagaatgggaagttacaggggtaattccaaggcggctgcccgctagcttgtggggccctgtgacagctatatctgctatgagaaatgtctttctcttccattatgttgg

SEQ ID NO: 21294 - DNA, 201 bp, Bos taurus
cccacacttttctaagttggtttccccgataggatacttgacaacataattctgtattgattataaagagttaaatgctgagctacttcatccttttatgaatatttacatataatgtagagtctgaaaacttataattaaaaaaggggtttgtccttttcatttaaaaaatttttactataacagtagcattttaaactc

SEQ ID NO: 21295 - DNA, 201 bp, Bos taurus
agttaactgaagtttattaggtggaagccttaaagattaaatacctttcttattatttatcatcaaacctactgttgtagtggagcaagctattagcacctggggaaaatagaaccactggttgtttgacggagataaattcctataaaggccttgaagttcagtatgaacttcatccctgcttttgattgatttataagc

SEQ ID NO: 21296 - DNA, 201 bp, Bos taurus
ctgcaactatggagtgtgtaccagtgttttggaataatcctgctgagaatgcaggaaaaatacaagcaatggacagagtgttaagttttctgttgtgggttggggaggcaagcctactccattcctgctgacaggactctggctcagaaataattattgacaacatcccttttgtatcaaatacaatgaataatttttttt

SEQ ID NO: 21297 - DNA, 201 bp, Bos taurus
ggaagactagacgctggattggttaaacatacacatagtaacgtgaaaccacaacatccatggcaacaaagaaggcagtgttgcaagaatagggaatagcgtgggcgaaaccagcaaggaggaaatgaaagtcagtaagggagctgaattgctaagggtgggtatttgtgaagggtagaagatgatctgttagaaagatac

SEQ ID NO: 21298 - DNA, 201 bp, Bos taurus
atttacttataatttgtttagcccattaatactttattaaagtttttgtggaaatgtctcaagaatgattttctttgtagcctctctgaaacagctcttcttcaagctcttcttttatttctaagcagtgttataaaataggaaattatattatgtgatttatttgcatgcttttatcttttatggtctcattctaaactt

SEQ ID NO: 21299 - DNA, 201 bp, Bos taurus
aatccaaccacctcttgcctagtctcagtaaaatatccaaatcctccgaatacatttccttttgcttaatgaggtgcccgggggtgacaacaaaggtttcaggcaggggagggatatgtaccagccgtggtctgctggtgtaggaggccactgaagtattacccccccaaaaaaaattgccatcaaagaatcatagctaca

SEQ ID NO: 21300 - DNA, 201 bp, Bos taurus
cagggccaacagctaggggaggatccatttccacctttatgtggttatcagaatgcaattcctccttggctgttagagtcagggttagggttccctcctgtctgttggccatgtggacctcccgactaaggtgaccttgtcttatgggcctccccactaaggggacctgcttatgtaaagtaatgacagagtgacactcca

SEQ ID NO: 21301 - DNA, 201 bp, Bos taurus
taagtggaagttgacaaatattatacatgaagaaggcaatgactcaaccttcaccggcaatgatattcctccaagtttgaagattgtgtctttaactctcctttttatatttaggatctaaaggattgcttcaaatatcatggaaaataattatttgtttaataaattcataggaagaataattgggaaaaatcaaattta

SEQ ID NO: 21302 - DNA, 201 bp, Bos taurus
atatcaaatgcagataaaaatactaaagaattagacttccatctcttaaaataattgtagactattattataaaaaacatacttcaaatcaaatcttctgatatggaaactgaggaagttgaggctagaaaggaaaaatcatccctgggagttaagggaaaacatctggttctgcacttcccctctgccactaaccagcct

SEQ ID NO: 21303 - DNA, 201 bp, Bos taurus
ttattctataaatgtaccgtttgccagtctgcaaatgctgcttcactggcatttaatgcctaagggtacatgtccagtttctaacaggagaaacaaagagcgcaaacatataagtctgtctcataagtacaagctgcttctaaacgtttatagtataaagggcaaaatcatgtactgttcactccaaaagagtctataatt

SEQ ID NO: 21304 - DNA, 201 bp, Bos taurus
ttggcatatagctctaacttgagtacaaacactcagtgctgatttggaatttcaattttcaaagatctaaaaataataatacatatttgaattacctaaaatgtcacttaagtctaacatattgttagcaatggaaatttagagctgtgcaatgtcttctttgactatctacacaggaaataggacatttttgtaacttct

SEQ ID NO: 21305 - DNA, 201 bp, Bos taurus
ctaaatttaactatcactaaagaaataatttaaaagagtgatttctaatacatattgaaaacgcatatttaagtttagcctgatttatttccccatgaaattttaagaaacaaagtttctgatataattttttttacctattcatctttatgatatctactactaaaaagactgagattgtcatgtctggaataaaatgct

SEQ ID NO: 21306 - DNA, 201 bp, Bos taurus
aggcctggcgtgctgcaattcatggggtcgcaacgagtcagacacgactgagtgactgaactgaactgaactgaggcagttgtatggatacattgacctcgcaggtcacctggctatcattaggagttaatctaagatcaaagagaccacgagtgttttaagcccaaaggcagagctgacctgtttggttgtatctggaaa

SEQ ID NO: 21307 - DNA, 201 bp, Bos taurus
atgtagtgcacagagatgaacttgatacttaaaaaaaattattttgaccatgatgcacagcatatgggatcttatttccccaataaggaatcaaatatgtggaccctgcactggaagttcagtgcctaaccactgtacaccatggaagtctctcaagatgcttcttcatggaaggacttgctgacctagcagccgagcatg

SEQ ID NO: 21308 - DNA, 201 bp, Bos taurus
ttgcagaggtagggggaatatcatcccactacttttacagggaacacattagccccttgaaagtgtgggtgacagaattccataaatgatctttttgctttcagagccaatcccatgttcctcttgaataaaaatacactctgtattttcttttcccaccttcatttctgtagctcgtgagttaggcagaacataactggt

SEQ ID NO: 21309 - DNA, 201 bp, Bos taurus
tttacatacccacaaagaaaagtaaattgtaatcccagtaaatgcttagtgtcttccagcagtgtttacgaaaggccgtcagtgaatcgtgttactgttgagctgcctttgctgctattgcaggaactatacttatgatcattgcatggtctgacgttttacctatgtcagaagagaagtggaaaaaggcaaccataattc

SEQ ID NO: 21310 - DNA, 201 bp, Bos taurus
gctgacttaatctagagtcagcaagcctgtgaacaaatgtataccaatgctgtggtgaatcaggggttccagagtagacagtgaggagaatagaccacagtagtctgtcaccgggccgtgcgtatgacgtgtccagcttgctgagtgctggaggcaatagccgtgtctgcttgtgtgctttgcctgatgagctacaatgtg

SEQ ID NO: 21311 - DNA, 201 bp, Bos taurus
agcattacagcttaaaagagatctaatactatctgaacaactatttctcaaacatggtgtgtccataacccaatttttgaactaataatttgacagaaatagtgttgttgttaaacattaatattcctgattaccaaatgaaatttataccatgttctaaggcagtgagttttgttataaaacagtaatggggctctgaac

SEQ ID NO: 21312 - DNA, 201 bp, Bos taurus
gtgcacaccaggagccaggagaaaggagcagggtcccaagaagagactgagtcttgagtgtctacaagcctctggtggagacacgagtggacagttggcctcaggccaaacaacagggagagaacacagtcccacccatcaaacaaattcatgtcatattacatgacgatttagatggtattgaaagaaagcaaaataaac

SEQ ID NO: 21313 - DNA, 201 bp, Bos taurus
tagtgacttgtatcatgtagtttctgtactggtgtttttcagttaaatgaagtatctactttctgattttcataacaggttatatatttagagaaatcaattgtaaaaactacagcagaatgaatttcatagcagtatctctgtggctcttatgagtcaaaatttccaatttaccaaatctcagagttattgggccttttt

SEQ ID NO: 21314 - DNA, 201 bp, Bos taurus
tcactataggaaagattaagaatacagaagagaaatgtttcgattgtacatgggcacatttgtatatgtgcataggaggtagggcttcccaggtggtactggtggcaaagaatccacccgtggattcaggagacgtaggaggtgcaggttagatccctgagtccatggaggactcatccctgccatgataattatacccaa

SEQ ID NO: 21315 - DNA, 201 bp, Bos taurus
acttttcagtggagaatggtggaggaaaaggcaaagtgaccttcctgctcctgccattttcccaaactcctttggcttaaactattcaatatgccaggggtccgtattttggggtagaactccatcaagacagacttggggaaaaaattgtattattttgaatatcatttatttaatatttcaagagcaattcaaatatga

SEQ ID NO: 21316 - DNA, 201 bp, Bos taurus
cagggaggccagctcagagcgctaaggaggcaacacacccagaggcagggctcagaaacgccgccatgctgactttcccaggaaagagagcagtgacccatggccaaggtctgttcctttgcacagcagatcacaaatagtcaggaaaggtaacgaaagtatgtatgcatacatgctgacatcaaaaccaagcttcagggt

SEQ ID NO: 21317 - DNA, 201 bp, Bos taurus
ttacaaatgtacccacaaagcaacttctgaacccaagaatacctaagaacaacatataaaaggtctataaaattcagaattcagaatcagagttacgaacactccctgaccagtctattataacattaatttgttgctcatccagttacatttaaattctcagtacttaaactgtaatataacacttttcattccttttct

SEQ ID NO: 21318 - DNA, 201 bp, Bos taurus
aggtggtcatgagcactgagatgatggccaggaaggaggaagaacaggatggtggtgatactcggaatccatcacctctgaataaccaggacttaacccaacttctccagccctatgatgtgtccaacaatggacctaatgggaagccacttgcctttaaccaccatgtagatgtagtcaacaaaggttttcatttgcttc

SEQ ID NO: 21319 - DNA, 201 bp, Bos taurus
gagaagtgctcaggaggtggaagacagcgtctgctaaagagaagggaaaattcgaagacgtggcaaaggcagcccaggccggttacaagagaaaagaaaatgtataccctgctaaagtgggagcggaaaagaagttcaggatcccggtgcacccaagaggcctccttcagccttttttttttttgttccgagcatcatcca

SEQ ID NO: 21320 - DNA, 201 bp, Bos taurus
gcggctgggtcggcctcctgtgaacccggaggggtccaggagcaacgaggcatcacgtccacgacctcagccatgaagcagggcaacggagaggtgagatgagaagaaaccaagcgtgggccagagacaaggccgggatccgcggccatgacggaggagggcggagagggacgccccctccccaacctacgaagacccctt

SEQ ID NO: 21321 - DNA, 201 bp, Bos taurus
ataaattctatttacataaaaaaacagaacatttgctcagatatcagcagtggcttatctgcctctgtgttagggattgtgggtaacatgattcctcccacttgtgctttctgtttccaggctttctctagcgaggacgtactgactttgtaatttgaaaagacaaaataaagaaatataaggattcttcgcctctcaccc

SEQ ID NO: 21322 - DNA, 201 bp, Bos taurus
ttttgctttgcttacctggaatttctaattttttctattggtcattatattacttgaacagtaagaaaaatacaaattttggtttctaccaaagaaagactcagtctgtcagtagggaagtttaattagtgagtggagaataatgcaaaaaactagtcataatgtggtaatccggtcttggacatattcactggatactgt

SEQ ID NO: 21323 - DNA, 201 bp, Bos taurus
ccaggtccttaataaagacatttctgggatataaagctaacaaaaaaaatgactaagacctatccagtcttcaaaataatttgtatacatttcaaagcaatgaaaaagcatacaacaattaccaattttctaaagcaaatattctaagaaagggaaataccttctagcttcagtagggtgaattaaacaactttttaaaag

SEQ ID NO: 21324 - DNA, 201 bp, Bos taurus
agccacccctcttaggctgtcacggagccccagcctgggcttctctgtgtcatgcggcaaattctcactggctggctgttttacagatagcagtgtgtatatgtcatcgttactctctcaaatcggaccaaaatttattcagctattcccctgttgatgaacaattaaatactttctagttttataaacactgtagtacaa

SEQ ID NO: 21325 - DNA, 201 bp, Bos taurus
taaaggtgtaaagtccttgggagggcagaaaggcaggaagtacaagtagagtggtcatccttggtgggagagagacagctccatgtgtccacatggggacgggattagaatgggaggggaaggaatatgtttgtgggcgtgaaaagggatgctgaaggggtttctgccttgtagtttctttctaaagaggcaggggagggt

SEQ ID NO: 21326 - DNA, 201 bp, Bos taurus
gttttttttcccctaatttttttgtcttccttattagattgagaacggctgtaagaaggagtatccattaatctttagtaggccttaaagttctttgaatcctgctgtcccctgtgtcctttcctgatgtgtcaggaggtcttctgtggggcggctgcacgagtctttgtctgtgtcctgagaggcccaccaggaagcccc

SEQ ID NO: 21327 - DNA, 201 bp, Bos taurus
aaatgcttgacctacacttagagagatggatacccatgaaatacgggtttttacccagttttctttgctgatagatgttgacaaacagtgtaatactgccgactatagatatcggctctagtggaactgtacttttagctttggtagaagcactgactgctcccgtttcctcactgctgtaaaagttgctcagtcgtgtcc

SEQ ID NO: 21328 - DNA, 201 bp, Bos taurus
acacgggctcaggctgtggttgggcgactctccgtgttcctatgccaggtgcggccggcctcctgctcgaccaagagtgcggcctgagaggctcccacacgtcaccggacctcagcagctgtgcggtctgactgacagctgtgtctggtggaagaagtggggacagggcactggggggacacagtccatatggactgtctc

SEQ ID NO: 21329 - DNA, 201 bp, Bos taurus
acccttgagatacatcctccaaaactggtcaagattcaagcccaccgagccaccaaggaggagactcacttcttttgtaatacagtctggccccaatagcaccttttggatggggagttcagttcagttcagtcgcttagtcatgtccgactctctgcgaccccgtggatggagaatcctggcccctaaatgggactgtta

SEQ ID NO: 21330 - DNA, 201 bp, Bos taurus
ctggttgggaagatggtgatggccatttggaccagtgtgatgtgatatctcattgtagttttggtctgcatttctgtaagaattagtgatgggcatcttttcatattgttggccatgtgtcttctttggagacatgtctatctagatctttcacccattttgtgattggttttttttttatattgagtttcataagctggt

SEQ ID NO: 21331 - DNA, 201 bp, Bos taurus
tcagctaggggccgggcaattctgagaggacactcgttcctctcactcaaataaaaattacagttgctaaaggaactgagcccaacctacctaagtcttgctaattacttggtaagtcctgcagtctcattccagactttctgggttcctttagcccctagaagacggggctaaaggacacacttagaagcttccagaagg

SEQ ID NO: 21332 - DNA, 201 bp, Bos taurus
taattaggttgcctccacatagattaatgataattaggatacattttcttctaccccatagtacgtggcacagtgctctgcaagggtataccttttgttaaatatgcacacagttacttgctatttagacctgctaagcccagtacctgagctcactttacttggcagctgatggttgctcttcaaagtagatgcgaagga

SEQ ID NO: 21333 - DNA, 201 bp, Bos taurus
ccagatctgatcggctcctaagcctcctgagaatttaatcattttgccccattttctgttgccattttatagtttcatcggaaacgcacttgctctgcatcgcacagttacaggcaacacatgtataacgtcttctgaaagagcagcgggctgaatacaaaggcgctggggtgagagcgctctgggttcaaacccagacag

SEQ ID NO: 21334 - DNA, 201 bp, Bos taurus
aaaatgacagttactgcttctttgtcttagaaaaaaatgttgcacacttttttctttaaagtaaatattttcagttctgttttgtgccaggcgttgtgctcggcatcagaatgcagtgggtacagtggtgagtaaacagctgtagtgcctgttctaaatatagtgattcatttagtgatgaagattgggaaaaaatacatg

SEQ ID NO: 21335 - DNA, 201 bp, Bos taurus
tgaagttcacggtgtatgtctgcactgtggagaaggagggacagacacacttacctagttcctgctgctttcatacgttacacggaaatggacgtgtcttcctgccaacagatactcacttcttccccttgtatcactgagacatggtgttctttgatgcttaagaatttagatgtattaggtgtataccttggtggtttt

SEQ ID NO: 21336 - DNA, 201 bp, Bos taurus
ggtataatctttaaccagaatttgcaatctgtgtgatcaaaatgttgtacctttcctagtatgcatttactttttgcatcattttgagagttcgtggaacgaaaagcataaaatgtattgactagtgccgagctcatgacaagttggtcataacaagtaggggtagttatttatctcctgctttatgaatgaaacacagtg

SEQ ID NO: 21337 - DNA, 201 bp, Bos taurus
attttgcccacagacccaggccaccatgggatctaattaacaagcgtggtcttgaccaacatgtgagaattagggtgcacgtgcgtgctaacattgccagagaggcctttggaaggagagagaagccacaccaagtggcaaaagcggtggtttggtggcgcacgggcggggagctgcgtccggcctaggagaactagacca

SEQ ID NO: 21338 - DNA, 201 bp, Bos taurus
gagtgaaacttggacaggaggaggggtccaaatgcctcttcttagtggttctggggcctgagacttaggggcctcgctgtgtctccgcacagtgcttaggtaggactttggctttgcaggcttggagcacagcgggccgctgcagagacggacatcgtggtgctggccagccaaggcctgccccaggcccacagggaggga

SEQ ID NO: 21339 - DNA, 201 bp, Bos taurus
tttctttccattcctagtgtaattctgtggaagacactggcctccaagtcccgaaagaccccaacccagccttggaaattgcacctctccccttgggccaccatcacagttaaaatgacttgaagtgctccagtggaagtttagaaattcagtctttagggaaagaggagcagacacttcccttggcaggtccttatttgt

SEQ ID NO: 21340 - DNA, 201 bp, Bos taurus
acctcttgtccatgtccagagttcaccaggccctttccctccatcgaccagacttcctactcctcagtcttgctttggctgggcctcgcactgggcagaactctattctagcccatgaagaaggcaagtgaacctttctgcacatgtcaagattatagattggaagacacaggatcgcttgtgatggcctgcctgttcacc

SEQ ID NO: 21341 - DNA, 201 bp, Bos taurus
acgatgtgtctttaaatctttgtcataccacatctctgcttgtgtgagaaagctgtaacagagttggagaaatctgtggtccagggagcatcagacacgtccaggctatttgggaactggcagacctcccagtggagagatttaacacatttattgagggcaggggactatacctctatatcaaagggatgtatattcggt

SEQ ID NO: 21342 - DNA, 201 bp, Bos taurus
tgagcagcccagctatggttaacgtaaaggcttcggcaacaggaagctctgggttttaattcatgttaatcctgactctccattactagtcaagtaacttgtctgaatcgttgagtagctgtaataatttgtttactagctgagtaactatgtaaggccatttgctgcctctgagtttcctttctgtggctgagagaattc

SEQ ID NO: 21343 - DNA, 201 bp, Bos taurus
cctatgagacacagagaacacaagtagtttgaatgtgggggtacttgaaactacagcatggctctgcattaatgtcttccaatttgatagtcctcaggaacgcctgaaaatctgactagcttcctggattgtcatatttttcaatatgactttaactaatattagctgtctttttttgcttgagattgaaaaagaatattt

SEQ ID NO: 21344 - DNA, 201 bp, Bos taurus
ccaccttgtttccaggggagcgctgctgagcatcacagaatctgcacgcccttctcactctgtctcgcttggctgtgctttgccttctgccctcctggatgggtcatagacccagaggccagctccctcccagagcagcatgaagacagtgccgcagcctcctcagtggttccctacttgaaagctcaggtcagttttcct

SEQ ID NO: 21345 - DNA, 201 bp, Bos taurus
caaatcgctctagaactctcagcctggacgcctgacaaccctcacgtggcagacactctgaatgcgtgtgtaggcacatacgttttgaaacttgtgaatgtcttgatgaacaaaaacaatcaatactttttttttttttttcaaatcatgtacattgtgtggctagagactattcaattaagtcaaaaattctctttaaca

SEQ ID NO: 21346 - DNA, 201 bp, Bos taurus
ccgtgcctcagaaggcagagaggttgaggacgtgagaagcctttttcctgccaacaagaaatgggggacacagacaggctttgtacccaggagggtcccatagcgtcctgtctgggtttagcgtgagggaaaagggaggacacgtaaagcatgtccctttggagctagttaagagattaaagacgtttaatttgtaaaaga

SEQ ID NO: 21347 - DNA, 201 bp, Bos taurus
agctgtcctcaggcaattttctgagtagtgctgtttaggaaggaaatagatacaagtggtgggcattgcttgaaaatagtaaaataatcagaaaaaccaacagctaccaagagctaagaattcactgaaccctgtgagaaaccccactaagacatggaggaacagtcagggaggtggtttctttgcaaagtttgggcattt

SEQ ID NO: 21348 - DNA, 201 bp, Bos taurus
gaaaaaagtgccatgctactggcttagagatgggggtgggcacatgacaggtattgaggaacctctacaagctggaaaagacaaggaaacaaatcccccccaaccccctgatgtaacacagccctgctaacaccttgactttagacttctgattttcagaattgcaagaaaacaaatttgtgcattttaatccaataagtt

SEQ ID NO: 21349 - DNA, 201 bp, Bos taurus
ctggggaaggcagatgcataagaggagccgtgagcacagccacggagcctttggggagcacagtagcagtctcttttgtcacttgccagtcagcttcacacgagctctcctgctgtctgtgcctgagatagattctctgccccaagacaactgtgatgctgagacagggtttaggaaaatgtgtaaagccaccttgttcca

SEQ ID NO: 21350 - DNA, 201 bp, Bos taurus
gtatcatctgatgttttcactcaatttgtgacatttctaatctcagacaagtattttcattcaagactaatgctttacctgctccttgtaaagacactgcactattgctgcatatttactaatgattgttcacaattattatttttctaaaatttcacataagaatcattattacattcattaatgcaaaaattcttaatt

SEQ ID NO: 21351 - DNA, 201 bp, Bos taurus
tatcacagaattttaaaggaaacggacagcccgcggcttgagaatctattaagagcgccaagtctaaccactgacgtgcttacctaccatgagttcatctgtagtcgctgcaccttccagccccccggctgccccgaggccatgggtgaggtgttgaaagggcctgacccaagggcagaagaaggctttctgagaagcacc

SEQ ID NO: 21352 - DNA, 201 bp, Bos taurus
aaccttttaaaactagctttgttgagatgtaattcatacaacacaaacttccccatttaaagtgtatgatccaagggacttccctggccatccagtggttaaagtgtcccaaataaagtgcagaacccaagggcaggaatcacttactgaagacctgccccccagccaggcgctgaggatgagccctgaggatgcggccac

SEQ ID NO: 21353 - DNA, 201 bp, Bos taurus
agaaatcttccttggggagaaatcttccttgggtgtggcagaatgggtgtgccccattcctgtcagtctggttccatgatgtactacaggtacacctgtgagttttgacagcgaggttttaaatttaggaaatccacagtcatcactttgacactttgaggagtggctgcttgtcacaatgagttaaaacatgcttatgag

SEQ ID NO: 21354 - DNA, 201 bp, Bos taurus
agaagagaggagagactcaattttggctcctccttttatttgttgtttctcctccccctgaacccgccctgtgtaaaaaaatgggaggctgtttgcttcatctcaggcactgcctccagtcctcaaccttcttttattttatttttgcaggcttttcccttctctctcttttgctgctgctgctactaaatcgtgtcagtc

SEQ ID NO: 21355 - DNA, 201 bp, Bos taurus
aagacttaatgtctttcgttattgttaagataaaatattctggctatatctggacactgcccgacactctggggccctcaggggcagctgcaggggccaccaacatttatctttaagaataaaggtaggaatgcagttatctgaaatgaacattgtgttttaggagacttgcacagctggaggagtcaggccatgagagac

SEQ ID NO: 21356 - DNA, 201 bp, Bos taurus
ccttgggattttcttttttagtgttctgtttctttgtcaattttctccggacatttatttgtacactgggagctttggatttcggttcacataggcattttctttcatccatgtaaaatatcatcttgttgggtttagcctatttatccagtctgtgttttccaacagtgccatggcctttctctttatgctgactaacat

SEQ ID NO: 21357 - DNA, 201 bp, Bos taurus
gactagtagataacccagttttaaagaagatagaaaatcagcaataggatctcatgataaaatattctattaatttatgcaggctttcaccttgaaatgtgatctgtgaaagatcaccttacttgtgttttcatgacttcatctaatccaaaaagtaaatatgatgagtttacttgctaagcttttgcacatgagattata

SEQ ID NO: 21358 - DNA, 201 bp, Bos taurus
tatgccactaaagatgctatgtggtttgtctgtttcctcatttggaattcagataattcaatgataataataatgatgatcgtaataataatacctcttgtacttagtaagttgaagcagatggaaatggaaagcccaagctgctattcagcagagaatcactatgcaaatattccaacagcttgtgtgatttttcaaact

SEQ ID NO: 21359 - DNA, 201 bp, Bos taurus
tgaatggcatctccaaaacctattttttgacatcctcaaaactgattgtcctttaaaatgacctgagaagctacagcctctaaggactggcacaaacctggcaaaaatcactctcagaaacagtgacaaagacagctcactggcagtgagttattaagtgaggtagaactgagagccgtaaggtcagaccccgccccccac

SEQ ID NO: 21360 - DNA, 201 bp, Bos taurus
tgctatagtgtattggtctgaatacagtttttatttaaaaaacaagcaagcaatgtgtacaatatctcctctaaatgttaaaagaataattttcctcttgggaatatcagttacattcccagagcattgttaggtatgatgttttgatattttgatatattgatatttgatgtttttatatattgatatcctgaatatcaa

SEQ ID NO: 21361 - DNA, 201 bp, Bos taurus
attggctgacttcccatcaaaaacttctcaacaaacttttgctgaaatggcagcaggcagagaccttagcagatggactgtggatccacatgcccatttggggacgctcacaagagggaaacccatgtggcttttgccactcatttatcatttccacgcctgtagcagacccacggaaaaaaggtattctcagatgtcccc

SEQ ID NO: 21362 - DNA, 201 bp, Bos taurus
cttatatatggaagctaaaaaaaatttttaatgacagaaatgaactattatacagaaatagacctacaagacatagaaaaaatttatggctactgaaggcgaaaggagacagtttgggactgacatatacacattttactatgtataaaatagatcaacaacaaaggtctactgaatagcatggagaactagactcaatat

SEQ ID NO: 21363 - DNA, 201 bp, Bos taurus
ataattgttttcagagcataaatctaattttaatggagggaatgtaattccgtctctacctcttacaccttgcaggttattttggcagccagaagctttttcccatagaatagaaatccacccaccactcttcccctttgtcgtgggcggtccagagtggcagacttcacggctggccactgtcactgtcctcattgctga

SEQ ID NO: 21364 - DNA, 201 bp, Bos taurus
gtgtggtcagggtccggtctgcattttcaccagaaaggtaaaccctgaatgtgtaaatactggtagttcaattctctgacatttgatacattaaaataaataagtctgtttataaaaacacatctaggccttgagagcagatagacaaaagtaaggtgattgcacccagataaaaaaaacacaggctttccggccagaggg

SEQ ID NO: 21365 - DNA, 201 bp, Bos taurus
gctctgctaacctctggggccacgcttgtctctgtgccagcactccattgaagccacacattccattataaccacacattccaccctgctgctaatggcccatgttgcaacagacctggcaacaaggatacctcatttaggtgtcatttgtttcctttaaaaattactatccaaggcccaatgctcacttcctgttttgaa

SEQ ID NO: 21366 - DNA, 201 bp, Bos taurus
aagagaaacttgaggacaattgtaatgagtatatttaaagcattgaaagatgtgaaatttctcttcaatcaaagtgtctctttgattttaatttcctaactgtgacttaacattatggcagttcagtttttacatctttctatgaatatatttttagtgctttactcagaaaggaataacagtatttcagaatgtctaagg

SEQ ID NO: 21367 - DNA, 201 bp, Bos taurus
ctcctgggcctgcaaacggccaccttctccctgtgtcctgacatcgtctttctctgtgcgttacctgatgttaccctgtgtgtcccaatctctggttcttgtacagataataattagattagggccccataattatggcctttactttaacttaatccctcctttaaaaaaccctatctctaaatacaatcacattttgag

SEQ ID NO: 21368 - DNA, 201 bp, Bos taurus
acataagtaatcaaggtgattagagattgctctaagttctcaagagaaaatagccaggatgacgaaacaaaataaatgagagcagccacgctggatggcatggttgatgaagactttctaagacactgaaatgtgagctgagtgggatcaaaggcaaggatgtctcgggcagaaggaacatcttcaggccaccaacacagc

SEQ ID NO: 21369 - DNA, 201 bp, Bos taurus
gatcacacacaaaacacactctttgactttttagataagcttgtgggctagtgaagtttgagaaataagatgacagagtttagttcctctgaggacttcttacacttcaaattatttaagaaatgggaaacataacttactttgtttaaccttagaatacccataaaaagacccagatatgctgagactgagctatagacc

SEQ ID NO: 21370 - DNA, 201 bp, Bos taurus
gctggtggactcacaggcgtttccttgaactggcagtgttggtagaccacggtcggtatctttatcaccaaagtaattcctcaagtgtgcagtctgaagtatgcatggttgtcaatggaatagataactttttacattcactggatgttaatgtggttttgattggaatcgagatctggtctgaagacaacctccttccaa

SEQ ID NO: 21371 - DNA, 201 bp, Bos taurus
gaccagtgtggccttaagatttcatatgccaaacattgctgctctcaccattgcagtagaagcaatgacccatccatacccacacaaaacttctagctcacggggggtgctggcccagcagcccttcctcacctcccctccagcacctctgaccaggggcagatatcacagatcttcatcaagacccctgtcatccagagg

SEQ ID NO: 21372 - DNA, 201 bp, Bos taurus
ccctgggaagacccctcccccggaaaccactgaagtaccttccgtgcagggaccactgcaagtgccagagactccagggaggccaaccccattacccaccaatttactgggcacccagagacttccctcatggtccagtggctaagtctctgtggttccaatgcagggggcctgggttcaagacctgatcagggaactaga

SEQ ID NO: 21373 - DNA, 201 bp, Bos taurus
cagtgcagggggcctgggtgcgatccctagctggggaactaagatcccgcatgccttgcaacaaaaagatttttttaaataccaggtactctcatgtgttgagtggccttcctgtgccagatactgagccagacaccccacaaacactgtcgtgtttgagacagaccacagagcgccaaagacaaggttgcagaggtctga

SEQ ID NO: 21374 - DNA, 201 bp, Bos taurus
tgtacaccagaaactaacacaatattgtaaatcaactatccttcaattaaaaggaaagggcctgcctcaaagtcaacctggactggagttgatcaaagagagtctgagaaccacctgcatcagaacgctctctcagcgggtaaattatgcagatccacagagggggccaggacaagacctagatcctctgattccaagagc

SEQ ID NO: 21375 - DNA, 201 bp, Bos taurus
ctatgtgacagaaatggcagcagcttacctcacactgcccctacacacctcatctcttgctaacaaaacactggttttgtctggatatccatttggccacgcactttaagggaagactgagcctatctccagtagcactggcatcacccacaaacttgtgaagaaagcaaattctcagtccccaattcaaagtactaaatc

SEQ ID NO: 21376 - DNA, 201 bp, Bos taurus
acacacagattatgacagaacacaaaggaatagtcaagaattttcaagcgtacgttaagcccccctccccacccctccacaactttatttggatgttactctcatcatgttatgcaagctctcctcatctatcttgctgaagaggaagagccttaggcatttggggaggaattttagaagctgtaccaggaagatggaaat

SEQ ID NO: 21377 - DNA, 201 bp, Bos taurus
tcttgggcctccgagctgacacgcagggacaggagagctgtccaggggtcgctgggaggacacacctccctcttaggccaatcggagcacactttctcttaaaagtcatatgttctcttcacctgaaattggaagacttttttcactccctgggctgttaggagtgccatggcccctgcatccagttgctaggagacctaa

SEQ ID NO: 21378 - DNA, 201 bp, Bos taurus
agactgggaggagcagtccttggaggtggtggggacactggaagacatggggacactgaaggacagagtgacagactgcagtgatcctgggggcatagcagtgctggggatatggtgattatgggggacatggtgatgctggggcgcatggccacactagggacatggtggcacagggggacacgatgacactgggaacac

SEQ ID NO: 21379 - DNA, 201 bp, Bos taurus
atcactggactcagccccttggcaattgcccagctgggtgctgtgacacccatcctctgtccctaccctgccgaattgctctatcgccaagaggccccttcccatcagcctttattcatcaagggtccagctaatgaacctgccctgagcatcatcaaactaacacagagatgacccacagagaatgatctgaaggttgcc

SEQ ID NO: 21380 - DNA, 201 bp, Bos taurus
aggatacaagggtcaggtgatggaacatagatgctatgtggttgtgaaacattttaagtcagatgagaaggtcaggtagccttttaaatgacctcatcctcgacctcaggccttcttatcaagtagcatatgtagaaaaagaaataagacagatatatttggctatttctttggcggtccaggggctaagactctgcattc

SEQ ID NO: 21381 - DNA, 201 bp, Bos taurus
gtagcagtgagcaagaaaatagcaaacccaaccattgttttatttatatgttttatcagaggatttactagagccccacaaaatctatttaattaaactcacttatgtgatagcaagataaataagtattgttttatgctgtttcacgttatagcttcttctgctttctctgtcttttggtgggctctccttctggaaagt

SEQ ID NO: 21382 - DNA, 201 bp, Bos taurus
tagttggtttcactaggtggttccaaaatagtaacagcatttaaccttctcttatgtatttcaaaaacttccatcctactgggttaaacctgttctctaagctttcacatattccccctcattcattccacctttaacaaacgacctgccactcctaatgtccacatcatatcctgtgaaatcaccaatttcttggtgtga

SEQ ID NO: 21383 - DNA, 201 bp, Bos taurus
aaccctggcccccctgcattgggagccgagtcccaggccctggaccatcatttcagctctcttttgctgcttctctttcctcttgatattcccagaagcccgcccctcctctccaatgccgcatcgttggcctctgcacctctgcccaacccagctcccctgcagagacctccgtcaggtcttcccctgtcccctagccta

SEQ ID NO: 21384 - DNA, 201 bp, Bos taurus
tggtgtggcctgtcttggtgtctggtacagggattttttcggtgtcactcctgtgttccagggttttctcagtggtgaccagcacacgaatacttgttagttgttcttgagggagagcgaaggcctataggaatggcctatgtcaccagcttggtgatgccactgtcctctgttgtctcttcttataagaacacacacaca

SEQ ID NO: 21385 - DNA, 201 bp, Bos taurus
atgaaagaataaatgggttactagcagagcctttactatttcagaccctgtgttatatgctgggatgttttggcaagtcagacaaggtctgtacctttcagaagtttggagtctaatggaatcagactcattcatgatcatacacatatataaactgtgatttgaactgtgaaggaaaattatctcttcgagaaagttttc

SEQ ID NO: 21386 - DNA, 201 bp, Bos taurus
gcctttaatgaatttggaaacagagttgaaactctaatgtcctttgatttctcttgcgatttgatttgtgatcataaagggcctcaaaaggtcaaacaccagactcagaattaggaaaagcagtgtgctttcaaaatacttacatcaaggtctgtggccaaagtgattcacacagtttagtctctgagggtaaaggaggtt

SEQ ID NO: 21387 - DNA, 201 bp, Bos taurus
agttttcttctttttgattggcaaattggtaggcgacatgagtatgtctcaagacactagtttgaattggggcaaatatacattctaatgattttgttactgtgttacaaactgtgctacactctcatgaaaaagttctgaggtgttaaagggcgtccctggtgactagtggtaaagaatccacctgccaatgcaggagac

SEQ ID NO: 21388 - DNA, 201 bp, Bos taurus
actatagtgcagaacaagaaatggaagtaaatatcaccagtttcgctttagtatttccttgttaacattaactgatatcaatcgggatggggttgggggaggtcttctatatgggtcatttaggtaggtaaacatatgttgtcatctgccctgtacttaagtaggaaacagacatttaatttggccagcacactctgctag

SEQ ID NO: 21389 - DNA, 201 bp, Bos taurus
ttccttagaagatacaagctgccaaaacatacacaagaagaaataaacaatctgaataggcctgtatctattagtgatacaaccagtcattatcacctctcttgatgtattgccgtttttatttataatatataattttagcttatcacagtcacagtcaagtgatattatgccactccacatagactgtaagaaccttaa

SEQ ID NO: 21390 - DNA, 201 bp, Bos taurus
ggacttatccagaaggaggaatgtgtctcattcctgtttgacaggagagaatttgacagcgcagagcaaggcaccaactggagttaggcccctcccctcctccagaagctggacgacaggggtgctgtctcccttggcatttacatctcaaacaaatgcctctctggtctttgaggaaagcatccctgccttataaagctg

SEQ ID NO: 21391 - DNA, 201 bp, Bos taurus
ctaagttttttagggggaaagtatttacatctccaggaagattctcttttccagaaaaagtgaaggcacttcagttggatccaaggctagaatctgggagaaattgaataatccaaggaattattttcaccagttaaaaagaaagtatgagatcattccctctactttccagcacctgtacatacagtagggatagcaatg

SEQ ID NO: 21392 - DNA, 201 bp, Bos taurus
atggctcaggatcttctactttggctttttgctggtgaacagagaaactttttgttcatgtctacagatggcagcgctctaagcaaaactcagaattatggaagccaaatagtggtgtatccatttgctactaaatataagcccacgattcaataaccagtcagagctgaccatgaaaagtaacattaaatcagaaccaga

SEQ ID NO: 21393 - DNA, 201 bp, Bos taurus
atatttattagcatggcatttatttatacatagaagaaaccaaaaataacttagtaatcattgttacttgcacttagcaaaaacagaatcaggattcatatgagaaagaagaaagggagaagggaaacccatagacagtttaaaaacagtaaattttggataaagggataattagctaaacaggggggctaatcaaggtgt

SEQ ID NO: 21394 - DNA, 201 bp, Bos taurus
cccccaggcaggaagacttcaccattcttaatggtcccataacaataaagcattcagcctgccccagatgcttttcaaaagacagcagaaattctcctcccacgttggagggaaaactccactacggcttatattacctctcactgtaagtaaaactacttaacaaaatacagaaaacaactacctgaggaccctgaaaag

SEQ ID NO: 21395 - DNA, 201 bp, Bos taurus
acacagaaatatgttaaggtctatttttaaaagtttacctgtcctgaaataaacgtgtttcatgtatttgtttaaactctgtgttcgtcttttattttcaatattttcccactgtccatgataatattttatacaatggattatttaaaacctctgtgaaatttgcctggaggcaagcttgcagttcaagaataattaaag

SEQ ID NO: 21396 - DNA, 201 bp, Bos taurus
aaatcctccagcagttattttctgaaggttatgaggagccatttggcacgctcagtgaggaggcggttgacagcaacctgggttgcttcctctaccgtggcgctgtttgcctctcacgttgacccaggcctcatgtctggctgtttgctgtgaccccttctctgttgatcaccccttgaaccttccagtgtcttaagcctg

SEQ ID NO: 21397 - DNA, 201 bp, Bos taurus
caactggatagaagaccttatctggagttgagttcattgaatattaagcagtacttatagagggaaaaaaaagtgctacatcaaattctgtagattctgagaaacattatttgcttattatacctgtctgtcatgtttttgtttatatactggggtttatcaacaaaaattggactcagatattttgtcaagagggaagac

SEQ ID NO: 21398 - DNA, 201 bp, Bos taurus
acgacttacaactcttactgtgcagttgaggaattgccatagataactaaaaccaccactgactgctcatatattgaaataattaatgccttaatctgtaaacctggctcataattctttaagtttatttttactgtataattactttgctttttacatgttgcaataaaattgtggcaatgctgcggatgccattcttct

SEQ ID NO: 21399 - DNA, 201 bp, Bos taurus
actaagattcacattcctactgcaagtagtaaagaattaacttctatagatttgcttgaaataaatagaaaaagaaaacaacctgagagcaaatgcaaactgaatgttgataagaaaggtagataaacagaagctcatcttgccaagaacatgatacaaatgcttataaattcattgtggtattataacttgatgagtaca

SEQ ID NO: 21400 - DNA, 201 bp, Bos taurus
ttccatattataaaatctaaagatttgctaaattgctgtcctcatagtctctttaataatgtcattttatttctctactacaattttaatagtcttattatggaggttagccaatatctttgccatattgaatgaaaaatcttaatataattgtgttaaaatatttataaaaacagattttaagaaaaggagcactactta

SEQ ID NO: 21401 - DNA, 201 bp, Bos taurus
agactcacattttttaatcccttgctttgtgaagtaatgtagtactatattaaatgggttacatatagtacttaatcactctaatattttcagtaaagcttataacccttagtttacagattataaacaacctgaggggtataaatagtaggccaattaccaagagtcacttaaatgtgtactacaatgagtttttgtagc

SEQ ID NO: 21402 - DNA, 201 bp, Bos taurus
aaacactataaaaggctatctggagggaaagggtgaattgggtggtgtttaatgtgtacagattttcaattttgcaagatgaaaagagctctggatactggctgtgcagcagtataaattatctaacactgctaaactgtacacttaagtttgattaagatggtaaattttatatatgcattttaccattttttaagtgaa

SEQ ID NO: 21403 - DNA, 201 bp, Bos taurus
ctttgcggaaatgagccggagcctccaaattcatggtcgttggtcctgtaaaggcagatttcaggagcagggccgaagacagagagaaaatgtatagctacattttgaattgcagaatgctagtttctttttccctaacctatcagaatcctggcagccagttgttaattccctctccctaatacctgatcaggttcacca

SEQ ID NO: 21404 - DNA, 201 bp, Bos taurus
ccactcctcttctactccattctcattactcttttagaaaaccttggttaacaaggatatatctttcattattttatcaaaacctaattggttataagcaaacagatacacacacaaacatataaatacatttatacacataattgcttgttattaagaattatacacagttctgcatattgattttcatagttacatatt

SEQ ID NO: 21405 - DNA, 201 bp, Bos taurus
ttcattattctacttattgaacattgcaatttattttgtttgtatgcttactctcactgttagaatgtacacagtgagtgcattttatttatgcttgtacactcagatatgcttgaaatgaattgaattatattggattggcctgccttgagtggaactgtactgaatttatttaaatttaattggcatttgttaccatct

SEQ ID NO: 21406 - DNA, 201 bp, Bos taurus
ttagagcaacaataaacaaatggggcctattcaaactttgcacaggaaaggaaatcaccagtaaaacaaacaaaaaacaacctatggaacaaggtgggcacgggggaggcccacaggaaatatttgtgaatgatgcagcaaacaagaagttgatattcaaaatatacaaatagctcataaaattcaataccaaaaaaacaa

SEQ ID NO: 21407 - DNA, 201 bp, Bos taurus
aagaccagctagccagccctgtgatgaatgctctggttccaaagcatggtcaactgatgttttgtacggtttaccttcccctatactttaatgatgctggaaaagattgaagacagaaggagaagggagcagcagagtatgagatggttagatagcatcaccaatacaatggacatgaatatgagcaaactccaggagata

SEQ ID NO: 21408 - DNA, 201 bp, Bos taurus
ttaaaaatcttagtttgtatgaaggcaatttaataaatgccatggaaaaggaaacccatggaatttggggtttcctttggtgtcccatgaaaagggacacctagactctatttctagcattagagatggagggatttgagaagacctcccagctgacatgtcatttaatgtgcacaattatggacagattgtttacacatc

SEQ ID NO: 21409 - DNA, 201 bp, Bos taurus
cagagattactctgggaaaaaattggtcaagaacaaataggctgaaatttggatatgctactgcttccaaggacaaagaagtaaccatctgtaacacacaactttatttagcaatgaagaacttgctcctaagaggaaaacacctcttgagctaaagcaaatagacccctccactagaagaggggatttggcctctcactt

SEQ ID NO: 21410 - DNA, 201 bp, Bos taurus
tgctttgaactagaaacttttcttacagctctaattaaaaggaagtttcaaacctacgaattaacagttttaatatgctattcctggtgattaactgcttcgttttagctggcattcactgttaacactgcaactgttaattttaatggcttgatttttaaattctaagaggagtaaaacgagttcaaaatgattcctata

SEQ ID NO: 21411 - DNA, 201 bp, Bos taurus
ctactcctgtactagaattcaccagacaacctctgtgaaagtcaatgtgtttttattgataagccaaaatacagcattcatatatcaaatattgcgagtcaaggagcaaacatctgaaatgctttcctaggaaataagagaagcttgacatagaaataaagtttattttcttttttccatagaatgagctacaacagatca

SEQ ID NO: 21412 - DNA, 201 bp, Bos taurus
gtgtttcagacaattcgggtattttattttgtttcagttgtataaaatcttcatggaagagagaaggaatttctcacctgtctagaatcctacattcacatagggccaggacccaattacgaacacactttggggacatataacaatggattggtcactatcacataagcacagatgtgctgctttatctgaaacgttgcc

SEQ ID NO: 21413 - DNA, 201 bp, Bos taurus
tagtgattggcaaagtcagaatactaataacccagacaaatcatttgatttctactgtcttaaattgcaaactgatagttttcgtctaaacctcatatcttcttaaagcattaactttggacctttacatccctcacagcatgcaggatattgattatccacacattttttttttgttgtacagttgctaagttgtatcta

SEQ ID NO: 21414 - DNA, 201 bp, Bos taurus
atatttggccttttgaaatttgtatttgccctaagattcatgtataagttcattgctatactttttaaaacaaataaataaaatcaatctaatttctctctgacagtaactaaataaattatgtcatcgcagttctatgaaattcattgtacttagtgaataattatgtatagactgagactagcgaatcaccaagataaa

SEQ ID NO: 21415 - DNA, 201 bp, Bos taurus
gtcggggaaagggtctatctccgagccttgcgagcgggtgcccagcccttggcggggcgttcagccccggaccgaggccggcgagcctgcagagcttagcgaagtcaggcagccaccgagtgtcagagactggcgacgctgcgggactccgcggcctccaggagactgggaggtgacagcaaggcccgatccactcagtgg

SEQ ID NO: 21416 - DNA, 201 bp, Bos taurus
ttaattatggcccagagtacccatgtcctctctccctttctctgacttttttctcaggcatccatacctgagttgatgacctgaaaagtttaaactctcacatgaatggccccaatttaatcactatgttccccattcccaagtccctgtctgcccactgcctttactgaagctatccacgtaggcaggaaaacagattca

SEQ ID NO: 21417 - DNA, 201 bp, Bos taurus
aaacttgttatttaatttctcttaggctacatttcctaatttgtacagagaagccactaatatctacactgtaaatattacagtgggatgagtaaaaaccgataaaaatatcccaagagctaaaagtaacatatcacaaatatgatatttggggttgtccagatatttgagttatagtcttaaaaatataagattttaaaa

SEQ ID NO: 21418 - DNA, 201 bp, Bos taurus
ttgcatccaaaaacttatagtaacgaagtagagatttgtaacctatgtaaattctgtaattacttgatttctattttaggagtacataggataatattgccattattttaagttagagaaatattcattttatatttgttgtataaagagttaaaatataaaaatggtaggttcattttaaatagccatttatttctcgtt

SEQ ID NO: 21419 - DNA, 201 bp, Bos taurus
ctgggcagctacctaagggagccatggcccattaaaggagcccctcagaatggtaaagactggttcaaaccttctacatggttaagcatgccacccgcccatgcctggtgctgtaggatatggtatctctgaggtcctctcagacaatggctgctattaattctgtgggagagtgtccagaaggcacttgggaggctgctt

SEQ ID NO: 21420 - DNA, 201 bp, Bos taurus
tgccttctggaggccccacgggacagtatatttcttgcctttttcagcttctagaggctgtccacattcttcatgtggtgatgcccttccatcttcagagacagcaatggccatttaagtctttctcacattgtatcactcttgacactgactctcctgcctctgccttccacatttatgaactcttgtgattacctccgg

SEQ ID NO: 21421 - DNA, 201 bp, Bos taurus
atctgcttaagcttttcacaaagtgaataaataggaaaagggtacaaccaaaagatatttatcacctggtttttttttaatcgaaatgttatccctggtaaaggaaggtgaaggtaggagtgagttgaggatgattttctaaggcaaacctcagtggcaggcagtcatgtgaaaccagagggttacatggacttccttcca

SEQ ID NO: 21422 - DNA, 201 bp, Bos taurus
ttacagtaagatgaaaaatgaaagtagaaatccgaacccttcaggagctctgcaatgttgctgtcaccagtgtccctgctttagttttccacaggatggaggctttaggaactggacaaggtagatggtaattgttgccagtatttttatcctcagggttctgtgtactttggtttctaaaattcatctgtctctgagccc

SEQ ID NO: 21423 - DNA, 201 bp, Bos taurus
ccaatcctggtaaagccagtcgtctcatcgcggccactgtgctccactttgtgccgaacgctctcccatcatcccacagcaaccgtctcctagccaccgtgggattcggccgtgtgagggacgccccagcagggtcccacagcgaatagtctctgaaacaccgcgctctgtgtgcgcaacgcccactcccccgcatttccc

SEQ ID NO: 21424 - DNA, 201 bp, Bos taurus
aaaggtttacagccaactgctgcctagaggggccttcttcatccacggatatacagtcttccaaggcagtagaagacagtatctgcagaagtggcatcacgagcagcaacgaggactttgggatcttctgactctcagcagaagaaaggagcttcagagctggtcatccaaacaacaattcacagttttcaaaattaatac

SEQ ID NO: 21425 - DNA, 201 bp, Bos taurus
gtttgatcatttctttatagactcgtttaacttgaattttctatcccctttctttcttgtgaattggagttagatctataagttttattccatttaggttgaatatttttagcaagacacttccatagctattgcttgttgtgtttcacatcaggaggcgcttagtgttgattatcccagtattagtgatacagagcttta

SEQ ID NO: 21426 - DNA, 201 bp, Bos taurus
cattttgatgtatatgtgtgtcatgaaaccagataatggtattttgaaaatgaaatatttaatttttcctcccgtaatataactgcccatttggaaagggaaagagtgtataatcttcattacaaggtttgctgactggtagcattatcttttgtgtgttccttaaagaacatctggccatctaataatcccccaaaatat

SEQ ID NO: 21427 - DNA, 201 bp, Bos taurus
aagttcgtaattgcacttgataaatgagtaacctttggatagctttcctgtaggtgtttgcagtgactttggaatcctaagtttgtaacttttttccagctgcatttccaaggttctgctttgtcagaggaactgctgtttatctggtaaagagtaatttatttaattgatgagatttttatttgtatacaatcaacaata

SEQ ID NO: 21428 - DNA, 201 bp, Bos taurus
tgttaaagtttctaacaggccaccaggtttggaggttacaatcctagcaacaatcttctggttgttcagctatcaggattctgtttcccagggatccccaatgctcatcacggacttgttctgggtacagatttctggaatgcttgtctaccccagcctctgggggctgcagctaaaaagctatgggtttaacaagttctc

SEQ ID NO: 21429 - DNA, 201 bp, Bos taurus
ccagggaggtgccagctgcttggaagacccagtgagaatttgttgagtcttctgggtcttttccagaccttcactgtcctttaggcaggcaggcccaccaatgactgattagaagcccagatacccctgtttcactcacagatcatgtgtccaacccttccccaggctcagcttcgattcccctcctcccccaaggtttca

SEQ ID NO: 21430 - DNA, 201 bp, Bos taurus
cttttcttggggtcccagtggcttcacctctcctggaagtggctgggggatctgtggttctcctggcctctgagactccagacctctcttctcagccttgggagttaatttctttttgtgctgttttttcttttcctttcttcctcccttccctccattcccttcaacttcatctgacatagttcttcgaaagttgaggta

SEQ ID NO: 21431 - DNA, 201 bp, Bos taurus
tgattagagaaaggattggcctcttgtcaaattatccttgtaggtgaagttggtgaaagatggattagatgatagtataatgaggtggattcctagctcattgaacaagcaggcccattagagtgttgactgatggctttttgcctgcttggaacagtatcactagcaccatgccacaggactctgtcatcagctctgtcc

SEQ ID NO: 21432 - DNA, 201 bp, Bos taurus
cgggaggagctggctaccaagtgtgggccatcaagctgctgccacaatcaagcaggggagagctaaggaggtgcagctgggcaacctgctatcactctcttggggccttctaaccctagaaactgagaggaagggttctagatggagggtgattctaggagaaagacagttcctctctttaaaaggacatttttaaaaaag

SEQ ID NO: 21433 - DNA, 201 bp, Bos taurus
gaatagaaagtctggttttctatagtttctccaaaagaaagggcattataattctacagttctgccagagatgaggtctgatgtttttgttgtaaaagacctggaacctgttatttagcaaaataaccaggagacgttccctcatgataccaaagaataaggctgactttcagaaatttaaagtgatcaaattttcagttt

SEQ ID NO: 21434 - DNA, 201 bp, Bos taurus
tttaagttgctttactgtccaggcctattcttgtactgattaaaaatttccattgtctataacataaagatatttggctggtcttagaattacctggagcatcattcccattgtggggcccactggtgagaaagaacaggtcatgcatattcagagatctaacaccagagctgagcccagggcccttgtggggaaagagct

SEQ ID NO: 21435 - DNA, 201 bp, Bos taurus
ggaggacaggcagtgagcgatcaggtaccatggaaggctggacccaggtagcccaagagctgatgacactgcagagaacgccacagaggaggaagagaggatcttccgccttctgggtaccatattgcagaaagccgagagagtcatgtttgtggaatagttctgtgtactagaaggatggcaataatctttatgggcttc

SEQ ID NO: 21436 - DNA, 201 bp, Bos taurus
caagtcaccaggagatagagatcataggggctactttaaaatccaacaactataccaattaatccacttaaaattaaatgcaaagttagagtaatacacttaaagcaagagacacaggggcctttgtaagttaactacaactatttttagcccttccatgttacttagtttctgaatcttgacaatgttttggacagtcca

SEQ ID NO: 21437 - DNA, 201 bp, Bos taurus
tttgagttaggaggggaaaatgcacataaagagaatttaaaatggtaccaaagtaagatttacaatacaggttgagaaatcaagccaaattctgtattttcatttaattccaaactgtaatgtttcaaaatttaacgagtgaggtagaaatccacttttacagcttagaagtataaaaatatgggataaacaaacatccct

SEQ ID NO: 21438 - DNA, 201 bp, Bos taurus
atgaactcaaaattaagcattcatttttaagccaaggtgaggacagtagctctatttcagcaatacagagaaggctttcagcattccaaacaaagaaagggagcaggaagactgagttctcctacagaccacagcctgcaagcatcttaacctgctgaaattacctaggtggcccactcataaggtgctttactctggaac

SEQ ID NO: 21439 - DNA, 201 bp, Bos taurus
agaaagcacagaggccatggccacagcctggaagcatggggcagcagagccacggtcagtaaagaacaaaagacaacacatggacaagaacatttcctccgggccaaaaaaagtcatcaggaatttggattgcattgaaaacaccaaattcagaattaaccatatttaaaactttaagtgactgagttagcttgaagcagt

SEQ ID NO: 21440 - DNA, 201 bp, Bos taurus
tttgactacaatgtacaaacaacaagcctacactcaggccacttgaattttagttgcagagataagtcacaccttaccaagtaaatgtagaataaaagtttaaatagtaacaagggccttgaaagaaaataaaacagggaaatggctgagaatgaaaatgttttagacaagatggttggaaaagccacacaaataaggtga

SEQ ID NO: 21441 - DNA, 201 bp, Bos taurus
gggattttgagttctagtaaattctagtattagaattctgcccctgcaagggacatttcacagacaaggctgatgcaatactcagagcatgtattcagagtaatgtcactgcatcccacatctgaaagctaacctgacaccttgtttgccagtacactttcaaggtggaaaagaagccactcatttcactgtcccatttcc

SEQ ID NO: 21442 - DNA, 201 bp, Bos taurus
aggagataaccaaacactgctaaagaagcaaagctttggcgtcactgtgcttgaatgccttgggaggtcatgagcctgcctagaccttagcccctgcagtcaagatttctggtttacttgatgcaagcacctagctgacacatggcagctagagaaaggagcaaccttcatcttctcacagcctccagtgatactcctcca

SEQ ID NO: 21443 - DNA, 201 bp, Bos taurus
ggccccagagaaagccaaaccacccataaagtcacacttgtacccaatcagtagcaacccgcagtgccccagttgatcctgccaggcaaagcctctctggtaggaagctgaaagtgtcctacccatctcatttcttaggctatgttttctggtcatgattcttccactctgttctattttgctggggtggaaagaaggtat

SEQ ID NO: 21444 - DNA, 201 bp, Bos taurus
tcagaagagaaagggagacttgctatttcctgacatctgtattttagtttttgtcattagatgtccatgaagtggcctgtatgttctcacaaaagcctcagtgaagtttggggaggtgtgttctcttctttgtagcctcactgaagcagtgagcagactcaaccacaaggcctgaggatcagaaggaagggtgactttagg

SEQ ID NO: 21445 - DNA, 201 bp, Bos taurus
accgtagactgagacaattccatgaggactgaatgatctgatctataaaagataattgtgtacctctgagtctctggaacctggccaaagcctaagaatcactgatcagggactgataacgggcacattaaactaaacaaaggcgagttcaagaacatgaagattgaggaagaagtccttatgaggttttgatttggtgac

SEQ ID NO: 21446 - DNA, 201 bp, Bos taurus
gaccacgtgggggcagaagtacagaccagaggtctaaacactccttataaagactttgaaacaaaacctggtattctcccttcccccaccacccttagctttggtggttccttgtactgctgctgctgctaagtcgcttcagtcgtgtccgactctgtgcgaccccatagacggcagcccaccaggctcccccgtccctgg

SEQ ID NO: 21447 - DNA, 201 bp, Bos taurus
ctttttctctgcccttgctgccactgtactggttgagacttctgttaccatttgctccaagtattgtgggagtcttctatcggggttccctgtcagttttcatcctctctgatccatcttgtcaatccactacccccacatccatcattgtatccttcttcaagtaccacaagctccaagattttaataaacagagtcaaa

SEQ ID NO: 21448 - DNA, 201 bp, Bos taurus
tgctgaggttcatgggtcggacacgactgagtgactgaactaaactgactgaaaccctattttctatcaggcacttgaaatctgtgttactaaatagtcctccaaacctatgagatctgtatctgtattccagttttctaaagtgtgaagctgatgttcagcaaacagaaaacattatacaaggacacatatagaataatt

SEQ ID NO: 21449 - DNA, 201 bp, Bos taurus
ctggatttaagtacatggtatttaagtacatgaaagagcatcacacttttcctttgtggagttccttgttttaagaactcagtaaggagttcttgttcacgttcttgaaaatgcttttctcaagaatccatgtttcctccttcaacagaaatcagaaattcgttgctttaagtctagattttggtttcattcattcctata

SEQ ID NO: 21450 - DNA, 201 bp, Bos taurus
ttaactaaaatattagtaataacttgataatagtttaatgttgaatgttatatttttgtatatttttgaaagcaaaatttagcttttattctttgttccaggggtgagtttctgctgctgaagagtagatctgaaatttcatgtgtactttaagaaaattgttgccttatggggcccattttcaggatcaaatccagtcac

SEQ ID NO: 21451 - DNA, 201 bp, Bos taurus
tttgataggaaatattctaagagtaatttttccccagttcttcttttgtaccctagggagagttactgtagcccaactcactgggcccccctccccgctcccctgtgtgtcatcgtggggtgggatcagcatcgttctgtgtgtgacacgacacagatgcggcgtctctgcgtttctccatggcccatttcctgctcactc

SEQ ID NO: 21452 - DNA, 201 bp, Bos taurus
gtagatacggattcagatactgactatcagttattgatgcaggaccctggataacctatgaactgcctatctcattcctctgaaagcattttattagatgtaaagcaccaaagagatattaagtaatagtatgatcttacaacagaagtgacaggtgtgtcctattttgtctctagatatgctctttctaatactgcattc

SEQ ID NO: 21453 - DNA, 201 bp, Bos taurus
gcactgacagcagcagtcctacaaggggccccttggaataagtcctcttgtaggtcaccactaacactaccatagagcctgtagaccccagggttgagtcaccttaggccagacaactaacagggagagagcacaaccccatccgtcatcaaataatttgattaaagctttattgagtaaggccctgcccaccagagcaag

SEQ ID NO: 21454 - DNA, 201 bp, Bos taurus
tggaaaaggaccacaatcctccacgcactcaaagatgtgaaggcctcacgaacacacttagaaaaattgcaggacaaggcaggcaggttgtaggaggtcaaagagggcagcatcaggcccggccacaggtgctgggagctagctccaaccccctcccccttgacaaaggccagctcagccccaaactgaaatgagagcagt

SEQ ID NO: 21455 - DNA, 201 bp, Bos taurus
ccttagtctgtgaccttagtcttagacctgtgctccttagtctgtctcaactgtgcttgcttctgggggtctgagcactccctttgaagcagtccctctacgcctggaagcagccatacaacaactgatagctcttactctcttattgggtgatgcctcccatagggcctctggctcccagaaagtaggcagaaaagatac

SEQ ID NO: 21456 - DNA, 201 bp, Bos taurus
tctctatgctatacagaagcttcctactagctatctgttttacacatgtagtgtatgaatgtcaatgctgctttctcaataggccccaccttctctttccccttctgtgtccacaagtctgttctgtacatctgcatttctattcctgccctgcaaatactttcataagtaccacttttctagattccctatatatgcatt

SEQ ID NO: 21457 - DNA, 201 bp, Bos taurus
tcatctcagatctccaggcttgccttccccgtgctggtgctttgcctgaacagtacagtggatgcatgaatacggaaacaccaacatcggttgtactgagcgccacgcactgatctgtagcaaagagaaatttgaaggctccttttgtttcctagtggaatcttgtgttttactctatgagagtgaaactctttccttgtc

SEQ ID NO: 21458 - DNA, 201 bp, Bos taurus
ttatttgtatcaataactcttccatttaaatctaatgattttgtcttttgcaatacctgaaatgtattggagaggttcattgaccttactatttcacacccaattattttatttttaaatatcatttaagtagcaaatgatgctcctccagacctaagtctcagaatatgatttcccaagttgtgacttggactcagcaga

SEQ ID NO: 21459 - DNA, 201 bp, Bos taurus
tagaagctagttccagacaccatctcagattttctaatatcctctgcgcccttccaaattccctggtgagagaatctgattgacagccttgactcccatgtccatcagccatggagggaatgggggataaaaaaatacaaggttcatgtggtaaaaataaaggctgtatgtgcttaacactgagagtggaaaagggacaga

SEQ ID NO: 21460 - DNA, 201 bp, Bos taurus
ctgttccaaaaacctacaaaactttgtactaatttctttaaaaaaaaaacaaacaaaaaacaacttactactatttcataaactttttacagcccatctgcagttgtgaaactcagtgtcagactgaaagcaaatgagttcaacagaggtgaatgatgtcagtttccccctgagaattgtttataattcaataaaaagttt

SEQ ID NO: 21461 - DNA, 201 bp, Bos taurus
tgcgggcccctgcctctaggcacagtctgtgctaaataagcagcaggagaaccttgaagtggcagttctgtaaccacttcttcctgaggtcagcacttcatgcatttgtgtgttctgggcccagcagcacagcatcccacaaaggtgggtgttctgtaagtgctttttaatgatggtggtgctgatgatgtatgaaggcct

SEQ ID NO: 21462 - DNA, 201 bp, Bos taurus
tcaaggccatggggccacagcattctctttggaaaagataatatttactagtttgtgcttattgtgtgatgcaactttactacaggaattactattgtccaccagtccctgggaaatctccctaatcagcaatgttaaatgtagttgccctggagagtgaagaacaaggaccaggagacctgtagccaaaagtctcatcct

SEQ ID NO: 21463 - DNA, 201 bp, Bos taurus
aaagaagacattatctaaaacaaggattcaaatctgatgggtaaaacagacatacttctcacctgggagagcacagtagaattcttcccggtgatgggaccggtactggtttgcagtagggcagtaggttagaacctagagccagagaataaagttgtcctcgaggaaccatctggagggaatgtctactggacaatatga

SEQ ID NO: 21464 - DNA, 201 bp, Bos taurus
ggctttttaagagaatatttggtggttaatttgtacctgagcaataaagttgctttaaaaaaaaaaaatccacaaaatgacatggaaaatgaaacagttcattgtttagggaatttaatagacacccaatctaacggagtaagatttttaagcttattatttctccatttttcttctgcccccgtatcctcttgtagatga

SEQ ID NO: 21465 - DNA, 201 bp, Bos taurus
atctcagttctaagttttacgaatcaaaatttcttaagagatttgtttggctcccatgaaacagaatatcagagtgaaactagcagctgagttcaactctgttctcattccttttacctattatctccagtaattaaagaaaaatacagaatagtgcagaaaataatttacaggtaattttgtacccactacactaaggta

SEQ ID NO: 21466 - DNA, 201 bp, Bos taurus
gacactccagttctgaactaaggtcccaggaggccttgcaggtttctactcatcctcttcaacccttgcttttgccatgagagagactgccatggtagagtagagttcagtcttgtagcttaggccatcttagagcattaagcctccaactaacctgtgagcggaatgctgacgcaggaacaaaactcagctgagatcaga

SEQ ID NO: 21467 - DNA, 201 bp, Bos taurus
tttgcatgaaaagtcttctggcttccttataccctcatcctccacacccttgcataacctgcttttcttcctctacaaataaaagaatacaatgtcttagagtgttgagaggaacctcagatgcccacagaaaggagagagttttaaaaaataggggacaaaaagaaaaacttgaccagctaaacagtatgccctaaacaa

SEQ ID NO: 21468 - DNA, 201 bp, Bos taurus
cacttgctagtgatacagtgcttcaggggaaagaataaggtagcaagaaagagctcttcagtattaaagcattccaagcacggaatcccactcccaccaactcacagagttcaaacactgagtaactagggcaaggttattcccagcttaaatgtacaggttacaagagagtatctctgaaaggaagtggacttcacgacg

SEQ ID NO: 21469 - DNA, 201 bp, Bos taurus
tataatttcataggctgaaggatggtggttagagggagggaactggacagagtggaagaaatttcaaaatccatgtctaagtccttatgtaagtttgatccgcatgaaaacttgtgggttcatcatcatgggtccagtgtctaccaaaataatccttgtcatattctagttcattttttcccactgacaaaaatacacata

SEQ ID NO: 21470 - DNA, 201 bp, Bos taurus
aagctgaaagaggatagtgtaaaagctggcttaaaactcaaaactcaactcagtccatggggttgcaaagagctggatacaactgagcacctgaacaagatgaccattctagttggccttgtcttctgtcctaggtgtacaatgcccatgagtagggctgtgtgttctgagcttatttcctagtttccttcctaaccttag

SEQ ID NO: 21471 - DNA, 201 bp, Bos taurus
tcgatatttgttgacccggatgtgctgtgtgactctctattactgttttagatgaaaatacgtaatgagcacaagtttttaggatctaacaaggaggcacaacaagacaaatgctgcaatgtgttctattctcaggacacccgctctagtctaatcaccccaatcatcttccttggcatcagctcaatggtctttgccaat

SEQ ID NO: 21472 - DNA, 201 bp, Bos taurus
gtcactagaggctgcatctgaaaagtattctgaaaaggaggacaaatacgaagaaattaaacttctctccggcaaactgaaagaggctgagacccgtgccgaatttgcagagagaacagttgcaaaactggaaaagacaattgatgacctggaagaaaaactggcccaggccaaagaagagaatgtgggcttacatcagac

SEQ ID NO: 21473 - DNA, 201 bp, Bos taurus
gatgactaataatatgttggacattatgaatgacaggatgtgaatagtagaatcagccctattacatggcttagggcaacagatttataagaagaaagttataacacagctactgttgcctactgttgtttagggctaaactcagggctgaaaataaaggctaaaattagcttttactgtgacaatttggtgtctaaacaa

SEQ ID NO: 21474 - DNA, 201 bp, Bos taurus
cagagttggacacaatctagcgactggataacaacagtcagaatatctacttgtggagagaaggagaaaaaaaaaggagggtgacaaagggagagttttgcgtgaggtacaatcataagaaaacttcacagggaccagtagaggatgctggaactcggatggccatcaaagttatcaacaatttgagccaaaggtcaagtc

SEQ ID NO: 21475 - DNA, 201 bp, Bos taurus
ttttaatttaaatctcaaacatttgtttctgagaaataactgaaaacttaatttagccaattcagaaataacttgatcaatttatttattaaccaataatctcatgcttaaacataacctgaaattcttgttcccctactatattccagagaagacttcaggtcagaattttcatgtcttttagtggtaatgtttctatcc

SEQ ID NO: 21476 - DNA, 201 bp, Bos taurus
atatgagattttattgcagttcaacctccaatatctcattaccttagatatgtcattcagtcattttgttgtaattgtctttgtttccaatacaaacccagttacctttaagagttgcttagtagatcgaatgagaataactttgaaagcatttttaaagtaaataacatatactgatgggcgatcccatgtatattgtta

SEQ ID NO: 21477 - DNA, 201 bp, Bos taurus
ttggccacctgatgtgaagaactgactcactgggaaagatcccgatgctgagaaagattgagggcataagaagaggtggtgacggaggatgagatggttggacagattcactgagtcaatggccatgagtatgagcaaactcagggaaatagtgaaggacagggaagcctggcatactgcagttcatcgggtcaaaaagag

SEQ ID NO: 21478 - DNA, 201 bp, Bos taurus
catagcacctaaacaacagtttagaataatcagcaattattatacaataatttttgaaagtcaggaatctgggtatggcatggtataactgggtaactccgagtcagagtttctaaaaaagactgtgatgaaggcatttatcaaagtttacatcatctcatagctctactctgggaggattcacctgcaagttcatccacg

SEQ ID NO: 21479 - DNA, 201 bp, Bos taurus
attcgtgctatagggagggaggaacactgcaaaggaatatcactggggtgtgtggggaggcctcgcagtgttttggccacactgggtcttcccctactcatagagtgtgtgctttcccagtctacactgctcaggctccaggttgctctgcaggggaactgtgtaaagtgggccatgggttgtgtgcacttcctaggtcta

SEQ ID NO: 21480 - DNA, 201 bp, Bos taurus
tgtactatctagatgcagtgcttcctgaaagagtgtcctgatgaagttaaaactgatggtccatcttggaaggattctgcaacacttaggtgccatcctccaaggcatagtatatgcactgaatcacatatcattattttgtcttcagcaggaaaactgtatgggtccagaaaactgagttcacctcacttactatcactg

SEQ ID NO: 21481 - DNA, 201 bp, Bos taurus
cacaaaattaggctaaatccttatatctgtatctgagttttcatcttctgtttttttttctttcctcacctaacattcatatgcacacaagctgagaaaagcaaccttttagttgggaaaatgttcagagatctggaaaagaaagattgtagatcttgatgcaggattcatgctgatgtgtttaagaaagatttcttaaca

SEQ ID NO: 21482 - DNA, 201 bp, Bos taurus
accataaattttggattttaaaaatacagaaatgtattccctcatagttttaaaagtcataagtctaaaatcagtatctcttggccaaaatcatggggtttccagagccacgtgtcctccagaaggtctatgcaagaacccatttttaacctcttccagatgttgatgactgccatcattctttggcttgtcattgtataa

SEQ ID NO: 21483 - DNA, 201 bp, Bos taurus
taggatggactggttggatctccttgcatagactaggtggccataaattttcttaatctaaaattttaagtgaaaccaggtataccattccttttctaacgttagagaccaggccatattggaaagagactaggagaagtcagtggaagaacttagctgtagctctcaaaagattaaaccaaaatagtctataaaagatat

SEQ ID NO: 21484 - DNA, 201 bp, Bos taurus
aaacaaaatttaggtaggattttgtgggctagactggttagataatcaggaaataatcctaaatatttgctccttgtggttctgttctaaaagtctctgattgatttcagttttagccactctcaaaggcctgacatcataattggtataaagttctacagctagggaggaaggtggtttttctctaccccctactgagaa

SEQ ID NO: 21485 - DNA, 201 bp, Bos taurus
ttacatggattcagcaagaaatgcttagaaattaagcatcctactagtttctgttcctgagaatcaggaaacgtgagatattcaagcttcatgtttctgggttgtttgtttgtttttccttctatatggcacttccaggaagctgttctggtatgatgaatttccttaaggaaaaactttttataaatgaaagtagaaagt

SEQ ID NO: 21486 - DNA, 201 bp, Bos taurus
tccatttaggctgccacagatcagctgtttgactctcagccttaaatgtttctcctttgtcaagcctggctcgacaagctgggtttctgaaagtacaatgtggcgggagaatgagaaacaagacacaagagttcagtcaaaggtgaggatcaggggatcaacaccgctccaaggtgaagatgtggaaactgaaccacgcca

SEQ ID NO: 21487 - DNA, 201 bp, Bos taurus
cattgcatatatgcacacaggataattgagaagtaggctttctcagatatgtttgtcaaggaatacctctctgagaaaaaaaaaattaaacagttactcagataatgagaaatgctgagtctcaagaagtttgtttttaacaacattctagaaataagaacaatacacataaagtccctgaagcaaaacaagtttggtttg

SEQ ID NO: 21488 - DNA, 201 bp, Bos taurus
acttttaaaatatgaacacatttatgcagttaacatgaacaagggactatgctaactcctctattatataattaaacccccacaacaaattataatgtaggtgtaaattcttccagtgcagaaactgaatcacagagatggaaattcactttcttgaagtcacatacctaagaaacaatacagtcagtattcacaacccag

SEQ ID NO: 21489 - DNA, 201 bp, Bos taurus
tttctgcctcccttcccctcatccccacattttaaactccagttacaacacacttaattccacaacatcccctagtatccatgcaatctgaagtcactataacattaaacaactggtcctctgccaatcattattcatctgtcccatcctagatgtggcaatatcccaaaaagatttaaaatacaatcgtgtcacatgtcc

SEQ ID NO: 21490 - DNA, 201 bp, Bos taurus
tactcacaaatcaagccattgaagaaaacagaagaggacactgaatacacctgtgagcccctgggagatttcagatacctattcagaactacaaatgagtgccgctctaatgaacacctccataattaagtttctagggataagatttctcaggacagctcttacgagccaacacagcttggcaggggttatactccaaaa

SEQ ID NO: 21491 - DNA, 201 bp, Bos taurus
tgttataaactaatttgaaataaggtagttgatttgttagactgtctttaaggaaggctcatgtgacctgaaggactattgttgtgaaccttggtgagactcagtgaaatctacagcaaatgatgtgcttccaacgacagcttgacttatttctcagatgattcagaaactcttacctcaacactggtgaactcacatggc

SEQ ID NO: 21492 - DNA, 201 bp, Bos taurus
aagagaaggaaaagagagttttctttctcttcctgctctggggaaagctcctgtgaggacacagtgagaaggtggctgtctgcaagtcaggaagagagccttcatcagaaatcagtcatgctggccctgtgatcttggacttctggcctccagaagtgaatttccattgtttaagccacttcatctatagtattttgtcat

SEQ ID NO: 21493 - DNA, 201 bp, Bos taurus
gtaaatagagtaatagaaaaaggacagtatctattatgtaatcaaatacgaatagattgttggaaaggtttatatccagtatctcaaaatgcttgaacaagcaatacattcaattacatatgctcttggaattataagccacattctcacacatatatagctattactacttgtgatccatatttcattactttaacctta

SEQ ID NO: 21494 - DNA, 201 bp, Bos taurus
atatgcagaaagaattgactctgccttttgtaccaatgttaacacaggagcatataatgaaaaatcaattataacataaaatctcgtaataggtgttcaaatgttcgctcatcaaataagagcacaaaactatgtctgaatgctgactgtattctatatcactagactatgaatattttttatttcctcaaagtaggaaca

SEQ ID NO: 21495 - DNA, 201 bp, Bos taurus
cctcatcaagaggacagcatctagtgtggagcatggcatctagaataatattttagtaagtttaatggcaatatttttaaaggtacttaatgtaaacagatgctctcttgctaaggggaactttaagaaaagcaattctaaagggatacattggcgggcactttacacaagacactcatccaagccctgaactaaacaata

SEQ ID NO: 21496 - DNA, 201 bp, Bos taurus
ctaaatatttttaaaatccttgctttgaaattgcctatcgcctagtaaggaagatgagcacatagtcaaattattttagaaatggtgcaaaaaaactgtgctttttgtttgtgtggcaaatctaagtacttttctagaagcagtgttctgcccgtgaaagggaaacatgggagagggcataaggaccgaaaaggtttctca

SEQ ID NO: 21497 - DNA, 201 bp, Bos taurus
cctaccaggctcctccgcccatgggattttccaggcaagagtactggagtggggtgccattgccttctctgattacctatataaatgcttataaatgagacaaatgtcatctcttttatatacatctgaatatttgccatcaaatcttatataatttggattctactgctgcaatgctctgctggccctcaggaagcatgt

SEQ ID NO: 21498 - DNA, 201 bp, Bos taurus
actggatgtttctctctggaatagattctgaactgggcccctcaattacagtaccggtatccttagggcaggcaaaatggaaatgtcctctaaagatggagaaatataataatacaaagtgaaaacagcaaacaatgaaacaaagtttattattaaaggtctgatatttcttcagacaaggtctacttaaaagctgagtac

SEQ ID NO: 21499 - DNA, 201 bp, Bos taurus
atagagactaaactgaagtctgagagggagactgataggcaaaggtttaaaatatatttttggcttcatttggtgaggcctcattttgtttagctaagtataatgattcagatccttgagctccaggagtaaatgggtttaaatattttttaattttttaaaatatgtttttggcctcattttgtgaggcctcattttgtt

SEQ ID NO: 21500 - DNA, 201 bp, Bos taurus
ttcatggaaagaacaacattgttggagatttcagtgataaattgctaggagtttttgttgacaaatatgttagtacttctttttttcctttgagatatacgagtgttttatttgttcagtatgtaaatgacacaaattgataagaagcaaaaggaagaaatgttaaccttgtgtatgttaacttaagagctcatgtagaca

SEQ ID NO: 21501 - DNA, 201 bp, Bos taurus
aggaatccaagggaaaagaaaatagtgttttctttcattttgttaacctgcaaagaagtttctatacatccatatctgccttctttaacaggggtgaaaacataggaagcttccctgtcattctttgtctctggaggtgggacaactgattgccttgctttgtttgcatcatgaaatcccttctttcacatatttactagg

SEQ ID NO: 21502 - DNA, 201 bp, Bos taurus
gttataaaacaactgaagggaagaagacagtaaaaccaaaatgtttaagtactcacacagtggctctttcaatagagatttttgctagttcctaagcatcaagtcatgtaaactctaccaagatattttgcagctgattatacagttataagtacctttttcagtgattgcaccaaaagtcctaatatgtactctctggat

SEQ ID NO: 21503 - DNA, 201 bp, Bos taurus
taatcatttcctttgatgtcataatatttatatacatacaaagaaacatgagaagcatcagtaatgttccagtcaggacactgatatagtaaattccctcgattctactgccaatgttactcttactgttttggttccgagatctaagccccacttctgggtagattacagatagtttgctaccctatacttggttcaata

SEQ ID NO: 21504 - DNA, 201 bp, Bos taurus
ttataacataatattaacaacttaatagaatactgttaaatcaggtcttccaaataacactattgggaaatgctgatttatgttattgatatgttaaaatctaatcaaaacctctaatgaatttacagagcaaaaggttaagatgctttccagtatttatttaaggaaccaagttatttgcacctctgttggtggcatctt

SEQ ID NO: 21505 - DNA, 201 bp, Bos taurus
tctaccatgtgcctgaaaagaagagaagaagaagtaccaataaaaggccaagagactaacacaatgggtataatcttgttttccatttctacctaaatacatatcaaactgattataagccaatttctcatacatttagcttgttctacaaatatttaacaagtactattgtatactaagtttttacaaaatggtaaggcc

SEQ ID NO: 21506 - DNA, 201 bp, Bos taurus
gataccacaggagattttatgagaaaggtttaatcatacggtacatataaatatttgctataattcattatgcataatagagtgcattttatagcctaccgtttccagtaaaaatatagcaaagccatgaggttgtgaatggttttccagagggaatgatgtcagatattcaaggatgtatacattcaacacatatttatt

SEQ ID NO: 21507 - DNA, 201 bp, Bos taurus
ttatacagtattgtcatatgaaaattttattgaaattccttaatgaatagcctaacagatgaccactgataaccactgatgaccacttaggaatctaaagtttcctaaggtagctatgtgaggaaaaccaagtaattcagtgatgggtttgactaaagaggagtatttttgaacaaatatatatatatgtatatacacaca

SEQ ID NO: 21508 - DNA, 201 bp, Bos taurus
aagaatatgtcttcttcgtgttagcagtgatggaacacgcagagtctgtaagtgaaatgtgatggcgtccatcttattttctatggtattcttaaatacggtttttaccagaatgtggggatatggagctccatgcatcctaattgtttctcgtgagatgtaacttaaatgtagtaacaggctgtctactctttgaatgtt

SEQ ID NO: 21509 - DNA, 201 bp, Bos taurus
aggtgagacttacaacctcaagtggataatggaataaaatggacacaatgagtaagtgagggaagagatgtagaagactgttctagaattagtaactagtgatcaatttttataaatctttaagatctgtgaaggaagggaagaaaagactctcttataaaagatgcttttaatgaaacccctatttaagccttacacatc

SEQ ID NO: 21510 - DNA, 201 bp, Bos taurus
aactaccacagggccccacagacaggtggatggccaccccagaatcacccctgcaactttcaggctccccattagtggacagccaccccaggaccatatctgcaactttcaggccccacatatcagaagatgggcccacagcttcccattcccaggccttccttcccagcatcctggtactcataggagtttccacagtct

SEQ ID NO: 21511 - DNA, 201 bp, Bos taurus
acacacagaacattaggactgaagcagtgactattccatttctgagaactgttgagaatgatatggcttcattctgctctatatggagaaagagttgtgtgttcatggggaggagtgggcataagacatccaatttagactctcttgaaaagcctgaagtattgagctagtcatcactgcagtatacttcacatgctaggt

SEQ ID NO: 21512 - DNA, 201 bp, Bos taurus
tcaataaatattcattgaatatccagaacgtgcaatatacacacggctgtggtttcactctcatctgaggaattctcccaattcaacataaatcccaccattcctctacagcaaatcttcacatactgaaaaatgaaatgttcatgacactgagttctccctctactaaaccataggctctttgtgtagaaaataaaggag

SEQ ID NO: 21513 - DNA, 201 bp, Bos taurus
tttctctggacccttttcaggttcctactgggcctttagacacagagtgcctcccgagcagaaggcacttccagtcctcggctcaccacaccaatttcttcgacagaaaaaaatggaaatgaaaacatatgagtgatgtctctcagcttgttttgtctttaatttggttagttctttcactaaaatctctaccttctcctt

SEQ ID NO: 21514 - DNA, 201 bp, Bos taurus
attttcatgttttattctggttgaataaggtactgcaaagagtcaatattggtagattgaagtaatgtgggcatctgcagtgcatactagctgcctttttctaagacatgaacatactttgcacacacacacatggaatcataagctgcggactcagtggtaaattattgtaatcatttttagaatactctaggttaaatc

SEQ ID NO: 21515 - DNA, 201 bp, Bos taurus
tagtttgttataccctgcctattaacagctcccaaagtatttttctgaaaccctacttgcagaaaggatagtataacaaaagggaggatgtccatctccacgattccagggattgatctggaggtactgaggcagattccactccccaggaacctgtagcagtggcctcaagagcatgccctccttccctctctctctttc

SEQ ID NO: 21516 - DNA, 201 bp, Bos taurus
tccccagtcaagaagctaagatgtagctcagaagcttaagaagtcttcttttgggagtgttgaccatcagcaaccctatggcacttacctgagtaaactatgtaagttattctgctgctgcccagggtcctttatttatagtaccaaggcagaccggctctccctgacaatgggctcccattaagctaaccttggccctca

SEQ ID NO: 21517 - DNA, 201 bp, Bos taurus
gaaactgactttgcttgctcctctttcatgtgttagtttcatggctaccattgaatgtacagactgtctctagcctaatttgtagatataatttgtcatttgtgcttctgtcccccctaggttttccaaacctgctagtccacaagtacccctccttaactctaacctgctgtctgttgctttcactatccaaaaagaaag

SEQ ID NO: 21518 - DNA, 201 bp, Bos taurus
caataaaataccatcagatttatgttcttgttgtccaaagagtctatattagctccaacagactgcaaaagaagcttctttttacccatttttcaaacatccaaatactctttgggactgaggagtaagtagctgacctaggaatagctgaaaaagtgagagcaagaaacagcaggataaaaaaagcaaacaacaggatga

SEQ ID NO: 21519 - DNA, 201 bp, Bos taurus
ctagcaccacctcaattccacctcagatcatcaggcattagaatctcataaggagcccacaacctagatccctcacatgcaaagttcacagtagggtttacgctcctaagagaatctaatgccaccactgatctgacattcttctggtccatggcccaggggttggggactcctgccctaagcctgccattgaaaataatt

SEQ ID NO: 21520 - DNA, 201 bp, Bos taurus
gtggtggtgtgtccaatagaagtgaaaaagtgaaaatatttaaaagatgaattctacaataaattataatcagtgtttttcccttccttttgaaattagaccaccaagtgagaaatctcactctttgtaaagtatcattttaagcattaacatgttttggactatcaacctaaataaagaggtaaattgaataaagaacct

SEQ ID NO: 21521 - DNA, 201 bp, Bos taurus
gtatgcatataccacattttgtttatccattcacccatcagtgaacatttgggttgcttggacctcttggttatagggaataatgctgctgtgaacactggtgtacaaatacctatttgagccctagcagttcttttggatgtatacccagacatgaaattattggatatatggtaattctatgtttaattttttgaggga

SEQ ID NO: 21522 - DNA, 201 bp, Bos taurus
agagagaattgaaatgaaattcagctttttcctcaacaggtggatgagacaatgatattatttactgatgattgagtgaggagtaggatttcagtggacatgtttgtggacatcaagatctccacttggagtcactaattttgtaatactagtcaagcaagcagttgaatataggaacataaagttcaggtaaggctgggt

SEQ ID NO: 21523 - DNA, 201 bp, Bos taurus
ttagattatttaaattagaaatctgagattcatatttaagttagaaatctgagattcatacaggacatcttcctttcccttatacacaaatcaaaattcaatcccaaatattgatgttttatttcctaaatctctctttaatctgcttccctctatcttctctgtctccatccggttccttaatctctcacttagacaact

SEQ ID NO: 21524 - DNA, 201 bp, Bos taurus
gagatcattaaaggcctgcatatgtgaatgaatgatggtttaaaatgctgtcagtctggtgatgcagtatggagtgtatgggagacaaggggagagagccgagagtcagggctgttccaacagtaattttagtgtggaatacgaagacctagactgtagtgctggcaaaagatagacatgaaagcaagggtggaaaactag

SEQ ID NO: 21525 - DNA, 201 bp, Bos taurus
gatggacagggaggcctgatgtgctgtgattcatggggtcgcaaagagtcagacacaactgagcgactgaactgactgactgaccacttaaaatgaggtatggccatgtgacttgttttggcctacaaaacacaaggggaagtgatttgtgttacttctgggcagagtatttaagagccaacacttagcacatgatgctct

SEQ ID NO: 21526 - DNA, 201 bp, Bos taurus
tttctgccaaaaatacataagcacattccattcatgaaggaaaaaaaacagaataaacaagctgactgatgctataaataaactgaacaatattcttccaaaggatcataaaagacaaggaaaactgaacaactgtactgaatggaagactaaggggaaataacaactacatgcaatgtgaaatacaagtctagaacagaa

SEQ ID NO: 21527 - DNA, 201 bp, Bos taurus
aatgttctgaatcttttgtacttccgtctctatgtaaaatatcctaaggaaggaagataacttacttcccttctgctcaagtgtctgaaaaaggaagactattttatttctgaaggcacaactggatctctataaccatgttagatgctattccctttgtctgacagcattctgtgcactgctccataattaaccacttat

SEQ ID NO: 21528 - DNA, 201 bp, Bos taurus
acgaatgatatttgagtatcttttcacccgatcattcctatatctccttgaaagtcttaccaagtcttttgcctattttaaaatgggctttttgtttctactgtggatttctagttctttacacattctggatacaaatcttgttgaatacatacacctcaaatatttcccccaatctgtggtttatttattcattttctt

SEQ ID NO: 21529 - DNA, 201 bp, Bos taurus
ggagaatctcctgatctggacactgtgggcccttccagataatcacgggagcagctattcagtgtgttttcaagcctcctcaagggtgggtgcatggagggaagacagtgggaagccactttcccactgaaagagaataacccaaagggcaacaaggaacaagttgtggctttagaaaaaaaaaaaaatcttctatttgag

SEQ ID NO: 21530 - DNA, 201 bp, Bos taurus
gcctgcgctggagttgggcggcgcccgggccccggcaacagctctcggctggaggagctttggggctgggggtggattgcggagaggcctgggagcggacgctctgtaacacaccctccctgccagtttcttcgggtctttcccccgtaggggtaaggggagtgaacagcaggcctggtacttaggctcaccactaacggc

SEQ ID NO: 21531 - DNA, 201 bp, Bos taurus
ctgataaatgtgtgttagaaattactccacagaagaacacacagttctttctcatttccctttacagcttcctttgtatggatgggccattttattcaacaatccacaacaatttccagtgttttgctatgacaacactgtagcatttttacggggcccactgcgtaaaagaatacaaacaacttcagtattcttgccttg

SEQ ID NO: 21532 - DNA, 201 bp, Bos taurus
taggtattcagaataatactccaatctattcccttacctgcatcactattcaagcccttataatttctcactttcattatataagtatagcctttctaatttcaagccattctctactagacttggcgtgatctctccaataaaaatgataattttacttattcacagagtcttgagaacttttaaagtgcaaactttgta

SEQ ID NO: 21533 - DNA, 201 bp, Bos taurus
gattcctgggagtcaaccgtatgggtcttggtttcgctcccagtgcttagcctctgcctccttcactattcttttcgtgttagccattggggccagtctcctcctgctcagaccatagaagcacacgagaagtaccttttgagtttctgctgacaatactgaaatcagcaagggccaagtttgcagggatgagttggaagg

SEQ ID NO: 21534 - DNA, 201 bp, Bos taurus
tcttggagcctgtacatcccatcacatgcatgattcggaaggaaggagacttcaggctccacagtttgaccagcaaccaaaccaagtggcctgctgactcagtgactttattggtagtaacccaattatcagcccagggtatttctgaactgtccttaagagtttgtattctgaattggggtctggagcactaggtaagag

SEQ ID NO: 21535 - DNA, 201 bp, Bos taurus
caaacacagagagtgatatggattatatccattccatagatatccaggccatttggctcttaggttgcatttatgtgtgaggatcttccctagttcagaactgctgctttgcctctttttgaggccttagaattgttcacagcagggtttgaacttaggtgccagtctagtgtaggtttttcccccttaaacaaactttga

SEQ ID NO: 21536 - DNA, 201 bp, Bos taurus
aatctgcatctatactgaatgcaatctgcatcaatagggaccacatgaggatgactcttgcattagttacagtgactcaaaagattatagaagtttctttctactttatctaatagcccagaggtggatgggctgtctagggtgggtagactgctttctacctcaggaaataatccagagacccaggtgggctggtctgcc

SEQ ID NO: 21537 - DNA, 201 bp, Bos taurus
gacgctatttcagtctcgtttcttctgtgaagaatccctgactacactgagcatcagtgacctctctcttctaggacttacagtgacattcttggcctgcgctgtctatttagtccccatcatggagtgtcctgcttatacatctaaatctttcatcgagatctgaaggtgctgctctgaccctggccaagtagtaggagt

SEQ ID NO: 21538 - DNA, 201 bp, Bos taurus
gcggacttgaagtcttagttcaaacatctgtagttccacagctttccaggatggccactggctcccctgccccactcagcatccactactgccctgtgccttcggcagggaccttgaacattggtatggtgacgtcaaggtcagatacgaatgccccatgtgctcaatcatgagtgatgctttgggcacctttgaaggcct

SEQ ID NO: 21539 - DNA, 201 bp, Bos taurus
gaggataggtatccatttttgtgcaggaagaaaatctataattttatctatttttcatgtgttcttttaaaatggtacttttatgtatatgttttgtgatatacctggcatggacgttagcatgggtatataatttacataaaaacaaatgtacatttatgatgggcatgctcagtagtgttctactgagggagtgtagca

SEQ ID NO: 21540 - DNA, 201 bp, Bos taurus
gcaattaaatagctgtgtgacctgggacaagtcactttacctctctgaacttgagttttaccacctgtaaaataaggagattggaaacatgatctctattagttcttcttgacatataaatctatgaattcaaagcacagtgggagcatgcctgcatcattttctcatgagggaaactcttgaaatgatttcattatctat

SEQ ID NO: 21541 - DNA, 201 bp, Bos taurus
cagtttcactggggccccgatgaagcttctcaaacactggcctgatcacagcacccagcctctcacatgcagtggctcacagttgcacccatgagcaaggccaggcttttaagcagtgtctgtaggcctgttgcactccactttcacctcctcaacagctgttctccaacaacttatgctcagttcaccagcctacttgtt

SEQ ID NO: 21542 - DNA, 201 bp, Bos taurus
cttgttttggtgttaattctttcactcagccagattggcagatttacccaagacaggtgaataaactgagtaaagagaaaatgaaagaaaagtgaaacaaccaaaaaatacttaaaaaaaaacacaaggaaatcttggtctcatttgagaggtattgaatcgatgttatcatttttcctttaatagaaaggtgtgggagga

SEQ ID NO: 21543 - DNA, 201 bp, Bos taurus
atttaaaagtagaatgtaaggggagagactgaaggaacttgacatgtttgttgataagtggaaaatgggtctgtgggcagtggagaaaggaaagtaccttggttagatatgaaacaagatataacacatgctaaggatccaaaaaaagtagaacagagtcaactagcctccttaatttgttcatggtagggcaatgccgaa

SEQ ID NO: 21544 - DNA, 201 bp, Bos taurus
acgtagaaatttttatcagtgattaagtgccattctttttgtgtgtgtgtttgtgtgtgtgcatttctataataataagttatccacagtgccattttccccttgaggtattttaatacacccacctaatattatactagctttctagtagagaatgatattaggaggtgtcatagacccagggatcagcatggcatcacc

SEQ ID NO: 21545 - DNA, 201 bp, Bos taurus
ataatgggtataactttcaggaatgggatgaaatactgcatggatggggtccacaggaaggcaaaagtcaacctgaagggatttcaataaaggcagggagcgaatttacttgttgatctaagaaacccaatattgacgtgattaaattataacgtcaggagcattcttgggaagggggtctttagttgatagcaaggaaag

SEQ ID NO: 21546 - DNA, 201 bp, Bos taurus
ttgtcaattgccactataacaaattactccaaacttggtggcttaaaacacataaatttgggttagagttctggaggtcagaaatctcaaacgggtcttactgggctaacattaaggtcagggcacagctgcctttcctttgtaggatgtagagaagaatccacttcttgcctttttcagcttctagaggctaacattcct

SEQ ID NO: 21547 - DNA, 201 bp, Bos taurus
gcgatttcaacaaaacttttttttaaatcaagagcgaaaaaattaagcaatgtttacagtagacataaatcttatacaattcaaaaagcattttttttttcagatcatagagcataaaatggaaaaatgtctatgtaggtgaagtctaactactgtacatttatcacctattaaagttgcttatatgtaccacagtgtaaa

SEQ ID NO: 21548 - DNA, 201 bp, Bos taurus
aatgaaaaattagtgttcatctgtatcactctaagatcactgatttctgaaaattaaaaaaataaaagtctgcccaaactaatggccatgtttaaatgacgggcatgaaagaaaaaaaatctagtcattctagttaaccaaatcaggtggaaatgaatctacctatggcagatatataaatatctgcagaaatatatggcc

SEQ ID NO: 21549 - DNA, 201 bp, Bos taurus
tggttgacctcctggcaactaaggggccagactggatatattagttcactctcaatgaaatgcaggttccccaagcacatcctccaaagctcagctacagcccagataccttccaagggccctccttgccctctctgccctccccaggcaaaagaaaccgcttgtcctcttctgctcccatagcaaccggtctgtaccatg

SEQ ID NO: 21550 - DNA, 201 bp, Bos taurus
aaataagaggatgaaacagatgttcatttcaagctctaggctgatcctaatgtctgtaaatgtgtcattctgatatatgaatgtgagtcctgcaagacttaatcatgagaaaataggagccccaggattcacctccatgaacttggttcaccctcatccaattctgttgaagacagacctaaaaaacaactaacaaggggt

SEQ ID NO: 21551 - DNA, 201 bp, Bos taurus
tgctcaggttttgaaagtgaaacagctaccttcctatctgctatgcaatctgatgagtttaatttttttttaagaagagatttgagtgagctcagaggccaaaagaagaaaaggagatttgatgactggagaagctgactgctcactgatttacccctggaatctgaaagttcttaatgttgaggtccttatcttggccat

SEQ ID NO: 21552 - DNA, 201 bp, Bos taurus
aagagttaaagctgggcatgctggggtatagagcggggtgggaatggtcaggctaaggatactaggggagacgagtttgaaggtatgtgtaggcatgaaccaaatgaagacaggatgtcagggcaggaagcacacataaacaaagacacgaggtctgactattctgtaatttgggaagtacctattggagcgtaggatata

SEQ ID NO: 21553 - DNA, 201 bp, Bos taurus
atgtttattactaaataaatggagcctgttttaaacaggccactggaattgaaagcttttttgcaaaattgctcttgtacttttttaaatcagaaaaggcgtattaaagacaaatggcccattttgacttgatttgagaaaaggataagttgataaataataaacattaacaatgttgtttttctctgccgagagagattt

SEQ ID NO: 21554 - DNA, 201 bp, Bos taurus
cagggaataagggtaagtcaggtgaatgccccatcattatgtgtaaagccgacctccctcatttgtcagatgaagtagtcaactgttttctaatgacttgatagaggccattacctggtgaatagggagttgctgtagaagtctcctactccatgggttactgggtgagggatgtgctatgttaatgacagacatgggaag

SEQ ID NO: 21555 - DNA, 201 bp, Bos taurus
ccgggcctaggaatgggaatcacttcccattgtcaacagcctcaagacatgacaccgtcatttctggctttcacgaaattttgccttcccttttgtaaataggccattctttctagtcccttctcgaatcctccaatttgagtgtttcacttttcttttcttctcagactcttagcaaatacgtttaatgtcaatagaaag

SEQ ID NO: 21556 - DNA, 201 bp, Bos taurus
ctgagccatcggggaagcccttatacttaatatgaagaataaattcctaataggaggaaaacaattagtaactgtaaagataaaacaaagatgactggggttgggggcagaggggcaactgcagtgcaagattctgtctctgacaccaggacttcatgactagaaaacactctgcacttaatgagaatcttcaacagttat

SEQ ID NO: 21557 - DNA, 201 bp, Bos taurus
ggcagcagaagtgacaggcagaagcaggtgatgaaacagctttgctccccagcgggacttctttcctcaaactcattccctcagcccttattatgtgtccatcactgcacctccaggtctctggtggccccacagactgtccgggaagaaagggagcactgagtacggtgggaggggagcaagcctgtgggcaaggaggct

SEQ ID NO: 21558 - DNA, 201 bp, Bos taurus
agacttcaggccccagctcctgttggtattctcatttcaaggaggtggcttctagacactgcagagatgtcactttttggggcagagcaaatttctaaagggttgcctatactgctcagcatacaaaaggtactactattatgtgggagaatccgacgattttacttttcctatgtcaggcttccagaatttacagaaaaa

SEQ ID NO: 21559 - DNA, 201 bp, Bos taurus
ctcctggagcttgggagcacttgttctcccatctcacagaattgggggtggcctggggaacatattggatgacgggagggaggccttgatccatctcagatgatgcagttctgaggaccatgcagtaccccagtgcagacacaagggggcagagagccgcaggacacgcagctccccgggcctgggcagagaggatgagtt

SEQ ID NO: 21560 - DNA, 201 bp, Bos taurus
caagtcagagttcaagggaggcactttcaaggcgaagccaccgcactgcagtccagagttttggccaattcttcatgattactacaatccgtacacaccaatggagagtaacgaaggacaggtcaggggcaggaggtcaggacaacacaggcagacaggcactgtgagcccaaggagaatatcagagttcggagagtaagc

SEQ ID NO: 21561 - DNA, 201 bp, Bos taurus
ttgaacattgcaatttgatattagaatacattcttcaataaatgtggttatgtcattaaaaaaaaaaagaacttgcttctcctgtgagatagacatgattcttattcacaatttacagaaatgaagatggaactttagagaggttcagatatctgcaggaagccaccacagtgctctgttgtgggggcaggactctcaccc

SEQ ID NO: 21562 - DNA, 201 bp, Bos taurus
agactcttcaatggcctattgcaaagaaaccttttaacaccgtgtttctaaaatggatttgtcttcagaattctatatttgtataatacctcctaaaatcttgtgaaatgtggggcccaccaaacctaacctgcataatactgatctacaaaaagagactggccatgctgtcaaagcctcatttctaaatattaatacaag

SEQ ID NO: 21563 - DNA, 201 bp, Bos taurus
tgtccatgtggcttatacactcctctctgcttgctctccgtcatctccgcggccaccacacccaccagcagagccaatgtttactgagtggccgtgtggggagtggttaagggctctgaagtcagacttgggcaacctgcttagcctttccaaagcctttcctaagctaaccccaatggggttagtaattgcacccacttc

SEQ ID NO: 21564 - DNA, 201 bp, Bos taurus
ttgggtgactggatcaagttctgatgcagaggctgttcagacctaaaaagtcaagtcttcctctcccagtttttttttccttgccaaatgggcatatttacattcacttagctttagcactcgtcctgttccagaagcgaggcccagtcttttgccaatattttccaggaaaccaccatgtcttttatcacttttgcaaat

SEQ ID NO: 21565 - DNA, 201 bp, Bos taurus
taaaaaaggaagttttcttattgtttatttttctctagctgtatgatatacttatatatgctcacttcatgtttcataaataatgtgaagtggttttttagaaagttaacatttacttttttaccctcctcatttttatatttatttcagatcaataaatggactgggaaaaattttagaaacacagagatcaaggtactt

SEQ ID NO: 21566 - DNA, 201 bp, Bos taurus
ctcttccagcatgggaacatgaaatcatcacatggagcattgaagaagaatggaataaaattgataacaaaacaaacaaagaaaagacagatcatatggtatgggcatggatttcctccagtgcccctttgagagggtcagtgagggaacagcagagtgacacagctcagacctccccaggctgcgactggatttcacatg

SEQ ID NO: 21567 - DNA, 201 bp, Bos taurus
gacctggcctactctgacctgaataacaggggagtgtacactggagacccatgaggtgacagagttccaggtggtgaacctggagttgtgttgctctgtattccaccatgtggggagtggagcactgggatgcactggaactgtgggatctcttctttttcagcgagctcccatttccacacaggcaacatttcctttctc

SEQ ID NO: 21568 - DNA, 201 bp, Bos taurus
tccccttacgccagagctgtgcttcattggacaataaagctcagctgctgctttcatggaacatgaagattggtgggacaaagaaacaagtaaatttaggctctgcaggtggggaaatggagcacacagaagggatctcgacctactaatcataatgtgaaaataagatagtaccatatattttatagtgtgtattatttt

SEQ ID NO: 21569 - DNA, 201 bp, Bos taurus
agtctctctgcttatctgaaaaaacagttctttgacttgccagctgtggccagaactctgctaccatgtccttggaggccacctccccactccttgccccaaaagcttccccagtccaatcagctcaagataagcaggacaaaataggaaacctcttctatgaggcccagggctgctctctacccgtgtttgtatcagatg

SEQ ID NO: 21570 - DNA, 201 bp, Bos taurus
agccctgcccctcttcattatctgtttcgccatgagtatctggaatctttgctcagattgatccttgtgctttttgccccagctcggctcctgtgcacacgcccacaggcatcactcatgtctggctcctaacatccataccttctggttaaggacattggctaacagaaagctggttgcatagagctttctactgactcg

SEQ ID NO: 21571 - DNA, 201 bp, Bos taurus
aaggtaatgcatgtgaagatggaaaagcagaagtttgataaagaagtatctgctgagcatgcagcgacaatgagacatggcgtggaccctgatctctaggcgctgccaagttacttccaccacgcctagcccatattctctacagatatccctggagatccctctattctagggatgggtttttatggaaaatcatttagg

SEQ ID NO: 21572 - DNA, 201 bp, Bos taurus
ggatgccactgttaagtcatcccaaagtattgtctctgaagggcctgtgtttctcaactgctctgtgatggttgatacttttcagtatgagtaagcttgaggagttttaatttgcaggcctataaattaatacaggctgccaagtgacttggttctaagagctgctctttgatgtataactttgtgaaacttaatatttcc

SEQ ID NO: 21573 - DNA, 201 bp, Bos taurus
cagaaaggccctgccagactttatcaggatcccagaggaagctatggcagtgatgctgaggaggaggaataccggcagcagctgtcagaacactcaaggcgcggttattacggccagccttcccgataccgggacacggaattataaggcccgagttttgactcctgtgtgctccgcggcgttcccttggagcagcactcc

SEQ ID NO: 21574 - DNA, 201 bp, Bos taurus
ggtatacatataatgcagcattagtcagacttacaaaggaaagaaattctgacatattctacaacatggataaaccttgaagacattatgctcagtgaaagaagccagatacaagaggacaaattgtatgattctacttatatgaaatacctagagtattcaagtttacagagacagaaagtagggttgcggttgccaggg

SEQ ID NO: 21575 - DNA, 201 bp, Bos taurus
ccactgtgtttgggggacgagctcaagaggtagtaacagtgtgtgttaacttgccgtgtacttggtcgttaaaggagggccctaggcccgcactgggttcccggagccaaacaaactgctaggcagaatttaattcttgagaacatgaagccatcatgtggatgagcttggagatgtctacccggctctgccactggccct

SEQ ID NO: 21576 - DNA, 201 bp, Bos taurus
ctgctctgtccacagtcttcaccactgcatggggctttcagatatttacatatgtaactatagatactgggatgtcagagggaaacaggccattacttcctgtgagacttcccaaacggagttactgttaagatccagcctcctgcttaacttctaaagatgggctgactcccctgacttaccggcagtcaggccggtaag

SEQ ID NO: 21577 - DNA, 201 bp, Bos taurus
catctccaggtaccctttcctggagttggaatttcctaagccatctgactgaaatcaaattcaggttcgcaacaggccacataaatagtatcggtcaaagaaagagtgtcaaaatgcattttcccctcacccggtctgcagtttcctcatcttgggataatatgttagcatggccacagttattattcttgctgcaagcaa

SEQ ID NO: 21578 - DNA, 201 bp, Bos taurus
ccaggacacagggaacacaaggtggtggacagttccactgaatcccccgtcactgaggagaagacaggcaccccagatgcactgcccatctggccagcctttctcctgtgcttcgtggggagatacatcattacttaatattcagaaaccaccctctcccaaataggactcaaggcctagctacagcaatacataacctgt

SEQ ID NO: 21579 - DNA, 201 bp, Bos taurus
caactcttaaacaaggcaaaggccaacaaaaaaataacttatttttactggataaagataatccttgttatttcattttaagtgacgctcttgtgaaatatgcacacacacaatttcatattttgattcaactgaaaatctaactttaaataaggaaatttaggtgccatgtggattctactttccttatttttgtctgtt

SEQ ID NO: 21580 - DNA, 201 bp, Bos taurus
ggtggagggtgcgatctaaattacgtgggaaaaaatccgctctgaaatcttattaaaaagactaactagtcgtaaacttaaccagccatcacttgatcaaactcctctgctgcctgaagcagtgttattttaaacctctctgaggactcttggccatatttaaaaccaccttggcaagccctgaaaagtagcaagcataca

SEQ ID NO: 21581 - DNA, 201 bp, Bos taurus
aacatttacttaaaaaatgaacacagattcaatgtggtcctgaatcattatgctgctcaactcttttgagttctgatttgctttcttgaatgagattacttccagcatagagtggcttagccaagagagtataagtcattatagcagagaagagaggcaaagagccattggaagtggataacttagtttctctttcagctc

SEQ ID NO: 21582 - DNA, 201 bp, Bos taurus
aatgcatcagtttgaggataatatttctttaacacttccttcacatttgctaagcttcctttttagtaaagactgggcaggctgaaggcctaagcatctgaacagaatttcataacaatgtgatgttttcattttgtttattttatggtcattttctattacatcagataacactgagttttcaacttatggccacgatat

SEQ ID NO: 21583 - DNA, 201 bp, Bos taurus
atccttttttccccaactaggccaagactcagttacaacctttcctcctcaggaatgatctgaggggtgaccaatctctattctactgcctgttaccaagagtataatcctttgtaggccacatgaaattatttcccaggctttatctttgaaatattaaacacaacatcatagaaacacagaacagaatctgttctatgt

SEQ ID NO: 21584 - DNA, 201 bp, Bos taurus
actgggtatactactctataatgattgttgaccactaaaccacttcatcatctgcagcacttttcttacagggagaacttgcatgacttttaattaatgcatggtttcagaggatccacactatttgtgattcaaccccatattctgaatgaagactaagctgagttggtaactcttatgacctttgcgggaacatgtatc

SEQ ID NO: 21585 - DNA, 201 bp, Bos taurus
ctgttttggcaggtttcagggtatcctggggaggtgctaataatcctgaaaagccatctcaagagcgtcagtaacaaatagatatggctcatgccaatcattatctattttcctcctctggaatttctatgtctacaaagtaatgtaggttatattctagagtagtattttcagatttatgccttttatggcattcttccc

SEQ ID NO: 21586 - DNA, 201 bp, Bos taurus
tgggcctaacaaaatcacagggcccttataaaaggaaggcaggagagtcagagtcagagtcagaggagatgtgatgacataaacagaggttggaataaacggctctgaagatggagaaaagggccaagagcctagaaatgcagtcagcctctagaagctggaaaaaccaaggaaacagattctccgatagtgcctaccaaa

SEQ ID NO: 21587 - DNA, 201 bp, Bos taurus
tccagttatttcatcaaatactactttaggccttcctgtgaaggtactgttatagatgtggctaactttaagcagctaaccattagtaatgtgggtgaacgggcctattctaatcaagtgaaggtcttaagagcaaaaactgaggtttcccaggaaacagaaattctgcttccagactgtagcatcaactcctgcctgagt

SEQ ID NO: 21588 - DNA, 201 bp, Bos taurus
aggcttatcattaatttaaattaatttttggccaagttgatcacagaaaaagaaatgtattgtgaattcactagataacttataaacctccattttcctgcggccatttgtaattattctagtaaattgcttctttataacagaattttgtttttcctattactctgtaacagctctttttatactatgtctattaaccca

SEQ ID NO: 21589 - DNA, 201 bp, Bos taurus
agaccagtaaatagaggaaatcacaggaaaattaagttgaaatgtacagtagacctttgaaaatagagttgtaagtctggagagagatttgtatgcaggcatatcttggagcatcgtgaaaatatagttgatagctgaaactggagaatgtcaagcaaagaatcagaagggaaaattatcaaggataaactttaagaagtt

SEQ ID NO: 21590 - DNA, 201 bp, Bos taurus
ttcacaattcaaatatcttcagggcattcctaaatcactgaaatattaaatcatgattgtaatttgtgatggtaatatttaactattgctcagtgttccacaggaaaacatacaaaaccatgttgatccatgaatttgtctttcaaaaagcatcaaatattttgaagaaaataaacttcactaaaaagtagcatcatttta

SEQ ID NO: 21591 - DNA, 201 bp, Bos taurus
tttgcatcccagtgcacagtactagtgaacagaagcctgtgtggacccttgccttcattttgtcctgctctcaaaattatgttgtctaggcactgaaatcaggaaaataatttatttgaagatgtcaaaatagaggactgtgaacacagactacccttgtaatttttatatcatgaaagaataaaaaaatactaatctaaa

SEQ ID NO: 21592 - DNA, 201 bp, Bos taurus
ctctaaaggcatagccaatcctgcctgggtatgtatcatttatctgagggctagaaattctattttccagacttgcggttcaaattacctgcatacttaccatcatccactagagggccccagctacattatgtaaagagaggctctgtgcttcttgcctttctagtcctttctttgtacccagacaagcaaggaaatact

SEQ ID NO: 21593 - DNA, 201 bp, Bos taurus
acagtcttacttactcatggccccagttttgggaacccattgatggatgatggattagacaaggataaagacacttgacataaatataccaagtctgttgcgcacaaatgagctgggcctatcttattctcaaacaatttgaattctggaaatggggaacagattaggttatttgaagataagccaatttttttttgtttt

SEQ ID NO: 21594 - DNA, 201 bp, Bos taurus
aactttcaccatagtataaatggtgctgacagctgcagcatctcataaccataacgtaatcaaaaggtaaaggaataaggccactatacgtaggatttcatagtattcaaatattataaaaatgttaaggcaagaggctctttctgacaacacgttaataatggtggggacaattaacctatgtccagaagaaatgggccc

SEQ ID NO: 21595 - DNA, 201 bp, Bos taurus
aatctatgcctatctttgtgtatccaagaatatatagcaaaatggtcctctgccatagaaaaggctgcaaagatacagtaaaataaaaattaggcccattgaccaaccagcaatctgtttaaaaaattccttgctagctcagaagcaacagcattttgaagtaaaattggaggccaatgtaaaataaaaataatgaaattg

SEQ ID NO: 21596 - DNA, 201 bp, Bos taurus
tccatgtgtttgagaaacagcttggaggccagtgtgaggtgagtaagggagggagtagtgggaggtccgggaggcatcctggagtcaaacctcataaaggctcggaggccacaggaggggctttgagttgcgtcctaaaagttgtgggaagccaccatcgaaaggtttttaggaaggcagtatcatgatttgacttagttt

SEQ ID NO: 21597 - DNA, 201 bp, Bos taurus
atatatgcccggccattcattataggccttgtgtacgtcctttaaattgaacgagatggaaaatactacatgggattttggagggttgtttggaacacaagcctagatttgaatgaagaattgaacttcgacatgagagtgtggtgcaaaaggactggcagagcaaagccacaggaggaggcagattgtggtgtctgccat

SEQ ID NO: 21598 - DNA, 201 bp, Bos taurus
atctgttctttttttttcagctcatttctttaatatagtatcatttccattttgggaaataaatctttctcatgcacacatgctcattcaatttctctgcctctcacccgccccctaccccacccccacccgccatttctcttgctcttagtatattttcctttccaatgtgctctttcttttggtagctcttgttagaaa

SEQ ID NO: 21599 - DNA, 201 bp, Bos taurus
tctaatcagacaaatatattacaaaatttccacctcagactttctcatggaagaactaagaaattatgtattacctttaacttgttctttttattgaaacagtggactttctgattctcctcaacatatgtttattgaccatcaactccataacttgcagctggcccctttcagagcaacatcaaggatgaccttgcctct

SEQ ID NO: 21600 - DNA, 201 bp, Bos taurus
attcattggtttgattgtcagggcttccatgacagttcattctcctgggacactgatacggggctctgctaatgcaagggggaggtcaaggcctccttggcaacagggaatgagttatcagggggttgtggaaagaaattctcttcaattcaacctggaagtagatctggacataatggcctcatttgactcctctaagtt

SEQ ID NO: 21601 - DNA, 201 bp, Bos taurus
actgtggcctgccaggctcctctccataaaagatgtggtaaactatggaaagaatattgttgcttgaggaaaaaagaggaagaagcacagtaattataataatagctaaccactggccaggcattgtagtaactgtaatagggaggaatttttgtgttctgttatgttaaccactaaagggacgttgcctgtaagtttaaa

SEQ ID NO: 21602 - DNA, 201 bp, Bos taurus
ttttatcccttttttcttctgaagtgctagaaacttttgcttcaaatatgaagtcaatataacatgacctgtatgcataaaagctgtaattaaatcactagtttaatgtttattgagtgctgacagtgctcttgggttagtatgaagtataggaaaacagacaaaatctgtttgaggtcacagcgagtgaagttttcttcc

SEQ ID NO: 21603 - DNA, 201 bp, Bos taurus
gcaagcttcacagtgaatgagcctcactgatcagtccatagactacagctcaacaaacaagtgtccctttacagagtattaatgttcatttcccccaaagtgggcgcaataatactagggatgttaatgttaatgaatacctcctttggacctaagcctggtaaagtctagggaaatttttcagctacgtagcaataacaa

SEQ ID NO: 21604 - DNA, 201 bp, Bos taurus
aagcaaaatctattcatgttagcccaccagtttatgatactttatttctccccatttctgaaagggacaggaagaaagaaacatcttgtgaggtgttgagagccaattaagtttgaaatggcatgctagtaaaatctcaagtgaccaatgttaatctaagtaaaaatgagtccaattacacacagaaagggatttctgcca

SEQ ID NO: 21605 - DNA, 201 bp, Bos taurus
aagaccactgtcaaagtgtatccaagcacttaagaaactttcaaaagtaacatctcaaatgtgctccaaaaagtcagtatttctcccactctgacctcttcatcttgccaacacgcataaataaaaataggcagctgaccatgtcactaacttcaccatgaaactgtgtacaaggccatgtgtccttgtcttttaaagtaa

SEQ ID NO: 21606 - DNA, 201 bp, Bos taurus
gaaggcagaaaactgagaggaagagaggagggccactgagagcatggatcaggccaacttgactgattgcccagagagggcaatgggcttgctgatagcttctgatcctctagagccccctgagataccaggctgagccttttgtcaaaggcctcccctagaaagggtttgaaactctcaaaattacctctcctctgccta

SEQ ID NO: 21607 - DNA, 201 bp, Bos taurus
tcaaggtcacagcacatgaacagggctgcaagatcacagagaagtctttcctgagattaatggcagggctgagccaaagatgatggaaagagcaccctctggcatgctcatttttcagggatttacttgttggctaatcatagcaataacagtttgtatctgacaaacacaactggatatgtgcagtgagaaactctgtat

SEQ ID NO: 21608 - DNA, 201 bp, Bos taurus
ttaaacaggattcttaaataggactggcatcttagaaaccaacttatgtcttaagctttgtactctagaagttaaaagaaagagttaaggtttgaattaactaattcgtcagctctcattaatgcagttcacatgcctcaaattatggacattataggagatatgctttcttctaggaaacatatttgtgttaagaataaa

SEQ ID NO: 21609 - DNA, 201 bp, Bos taurus
agaaagtctcaagcacaaccctggctttagtgcaatctatatgcactgattcccagattgaaatcaaacactttgatgttttgagcaccagatttatattctttttattatcaaatgctcattttcatgtggatataaatatgcttgttccgtggaggataccacgctcatcttaatattctgttcatagttttcaatgga

SEQ ID NO: 21610 - DNA, 201 bp, Bos taurus
aggaagcaaaagagaagcaggggtactggggtggcttggtgcagaggaaaaagtgcaaattctacctcatattcaagtgctaattctacctcatatgggtactgaggcttctctacagatgcaagctctgtgtttctgtcctctctaagcatgaattttccctatgaatctagacacattctttagatcaggttttaccaa

SEQ ID NO: 21611 - DNA, 201 bp, Bos taurus
agtaatcaattgcagatctttagtgaagcaaaaatcatcaaatcagagaactatgtattccctagtctcccatccgtaatcttccctttggctagctgaacacaatgacccggagccaaaggactacctttcttagtcttccttatagactccctttggccgcctgaccaagttagggccaatgaactaaaagcagtggga

SEQ ID NO: 21612 - DNA, 201 bp, Bos taurus
ctggagctctgtaactgtctgaccatgaatctcgatcaccacgtgtcacctgccatgattctctctgctgcccagactgtcagaccactcctgtagtgttcctgacttgctcttcacctctgcacctcatgtctccagctgacgggtgaaactgcttgctgccttatgtcttgctgtttggaaagtaagagaagggggtct

SEQ ID NO: 21613 - DNA, 201 bp, Bos taurus
cacctcagtcatgctgctgcctcccgggactttgcagatgagttttattggctagattttcagtgtttagagcttatagtttgtttctttttctttttctagcttgtagtttgtttctctttcttcttatttttggttcaatgtctgtctttgggtctttgtataaaagagactttatagctcttacagtcccaccagttt

SEQ ID NO: 21614 - DNA, 201 bp, Bos taurus
atgagcagtagagctcttttgattcatagtacctctctcatgcagtcttgaaattaacccctgaaaaagatttcagttcttccccaattgggtcatatccttattttcaggccagtcactttgtttgtgggggtggtggtgttttggtgagttagcttgggtcacttgtccacccttgaagtgagggagatgttgacattg

SEQ ID NO: 21615 - DNA, 201 bp, Bos taurus
ttatctgagtgatatttgtaacaatgaatttaaaaattcctaaccttctggagtgattacttccgattaataacagctggtatcttttgttcttttgagggtagcactgttagttggtaggctatgctttctatatattttgtttttgttttccccaaacttccgcaaataggaaaacaggcctaattctatgacattact

SEQ ID NO: 21616 - DNA, 201 bp, Bos taurus
ggcagacctgctcaggctctgcattcagactttccatggccagggctaattcttaccacacaacactcaggtaagaagactgggagtgacagcaccccaggtaccatgtaagtattactctctagttatcagccagtgatccttaccctcatgttaaaagctgatccccctctatctgaatatgatcagaatttttgtaag

SEQ ID NO: 21617 - DNA, 201 bp, Bos taurus
ttaactgcaggacgtcttctctaatttccagtactaatgggagcactgcaatagctggtcacagttctgaccagttgcagtattttttgaccatgaaccctttttttaaggtatagttaagagaatacatcatgggatgattgctgctgaaacatgcttcagaaactgtgacgtttaggggtgaaacgagacaagctcatg

SEQ ID NO: 21618 - DNA, 201 bp, Bos taurus
agcaaaggtttctgtctacacataagaggtgtggttattaacgttaggtattttgcaaatggcaaaaggctagttccttgagaaagtcagaaggcttttctccctcattccctacccttctctggtggtggtatttttatagaagatagttggcaactctagtgaacgggaacagtcaggcaagcattgacagtgtgctag

SEQ ID NO: 21619 - DNA, 201 bp, Bos taurus
taagggcccaacttgctgtcatccgcgagcccctgggaggaggaggaagccgcgcagcagcataccgctcggttccaggtcctccagccagggatccgggcgagggaagcggccgagagcgaaacgcccggagctcaggggtgggagaggctcactcacccagcagcagcaacttgagctcgcggcgcgcgtccttcttgt

SEQ ID NO: 21620 - DNA, 201 bp, Bos taurus
caaatggtgattaaacctcattattaaaaagaagtcccttaaataacaagatatacatgaaaaaaaaaaagaacttctttggttcaaaagccatatacttgtaacccagggaacatttgaaatttatgaataggtaacttatctccatatgggatatttgttcatcaactttttatcaatcttatatacaaaagaaatgct

SEQ ID NO: 21621 - DNA, 201 bp, Bos taurus
tagacttgccagtccttggcaaagacctatccgagaccaggaggaacactgggccacttcaaccggcccggacagaggttgctcagacacaagagtggccggtgacttagaggaggtttctcccttactaggatgatttcccctgagccgattcgcccccacccccaaactcagagggccaggagttcacttagcctgcaa

SEQ ID NO: 21622 - DNA, 201 bp, Bos taurus
atgtatttcatgaggtgcagattacaaggtacatttaaactcacttcagcaaactgagttctcgaccacacacttgtgggtctggtgctgaagaaatgaccctccatttcacagatggggatgctgaagcccagtgaaatggagatacacacaaggtcccacacccaaggactcccagcggttctgacctctggtcctctg

SEQ ID NO: 21623 - DNA, 201 bp, Bos taurus
gagtttcaagccaacttcttaattccattccaaattcctctccgggtggcctccaggcatctctaccatgtttggaacactcccccgaagccctttctccagccactgagagaagtgctgtggccttgggcctttctgaagagccgtcattcctcatagcgggtggctgtgtgctgtgcttctctctctcaaggccctcct

SEQ ID NO: 21624 - DNA, 201 bp, Bos taurus
cttctttctgattgaatggggtcatgggtgggctcctggcctgagtgagaccacaggctgtgttcaacagttaagtagggccatatgctgggctccgatgttggctggggttttaggctgtgatccatggctaggtggtactagagagacttggctccaaggttactgagcatcattgttaatgctccctatttttatggg

SEQ ID NO: 21625 - DNA, 201 bp, Bos taurus
agtaaaaagcctaccaagatgtggctctaagtgtgtggaaagaggatagcagaaaacaaaacaatagaaaagataaatcttaagccaatcaagggtcaatgagaaaattttaaccctctaagaagagcaacatccaagtgaaaacctcagaaattgtcaaggccctaccacaatattgtgctttttttcctttatagattt

SEQ ID NO: 21626 - DNA, 201 bp, Bos taurus
atcctttttcctttacccctttcctcttctgctctcaccatcttttattcgtgatatgattttgggtttcatgggaaaagcaaagctagattaggaagaaagaggaaatcgggcattccagaacagcatatactcaaaattcagggataaataacaccctcaaaactgaatattcttggatcaatgaaaagtgtcattctt

SEQ ID NO: 21627 - DNA, 201 bp, Bos taurus
tgctgattattagacaataccgtaagtaaggagacagtgtaaaacaaggggaggtctttgattttctgaacctttcagtgatttgaatatacacaaggacaaaagcaaagacatatttataatgaaatgccaaagagccttgtatgcacatatgagggtactctgactggccctttcaagccctgttatttagtatatgca

SEQ ID NO: 21628 - DNA, 201 bp, Bos taurus
accacatatttcttaccaggaacatgaagagataataaaccactgtccacagtgaagtcatttacattctaagctttccaagaaattcaagagtggttcattgaggctcatagcaggctggaggtaaggtttcagaatctccacttgtaaaagtttactctatcaagaacaaaatgagaaatctgtggaatctgaaatcta

SEQ ID NO: 21629 - DNA, 201 bp, Bos taurus
ttaaactcttaagagagtaatacaaaaacacagataatttgagaattttttaaacaaaactagtctcagcatgaagaagttggaaaaaaaaaaaaggataacatactgctggcttgatgatggtactgaggaagaaaacaagaacaaggagaaaatatatgaaaagagttggcagaaatgttcacctcacagactgatctc

SEQ ID NO: 21630 - DNA, 201 bp, Bos taurus
ggttatcatgccctcctccagaggatcttccagacccagggatcaaagccaggtctcctacagattctttaccatctgagccaccacatttagaaacatgttttcctatatcttaatgtctcatggcaactatacttcagagtaatttttaatccaataaatattctgcccttacatttacaatttgtaacataagaaaag

SEQ ID NO: 21631 - DNA, 201 bp, Bos taurus
gaattttttgtggaactctctctccagtataatcactaagacaattcattgatcagatgtctaagttgaagatttgaatattctaactccaaaatctaacggtgaagtctgttatattacacagatacagcttcagtgagcctttagcactctgggtattgtgcatgtcctctagtaattcatcatctgtgaatcttgagg

SEQ ID NO: 21632 - DNA, 201 bp, Bos taurus
catgttattatttaaattatatcattctctttaaaatgctttcattgtctacataaagcctcatatcagaagaagctggccaagtctttttaaatatgacaattttggatattctcatttgtcactctgatccactcttcatttacccccaccctgctttctggcctaggaacctgacttccatggagagtaacaccatga

SEQ ID NO: 21633 - DNA, 201 bp, Bos taurus
tcacaatttccaaaattagcatatgacatttcatctggagtttctttttaaattcatgttttctaaagattctcccattttaaaaacatctttatgattgcataatttgactccagtttaggaattttgtgtgtctactttgggtgattatttgttatttgtgcagttataagtttcatagacctaaagacaagcaggtga

SEQ ID NO: 21634 - DNA, 201 bp, Bos taurus
tgtagcagtcttctgtctctgggctttccatttatacattttcatgatgtgaacaatgcagtacaccaaaagtcgtggctcttgctatcacaagaaggcagtgatgctagttgtgtttggacatttaaatcttgactgctgtcttaatcctgaagtgtcttgttatcagtgactacaaaagcacatagaatggtattttca

SEQ ID NO: 21635 - DNA, 201 bp, Bos taurus
taatgtctgattcagatagttactgggaggttggaaaaacaactatgcatggagaggtcctagccaaaggcttgtactaaccaatgcccactttctattgaggatatatattggcttccttcatctatacatctgtttttttgaccagagacatggcaggaaacaagttgtacaggcaaatttaataattcaaggagagct

SEQ ID NO: 21636 - DNA, 201 bp, Bos taurus
tctactcggtctaccaactgctacataaatgatggagattatagatagaagtataattagaaagagggacatctgtgaagtaacaaacaggaagggaagcatgctaatgttggaaatctaacagaagtcggtgagcccagtgatctgtaagtatagcactgtgtatctgtggtaaatgagtgaaaaatacttgagtagctt

SEQ ID NO: 21637 - DNA, 201 bp, Bos taurus
agcctagtaccacttgctcgtggcttatacacagagcttccatcttggtttagtaaacggtctttctcctttgagaagagcttgaaaggcaaattgccagttctagtctatcaggctggggacatggtttaaagctaatactgggcaccaagaccaaatcagggcacccagaccttgcaccttacggagaaaagaggggtg

SEQ ID NO: 21638 - DNA, 201 bp, Bos taurus
ctccagaagaacaggggcccagcattaggaacctggatttctggcccaaactcatcacactcattgtgtcaatcatagaggaagataagaattcctacactctcgttctgaaccagtaagtatcacctcacttggcttttctgtttggtggttggtttgtccacctgtctaacagcctctttctttcctgtctctgtgtgt

SEQ ID NO: 21639 - DNA, 201 bp, Bos taurus
aaaggaatttataaatagacttgtctgaaaatgcagaggctatcttaagagatagtgatttcttcgtcactggaagtatttaagcaaggtggccaggattactggggaatgattgctctgagtgggagaatgaaccatttatctcccggtgcttttccaattgtggaattctgtaattttcagaaccaaagtgaccctgag

SEQ ID NO: 21640 - DNA, 201 bp, Bos taurus
gtactcaggagttatacagagaactaataacaaaatatcaaggtgataaattctgtttctctttggtcttgtgatgccacagtgaattattttaaagctcgctattaccagtgattgtgtagaattgttattcatttgcagttctcaatacacaaagtctgcttctaactcattttcagttagatatggattgtgtcctaa

SEQ ID NO: 21641 - DNA, 201 bp, Bos taurus
cagcatcaatgacgaataaatttctatttctactttccaaaagtgctggggacctagcaaactaatgattgctgggccagaaagagagaagccttgtacttggtttagaatacactattgcctttgttctaacggagcagcggaatatatcctttcattgacactgctttatcaggcctttagatggagcaagtgggtgag

SEQ ID NO: 21642 - DNA, 201 bp, Bos taurus
gccaaaaaggaaaaaagaatttagttttcaagaatttaaatgggagaatgtggagataagcacttaggtagcagtggggaggcacacagagcctcagacacccctggcccccaggccttcccactgggtgcacttcttccaactgccaggatctttgcagctttttattggcaggcagtgagaagctgcgggaaatcagtg

SEQ ID NO: 21643 - DNA, 201 bp, Bos taurus
ctgcctccccccagggacctgggggcacagtgctttacataagcaggagtgcttgctgcaaggggaggacactcaagccagaaaggtctaaagtcggagaaaaaattgaggcttgcctgagagggctggaagcaagagatgtgggagttatgaaagtgaaataaaagggaaagacagttttaggcacaacgttattgataa

SEQ ID NO: 21644 - DNA, 201 bp, Bos taurus
ggccatactgttgccagagatgggaatgcaggctgatgggaactcaggctgagccctcagtgataggttttcctgtgagtgaaggatgggagaacttcctttccaggcctggaagccctctgggtgagaacatgctgggaacttgcccagaagtggctctgggctctaggttcttgattcccgtcagatccaaggtctctt

SEQ ID NO: 21645 - DNA, 201 bp, Bos taurus
gtatcacctttcctattgagttcaaccaccggcccctgctctcttttcatcaggacaacatcctctgcgtgtacagccaccggcagagtgtagagatcaatctgcagaaggtaaaggccaacaagacaaccacctcagtgcctcttttgcccaacaactgccccttggatgtgtcccatgctatatgctctgttggagaca

SEQ ID NO: 21646 - DNA, 201 bp, Bos taurus
gaagatttcctagtgttgaatttatcctgcaccatcaggatagactattttactataacactatcgtttattatttaaacatctgcatctgtactcaagagggaaagtagttgaaaggttttgtttgctgtactgtctatgaggtttgattattaaggagcttcacataatatacttggaaaatttctatctgtggctatg

SEQ ID NO: 21647 - DNA, 201 bp, Bos taurus
tacaacagagaccacatggcctgcgaagcctaacatattcactagcaggtcctttacaggaaaagtgtgccaatttctgaccaggaaaatgaaaagtcatcgcttcttaggcctgtggaagcttggtgacctagccctgccaacctctgaactttcttccacaccaccaccctcctgctcacactcaggtaccccactcct

SEQ ID NO: 21648 - DNA, 201 bp, Bos taurus
caaaagtgctccataatctacaaagtgctactgccagtattgtcagaggggaagaactgctaagaattctgaatggcctcactcttccaggaagccctcctggacttcccctcttgtgttcctagaaccctaaagtgcatgcacatccctacagctgcacttaacactctgtattgtatacttcattatttaagggccctc

SEQ ID NO: 21649 - DNA, 201 bp, Bos taurus
ttaagagcatctgtaccagatatttctaacattgtagaatttgggaggaaaacactgaagacattcttaactatttttctccttcttcccctcttatatattttaggggttaaaaactacttcccctccccacaacaaataagcaaaactgatcagagcaagaattttagatgatagttttcattccctacatttttctga

SEQ ID NO: 21650 - DNA, 201 bp, Bos taurus
cacttgatgagtaaaatacatggggggctatggttctccagaatgagagaaagagctcaggaacaataggctcccataaggccaaatcattctcacctccgtagctcacaggtcctccctacagcccacagaggcaatgaccaggcaggttggtagattgggcattggagctgggctttgacagatgagtaggagttcagt

SEQ ID NO: 21651 - DNA, 201 bp, Bos taurus
agagcagggcttctcaacagagggataactgatgtttggggccagaaatcctttgttggggtgggtagcggagggctgtcctatacaatccaagatattcagtggcattcctggcctctatccaccagatactaggagcaatccacctgccccttcaccctgtgtggcaaccaaaccggcctccagacattgccaaatgtc

SEQ ID NO: 21652 - DNA, 201 bp, Bos taurus
gatttgagttctagatttgcgcaagtctttctctgcccttggcctcagtttcctcctgaagggagtgcgtgtgcactggctgatctctgagcatcctttccaaccatgagtgtctgaatctctgcgttactgagttaaagtgaaacccgtgtgattcaaatccaccctgattaggagcctgcttttgtagtgagcccacac

SEQ ID NO: 21653 - DNA, 201 bp, Bos taurus
aggaataatgggagctgacaagccgatctaatgcttatatgtaaatacaaagaacacagaatagccaagataatcctgaacaaaactagagcatttacaccacccagatttaaagatttactacaaagcttcagtaattatgacagcgtggtactgaaacaaagacaaagagaccagtataatcgagtcctgtaataggtc

SEQ ID NO: 21654 - DNA, 201 bp, Bos taurus
cttgaaactgagtcactgtcacgacaaggtcttagtatagtactgtctatagagctttttgcaacgatgaaaatgttctatatctgtgtagtctaacagggcaactactggccacaaatagctataggatacttgagatgtggtagtgctactgaagtgctacattttttactttaattaaattcaaattaaataactacc

SEQ ID NO: 21655 - DNA, 201 bp, Bos taurus
gggctgggctggctgcaacactctcggaagagaaaaacagattcctcagaccctaccctgagagtctcatttagttaagctgtgtggaacccagaaatccaagtttttaagtagctccccaagtttacagcatattcttatgctaggaatatcaggtgatcattgaactggattgtttctccagttttctgttgcctgaat

SEQ ID NO: 21656 - DNA, 201 bp, Bos taurus
gcccaaggaaagaccttcagtcagaggcccttggagctgcatatgagcaatgcactaaagaatcccaggggcaagacagatacttctcagtctggttgtccgctccatgctggccccaggcttattagcactgtctctccacttccttttaaacaccagcccctcctgccctacctccagtgtgtgttttgttaggaagca

SEQ ID NO: 21657 - DNA, 201 bp, Bos taurus
tattaacataaagaggtaaaatgatcaaagacagcacacacttggtcagtgcagcagaaactggggaagaacaaggggcatctggagctaagtgctccccgaaggaaatgtcttccgaaatgcagtctcattctccagtgccatctcaagtgcatatgaaataggagctgaccaagggttgtcctataggcgtctttgaaa

SEQ ID NO: 21658 - DNA, 201 bp, Bos taurus
actggcctatcatattaatccactaacctaaaaaatctgttatcttcataacgtcctgttacttctaaccaaaccaattctaaatgtcaaacacatccttgaaaggccatatactagctaagatatctaacctaattaaataatcattagaagaagactctttgatactgcctcctaggctcctaaattaacttttgtaaa

SEQ ID NO: 21659 - DNA, 201 bp, Bos taurus
actgagagcatttgtaagcatcatttatacagtatatcttcatgaaagcttgaataaaggtatgttgacagtaatgtcaagagtgtgtgaataagcatttgtagcttatggattatgtcttcagcccatccctatagctccagggtctctttgctatagtcattgaaagctctgctaaccaatttgaaatgactcaaaaaa

SEQ ID NO: 21660 - DNA, 201 bp, Bos taurus
acacatgacttctttccctcagtgttgataataactcctgttcctggtgagttaaaagttctttatttatcaagaaagatttcagagatgaagcaaggaagctaagaaagtaaagtgagagtttatttgaacaagaatatgctctgagacagaaagtaggcagacaggtcaggagccactgccctgggtttctttagcaag

SEQ ID NO: 21661 - DNA, 201 bp, Bos taurus
tggtaagattgaatcacctgccttctttctttcccctgggctttcctcaaaatgggaaaaagcacctatatctcagacctttcctttcatagtgctgaaatgttgatgtcaaattatccacaaaatgacccatcagaatcctttggacagaaagtgtacatgctgcaaatgtctggagaaaaagagctgaaccattagtgc

SEQ ID NO: 21662 - DNA, 201 bp, Bos taurus
gaaattcatgagtcaccagatggccccctcgctgacacgaatgggtcttgcaaaatgaatgggtaccatgtccccggtggcccccaaaatagctgttattcagcctgtgaggggagctacaggtgtagttaccacagaatgttcagttccagtatccaccataaaagtcattgattggccccctactttcatcatgaccgt

SEQ ID NO: 21663 - DNA, 201 bp, Bos taurus
caatagcctggaaatggccacttcctctgtcatttactgtctgggacagcctcaccaggcagtctgaggatgagagcttcgccaagtactctccagatcaccagggccaagggggtgggggacccagacccttggaggttaaggggtttgatcaaggtcattgtgaattgtggtgctggagaagactcttaagagtccctt

SEQ ID NO: 21664 - DNA, 201 bp, Bos taurus
cctattcctgacatgacctgtgacacattactgcctgaaatctaaggcttaccagtgaaccttccctatgtgatggatgcttattttttcttactaaagtcaggttattgagctaaactcaataaaaaacctgaacatccaaacacagagaatggataaagaagatgtacatatatactatggcatttactcagccactaa

SEQ ID NO: 21665 - DNA, 201 bp, Bos taurus
ctaggggtgggagaggcgagaggccctgtcacccagcctgtgcagagggtcactcagctcaagcctgcagctgtctgctcagcattagcaccaattgtactaacagggaaatgtctccatgctggcccacgggccctcacccaggaagggagagagctgagcatgctggctggagggggaatggcagacatgtctcctgag

SEQ ID NO: 21666 - DNA, 201 bp, Bos taurus
cagaagcgaaagaaacaccccctaaggcccaagtcattctccagaaggagatcacacagagagttgcttgcctggcccaagtacggataaaggattttcctccccagaaaagacttcattgaaaaccttcagagaacaccccgacaaactcaaggagccaggccaaggcctagggagctacccagggccagggctgtcgag

SEQ ID NO: 21667 - DNA, 201 bp, Bos taurus
gtgtatccgtgtttcctcaattttctaggtgaacacaaattgcttcggcaataattgaaaatagtaagttatgaactttgaaaatgtctaccattcttccaggcccacgtccaaagccaagagctccatgtgctgcacccccacagctgaacgcatgagccttttctgccctgaaagcccgtgggagtcggacttcactgc

SEQ ID NO: 21668 - DNA, 201 bp, Bos taurus
ggtgcctctcagtgtgtaccagttagactactaattgctctggtttcttccagtggtggtgggaaggtgtgagccaagaggtcaagctaactgaaaaggagtttgaacaattataggggaaaactctagtagcctttgaggaggaggcatgcctttccgttttagtgtaaaaaataattgtataaaaaagttttgccaaat

SEQ ID NO: 21669 - DNA, 201 bp, Bos taurus
tggacgattcagtactgagctgtcacagtctggtctggcttaagattcaaattgctccagtgatgaacttggcagggggcctatcagcttgttcctgataaccgaatggtatcactagagctgagcaggtcatagtattcacagcttagtagttcaggcctacagttcttatctgtacataaaacagaggaagaagattaa

SEQ ID NO: 21670 - DNA, 201 bp, Bos taurus
gaatgacaggccagttaaaaggaaattccttccaaaacatgacgttaaccatgtgcattttaaggagaggaaaacaactgattcaataaaggaggacattgttttttcttccttaaaataaaggattaggtctttaattatagattctcataaggaaggaaaaaattctctttgatctactgtatcctcccagaataggac

SEQ ID NO: 21671 - DNA, 201 bp, Bos taurus
tcccaaacaaagctgtggacccaggcagtaaacttggatgaaacaaacaggccactgaagaggatccttctaattgcctgggtgtctgtaatgggctcaccgtgtagctggagatgctaatgtgggccagagcagccacccatctcagaatcctcagtcatggacccctgtacgctgtaatcaaaccaatacccgaaggac

SEQ ID NO: 21672 - DNA, 201 bp, Bos taurus
cgggtttctaggggctaactatgtgtctgtggacaagttggggtgaggcagtaggctgggagctaagattcaggaggacccttctccatgtgaggaatggatctggaatgcagagatgagctcccccgctttccattcctccatggccagccatcaccaatgactccgggactcttggggcttccctgccagcctgctcca

SEQ ID NO: 21673 - DNA, 201 bp, Bos taurus
ctggccctgtgctctgggggacacacagatgaaggatgcgggatttgcccatgaggaactcaaaaactagtaagaggacaggagagcaaatctgcctttacatgggccaggtatatgatggaagtgtgtactgggaaccatgggggcaggcggtggagggatggcaggggagcgaagaggttctcaggctctgcatcagag

SEQ ID NO: 21674 - DNA, 201 bp, Bos taurus
aggtgctttacctgttcttctgaactgtgctggcaaatattctgtcttcatacctctgtcgagcggcattgccaccaaacccaaggaacgtggccacatagacacggtacacatgctccgtttggtgaatgtcacaccccaagttaaattcagccaacaggttcttagctacttcttcctgcagacgtaagggccacaaac

SEQ ID NO: 21675 - DNA, 201 bp, Bos taurus
aattagatttagatggggtcatgggagtgggatttccaggatgggattagtgtctttagaagaagaaagaccagaagtctctatctctattcaaaggcaccgaggaagggccatgtgaagacacagcaagaaagaaactgtctacaagcagaaaacaggtccttaccaagaactgaatctgttggcaccttgatcttggac

SEQ ID NO: 21676 - DNA, 201 bp, Bos taurus
aggcctcaaaatcaaccttgtcatttttagagtagttaagatgagacagatttgactggttattacagtgcaggaggcttcagaaagtatccgttattatcgttggggccagtttgactcttttcatttcgatcacatttttgtatttgttgttcagttgctcagtcatgtccccgactctttgtgaccacatggactgca

SEQ ID NO: 21677 - DNA, 201 bp, Bos taurus
cccctggccccccgcttatattcccttttagaaaaggtcatccttggagtagagggtcaagaactggttcatcctaaaaggcttcctctgattcagaagcgagatgtttggcacatccatgaggatgacatacaggtatgggctttgatttaataaatgaaatgcattgtttcgcaggtatgcagagagcaaacaagtgcc

SEQ ID NO: 21678 - DNA, 201 bp, Bos taurus
ggtaaaagtcccaaggaaatcaatgtgtaaaaaaatcaaacacataggtcggaattggtgtccgaattgtaccaagttaatggctgggtgcaggagaacgaaagaagcacttgatgtggcaaccagtaaggtttgttaagactggaaggagagtgtgtggtggaagtggttggagataacaattataattgttgctcttct

SEQ ID NO: 21679 - DNA, 201 bp, Bos taurus
gatcggggagaatgaaccactcacgtcagtcttgaataaagtgatagcaaccaaagaagtgaatcacaaaggacaaggtactcggccctgtgtaccaagcagggagggggctctggtggggctcgggagtggtggcgctcagagctgagtccttggactctggccctttcattatctttctctgatataaaacagaccctg

SEQ ID NO: 21680 - DNA, 201 bp, Bos taurus
gctgtccacctgaaaccatcataacattgttaattgactatatttcaatacaaaataaaaagttaaaaaaaaaagaatcctgcaaaggaaaagaaactatccttggtttataagcagaagggaagctagactgcagtgaagtagaaatttctagaagaaatagttactatagttacgacttcttcctcagaagccaggttc

SEQ ID NO: 21681 - DNA, 201 bp, Bos taurus
catgagggaggaaataaaaatctagttggattcacatggcttgttcacacattccagaattcacccccaagtggctctgaattttttagaacacataagcactgactgtgactttgaatttcaggacccagtttgtggcttcacacacagatttttctcctttcacccaatattcctgggccactggcagtactcagtact

SEQ ID NO: 21682 - DNA, 201 bp, Bos taurus
actggcattggttacagaaaatttcctcatggtgcatttacaattacacatatagccaatgatctctcaccaagctggcatggcctgcctgacacaggccgcacacagaacatgtgacctctctgccgatacacgactgatatccaagcccctggcttgtggagggcacaggtgatggtttaggctactcactttccctga

SEQ ID NO: 21683 - DNA, 201 bp, Bos taurus
aggtcatggagtatcagagatttaaggccctttctcttcctcagagtttctgactctacaaactggatgacatgtgggtttgccccagacattaggagaactgaaagaacataccaggcttttggccctttccttcccaaaaagtgtgactacaaaattgtgcaaaaatctttttacaaaacccagaacatggaagcaacc

SEQ ID NO: 21684 - DNA, 201 bp, Bos taurus
gaattggacaatgaacagttgacatgttttaagatcaacgtttaaaaagctttatgcctgttcacaatttggggacaaaaaggcaggcttccttttcctatgtttgatgaaaactggcgtaagatatttgtaaatataatcaagagcaaaactgcacaaacttgcacattgacaagtgcagcaagttattctgattgcagt

SEQ ID NO: 21685 - DNA, 201 bp, Bos taurus
tgtttgaggagcactgcttagaccctgctaaatgctagggaggaaagtagacaaaggggaagggggcccttgccgggaagggggccttggagtacaggccgtgagctccgatagataccgggaggaagaagctgccgcaaacggtaaggcagagtgagcgggtgaaagaggctgcgcaagacgaccgaattattctcgctg

SEQ ID NO: 21686 - DNA, 201 bp, Bos taurus
gggctagtcacaggccggggatgtgatgctaagggttatgggtcttagcccacagggactgtgagcaattccaacatgataagcagaagcgtaaatgatacggccagctttgcacttttgtaaaagtactctgactgcaggaccgaatagactcaggagcagggtcccagtgaattaggcctgtgagagatggtgacaact

SEQ ID NO: 21687 - DNA, 201 bp, Bos taurus
ttaacttgccaacgtgatattgtgcatgttatccaaggtgaaattattagacatcaactgtttatgatgatacattggtccaccagtgcagatgaaaactaaacactaaagtacaatatttctatagcttgatatgcatagttttattttctttttaatttatttctatcatattttggctttccattaaccatatttttt

SEQ ID NO: 21688 - DNA, 201 bp, Bos taurus
tccactccactctccccattggcccctctccagccatgaggctgggagagcaggtttagacttgaaacatagggctttgtggccagcatctggttcttctgaaagactgtaccctgtgttcagtccctccgttagcagagcccacctggcaggctgggggcctcttcatggggagggaccctcttgagacggaggctaggt

SEQ ID NO: 21689 - DNA, 201 bp, Bos taurus
cacccctcaactcatcgactcccggcccggccacttcgcgaacattcgacaccatgagactcactcggaggactcgatttcgatcgacatagcgttgtctttccgggcgcaggccccactccactctcaggcccagtcgcgcaacgcaccaacgccacctccggcgactcacgtacgtcacttccgctcgacaacgacgcc

SEQ ID NO: 21690 - DNA, 201 bp, Bos taurus
gtctaggtttagttttcttgcacccgaccactgcagcttcatgagcccctccctaacgtaaattcatggatatggtaaattcaaagagggcaaggcatggggccaggagtctgtcctatgaactctctagccgtgtgttaggaggagatactggtgggatcctgggcagtttctggggaatgtttcctcagatgtgtgaat

SEQ ID NO: 21691 - DNA, 201 bp, Bos taurus
ttcttatattttacataaaggttctggagtcagtgtattcttaaagcaaagtaaaaagcctaagttaccaaaattactaccaatatccttaaaaattaccaccaatgaattatgaaaatgagtaaggcatggaaattagatgtaaaaatcaacaccttcagcatactctcacatggggaaattctgtttccttttctggaa

SEQ ID NO: 21692 - DNA, 201 bp, Bos taurus
ccagtagaccatttcgaatgaggcatgtgcctaagaacaaggactttctttcatggcctgggagtaaggcctgctggcaggaatgggagggcccacgtaagtccacaaagcccttctgtgatacatagcttgctgcaaagtctggctggaaagtgggagcagggccaagattccacagaggccagaggtctaggccaggcc

SEQ ID NO: 21693 - DNA, 201 bp, Bos taurus
gctgcccacctacccccgcccccccccaccccagtgccatggtcaggccacacggctacttctgtcctctctcttcgctgtccacttccagttcggttgttaaatcagtctgtcctcactgaggcctcctctgctatctgtcatgaattccattctttatttgtcagtaaagtaaaacagctatattacacctctatgaag

SEQ ID NO: 21694 - DNA, 201 bp, Bos taurus
accacaagatgcacagacaactctcccataaggaaggggtaaaaggctgtaggtagatggctggaaagtgttttcattgggaaggcaaacatgaattcacagtcctaagatagggatacggtagctctggtgaaacaaacccttactggccccagcagtcactttcaccaggcctgttttgtgcagcagggaggttgatgc

SEQ ID NO: 21695 - DNA, 201 bp, Bos taurus
tgggttgggaaaacccgctggaggaagacataatgaccagaggagcctggcaggctgcaacgaggagcatggagtcgcaaagaggcaggcacgactgagtgcctgagcacgctccagtccttttaccatgaatttgcccttctcagctccttattttggttcaagtctcggctggttggattttgtccttgcctagttttt

SEQ ID NO: 21696 - DNA, 201 bp, Bos taurus
atgactctgaagctaatcactgtacaaatatgaaaataaatctttatctttaagctcaattttatcttcagcaagagggttgtgtggtttgggccttatgcaaatcacatttagtattcaataatcagatgtcacatatgttatataaagcagcaagtggaaaaaataaattataaaaatgcatgaggctaaaagttaaca

SEQ ID NO: 21697 - DNA, 201 bp, Bos taurus
gttgtcagatctaccatgtcaataggaaaactgttcttggttgtcattagccctgaaaccaaagccctgagcatctaaactaactagtcaaccccatatgtgatttctggtaatgtaaaaataaagatatgcctggaaatgcctcctttgattccagcctccagcaggaaaactaagcatggataaattaaggcaaaggaa

SEQ ID NO: 21698 - DNA, 201 bp, Bos taurus
gccctctctgtgagaccatatttgtcactttcttctctccctccccaccccacctgccttctgtgctacatgaacagataattcgccttcattttttcatccttccttttagaggtaggagttggacaatgaaatagtctgtactataccaacacctcctgctgagattgcatgtacagatggattacacgcccatgagaa

SEQ ID NO: 21699 - DNA, 201 bp, Bos taurus
cgacaacacaggaagccaatctggctgcctgccctcctggccaagtggggaccagtactggtaagaagaagcaagaacaagaaactgaaactttctgagcaagtcagaaattcccgggcccatctgaacatcctgcaacctttcaagcaactagaaaaacagatgataatctgcatgtccctgttcattgtcttatatcaa

SEQ ID NO: 21700 - DNA, 201 bp, Bos taurus
ggaactattagatggaaggagagtaagttccacagtctttaaaccacagtttattgagcatttttgttacagccactgttttacccttattaatgaagttgggcgacactgccttctctgggaagttctgaggtgttactcctaaaagatttagccccagttctgcttctgtatcccacatcccccaccccaatgatttta

SEQ ID NO: 21701 - DNA, 201 bp, Bos taurus
ttgtttagaattcagtgtgtcctttggttttcactgtgaggtcactggtaagatttaaaagagatagcctggcaaaagagaagaggggaaggatataattcaagaggttgtagtaaaggttctatgggggcgtaatttcctgagggtggtgaaataaatgatgggggaagcttctagaataactttaatttcttgcattaa

SEQ ID NO: 21702 - DNA, 201 bp, Bos taurus
gaactgtcatgcccagagtgaaaagctcctagagatgagttctgttcagaattacagaggtttacatcggagtctcagtttgcttaagagttcccagaatgatgctgacctctttttaaaagaggtaacagaagaggaagcactatagctgttgcgtttttttttgctgctgcttttttgatgttgtaatttgtttggcta

SEQ ID NO: 21703 - DNA, 201 bp, Bos taurus
caccttcttgcctgtctgcttgtaaaactcataaacatcctattctagtaaatcatgcctttcattgaattctttctgcactgagaaagaaaagactggagctccttgctatgctaagtcaccttagtcgtgtctgactctgtgtgaccccatagacggcagcccaccagctcccccgtccctgggattctccaggcaaga

SEQ ID NO: 21704 - DNA, 201 bp, Bos taurus
ggggacatagtttaaaaagtgagaattataatggaggacaattggaaagagagcatcctttgaaatgataaagggtgaaaagaaatttgcatttgagttcagatagggtagccaaaggagcatggactcaagtcctgctcagttcttttttggtggcttatcttgtctgagtttcttctctgcctctcttttttaatctgt

SEQ ID NO: 21705 - DNA, 201 bp, Bos taurus
ccgagctgctggaggggaaatggacaaagagcggggtgggcaggggagctggggcggggggccggggccgcgggaacccgcacccacttacaaactggcccgaaggcgcacccaatgcgttccactgatgttgctttggcagaattgtgttgtatggacactgctcccttccaggaagactggaaaatatcgctttttctt

SEQ ID NO: 21706 - DNA, 201 bp, Bos taurus
aatctcaatcactccacacatcctcacaaaaacaagtaaagaaaatcaacaagcagtgcaaataaaagcacacatgcccaggcctgcagcattactagacgacagaatgtaagagacttgctcataggtagaaagatgggcagatataccagggaagtggaaacaaagtagactgcaggccaaaaaatactaagtaagaca

SEQ ID NO: 21707 - DNA, 201 bp, Bos taurus
atgtggatgttgtcctagctgacctctttaatgaaagtcctgaattcacccaacattcctctgattgcagggttgggaaaatgccttttggtaaaatcatagagtggtaaacatcaagagactttgggtccatataaacccatctctctactcgaggacatagacttcttggtgacagagctagggctaaagtacttagag

SEQ ID NO: 21708 - DNA, 201 bp, Bos taurus
ttcttttgtgccatgcaaagtgctcaaaacgttgtagtgctcaagactgaaatgacaaaacccagagtgatccagaaagaactataaggatgccagttccgtaggaagatttatacacttatttttctccaggcttctctctggtcctggtgcattttcagaaggtcggcaccttgcagcaccaggggccttacaggcaag

SEQ ID NO: 21709 - DNA, 201 bp, Bos taurus
agttggatttatgaaaagattccgatttctgggattttcacaaagaaattgaacaaaggtggtaaaatagtgcaaggagccatcaggttatgccacatgcgagtttcaggtgtctctgtgcttgtaagtgctcagccatcaaaatttacacaaaacagctttcagccagaaaagttctttgggatacaggatgcaaatgtg

SEQ ID NO: 21710 - DNA, 201 bp, Bos taurus
agaggaaggtggaggcctggcctctaccttgtcctccccgaggccactttgcaggaaggaagggctgacatctccttcggcagtgtggcttctccgaggttggtgtttagctttgtgaggccgtggttttctaatcctctttggtttctagtcatttgttcagggcatgttccctggcagccccatatgtaccaagcagcc

SEQ ID NO: 21711 - DNA, 201 bp, Bos taurus
tggcctggggagtagcttgctgaggttggagcaaccaaacaagggacagacccctctgagcctccatgggatatcctgagggtctcctgcaactgtggctgtctggggcaggaggccccaatctccagtcccctgacaaggtcaccgttcataaaatgtgtgagttgctcctgacatgacaccctctctttgtaaaggcat

SEQ ID NO: 21712 - DNA, 201 bp, Bos taurus
gcttcttggggagagaagtgtttcatttgagtcctgaggttctgctgagcccctgtaggacttagccaacaggcctatcacccatcttttctaagcagtcgtctatgggggttgggggaggatgactgaaatgaaagaccactatggagcggggaggacattccaggcctgccccccaccctcttctttccagggctgcag

SEQ ID NO: 21713 - DNA, 201 bp, Bos taurus
ggattctggagacttgaggtggtggaggagaaggtcaggcagaattggcgtggagctgtcatgtcaatagacagtcttcccacagagggacaacccaaccatccctaaaagttctcacaggacatttggcagcatctccagtaactcagccaatattactcactactgtaccaacctagtgtgcaaaaaaatatatataaa

SEQ ID NO: 21714 - DNA, 201 bp, Bos taurus
ttgaggacctaaaagacctctttggccctcggactttccctgtggggcacaaggcacagtgcgggttgtctgtgccatcccccctgaaacaaagcccgccactccattgggcggctctgactctgcagaggacaacagtgactgttttgtgcatgtgtgtttgtgcgtctgtgctccaagcagctggccccccacgaggcc

SEQ ID NO: 21715 - DNA, 201 bp, Bos taurus
tttattggtccgatgggggtactctgtttatgagccactgtatgcataacctctaccaggccttaagtgtgatgaaaaagcagcaactcatgtttactcccgatcatgtcgtgctttctgtcatcagttactgtcaggggttccaccatagccagagtactcacacgaaaatagaggggatcctctacacggcacaaccat

SEQ ID NO: 21716 - DNA, 201 bp, Bos taurus
ttctcatgaggacagaccatctaatgctgtggcatcagccaaaatttggatgtggaaacctgtcctcttccacctctacccaggctccatgctacctttggttctgatgagagttccacccagggaacacctgaaggtggaggacctgggctggaatgtcatggtgtatgtttcactcagcatctcagaaacactatgggg

SEQ ID NO: 21717 - DNA, 201 bp, Bos taurus
gcatgttccttcctcccggtgaccgtgctgttcctcggaagggccggcctgggcagcccagcttcttcctcgctgggggctgggctgctggtgccaggagaaggaaatgaggacctgtctggcctccaaggcggagagatcccaggggcagtttgggtggcagcttgtgtggaattcattctcagccccttcatgatcaga

SEQ ID NO: 21718 - DNA, 201 bp, Bos taurus
agtggaacagaatagagaactgagaattgaactgacatttacatgggcaataaatctataacaaaggagacaataatatacaagagtagaaagacacccttttcaataaaagggattgggaaaactggacagctacatgcaaaagaatcatactggactattttctcccaccatgcacaaaattaaattcaatgtggatta

SEQ ID NO: 21719 - DNA, 201 bp, Bos taurus
gtttttggtatacctcaccaatttattgagcatatttctcagatgcaatggtttctccaggactcagaaagctgtcatggatcagacaccatcaaacagtgcccaagaccttttttagtgcaagtttggctttgaaaagagctttgaagcttcttcttggtccaccactgagttggtcgtcaacagttgtataaaatccac

SEQ ID NO: 21720 - DNA, 201 bp, Bos taurus
taggcaagagaatgaaataagcagagcaatgatatattgtatcttatttaggacaattttggaaaaactacttgattgttgtacctccttttgtagcaccccaaagctggaatctaatacctatctgctaaacacaaggatgctattttaactgctgatctttcaagtagaacttattgttaggtgtattctgtataggta

SEQ ID NO: 21721 - DNA, 201 bp, Bos taurus
atgatacccagaggcatctgagtcagacactcagggtgtaactttggagtttgttcagtggccaaaattttcagaatagcggatgttttcatattcaattcgagtcatggatattgcgctgatacggtctgtgcaacttagatcctactcttaggcatgcagagaagtaagacatagtctaaagtgaaaacaaaagacact

SEQ ID NO: 21722 - DNA, 201 bp, Bos taurus
agcctccacacccggaaccacttggggcacgcagagcagtcggttaaactttaacccaccttgcggccagcatcgcctggtcctcggacagcattccagccggttggggtgtatctttttgtatgtgagggaagggaagaaccagtgcggaaatgcaaatgcactgtcgtttagtgacccatattgcgaaaaccagcaaaa

SEQ ID NO: 21723 - DNA, 201 bp, Bos taurus
cagggaagggaaggattgtggagacaaaggaggaccagtcaaaaaccaatgatcttggttccccctcaatggatatacacaatatgtttgagctgctttgcagatactgaaacccccaccaagtgggagacgttaactctatactacccaaaagcacatagacttgtggttaaaccagttagcatcagaaggttaataatg

SEQ ID NO: 21724 - DNA, 201 bp, Bos taurus
ggcacctgcagagaagggagaggggaggcatggagtcaccaaggccggaggagcctccagctctgttctggtgaccctgcctcagcatggtgtctgctaaccagcccataaatgtcggggccactctgactccagagtcagcccaattctgacctgggagaactacagtgtccccccgtgggacactgtcagggtttaaaa

SEQ ID NO: 21725 - DNA, 201 bp, Bos taurus
tccacagggcctcctctagctgatgtttctaccaccttgatcaggccagaggcaccatgtgaaacaccgagtgtgtcagtggacacttttcaaaggcccaatgcattccaggagtacaaatcctcatccttttctcccactgtgtgatttatttgctcagaaaagaagacctttttaactttgcacaggattggcgagctt

SEQ ID NO: 21726 - DNA, 201 bp, Bos taurus
tccaaaggccaggacaggggttgcaaactctagcattcgcagtgaccaggcaatgcgagatggggacatagcgtgggagatgtccaaggagccatccatcgcagctctgcccagctggccgcttcttatctatgtagcgctctaggaatgtgcattattgggaacctgttctccttcctatctccagaactccttgcttgg

SEQ ID NO: 21727 - DNA, 201 bp, Bos taurus
tgtgtgcaggcaccatcctgagtcgtgaaaaacagaaaagtgcttggagatcttgttctggaggggaaacagacatgaataagaagaagacaaaaaatgcataatgtgatttctagggatatgtgccaagagccctggagcagggaaatgggggaagtgggttgggggcctaggttgaaagctaccatacaatcatgggca

SEQ ID NO: 21728 - DNA, 201 bp, Bos taurus
gacgcggctttggcttcaagtcagccctcatcagacaccagcggacacattcaggagagaagccatatgtgtgcagggactgtggtcgtggctttagccagaagtctcacctccacaggcataggaaaaccaagtctggccatcacctcctgccacaggaactgttctcttgacatttcctttccttccctatgagtgtct

SEQ ID NO: 21729 - DNA, 201 bp, Bos taurus
ccacaggaggaagctggggaatgggctttcccagactcctactctagcgtgacagtagtggaacttgatgaaaggtcccaatctcccatggaacaagaagccatagagggggactctggttggaaaagtacttttgaaccttgtttgctgatcaaatcacaaagtaataatatggatttgaggagatcacagtctcaaaaa

SEQ ID NO: 21730 - DNA, 201 bp, Bos taurus
ctgtgtggtatgtttctattccattctattctttattcttacgatttcctttaggtgaaataggctggctgtgatccattaatcacaccctttaatagctcgtgtcccatagtttggcctgtatttttaaagcatgacttgtagctcgagtacttttcagcagaggacgataggttgtctgagtaagagcccatctcctgt

SEQ ID NO: 21731 - DNA, 201 bp, Bos taurus
tcctcattatttgcagattctgtattttcaagtttacttataacctaaaatgtgtttgtaacccccaaatcaattctcacagcattcatagacatgcctacagcagtcaaaattttgatttgctgattcacatgttccctgatgagcttgtacaaaacaacactctgtctaatgccccagctcatactgtaaacaaatgtc

SEQ ID NO: 21732 - DNA, 201 bp, Bos taurus
gccagaaattttgcctaaaactggattaagcaagaaaagaaatggctcagaggaggatatgcagattccattgcttatgtgacaaggcctcagtgtctgcctgtcagctctacctccaccccccccaaccacacccccaactccatccgcaggtgtttctctcactcaagcagcgagcaacgtgcagcatagtatgtgaga

SEQ ID NO: 21733 - DNA, 201 bp, Bos taurus
caacagtgtgtgaaacttcatccccagcaaagcatgcagtggggagtgttgatgggagtgggggtcccttcagagttagacgagagaattgctgggtgtcggggcctccacaggaagtggttcagctaaaacagcagcagtggctaatgtgatcagccctcactggtcagaatgcatcgtaagactgagcatagtttagag

SEQ ID NO: 21734 - DNA, 201 bp, Bos taurus
aagggagatggaggaagaaaggcaacaaaagggaaaggagtgaggacagccactgagccagaggtgggggcagcatagttgcttgacttctaggaaaagcattcttagcctttcctctcttcccttccctactttcatcacctggaaagctccatcaggccagtctacagggttctggggctgaaccgccaacctcctcac

SEQ ID NO: 21735 - DNA, 201 bp, Bos taurus
ctggagtggggtgctgtgccctcctccaagggatcttcctgaccctgggatcaaacctgggtctcccacattgcaggcaaactctttgctatctgggccatgagtcagctggatcacagattctctgagtgagaatattcctctaaggtcagcatttctgagcccatgggccttgcagggacacaggagcagacacacggg

SEQ ID NO: 21736 - DNA, 201 bp, Bos taurus
tgaacaagtgctgagaaattggaggcatcaatttgactttaaatatctattctattttcctcaagtatctgctccatatttctagcagatatcaaggcttggcaattgccttgaggattttggcctgaaagagaggcagcctttggcagcctatcttgtacataagcctcagctgcagaggagataatgcacgcaagacat

SEQ ID NO: 21737 - DNA, 201 bp, Bos taurus
cacccatatatcatttaaatgtgtttgagtctcacattaatccagggaagcaaacattacttgttatttctagttaacaaaggacaaaacaggttcagaacgattaagcactatatatatattcactcactggatttaacctacattgccttctcacatcaacaatggctagttctctcaagtagtcagtctgtttaaaac

SEQ ID NO: 21738 - DNA, 201 bp, Bos taurus
ctgggcacacaagaaaagattacctttgatattcccaaactacagtcaagagatacttgattgtaggctgtcattgcaataggccacggcccctgtggtttcagcaggtcaaactgggagccagtcttccaccttgcctcacttccatcatacagaaacatgaggcagcaacccagcaacccgctcagcagtgtctacaag

SEQ ID NO: 21739 - DNA, 201 bp, Bos taurus
gccaagcaaactcaggcggctctggcctgctcctctgccggcctcagcttgcaggcttgtttccaggagctttgcatgtacttgtctctctgcatcctcacgccacctaatgaggcgggccctgcctttcagatggaataacctgactcaagttacatggccaataagcatggggattctccccagaccctcgaggctcac

SEQ ID NO: 21740 - DNA, 201 bp, Bos taurus
gcgctggtgcccctctgtcctgctgaggatggggctccgaagagccaggaccgggctagccagagggctgtgtccaggacctccctccgtggccatcacctgactctgatcttgttgggtccctttatagtgagtggaagcttctacacctgcagccacacctggacccgctctgtccagcaccgtggccgacaccattca

SEQ ID NO: 21741 - DNA, 201 bp, Bos taurus
tcaccacatagtccttcaggtccatcgtctccccccgcatcctcatctgtgtgcatccatcccagctgtgctgtctctcctcatgtgcatgaaggcctcctgccaccgcgtgccctcgttggacttcctgcgagagagggaccgaccaggctgcggggctaggcaccctggcctcctccacccccgcgacgtccaccacag

SEQ ID NO: 21742 - DNA, 201 bp, Bos taurus
agttgagtcttagtgcttagaattgccacatttggtgatgacactttacttgccctaggaaataagcaaacaacttgctccaaggccataggatacctcaagattcattcagtaagactctctttaactacaatgaggtatctcctcacactgtttagaatggccatcatcaaaaaaagtctacaaacagtaaatactgta

SEQ ID NO: 21743 - DNA, 201 bp, Bos taurus
ccatgagcagaggagcctggcgggctacagttcacagggtcatgaaatagttggacacgacttagagactaaacaacaacaactagactataatccccatgagggtagcagtcttgttcagtgttgttatttgccaccatctagaataggtcctggcacataagtggtgttcaataagcaatggttaactgaatacataaa

SEQ ID NO: 21744 - DNA, 201 bp, Bos taurus
cgtctcctgcattgcagatgaattctttaccactgagccattggggaagtctaaagggatacccccaggcattaaaagcaggagaagattcatgacccattgcttgcaggaccagttaagaagagatgtctgacccttgaaccattgaaggagacttactgttatggtaggattctggttatataactctctgatttagaa

SEQ ID NO: 21745 - DNA, 201 bp, Bos taurus
gaggaagaggtggggaaggattccttaggtttcctggccctgtagcccccaccactgtgtgctgctctgatctccccctcctagtggccaaagtggtggggggtcatgcctagagactggagttatgtcctctcatctccctctgcaccagccaggatctgaggtctgacccccagtggtccttgctccctggaggccacc

SEQ ID NO: 21746 - DNA, 201 bp, Bos taurus
tgacttgtccaacttggaggccaaaaaaccccacgtagtgttctcctgcttctcttggaatgctcactctttcttgggacccagtggtgagctctgagacgcccaggacagaggccacacactggacccttggtggacagtcccaaacaagcccacctcgattaccacctgcagctttctgagtcctcctagctgagtgtc

SEQ ID NO: 21747 - DNA, 201 bp, Bos taurus
gtgtgttggttgggtttccgttggttattctgtgtatacacactagccaacaccctgaaacttaaggtccaagatgtaggctctcttgggctccagtgggaaacattaccatgaaattacttccattccacaaaaatccactcacatcatgactgaaaaagctgatgaagacacgagttttacctttcctgttctcattct

SEQ ID NO: 21748 - DNA, 201 bp, Bos taurus
tgtctgaatatgtcacctcagggtgagtgttcttgaatgccagcactggatctcattcagcactctgtcacctccacagggcctggcaggctagtcactgattgcttgctgactgaacagatgactgtcttctctctcctccttttctaggtctggaatgaggcttcaaggaccaaggaactgtggaggtgagtgaaggaa

SEQ ID NO: 21749 - DNA, 201 bp, Bos taurus
ctggtaatgtggttccagtgtgggtctgaaggccagaggatcagaggaactgatatgtaactctcagtctgagtccataggcctgagaaccaggagaaaaacaaggtcccagctcaaccaaggtcaggagcttattctcccttcatttgcctttttctattcaggccctcagtgggttggatgatcccacccacattggag

SEQ ID NO: 21750 - DNA, 201 bp, Bos taurus
gcagagacttttggcccagaaaacccaccacaccagcacaaagggtccactttgaagctgcagcctggtttgtgctgttgaggcccaatgtgcagagttagacctatcccaggggaggtagctactgcttctgaagtgctgatgctcagtgaagaccacatggaggccaggcaagtaggagattacagatcccagcccaga

SEQ ID NO: 21751 - DNA, 201 bp, Bos taurus
tggagctctgatttggacattccattccttttcttcttggggagaaaagtgtgaccaatgatgatggtgggccttcaaagatatgtgccgaggaatattctgtaaatgaagatggcaaggataactccttttaattttcttgtattctgcagtccttgcctaatttatcctcatagcatcccggagaaatagaaaagagat

SEQ ID NO: 21752 - DNA, 201 bp, Bos taurus
ggttcaggccttgaagtggtggtgaacctctgccccatcccctgcaacctaatggcggcagcagtcatcctggctcacagtgcttgagacccatcctcgtttggggagtctgaggggcctaaggtctggctgggtcctgggcacctggcttcctcagtgatgacagctgggcagagtctggggacctggccctgggagcac

SEQ ID NO: 21753 - DNA, 201 bp, Bos taurus
atatcctgtaatcctttcaaatgaggacacagaggtcatggcaagcagcctgtcaaactccacataaacatacattaaactttagatctgtccaacacgaagactttgctctttgtttcacagtacattgtcccttactgggaggttttccttcaattcattttacagaatctagtatgagaatgtttgtatggtcttatc

SEQ ID NO: 21754 - DNA, 201 bp, Bos taurus
caggtcttttatgtctcctgtattggcaggctagttcttggccactagcaccagcatgacactttccaaaacttaagtgaatatttctgtatactaggctgctatttaggaacatgccatagtggccacagaacctactgctcctcatctgatggtgaccccagagatattcttatattctgagtctgtttttccagaagg

SEQ ID NO: 21755 - DNA, 201 bp, Bos taurus
acaagcatttaactaggttatccgcttgtgaaatgtgttcagaggatggcttattgctacagggcagaattgttcaaagaaggaagctatgggtcttctaaaagtcttaacaaaattatgtcatttgaaatatttccttctggattaggtacactgacctagaaccagtctatttgttcttttttgattatccccagcttt

SEQ ID NO: 21756 - DNA, 201 bp, Bos taurus
ttttctggaaatagttcttaaaacatggatattgggaaatatgaattatcttgaatctaacacctagtaaatacatttaatgaggtagcttagttatggtctctgaatctagaccccaccttaaggctttctgcttcacctgtatttctgaaagttctgcttatccctcagccctcggttaaactacttctatctggtatt

SEQ ID NO: 21757 - DNA, 201 bp, Bos taurus
aatttccccccaaactttaagtagaaaaacaagtaaatttaataaagctatcttttaaccaagaaacaaagttgtgctaatttcagaattttctctgcaatagcaaactcagaaagaccatggagccctattggcagcattttgaggaaaaactgtacacatgacacactttataccaaacataaatgcctatgatatatg

SEQ ID NO: 21758 - DNA, 201 bp, Bos taurus
gcaaaagcaatacagttccacttatgcttccctacactgtcttcagaactacagtcaggtccaagtgtgtcctaagaaggaaaataaaatagcaaaacaacataaagcagtcctctgggtgcatctgaggtatgagatttctctaataatgttggagaaatataatttcagttgccctcattagggttcaaagttctatgg

SEQ ID NO: 21759 - DNA, 201 bp, Bos taurus
taacaaaccagttaaacattctttgcttcatttatatgtagtattaaatgaggatattcttatccatgttgtctatgtaactattatattatggtattgaatagacagtgcctttagaacaaaataagaaatagagccagccatagagtattctggtaatgaaataaaactaattctgccttttttctttcaagaaatgtc

SEQ ID NO: 21760 - DNA, 201 bp, Bos taurus
gattttaacggcagttttgaaatgaaattcatgactttattcatgtatgcaaaatttcccatactggatatgagcagataccttgtgggaaaaaatgccagtgtctgaagatcctgtgaattaaatggaagagcaatcctaatggtaattatcaatcttaaggaacacagagaaatatcttagaatataaaatgtcaactg

SEQ ID NO: 21761 - DNA, 201 bp, Bos taurus
catcctctgtcgtccccttttcctcctgccttcaatctttcccagcatcagggtcttttcaaatgagtcagctctttgcatcaggtggccaaagtataatccatattaattaatggtatataagggcatgtgagtttgatccctggtttgggaagatctcctaaagagggaaatggaaacccactacagtattcttgcctg

SEQ ID NO: 21762 - DNA, 201 bp, Bos taurus
gcaagggaaaagaacttgaatattgcagcaaaactaggccatctattcacttcaacaggaatcgatcgcttataatttatctgcagagctccctgagaaaggagagggaaagccacagtatcattatcatcatcgtacaattacttatgtgttaaatgggtaataaagcatgatgatatgcattgtaaagtagaatggtag

SEQ ID NO: 21763 - DNA, 201 bp, Bos taurus
ttttttatctggcaaacagttccaggaaaaaggcttatgacctctaagcttttaccttttgtctttatcgagagtgtaggttatatgaaatacttgtactggcctattagcttaatgatgagtgataaataaaagggagaaatgaagtgataactaaggaaaaaatccaagtctttaaattttgtgtgtgcatgtgtgtga

SEQ ID NO: 21764 - DNA, 201 bp, Bos taurus
ccatgtacatacaccttagggatacctctttctgttaacttggctctcccaacaataggcagctgctgcctcatacccaagataagatatgggatgattggattatttctctaagctctcttattgtgctcttagatttcatcaggtcttgcattagtttactgctgctatataacaagctaccttaacttagaggtatat

SEQ ID NO: 21765 - DNA, 201 bp, Bos taurus
agggactagattttcaggtagccatcctctccttgtgtccttacatggcaaacagtgagagaagcaagctctctcttcttagaagggcactaatcccatcatgagtactatctcccaaaaggccccatctccagaaaatgtcacactggggattaggcttcaacatataaatttgatgggtgggggagagacataaacatg

SEQ ID NO: 21766 - DNA, 201 bp, Bos taurus
gtaggaagaaagaacctcaccatcccaccataacaaatctgatagaagcacttgaaaatgtcactaagggcagtatttttaaggggagttcatctctcccgttacagaaaggaaagatcattccccagattatgaagtataatgaaacagagtccaaatgctaatttctacctcttacctccctaagtgtaaggataagat

SEQ ID NO: 21767 - DNA, 201 bp, Bos taurus
taaaatacatagtttatcaaatatttattgtatacttataccaggcactaaagatgcaagaatgagcaacatgccacagaatgtgttcatggagctcacagatgggcaggaaaaaaagatagactagaaatgaccatattactttggagtctggtggtgtgattgtactcatggaattaataaggatgattgacaaggatt

SEQ ID NO: 21768 - DNA, 201 bp, Bos taurus
ccttttaatcacaaatacattaagttgttaattcatcacacattatggtgtacatattctgtgcccaggattgtgtttggcactagagtaactcagtctagtagggaaaggtggtaagtgaactaactatattataagaatgatgaaagaagtaaactcccaggctaggtagagttactatagaaacacagaaaagactca

SEQ ID NO: 21769 - DNA, 201 bp, Bos taurus
gaggaatactgatccacttgtagcaccatgaaactggccccacagagaaagaatctcatatcaggaggtgggaaggaggcactgcaaatagaattcctggagctttcaatcaggccagagagaggacattgtggggagccagggagagccaggcagacaggtgtgtcatcagccaagtgagcaagcagtcagcagtaaaag

SEQ ID NO: 21770 - DNA, 201 bp, Bos taurus
gtgtggtgatgaagcatcagagtaggtggttcttgacagtgagcaaatggctatttcttttatttttacagcatgaatgcgtttggcaatctctttcttcacaaatagtccaaatcaacacttcatagcaaatcgtattaaacataccacatgttctatgggaagtaaaatacaaagagaaagctctcagagatgttggtt

SEQ ID NO: 21771 - DNA, 201 bp, Bos taurus
tgggcctttgagtgtttcactgacctccagttcacatagcatttgaataggtttgaatgctagaagtttgatatgacttggaggctggtataaaaatatcgttttagaataaaacaagaagttcataagttattgacaggtcaaactcctaagaatatgattgtattagatttaaaaagcaaaacaaaactaagtcaaagt

SEQ ID NO: 21772 - DNA, 201 bp, Bos taurus
ttacatacttatttattcaacaaatacttatgtttcatgcctgcaatgtataatgaaggcagatgttgttcctgttgtccctgcatgtaaaggccatcatattctaaatcagtgcttttcaaatttgaatgcacatatgaaccacccgaggatcttaaagtgtggattaaatatagattctgaatcactgggtctgcagta

SEQ ID NO: 21773 - DNA, 201 bp, Bos taurus
acaaaatgtataaatgatatgtagagtttctcctttaacatatgaactcgggggaagatgctgaattaaagggaagatgccttggtgcaaaataaagtgagttaggctgccagcagaagtgctaacagggagacattttataatttatcacgttttaagtggttgtctctgtctcaccaataaacagcagagttattcatt

SEQ ID NO: 21774 - DNA, 201 bp, Bos taurus
tgtgagcagtgtgaagcccaccccaatgcccacaacagtcctctggggaaaggacgcttgcccaaattcagtttcctcctggctgagaactccactactgcgttgtgtgcacctgcctctgtttctccttagagaaccttgcttctaggaggcactcaatatttgagttaatacaaggctggagtaaatattgagcaacct

SEQ ID NO: 21775 - DNA, 201 bp, Bos taurus
tcaagtaagaagggaaaaaaagcagtaaatctggtggctctcaaagctgagacatttcttcttcaccctccacacaactctgctgaaaactgttctggtcaagtaactttgatccttttagaaaatctgttgtccgtgtggacaaaagcaattcttcatttgaataggacatcaattctttctcctgctttttccctgtgg

SEQ ID NO: 21776 - DNA, 201 bp, Bos taurus
ctctatcattatgtggggctcatgggaggaatattagtgacaggcctcctccttgatgagaaagtcaggggcccctcagcctagagttacagcctttttatgagcagaggctgtccagggttggcacaggagttcagaaaaagctagaggacccattgatctctgatgcctataaaactgtagcagccatacttgcatgga

SEQ ID NO: 21777 - DNA, 201 bp, Bos taurus
gagggatgaggcagcagagcggggctagagaggtattcatcagtgccttgaaagtcaggacaaggcgttgttcctaaagacacgaaaggggtatggccacattcaactgggaagaaacataatcagggtggtgctgtagataagttagttgctgctgcccagaagactgatgagaggaggccaagggaaagaaggaagaga

SEQ ID NO: 21778 - DNA, 201 bp, Bos taurus
tatgtcttcatgttttcagttgaatcaccatattctctttctaggatctagtgatatcaaattttagttatcttctttcactcatccttattacacgaaagacaatgaagcattataaaagcatcatttagttatgcaagtgtgcctgctagtaacaacactttctcatgaaaggccaaaactctagaaggaaggaatccc

SEQ ID NO: 21779 - DNA, 201 bp, Bos taurus
tattcacacagagcctatgatttggagataactccaaatttctcatttctaggatccaaagtaccccctgcagagggcacagcctggctgcagagggcaataggaagaaacaggaaggccatctactctcctccatgagcaaagtcagaattcctgagagtacgaagaggcttctgagagaaggtgaggtgtacgtgtggt

SEQ ID NO: 21780 - DNA, 201 bp, Bos taurus
tcatctgtaaaacagagtagtaatcctctctctagattcaggcaagaagaaagaatgttttaagttcttatgtgctgatgttattttatattttactgacatttatttctgggaactaaccaattttaatccatgactcacgtttaccttacagtccactgagattcccaggtggttctggctacacctgggtctgctgag

SEQ ID NO: 21781 - DNA, 201 bp, Bos taurus
cgcttctggctgtggcagtagaaaccatgtcccgagggaagtggcccagggactcaagagtagtgggatgccatccgccaggagtgactcaggcctctgcattttgtcacactcctgacttcctctggcacccgggaccctcagggtcccctcaccctttgtctccagtagaagccgtttatctttgaagcctctagtcaa

SEQ ID NO: 21782 - DNA, 201 bp, Bos taurus
tagccttctctcattttcttgaatgcccttgatgtcttttcctccttggagctttgctgtgcaccattctgtcttctaaaatactcatctacttacccttatctcctcatctactcatcccatctccatggcatccccaccctttgcagtgcccgcttctttcctagctgacttgcagtcagcttcagttttcagcttcag

SEQ ID NO: 21783 - DNA, 201 bp, Bos taurus
agaagcagacctggaatttaacttacgatcatttgattccaaagacggcaagtcagccacagacatttttttggagtggtgggtcaatgctgtttgttttttttttagggtgcagcatatatatatatatatatatatatatattttttttttaatacaaataaagtgacaattttattatttggaataaagttatgtgat

SEQ ID NO: 21784 - DNA, 201 bp, Bos taurus
taaaatggactcaaatgtcagggagatggtgttgccatgcaaaaacaccaggataacaatgatcatcaaatcaatcctcagttattcacattaaagaggagccacgtctaaacttgccttaaattttgttgacatgatttacctttgctctggatgataccattattgaattcatttttattctgaaaatacctaacagct

SEQ ID NO: 21785 - DNA, 201 bp, Bos taurus
tccactgtgattctggttctgagattcaaacagatgcagcatatataacatatatttagggtagcacttaacttacagggactacaactcccagaacacaatgctggacatctcctgccccctccccacatctacactcaaaacatcctaagtattttccaggaatctcagtctctaactggatacagatgtatacatgtg

SEQ ID NO: 21786 - DNA, 201 bp, Bos taurus
atctatacatggacacttttgcaagaacagacagtatactacaatgatgctttgaaaatataggatttaggctccaatttggcttaagggtgcagtgatttattaaattttgttctccttaaatcattttagagaatactgcttggcagtaaaggagctcttctgtgcaaaagaatggctggtggtggaagaaaagaccca

SEQ ID NO: 21787 - DNA, 201 bp, Bos taurus
acttacatttggcctaaaagtctaccattctttctacatggcaattggctaatgtgttcaaacgcaggaatacagatagcccatcgtgctcacgcaacccgcacaaaagaaacccaagcaccacaaccgcactgttatatgtgtactctgacagagctcaagactctacagattaaagaactggccagaagtatttaaata

SEQ ID NO: 21788 - DNA, 201 bp, Bos taurus
aactgagccaatatttgcctaatttctccccatagatctagagaaaggacattttataatatatccctatcattccacagagttgtataaattcccctggttttattatttttttgaacttgagaaaatgattcttaagttcaagatgactgatacatatatgctttcaaaacaggaagaaagagaaaggagaggtgacag

SEQ ID NO: 21789 - DNA, 201 bp, Bos taurus
caatggcctgcctatcagccacccaggagctcaagccaagttcgcccttgacctctcacctaagtcctaaatctcctcttctccatccccacagtcaccactcagtctaggccacatatcttatttgtgctttgccacagtgctgtcaaaatgcttctataaactgaaattccaaataaaaatcttaactttgtactgtat

SEQ ID NO: 21790 - DNA, 201 bp, Bos taurus
attttcagagcagtgagaggagagctaaggcaaggggatgaggactgagatgaggcaagtgatattcacgtaaggaagtcaatggtgacctctgagcgaacagtttcaataagtggtagaagcagaaaaagcggtccaagagtgaatggtaagaatctggaagcaaaaggaatacatgccgctgctattaaagctccagtg

SEQ ID NO: 21791 - DNA, 201 bp, Bos taurus
gatcactgaaaaggaagttggagaaacataaccttcagtgttgaggtccagggcccttggcactggaggctgatgagtggatgaccggccttagtccctcttctgcagcccggcgcctcctgaaagcataagctctgggctcgtagctcaggtcggaaggtagcagtctcgtccactcctttaaagaaggaccccatcctc

SEQ ID NO: 21792 - DNA, 201 bp, Bos taurus
tagccttattgcaggggagatggcaatggcctttagaggcaatgaccgcatcccaagcatcctttgacaagactggagagccccattctagacacatgaggggcctggagggcaaatccaggaggagaagggctctagttaaggccctcagcagggcaagttccactgcaccccgacctgagtgacatctacccggtgggc

SEQ ID NO: 21793 - DNA, 201 bp, Bos taurus
cgcctctctctgagtgctagctggtccaccaaggtgggggcgctgggcggggaggactgcagagcgtgtgctttggtgcctgcgatgtgatgcagcatgtggatggccttggatgggcccccgcgctgcgccgggcactgcgtctgcaccgcgtgctgaccgcctggagcccgtctacctggtggaggcccactgtccacg

SEQ ID NO: 21794 - DNA, 201 bp, Bos taurus
ccctggggaggggtagataacttagaagtctctgtgctcggtctcatctgcttcctactgatgttccaggcacactcgggcttcttgtcacattctcctcgccctttcacagcttcatatccttcctgtccctggaggcccctgccagcctggatccatcctctgggaaagcctatccagacctctcaggtccagcatctt

SEQ ID NO: 21795 - DNA, 201 bp, Bos taurus
atcattttggcaacacctgaggcagatcacatttttcttcctgcttacaggaaagtgaattttattgtgcacagccagtaaagcatggagctgcttacatgggtgttcttaaaggttctagaaattctcaccccttgtccttcccaacatccataaattccttcttggactgtgtcaggaagagagaggagccaagaaaca

SEQ ID NO: 21796 - DNA, 201 bp, Bos taurus
gatgtggcttttctggaggtagaaagagagatttcaccatcagtgtctttccgattgctcttctcccagcatatagaagctggtggcccagactcctggggtattttattttttttggctgccaacaacagctcagcaagtgccagttgtgaggatggacctggtggaatgcatggggcttggagtcttcggaggccaggg

SEQ ID NO: 21797 - DNA, 201 bp, Bos taurus
agctgctactttcagaaacagagcattatgatgctgtatcattcttcccgtaactatgtcctcacggacaaaagctttaacatgcacggtggcacatgcccgaagttagactacttgtgaacagctcagtagctttaaagattcagaataaactatgtatgcttttgctaaaactgaggtgcttcctaggtagtcgccctg

SEQ ID NO: 21798 - DNA, 201 bp, Bos taurus
cccgcgcctctgtacctctggagttcagcaggctgagcaagtttgcccaccgtccggaactccagccaaaccagactgcaggacaactgtgagccgagagccagcacgtggcccttctcactgaacgctcggcctggtcctcattaactgccgtctcaagctactttggactccacggaaaccacgtgtgtttccactgct

SEQ ID NO: 21799 - DNA, 201 bp, Bos taurus
caggaatctgtttccagccacatttcacccaaatgtgagtttctttcccaggagtctgtgtgctctgcatggttgagaaggcgccgggctattctctctgctcccttgataaaggcactttcaccatcaaatggctccactgaatcagcccaacattttccctccctgctccctccccgctaactacattttggcacttct

SEQ ID NO: 21800 - DNA, 201 bp, Bos taurus
ctcatatctggttcttaggattcaaagggacacgatccaggcaaggtaacatttctacacatgctggataacaaaggaaatgtaatgccaagctcctgaggtttggctccaaggcccttctgaatctcctctgtttacttagcatcgccccacccaggcataattaagccaaacaaacctgaatgttagcagttgtcttat

SEQ ID NO: 21801 - DNA, 201 bp, Bos taurus
caaagcacttcaaaccatgatagtatttatctggaatttcctaccagtttgttctttcagatgccctctcacacactctctcttgctttctttgcttatcaatttatttatttgtaatttttcatctttgtttcctttcctaatattttttttcctactcccttcaatatgtccttcaaaactcagctcagctaagttcca

SEQ ID NO: 21802 - DNA, 201 bp, Bos taurus
ttataactttttccccttcccttttcagtagctggtaggggtgggaggacttgacgaggtccaagacaaactgtgaatggccttaatttccagtggtccttgcagagtgctgacagacatctgacatgcgagctagattggagacgctgctcgctggggccaggagccaaccctcttttcagaggaaatctccatagatgg

SEQ ID NO: 21803 - DNA, 201 bp, Bos taurus
gagtggctgtgtgactctgagcctccatttctgcttaaaccaggggagcccgcttctagcagtctccgtttctgacgggattttgcctctgattgcattcgaagagaggctgtccctcctgaaatccagaagacccactacctgtgggtcttcccagtttcccgtttggactgaacgatctccggggccatctccatgtaa

SEQ ID NO: 21804 - DNA, 201 bp, Bos taurus
tcaccatttcttagaaaaaataactgcattttatgcttacagtagtggggcctgggagactctgagtctcatcctctcatgctttacctctagaggcattgcttccccacctacactttggcctgagtaactggaatagatcctgattttcaagctgtgttcactgaaatgcttaagagggggaagagtaaagataaggaa

SEQ ID NO: 21805 - DNA, 201 bp, Bos taurus
cagggttcttccccaagggactatcagcttagtcgagggagggagagcattggggccaccagagcttctgtcattctagggatggccctgctgtccccagagtcccctttccaattatcctgctccatgtgcacctgccttcttccaagactcccgtttcccagagacacgcccgtgcttcctaccgccccgccccacggc

SEQ ID NO: 21806 - DNA, 201 bp, Bos taurus
ggcaggctgtgtgtgtcaataacatacgacccgtcagagaaaagcctgcctctccgtgtttcacttttacttgtgacatttcccatcaggccagcttccccgtggcagtcagtatgtctcctagagctagcatgggctgcggagaagtgctcatctctcagctgctttggcaaagcttcactaaatactggggcctgagaa

SEQ ID NO: 21807 - DNA, 201 bp, Bos taurus
ccagccgcataagagctgactctcgagactgatgagttaagcctttctcatccccaccatattcccagtccttgtccttggccattggttccgggtggggcgcgatgactgcgcttctccagcagagggcagtgttgccatgccagccaagactcagggctccgggaaaccggaaggaggcccggactaagccgacgcggt

SEQ ID NO: 21808 - DNA, 201 bp, Bos taurus
tgtttataatgagagttgataaaattgtacctgtggtttgaattttcagtttagatacattctcctccattctttttcttcctcactccacctagtctgacttctctctccagtgaaaatattgaatattaaaatctctctccccgcttgtacctaaaatatctgtttctcaaaaaggattctcacggtgtttattggccc

SEQ ID NO: 21809 - DNA, 201 bp, Bos taurus
gaagaagaggaggagcgggggagggaagaagaggagaaggggagtgccgaagtcccgtttgtgaccttgcttagctttttcaatccaaaatggcggttggatgtgagaggagtcatctggctgaggggtaaggggatgaatagaaccagagcaaacttctaatgaagagacaggctgacacaaagggcagaacattggctt

SEQ ID NO: 21810 - DNA, 201 bp, Bos taurus
aaattaaataatcatagctatatccatctggaaaacgtacgcagaagagatgcataagccagcaattagtattagcttccagcctttcattgactaactccgagggccttgtggtggctgtcgcactcgggaccatgaatatcccagctcctggctctgtgcttccagggtaatgattcttcaagcggttgcatagggagg

SEQ ID NO: 21811 - DNA, 201 bp, Bos taurus
ccctccatctatagcattttccaggcaagagtactggagtagggtgccactgccttctctgggtatggatatgtagtcctggacatattagtcttttttaaattctcagatctgtcagggcctttctagtaccaaggcttttcttactccttcactgtttcctcctgctacttaccctccatcatgtccctgcatggctct

SEQ ID NO: 21812 - DNA, 201 bp, Bos taurus
ttcatggggtcgcaaagagtcggacacgactgagtgactgatctgatctgatctgatgaacctgatggaaacggtgacctaattcttttgtgtgcaagtgagcttgtatataggggtacaagtagacagttctagattaatgggttagaaactaacccatttggctatgaggggtcaccacataaatgccatatatcatac

SEQ ID NO: 21813 - DNA, 201 bp, Bos taurus
ttgaggttaagtttaaatgaagattaccagagtactgatgacataacagtagatataggccttgttaactttggaaattgcccattgatggtgaaacaaataaacaaaaaaaacccaaaataaacagaaaccctctacactgacacatttttttagtttctgctgaaagtggctccatttgaatgcatgctcagagggaca

SEQ ID NO: 21814 - DNA, 201 bp, Bos taurus
gaagctccattgctctttcctggaacaaagatgatggaatggcacactacctctggggctccctaaggccctctatctaactctctgcagtgaccatggcaggagggacctgtgcagcccctaaatgagaccctcccagccaagcagtgctgacactacttcgttatgaagatgcatgggttggctgctagctaatgaatg

SEQ ID NO: 21815 - DNA, 201 bp, Bos taurus
tttgtggcccttaataaccctccagctgtggaaggttttccgttccaaagttttcaacgtgcattttaagatgtgtactgtgagagtgtaactttggagcggcatgtcctgaaccccaacctaaagaaacagcacttcttttctttctaacattcttctctgccgtgatgtcttccttgcctcttctcttccagaacatgc

SEQ ID NO: 21816 - DNA, 201 bp, Bos taurus
aggcaaatgaagtttaagctgcagaacccctaggggttgcattagcaatatgatcatgtttttcgttttttctttccttcagattttccaaaggaaaacattgcattttatcattgaccaagactgccgtcactttttgcatggactctcccctcaccgggcttcccaggtggggcaagttaaagtcactcagtcatgtca

SEQ ID NO: 21817 - DNA, 201 bp, Bos taurus
ttcacaaagggagcagcttattcaaagtcatggatctttgaaagggactgcattaatttcctagggttgctgtaaaacaacaaaaatcattgtgtcatagttcaggaagctagaaatccaaaattaaggttttgtcagagctctattctttccaaaaacttgagagagattcttccttcacctcttccagcttctgaaagt

SEQ ID NO: 21818 - DNA, 201 bp, Bos taurus
atcatacaacctcataaccaaaaccgcacaaaaggatatataataagaactctagtaagaaaagaataagtatataatagaccactgctattcatgagcacgtaaaagttctaaataaaattttagtaaacagccttcaacaatgaataaaaataccaatgcatcatggttaatatgagattgttctaggtatgattaatg

SEQ ID NO: 21819 - DNA, 201 bp, Bos taurus
gcctctccagcatggcttgtcaggataactggactttgcatatggcagcaaagggctcccagggagagttttccaagggacaagaggtaagtgccaccacgttcttaagacctgggcccagaaactagcaaaacaccatttccaccacacttcattgttcaaagcagtcacagggactatccaaactcaaatgaggcaaca

SEQ ID NO: 21820 - DNA, 201 bp, Bos taurus
cttccacagggtggaatgccaaatgtaggaacaagaaatagcagtgcaagaatttaaaaaatgagaaagaggaggggaaaattagatttacttgtgacagaaaaactgaagctgttaattcttcttctttttttttaattataaaccaggaagtagatgtagaccaaagtgttcaaagaaaaagcccaacaggtagggtgg

SEQ ID NO: 21821 - DNA, 201 bp, Bos taurus
ccacagaattctaaagaaccccttggttagggcaaacagaaatttcacaaaattattacaaaacatataggaagaaatgaccagcataacagttcctaggcttagaaactgcccttggcctggcaccaacagactgtgtggcatcaggaatggtcagctgaccctccagccccctgtgcaaccttcccacactgccccgaa

SEQ ID NO: 21822 - DNA, 201 bp, Bos taurus
catacatgctgagtactggctcgggtgcagagacacagcagcaaatgaaacgaagtccctgcttgcgtggaacctggcctttgcaaactcttaaacgtcacctcctcagtgaagccttttcaggtcaccccattaagaacaggtccagcttcttacaatttttacagcatgcaaggccaagaattcaataatgcttgacaa

SEQ ID NO: 21823 - DNA, 201 bp, Bos taurus
ggcatggaagggtagacagaaatttgtccatggcccccatccaagtctgagtcaagttaccactgaaatgaatgcctttggatcttagagaagaaagcacgaagcactggaaagaatgtaccattaggaatgcaatgtggccttgagtggcctatgaggtccagcacccataatgggaaatggacgagtgagtgagtgccc

SEQ ID NO: 21824 - DNA, 201 bp, Bos taurus
agctggcctcattcttcctccattccagacattatacaattattcctcatataccatttcctgagtgtcactgtatagacagtatatgctacatgttttactttttaatgctactctggttcagttcagttcagtcgctcagttgtgttcgactctttgtgactccatggactgcaacatgccaggcttccctgtccatca

SEQ ID NO: 21825 - DNA, 201 bp, Bos taurus
ggacagaaagcacacaggctttaccccattgtcaccgttcactggcagttgcatccagctccagggcccgggagcatcgctgtctcgcggaaggacttccgtatgcccaccttagtggttctgccctatttcagagctcacctcctttcccctgttctcctgcagtaaaccagtgcagcagagggaacttaagacagaaac

SEQ ID NO: 21826 - DNA, 201 bp, Bos taurus
atggaaaaatttgaacccaggacttgaaaatcttcctgtgacctagctcctattttcatccccagcctctgccctctcctgcaacccaatgggtatctcaggtcatacagagatacttccttgttcttttcttttccactatggcttattacagaacactgagttaatttctcaggtcatatagagatatctccttgttct

SEQ ID NO: 21827 - DNA, 201 bp, Bos taurus
gcagtttattcattctttaactatttatggagctctgcactgtgccaggcacattagtcaatgaatcagtccttagcatcatcatcaccttcatctgagccgctgacacatgctgcacccttcacactgactttcttttattatcagaatgatccatgacttgggtactgttaacacctgcattctcagaataggaaacag

SEQ ID NO: 21828 - DNA, 201 bp, Bos taurus
cccagcttctagagctgcactgcccacatgccctggctcagggctccgtcctgcatcttcaaagccagcaggtagcatcttgcttcagtggccacattgctgtttccctctggaagtaaatctccctctgcctccttctcatcagcacacttgtggttacattgaaggccccactagataatctaggacgataccaatacc

SEQ ID NO: 21829 - DNA, 201 bp, Bos taurus
agaatgaaaacaaaggatgcgctttgctgactgtgcccccttgattgtgtatttgtcaagtcaagattagtcacagcaattcaggaaatttatcctccaagctcctgcaattccaaacaccacggctgacatttcgggccgcgcggtcgggctgtccgtcttcccgtggaggacacgctttccttggcgcttacctttcgg

SEQ ID NO: 21830 - DNA, 201 bp, Bos taurus
agagaaagcccgggtgcccaacaaagacccagcacaacccaaagtaaaatttctgtaccttattctacccaattaagggagtccttacactgttagttttgaactaacagttgggctatatgaggtatttagcaatgtcagaaatgataacaaaaaataaccaattttcattactactcccccagactgatcaatcatgtc

SEQ ID NO: 21831 - DNA, 201 bp, Bos taurus
gtgaacagtcacaaaatgttgccaacagctaattaatcctggccaattaaaaatataaccaaaacacgtgcccaggaatcatgttttaccgtgaagaagtggggggaggggcttcttctatcacatctgcccggccacacacatcaagtgtgccacatacacatcttaggaatactgacatttgtgtacaatgaactgtta

SEQ ID NO: 21832 - DNA, 201 bp, Bos taurus
cagatcgccagagatgttgccaggtacggggaaggggcttacgtactgccccagggggctcaggagccaccaggaggctccagaggggccacttcgggacactgcttttgcttttgacaaccccatctgtccagggctgaactgcacagctgtctaattggggcgactggagaggcacgcgtgaatggcccttggatggat

SEQ ID NO: 21833 - DNA, 201 bp, Bos taurus
tccgcaaggcctgcgggatcgggggctcaggtggctcctccctgtccttcctcatctcgggcgtcgcgctcctctccccttctctgcctcaaccagcccctgagagctcggcctgcaggacagcctcaccccgcccccaggggacccttatggtggcaacacagggttccacagccctggaatccggagagctcctgcagg

SEQ ID NO: 21834 - DNA, 201 bp, Bos taurus
gccgacagagggagctttgatgcagagaaggctgccctctgtgtgatggcacggaagaggtgagtggaagttcagagggcgaggaaggcgatgaatgttctggggagaggctcacaggccttactacggatgggaaaacggtgcaagaaagcaactgtacagacatcggattggctgctgtccacagacgagagccggcac

SEQ ID NO: 21835 - DNA, 201 bp, Bos taurus
ctgtactgacagcaatttaacctttggtgaaggaagcattaccatatagtcacataagctcaatattaaaccaaactaacaggaagaattaaaagaaaaatacgtatatttcaacttactcttacatatggataaacagcaagagaaaaactacgatttatttcatgtatcttacacaattctgaatttttatcaattttt

SEQ ID NO: 21836 - DNA, 201 bp, Bos taurus
catcctaccagccaagtatcccttctctcaagacacgaattcttggaagagtcatttgggtcagactgtggtggagctagggcctctttagggggttgtggatgggacagacagtcctgctgggacctcatggggattgaggagagaggcagacactccaaagagacagggaagggactgctacaaaagatgcgagaggaa

SEQ ID NO: 21837 - DNA, 201 bp, Bos taurus
tgaaccaggacagcgtctgggaggccgatggggaaatgagtgtgaatggggagcgcggaggggcttaagcatccctgctctggcctcagccctgactctgaagtgtcccagagggttctggaagctctcaggaggggtacctagaagatgaggcgggtgattaggcagataccgagatggaggtgaggccggaagcacccc

SEQ ID NO: 21838 - DNA, 201 bp, Bos taurus
gggccccagcaaggcaggacaggcacgcggtgcccacagcccaggccacgattatgccagtaggtaacgcaggcaccaaatccatttcctagaaaccaaattgcatgcccaggactttgataatctgcaaagggaaaccccctccacacccacttaactcaagctctcgaattcacttggccactggtgtaactacttcaa

SEQ ID NO: 21839 - DNA, 201 bp, Bos taurus
gggcgctgcacagcaagaaaagtcacagcaatgagaagcccttgccccaacgctagggagcagccccactgggcacacttggggaaagcccgctcagccacgaaggccccgtggagccaaacacacaaatgacagtttttttaatgtttatattaaaagtctttttaaaaatcggacaccgtcgacattctcattaaatca

SEQ ID NO: 21840 - DNA, 201 bp, Bos taurus
ggcgtgcagtcacacctgtgcgttgtctggcccaggacacacctggccagcctcctatgctccagagtcattgtctttgctgggggtttgccaaggttgtttgagacccgccctgtggccagggcgctgaagtggctggaggaggggtggggcgtggggccagacttggggggctcgccttctcccctccagcagctcctt

SEQ ID NO: 21841 - DNA, 201 bp, Bos taurus
gcaggagcctcgtgtggggaaatcctgttggcctgggaaccaggcggccttactaccagccatgcagcttgagatggcctccttggccatccggggcctctgtttcctgctctgtgcaataaggggacgctagatagctggtaggattggggtgcaggttaaagcgaactgtgaaaacacacgctgtgtttccgagggccc

SEQ ID NO: 21842 - DNA, 201 bp, Bos taurus
tcccggccgagaggcctgcgccgctgagtgacctctattctccctgggacatacacacacagaatattgcatgtgtgacagaatgggccgcgtgactattgcgccccagcaccttcaaagtgccccctccacgggctcccggcagctatcctaaaagcccgtctctgtaccaacaagagctgtggcctggttcctgtaaac

SEQ ID NO: 21843 - DNA, 201 bp, Bos taurus
tgcagacaggacgtgggcctggcggtaagggtgtgtggacggggaggggtggggggttgggggctgcgcttctgtggcagggaaacagtagagtgggaacgcgtttccgaatcagaaaaggccactccgtcctgcacacctgtcctcttaaaatccgtcttagtccgcgtcctgatgttctgccatctgtctgcccgcctc

SEQ ID NO: 21844 - DNA, 201 bp, Bos taurus
agatcctatcacccttttattcacaatgctctggtccctttccatttcacacaaaggagaaaactaaagttctcctggcctatgagactgaacctagcttgccccctgtacctttctatttttacctgctcttctccccctttttgctaatctggccacatagacttgcccccatttttctgttctttcaccatcctgggc

SEQ ID NO: 21845 - DNA, 201 bp, Bos taurus
caccatatagcatgtggtactgtgtgtgtggctgcgattctctcagcttgggctccagtggaagattgggaaggcagtggacagtttgctgagtagcatttaaagtgcgttacaggcagtgagttcccatttaccaaacaaggcagcacagactgccacgggaaccgtggggtgggttttcctgactgacctgaaggcgaa

SEQ ID NO: 21846 - DNA, 201 bp, Bos taurus
tgatttcaatcagtaggaagagacacaagttactcacttgggacaattacaatttcccaaaccaggacattcatagactcttaagagtgtattaactgagataataatggattcagagtacagcaacctcgcaggacccagaaacccatgaatttacataatattcagattgccggttcatcttttctctgtgctccccaa

SEQ ID NO: 21847 - DNA, 201 bp, Bos taurus
ttccatagatagttttgcctctaaagaaccatgcatttggatggctcagtagttgtccttgaattgtcaggattcatccaccatttcttattcactgagagcatgcatttggatggaagaagccaactttaattcatgaacttgtctatttttagcctataatgttatcttgttttaaaaagtgctcaaaaatgtattttg

SEQ ID NO: 21848 - DNA, 201 bp, Bos taurus
ctggaccattctgaagaaggtatgtcttcttctttcaaatcagatgttaaggtcaaataacctgtaaaatacttccaacctggcataagttcagacatggaaacagaagtcggtattgaaaatgattgagttgctgaaactgcagaaaatattacaggagaggttacttctgagaaatcagacatagagtctatgtgtggt

SEQ ID NO: 21849 - DNA, 201 bp, Bos taurus
atagggggtggagacatcaccatagcctctctctgcccacatgcctgcatcagcagctgaataacagagagactggcccctcaaacgactgatgcactgaacagcagagtagtaacccacccaaggtgtccgtttaagtgactgatgtgccaaactacagagaaggcccacaagcaaggaagccctataagttcgtgaata

SEQ ID NO: 21850 - DNA, 201 bp, Bos taurus
ttcatggtcagtactttgcttaaagtctgcaatggccaccttttggccttgcacgtttgctgaaatataatcttccaaacagcattcctttgctgactcaacccactctgcttgtcaggactgtgcacagtcttaactgatggagagaggcatagtctgcatcctagggggcggggggagatggggatccttatttctctc

SEQ ID NO: 21851 - DNA, 201 bp, Bos taurus
ttccaacaatgatttggggtgagttacacatcaaagcttcagactctcacttaaatgttttgtttttttttttttgagtgtagatatatactcaccagctgtaaacagataccagatatacacagattttcaccttagggaactaagcattgtaaacaatgttttacagaataccttatcatttatttatgattatgatag

SEQ ID NO: 21852 - DNA, 201 bp, Bos taurus
cttctgtgtattcttgccacctcttcttattatcttctgcttctgttatttcaataccatttcaaaggaaccacaaatgcaagacagcgcacgagtggccgagaggagctatccacatccaaggtcaaggagacgacctagaagagctaccctgtcagggaacatttaattttaaggaatcctttatgttgctttctgttt

SEQ ID NO: 21853 - DNA, 201 bp, Bos taurus
tgggcatgacttagcaactgaactacaccagcaatcacacaatctgcagttgaattcaacccaaggtaatggtgccagtgatatggcagaatcaagaatatggaagaatctgatataggaaggctggctatatgctattcacagattttccactgtactgactgccatgttcaagggtcaactgcatttgaattttgcacc

SEQ ID NO: 21854 - DNA, 201 bp, Bos taurus
tctcctctctcacatcctctcggtccatctctccacggtcaacaccagccctcaccctggaatttctccacaatccctaaactccagctcccagctgctgcgcctgccagaggacctgtgttcctgtacagggtatccttgctgtatggttgcagcaaggactgtctgattctcattccatttaagttgccacagatcagc

SEQ ID NO: 21855 - DNA, 201 bp, Bos taurus
gttctctgtgatctattgtcttcctgctgtctactctggctttcttcctataaggaaattgagaattgtctccagctccctacagcttgaaagtcaaagtaatagccaattatgtgactttagccttatgggagcatatggattttgtggagaatttttttttaattaaaatctttgagctgttaactcataaaagaaaat

SEQ ID NO: 21856 - DNA, 201 bp, Bos taurus
ctccaggacgtttggccatgcagcacttcagcgggagttttcaatttgtaaaggttgaaaagtcatttttcctttccagctcataaaaggtgaagctttacggccagagggcattttgttcagatctcagatcccagtcttctttgcttcatgtgtgaatacattaccctggtttcacagttacttctaatttctatttat

SEQ ID NO: 21857 - DNA, 201 bp, Bos taurus
aatacatggtacacacagacacaaacgaataatgattacttatatatataaacggtggtaagtacaaccattatttacagaaaatttccaacaaatgaatatataagtaaggagaaaaatagatcaccataaaaaaaaaactaatgctgcaataattgctataggcaagatccactgatgaatgttaaaatcagtggatac

SEQ ID NO: 21858 - DNA, 201 bp, Bos taurus
gcaagaaaaggacagccttcaataaaatttcctatcagataatcaaatgaaaatccagatgaaaactcatctgttttccctgattttcttgcttccttcttgggatatcttccctgagtgtgcaggtgtgtccatcccctaggctcactatctcatttctgattttcatttttccactatcccccagagccctgggtgggg

SEQ ID NO: 21859 - DNA, 201 bp, Bos taurus
tttataggcctcaggctagaattattgttcagctatggattcgtttgtagttagagtttgctacgcagaaaagtatggtggatgtaagacagtggacgatgattaaggttgtagggcctatgtaccttcaaggtgtttggataagaatggctatgatacaagtgccatgtggctgacagaggagaatgcaatgagtgattt

SEQ ID NO: 21860 - DNA, 201 bp, Bos taurus
ttctgttttgctttgttatgccacctatcagtagctcagactcaaactgacatagaacaacaggaatcaacaagaaagtctctaaaaatcaagggcattctatttgcatttgtagtgaattctgatctcaggaattgctccaaaacttatatttttttttatctctatctcagtcccactcacctcttcccccctttaata

SEQ ID NO: 21861 - DNA, 201 bp, Bos taurus
tgtttccaactgagttttaccagtgggaggttttaacaagtgattcaaagctgaattataaaagtcctactgttctacttcaagtgacattgtttcctgtcatggcagatcagtactttccactgatggaagcctgtactataattagccagccattatggagctggcctttctaactgtctactgtgttttatttttttc

SEQ ID NO: 21862 - DNA, 201 bp, Bos taurus
ctaggaagaggacaggggttgactgctgtgaagatactctgaaggagctagtatgacacaacagagggggcccagggaaaaccctaggcatcccagagaggcaagagtttgttgcctcagggaacctctggccccatgcacttgtagaccacaggaatttgcatttatggttgctgtaagtgtgatgggtaaatggtaggg

SEQ ID NO: 21863 - DNA, 201 bp, Bos taurus
tggaaaatatggagtttgaaagtaaggacagggtgccagttccaaggaaacattcaaacacattgcatcatttgactcggactctggcacgtccctccagtgctagaagaagaatatttcttgagtagccattgttccacaaagactgggatacacagtgagcaaacctgatcctagtccaaagcctcaagccaaccatcc

SEQ ID NO: 21864 - DNA, 201 bp, Bos taurus
tgacaagtattactggcatgaaatatttatggattatgtcaaataatgatgcttatggtttttttttttttttttttcagtcgctttttaagtccctttaattcttggaagagaagttgctaaattttacttccagatagttataataaatgtgataaactatccacactttctaaatgttgccttgaaaaaaagaataaa

SEQ ID NO: 21865 - DNA, 201 bp, Bos taurus
gatgtgtagtacataaatatgaatttaaaaaatggaggtgagcaaaaattaaaaaaaaacaaactagaagttaacactatttattttcaaaatacatttggtacaacaacaataattaaacttccataaatgccaagatttttgtctctcttttttttaacttccaggtacaatgtctaacatgtaacagatgtttaatat

SEQ ID NO: 21866 - DNA, 201 bp, Bos taurus
agaatcatgctgtccccagtaaaagagaaaatgtacgttaagaagcttctgcccctaaggtttagagtctgttgaagacagaggctgaaccaagagagtcatgtacctccttgacccactataagctcaagctgaataataagccaacagcaatctgctgggatccagtgggaatagagtgagcatgtcacctctggtgca

SEQ ID NO: 21867 - DNA, 201 bp, Bos taurus
gtgtgaatttgtgagaatttgcaaacccattcatgccttgttttcctggtatacctaatgagataacactaacttacaatatcattggtagaattatacctactactatacactcctttggtttcagtgattctagtgatgatttttagattctgattctagcagggatagaaaatcaatattctctcatatgctaagcaa

SEQ ID NO: 21868 - DNA, 201 bp, Bos taurus
gtgctcatccagaaagtacaactcaggtgcagattttgaaagagtcacctgggagtttttagatgtttacactgcagccctggaagtacgtgcctgagaggaagcatagctggtgttgaactgtctcacaagtgacactgagctctgatttgaatgaggccactgtaggcatgtcaagcttgcatccatgaacccaccaca

SEQ ID NO: 21869 - DNA, 201 bp, Bos taurus
tgtcagccctgaaatgataggatcaacctctcttccttggatgaagaacttgatgctgatctactttcacttaatgaataacagatggccatgatattgtccatttgataaacttatgggttgtaggtgtgtgagagtctctgtattaaaaactaataactgtatggaaagaactgtctagacatttttctgctatcatca

SEQ ID NO: 21870 - DNA, 201 bp, Bos taurus
gagataattttagaaacatttcagtgcttaaagaaaaaaatccaagaagcctattagaacagtcacatattctcattgtgcatcaggcaataaagtatacgtttcattgtttatgaaaagcctctccagttgtgtcttgttggagagcacacatttatttacatattatttatgttgtctaaatgttcacagctgtcaccc

SEQ ID NO: 21871 - DNA, 201 bp, Bos taurus
gtactggagtggagtgccattgccttctccattgtatagctattgctattgtaaataatgctgcaataaacagagtggtgcgtgtctttttaaattagagttttcatgttctttggacaaatacctcaaagtgaaatacttaggttacatggtaactttattcttaaatttttgaggaataatcatactaattttcatact

SEQ ID NO: 21872 - DNA, 201 bp, Bos taurus
ggcattctaagtagggggacctcttgttactttgtaagtgatgctgcacagaggggaatgttctttgctcctgaaaagccctatttcacatgaatgagttttcactggccatgtttatataatttctacctccatctcaaaaagagtggaattgcttctatttcctgtattttgcatccttccttctcccaaacactctca

SEQ ID NO: 21873 - DNA, 201 bp, Bos taurus
acatgtgatctatcctggaggatgttccatatgcatgtgaaaagaatgtgcattatgctgtttttggatggaatggccaattaagtccaactgatctaatatgttattgaaaaacaatgtttctttattgatttctgtctggataatctggccatttatgtaagtgtgatgttaaacacccatactaatattgtgttaatg

SEQ ID NO: 21874 - DNA, 201 bp, Bos taurus
gaatgggtggcatatccagtgcaaacaatatgacattatggcacacgtaacctgaatagaaaatttctgagttatcactagtttagaggcaggcctggaggtcaacctggtagcacatatcttcatagtaccccagtctgcttctactgggggatcagcgttctttctgattggccaacacagtgtctgcatcttagatta

SEQ ID NO: 21875 - DNA, 201 bp, Bos taurus
ccctggcccctcggtcattgcccctctgcccggtggcagcaccacaaagacttgtttctgcggcaggtccaatgcccaaaatgacagtgccatccactgatattaggcctggtccttctgtgccctgttctttactatgtcgagagtacctgctgactcggaatttcagggcattctgctttcactgaggcattttattgt

SEQ ID NO: 21876 - DNA, 201 bp, Bos taurus
cttttgagaacaccagtcctgtagagtcaggcccctcttctgatttcatttaaccttaattacctcctaagacccagttttccaatacaatcatatattgagggttaaaggccaaatatatgagttggggaggaatacaattctgcctgtaacagtggtcaaatttaacatcagggataatagagaaattgacaacatttg

SEQ ID NO: 21877 - DNA, 201 bp, Bos taurus
tagtcaacttgcctttctacctgctcatcctgtagcaccatctcctcaaagcttcactctcagctggcactgaagggtagaccctctcactatgacccaggttttctcaaccttggccctagttacattttatcttcagtagtctgggagatgctgagggacagggaggcctggcattctacagtcctggggtcacaaaga

SEQ ID NO: 21878 - DNA, 201 bp, Bos taurus
acagaaataagtttgctgacccagctgccgaactcgagaacaacagtcacaagtaccctgtgactcctgggtgctggaatatagttagtttgagctggggtatgctgcaggtgtaaaatgcactctaacttgcacagaatgtgaaaaaaagtaatgtctcattaataacgtttttgactatctgaaataatatttcgaaca

SEQ ID NO: 21879 - DNA, 201 bp, Bos taurus
tcttgcctggagaagtccatgcacagaggaacctggagggccaagtccatgaggtcacagagagtcggacgtgactgagcatgcacaatttgtatgtttcatgagccaaagttattggccaactacacaaggcactgtaatagaacactttcagccattctttacagtttttgtttttgtttttttttaatctgtgaagtt

SEQ ID NO: 21880 - DNA, 201 bp, Bos taurus
tctgaacttgcccatgttagaatgcgactctcctgcgggccattcacttttccagagatcgccctcgtggtttcctaaaagtgaattgtagagacatctctactctaggaggccacttggaaatccccccaccagctgcaggaaacactatggtcacttaaaatctgcctctccctgctaagctcgcctattattctacta

SEQ ID NO: 21881 - DNA, 201 bp, Bos taurus
gacacccaagagccagggcagtggctgaggaggagccaccctgactggccctgggggctgatcacctcccccttaaatgacttatcagccagcaaggagaattagtgcagctgatgccaaggcctgggttccaaggtgaccttgttctgccaaggccacttgctcagacaggagcctccgctcttacattctcatggaaag

SEQ ID NO: 21882 - DNA, 201 bp, Bos taurus
gaataagctagatcgggttccctaatgcccagatgttgtaaaatccatctggtctgcagcacagagggaagggaggctgaacactgtaatcctggggcctatgaacaaaataagacctggagggtttgttgttgttgttcagttcccacttcgtgtctgttctttgtgacccgatgggctgcagcaggccaggcttccctg

SEQ ID NO: 21883 - DNA, 201 bp, Bos taurus
agattttaaatattctcaacacacacacacacaaatgataattatgtagtgtgatggaagtattcactgactttattcataatatagaagtggatgaagtcatcagtttgtacacatgaaacttatacaatagtacatgttagatgctgctgctaagtcgcttcagtcgtgtccgactctgtgcggtcaggtatgtcgcag

SEQ ID NO: 21884 - DNA, 201 bp, Bos taurus
ctcctctagccatgctttgtatcagcacggaaaacagaaaaatagcacatctctaggggatgtggctatagggcaaccactgattccaagaccccggggtttgtattgtttttctgacactaatcagagaactgcctttggcgtttacatgcaccctgtttctctgtggtcactatccccgacctgatggaggttgatcag

SEQ ID NO: 21885 - DNA, 201 bp, Bos taurus
gtgctcaggccatgctcctgctgtggatcctgggccgtgctatgagtagcaagaactggaggatttcacagttcctgaaggttttcctctagctttctgtcctgttaccaaggcccaccccctgaaaccatctttctccccatctaccttaccctcccagctcttctccttgtcagttccctcttaatctgtgaattatca

SEQ ID NO: 21886 - DNA, 201 bp, Bos taurus
acgctggctcgcagaaaccagggggacccggggggcctggggggccgggcacaccggggatgcccgccaccccaggggggcctcgctcgccgtcccggccattcctcccgtagctggcaggacccgggtcacctgaaacacacagaaggcacgctcgtgagcaggagacccgcagacgcagacgcagaaggcactggctcc

SEQ ID NO: 21887 - DNA, 201 bp, Bos taurus
aagacaaaaaccttctaagcaaaagggttatctgcatagctgaccttacgtgcacttttataatgtgaccttgttcaggatgggaaggtgggataggactcaggatggaaatgccatcaaaatatgtgatttcctcctgcctacgttcatcaacaaggcagttttactgagcttctgaaaataagcaaacattctttttgt

SEQ ID NO: 21888 - DNA, 201 bp, Bos taurus
tattaaaattctgttacagcaaagagatacaaagcagagccatccaggagaacagacgcattcagccaggtctggagggccccagatctgtgaagctcccattgttctctccccagggagtcaggaatacatttcccacccaggaagcctgtgtgttaacacagagacaaggggccatggctcagtgtctcgcatttgttg

SEQ ID NO: 21889 - DNA, 201 bp, Bos taurus
tcaaaacgggtattatgaggaggcagattactcctctctggaggccgcgggagatgctcactgtgcagatggagctgacctgggaggagaaagacttgccgagtctgaaagactggccggcgactatctgagcgatggcataaccatgcctactgtctgtacttctggctgtctgtccttcccgtctgcaccacgagagtc

SEQ ID NO: 21890 - DNA, 201 bp, Bos taurus
aaatcgtattttgtacttaggtctccctgaggcttatgttactgtgttgtataagcatctgttactaatagggttagctggagccagctcactttcttttctgggaagcagaaggtaaaacctaaacatttactgaatcaactgattaatagggcagatgtttttgacatttaaatagatgtctgtctgttgtgctttaga

SEQ ID NO: 21891 - DNA, 201 bp, Bos taurus
gtgggactgtggaagaggctggctgtgaaagtgcagtgtgaaacctggcataatgctaaagttcgcaatttacacgttattttcctcaattcaggccttacttctcttcctagtcagaggcagatgagtttttcatgccatgcaaagtgacgtcaggcaaaacctcctgtgttctagggcctgtttagagtgagtggcagc

SEQ ID NO: 21892 - DNA, 201 bp, Bos taurus
tcaggcccagagaactgttacaaatacgggtctccagcgccatctagtggacaggaagtggggggtgatggcgcacagacaccgggttctaaaatgtgaatgcagggttctgggtgtggcccggtcttcctattccttttggagtgtcttggccattctccgagcaggatgaaacctgagaaggatggcaggagcccctgc

SEQ ID NO: 21893 - DNA, 201 bp, Bos taurus
ttaatggagagtgttgaatgtatttgttttggaatatgatatgaaattttgaattgtagagtctcctattctcatattttaggattctttttcttttttttccctaatttctatcggaacacttgttctgattcatgtgttgagttcaattcacagacaaatcatcctgtgtaatgtcatctttttcattcctccatagcc

SEQ ID NO: 21894 - DNA, 201 bp, Bos taurus
gtgtctcttgtttcttgagtggccactgatacctgtgcgaccctgggtgagtcagtgaacaccttcacctgcttccccaaagcatgcatagctgaaaccgtgtggccgtaggtaagagcctttcaccatcagctgtctcaccctgatctttcaggacactggaaagaatttctcctatgactgcttgaacagagacttctg

SEQ ID NO: 21895 - DNA, 201 bp, Bos taurus
cataatagctgatggtggaaatagaatagtcgatggtagagggggaagtgatctaacatgaagagctgaatatttgtgctgaaacctcataggggcttactaggtggtgctagtggtaatgaacccacttgtcaatgcagaagacatgagacacgagtttggtccctgcatcaggaagatcccctggaggagggcatggca

SEQ ID NO: 21896 - DNA, 201 bp, Bos taurus
agttcccaaccacaagtggccctcctcactccactgcggaggatatttggcaatgtctgagcatattttcaattgtcacaagtgaaggatgctactggcacttagtgagcagaggccagagatgctgttaaacatcctgccatgcaaaggacaggcccacaaatagaattatccagccccaaatgtcaattgtgctgagat

SEQ ID NO: 21897 - DNA, 201 bp, Bos taurus
aaaaaacagaatagtttagccatccttgcaaacttgtacttgtaatatctgaggaaatgaaaaatagtattttaatggcccgaggcatgatgtaggtgataacacacattgtcagtttaatatagatttgatttcactactgtgtaaattcagaaataggaaaggcccaagtgtatgggaataaaggtgtgagtatatgaa

SEQ ID NO: 21898 - DNA, 201 bp, Bos taurus
ggaaggtttaatctaagaaggatgtattttgaaatgattgtattggaattgtaactttggtttcatctatccaaaccttaaatgttcggggcctctgggaaagaattcctttcctgtgtcagtaggttaatctctgatcacctgaactgagatgtctgtgtgactagcagtgtgtggcctgtgcacgtgtggtttgaggat

SEQ ID NO: 21899 - DNA, 201 bp, Bos taurus
tcaaagaaaatgttcatcgcaaaaagaggctgaatttttatgatatagctctgaatttttttcatcttcatcatatatcaattttttttccaggcagacaaatttcagatgttttatgtaagatcaaactacaaaaccaaatataagcataatcctataaaatcctttaattgtactcagatgatacataattttagttct

SEQ ID NO: 21900 - DNA, 201 bp, Bos taurus
agcagacgtgagcaaatcacaggtaccacgtaatgacgtttttagtagttggtcccatgcaggtttactctaagctcctatcttgggacaaagtcttagaagtcatggttttggctattttgttctgtttgaatcaccacaaagagatgctctgaggtcacagtatacaattactactcaaatttgttcctttctcccatc

SEQ ID NO: 21901 - DNA, 201 bp, Bos taurus
tcactgtggcaacactggcctaatatctccacataacactcgcacagcacgaaaattctaacctctgtcatcctatcaacactgcacttctccttttctcaatgtgattgcagcccaagtcagggccccactggtgggttttgatatcgcagttcatggggctgctgcctggagccatcctagaaattcctcctttttacc

SEQ ID NO: 21902 - DNA, 201 bp, Bos taurus
ctcaagctcccagggtctgtagcaaccatccgacccatgggcacccattcataaacctccttgttgttcgtataaagcaagagctctctttcaagtaagagatggactaaaagaggccattgtgaactcatacaactcaacgttaaaaaaaaaaaaaaaagccctattaaaaagtaggcagaagaactgactggacatttt

SEQ ID NO: 21903 - DNA, 201 bp, Bos taurus
actgactcgatggacgtgagtctgagtgaactccgggagttggtgagggacaggtagtcctggcatgctgtgattcatggggtcgcaaagagtcggacacgatctgatctgggaaatatagaacaaagttacatgtagttccactatatgtaataatgtttaagtacataaaataaggtttttagttggagtttcaatatc

SEQ ID NO: 21904 - DNA, 201 bp, Bos taurus
aacaaaaatgttggccactgacccaaacctagaaagcaatgtaatgattttccaaggcatagaaaagatgctttttcccatactgtgcatgtttcactatccattgggtggcccaggccatgtggccaaggttagaaagcaggtaagggccacccagggaaagaccagtgcaggattcaagacccttgaggacagacaaga

SEQ ID NO: 21905 - DNA, 201 bp, Bos taurus
actggggcacgtgtccgtcccctggtgcctctggaacctaggtgctcatgtccactcccaggtggtgtggtcctcaggccactgggaagacaggccgggtatgaccaggtatgacgagaactgtgatactccgagctgtcagtcagcgccccagaaggggaagagggggaagaggggacattggtatagacgtacagctgg

SEQ ID NO: 21906 - DNA, 201 bp, Bos taurus
ttcacattatatgccaaatagctctaagtctctcaataatgaacctcaggtacttcaactggacccagcattccctctgcatatcaccataaagaaccccaggtatttacactgaacccagcattcccctcacgtctagtgatgaagaaccccaagtaccctctattccccacccccatgtctcatggtaaagaaccctgt

SEQ ID NO: 21907 - DNA, 201 bp, Bos taurus
tgagatgtgggcagaggtctttccaggccagagagcaggcaatgcaaaggttcttgagaccaagggagctcggcgtgtaccaggaagagacacatggtcactgtggccagagctcagtgagctcggtgtggtaggtgatggacagatggccactcccaggggccgtgggggccacatgaggccatctagttgcctgagatg

SEQ ID NO: 21908 - DNA, 201 bp, Bos taurus
ggaagtctagataagaaaggtaagaaattgatttatttagagagaaacatagtgcacaaatagagggtaagccatctcaaaaggcgagaggccctgaaatgtgggatggtcagcttttatgagctgagtaatttcataggctcatgagcaggagcctatgggctgtttattccaactatttgggggaaggggcagagattt

SEQ ID NO: 21909 - DNA, 201 bp, Bos taurus
acacgactgaagtgacttagcacgcaagcgcactggctccatagtgactgttcccaatctttgtgctcagcacagcacgacttctgttctcagtagggcctgaccgtcacgctcactatgacttggttctcgtcctgagtatgctctgattctggtcctctctatggcttgactctagtcctttcttaatcctgaatctgt

SEQ ID NO: 21910 - DNA, 201 bp, Bos taurus
atatggttatgagttggtgttggccacaagagacactttatgtgactttggaagccagcttgaagcagaagtcgtatttttcactctgaaggttggtgccaggcgctaggcattggccaccagcccagattgttactgctgtgctagctgacttggtgggtgtggggcggcagtggggcccaagttcctccacttctcagg

SEQ ID NO: 21911 - DNA, 201 bp, Bos taurus
cgggaaaagcagcccaggaagaggtagtctcctgaggtgatgacccaccagctcggaggggtgggaggaggcggggaggaaaagtgaatgcttgaaggccaggggtctgtctaaatgtttcctggttctttcacaccagaagggcagaggtgctgacttggaattatcctggccgttattatcctggtattatcagcggac

SEQ ID NO: 21912 - DNA, 201 bp, Bos taurus
ttcattctcaaagtcaggagacctctttgaaagtgcagaaagtctcgttggaggtcaaaggggagtgatgtcaagatacattctgcccataggcctctgcggtagaatctatcttgcctaagagatgcgtgcccacctatgggaggatcctgagatatatcaaatatggactgtgaaccaggcaaatcaaagttattggcc

SEQ ID NO: 21913 - DNA, 201 bp, Bos taurus
accagaaccagtatactttttcacagacagaaatgtcccctatccctctttcgtttggatcttgatttctgttagtgagtcctgttactgaggcctaactcccttcaatatcagcaccctttaccaagcgacatcccttagctgttctggttgcctcgatatttttcagtttactcccaactaaagagccttttggagaag

SEQ ID NO: 21914 - DNA, 201 bp, Bos taurus
ccacaggaatgagagttctgaactcaatgtcagcaccctcatcctagccatcgagcactggaaaggtgagcccccagaatatttggctttgaaggccagcccggctcaattacaggagctccaagggactgagggaaatagagacttcactctggaaaggtgtacagaaaacctcacatgcaccagaccaaaggccaaagc

SEQ ID NO: 21915 - DNA, 201 bp, Bos taurus
tcatttaaaggtctatgtaaagtcacaggtgccatagcagccaatgctttccataactcaggctgcatgggacctgttccattgaagctcactaaaggaggaacccactcattagcatgccacttagtaattactaaaggcatagggagaaatgaattattccatgtggacctataaggttctacataaatcaagccccgt

SEQ ID NO: 21916 - DNA, 201 bp, Bos taurus
tattaagaagtttcagatgaaccaaaggagatctttgattctttatgtatttgatttatgttggaatcagaaatcaaatcaaagagacttttttcataataaatattttattgtggcctatgagaaaccacttttattttaaggtccaaatttacttagtaaaggtaaaaaatgtgagctagattggggatgtaaagtgta

SEQ ID NO: 21917 - DNA, 201 bp, Bos taurus
caggggaaatcttacttgatctttgttttcttaacaccaagaggtttgagaaaactccccctctgttttacacatattcagttttgacttttgacttcctactatgtgcagcttcaaaattcacttcatatctaacagtatatactggctgtgtgcttgagacctctagtttcgttgcatccatctccatgactcacaaat

SEQ ID NO: 21918 - DNA, 201 bp, Bos taurus
ctatatttggggttggctaaggctgattcatattaagtgctcaataaatgctggatgaacttaattatattaagaaatagaactgaatgttaccagagaaagttttagcctgatatgactttggttaagattcttcatcgctttggaccgccttctatctcataaagatatgaagagtttgaaattaacagtctctaaaat

SEQ ID NO: 21919 - DNA, 201 bp, Bos taurus
cagggtaggaggtctttagtttgctctttgaggtatgaataatttctctgccatctatttcactccactcaagttaccatgtggaatgccatttgggataccttggaaatggttctatgttgtatcataaaaaagactctgacaagttttgtgtattttgtgatggcacagaaaataaggagaggattcagggtttgacct

SEQ ID NO: 21920 - DNA, 201 bp, Bos taurus
gaaacaaactctcacttcaaaatgttgaattgggtttataaaccagcagacagaaagggttatgttcaacagccaagccttctggtgaaccatagttagcactgggcctggcttcacatttaatgcaaggaagaaatgcctcacttcccagcatggaaggttctgaggatcatctgccaagtgtagattaaatgctacaca

SEQ ID NO: 21921 - DNA, 201 bp, Bos taurus
cttcatatactttgaaagtttgacatgccaatgattcccagatttctaacctcaaggtgtgagaaactgattgccaaaaatatcgagcttgatttaataaccatcactcagtccagcttcaagaaaaattcaggacttgatttctcagcacttctatgacctttgggagcattctattaaagaaaaatgaagcagatttgc

SEQ ID NO: 21922 - DNA, 201 bp, Bos taurus
ctaattgttcaagcacaataaccactgaagcctcaggttggaagtgactttaaatctaaactgacagtcttattgttaggagcattttctaaaatcaacttatgtaccataacatctttgcttttcaattttaaatgcttataggatatacattaaaagccaaacttacttctgttagtaaactttgtctatgagggttgt

SEQ ID NO: 21923 - DNA, 201 bp, Bos taurus
ggcccacatgctggggtggggccgaaaccaaagctgagtcccacttgggccaaaaccaaagcacagcccccacaaaaggactgtgcgactaaagaagtctatttagctatataagctgaggatgaaatctaagtattctcctcagtaaaacctgcatttgtggaatatctgaatggacgataagtgctcccacagtttagc

SEQ ID NO: 21924 - DNA, 201 bp, Bos taurus
gctaagcccagagggccctcaagagggagaacaatacttgcaatccagcagctgccagctgacatcattctctacaataaacaagaacttaaggatgtgaataatcaagaagtaggatgctggccccagatagctgagatgcacatgaaagaaattatttcagtgcacccagacacttgcatcttcccatacatagaagag

SEQ ID NO: 21925 - DNA, 201 bp, Bos taurus
aaaaaaagcttaaattgaatgccccaacactgatgtgataagcaagtcttattagtttctgttttacacagaaatgtggctttaggctgaccaagggaatggaggaaccagagcctgaaaggaaggcacagatttgaggaggaaataggaacagaggctatatattatccacttgtaatcttcaaaggtacagaatcaagt

SEQ ID NO: 21926 - DNA, 201 bp, Bos taurus
aactccaaggagcttcagagggaaggcatccccctatagtgtttagcagactactgatcagcatgtgcatataaagaaattaccctagcccaaaggaagaactgtctaaggattaaaggaaaacaagaccagtgctcacacaaaacatgaataatgcctgcagatagaataaccacacaattcatggagatttgggtagag

SEQ ID NO: 21927 - DNA, 201 bp, Bos taurus
gcttactcccttatgacgaagtacacctctatggttctcatgtgaaaccagaatagaaaatgctgtattcggagcgatccaggcttcacttagacagccctcagcacccctcactccccacccgcaccacccccaggcctcccaccctgagtcacaagagaacccggtggagaaaggattttcgcctcacatgtgcggccc

SEQ ID NO: 21928 - DNA, 201 bp, Bos taurus
cccagggttagtcggcctcctttaagctaccggggatggagacgagagcgcggaggggaatgccgcagcgcggtccctgaattcaccgccctcagtagagaaggaggccgggtggccaatataacctcttctccctgtttgatctgacatctctaaatttgtctttccccacaccgggctcgatagcctccgaatttgtct

SEQ ID NO: 21929 - DNA, 201 bp, Bos taurus
gaaccttcaagaaacataaacaaggccacagcaggacagaacataggagagaggagtctggaaagctacattgagtccagtcatgtagaacagaggtctctggcctggatctggttcacagctgtgtgtgtgtgtgtgtgtgtctgtgtgtctgtgtgtctgtgcgtgcgtgtgtgtttatgagctgccagaagttgaaaa

SEQ ID NO: 21930 - DNA, 201 bp, Bos taurus
caacattcaaatcatcttgcatgtggaggatcattcttaaaagagaatttttcatttctttataagtcatttgagatgttcctggccccaggttttctacggctttgcctgactgagtgagggaccagggtggaaactgacatctctgtggtcggcagcagggccagcttcacaagctggtgacctgtgcgatcagacagg

SEQ ID NO: 21931 - DNA, 201 bp, Bos taurus
tttacagtcttgttttagtaacttactaagtgaaaaattttttcctttttcagtttggtaattctattatcaccacacctctaaaacgtcgcaaagtgatttctcaagaaactttagttgctcctgtatctttaagctgccaaagttcctctgataccgtagttttaaactgtcgaagtatacgagtaggaacactattcc

SEQ ID NO: 21932 - DNA, 201 bp, Bos taurus
catgttccatatctgcagctggctggccttcagactaaagccctgaacacgcggcatttaagggtcaacctttccttttcccagtctacattgctagtctcgtcttttgtcggccagcagtctccctctcacactcttgccatacccctggtcttgtgtgcgtttctcttcctcttgcagccttccccctcggtcctcagg

SEQ ID NO: 21933 - DNA, 201 bp, Bos taurus
tgtggtgtagggggctgggtgctcctagatcctccccaagttttagaatgaattgtatgcaatataagagcagaacccatggacctattgagcctggaccaagacaggcctggtgtatacattcttagcatatagaaatggcatgctggggaaggccagtagacattctgtgcataagccttgtggaaggatgaaatagaa

SEQ ID NO: 21934 - DNA, 201 bp, Bos taurus
atcaatatagaagaaaggtagggccctaagacatgcaagttaaggttttccttcattaaaaaaccaaagagcaagcatacctcttgcttcacaatctgggcactttagtttcctcacagaacaaaacttttgctatgcctaagagatttttctttttttagtgtaacccacacctaagctaacttacatccttccagaagt

SEQ ID NO: 21935 - DNA, 201 bp, Bos taurus
actggagtgggttgccatgccctcccccgggggatcttccgaccccagggatcaagcctgcgtctcattcatctacctgctttggcaggtggcttctttactactagcgccacctgggaagagagttggtgatgctatattatttatttacttaatctctgcctctcctactggattcctagcaccttaaaagcccaattt

SEQ ID NO: 21936 - DNA, 201 bp, Bos taurus
acatgttccttaagatatttcacatccttaagtagactgtggggtctcagagggcttatatactatatgccctatgtcttatgtctcttttgcattcctgcaccttcttgcccaggtacccaacaaaaggccgtctgtgtccagtggatttgaaatttattttcttccttgagacatggataataatgtagaggtcttatc

SEQ ID NO: 21937 - DNA, 201 bp, Bos taurus
tgatacccagctttggagatctagatccttgaaggctacatttttcaactggctacttcagctcttttagctcttcatctaggattgctggacagttatccctttctaacctaattaaagtcagtgaaattgtaattcactggacatgtaaaatgccttatcacctttgaatatccaactatagatgcccaagtatttctc

SEQ ID NO: 21938 - DNA, 201 bp, Bos taurus
atctgggagataaagtttgatcactgaagagctgatatcttgaagaaatgtcaatacctaattaagaaaagtgaaaacatcatttgaaattaagattttttctttgtgccaaattttatttgcacaccctttgttttggaaaattagggtttgtgagagagtggggagtattcgtactgctaataaaaggtaagggagccc

SEQ ID NO: 21939 - DNA, 201 bp, Bos taurus
aaaaataaaacagaaaaataattagtttctagtgactgtcattttcatgcaaaaaatatagctaccctactatatgttttattgttatatttattgttgttgttctggtatggctgaatcctatattggctctctaaagtgttgtttatcctacacaggctagggagttgctgtccatggtatttctattccccggaagtg

SEQ ID NO: 21940 - DNA, 201 bp, Bos taurus
caaatttagctgggcttctctccaaagctagtgtttgacttttcgaatgatctgcctctggacgccaaccagagcagagatgctgcttcagccagtcctggataatgtcctcagcccagtcctagcacagacggactgcggtaaatattcaaaactacactgtagttacacatgtcacattcaaatggcagaagaccatgt

SEQ ID NO: 21941 - DNA, 201 bp, Bos taurus
tctcagattctgggccttcactctttaatcttgtctttagcatattcagataatcagagtttctctgacattactgtttatatttcactaatcagttttgccctggcctactcttcttctctcctactccactttttagggtttcttgatggcccattccccagttctgttcataattatttccattctatttatgaagtc

SEQ ID NO: 21942 - DNA, 201 bp, Bos taurus
gatagattttccttggactacaaatactcatatttttgagcagcagtactcttaccatggataataacatggcagaatgatcaaataacctctcataaatatctttcattctgtatcctcttttgtttacatatttatttctttaaggttaatacagtatgttggactgcaatatgtttttaattaattgaatgagatcac

SEQ ID NO: 21943 - DNA, 201 bp, Bos taurus
tctgaactttaatttttccctggagttaacacagttggaaagaagttaatattcaaatttggaagtgccctataatgttgatattttattactggggtgaattaatgctgtcattttatacttaactgcagaacctctaatgcagctagctggaattctgagtggaaatgaatgaacttaaatcttgtgaaaagaacagcc

SEQ ID NO: 21944 - DNA, 201 bp, Bos taurus
aaaaagaaattgaaatacttccaaaagcaattttctcacttaaaacctgaaaagctctgcttttctccattcaacaagttaaaagaaaacagtaacaaacccaaagagattctttgaacgccagatatactgaaggatgaggttctaaagataaaaggtaataagcttacatatgctcagacttttccctatcaccacttt

SEQ ID NO: 21945 - DNA, 201 bp, Bos taurus
gaaagaagaatgcagaaggtgagaaaagtttctaggtaaaagaaacagaaacttgtggtctgacaaagaaattctttatagactaaaaaattgacattcataggatttatttaacctaatactcaagaataaattcaacaaactctttttaaaacttggcttaaaacagaatcttttagccagattacaaaacaactcctc

SEQ ID NO: 21946 - DNA, 201 bp, Bos taurus
atgaaatactcttggcttcctgggcagaaatgagtacatcaacacttcaggctatgacaatgcatattatccattatggataaaccaattaaaaagggccggattaccaaatgtaagacaatgaaaggcagtgctcttcaagtaaacataagtggttactagtgtacatggccggagaaggcaatggcaccccactccagt

SEQ ID NO: 21947 - DNA, 201 bp, Bos taurus
ttagcgtccctgccctcgtggggttatgggattggacccagggcctgggcagctcattgttttgggacctaaatcaggcaagagtgtgtgtgctgaatatcctggtcaggtgaggccagcagttttgccctgcagacagggagagacatgggctatactctctgttcaggtgccatgtgaactgtcatgtcagcagggctg

SEQ ID NO: 21948 - DNA, 201 bp, Bos taurus
tcgtgagtaactgaagccacagaaagcaaagccgtggataatggggaccactgggcacattctcaactattcccacatctgtgaagttgatgtcataatagcactattttattgagacattttgaagatggactgacataatagctataaagtatctagtgactgatacaggccaagtgcccaggagatgtacctgtagtt

SEQ ID NO: 21949 - DNA, 201 bp, Bos taurus
agaattaatcatatttagagttcaaatgagtaaactttttttttttctgtacatgataccttaatgagactcaaagcacatttttttttgactttttgtgatatcatggcatatttatggacacatgctaaatagagactcttgagaattaatagaaaaaggtgtgaattttcatgatcaggttcatgatggtcaaatctt

SEQ ID NO: 21950 - DNA, 201 bp, Bos taurus
gtaattttatcaattagtcaatcctaaagattttctgtcataagtatgtatcacacatgtatcccttcctagctgttcctgatctactattctattggcctacttttgaccaaagttttaatacatagacacttaattatgcgcttctttcctctgttatacacttatgatttcccaaatactaactctgaagtataagta

SEQ ID NO: 21951 - DNA, 201 bp, Bos taurus
taactttctttttataatcgatctgtaagtattaaagcatacagtaattttccgtatttttaaataaactattttgagtactggctttatgtattatcaagtgttatatcttagttatctttgggaataactataacatgctatcgggcttccctagtggctcagattataaagaatctgcctataatgtgggagacctgg

SEQ ID NO: 21952 - DNA, 201 bp, Bos taurus
tggacctgcccatgaacaagcagtaagcagaagccaaattcctatgtggctcccaagggacaggcaggaactattccttctgattatttattgatgagccaactccaaaggtagtagcctgtttcactgaatagggcatcttcacaatttggtcttcatcttgaatggcagccaaggaattcctaccaggagttaccaaga

SEQ ID NO: 21953 - DNA, 201 bp, Bos taurus
gcagcgtcccgtgcacttaatcaccgaccactacctccatctaccccactggaacacatcacagagatgaggtgggggtctccttattcattaaaccctctttgtcaaatacccactctgagaagccttcgggtgaatacactctcctagtatcatgttcatctgaattaatcattgtcacccaaggactcttccagtcat

SEQ ID NO: 21954 - DNA, 201 bp, Bos taurus
aaaactaagcattttcatttattgaagctatatgatctgctttctacaagaagtttgaaggagcttatagtggagagaagatagcataaacagggcaatggaaaagaaatggaaaagaaaacttgaataccaaagtaaaagatatgaagattacaccaggagagtaagcagattattgtatttgtttctgattttctgaca

SEQ ID NO: 21955 - DNA, 201 bp, Bos taurus
tactgttgaggtgtgcagagcaagaaagtttctctggggaaactgctcagtgaagagagagagaaaaaaaaaagtaagagttaactgctagagcagcagcaacagacctacccttcttgctcctgaatctgcactgtcagatgatttctagtgctttcctagaaaaagaagaacatgctctgctgttgggcatgaaacaat

SEQ ID NO: 21956 - DNA, 201 bp, Bos taurus
ggaggggccaggagacttgtggtgctctcctgggcatcaggccctgggaggttcagatgatgctcccagtctctggcttcagggaattctctctcaggacgtctaccttgaggcccagttaaatgtatctgattccaactgtctcctggactcctaaacaggtatatccatcctccagctggttgctggtgaggggtgacc

SEQ ID NO: 21957 - DNA, 201 bp, Bos taurus
agaatccagtccagaggcgcagtggtctgagacccgcactgcctgtgctgagagcagaggtacgttatcaattctagagaaattggggcagtcttcctactagaggacatgatcaggtccaatattaatcatagcttttagaatacgctattgagacaggcagaaaacaaaatttaaattagcctcaaataggtatgattt

SEQ ID NO: 21958 - DNA, 201 bp, Bos taurus
aataaaaaaatctgaatagctgggttcatttattaatgagatgtctctaagaaaatgaaagggatgttttcctcccagagtaaaatcaagtatcacataatgctctaaggaattccactttctaaaacaagatctgccctcatgctgtaaaaggtattgcccaatcaaagaccagttaatcaaatgctttgtcagcaaaaa

SEQ ID NO: 21959 - DNA, 201 bp, Bos taurus
gaaacaagacaaagttcatgataaccctctcctgacaggtcaaactcagccacccagcttgacttccctggggagaacttgcatcaaattgaacacaaatatttacttactcagacttaaagaggaaccagagcctccttcctgcaggaattgccaccctgctctggagaactgggcaatcacaactccaaagcagtgacc

SEQ ID NO: 21960 - DNA, 201 bp, Bos taurus
tggtcttgaaggaacaagaatgaatactaatggcgcttgggtggaatggttggcgacaacacacttcaacacaaagtggtaaatattatggaatcatttggaatccaagccattgacacaaaaagaggaaatgagtaattcttcccatccatgtgttaaagaggcctaaaacagtgggggccagagtgggagcctctcagg

SEQ ID NO: 21961 - DNA, 201 bp, Bos taurus
caaacaaaatccacgttttgagattctaaaaaaaaataaaaaagtgtcactcatactattctgtaaacattatacctgggaaaaaagtccaagtaattaagatactacaaaacacttcaaaagagagttaagatgattagtttctaaatgttgaaattgtaaatatgataaacagtaataacatcaaaatatttctatctc

SEQ ID NO: 21962 - DNA, 201 bp, Bos taurus
ttttttgacacaagagaagccatttggggcctaagcttctgtgatctaagcctgcacagtgctcatccttcaacagggctcagtgattattttaaggaacaaaagaatgcaggcctaaatgactaatatcaggcaagagaagtgaaaatagcagagataataaatcacttataaagactaccagttaatggtaatgactag

SEQ ID NO: 21963 - DNA, 201 bp, Bos taurus
aacagtgtgcctggaagagaaaacaatacttggggattcagggaagatggcaaagacaaggtatggttctaggagagctgaaaatagagtctggttgttggtcaattaatttaggccacattaatagcactgactggattgtattaccttctttcttcacagatgccaggtcattacttttggagctgggtttttccctcc

SEQ ID NO: 21964 - DNA, 201 bp, Bos taurus
ggtagagtgggtgctttcatttggattgggtttagttgtgagtggcagaaaactcagaagtaaatttctctctcttacaagttcttagatttcaagtccatcagtgatagtccagccttgctctatgaaaccctcaggatactcctagctcattgctcctctgtccccggtaggcagccctgatcctcttggtctaaattg

SEQ ID NO: 21965 - DNA, 201 bp, Bos taurus
gtcagcaccctcagcaccgcttcttctctgcaagcacagcagtcattcttacaggcatgggcaacacgtgctgaggggcctgtctgctgttcccttagtgtgtcatcacctggcacctctatggagcttgcctaccagtcctgatgccttctgtgcccctggactttatgaggccgtactctgagggcacagcttccctct

SEQ ID NO: 21966 - DNA, 201 bp, Bos taurus
cctgagtatcagccccacccaacccacctggcctgctcctccaaagcagctcttgcctaccctagccagcagatggctccagctggcaccagtgcccctccaaagccactcccactcctggcgaccagccctgcacaccaacatacccaccatagccacagctagtcctcttagctgggttaggaccaactctgccaacca

SEQ ID NO: 21967 - DNA, 201 bp, Bos taurus
ttgcctcagacataggcagctcctctacattccatttacttcatttggaggaagttctcctaacattcatttactcagtcattcattcaacaaatccttattgagtttcctctctgtagctgttagacactgaaataagtggtgggtatactatgatagtttctgcttttaaagagattatagtcatgggcaggggcagtg

SEQ ID NO: 21968 - DNA, 201 bp, Bos taurus
aaggagtttctactgtatatgaaaatgagatttgtacatctgcagtctgagtttggacttctggcttaactacattattataactcgagacttctgtattactgttgttgttattgaactttttctgggacattcagatatacaattaaaatatatgtgacggaagaatcaaatctataagcagttattggagaatgatga

SEQ ID NO: 21969 - DNA, 201 bp, Bos taurus
cttaaagagacaaacaagcctttccattctatggtaggagagctgccaggaatattctgccacagtactcatgactgtgatcttgttctttcatcagccagatgaaaatacataaaatcctgggaaaatcaggacattaaaaaccaataggaccactgtctattgagaagtcacaaccaaacagagatctgcccccttatt

SEQ ID NO: 21970 - DNA, 201 bp, Bos taurus
gtccctgaatgatctgaatttcttagatttgaatgctttttgaccttcttgtaatgtatatattgccaactcacacgatttcttatatacgtttcactctcaattaaatctgtaatgggttttgaccaaactcttatttcaacatttttttagtgtcatatttatggaacctagttcagtcaccgcattttaaagtttatc

SEQ ID NO: 21971 - DNA, 201 bp, Bos taurus
tggcaaccctctccagtattcttgcctggagaatcccacggacagaggagtctagcgggcaacacccccatggggttgcaaagaggcagacacaactgagtgactagcactaacacaccccgggtttactcgggggtaatttttttctgctttcctcagtagttgacctgtttcagattcttccagagagcttgttaaaat

SEQ ID NO: 21972 - DNA, 201 bp, Bos taurus
agtgactgaactgaactgactggactcatagaggtggagagtagaatggtggttgccaggtgctggagggagggagaaacagggagtggctaatcaaagcgtataaggttatggctgggaaagatgagtaagttccagagacttgctgtacaacattgtgcctataattaacaacgctggaatataacatataaaataata

SEQ ID NO: 21973 - DNA, 201 bp, Bos taurus
gcagcagtggccttctgggcagcggacataatggcaggcagcagggcccatatattattgccctatacacgccagttccactgatcacacatctgaagcaaaaggcagagcgggcatccagccaggccaaaaggcctcttgctttctgatattacagagctacctatcagaattagtctttctcccccagttttcctgata

SEQ ID NO: 21974 - DNA, 201 bp, Bos taurus
tctgggtcatggaagatcaaaggcttggctggtctatggcagaacagttagaaaactatgaaatttaaggtaatatgaggggaaaggattcacataggacatgaaaaggcaaggtcattgtctggactaacaaactaaaattgaaaacaaacataagatttagaattttaactccgtgtgcttgaaagcatcctcttcttc

SEQ ID NO: 21975 - DNA, 201 bp, Bos taurus
cctatccctctattgtcctttacaccatctctctcctgtactgataatcactagtttgttctctgtacctgtgtgtgtttcttttacattatgttcactattttattttgagattccacatataaatgatatcttacagtatttgtctttcttcgtcaaacttatttcactttcactttaggataataccctgcaggtcca

SEQ ID NO: 21976 - DNA, 201 bp, Bos taurus
gacacttaatgatggaagtgccctagagacacttaatgatggaagtgcccaagaataacaccacttctttccctgcaagaagtcaaaggcactaaggacatgaaacagtgatgaaaacaaggataaagaagaattcaattactttcccacatataacactttcctcagaccattaagatttgtcctaatatttacatgaaa

SEQ ID NO: 21977 - DNA, 201 bp, Bos taurus
ggaggtgtgggtcggcggggctccccagagggacgggggcactggaaggtcccctttggtgtaaagtctctgacagtaaccctgctatagagcccatagaccacagggctgggtcacctcaggcaaaactaccagggagggaatgcaagcccactcatcggcagataactggattaaagctttactgagtaggccctgccc

SEQ ID NO: 21978 - DNA, 201 bp, Bos taurus
tccctgcctcgtggcctttgctcttgctagtcctcctctggagcacttgtcccctacatatctacatggtttcctcagtcccttcaagtctttgctcaagcgtcatttgtcatctgaggccttcactaaccatgccatggaatacagcaattactattcttcctttacacatcttccttactctctataggtcctccttac

SEQ ID NO: 21979 - DNA, 201 bp, Bos taurus
agctagatcttctgtataacttgctgcagctcctgcatcggtatttgctgtgtaagtttgcacttttaggctgtagagatggcctctttctttaaacctcatgaaacagcctgtgctagcttcagagttttttctgcatcctcttcacttctctcaaccttcacagaattgaagagagttagtaccctgctcctgatttag

SEQ ID NO: 21980 - DNA, 201 bp, Bos taurus
aaatgcacatatttctgagttgcaagtaccttcctagtttgtctgatggaaactgagcaggtctgttgtgctcaaaactaggaatgaataaccctattgatggccatgatagtatgccagtcctgttaaaagtttttacatctaatttgggtgctgtcatctgaaaagttttaagagttgcacctttaagcagcatttaag

SEQ ID NO: 21981 - DNA, 201 bp, Bos taurus
tttattgtctctcacagtcttacagtcttgggggtctgctgagctcagctggacagttctctctcagggttccttgcatggctatattcatacagtggctgtggggttgggatcatccagactcattcattcacatctccgtctcctatgctgggaggacttaaaagccatgggctggagcagctgggggtagtagatgag

SEQ ID NO: 21982 - DNA, 201 bp, Bos taurus
atggtgtgcgggaaggggctgcaattactggaagtggccaccttcttttgtgactttctactttcgtgcctttttagttgacgtcaatttacccgcaaaagtacgatcatccttggccaacagtgaagtggggacagatctgggacaatagtacaaccctgacagagcccttgagaggtcctgccattcgtcactccaaac

SEQ ID NO: 21983 - DNA, 201 bp, Bos taurus
aatttttagtttgtgagtattttccaaaatgaaacactgttatgtaagcaattttcacacagaggcacaaaggaatacttccaatgggaaaaacaattttactgtttctttctcctaacatttttatccattaatatgtttacatggtatatacatatttaacacatgtctaacagcatttttctgaaaaacaggtaaaca

SEQ ID NO: 21984 - DNA, 201 bp, Bos taurus
cgcacttgggaatgttctttggactcacaggataatgaaagctccatcaaattctgctgaacccctctgaagctcccttccactggtggcctgacagtctttgcattctctcctccacctgtgagaactgatgagtccctccctccttcctacagccacgcctcagtctgggctctcatgcccccaggcctctctgctcac

SEQ ID NO: 21985 - DNA, 201 bp, Bos taurus
accacacaaagcaaagatccagcttctagcttctctctgctgggaatggcacatcacaagatctcttagaagacatcggagccttcttaaagatgcataatagagaaatcttaaggacatatgggagaacaggggagggggacaggaggatcctcacacacttggcacaaatggaagagaaagcaggaaaaagagctatgc

SEQ ID NO: 21986 - DNA, 201 bp, Bos taurus
ggcccccatccttgaccccaataagagcagttctccaggtccattctctctctttctcttcctctatccttcaaaggacttcaccatgaggcccaggggtgccatgtgctctccaggaaccatggataataaatctcccctccccccaaactttcctgatggttattgctgaagggcctcttacagtagtaagaagaacca

SEQ ID NO: 21987 - DNA, 201 bp, Bos taurus
ggggacaggaagatacgcaaagttatgattcgtccttttcttcccctccatgcagctgcattaaagaagtcatggactggcccttcttttaaggatgctcttcaccccacccttctacgtctttggaccttatttgatgtttcaaataattactaatttctatttttggttatctatgaaacaatgatggccaccatacaa

SEQ ID NO: 21988 - DNA, 201 bp, Bos taurus
aagttcatctctaaaaatattgtcagtgaaaatcattccaaagttccataaaaactactgaccctaaacaaaatgttattttcatggaaatcatccaaaagttcagtgtttgacattgttctcttgatgacggtccaacattttacagctgtgatcccaaccataaaaaatatattgtttctttcttggtcatggattgat

SEQ ID NO: 21989 - DNA, 201 bp, Bos taurus
caagaattctataatgccacagtaaaatagtctgtttacattctgagggctataaatatatagtttagaaatgaagtacagcagacattaaaaggtaggcgcaattactgatggttgaggtatttcaagattgcagagagcaattaggaatagttatgggacttgagggaagagaataacttagagaaatggaaagggaag

SEQ ID NO: 21990 - DNA, 201 bp, Bos taurus
tcaccgaaattctccaagccagttggcatcctacaattttgagctaatgaagccttctatttggattttgaaaacggttccaaaaattttggctaaatgtattgttttgaatctgaatgaatttttaatatgaatccttcctgtagaaaactcaactcttcatcactggggtggttgttacaaatattttaagaagtaaac

SEQ ID NO: 21991 - DNA, 201 bp, Bos taurus
caatcatcagttgaattttaggacaatgaccacagtaagtgtctatgctttgtggaaacctgaagggcttacagataataggattatggctctactttcattctctgtgaacttcttctggggcaaatgcagaggcaaagtctctttttcactctctgggcctgtctcactgaccgtagacaatttgctgaactttggacc

SEQ ID NO: 21992 - DNA, 201 bp, Bos taurus
gatgttatcttctccaagagatgattcatttttgttttaggcaaacaggctgaaggcagataactaatccaatcaggaattgaatcttttctaaattcttcaggagggttagtctagtctgtttctcccttgctttcaaagagcagcccagtagaagtttcatctggcagcttggattatatgtcagatctttttcttcag

SEQ ID NO: 21993 - DNA, 201 bp, Bos taurus
tatttactgacatttcatctgttttatttccctaaaacattccttgcctctggagagtaaatttttccttaattggtcttatttttaaatcctgtttcatcctctattctctattctccagattcaggattagattaaaaaacagaagaaccatctaatgtctttatctatcttgatataaaacaagatagaaaacccata

SEQ ID NO: 21994 - DNA, 201 bp, Bos taurus
gctagaataacaaaataaaattttatgaccaacacccactgcaaaagttgatgaaagagcatctctgcagctcccagacttggatctgccatcaggcccttgtggtattagcaactgcatgcaagagagtggagggaagaaaaataggacttctgatgaatatgaaatccaggaacaaattcctaagaggggttcacccca

SEQ ID NO: 21995 - DNA, 201 bp, Bos taurus
gaagaaggtaaacactaaggccagagaatattatgataatcataacccaccatacaatgtgattctctttcctactctaccagccacacacgtgccctctcaactaaccactgacaacatcagggctttttgctagttttaattcctccttgatttataggagattagtatctcataatatatatccataacagtcacttt

SEQ ID NO: 21996 - DNA, 201 bp, Bos taurus
ttgccgtatgcccttaggacaatatccagagactaagtgattattgtttttataattcccatcagtaatggctgtttcactggggattggttctgtagaactcctcatgcctgccagtctgcatatataatgcttttatattagaattgtatatggttcatttccagataaatgtacagatgttgtgctatcatgttccca

SEQ ID NO: 21997 - DNA, 201 bp, Bos taurus
ggcaaggagtcagatacgactaaaacgacttagcacagcgcagaagaaacctgcctcagaaacggtgtggatggaggcagggtttttacatcctgttccctccctcactactttagtgaagctgacttcctcaaacttgacctactgtgaagaaactcaacagtatctcatgcatcatttgtcttgaccactgacagcccg

SEQ ID NO: 21998 - DNA, 201 bp, Bos taurus
ataacaagaagtgaagtaactgcccagataataacagtttgaaaaataggaggcaatggaagcacagtgcaaaacggtttacttggacccgaatgtacagacccgggttcttcactaagcaagacatccgcagccgtcctagcttcgttaatctgactccccaataaataaaacagtcgcgtcctaaaaggccacgaagcc

SEQ ID NO: 21999 - DNA, 201 bp, Bos taurus
ttaatgtcacatattacctttcttttttatattacaatattaagaaaatatatctatgaaattctaatttcctggggatgacagcatttggattcaagttgtctcttgatcatgttacttagcctttctaaagtttgctcctaaattgctccctatatccaactttaaaattcaaaagggtttaaagtgagaaaatattat

SEQ ID NO: 22000 - DNA, 201 bp, Bos taurus
ttgaaattgacatgcatttggggactctcatccacaagatagaaaacctttggcctcacttctgttatttctgtaatcgtctctcataccctcattgtccctgattgtgtctagtgtgctgcaggccacaacataagtactcctgaataaatacatataaataaagacacttacttatttaacatacacaactgctctcct

SEQ ID NO: 22001 - DNA, 201 bp, Bos taurus
aaagtactggagtttcagctttagcatcattccttcccttagcagtcaagaaaaaagggtgagagaaaatgatctcctgaaattatgttgctgatagactcaggcctccctcttaaaaaagagatttattcttctttacaaaggaaagttcgcaacattcctaaaggttagtgagaccataatcatctgtatttattaatt

SEQ ID NO: 22002 - DNA, 201 bp, Bos taurus
gaatcccagatggcatgaactggccccgtttaccccaggctcctctgggctcccagccaacccacatcttcagggtgctcctgaaggctctgaaaactgcaggcacttgaggatagacaggccttgttcaccctatggctacagtgccactgcccaggcccatgtgagtggcttgctttgtggcatcattttactgagcta

SEQ ID NO: 22003 - DNA, 201 bp, Bos taurus
ggccatcagcaaagacctgggagaggtggctcattcagggaaggaaataagtggagtggatgtaagaataaagacatatcttctcataaatctctatcaaagagcaagcagaccaggccacccgcacattacaggagaaaatgctaccaaattccggtagcttttatttctatgaatgagactttcatttgtccaggtaaa

SEQ ID NO: 22004 - DNA, 201 bp, Bos taurus
aagggccaaagggcagaagccagaaagaataaggccttgaaagacgagtggggtgtccctgggaaaagtcatgggaccacagtgcaggcagagagcccaaactgagctgccgtcgaggcctgagcaaacagtgcatggggaaacagcaagcgctcgcatggaacccgaaaaggagaaccgctttatctgggtcagccctga

SEQ ID NO: 22005 - DNA, 201 bp, Bos taurus
tcctgcagagcctgtgagtgccgtgtcacctcctgcaggttcagagatgatcatgcttgagtcggagaacaggtggtcgtcgagcaccaccatgggcagtaagctgaaggtcacgaatagctcctggccctcattgtccaggctcaggctaacgagggccgtgagcgtcagccagtggttgtagctggcctccttgaggca

SEQ ID NO: 22006 - DNA, 201 bp, Bos taurus
gcccagaggtttgcatcttcccatacatagaatgcgaaattgcttaacgtgacacctgatctttgatgttcagactgcctgctccctttgttgcaaagttttatgtggcctgactcctctgctcctgcctccttgcagcagttttctcagagctactgagatgctgtctcctaggcttggagtcctaaacgttcccaccaa

SEQ ID NO: 22007 - DNA, 201 bp, Bos taurus
cacaccggacctgggcattcagtgggcagcaggaggctgccaaggaggcataaagtgaaccccgctagaggacctggggaggacactgcagtgataatttctactttaggagctttgcccagggctgacctgcttaaggtgcaaacataaataaatcatatacaataaagactctgttgccaagagctgcagggcagaaaa

SEQ ID NO: 22008 - DNA, 201 bp, Bos taurus
cacaactgaagcgacttagcagcagcagcagcagcacagacaccattcatatggcatccagtcgctttcgcttatccaccatttagctccctgcagtttcagttacctgcagttctactacaactgaaaacattatatggaaaactccagaaataaatttcataagttttaaattctcaccgttctaagtagcatgatgaa

SEQ ID NO: 22009 - DNA, 201 bp, Bos taurus
ttggaaggactatcatgggagggtactataaacacagagagcagcaagtgtgattaaaacaacaaaaaaagatgaaacaagaggcttctacatcatttctatgctaaataaataccaatgactcccattatttatatggtaagttccaaaatctttattttactgttcaaggacctccatgaatattggagcatgttatct

SEQ ID NO: 22010 - DNA, 201 bp, Bos taurus
ccaaaagacatctggccccaatggctctggttataatagaaatcaatgtgtcatagtggtacagaattcaagttttggaattggaaagtcaagtttgaacgctaactagccatgttactgcaagaggtaacctaattgctatgaatctgtttctttatctatagattagggatattgtattacatagctcctaagattttc

SEQ ID NO: 22011 - DNA, 201 bp, Bos taurus
agcaattcctaactacagaagtgagggtcagcagaaacaaaggaaaaactattaaatgagaaaactaatgacaataattaagctatgaaacagagtcctagtttctcctcaaaggataacaacatgatggatatccttgagctgttcttcttgaactaagaccaactcccttccatccagatggaggatggaaactatatg

SEQ ID NO: 22012 - DNA, 201 bp, Bos taurus
tttacagctaacacaactcgtttatgtgtctggccttgtcttttatagatgacgtttggaatctctgctgtacccgctgtattccacagcactacaactccgctctgttctcctccatttgtggcccgttatcttacaatgctttggagcttaagcctgcactagagatggcaaaggatctctcctggataattcctcttc

SEQ ID NO: 22013 - DNA, 201 bp, Bos taurus
ccccatgtttaattagtataaaaacattagccttgcagatttagtttcatttcttcttttttttttgactggggatatggaggaaaaataactaatatgtgatatagacatgggatgagttcaaaatcactgctttctctgcccatgtgttttctcaacttgttatttttaaaccattttttgaaaatctgcaagcgtcta

SEQ ID NO: 22014 - DNA, 201 bp, Bos taurus
taaggctgaattgcatcagtcatgctctcctcttgtgacaagtcctttgaggaagttctaagactccttcaatccaggaaagaattcatttgatcaatcccttcattgtaagaattcctctctgatgagtagttttatttttgaaaactaaaagaaaccattaagtcatgaaaatgaatctctagtgataaagcttctagt

SEQ ID NO: 22015 - DNA, 201 bp, Bos taurus
gaagtaaaaaaatctgctggaatgtagtgtttagagttttctcttgtgagagtgcagatggaagatgcatctgctttacttcaaatcaatttcctcccattggtccactgttatcctttttcccagagaaatttcttgttttccaagagtgtattttcccacacaatataagttatttttgtacaattaattcttgagttt

SEQ ID NO: 22016 - DNA, 201 bp, Bos taurus
ttaaggcaacaaatacagagctgccaacatggaggcaaaggatacagctgttgtagcacttctgatattaaagaacatgtgtgactttgctttctgatctttgaagtaccatgcaaattcaagaggttctggcaaccaaaggcaacaagttaaggctaagagtttaaaccgcaagcattcgttaggttgaatgtgagaata

SEQ ID NO: 22017 - DNA, 201 bp, Bos taurus
tctcctgtcagaagaaccaaagccatctttaaaagaagattaaaagaatatttgagtgctttttagtttctcatttaggtttataaatctatttatggaaagtccacttagcagctgttcagtctttcatcttggatccattgtagaaccaattgattttgtcccattcaccagtcgcttgctttataggtcatagaatct

SEQ ID NO: 22018 - DNA, 201 bp, Bos taurus
tctgaggaaactttgggaagtggtagcccattcaattaaatgtagaactgcaggttattttggtttcatgagcattatcatgtttatccttctccttgcaagacttcataatattatcttgtcttagtctcaaattattctttactgcacaaagtcaagaaacttgattataatattttcatcaaattctgcaacatgaat

SEQ ID NO: 22019 - DNA, 201 bp, Bos taurus
ggcctctcctgaggtttactcttttgtattcaagtcagaacttgtgtctcccgtttggagacagagacccttgatacattgtgcagttgtcctgcagtctgtgtacttatacaaaggccccctgctcttctttcatctcaagatttggactggcgtggcaagtgacctgaccagttgggaagagctgcttcttaattttgc

SEQ ID NO: 22020 - DNA, 201 bp, Bos taurus
tatgctggttgacgtccgaagctggtagaattctgaatttggcaataaatggtgcatatcaaagaaactcatgaaaatgaaaagttgtctggccttctgagcttagttgtttcattttattccaatacatcatactgtctaacacttgcttgtacagtatatagagcccaaggccaaaaaatgtaagatgccaagcaggaa

SEQ ID NO: 22021 - DNA, 201 bp, Bos taurus
gtgtggaggcctcatgcctgctcctgccaaccccacagccccagcaaccattactctccaaaatcctaggttcttgtgggtgtgtgctcagttgcatccagctctgcggccccatggactgcagcccaccaggttcctctgcccatggaattttctaggcaagagtactggagtgggttgccatgccctcttccaggagat

SEQ ID NO: 22022 - DNA, 201 bp, Bos taurus
ctgtgtggctcggtaaaggtcccgtgtgcagaggttatgagcatttcactaaggagggtgatgcttcttcaggtccaacagcattctccatgtaagatgatgtatgagaactattctcatggtgcttttagcaaaaactgcctcatcaatatgtgttttcatacacaagttccttgctacctttgaattccatgatcagtg

SEQ ID NO: 22023 - DNA, 201 bp, Bos taurus
atgataaccgtactgtatcacacatcaagctccagtgtaattgcctgccttctcctgtttttcctgtcccttagtgtgcatgggcttccctgataactcaattggtaaagaatccacctgcaatgcaggagaccccagtttgattcctgggttgggaagatcccctggagaagggaaaggctacccattccagtattctgg

SEQ ID NO: 22024 - DNA, 201 bp, Bos taurus
gaaggagatgatgtcatgtggctcttctggcccactgggtttctaaacctgtatacttttgagcagactggcaccaaatgtggtcttatgagtctgaatgcttaatttggcccccaaagatttcctaatggggagtgcacttcctaactccactatatctgttatttctctcctacaatccattcttcacgtaacaaagtg

SEQ ID NO: 22025 - DNA, 201 bp, Bos taurus
ggctcctgtgatgctctcgagcactcctgcagcattttttatactgccttccctccttgtgatcctgtgaatttttcagaaaataggaccatgctggattaatttgacatctctgatatccaagactatttttgggacacagtagtagtacttaatatttgttgactgtaatggcttccctggtggctcagatggtaaaga

SEQ ID NO: 22026 - DNA, 201 bp, Bos taurus
gttttttattcttcttccatgggggaagctacttgctgaaagaatctgtgtatgtgtttagtgatgtgtctctacatgtctgaagacaatgatgtgacaaggttctgtgatctcgggtgatacactatcatagtatgtggccatgtttaaataaaactaaaaattgatccttattaaaatcatcaaaaggatgaaaaccac

SEQ ID NO: 22027 - DNA, 201 bp, Bos taurus
tggctcctttgaacaagaagccaattatcaacttaggttccaaatcctatacagctgttccctcaccttgagctagctgacttcactgttaacttgaaaagtttgatgtgtttgtgtctgtgtgtgcacagctcaaatttacatttccaattaaaacaatgtccggacacccataaaatttaggtaaaagaaaaggtaatt

SEQ ID NO: 22028 - DNA, 201 bp, Bos taurus
tgttacctttattatatgggagaagaaaaataatctgccctgtgctctagaggaagattatcaatctgccaaggctgtttgctatgcaaatactttgggaagatagttctaaacatggcaagtcatttcttctgctcacaagatgtgagacacccatagaaaattgtcccccaatatggcctctatatggcctctcactat

SEQ ID NO: 22029 - DNA, 201 bp, Bos taurus
gttgtccttcctaaactagaccatcaaagatgaaggggaaggggagtaccacagtcgtctgattgttggcagaacccagtctgagatccatcatttgatgattttgagaaccaactttatatatgttttccagttttccggggtagaaagttgtggtctttctccccacacaccccaccctagcctttatgcactcgcact

SEQ ID NO: 22030 - DNA, 201 bp, Bos taurus
atgaagaaaggcatcttcaacctcaaaagggcactgtttggtctggtcttctttcaaagagtagagagtccaagatgaaagcaaacctggcgcttttaccgcagtcaactgggggaagatgtcatttaatctactggataatagtgggaataagtgccagagtcatttcctagaattaatgagaaaatggcacgcaggcac

SEQ ID NO: 22031 - DNA, 201 bp, Bos taurus
atagaataaggaatatagatgtaggagcataaacattttgagagaaaaagaggtcactgaacgagtgaccacagcaaacaaaaaatagaacactcatttgtaaaagttaaaaaaaaatgttcctctttgttaccttgtatccacaaaatgcatgttttaaagcaaaaacccacatggaataaaaatatagtgaattttaaa

SEQ ID NO: 22032 - DNA, 201 bp, Bos taurus
aatctatttttttggatatgttgcattatgagttcttagcaaaccatctttgcagtcccataattaacctcatttgtttatgttatatggaataacctgcataataatagcttgtgaatcatttttcattgatatttataagtaattttgatgttaaggtatgtattgtatgtgtgtgggtagttctcttgagtaaatact

SEQ ID NO: 22033 - DNA, 201 bp, Bos taurus
tccagacaaatttctctgtatcttcagaatctcaatccagcaactataagtgcaccagatatgaaaaaaatgcccccaaaatatgtagtaaagagaaagccagctgtaagcacgcatagcatagtgtagatttagagcacaggctctacattcagagagactgagtcttccttttcacttagtgttgagtcttgggtgatg

SEQ ID NO: 22034 - DNA, 201 bp, Bos taurus
taattcattcttgtcactgaatcagggcatcaagctagggttctgctacacaatatgccaaagaaaaataaaagactgctaggagagttttctttcccagcgagcagtttgcctaaggtgttcacacatccacccactgaaatttaatcattaatgtagcacattgccagagagatgaaaggcagtaaagtgacataggtt

SEQ ID NO: 22035 - DNA, 201 bp, Bos taurus
tgcctgactgatatgatcattgaagagagaatatcagagttagctcaatctgaaagaagataacattagctaaacagacaggatcagctttgcatacagacaaatactgctgtactttgtggagatgacaaagttcccaggggcttaaataactacccctacttcctgattcctgcctaaaattttgttatgtatttatcg

SEQ ID NO: 22036 - DNA, 201 bp, Bos taurus
tgtggccacactacttaactctgaactactgtgagtgggaacaacttgaatctctattgtttgaaaccataaaaaacaaaaagaaaaaagagacataaaacacttaggatatctaccttgaaagaaaagcagtttctgaaaaacagcaagtcatttgttccatgtagtcacctaaaattgtccttatagaatagtctccag

SEQ ID NO: 22037 - DNA, 201 bp, Bos taurus
aagatctactggaagcccttctctaaggccccagtgttggggaaaactatgctacttttgaacagtgtaggatgacacaggagaccttcagcagactgtggtatcttctttgcttggccagtaaaaaactcagaatgaaatttgcaatccagttctgcaatgttccataaacttattgtatgatttatttttatctattta

SEQ ID NO: 22038 - DNA, 201 bp, Bos taurus
gaatgactaaaacataacatgtaagaaaatatttagctaatataaaaatttaaaattaagtgccaggcataggtacctatgattcagaatgttactaattaatttgcaatcttgctaaagttattattttactgagcatgtgtgtggcatgatttccacattgtgaatttgattgctgttgttatattgggtgggtccaag

SEQ ID NO: 22039 - DNA, 201 bp, Bos taurus
ttcttgttgcttctgtctcaaaagccacagcaccaggcctcctgaacagaaagcacccaaccccctcaaaagtgagcaccctgctccctctagtccagcaattctagttcttctaccggcctctgtctgtgtctctgcttctatagctttgttctctgtgatctgtgactttcctttttttgttagcctttagcgcttcat

SEQ ID NO: 22040 - DNA, 201 bp, Bos taurus
atcttcctgaaacaatcattatattgctgcttcttccagataaatctgtcctgaggctccaacaatcatgataaatataacactttctaatttaatgctactttgattactagcattgcaacattatttttttccaatgttttattcttccctagggttttagatctttatagagcagactagcaccaaagcaccatttac

SEQ ID NO: 22041 - DNA, 201 bp, Bos taurus
tttctcaggaaagttgccacatttggggcctacaggtaaaccatctgtaaacagggggctacttgaaatattcattgtcttggaggcatctaccaagtgaacttaagtagctcatatggagtggaagcaacgttgctcatagactctggaatcctggcttctcagaccctgtttagtggttgcctcaccttgaacaagcca

SEQ ID NO: 22042 - DNA, 201 bp, Bos taurus
aagtgtctgtgcccctgctcacttcccgctcgctcctcacccggtccggactggctcctcttgttactagtccacagactcggcctcagcctccagtgacgttctggttgctggacttgggggatcttgtcttcctgtggtactgacttgtgtctgattcacaagcatctcttcggttctctcacactttcctcctgtctc

SEQ ID NO: 22043 - DNA, 201 bp, Bos taurus
ctctgtctgcatgtcatctgctgccactgtctcccttctttttttacagccatactggactccttggagtggagtttctggaccacacgcaccaagcttagtccatctcagggcctctgcatcttccagtgcttatggaattcaccttccccagatctacatggcttgttcctcaatttgttcaattctctgctcaaatct

SEQ ID NO: 22044 - DNA, 201 bp, Bos taurus
tggcccccaggctggaacttccctgacagttaaaggtacaccctaatgctggcttcagggggttgttgtttttgtggctgttagattaatcctggacacaatgcaaaaggctgaggcctctcagaaggtgggtgggaaggggcagcttctagagagtgaaccaatgccctggggtgcagtacactcggcagacacaattcg

SEQ ID NO: 22045 - DNA, 201 bp, Bos taurus
ttagtatggatcactgtaggaggcctctgggaatcccacaactttttttcattgtcaccatagcattccaactgccttaaccttcatgcctgtaaaaacaggtactttttcaaatttgggccatatctcccatgtggcagtgttctgggttctttgtcctcaatgtggttatgaccactctggaaattcaagaaagacata

SEQ ID NO: 22046 - DNA, 201 bp, Bos taurus
atgaaagcttggtgtgtttgctgatgtaacacctgattccagttagtgtagttttcttgcctgaatttatgtctttctgaagttctcatgatttctgctttgtgagagctgttcattgattttttaccatctctgttctttggaaactttcctgagttttctaatttgtgatctttgtttttccttgttggatttgcttca

SEQ ID NO: 22047 - DNA, 201 bp, Bos taurus
tttcagtttcctcaactatatgatgtagttagtattccttaagtttcagaagaatttaagatgtattatgtgactataaattatatcattacattgatctatttttatatactattcccaagtttcctgctttgtgaatatgtaagagcttttgggatttaaaaatgaggcaaacgtttttcacttggaaatgaaaatctt

SEQ ID NO: 22048 - DNA, 201 bp, Bos taurus
aaatcacttttggagcccgcaagacagagctgcactcatgagacggtggcatacacagcaaggaaggcttgccccccttcccttctcaactccctgccacgacaccttgatatttttagcctgtggggttgggatgatgaatacccaagtggaaatagtgttggaaggagatttttcttggcaaaatggcagcaaaggctg

SEQ ID NO: 22049 - DNA, 201 bp, Bos taurus
aatccaaatcatcctaaatgtctggattgtggtaaactagacaaaaacagaaagaggtggtcaagtggagaaaagcctgtgctctgctgcagatctatagtcaggctccaggatgctatgaggagggcttgctcagctctgaatcttacattcaggcggtgtgtgggggatggggagacagaggaagctgggggtcactca

SEQ ID NO: 22050 - DNA, 201 bp, Bos taurus
attccttccacttattcaaactgagagttgagtttctgtttcattacctcagagaaaagatgacagggccaatgcagaattagcttgcaaatctttctggattttattttcccaaagcttcataccttaggagtaattagcagatgagataaaaggaagaaaagattttccagtatatgcagaaccttggatatctacagg

SEQ ID NO: 22051 - DNA, 201 bp, Bos taurus
cttgcctccaatttgtctatcatttttgactgtgtgagaaggaaagtgctgggtaaaaagaggaaacaggagaagagataggaaacacacaggaaaaccactgggagagaaaaggtgggaagtgattctatcctgagatttcacaggcatattcaaagctctagaataaaatatgcactcatttctggggcaagcatctgc

SEQ ID NO: 22052 - DNA, 201 bp, Bos taurus
tatttgtccactgaggcctcttaggttgtttccatattgtggctatcatgaataatgctgtaatgaacatgggagtgcagatatatctttgagatactgacttcattccttctgaatacatactcagtgtgggattgctggatcatattgtagttctatttttaatttcttgaggagcctccatattgtcatatggttttc

SEQ ID NO: 22053 - DNA, 201 bp, Bos taurus
ataggttttcttttggaaacaacactagtttccatttatcatgtagatttaagcccttattgcattgctattaatatactatgacaatgaatgcaaaaccgctggagaaactaaaacttctctgaagcataattagaagtgagaaatgttctgagtcccaggggttttttttctgaccatttatattctgaccaacataaa

SEQ ID NO: 22054 - DNA, 201 bp, Bos taurus
ccacctcaaccagaccagctacaactgtgtctggtttatctatgaaggttctgagtaagattttacttgaaattatttttttcttgaaaactagaaactagatgatcttaatgagtcctgtaaaccaaatcttcaaaataatcttcaaaagttttcccccaaattaacttctccttcagttctcttaggctaatgataacc

SEQ ID NO: 22055 - DNA, 201 bp, Bos taurus
agtacggaccccttgggctggctcataaactgagtgggccagcctggggacgaggaccaagagggcttcaggagatatttcaaaatgagagtaaacactcgtctgcaaaggcctgtgtagcctactagcaaaaagcacatgtagtccacgtatatgaaacactaaagccagactgttgtagatgcccagtatgctcgtcac

SEQ ID NO: 22056 - DNA, 201 bp, Bos taurus
aaagtaaaataaatattactttacttgcaggctgctgtggaaattcaaggtgaagtatacgtaaagttctttacatgtaatagtcgcttaataggtggtaactatttatactgaataataataaagacaatttctctctttctgagttccttgctttccttaaagaatgtgtgctttcctcccttcgtgcttttatcttgt

SEQ ID NO: 22057 - DNA, 201 bp, Bos taurus
tcaaactagggtatgaaatctatgacacgtgtacagacatcacagtggcaatggcagctgctctgaggtgtgtttctaagttcaacagctccagagaaatcgtggagtttaagtgcgactattccaactacgtgccaagggttaaggctgtcataggtgctggctactcagaaatatccatggctgtctcccggacgttga

SEQ ID NO: 22058 - DNA, 201 bp, Bos taurus
tattaatcattccactcataatgaacttttaagatttgaatcagggggagtataaaagcatttactggatcagtcgttttaaaaagtaggagccaaatttcgaactctagctcatgaatctgttaatgtcaagactttcttttctttcaagtatctactcctactcctcagaaagaaataaaaatgcatatttacatacac

SEQ ID NO: 22059 - DNA, 201 bp, Bos taurus
ttccccaagttcttggtgttttattttttggttgacggggatggaatcttccatggaaggagttaagagaaaaaaaagttttggatgaagagggcgtgcagatatggaaggcagcaacgcagggcactggctttgcttaggtttgctaggctatatctgggtcctagttgttctgcaagtcgcagcgtcatgtctccatag

SEQ ID NO: 22060 - DNA, 201 bp, Bos taurus
aaataaaagcctggagattgagcatcagtcttctgagaatggtctaaaagattttactaagcattccatgacaaacaaaactgttgctatagctttcaaacgcatccttttgtgtgcagtacagtttgtcgaagttaagtaaatatgactcctggttacatgtagacctctttaatatctccaacacttttgaccactttt

SEQ ID NO: 22061 - DNA, 201 bp, Bos taurus
aggtcaccaatgcaaaaaaatcctcccgagtgtttcctctgaagcatggtcctggtaccaggacacacatgttctacagaaggcatttacttcccaaggcccctgggactgcagccttaactcacttcaaggatcccatcccttaatgttaataagaaagcagaaaaccaccaacagactgtaactgtaccacaggtcagt

SEQ ID NO: 22062 - DNA, 201 bp, Bos taurus
gaaaaatcaccaggggagcaggtagaagagggagcaaagatgcagcaggaaagaggaccctgggcctcaggggcagctggtggcttggtgaacctgatcacagtgtgtctgtgcaggagcaaaggaccgtgaggtccaagaaattaccagaatcttgtgtgccctgctaaagacattagattctattccaaacatgttttg

SEQ ID NO: 22063 - DNA, 201 bp, Bos taurus
cttgtcgctgttgagtgaaaaatgaatgagtggataaattttatgctggtagactgtagttataactttgtcaccagttcttgtgtgaacctgaaaaaaaccacttaaacttactgaggaagatgagtattttctgtcataggcatcattgataatttaaagaaatgatggattcatgtcccagaaaaatgcatatactca

SEQ ID NO: 22064 - DNA, 201 bp, Bos taurus
tttatttggtaatttaggttgcaaaaaatgagggttggatactttaatgaagctgctattgggtgggagggttgcccagtagacagggcagaatcctaagtgtcaagcactatactccacatgcagcccattgtcttttcctgcaggtgcctttgtcataacgatgagtcttcagaattttcagattttatataaatgttt

SEQ ID NO: 22065 - DNA, 201 bp, Bos taurus
atattaaagtttgaaatcaccactctaaatttgtggcacatggaccatagaaattgggtttctagccttcctcagttgtcattttaattttgtttctgttttcttccttagcttgaatttttttcagtaatgatgaccacagacttctaatacctaggtgtcttttacttgctgttaaagcttattatctcctaaaagccc

SEQ ID NO: 22066 - DNA, 201 bp, Bos taurus
actgaggttctgtgggaaatgatttaggtcaagggtaccagagctggtggcattctgagcagtgacacacctgctgttcacaaatgatgtaaattgaacagacacttctttccctgtccttgttagcctaactctctggaggaaatccaggagcaggggacgatggagttcatgttacctagcaattcatcacataaatct

SEQ ID NO: 22067 - DNA, 201 bp, Bos taurus
aggactgaaaggatctagaaaatgaaggttttttgttttacatatagagaggaagccatatagcactaaaaacatgcatgcttaaattatacacattaataaagagaaaaagaagcggggagtcccataaagttctagggactcttctgaagagtatgatacctctgggcttcctgcaaagaagggcttagggactagaca

SEQ ID NO: 22068 - DNA, 201 bp, Bos taurus
tcctggcatggttgggtcagggatgcagtcagagcctaacagatagaaaataatgtctcttcacacttcttgcagaatttttaacagagaaagcaaattcgaaaatgactgtcctggaattatggcagatttcaagctaactcgttatatgcagtttactgaagctttccatatgcctgcaggcaagtcagtatgtaagga

SEQ ID NO: 22069 - DNA, 201 bp, Bos taurus
gttttctttagatggcatatcatatatgtttggatcttgcttttttagtcaatattgaaatctctgtattttaactgttgtgcttagtctagtcatataatgtgattactgatgtgattggacagaggagcctggcagacttcttggtgtccaggagttcacaaagagtcagacaggactgagcacacatgcatagagaca

SEQ ID NO: 22070 - DNA, 201 bp, Bos taurus
gttgattacttttactattggtatagatcttaaatgtaggagccaaaaggtataatgtctctgctaacgaattacaggcagagcccatataaactatcaattttattttgcaattccattccctcagggtcttcagttggaggaaattcctcacagtttattacaatatgttgacagccatcccttaatgttagtgtgttt

SEQ ID NO: 22071 - DNA, 201 bp, Bos taurus
agagctggtgtgtgggcccaggccgtccactgtgctgtgctgctgcttctgaacagatgttttttggtttgtctgtttgtttgtttcagttttcttaaaccgggaaccaaaggggggccccgttaagttgtaaagcaaatgcattctagcaactgagatttatgacagttttcaaattagagtgaattcttaaggaattca

SEQ ID NO: 22072 - DNA, 201 bp, Bos taurus
ttaaaaatggaaaggatactcacagaactactttaattcttcttaatctcttttgatcatattcacttgaaaatttgctgaaaacttggccctttctctatgggaaaaaaaaagagcatacacacaaaaatttgtattgaatttcagaggatttgccaactatttctgtgaatctccaaggactccttgggcccatgaaag

SEQ ID NO: 22073 - DNA, 201 bp, Bos taurus
actgaacaacaattctgctcaatgttgtttatgctcaccaagactgatctatccagtatacataacaggaaaaaatataatatgaaataagggatagaaatgccagtatgaaatatatcaattttcaagggcactggggaaattgaattctgactagaaaacaaaatgcttaacaccaagaagtgtcttaaattaatttta

SEQ ID NO: 22074 - DNA, 201 bp, Bos taurus
ataaatctgaacttccaggtatgcaccacagatcctaaaagttatttcatggtgaacagcctcatctctagccttttttgtgcttcttacttggcctgttcaaagcaccagcaccacttagagcagcagcaggtaaagagcagtgctctagaaatcacaaatgtggagtaggccccagctttacattatttattgaaatat

SEQ ID NO: 22075 - DNA, 201 bp, Bos taurus
aattttattgctataatctgttagaagttagaacctgactttcaatttccagactttcaaaacagtacaggtgagctggccagaaattttgtaaaatcctacagccagtccagcagtacctgttgaatgactgaatctccatgacagtaaatgactatgctcagtaggagctgattctactgaatagaacggaccatttct

SEQ ID NO: 22076 - DNA, 201 bp, Bos taurus
atgttaaattttagtttaaccttagtttggatatttcaaagtcttgtgtgtgtgtatttatatctatgtaaatgtaaaatttatataaatgtatctctcacagctgacagatcacactgatggttgtgaattttactgagcacactcagagggcaaacttctttcaaaatcggggtgttgaggtgtgcacatcagtatttt

SEQ ID NO: 22077 - DNA, 201 bp, Bos taurus
aggacggctcacactgactggagttaggtattcccttttctcatggtcaattaggctttgattgtattctagtagatttggatctggttaattagtttctcctgcttactccttgaaagaaaagttatgaccaaccaagacagcatactaaaaagcagagacattactttgccaacaaaggtccgtctaatcaagactatg

SEQ ID NO: 22078 - DNA, 201 bp, Bos taurus
agagagagagaaatcccatgcttgggctgacatctggtaagtaggaactcatctgccctttgagcaatggaatctgaacttcagtgagtagaggttacagtgagtccaaatcttttaaaattctctttgcctcattcagtattcagaaatcaatcacagtggagctattgtcgttggtattgctcaaaagcttcaataaat

SEQ ID NO: 22079 - DNA, 201 bp, Bos taurus
cagaaagtcaacagtatgaacctcacttatttaaacattattcattttcaataaccattggaggtggctacaatattgttttaaaaccacaggctattcatgaatatcttaaaatctcccttgaactaatttatatttccagcctcttgtaactgttctgtgaagtgtcccctttgatcctacttctacatcaaccttcgt

SEQ ID NO: 22080 - DNA, 201 bp, Bos taurus
tgaatacagaccgtccagacaaaggccaaatccacagaggagcagtcgctcatggagtcagaattcagatgggaactggggctgtggcagaaatctgcccggtggaaactgtggccacagaacggacttctagaaagagatggaattacggagactccgattatgctagaaatgcaatccaaagcccagggagatggcaaa

SEQ ID NO: 22081 - DNA, 201 bp, Bos taurus
cgacttagcgactaaacaacaaccacaaatacttaagtactcttttacctgaaagagtaatatgatgttcagggtattttttctaagcttttaatgttaactcatgaagttcatgcattctcaaaatgcttaataaaactaaacctgctgggcttgaactgaaaaataaatggtttatatgagttttaatctaataaaaat

SEQ ID NO: 22082 - DNA, 201 bp, Bos taurus
gaagctgctcgctacaacccacacctcctctgaggccacagagagcaaggatgtggcagcccaggaggggcggagaacaggagacagcagtggtggaacgcacatcagacggccccagacatagtcaagaaagtgggcctgaggtggaagttttctctcatgaacatcagaccacaacgcctcagctcactccccgagcct

SEQ ID NO: 22083 - DNA, 201 bp, Bos taurus
aaggagatagttagaaaaataaatagatttccaaaaatgaaaagtttataactgaaattataaactcaatggacaggtttacagcagaaaagtcatagcaggagaattagagaactagaagctgaacaaattatctagaatgaagcaaagaggtacaaaggggtgggaggaagcagtaaagaaactgagtcatagaaaata

SEQ ID NO: 22084 - DNA, 201 bp, Bos taurus
ctactgtatggccagcctattggatgttgccacccaggaacgtggatcttcagcaactgagagaagaatgaagagatagcttcaaatccacctccaggctaaagtccctggcagtgtgaaggccctaacagagctttttacccatcctcgggcttcccaggtggtgctagtggtaaagaacccatctgtgaatgcaggaga

SEQ ID NO: 22085 - DNA, 201 bp, Bos taurus
aaagtaaaattaggacttaaaaagtgtgttcagaagtgagcttggcatatttcagggtaagtgttaattctagtttcttacagtttcctttaaaatgtaggacttgcctatcaaaggaccatgattactgaccattggcaattttcactcattcatttatttgttcattcatccagcaaatcaacagatacataaagtggt

SEQ ID NO: 22086 - DNA, 201 bp, Bos taurus
cggaatggtcattaatcagttttacagacaaaaactaaagctgagaacagatgggacttttattatagatcggtcagccagaacagtttacaccaaaccagtagggaactgagcttttaaaattctgtgtctctgctgcattattatacccctccatttccccatccttattatacccacagatatagattgtgcttggac

SEQ ID NO: 22087 - DNA, 201 bp, Bos taurus
acagggcgctcagtcctacagctgcaaggaattgagttctgactcatcaattcagctcagaagagaacctcaggatccgaggaagatacctaatagttattggcctcataagaaccagagcacaaaacccagtcacatcacgcccagatgtttctcaaacagaactgggagttaataaaggagttttaagttgcataaaca

SEQ ID NO: 22088 - DNA, 201 bp, Bos taurus
cgcagacgtcgtcggcagggtggtgagcggagggtgagaagtccagcccccagcaccacttaatggaaaattaattggacctggaggactgaagtaataattcggatttgtcttagaacacagtgttgggctccctacctcattaacttcttggctcaggcattgagtagttattttattcagttttgacctcttgagttt

SEQ ID NO: 22089 - DNA, 201 bp, Bos taurus
ctttccctatatatggtctgattttttttctttttagtttattaaacagctttatattgagatataattcacataccacacaattcatccatttagggtacgattcagtggtttctagtcactgcagtcaattttagaacattatcatcaccccaagaaagaaaggcctgtactcagtagtggtcactcccaatttcctct

SEQ ID NO: 22090 - DNA, 201 bp, Bos taurus
tgtaaacagactcaattcatgtttcaccactgtctcttcaattgtgtgaccaaggatgggttactctctgagcctgatttcctcagctttaaatagggatacacccttgcagaattgttgagaggagtaaatgaatattgcaaggtgaagcacttagcatagtgccaggatatagaagcatttggtaagtaattagctttc

SEQ ID NO: 22091 - DNA, 201 bp, Bos taurus
atgttccatccttaggaaggaagagggacatcagtttcctttgtggtttgtaattagttgtcactgatttaactgaaatgacatatgatgaatcttaatagcttcaatatgaatacagtattatttgggccacaggtattgctacaaatgttgtagtatgataaatattgagccattatgaagactcatattacagtgtaa

SEQ ID NO: 22092 - DNA, 201 bp, Bos taurus
gaagaacctgcatgcttaattttgaaggtgaaagagaaagggagcaaaggcatgttactggttagtatttagaaggttgccatttaggtaaatctgtatgtttaatgtttgtatatgcagaaaccatttctgcaaggaaacgccaaaagctggaaactgggctccagggaggaaaactgaggctgagaggtaggaaagtag

SEQ ID NO: 22093 - DNA, 201 bp, Bos taurus
gctacagtccatgaggtgacaaagaattagacacgacttagtgactaaacgataagatcaagcacaactatagatgcatttgccctttgacccagtcaccccacttctagaattatacctcaaagatattagaaaaactactgggtgatatatgcataaaactattcacttagtccaatgtgtaatagccaagactgaaac

SEQ ID NO: 22094 - DNA, 201 bp, Bos taurus
caaggttataggccctaccatgttttccccactccccccccagtctctgcatcactaaggcagcagccgcatctgggccctgcagttttcagctgtctctgatactttctctgagaaaagcccagggtaaggagcagtggtgtggcaatgcctacttcagcagcaaggacagtatggccatgaggcagcagtatgtcacat

SEQ ID NO: 22095 - DNA, 201 bp, Bos taurus
aaccccaagggccgcggcatgccagtcttccctgtccctcaccatcccccggagcgccagacaaatcacctgatcctatcattgtcccaagcttggatttgtatttccaattctggtgaccagatctagtcaacatagttagaacactcctgcctctaacacattcctcacacctaattagttaccaaattgtaccatgtc

SEQ ID NO: 22096 - DNA, 201 bp, Bos taurus
tgctggctggaagcgaccaaaacgtccaaggacagaggaaggctaaagaagaaggcgtgtgtgtccgtggcggcgtaatattcagtcatgaaaaataatatgcatggctgagttccttcactgtacacctgaaactgtcacaaagtgttcatcagccatatcccaatacaaaatgctttgggggttaaaaaactaaataaa

SEQ ID NO: 22097 - DNA, 201 bp, Bos taurus
aaatattccctaatgaaaatgtgttaacattccaagttattttcatgattcttaaagttttatcatacttgggcaagtttgatgatcctatttgaatataatcatcctacacatacgagccacgaaaacattaataattgtcactgtttacaaaaagagggagggaagaggaacatcattaggagaaaaatgactaaaagg

SEQ ID NO: 22098 - DNA, 201 bp, Bos taurus
agattcgtcaagcgaacgttctttcccgtttactgtcaagcccgtcgctctgcagaagcagaggcaagggtgggagtgacatctgcgagcagagcaaacacacgtgagcagtgggaaggagctgcggtgcacggggtcttacggcctcagcgagcagagtccattctgcggcttagtgtggtccagggtgctcccctcctg

SEQ ID NO: 22099 - DNA, 201 bp, Bos taurus
acctactcactcactgttcctcatgcattctggtgatatactataactaatcatatatatttatatcatttgggtctataaaaaagattatttgtgataatttaataatcatgcaacttcaaatgttaggttttaattttgaggatcatttctacattttactccttttctttggattagccagctattttatgagggcca

SEQ ID NO: 22100 - DNA, 201 bp, Bos taurus
cactagaaggccttttcccactttgaggttatttaaaaattttctcctatgatttcttctaggaccgtcaggattttgttttatatatttaagcgtcatttatctatttgaaatttattttggtgtaagatgtgaggcttagaggcttccctggtggctcaaaggtagagaatccacctgccaatgcaggagatgagggtt

SEQ ID NO: 22101 - DNA, 201 bp, Bos taurus
aaatctccatctgcaaaatgggcgcaatgtagattgcggtcttttaagagctaacatcgctttgcaaaaggcccctaacaaacccctcaccggccctcctcgcagctcccgctttgtccccacgccgccctatcctgagagaccctagtttccaaactgtggaggagccgattcggaacttaaagaaacattcttatcaaa

SEQ ID NO: 22102 - DNA, 201 bp, Bos taurus
tgattatagcatgcagcagtttggaaactactggcatatcctggcaccttgactcgcatctccctgcagtgctgtgaaagtattagcgtggccactgcacgtcagggcacatcagggttgttcccccaagcaatgggggtccagcactttcagaccaggaggtgattcagctcccaaatccatcctgaggatctgctctct

SEQ ID NO: 22103 - DNA, 201 bp, Bos taurus
atggttcctgtttttcttgttgaccaatcagtatatatctttctttttaaattaatttatcctttttaattttaaatagatttcaaagaaggaaagtaactttttttgtagccaggggtaggaaaatttattgccagttgaaggtcaacagcctaagcagtagtagattgggggtatttgcttactaaagtaatgctcttc

SEQ ID NO: 22104 - DNA, 201 bp, Bos taurus
tatatcatgaatattgtaatatatgtaaattatagcattaaatgcaaactactttggcattgcagtttttttgcaactaaaaataagttgtcttctgtctcaatcagatttctcagtatctctaacatttgaaactaaattttcatgtaccataaaattactgttacaattagactttgttaaaggaaatactgcccagta

SEQ ID NO: 22105 - DNA, 201 bp, Bos taurus
acatttttgtgctacctttgcagagtagagagtcttgagaaaatgttctaggacaagtacatgtgctgcatgcagtaaactgagaaaactgcgcaaggccggttttttctggctccccgcttcatctggtcttggagatcggatgctcttttccccccggcacagggcacacacctttaccgagggtctcctggccagctt

SEQ ID NO: 22106 - DNA, 201 bp, Bos taurus
gagcctttatgagctggtgttcccgtaaattctaaccagccctgcagctcagcagagcccccaggggagcttcagccacaggtgggcccccaaagacactcgcttcccagttatcctactagttttcacctaagtgacacttattaagctcctgttgtgtgcctaaccttgtgctgggtattgtaggggatacagaagagg

SEQ ID NO: 22107 - DNA, 201 bp, Bos taurus
atatggtatctttcctattaaaaaaaaaaaagtcctaatctgtattaagcaagagataatgagagtgtatatacagagaaggcaatttaattatagaaaactgtggggagaacatcctgaagagagaggtgactcagcatccaggctcagcctggctactctgtttctaaatgacctaaacctaaaaagagagatgttcac

SEQ ID NO: 22108 - DNA, 201 bp, Bos taurus
ggcatcaggccagagagaacagcggccttctgctcccctcagtcctggagcgtgacccgtgtctgctgtgcatttgttaaccgttgtcagaggccaaggccgccgtgttctgtcagtgtaagtgcactttttagctcctgttatgagagagcttataaaacattttctatggaatatacttaataacattgattttcaaag

SEQ ID NO: 22109 - DNA, 201 bp, Bos taurus
attaagatggaaagatatataaatagcacttgataaaattacaaaaacttgtatttaaatttaattttctctgcaactgcagttagcattgtttttttccccccactggtctctgacatactatttttgagagagaaaaaaaaaatgtttttgctaccatggcaacaatatccttctcttgctttccatcacaaaccatag

SEQ ID NO: 22110 - DNA, 201 bp, Bos taurus
ttgttaggtctctacagtgtttgttttgtcctctttagtcagcacatacaaaacacctgaatataacctatttctaaagaacagttgtatactgagttgagtatcattaatgactgttatttgccttgaggaattttctgtctcccacccatacatggaacttgtttgattttaataacaactttatggatgaatggcatg

SEQ ID NO: 22111 - DNA, 201 bp, Bos taurus
gcatttactataaaatcaatgtagataaataaattaaggatttattatcttgtacttgattatttgtttcatctcagctcagcaggaaacagattagttataataccttttacttatttttcctcccatttcgaatcacttttcttggcaaacatttcagtaacttttatgcaagcatgtttgaaatggatacatgttgtg

SEQ ID NO: 22112 - DNA, 201 bp, Bos taurus
tgggttttcaatatgcattacaatattcaagatgctgggcagaggcagcagtccacgcggtcgcgaagagtcggacaggactgagcgactgaactcaaccggacctctctctctcttcccacaaacccctcacgtacaactgagatctctggatactcatatgtatctctggtactagcttgttgttctttggtacttgtt

SEQ ID NO: 22113 - DNA, 201 bp, Bos taurus
ttatatagtaagttaatgacaaggctggagttacaactttgaacttctatcaacctagtaaaccatgccttgctattgatagagccaactgtcgaccaaaatttctgctccccttccacagtacagacatgctaggtaagcaattacctagccaatttagcaatccagctgtggttatttgactatttctagcaggtttgg

SEQ ID NO: 22114 - DNA, 201 bp, Bos taurus
tataatatttctcttaggattggctgcatgtgtacatattttgggttaataataaaaagctaatagaaagttagaaaataaagtctgagatctcagatcattcactgaagggctgaaggcttccaagtctcccacttggtttcacttgggctttgtgccattggctaggattatatatgtttgaatatatatactaaaaaa

SEQ ID NO: 22115 - DNA, 201 bp, Bos taurus
atatttaatagtacactactaaaaatgccttctatttctcattttagtaacactactaggctagtgcagtacattttaaaggaagtgctaaacttttaatgcaattagaaaataatgactaaagggtttgtcattgaaaatgtgattattttactgcacagaaaacaaagcagccacaacacttctggtatttggaaatca

SEQ ID NO: 22116 - DNA, 201 bp, Bos taurus
aatatcaatgtgtaaagtgaaagggcataagccagtagtaagaatttctaggctaaaatgtgaagtttctaaatctcaaaaacatctcaaggcagaaaagtaactgcggcccactaacccaacctgctctgctgtgtgccttaggctgcacacccagaataagtacttttttcaaatctctaacaaggcatcaccagagtt

SEQ ID NO: 22117 - DNA, 201 bp, Bos taurus
ctagcgcccatgaaccacactgtattgatgggattcttaatgaactctctagcaacaatgcactggccttaataatttaggtcctgttaaatcgtgtctgtttctttactacatttggaactgctactgatctagaaaagagtcaatatcaaggggaagtattctctgcacttccagcatatgtccagtacatccaattat

SEQ ID NO: 22118 - DNA, 201 bp, Bos taurus
tacagggaaccttttctataagaccctgtaagtaaatataaacattgaaatacaataatattagggtcaagagtgaagccattcaaagtatgctttaatactagttttgagttacatgggtcagacatttggatcttaatatattactttacaggataattgctatctaaactttgtaaaatatttcaaattaatataatg

SEQ ID NO: 22119 - DNA, 201 bp, Bos taurus
tgaactcttaaagatctgcacacagttccaaaatgatcagtcctctatattgatacaaagctataaggttagcattgggaaaactgtattaaatttgtctctgttaattcagacatctgaattccttagcacaatttttaatagttttaagtttaataataacttaccatgttaaaaacccaaaatacttatttacttgca

SEQ ID NO: 22120 - DNA, 201 bp, Bos taurus
gcaaattatcaaagaccaaaatatgttgagcaataaggcctggggcagaagagaaggaaaaatcaacacgaagcagagaattaggaagttccaataaagatagttgcttccatttccatctctcctctgtcacctaagtctagactttgaaaattgcctattagtggtctaccatccccagtatcctactttaagctacta

SEQ ID NO: 22121 - DNA, 201 bp, Bos taurus
agttatttaaaaacagatgtctagaaaagtagtactatttaatggaataaaaaaaattcatttccaaatacatttacgcagaatcatatgctaatgctgagatgcagattgatgtgtttgagatttttccccaagtcttcctttattaaaattgcttttttatgattctgaatctgtttgggcagttttgtttacctttaa

SEQ ID NO: 22122 - DNA, 201 bp, Bos taurus
atgatatctctggtttagagaccagcttctcagatttaggggtaaatctaatcctggagatgcaaccagagtaacttttagttgggtgcataaattttgatgagaaggtattactggaccttaggaagatgtgagagtggatcttgcatcgcagtgaataggactctgaaaggatgggtcacaaagcctctgggtacaaag

SEQ ID NO: 22123 - DNA, 201 bp, Bos taurus
actttattagtttcacagccaatgggagggagaaaaatccatcattttcttaaacattttcctttagttgaaggaaatccttccattaagagctgtcaactcggagccacacagtgtcgttaagccacacagagggttaaaacaaaagcacagtgcaggttcctaatatctacagctgcttcacccctgccctcccactgt

SEQ ID NO: 22124 - DNA, 201 bp, Bos taurus
tttggattgactggttttatctccttgaagaacaagggactctcaaagagtcttcttcagcacacatttgaaaagcatcaattctagtttaaagcatcaatcattctaatcaaagaaacataataactgctggactgggacttccttgacagtcaagtggttaagatttcatgctcccaatgcaggagacacaggttggat

SEQ ID NO: 22125 - DNA, 201 bp, Bos taurus
cattattctatacctaccattaatttcaaacttctccccataaatgtatgctttatcaagataaattgctattttataatattcatttggcttttcagtgattccatggagcagtcacactttttcttacattatttcctcaattcagattatcccttctgcattctttcctaatatcagagatgcagtattcttttgaat

SEQ ID NO: 22126 - DNA, 201 bp, Bos taurus
ttcaatttgatgtggcttcagtattaccatttaactttagtaaattaactaagtagcttcagattcatagtattttgcaccttagatatgaatgccttaacctgtttcattatagtttgccaattaatgttatattgaaatacagatgctaaattttgtggttgatacagtttatttcaaagtgatcatgatatctctaat

SEQ ID NO: 22127 - DNA, 201 bp, Bos taurus
cacagctattatttttagactgctccagcgtcctctaacgggtgatgggaaaggctggcatgatgttgggagaggtgtgctctttgggaggcagaaatgagatttgagtctatcaggtccacttaggtagccttgtgttttattgtggtggttatttttttaatagctcctgtgaaagagtttagtgaaagaaatcattac

SEQ ID NO: 22128 - DNA, 201 bp, Bos taurus
tagttaatatttttccaggcaccttttttttccatttcaggcacccttataaaaataagactctagttctaagagcaggcatttggacctttctggcagggactcctgccctgggcaagcacacttgatgatcacacggtacatggtcccttctctcatgaccatctgctagactggctctctgcccactcacaagctcac

SEQ ID NO: 22129 - DNA, 201 bp, Bos taurus
ttcagtccagaaagggctaaaacttgctgcccattggtttctcaaagtgaacaataaggaaatcatttggaagggaaaaagtttccagttttctttgccaatcagtgtcatagtaataaaattcagatagctaatatattttaaaagcacagagttagtaatgctgacataatctaatgaatctgctaaatgattaataat

SEQ ID NO: 22130 - DNA, 201 bp, Bos taurus
ggagactattcaggtgggcctgacctcatcaggagagcactttatgggaactgagcccttttgaagtcagagatattggaagtgtgagaggacccatggaggaggccatatgacaaggacccaagagtagcttctagaagctgacaactgtccctggctcatggttaacaagacaacagggaacctagttgtacaactgta

SEQ ID NO: 22131 - DNA, 201 bp, Bos taurus
gtagaaggtagcaattggagttgagtcatcctgctgttttctctcagctggtagcatatgtctagcttcctcaggagcaagcctctacttcttttgctcagctacttctacatacaaataaaaaaaccattttggttgtaattagtgcttgccaagttttgccccagtcatttttggcacttctgataaccattgtttcaa

SEQ ID NO: 22132 - DNA, 201 bp, Bos taurus
agtatataaatataaatgtatattttctcttgaagtgcttatttatttcacgtctagtgaaactaagcatatgttgtttattgaacatttgtagttcttcgtgtattactaatcaaattctcttaatcatatgagtagtcaatggacaattttattcctacttgtactattaaagcttagtagatacaattacagtgtaat

SEQ ID NO: 22133 - DNA, 201 bp, Bos taurus
attcttgcctggagaatcccgtggacagaggagcctggagggatacagcctatggggtcataaagagtcagaaatcattgaagtgacttagcacacatgcgcacacacatatatatgctgaacaagaaattagaggcagctttgtattttatacatttctggttttccttaactttaatattacttttattttcaaaactt

SEQ ID NO: 22134 - DNA, 201 bp, Bos taurus
gtcaaatgaataaatatatattagccatgagtttaaaaaatagctcaattgtccagatgtattcaatctggcttactcaaattagctccactattttactgtcacctgggaattgactatgcaggtccactgctttcctgaaattttcgcatcagtaaaaattctacattattctgataagaatgtggatagtatagaaaa

SEQ ID NO: 22135 - DNA, 201 bp, Bos taurus
atcaccaaggaagtccttcataactgcttaatgctgacagatcatcctctgactcctcataatgattagcaggaaattcatttgggtaacactgacttttcatggttcactgatggttcatatttaaaatgtgacaatggcaaatattatgctggatatgctattacaactccttttgatgttattggagcagcaccttta

SEQ ID NO: 22136 - DNA, 201 bp, Bos taurus
atagctgttgtcccacataccaaaataatacagcttgtatttagttagctttacttgagtaaagaatttaatcaagtatccataggtatgtacctgttctatctctccattcttgcctgcttttccttcccaggctctcttacaaccacacagaagccaaaacacaattttagatggaacattcaactaacagcagtctgt

SEQ ID NO: 22137 - DNA, 201 bp, Bos taurus
ctcagggtatgaaaaaaaattgccaaaagaggagagactctgaaaagcctttgttaatatatagaatattataatttactaatagagaaaagcactattacatacttaagaatgcaagttaaattataccagatgagtggtgtctttactcagctcttcattgactcatttcccaagttcttattgtgaaataatttactg

SEQ ID NO: 22138 - DNA, 201 bp, Bos taurus
tactgaccactgcagctctgacattctttggttataccttgagtgacctagattaaggatgcttggtagcaataatatattaggctgacaagaacagcatacaatgacatttattagttttaagatattacacatttccaattttctgaaccatggttaaatatctgttatcagtaatacttttactaaagctatcttaag

SEQ ID NO: 22139 - DNA, 201 bp, Bos taurus
gttcattatctcctcattacaattaaattagctttgccagataagaagtacccatcatataccaatggcgtcacaattctgatcaagaatatgtagggacgaaatccctgttcaccttggcaagaaggatccaggatgaaaaaaaaaaaaaaatcaacccaaactccttccttctcatcgtttctacactccctaataatc

SEQ ID NO: 22140 - DNA, 201 bp, Bos taurus
gaagaaagaagtctgaaaacttgaggaggaaagagagggcacatcaagaaaagacatagaacggaatatgatagactataccactcaatgtagtaaagataaatcaagttaaacaaaccaataatttatgcaatattctttttctacattatagttaatgacttgctaagagaaagaggcagtgagagctagaatgttgtg

SEQ ID NO: 22141 - DNA, 201 bp, Bos taurus
cgtgtagaagtaaattttaggagaatttggccatatagttctaaatggcaattctaaattccttggttgatacattgagattattcttgaatgactacatgctggtccatgaaacagtgaagcccaaaatgagttaaatgcaagaaataaaatatcttgcgttttacttgtgttctgctgcttgttttgattttggaacta

SEQ ID NO: 22142 - DNA, 201 bp, Bos taurus
tattgttaaagctgagctaagaatagatagatgacagctgatatccaataccttcctgaaaagcactcaatattgaaaaggggaatccttataggacccagtagtcccataactatgcaatacatagcccattacttagttaatcagagatatctctaagatactggatttctgattgcagatttagcacattaactctga

SEQ ID NO: 22143 - DNA, 201 bp, Bos taurus
atcttttttaaatacccttttaagtttggcagttttctttgagggtgccacctcctggtgtagcagcttctttgcgagttctgtaatagactctgaattctacagtgttataccaaacattcgccttctttttgaagtgtatggctcacatttcacacagatcctgtatgatgatttccttgcatagtgggaagtttttga

SEQ ID NO: 22144 - DNA, 201 bp, Bos taurus
gcaccatctcccagtccccatttttaaaaatcctatttctagtatgttcctcacaacagagttggcagacaaggtcaagatcagatctaacctgacttctggagagcacctataaggagcaggggacatgaacctttgccagatagaaatcactaacccaaggggaaaactctccccctaaaatggcctcacagttgggtt

SEQ ID NO: 22145 - DNA, 201 bp, Bos taurus
tcgagcccatcatttaattaaactggtatttgcattcataaagcagaaataaccaagggcaagggcatttcctcctatgtgtggcctacttctataatggagatgtgcacatctgtcaagtttgttgaaactgaagccatgtgtcctctgatgtcggatggtgttctggacacactgctttagcctgtctacagagcagtg

SEQ ID NO: 22146 - DNA, 201 bp, Bos taurus
aacacatttgtgtactctttagaacatggcaattctagattatctaaaacaagaatattcttggttttgattttgaatagatcatatatttaaagaaaagtgttattctttaagaatatgaaggggactattttctttagagtttggtcttggaaaattgccctacattgaaagttttgtcatgatttataatttagtact

SEQ ID NO: 22147 - DNA, 201 bp, Bos taurus
tcaaaaacacatgatgaaaatcaaaaaggagtacctaggccagttgaataggaggctgtcacagtaaccaaagaaggaaaatttcctgagtcagttgatcgtagaattaaatgtcacaggaggtcaacagaatggaggcaagaataaagtccaaggatttaacaatttcaagccgtgagacacaattctgatagacaactt

SEQ ID NO: 22148 - DNA, 201 bp, Bos taurus
agaaagtgaagggtgtgtaatttgagctaaatcaatgtctgccttacataactatctattcttcaaaatctattttgttcctcttttctcttctttcatcgtgggcttccctggtggctcagacagtaaagagtctacctgcaatgtgggagacctgggttgggaagattccctggagaaggaaatggcaacccactccag

SEQ ID NO: 22149 - DNA, 201 bp, Bos taurus
gcactccatggaggtttcagaatcctttttgaattaccattactgctttgtattttcagcattggcaaactggaatccagagcagtgaccaatagattcagatatcacttagttgcgaacaaagtctaacatgatttctacaataaatctggatccaggcttcttagagtctgttctctatataaatgaactaacccattt

SEQ ID NO: 22150 - DNA, 201 bp, Bos taurus
tttatattttaaccttagaaaaataaatgtatcagaccataagaatccacagagagagaggcgacaagggagaaatgtcagttctcccttgggaaaagaggttctccttaggggaagggaggttgcaactgctttttgacacttagcagtcagagtaagtgacaatgaaaagtagataatgcttgtgacaataatagcaat

SEQ ID NO: 22151 - DNA, 201 bp, Bos taurus
aaccatacccactatgcttggtaaactttgttgtcacatactctcaattgttttccaactatggtgcatccctcatgtcttatcacactttttagatatacaagggtgtttaactcatggctttggaatgagctgaagctaagtggctcaagctgagattgcttctttggttttcttaacatggtacattcaaaagctgga

SEQ ID NO: 22152 - DNA, 201 bp, Bos taurus
tgcttatttactcttgagtgtacactggctaatgaaaagccacacaaatgtggtttgaaatgttgtcacacatgataaaactgtcacagaaattttatcataaacatgactaaagcacaggaaattttctcggggtcatccttccaagtttcatcgtttctccacagattcttgagagactattttaataggaaatgtatt

SEQ ID NO: 22153 - DNA, 201 bp, Bos taurus
gtttatttgtcagagtttggaatctctagcgcagacactgaggtggaatttgagatgcaagatactttttggtactcaacacctgtgaaaaaaaagagaagacacaggattgggtagaaggagaaacaagcggatgttagctggttgaaatctcagtcaggccagcaagaaatttggcaggcctgttgcctaccaggatgg

SEQ ID NO: 22154 - DNA, 201 bp, Bos taurus
tacttggaccctggttatttggatggtttggattaacagtttgtgagagtatttggtgagtcattcgactttgttcaccataggagaatattttacaatccatttgcattcccttccctccatagaaccaaaatgttcttggcatgcaccattcctgggaacccaccagggcacagtacaccagtttccttgtgggaaact

SEQ ID NO: 22155 - DNA, 201 bp, Bos taurus
aaaccgtaagaaaccctcaggaaaaaagaaagcaatgggtgaaggccctaatgcagaatgagcactaagccattgggaaggtctgctcatggctcttagaaagccacgtggctttagcaggccatgttagagtttgttttctaattaccacacatgcatgagtatttggaccatattatctctgagctccattagatctca

SEQ ID NO: 22156 - DNA, 201 bp, Bos taurus
gttgctattccttctgttttactacttttgtggctgtgttatattatttagctttaattcctcccactgtaatttaaaccttttttttttttcttgttcactccttgatgaagatggaaaacagctggctgccaacaatcctttattttccctcaaatctttcctcgaaacaatacaaagctcactttattttcattgttc

SEQ ID NO: 22157 - DNA, 201 bp, Bos taurus
gcaaaaagtttatacctttactgttttcattttcttaatatatctcaactaatagaagaagtgcattacaatctttctgtaatttcttctcaaactactggtgaaggcatatctatacatctgtatttgtcaacctctctatccacaatgttaaatgcacacattgcacgatggttattctccctgttgagttgaaactta

SEQ ID NO: 22158 - DNA, 201 bp, Bos taurus
tcttcaaatatatatctgtgaacattgctcttcctcatgacctagtttcattggaactcctggaattgatgggttttattccactgctcagattcagctagtgtttgtgaagtgtcaactacttgtcaaattctgtactagctgcctagaagggactcccttgtgcaagataatcatggatactggcttcatgggatctag

SEQ ID NO: 22159 - DNA, 201 bp, Bos taurus
tgtaaatatagaacagaaagctccagtctcgagagaaaaaaatgcaacaaaactgccactaaaattgcaggcaaatcttgtctggcatatatacacggtggctctacaatctgaatgccagatattgtaaaatgattctaagaagtataaaccaggctgtctttctttgaactttcaaatcaatgttgtttggcattagat

SEQ ID NO: 22160 - DNA, 201 bp, Bos taurus
ccccaccctaggccttccctaccagacactctggggctgagacccaggaatctgagttttaacaagtcctccagaggggccagggagggggagcttgcaggttcaagaagctgaggatctctgttttagggaaaaggagagatcctgccaggggagtaagaaggttaaagcaatgcaggaccccacagggtagtgtacaca

SEQ ID NO: 22161 - DNA, 201 bp, Bos taurus
aatacatattttcttctttagcttctgtttgagtctctaggtctcaaacaggcctctaacagggcatgttgcataaagaaacctagaagtactttgatgcggattgaagtgcccaatgagccatgtcagaggtagccatgtccaacccaaccatgaggtctggacccaaactttaccctcaaagaagccagaagaagataa

SEQ ID NO: 22162 - DNA, 201 bp, Bos taurus
ctgcgttattttgtaaatattgtgaaagtgcttttgtttcttttcacctcgtctagtttctggtacatcttcaaggcctcggttccaacactgaaggtgtataagcaaacagcctgcaatgcaaacaagcaagtcagcaggattctgtgaataagcacacagatggcatcactgggccccatattttgtgtaaaagcactt

SEQ ID NO: 22163 - DNA, 201 bp, Bos taurus
gtaactattattttgggaaaataattcttaaggcaatgcttttattttgggggtaatatacttcatgaatacacagtgtgtgaagtaccagcacagaagctacacacaaaagtgggtacaaaatgaacactggcctttatgagcggagaaccaggagccccaggacctacttggctaggcttcaaatcagctttcccattc

SEQ ID NO: 22164 - DNA, 201 bp, Bos taurus
ctctggttaattggtattttttttaaagacttctaaaacacatgcatgcaaattactgtttttccaattcttagagactcaagcaaagctttcaaaattatagcctccaagctatgtttgaagagactgggcctcccctatacagacagaatacaccctcggagccttgccaacaaaaccgggggcaaagcgtgacagaga

SEQ ID NO: 22165 - DNA, 201 bp, Bos taurus
ataaactgagaagagatgaagacatttataagcactgaaatatttttgtggttgtatgtaatttaatgtgatgcacctgttttatattttgagaaacttactcttctgttttaaaaaattgatacgcaactgtgcttttctaacaagaaccatactagtctgttttttgtctacctctctctcaccaatctcccatgtctg

SEQ ID NO: 22166 - DNA, 201 bp, Bos taurus
ttgtatccagctcatttcatgtacaacaaagttaaaaaaagttaggctttttttgtttagacttctcactgtatatagtctaggttcttagtctgtgatataggctttctaaaacatgattttgcattcaaccatggtagcatactgtccttatggataaactaatgtattaaaaataaattttctcccttaaacttcatc

SEQ ID NO: 22167 - DNA, 201 bp, Bos taurus
cattaaaattatctgggaggcttttaaaaacattaatgtccaggttccattctgcccagatcagcacctctgagatggggcctggatattgggttttaaagtattttatttattttaaagtctttgttgaatttgttacaatattgcttctgttttatgggttttggccaacaggcatgtaagatcttagctccctgaaca

SEQ ID NO: 22168 - DNA, 201 bp, Bos taurus
ctttagctttgctccattttgatctttgtaaattatcttaaagattatatgtaccttcctttggctgtgttaagtgtgttgaaatgacttttggtcaaatgtaataaaattctacctgatcgcagcttacttatcttgcctgtctaatccatcttgcacttcctgcctactctacagaaggtgccagtgtggtgatctgtg

SEQ ID NO: 22169 - DNA, 201 bp, Bos taurus
aggactcagtgcttttaccatgggcttggttttgatccttggttgtggaactaagatcccccagaccacacagcatggccaaataaataaataaaacattttagagataggtcaaagacagactcagtgacaaatagtagataagttcagctaaaattaatcctttgtccaaaaactttgggaaacattgtttggatgagc

SEQ ID NO: 22170 - DNA, 201 bp, Bos taurus
ccctgggaaagagattcaaatgaagaagaggatgttatggttgacaattaaatggatgaaatgctctgtgctatttgaccccaaatgaaaaaagaaaacaacaccaccagagagtgggtcagcccccgattcaggaaacacagcgagagaatgtactcctgctgagcttactgataaagctgccaagttccaacaaaaggc

SEQ ID NO: 22171 - DNA, 201 bp, Bos taurus
agactagggtaaaaagtgtggaatatgccctcatttttacttgctacccatttctgacatgaggatccatccaatgatgtatatttgtgtgtacgcatgcgtggagatgacaaaacccacaggcaaaatgaaggtgacagtcactgctcagtgaaatgacctcaaccctcctcttttgctcagcatcctgctcctcattct

SEQ ID NO: 22172 - DNA, 201 bp, Bos taurus
gaggccctttctccagtacagtcacgtgagggttagggctttgacatacggattttagtgggacagtttggtccattgcagtggcacacaaagccagtctcgttgtcaacaacagtgacataggaaacatatagagttttctagcttcctttcactacagttttttaacactttgtttcctttttcactttttcaattgca

SEQ ID NO: 22173 - DNA, 201 bp, Bos taurus
tgaagaaaatagcccatgtttaaaaaaaaaaatctgtatttagaaaacggaattcatttttcatttgcattttatcaaagtttattcttgttagaagttggcacgttccctatcatttgaaatttcagagcaactgcccccaaaataaatgtacctgttgttttgtaaattctttaatatctgtgatgcttgaattataac

SEQ ID NO: 22174 - DNA, 201 bp, Bos taurus
atgaatgtgccatctttggagggggcaaaccttgggaaaaatcagtttcttcccaaattcccaaccttagtggaggcagaatcaggcctaatgagcaatagagcaatgttggtggagagaaaacatccaaagaacgacttgaattagaaggtgtgttttggtggtggtggcagctggattttatggagcacatgagtgctt

SEQ ID NO: 22175 - DNA, 201 bp, Bos taurus
tcacccttaaatgcctaaattatctcctatgttgacaacagctgttgggtttattttgccagaaatggggcataatttcactggaatccagaaagcattccggagagactggttttgtgtgttgctcagttgtgtccaagtctttgcaaccctctggactgtagcccagcaggctcctcagtccatgggatttcccaggca

SEQ ID NO: 22176 - DNA, 201 bp, Bos taurus
cctggtgaaatggctggtggctgctgccagtccttggtgttccttgcttttatctgcatcatttcaggctctgtcttgttgtcatatggccttatcttccgtatgcttctttgttcctatgagttttcttctttccttataaggacatcaccagttagattttgggcctatcttccttggtggttcaaatgataaaaaatc

SEQ ID NO: 22177 - DNA, 201 bp, Bos taurus
atcattagtgaattcatctaattcacactctatatctgttcacgtatctgttaaatcctattaactgtatgctcaaaatggatccgaaatgttctctctccgtcttttaaatgctgttttcagcagctaaatgtgcatcatccatggactctctgggcatcttatttgtatgaagagggtgttaggagctctacacttgcc

SEQ ID NO: 22178 - DNA, 201 bp, Bos taurus
ggtgatacaagatcatatggcaatttctacttttagtctgttaaggaacctccatactatcctccataatggctgcaccaattttcattcccaccaacagtgtagaattgagcattttaaaagataagttgaatagatttgtgaggagttgcaaggaactttaagcagagcattaacatgtcagaagaccgaagaataact

SEQ ID NO: 22179 - DNA, 201 bp, Bos taurus
gatagtcataccactgagttttcattgtgcagagttcaactctttgactaatgctcacccagctgcagagagggaggatcaaaagctataatgagatgaacatagcttatgatattttaaaagattattatatattatgaagctttggtggaaggagaggttgaatctagagccctaaaaagatctggcacccattctatg

SEQ ID NO: 22180 - DNA, 201 bp, Bos taurus
ctccagtactcttgcctggaaaatcccatggatggaggagcctggtaggctacagtccatggggtcacaaagagtcagacatgactgagatattcacttcgctacttccaattacttccaagggttaagaataaagagaaaaaaaaaaagaagcaccagtgtgagaagacggtggtatgtgaaatacagagggcctgggca

SEQ ID NO: 22181 - DNA, 201 bp, Bos taurus
ttacataaaatggtagtgacatataaatacagtaacttaaaaaaaaaaagttggtgttaattccctgtcctttttttctctccactcatttggaattttggaaattcaagttaaagagtaaaaatgaaagaaatttgtatctggacatcagttttatttttaatagatttcatgttgtctacttttgtcacggagaatagg

SEQ ID NO: 22182 - DNA, 201 bp, Bos taurus
caacaagctaagggactgaatggctgacttgcaagttgagaaacaccaacttgaaagtctaaattcacagaaatcttctagcactgataattttcaagaacaagtaagacagtgggagacagaaacggggaggggaagaaagaacatatttttccactcataacccggcagcggctagcttgtcactttccctgttcaatc

SEQ ID NO: 22183 - DNA, 201 bp, Bos taurus
agtgaaagggtgacagttctggacttcataaggagagataaacactcttttgctgagattgctaaattctacagtaagaatgaatcttctgtctatgaaatagtgaagacagtaaaagaaatttgtgctagttttgctgttatacctcaaacagcaaaagaaatggccacagtgagggacgactgcttattttggatggaa

SEQ ID NO: 22184 - DNA, 201 bp, Bos taurus
gaaaccaggctgtttgtcctgttgactctgccacagcctggatttgctgattgaatcctcattgcattgcttaccatgttcttctctttctcatattttccgcaaactggtggcttttgtttcatttaaaattatccatacctgtcttgaatgagtgagtagatgagaaaactatgaatttagaaatattggaatctgtcc

SEQ ID NO: 22185 - DNA, 201 bp, Bos taurus
actgttgatggttctctgtaaatacttcctctgagtctgtgtgcttgtctcattggtaagctccacaagggcagaggccacatcttctctgattcttagacgccctcagtgccaagtatactacccgacactcggtgaggctggaaggccgccatgagtcatccactaaccttcagaggagacctaccagtcatgtcgccc

SEQ ID NO: 22186 - DNA, 201 bp, Bos taurus
aatgtatttctcattcattcatgtcagttgtgggttggccagtagctctttcacatcattcttatatgagaacctggagtgattgacgttttttatctaggaggttgtcaatcatcatggccaaggggggaagagatcatagcaaatcacacactgattcttaaaggtttttgccagaaaaaggcatatatctctccactt

SEQ ID NO: 22187 - DNA, 201 bp, Bos taurus
aggcaagctgaaaagacttcatactgtatgattccaactatatgatgacgtctggaaaaggcaaaactacgaagatgaaaaacgattaatggttgtcaggggttagaagggaaggaaggatgaatagacagagcacagaagatttttagtgcagtgagacagttctttataatactacactatggatatatgtcattatat

SEQ ID NO: 22188 - DNA, 201 bp, Bos taurus
ttttgatcaagagggaaaaacagaatacaaccgctcaacaatttgttaagaataatcttctaattccttggtcaacatttttctaaaatgtcaatctttggcatcccttgggtaacctttaggaatcatggattctccccctatgcttaattatcttcacatttttccttaggtttgctctaaattttgtgatttattcta

SEQ ID NO: 22189 - DNA, 201 bp, Bos taurus
acattaaaaattttgtggaacatatttattatttatatttatcagtcaagatttcagtaccaatagtttttatgcttctgtgctttaaaatataatcatcgtgaagtcttgaaatgttgattcaaaattcatttcagtgtaattttattttgtgaatataaaaaaagcgttttcatcagtgaaggcctatatgatcacagc

SEQ ID NO: 22190 - DNA, 201 bp, Bos taurus
tgcagccatgccttgggcacactcagacctccagggagggtggagttggggatgaagtagaacattgggttctgagaggccaggaacctcacacctcactggtgcctctgatggactttgaggttgaaggcactatagtcaggctgtataggctcaggaagaggggggaggaagaggggtcctgtgaggcctgtggtgcag

SEQ ID NO: 22191 - DNA, 201 bp, Bos taurus
tgacttatttcactttaaattcttgactgcagagcactcttgccccatctccccagctcctgaaagattaagtcacactttctcctctaacttcccatgcctcctcactcactgtcattctccaccaggggccctatttctagatcactgagacaacaggaacaatcagaagacacttccacaatctcctctgaccctacc

SEQ ID NO: 22192 - DNA, 201 bp, Bos taurus
cactcagtcatgtctaactctttgcaaccccatggactgcagcatgccaggcttcgctgtccttcaccaactgctggagcttgtgcaaactcattcccatcgagtcggtgatgccatccaaccatctcatcctctgttatccccttctcctcctgccttcaatctttcccagcatcagggtcttttccaatgagtcagttc

SEQ ID NO: 22193 - DNA, 201 bp, Bos taurus
ctgataatggtactttcttcattctagggcctcaaagtgaacacgggctgcagctagtagatttctgtctttataaacacagcttaactctctagtataagtaactatcaggcccagtaatatactctattgcattatttcttaataatcttttttcaaaaatatcaaagaacaaattggtatgacatcaaactttaaaat

SEQ ID NO: 22194 - DNA, 201 bp, Bos taurus
tatagtaaccaactccatgagacattaactggcaatccacgttaccagtgagtatacattacagcactaaaataaaaataaactcattgaagaaatagctagagacctcaaccatgcttttctgttggtgaaatggcatgacagtttggggatttgtaactgagaataaatttaattatgtcactaccttgctgctgctaa

SEQ ID NO: 22195 - DNA, 201 bp, Bos taurus
ctgcctcccaaatctacagcaatgacaacacgcattgtattcgaaattacctgaacaagaatcttggaacattatgggttttgcaacagttctttgcagtcgctttgaaacatcatgatgattggcggttttgtctaaaaggcttttgtttttagccttttaaaaagtgaaggtgtgtatatattttccttctctactatg

SEQ ID NO: 22196 - DNA, 201 bp, Bos taurus
tttaatgtctccttgggaagaataaaacataagcagtaaatctctgttgtgatttggattcagcgtgctaaaggctgactgatgattcctttcttctgccgtttgactataatatcagagtatgcttaggggagttaaaaatgcaaatacatgtatactgctgtttcactgtgtcaggttaactgccttgaaaagccagat

SEQ ID NO: 22197 - DNA, 201 bp, Bos taurus
tgcctttgatcactgtagtcaaagttgtatctgaccggtcccttttcatatgatgcggaagtgtccccttaaatctttacagtgtcacactattttatagggtctcatgtcagctcaacatgcagtgtttacaactttgttaagctttgtcttcttgttgttgttgctgttcagtcactcagtcatgttcaactctttgtg

SEQ ID NO: 22198 - DNA, 201 bp, Bos taurus
ctccttcaccttcaagtaccaggccaggcacatgggagggctctgtgaaaaaggacactggtttcctgcaggtggcctgcattatcagaattgacgtggtaagagacaaatgtgggttcccatttctcctcagggattcctgcttgtcctagcagggcccctggtctttgctgcccctgttccaagtgcagcttttcctcc

SEQ ID NO: 22199 - DNA, 201 bp, Bos taurus
ctgcagcaacctctccccgctctcagtttccaccgacagtggctcttctctttccatcactgctccgaaaggcaggcatcaccgcaacaggaccccaggatgccccggattccgagtagaggctctggctgctgcccagcaggagaagggcaccctctgcgcgcccccagctacctggctgctctgcggcgtgtgcactgg

SEQ ID NO: 22200 - DNA, 201 bp, Bos taurus
gcgcggcgcgcgcacgtggacgcggccaaggtcgccgctcctcctggcgccctgctcgcgcagccttcggtcgccccgggcggagaaggggacgcggggatagaccttggccgagacgtgctgggggaaaaagtccctggaggcaaagcaaacccacgcttttttcctcgggttgtttgattttcttttacttattcgttt

SEQ ID NO: 22201 - DNA, 201 bp, Bos taurus
ggcaaagattagaaagaaaggttggctcatgctcctgactgggtcagccatccagaaatgaggcagagagtgtgtaaggcaagaggagggcttagattaggaaaagtacaaacagaaaagtcaacttctggttgagttcctaaggccgagtagaattaaacaggtgaaaagcaacaaggggaattattcaagagaaagtac

SEQ ID NO: 22202 - DNA, 201 bp, Bos taurus
gcattaggattttgttctttttactcctgagttggattctattttatgaatgtaaaacaatttatctgttcaacatttaaggtcatttgggttgttacccgtttggggtgattacgaataaaattgctataaatattcacttatggatttgtgtctgtgtgtgtgtgaatatgtgttttagtttcttttgggtaaatacct

SEQ ID NO: 22203 - DNA, 201 bp, Bos taurus
ttattcatatttaaatctttgaaagattgttttgagaaatagatatctaatgaagataccactgtgcctggctcacagagaccactcaataaacattatggatttactaatagaacatttgcaatgagccaggtactattctaggtgctagaattacagtggggaatgaaggaaaatctttgtcttagtgtctttaatact

SEQ ID NO: 22204 - DNA, 201 bp, Bos taurus
agcacctcggccagcgagcgggcaccagcacccgtcggccagagcacacccccgaggagcccccaacgcagcgctgccgggcccccgcctgcgaccactttggcaatgccaagtgcaatggctactgcaatgagtgctttcagttcaagcagatgtacggctaacccaacccagggggtcaaccccagacccggaggggcc

SEQ ID NO: 22205 - DNA, 201 bp, Bos taurus
tccttgtgttctacatcagtgatgcttttcccctaaagacgaaatcgtgtaatcttaccctgtggctttcacagtctctaaagtcaatgactctttcggtttatgctgaaaatataaaagagataaaatgaggctgctctgatttaagtgagggtggagaagcctggtaaaattaagtaacatttcatttgttgtgccagt

SEQ ID NO: 22206 - DNA, 201 bp, Bos taurus
ggcaaaattcagccaagggagctggcccattgctttaaaccagctgaggctactggagtgaggaaaccccattctaaggagcttctccacttttccttccggaaactccttccttcttcatgggccagtctctttgctggtttgactctggtttgactcctgtggggtgtctgttctttggttacttcctgccagagatgg

SEQ ID NO: 22207 - DNA, 201 bp, Bos taurus
agcaaaacatgtaattttttctacttaatatactttatcttgcaaatataagtcattttgaaaataacgtaataggatgtctgcttcaatgtacttgattaatcaatctttctttaacttagcctcaaattgaaattttctgtacagatgtctaccatatagaaacaaaaatacatttgaacgaaaaaattatgaaaatcc

SEQ ID NO: 22208 - DNA, 201 bp, Bos taurus
ttcttaattgtatgttctgatttatccgaagtggatagaaaaacaaattatttctgctaaattatacttaggaggatagtacttgaaagcattctaaaagttagaaacaagaaagatattaagaggaagtttaaagaaaagtgaagaacttaaaaaggaagtgttaaatgttaatcatatcactgtttagaataataagaa

SEQ ID NO: 22209 - DNA, 201 bp, Bos taurus
ccttagattttacctaatttatgctttctgttccaggattccattgaggctattgaattgataacagtatttttaaagggccagttaagtgccagatccattcatgccattacttcatttacttttcatacatcgtatttagataggcattacagttgacccttgactagcactggtttgaactgcaagagttcatttaca

SEQ ID NO: 22210 - DNA, 201 bp, Bos taurus
gctgtatttcattactggatactaactcttgaaattgtcttgattatattattgtattgtggctttgatgagacgattttttgagggctcttcttaacccatgaatatgaattaaaagggaaaaagggaggatacaaagggaagacctgagtgacttaaatttatactcagcttgatccacttgctgaactgattattatt

SEQ ID NO: 22211 - DNA, 201 bp, Bos taurus
gaatgaaactgtaaaagaccacaataagatctaaaaaaaagaaaagtatgattggaatccatgaaagagaaataatagataatgtggcaggtacaatattagaagacataataactcataactattcatcaagctgctgatttgagaatctctatgagtctcataaaaaataaatacaaaggaaattacacttaagtacac

SEQ ID NO: 22212 - DNA, 201 bp, Bos taurus
ttaccagctgagccacaagggaagcgttggctgtagtcctacacaaaattatatatttttaaataacttcttcaactgaagtttcttccacatatcccccaaaataaatgttttccaattctttctttgaacatgcttttcattttctctatatatgtgtttggaaatatcactaataatcatttaagactatcaacagac

SEQ ID NO: 22213 - DNA, 201 bp, Bos taurus
caagcctttaaaattctactcaatggacagaagcatgataggacttttcagttcttcttcctcatctgcatgataacggatgcatgaacctttcttacagcatgtaaatggaagtggcatctgaggagctgggcttcagcagtcaacgcagatcacaacagtgaaatctgtgctcagagcagaacacagaatataacttac

SEQ ID NO: 22214 - DNA, 201 bp, Bos taurus
agaagtgtaagtatagtaataagaaatatccatcaaaactaagttcaaatagttgagcatactccagaatagaagccgtcaaaacaaaactttgtcactatatccaaggaactgaaaaagaaagaaagacccctaggttaagggccagaaatagtagcaggcagtgaagtcagtcagatcgatgaagtccaacaagatagg

SEQ ID NO: 22215 - DNA, 201 bp, Bos taurus
tgttaatgttgtgtatgtattttgaagtacgtgtgtgtgtgtgtgtttctcagtttctgggtatttgagtggtgaatctttgccatgcctaacagtgagcgttggatatttagcagtgaatcaagtagccatacgccctgactttatggaaattgtctgcatctatatcctatatgtgtccagaaggggaacatattatgt

SEQ ID NO: 22216 - DNA, 201 bp, Bos taurus
caatacagctaccagaatagtaatatcttgctatatatttttttaaagtaatacatctatttctgcaagtagaagttatcactgtttgattagcccacttccagttagcattttcatttgaatttcgcagaaacttgcttgttcaaaaactttggtagataactatgcacagactgtcttctaaatactcagaattgtcaa

SEQ ID NO: 22217 - DNA, 201 bp, Bos taurus
agttaaggccaaaatatgagtggggagaatagataagtagtctctaaatgagattaggtttaacatttaagagtaagaaaagatctaaggatgtcccagagtctaggaggacaggccagttggcatcttccaagatcatagtccaaagagaatagaccaggattgacaggaaggatggactagatagaaggagttcgtcca

SEQ ID NO: 22218 - DNA, 201 bp, Bos taurus
gaattattccataagaatagaaaggcaagatgctggtattttttttcaagtagcaggccaaaagacaagcaaagatatgttgagtgatattttcaaacccctgtgttagatctttacttctggataaggtgaagtagcttgcaccaaaccaattgttctggtaagaacaaatcgaaaaatcagctgaaatgtaaaaaccca

SEQ ID NO: 22219 - DNA, 201 bp, Bos taurus
cctaatacctttggcccaattgggtctgccttcttgggctccacatcaagagggtgacgcaagctgggtcacacatctctgagcaatttcagaataaactattgtaatcaacatagtccctggaccccagaccttctgtcatcaatcagatacagattaaactggcaggatgctcacgtgtcagaagaaaaaattaacaca

SEQ ID NO: 22220 - DNA, 201 bp, Bos taurus
gtgacagtacttattagagtttgaaaatcataacatacagtttcctgccttttcctagaacatgcaaactatacagcaagagcagaacaaagcctctttcatgaccattaaggagtatcctcaatagaattcaaagttgctggtggttcagttatcagttccaccgtcttcttactcttggaaaactctccagtgaaggaa

SEQ ID NO: 22221 - DNA, 201 bp, Bos taurus
aatatattatttatgtgtatatatgtgtattatgcatacatatatatgtagtaacatttctatcttgaagaacttaacatacctgaagtatttaagcaagtaagatgtgagacacttaaagctgtaaaggtatggctctcaaggtaaaatctaaagagcaattttttgtgcaccacttttcacatgttgttgctgttgttt

SEQ ID NO: 22222 - DNA, 201 bp, Bos taurus
gactgaagcgacttagcagcagcagcagcaggatggctctagcagtgcagtggtggtgtggaaaggtggcagctatagcagaggccagttgggtggctgttccaagagtgtgattggaaattgatgtgggtggtgccatgggggtgggattgaggggtggcctgggtacagatcagtagagcatgataagtggatagggca

SEQ ID NO: 22223 - DNA, 201 bp, Bos taurus
tatagttctatggctctgtcatttattaggcacttctctttgtcaagcactctgaagaacaaatttgaattttactcctgtcctcttcaaggttataattgaaaatagtgtacagtgccaagaaatggggtaaaaatgacaatgaaaattctagatggttctttatgtttttttctgacaccatctagaatgcatgtgaca

SEQ ID NO: 22224 - DNA, 201 bp, Bos taurus
ccaaagccatctagcatgtatctttggaccattagacaaacctcttgagagtagttggaacactggaggatgtaacaatttggctcagggggacatgctcgcactccaactcccagaaagttctagaatatcatcagtttatcatagaggaatacttggatttcgtcctccatccttatctttttgtgccttagactactc

SEQ ID NO: 22225 - DNA, 201 bp, Bos taurus
tccagtctcagatgacccatttacatggctcatcaagatttctgtctgcctctggtcagtttcctctccctgtccccatgtttatcacagattttaactcttctgttcaagctcctttttctgcacttgccctttcctcttctggttggtaaagctgctgtctgcatcccaaagataattgaagttgaagtgggataaact

SEQ ID NO: 22226 - DNA, 201 bp, Bos taurus
agcataggcaagagttggagactctgaacagaagtaatagaggagattctcaaaatttggggactttcagggttggaaaatctagtttctggactcaaaacgccaagtaatgtgaatgaaaagaagtttgaacaaagatgtgttaggatttttgtggctaaatagaaaccatactctggctacaaagaatttattaagaat

SEQ ID NO: 22227 - DNA, 201 bp, Bos taurus
gtaatggaaaggatcttatcttggagtcagacaggcctggcttcaaatcctggcttctgcatgtgaccttgagcaactcagacaatgagtctgaagctctcctaatggggagaactgggaggccctcaggaggtccctggggattcaacccgggttcgatccctgggtcagtaaggtaccttggagaagggaatggctgtg

SEQ ID NO: 22228 - DNA, 201 bp, Bos taurus
tctaatgactaagataggcctcggcacatagtttatgcttaatcttgttgaataaacatacgaaagaatggtttagaataaaatgtgaaatggatatctcagagttgaactgaacactgggccaatacccatcttttcagttctctttgttattatccttagtgtacaatggggaaaataataatattttatgtaattttt

SEQ ID NO: 22229 - DNA, 201 bp, Bos taurus
catagatgtctgttaaaattttctttgaggttggaatgacagtcaatacaaccagaacccagaagtctgtgcatgcaaaggccttgcattctctcctcccccaagcatgatacagtgacaacccatctccctaaaacccagggcaagaaacttctaggccatcaatttatcacaatcaacaatttgttcattttttttact

SEQ ID NO: 22230 - DNA, 201 bp, Bos taurus
atttaaacttaatctaacaattgcaatatcagcatccccatgaattgtagcttgtccatatatacagaaatagtagtatatgtcaatatcaccatttggttagacacttgttgaaggcataaagatcatgatctactgaaaaactgcagttttcttattttctgaataaattgtctatttggttcatatcttcaccattta

SEQ ID NO: 22231 - DNA, 201 bp, Bos taurus
gaatgagatccctgatggtgaacaagatggacctaggttagtagcaaccagagaacccaggtaaactgaactcagtcttctctgtgtacctgctcagtcattaagtcgtgtccgactctttgcaaccctgtggactgtatctcaccaggctcctccatccatgggatttcccaggcaagaatactgaagtgggttgccact

SEQ ID NO: 22232 - DNA, 201 bp, Bos taurus
ggctctggagcctaggcatgtaaggacgaataggtgaataaagggaagatgtgtctgttggcttggaaagtggtctctgattcctaaatattatgaatatactgagaggccctactttattttttaggctggatattttcaagctcttgtttctcaaggtgtatggctgtcggcattcacatgcccaacgtattttcatat

SEQ ID NO: 22233 - DNA, 201 bp, Bos taurus
cttaatttcatgggaaggacacatttcctctgctgttatgatgaaagcaatcattctctagacagctaaaaagcgaagaccactgaaaagtgcctacaatgtaatgaaaagtaaaacagcaagatgtaaaacttcatgaggaaagacttcattctataatgggtgcacagaaaaaaaaatagtatgccagtatgttaatga

SEQ ID NO: 22234 - DNA, 201 bp, Bos taurus
accttggaacctgaaatacctgttagtctagcatagactttggagtcaaaaggcctgctgtgaatcattgatttgcctcgtacttaatccctgggaatccgtgggcagtttattcagcacctgtctgtaccttggttttctcaaccataccatggagagaagatgcctgtatctaagattactgtgaggattaaatgagat

SEQ ID NO: 22235 - DNA, 201 bp, Bos taurus
cccttcagttctgacccacagatcttttggaaaatacttgtggccgcctagtcttggtataatttcttgtgtgtttttgtttgtttttaccttcagaggtgttctacctagtttacttgcctccgtaccttgacagatcagatccacttctctgtgaatggatggctcacccctgtgagtttaaatcagataaaatggagg

SEQ ID NO: 22236 - DNA, 201 bp, Bos taurus
agctggtgactcatgaagacataagttggaggagaaaacagaattgtaggtggtttcatgggtatttgagtaaaatatttagttctcaaaaattacctatgtatattgataggaattatcagtgtacctgggatgagttgtaatatgtgttgggatttcaggtggctgaataaataacactcctttagtcctcttctgaat

SEQ ID NO: 22237 - DNA, 201 bp, Bos taurus
ctatcattaggataatttaagtgcactttccagtgtttttcaacattcactttttccctacctatccggcttcacttttcttggtaatttctttttctttataattcttctgtcttttgctattttattgtccccaatattcttcataatttatttcatttgaaatttgtatctattgttcaaattgtgctttttaatact

SEQ ID NO: 22238 - DNA, 201 bp, Bos taurus
tctgctgttgtcagaacatcaggacaattggtcatctttaaaaaatgcatcctcttaatgcaagtgcatgtgagcacttctacctgtgtgttcaaaagcaattattgtcagcagtgatcactgtaacatcagaggctgactgatttacttaccaggacttgatgtaattttgccccaacaaacagcctctgggccctagaa

SEQ ID NO: 22239 - DNA, 201 bp, Bos taurus
cagtcagatggataaaggggcccactgacctgtgtcttggaactcaagcccagagagtccagaagcttcatagttagaaaaatctctgtctagatgagaaaggccaccatttgccatagttgtgccagatctatttctgaaattaactcttgttttcctagatgtttcgtattctggcctctctatctgtgtgagagtgtg

SEQ ID NO: 22240 - DNA, 201 bp, Bos taurus
atgcagtgaccaggttagatgtaaaacacgtcagggatctataggagggagtgtccgaccctgtgagggaaggaaagatatgagagggagttcttcctagaaaaagtgacacaatctgtgtgccagataggcaaagaagaggagaatttgggagaagcaaggccatttcagtcagaacaacatgtgtaaaggatggaggta

SEQ ID NO: 22241 - DNA, 201 bp, Bos taurus
ctccgcctttgccattcaacgtcccatgggtatctttgcatttccgtctatacctagcgtgctttttgcttttgaccgtgtcctttgagctaagttttaagcaccttcaaatctttctgtttgctctaattttaaatacttgcctatcttgcttatcttgtccgtttatttatttttcttcacgtgtatagatgcgcacca

SEQ ID NO: 22242 - DNA, 201 bp, Bos taurus
ttactgcacaagcatttgtcactttcataacatgaaaatacaataaatagagaaatgataaactgaaaggatttgagaaaatgttttgtgagggccagttagttgcacaggagtcagaatacgtgtatggcaggtagacttaagtgggtagagtcatcttgtccttcctggctgcctcgtagtgttttaacacctggactc

SEQ ID NO: 22243 - DNA, 201 bp, Bos taurus
ctgcctcacctctttcttcctgtggaaaacatgttttcaccctggctccctctgtctcctgcccagccctggtgctccctgggtggccctacatggcatgatgtgcccccttctctcaggagctgagaacagcaaactctttcagtctctcctgatttgttggcctcactgtacctgaatgataatataacctatattttt

SEQ ID NO: 22244 - DNA, 201 bp, Bos taurus
atatctacatatgaagaaatgtaacagataagactgccctgggcatatagtaatgggagaaagatggttatatatcccaacaaattgttattgaaagggaatgaatttgtaaataggcaagcggtgacctgcaaaatatgtcttagctaaaatttcatgatgaaggcaagtgggagttaccttatcctgggttccttagca

SEQ ID NO: 22245 - DNA, 201 bp, Bos taurus
cagaaaagtcaccgtgtctgcaccttaactcagatgacagatgtttgtcagtcacttacctgtgtgtcagactgtgctgaacgtgagcagggagaaaccacacagagtgaggtcactgcagttctgccaaggaagacgttacagtgtatggggtaagaaagataattaaacagagcacgacaaaagtgttggcccgttgcc

SEQ ID NO: 22246 - DNA, 201 bp, Bos taurus
ctctaaaatgagcaactttaaaaagaaaataaaaataaggtgggttgctggagaaatgggtatttattttttcaatatgttttaccaaacatatatgatcaaaattctgttgtctgaatcaaatattaggctgaaaatgaagtcaggaaacagagaataacctaacagcccagaatgagcacccctttacatccatcacca

SEQ ID NO: 22247 - DNA, 201 bp, Bos taurus
atcattgtctgtagctaagacttaaatatggcccctatggtgtgctacatgccatttaagtactttacataaaaactcatttacctttaactgagaactttatgacaattgcttcaatattggtgtgggttaaattcggagagactgttattcgatgtaatacacgtcttctggggaatataccctgtattgcactcatct

SEQ ID NO: 22248 - DNA, 201 bp, Bos taurus
gtttctccaaggaccgcggtctacagaatttccatgtcgctgagcctcactcttctacatgtgaactagactcttctgctgaatgactgtccagtgtggacggtttagaaggattgtctttattgctcttaatctatgttttaactgtcttttaatgttgtgttttacattttcattgactcactcatggtaatccataaa

SEQ ID NO: 22249 - DNA, 201 bp, Bos taurus
tttatactacgtatttcaatgtttcctcatgtacaattaaacaattgaaaatatcaccatttcctggttctcagattaaaatctattacttccacatagaggaaatgaatgcaatttaatattcaagtaaatagaagtatatttgttccagctccctcagatatgtgaacttcttttttttttttaaagtagaccttataa

SEQ ID NO: 22250 - DNA, 201 bp, Bos taurus
tatacttcttgccttaccatgtgtggttttggctaggattgtgaaaaattagagaatttatgggtttaggaatttgcctttattcacctgatttaatcttcatcaaatctatatctgtcctaaagaagattacacttttggaggagattatgtgctcatacatatgcaaacatatgtatacaacatatgtctatattgcta

SEQ ID NO: 22251 - DNA, 201 bp, Bos taurus
attaaaattttctgaatatcacttatcaacttatggccttattttcattttaataccttgtcttctttagtatctttagtattcttgacttctggaggaaatcaactccaggacaaaagtcaaatgtattgccttcagatcagatcagatcagtcactcagtagtgtccgactctttgtgactccatgaatatcagcatgc

SEQ ID NO: 22252 - DNA, 201 bp, Bos taurus
catactcagttcagtttagttgctcagtggtttttgactctttgcaaccccatggacagcaggacgccttttaagatttttctctttatgttttgtgttgggggccagagtgaggcactcggcccgtggcaaaggtcatgaggaaggaggttcgacatatgcaaaggggggatcaagcctcaggagtccccctggaaatcc

SEQ ID NO: 22253 - DNA, 201 bp, Bos taurus
aaaaaggtaagctgagctagtttagtgtgtctaccattaggaagtgtttttctacgcatcttgattttattacttttttctaatgtctgtcactgagttacaaaagagaactcagcacctcattacccctgtacataaatatatttttatttcattatgtctcccagatactgctctatctacaatagaagttcttcaatt

SEQ ID NO: 22254 - DNA, 201 bp, Bos taurus
caggcgccaagtcttccgagttccctaagggacagggtggaaaacaaagctgaaagtttgcttgatgccgtatcacagaaggccttacataacaggataaggaggagggttttgtgtagttatttttgtgctcacaatctataaaatactgcaaatataccatgagaatttattttatggaaaagaggatcaagaagatgg

SEQ ID NO: 22255 - DNA, 201 bp, Bos taurus
tttctaacatttgaaattactgggtactaaatataaatatatatgtaccatacatacatacatcaattttacaatttttttcgtttctctatagtccgagggaagccacgggacttccctggtggcccagacagtaaagaatctgcctacagtgcaggagacccaggttcaatccctgggttgggaagatctcctggagaa

SEQ ID NO: 22256 - DNA, 201 bp, Bos taurus
cagctaaggccagtgttcacaaaagggagttctccttgttctgtatccagaaccagaaccagtggcccatctgtttgctggtttcgggatcttaatagcagttccttactttaggttcaatagattctatctgcccttttctttccaaaactttccagtgtttttgttttttcctccctctcttgcttctaattctactca

SEQ ID NO: 22257 - DNA, 201 bp, Bos taurus
tttttctgatatttagttttcattatttattcttcatcgcttcaactcttagctctttaggaaagactgtgttttttgcttttctctgaattcttagggaatttagtcccatatcttctgagtactgtgtgtacataaaatgatactgttatcccccaatctaaacttctctttcttctaaaacttacttttagatctcct

SEQ ID NO: 22258 - DNA, 201 bp, Bos taurus
ctgagccaccagggaggcccaagctctacatcagtacacaaggcaactgccagaaagcttttgctttcctggttcttgtttcattaagctagcctgaattggcttgagtcagaattcacagcaactgaggaaatatatacagtttaccaccaagtgtactttgcagttaaataacagctcaggtcaaggtgtcaacaggaa

SEQ ID NO: 22259 - DNA, 201 bp, Bos taurus
gagcctggcccggctcctgtctgggaagagatctggcctgcgggcaggccctgacctctcagctttctgtctggggcaggcagggatgtgatgctgtaacccaattcacacgacaagcggaaaggcctgaggaggaggagaaaggttttcttcatgttttctccacaccatgtctccctcgtggtcctgaatttccaggat

SEQ ID NO: 22260 - DNA, 201 bp, Bos taurus
ggacagggaggcctggcgtgctgccattcatggggtcgcaaagagtcggacacgactgagcggctgatctgatctgattcgctgatcttaagagaatagtcccaaggaggcccaataaaatcacgtgaatctttaaaagtagaaaaaggagggagaagagagagtaagccagagagagattaagcagaggaggaatgcaga

SEQ ID NO: 22261 - DNA, 201 bp, Bos taurus
agtgggaaaacgagccatatagaacagcagggattgcctatacacttttgctatctgacaaactaaattttaagaccgtagaggcaatagacatactgctgttctctctggacagtttttatttgggagacttgtcaagtcaatgaacatattggataaatcaagtgaaaaatgaatcacccaaaaagtacccaactcttt

SEQ ID NO: 22262 - DNA, 201 bp, Bos taurus
tgagggttccatgtacctcctaaaatagtgtgcaaacctttatacttgcagtttctagggtgtggtctagacatatttttaatctaacattctatgcaccgttgccgcaggaacatcctgacaatatcaggatgcatcaatatttattctaacatcacatctggtacatttggatcagctgaggtttgaagcaatgtttta

SEQ ID NO: 22263 - DNA, 201 bp, Bos taurus
gaaagcagaaaattttctaagtaacccagctagtgagagttttgtaagttcttcaaattctgaaaaataaatatgatatatctttaaaaacttcccatctgttagaaactactgtttttcaggaaaaaaagaacatagacaaaccatgtttacattagtcaattagaaacaaaagaaatagttgacatatgtaaactttct

SEQ ID NO: 22264 - DNA, 201 bp, Bos taurus
gtctgatgaagtcctcagctggccttccacactttgcttctatgacttctaaagatttcagtctctcagtaggaactctagggggaaaaaaaggcatttcaggaggccaagggattcattagagcattttctcgggactgagccaccatgcacagtgaggtaccaatgcccggggctttggggaatcctggcttcaagcag

SEQ ID NO: 22265 - DNA, 201 bp, Bos taurus
aagggattgtgtaagtggggaaatctgaatacgttctagttggtattaacgccagtatcctggaaatgtagaccacatcatagcatacattacactgttttactcagtctcttagcctgattagaccaattttttttctagaattaataaaaggtctgccctcacatgggtttcaagtttgaatttatgctacttaattgg

SEQ ID NO: 22266 - DNA, 201 bp, Bos taurus
ggtgagaaaagggaacataaaggaactaaggtaagatgccaagcccactgcctggctgattgtaacaaacactgggcctgcccaagtgtgcattccttccgggcgccccactgcggttcatactgaccacataaagtgaccttgagggtcccaaggaaatggtgtgagggccattgatgaagcaagaagctcagattccct

SEQ ID NO: 22267 - DNA, 201 bp, Bos taurus
agacgcgttcagggtggtatggccatagacaagccttaatatttcttagactgtccatctggaaaacgtgctgtgctgatgcccttcgagcctctccagctacagaagtacctgcaaggccagacgattctttaaggaggaggccaggtgccatctcagctttttacctggtatttctcaggaaagctgtccttacctcat

SEQ ID NO: 22268 - DNA, 201 bp, Bos taurus
ctcagcagagcatgtgggcgacccgcaacgatatgccttatccctaccagaacaggcaaggccctggcggccccacgcaggccccgccttaccccggcatgaaccgcaccgatgacatgatggtccctgatcagaggataaaccacgagagccagtggccttcccacgtcagccagcgtcagccttacatgtcctcgtcag

SEQ ID NO: 22269 - DNA, 201 bp, Bos taurus
tgtaaaggcaggtgaggcaggaatgcaccgggcattttcagaactccccacgaagaagaggaagtggcttccttccgcttggttcagtataaccacctcccgtcatccctctgcccaatgctaatggcagccagccgagccggaggtgctgctgctgttgctcagtcgctcagctgtgtccaactccctgcaactccatgg

SEQ ID NO: 22270 - DNA, 201 bp, Bos taurus
gagcgactgaactgaactgagccttataagatggttgagaaaatttttttctagtaagataatgtctccagcccataatagatactcattaaaggcctctgtggaattctttttttttttttttccaagattttcttttttatgtagactgtttttaaagtttttattgaatctgttacaacactgctttgatttttaggc

SEQ ID NO: 22271 - DNA, 201 bp, Bos taurus
cagcctgatttgtgtggaaacaaagatggctttacagagaaagtgggacgtgagtttcaggccccacacttgcctggcccattgcgaagttcctgtgccattttttaaattcttcagttcagttcagttcagtcgctcagtcaggtctgactctttgctaccccatgaatcgcagctcgccaggcctccctgtccatcacc

SEQ ID NO: 22272 - DNA, 201 bp, Bos taurus
gttccttccttccccaacttggcttcttccttcccctctcctccctcgcttccttccttccctctttcctttatacctttgcagtgggaggtatttaacccctatgtctgcttaggaatttcatgaactaggtatttgcagcatctgtgctcgccaccccacctccgcccccctcctctcctggggcatactctccttctc

SEQ ID NO: 22273 - DNA, 201 bp, Bos taurus
attcacatcaaagctcttactcattgcaaaacctcagggaaggtgtttaatttctttgtgcctgaatttctcatgtttaaaacgtgaataggatgactatgctcagaggactgctgtaaagagtaaatcataaaatacaggaatgttttttgacacctagtggctctttaataggtagtatattgttagctattattgttc

SEQ ID NO: 22274 - DNA, 201 bp, Bos taurus
ggtagctgggcgctgggcgggctgggcccccgtcagaactcctccccgcggtttctgcttggcggcttagtgtgcgtgcctcagagaggatactggggttgtcacagtagcgatgggggggaccggcccctgagacccctagcctggtggggccagggcaagtctgcaagggaggagtcctagatggaggctgggacccgt

SEQ ID NO: 22275 - DNA, 201 bp, Bos taurus
ataggacaccgttgatgccagccttgctctagaacctaccatgactctagcttattggttagcataagatttgaggagttaatagataaaggagcttgtctagagcctgctttcaccacctttatgcttgtgttctccaatgtggccatgcacaaaggtagtttactttggaacacaccttttatctttgtttattccaag

SEQ ID NO: 22276 - DNA, 201 bp, Bos taurus
gatgtcacagaattcccagcgcttttgggggtcggtggtgaaacaccatgggcggggctccccatcaggattacggcagtagttcatcttcagattcttgtttggaaatctgaaggtgcaagaaggactttaacagcaccgaacatttaccttcacagatgagaatcatttcaaatgagcaaatactgagcaccgctgtgt

SEQ ID NO: 22277 - DNA, 201 bp, Bos taurus
tcgttcctattaatatttagctcctataatatttccttggcctccagatttataggttagaatcttcatgactgtagctttgttccccgtttcccatttctgacccttctatcctcaggcccccggcctctgttccttggtcaggctctgcagagctgtgcagctcggacttaaaaggcttgctcctgtcactcaagacac

SEQ ID NO: 22278 - DNA, 201 bp, Bos taurus
catcctgcttctctcacacaagtggagagatgcatccgaccgtcccttctacactcgctgctaggttcaccattagagaacttaaaaccatagtgtgctcatgagcactcaatggcctgagttaacgaagtgaaaggctcagcacagtactgaggccactatgtaacatcagcaaacgacatttccctcctggtgtgtctg

SEQ ID NO: 22279 - DNA, 201 bp, Bos taurus
acatcatctattataaaagcattttattatgcttattattatttatttttcttccacagctctgaagttctgtgttaaaagagcaggagaacatcaaatgccatctcaggaccccttactgtagtcaagagaaacatcaaaactataaagcacacgtttgtccttctctgggaatagataaaatattgttcttctaggcgt

SEQ ID NO: 22280 - DNA, 201 bp, Bos taurus
agagtcagacacggctgaggcgacttagcacacacgcacgtcctcgtgagaatgaggaagctgatttatagaaaaagcaacttggctgcctcagaaacggcgacattttcagactgtgacagaatacttccacttgagctcaaaaatacgtttttcttggaaggggcctttttgctttttcttttcaacgttcataagaca

SEQ ID NO: 22281 - DNA, 201 bp, Bos taurus
agggaaggtgggactcaaagtcaggctgggccgggttaggtttgccctgggggagccttcaaggatttactgttagcttcattcattcagtgcttaaaagatgaaataccgaggccctcccctgtcagcatcctggggccactgaaaggcaaggcaggtgaggaggaaggctgagtgcctttctccggatccaagcagcac

SEQ ID NO: 22282 - DNA, 201 bp, Bos taurus
aactgcccccaagaccttggaagcaagaagtggagatgtccctcagcaaagtcctcacaggttcaaggagagtttctagcttccagggcccctggttatccgcttgtgacccactctcttcacttttctgatgataaaaatgagaactccaagcggtaaagcaaggtggtctctggagctctgcgaggcgccctcacaggt

SEQ ID NO: 22283 - DNA, 201 bp, Bos taurus
gtcaggaccggcctcacgtttagttcaacactgcttctacaccagtagtctaatttgagaaacaagttcaagcgcactaatgaatccatctcattgtagattccaaaaaacacattgtaagcccactgttaccatttcccttagaagtattagcctggcagaaaaaattacactcagagagaaagctgtgaactggaatca

SEQ ID NO: 22284 - DNA, 201 bp, Bos taurus
ctgtgggtcacagggtcatttctgttttgtaaataagttcatttatatcatattttaggttctacatataagtgataccatatatttctcttgctctgcctgacttacttccttaatatgataacttctaggtccatctacgttgctgaaataacaattgttgttcagtcactaagccgtatccaactctttgagactcca

SEQ ID NO: 22285 - DNA, 201 bp, Bos taurus
tgtggagttgagcagaagggactccactttggggctgttatctcttcactaacaagctctcaaatttctctctgtgtttggagaaataggcctttttaatctataagactgaatagatagctgcaatctatgtgcacgtgtcctggggcaggtgggctgctgggccaccacttcagctcttccttccccgggtttccaatc

SEQ ID NO: 22286 - DNA, 201 bp, Bos taurus
acggacctttgttgacaaagtaatgtctttgctttttaatatgctgtctaggttggtcaaaactttccttccaaggagtaagcatcttttaatttcatggctccattgaacaaaattcaatatactttcatgataaaaccatctagcaaactaaaaatagaagggaatttcctcaatttgctaaaaccaaatatgaagata

SEQ ID NO: 22287 - DNA, 201 bp, Bos taurus
agcctgacagggttttgcacaagaacaaggtgggccatgttttggaacctgtaggagagtacccacactgtctttgcagaagacactggaaagcaggtgctggggttctgctgaatctgtgagcgtccgaaggtccttaagtcatgtcacctgagcccaggatccccctcctgggtctgtgcttcccagctggcaagactc

SEQ ID NO: 22288 - DNA, 201 bp, Bos taurus
ctccgagtgtcctatagttttcagtctgcaggttttccaacttcttccaactccttaaatttattcctaagcatttcttcttcattatgtcattgtaaacgggattgttccatttatgtatttttcagatatttcctttttagtgtatagaaacacaactaattcctgcatgttgattttgggttctgcagctttccaaat

SEQ ID NO: 22289 - DNA, 201 bp, Bos taurus
ttgagtagtatcagtacagaaaaggacgtagggattatcaaattctaacactttgcttttcagatgagtaaacaatagtctataaaagccaggtcacagcacaagctatcacaaggctatgacagaagcaggagtggaggtgtcttctcagctctggtccaggctcttccaccacttatcctggttttgcacaatttgggg

SEQ ID NO: 22290 - DNA, 201 bp, Bos taurus
agcagattattaatagaaactggagtcataaaaccatgatgtgaaggaatagatgaggatttaattaaatgggaagtcaaaactcagctagagttctcccggagggtcagtggtaaagaatccacctgccaatgcaggagacacaggacacccagattcgattcctgggtcaggaagatccccaggaggagtaaatggcaa

SEQ ID NO: 22291 - DNA, 201 bp, Bos taurus
attagagtccacccaaattactttcttttattgtaattacctgtctaaagacactctccaaataaggtcgtgttctgagtcactgggggtgaggatttcagtgtataaattcttaaggcacacaattcagaccacaacaggggccatgtatctaaagagtttatttatttctattgcctttaaaactgatctgtacatccc

SEQ ID NO: 22292 - DNA, 201 bp, Bos taurus
gcctctttcatttccacacacatcaggggctctagctggtctgaaatctgaaaacagaaatgatgtactctctccacttagcagttccctggctggagaaaggcgttaacggtagctgggagggagaaacagcggttctaatgcaccatgaccgactcctcacctcccaggggaacattacgacgagcacggcaggagaaa

SEQ ID NO: 22293 - DNA, 201 bp, Bos taurus
aagtgaaggtggtgatttactgcccattaaaaggtgctaataagcagaaaggaaaaagcctctgcccagcgctgccttggcccctcagccccggctctccggtgtgggtgcgggaagctaatgaaccttttatattgccagtcataaaaagggccaatggctctccatgcagtaatggactctacagtgaaacctgcctaa

SEQ ID NO: 22294 - DNA, 201 bp, Bos taurus
aaaccctttctaaactgcaggcctggaataggtgttaattcagcctgcaaatatttatgagcacttcatatactggccacctacccatatgaggatcacagctcttcataagaatagagttctctagagtattcagaaggaatttccattgtcagtcatgccatcttttttcctaggcctattaaattcatgtgattgctg

SEQ ID NO: 22295 - DNA, 201 bp, Bos taurus
acattcaggctccatgtcctcagccatctccaccttccacctgcagctgctgaggctgggagttgctctggaaacagacaaacattccaaggccctcctccggggctcctctgttgccaggcaaccggggcacagtcccagccaagggatctctcctctgaacctctcttatgcctctggccttcttgaacagggagtact

SEQ ID NO: 22296 - DNA, 201 bp, Bos taurus
aggcccgcagcggcggcaatgaacagggcttaccacgcaggggagaggcgcgctgaactcacagacagaagattccgggacatgtgaggtgtctgcgggcgtctggggggctcagggccgagggaaggggcacacacctgtgccccagctgtgtggagacgttgtacaatgatttcactggaggaggaaatgcctgagctg

SEQ ID NO: 22297 - DNA, 201 bp, Bos taurus
aatactttcaaaatctgaaaaatgtttcattatgcaagggataacagtgtaataggagctggacaaccactcccttacacaacttacagtccagcagaggtggtgggcttaaatactttcaaaatctaaaaaatgtttcattatgcaaagggtaacagtgtaataggagctggacaaccactcccttacacaacttacagt

SEQ ID NO: 22298 - DNA, 201 bp, Bos taurus
cgcctggttcccaagtgctgagccggcggcctgggggagccggcggcctgggggagccggcttcccgcgcctcccgcggcccgccccgggggcgccttaccccctgcgagtgcaggtagtccatggtcttggtgatggtgcacagcactgcgctggcctcccgctccgagaagtaccgctgccgcaggatgcggtccagca

SEQ ID NO: 22299 - DNA, 201 bp, Bos taurus
tgtgaagccagcacttccagacccgcccacaggagggccacactgaccgggcaccatgtcacctgcacaggatgtgaaccttcatctggagacactgatagcctcacaggctaattcaggggccccatgacaggtaggggctcccccggtgcctcagtggtaaaaacccgcctgccaatgcagcagacacaggaggctggg

SEQ ID NO: 22300 - DNA, 201 bp, Bos taurus
tggatgcggacaatgacgatgctgtggtcctgggcggacacccctgcccattgaactgcactgacgctcccgctgcagacgggcctcccctgggagcctccgctggtcacctgccccctccatcctgccccaggggagggggtggtcctgcttccctagccccgtaaggggcattcccccaaacccgggccacttctgtgc

SEQ ID NO: 22301 - DNA, 201 bp, Bos taurus
cggccgaggagaacgtggagcaggtgcctccagggtttcctggggctgcgtgaccctgggcgagttactaggcgtctctgttcctcagtaagaagcgaataactcgggcctcggctggcactatgtcatggcttcccctccctctccttgcgtcaccacagaccctcgggactgtcaccatcagctagctctttccttgaa

SEQ ID NO: 22302 - DNA, 201 bp, Bos taurus
cagagggctgatcgcagtaggccagaagagaggagcgggcgggcagacagacggacggagccctgaaggtgctgcgggagtggggaatagtaatgggatgtgtcgggggaaagtcatcaggcctggctctcggggaagctgtctatccgagggcagatggcacagtgatgctgccaggcgctgcctctgatcagacatgtg

SEQ ID NO: 22303 - DNA, 201 bp, Bos taurus
tcagccaaagggagtttccattcattcacattcatgctggggttggggttagcgttgcccctttgaaatctcgggacagatgggccctcagggtcagatgcgtgtgcacctcggagttctgtgcatccaggcttaattctagacttgctttgatcctgcttgaacgggatactcaggctttgtgcgttttagtggccagat

SEQ ID NO: 22304 - DNA, 201 bp, Bos taurus
ccctccccgccagcggctcaggccggagcccgtgtttccgtcccatcctgagagtttgacccatcgctgttcacacggtgatgctctgacgtccagaccacgagggcccgccgtccgcagtctgagcgccttgtccccttccccccgtcctccccgcaggcaccagcgtgagctttcagaacatgcgcctgggctgcaagt

SEQ ID NO: 22305 - DNA, 201 bp, Bos taurus
ctgtgggcagcgcccaagtgttacagcatcggtccaagcgccggctcacacttccgcaacaacgctggctgggtgctgatgttaggcctgctttacagacgtgaagcctggggtccagaggaggtgagccgtgaaccatctgtgtccactcccacccactaccttgaatatgaggaatccaacgccccctgcccctggggc

SEQ ID NO: 22306 - DNA, 201 bp, Bos taurus
ctgagtgttgtcttgcccacccacccgcgctggccatgtttctgcccagaggagaccatctgagaggaggacagaggccctgagggcgtctctgcaccccatcacaccttcctgttccccagctctcagtggggctccagcagttccagggccctctgctctgcaaacgctgtggcttgagtgcagcctgcaaacagggag

SEQ ID NO: 22307 - DNA, 201 bp, Bos taurus
agcacttgttatgattttactcagaaaagctgtttaatatccataattagaaagcagtgagtctatgtccctgagggtggggctctgaggggccccccacgtcctcctctgcgccttttctacaaatgtcttagtgaccgtcgtgggctgggtgatgtccctgccacaccccagaatctggccaggttagagactgggtct

SEQ ID NO: 22308 - DNA, 201 bp, Bos taurus
agttttgaatacaaatttaatttctgtgataggttatctattcctcactgagtaagctctggatgtatagctctttcaggagggttttttaaaatttcgttgatttattgaatttagtggcataaagttggttgtaaggtctcttgctgcagatttagcgtctacagagtctgcggtgcttttgcgtctgccgtctgccgt

SEQ ID NO: 22309 - DNA, 201 bp, Bos taurus
aatatgcacaataaaatgtttaaaccccactttgattagtttgtcaggtgactagattattgcagtgatttaggtttttactctagagactcaaataaattagtgtgttagctttaaagagttactgaaagcaagtctgaaatgtaatcatttctccacacttgcctgaccgtgaactaaagtcccctgtctacacccgaa

SEQ ID NO: 22310 - DNA, 201 bp, Bos taurus
aagatatgaatcttacaaattcatttaaaagtaacaataaactctgtatttacctgtggtcctcatttgtagctatcaagctggatacattccgtaatatcccacctccactttcaataatggctaaagtattggtctggctgcgataagtgagagtgccaaccaaaaatgcaagcgcaccatccacagcacatatgtcag

SEQ ID NO: 22311 - DNA, 201 bp, Bos taurus
agagtcgaacacaactgagcgactgaactgatctgagctgatgttcccagaactgctccatatttgtggtggttaaaggattgtaaagagtgattatatatagagaaataagagcactgaattctatttctgaggtcagattatcttctttctgccttattagactatggcctccaagtctaaagatgtagttcagtgata

SEQ ID NO: 22312 - DNA, 201 bp, Bos taurus
agcagtctcatttcatttgaacataaagatggcacagttttgaactcatttgacatccgaaacactgcaaccagcagccctgctactggcctccgcagttccgctgcagggactctaagagctctagcacaattatcagctttatattaagtatctgaaagtgcatatatttaagtgacaaacttcataaattcaagggaa

SEQ ID NO: 22313 - DNA, 201 bp, Bos taurus
ggatattaataatttccctatcaggggtctaacccaggcccatggcaatgaaagccctgagtcctaaccactgatttgcctgggaattttcctttcctcccagagttcttgaagtacctaagtctccaaaaggtgtgctatttttccctccacttccttattttattttttatatgatccttttcaattttggtaatatcc

SEQ ID NO: 22314 - DNA, 201 bp, Bos taurus
gaccctcctctagtgccttctgtaacaggccttgccagatgctgtcacggctgataaatgcaattcaagaaggaccaaggacccaccttgagggctcaccagttaggaggagagcaggacaatgggctccatcacctggctatccaaattggaaagagacacacgcccaagagagggacagaaaactcgatgatagtgtga

SEQ ID NO: 22315 - DNA, 201 bp, Bos taurus
acattttcaccatattctgagttatagtgacataaattacttattttggaaatagactcagaggtaaggaaaatggcctattttattgactattctgagatattaccatactatgtgctgcgtatgctgtgctctttgtgatcccaggaactgtagatggccagactcctctgtccatggtattctccaggaaaggatact

SEQ ID NO: 22316 - DNA, 201 bp, Bos taurus
ataagcattgtctcactggagaagcccccagaatgaaaatatattcacatagctgttttgatacctgttcaccacacagttcctgagggcagtggaatgctgggtcctcctaggccaacctggaggggcttccgtaagactaggcagactgagactaggcagtcctatccagaaaggcagagcagggacttcacagcggtg

SEQ ID NO: 22317 - DNA, 201 bp, Bos taurus
acctacccaactttcagtcacaaaagctatagtacttcatgacccaggcaccctgcactaacattgattcctccaacactgcctgctgtcttctgactgcctgccctcacagtgctgacccgctacctgttagggaggtagaataggaaaaaggagtccaaaatgacggtggctaaaagacaaggaagggaaaagcccatg

SEQ ID NO: 22318 - DNA, 201 bp, Bos taurus
aaatcaaagaggaaatcagaaaatatctcaagacaaatggcaatgaaaatacaaaatctgtggaatgcagcaaaagtagttctaagatggaagtacatagcaatataggtcttctttgagagataaggaaaaaatgcaaataaaaacctaaactaccacctaaaagaattagcaaaagaacaaacaactcaaagtcaacaa

SEQ ID NO: 22319 - DNA, 201 bp, Bos taurus
agagacatttggcatccagccaagggcctctgaattcttgacgtgttgggatgagccaggatggaaccagggtgtcttcactggtagaaaggaggcctgcaggggctgaggaactctcttgcggagcagggaaggctggtaacccgcaaagccttgagcaaacagggtctcaactctggacgcatttattgggcccccgtt

SEQ ID NO: 22320 - DNA, 201 bp, Bos taurus
ggttataacctacaaaaattccaaggtttccaagggaagctagataagtcaactttagggcagtgagattaatttttacgtgtgatgctgcattaataggccttgactgtggccatgtggagctagaatggcagccagaagctgggagctgtagtttactacttactacttagtaagtaaataagtagtaggttagtaagt

SEQ ID NO: 22321 - DNA, 201 bp, Bos taurus
ctgagtcgaaggtgcttttgctgtttcgataagtgaggcagaatactaaactgtaccaatttgcaggtttcaccaacaatccatgtcactcaggattttaaactgagatttagagatttgttcagttgatagcaggatcagagattgtaaaaaaaaaatgcaccaagggaaaaaaaaatgcaccaagagaagcagtgaagg

SEQ ID NO: 22322 - DNA, 201 bp, Bos taurus
ccccaacccctgaaactcacatttgaaaccaatccccaacatgatgctgttagggaggtggggcttgtgcggggtgattaggccatgtgagcagaacccttagcgttgggataaggtcccttaccaaagagagagccagccctccctttcaacctgggaggttgtgaggttatagtgaggagatggccctcagtgaggaag

SEQ ID NO: 22323 - DNA, 201 bp, Bos taurus
attccaccattctccaagatgctctcaaagacctatctcttcctttgttgttgagacagccccagttcctccactgttatttctctcactgaaatacacatgactttatttaactaaggtttgtccctgctagttttgagccagttctgctacgataaaagaagtgtctaaatttcaaattagggcacctttaagtcatgc

SEQ ID NO: 22324 - DNA, 201 bp, Bos taurus
cccaaattcaccactagggcccgtttccaaactgggactgggccagagtgaacttatcaaccatcaccttcttgttctagcttttggagctgtttggaggttcaagaggcggtagtcttgggcccctgtgcctctcagaatgccctgtgctacaggaaggagtgtggcctttgctatcaggcaaacctgggttctggtctc

SEQ ID NO: 22325 - DNA, 201 bp, Bos taurus
catgtccagttctaactgttgcttcctgacctgtatacaggtttctcaagaagcaggtcaggtggtctggtattcccatctctttcagaattttccacagcttattgtgatacacagttgcccttcaatcagtaaacagttaagtaaactggtaatccatacatggaatactacacacagtaaaaggaaataaattactaa

SEQ ID NO: 22326 - DNA, 201 bp, Bos taurus
tctttatacccatacaaagtcatcaagtatcatcaagtgtcaggtttaactttctttttatgaatgaggggacccaccaaggtaaaagtgccaaggccctgtgaatgttgtgatgcagcccacttcttttgaactctgaagacaaatgctttttagacttgttgccataggcctggaggaaggtgtcagtcatgttacgga

SEQ ID NO: 22327 - DNA, 201 bp, Bos taurus
ccttgcccttcccttttctgctgcttcagaggatttccatcttcctctgtgaggtgccccagcaaagacacgtgtgagggtagaggccagagtgtccaagataagcaccgccagccagcctgtaacacacccaccctgaagttcactttaatctctgctaagctgctctggcctccacttttagtgctaacaaggcgtgtt

SEQ ID NO: 22328 - DNA, 201 bp, Bos taurus
ccactggaagagaaaccacttccccaaagccacacgcctgccagcagtggggccaggacgcgtccccggtgctgcctgctgcgtgccgttggtggggcccactaggcgtctggtgaggtctagttcccctggggacctccctgtaggtagcacccctgaaagaatgaggtgttatttgggcctcacagagtcttaaccata

SEQ ID NO: 22329 - DNA, 201 bp, Bos taurus
tagaattcagcttaagtcatggcgatggccagcttgggaacagggagaacgggccctggcagcttcctgctctgcctgtaaacacactcctttggcctgggagcgaataacaattccaggaaaatgaagggtcacaagatagatagtaactatggaatttgcccaggacaaagattacccatacttctttgcaagcaaatt

SEQ ID NO: 22330 - DNA, 201 bp, Bos taurus
atttccttagtgactgaaatggctttattactctccatgggccctgataatttatgctaacaacatgacctacggttgacccctagtttaataatgggataactcaggttgtgaggctggccatttcacaaagaccaaggaagtgactagaagtttggggcttagagccaggtgggcttattagcttccctggtggctcag

SEQ ID NO: 22331 - DNA, 201 bp, Bos taurus
gtggccaatattttgaaagtcatgatttcatatacttggtctgaatttacagttgttaaatattaatatgaaggtaaatttgacatcagttactccttttcggccaaaaatgggaatctctgtatactcatgaaaaaaaaattattattgggctggtttggatctttcttgcatcaggtgagatctttccttgcggtgcat

SEQ ID NO: 22332 - DNA, 201 bp, Bos taurus
atctcatctgatcttggaagctaagcaaggttgggcctgattagtactcggatgggagaatccacaaacctctgaacctcagagtccagtctttctgcctcggacaggcctggcacacagatgtgctgactgttctgatcactggcgagagctctgtagctttcaacattcaccttcactaacagctactccctgagaaag

SEQ ID NO: 22333 - DNA, 201 bp, Bos taurus
gaggccttcagaatgtggtgtgtgaatggaataccatggcccaggcattgggaaggaattataacagtttcaaaagaggcttagtaggaatataaaaggagtgaaaaggctgatatggccacccatgattccatcctcgcagcagacgaaggtacctcttacaacccactcccgtattcttgcctggagaatcccatggac

SEQ ID NO: 22334 - DNA, 201 bp, Bos taurus
gaaatggcaaaaaatggctgtcaggggctgaaattaggagaaaggttgactacagatggtcttggaaattcggagggtggtagaacctgttccaggtcttgattgtgatgtgtggtatatttgtgaaaacttgcagaactatacctctacaagggtgatcagctgggcagaattgacgttcccagagctgattcctagcaa

SEQ ID NO: 22335 - DNA, 201 bp, Bos taurus
acagaggaaggtagaaagagaaaagacccattggtagatggggggagacacggaattgggtgattctgattttttacctgctgagcttgaggtgacagttatatttatgacaaaaggcaggcgctggtcatgtctgcctcccttgctatggtattccttggttctctgttggcttttgcactcagcctcacactgactaga

SEQ ID NO: 22336 - DNA, 201 bp, Bos taurus
aataagagttcagatcttgctcctaactccttttgcctgccagattgatgtttcaggtgcctcattagtcggatgtgtgcttggcctttcttggggaatggatgagtgaccttcatatcctctcttctgcttgggagtgaagtgaagtaaaagtcgctcagttgtccaactctttgcgcccccatggagtatacagtccat

SEQ ID NO: 22337 - DNA, 201 bp, Bos taurus
ggcgctgtcaggcagggacctgatgcagtgattggtccacatagaaaacatgaggcacaactgagattccccttcatttaaataaatacagagcagcaagaacaatcaaaagagggtcatttggggagttaaaataattgtaaaaagcggcacctaataaatacatttttcccttttgttttccagatattctacccggaa

SEQ ID NO: 22338 - DNA, 201 bp, Bos taurus
ttaaagctattctatgacacttaaaaaaaaaagcaatgaaagattagctatagccttcacagattaaattcctcatacaaatataaaaaggccaactttgcttaagaaaaatattttatgaaagcagtatcacacagtgattcagagcactgactctgcagtcagactactgcctttggccctatacaggctgcacaaact

SEQ ID NO: 22339 - DNA, 201 bp, Bos taurus
atgtatttcattagaggtagtttccttttcagcatttttggacttctgctgtgttttttttttcgtttgtttgtaaggaaagcatttgttaaatcagcacattggggttgtgtgtgtatgtgcttggttggcagtggggcaggggacacaggggcttaaagaaaacgcttttggaagcagatgtcaaagtgtgtttatgtc

SEQ ID NO: 22340 - DNA, 201 bp, Bos taurus
gtgcaggtagtcaaccatcacaatctacccctttgggcacatctgcaggcttcttatgcacatcttcatacagaatccacaaccatgatctgcattataattaatgaagcagcacatctgaccaggtccaccaggtctgatgtagaaccattttcaagatcttcagggaattgaagataccctaaggagaaagtatggcta

SEQ ID NO: 22341 - DNA, 201 bp, Bos taurus
caagaggagtcaaggtctcacagtgattagtgtgacagttatcgctacatacctttttttttggctgtgctgtgtagcttctgggatcttaattcctcaatgagggatcaaaccaggccccgtgcaatggaagcaaggaatcctaaccaagggactgtcggggaattccccctcatttgcacttttaattcctatccattt

SEQ ID NO: 22342 - DNA, 201 bp, Bos taurus
ttagtaaatgtgcacccagcactgttgcagaattataaatggtctggaatagaggccattgttcgctgaattctatttcagtatctgaacatgctatcaccgtgtaaaacagatttctttattacatgcaagaaaatcataatctctttatttggggacttaagaagataaatacttaaacagtaaaacaactgcttaaca

SEQ ID NO: 22343 - DNA, 201 bp, Bos taurus
atgtgctccacgcctctagaattatctgatgccattgtagtgacgtgctgggcaaactaaccagacatcacattggccattagtatcccaaccacttatacagaggtggacagagcactgctctcaccaacctgactttttctctcatctttccttggctcttggcctcctgccagtagcttttcttcagatagctaatgt

SEQ ID NO: 22344 - DNA, 201 bp, Bos taurus
aatcagaggttagattattgagtaatgaggcacccacagtcacacaaagtcagtgacagggagcctgggtggttatgcggctttctttgggtggacacacagagggtagtgaattctgacctaagtgaagatctgggacattgtgttacaggctgcaaccctcccccacttgccccagcagagactcatgaaggcaggtat

SEQ ID NO: 22345 - DNA, 201 bp, Bos taurus
accttccttgccttttctagcagctagattgcattcctttcattccttggctcttggcccttctttaatcttcaaggccagaagcataacatcttcaaaactctccgctctgactttactttgccttcttccaatctatgacaaactccctcggcctcactcctacatggacgtttgtgattacattcggttggccaaaaa

SEQ ID NO: 22346 - DNA, 201 bp, Bos taurus
ccagggaaaatagtgtcaaaaggcaaggagtgaggggaagagtaccctgtctccagggttagcaagcctggcagaggggctgcacctccatctcagagagcggccagtctcagctccagaaagctcagcatgtagagctaaacatctggcttgacagcagggaacatgctgttaatggcagttcagaggaatttctgtgtt

SEQ ID NO: 22347 - DNA, 201 bp, Bos taurus
aaaaggctggcctgaggggccaagagcatgcagcccgtaagttctagaaagatcaaatgtgtctgacagtgggctgctgggggcacagggacagcctcaacggaggccagccatcaaccatcctggtaacctggctctttgaatggcactgctttttcccgggcatttgaagtactagacgaacaccattaacattttctg

SEQ ID NO: 22348 - DNA, 201 bp, Bos taurus
gagctgtaagaccactgtacccacctttcctacaactggaaactgcttttaggaaaaataaaaagaaggtgatttttctttctattcttcagggccttttggaacatctggatagtggggaggttgtggttggagatggcagcttcctcctaactctggagaagaggggctacgtgaaggccgggctctggactccagaag

SEQ ID NO: 22349 - DNA, 201 bp, Bos taurus
cttgtcagatttccatgaggctaagccagcgggtacagtggcagaatcgccttgtaggccaacaaggaggataaccaattgccttctatggcagtcagcctagaggatggtcttcaagtcaagtgcagaagccaaaggaagctgtgggggccaagttttggactcgggttagctagatgagtaagagaggccctggagggt

SEQ ID NO: 22350 - DNA, 201 bp, Bos taurus
tatgagagtttagagaatgcagttaatagaagtgctttagccaaaatgatagaatatcacattcagcctcaaatgaatggacttaattcaagtctcaacatagtatatggcagtccatccttgtgaaaatcatgctgtggctggtttggaatgggcttactgggtgacctacctggacagctggaaacctctcctggaaat

SEQ ID NO: 22351 - DNA, 201 bp, Bos taurus
ggaatccatcttggaaatcaagaatccttctgagcgccaagagggaaggatctgttccaggcctctctcctcagcctactgatggccagcttccctctccgcatacctgtatccaaatttcccctttttataaggacaccagttatattggattagggcccactcttacaacttcattttaacttgattacctctgtaaag

SEQ ID NO: 22352 - DNA, 201 bp, Bos taurus
ccactgctctgcaagatcagctactctactgggctgagctaacagattacacagcggaacccgaacactgctgcctttatggtgttcttacaggccacctgccttcacagttcactcatccacagtctctgtctttgatttactgatccctttccactcatatgccccaatttttcttttctctccctcgcagctccctct

SEQ ID NO: 22353 - DNA, 201 bp, Bos taurus
attaaaactttgtttgctttgcagtaagtaatgaattttctcccatatatgtaaaactttgataacttttaaaagagattacttggggggaaaaaaatcagtgcgtccctgtaaaacagcatttagatagctctccccagaattttcattctacagaattccactattcgaggcttgcagtcgaacagtaagtgcaaggcc

SEQ ID NO: 22354 - DNA, 201 bp, Bos taurus
gtcatggatttgtgagacggtccttaaagtcacgtggtgaatgaatgacagtgggtgctccaaaaggaagatttttactttcctgagtgaggaacacagctgctgccagagcaggtaggcaggctctcgatcctcaaattgtggcatctaattgctttgacagataagcaacaggggtgaaggaggggccctaattttgtc

SEQ ID NO: 22355 - DNA, 201 bp, Bos taurus
catgtaaaaaggaagtggtactaatacatcttcacttacctcagttacttatgaactgcttgtggttaatgtgatgggaaatgtacatatattctttgcctggatagcttactggaatcgaattactatgttccttcaattctgtaattcacatactccctttttttttttacctttgtaaaaccaggatgcttttgccac

SEQ ID NO: 22356 - DNA, 201 bp, Bos taurus
taggggaagactaactggcagccctaaccagatttccacaatacagaagaggtgagccttacagaagaaatctagattctgtttgctaagaaaagggagcgtgggtgtggagagggaaaaaaaaaaaaacagcaaagagaaaatctatgaatcctcaaaacaccacttgctgtgctcctacctagccttttatccttttca

SEQ ID NO: 22357 - DNA, 201 bp, Bos taurus
gttaattctagcaaaaatagcttttgagaactaaaagtgtgagttccattttcaaggaaaaaattctttggggagcactggcagttaagttccacatcatctcaagggccgcattgttaacgcaaaagacaaagctcaaccagtaagttcaaagctctccatccctagtctacagagccaacccaagaaccataggccagt

SEQ ID NO: 22358 - DNA, 201 bp, Bos taurus
atcactcatttatatctctctatcatttattacgggcgtccctggtgatgacctcaattactaagattaattagatgaataaatggtatcaccttgttcttgcaataagatatgtcctttgagaatagaggttggtatgacattacttttaagtttctctattatgcaaggcagagaataagcaaatgcagatgctgagtg

SEQ ID NO: 22359 - DNA, 201 bp, Bos taurus
aaatgatagaaacagctgagagtctcaccatcctccttccacatcttgcctattgccccgcttcctcagagcgccgtctcggacacgctttgcaggccccgaggggcgctctcaggtacactcctattctcttgggtcgcctctgtctctgggatgctggtgcagaactggagccaggcaggaggcccatcagagaaagct

SEQ ID NO: 22360 - DNA, 201 bp, Bos taurus
cttggaacgtcagacattggcacctaagtggaaagaagaatctaaaggtcagttgcactggtgtggtcagagcagctggccttggcctaaagggaggcgcgctctcagaactacagcttctgaagaggcgtggtgtcttcagttagctgccttctctaggccctgtctggggataataatctcccttgggggccctctcct

SEQ ID NO: 22361 - DNA, 201 bp, Bos taurus
ctcatgttcacactaggtaacacacaggtcttggtttctttattaattacaggcagctgttgaaatcagtctccccaacttttcaccatcaagaagccttgttggtgtcccctgtctgcaaagctctctcaatttgagagacactgctgtccccacgcgctggtgtccaaggccagtcacgtactgaacaggtgcaatttg

SEQ ID NO: 22362 - DNA, 201 bp, Bos taurus
tcaagggacagaaaacacagagccagcggagcactagcccggctactgaatacctttttgtttaaaattagaattctgtggtgaagagcagcccctctcatgcacagaccttgaaaaagcatttgctgccacgtccgcagctcccttctgtccccgtcacggtgactgcgccccagcgtgcgctgacacggagcccaccgg

SEQ ID NO: 22363 - DNA, 201 bp, Bos taurus
ttagcagccatattcctcagcttctataattctcactgggtgattgagatggtattgggtatgttcagggtggtatggccgtggactcattggagggatttagggggaaaaaaaatttcttgaaaaatatttggagcctttcaaaggtgtgatgtgagtttgagtgaactccgggagttggtgatgtacagggaggcctgc

SEQ ID NO: 22364 - DNA, 201 bp, Bos taurus
ctctgggcatggggaggggcctgaggggggccacagggagacgatggatcctggctcatgaccactcaccttgcctggtgccccactgccttttatgcaccggtggccctgaccttcccctgcagacccaggcccacggggtcttcccatcctcagtgtaccctctgcacttgactgcagaccaagcaggctgtgaggaat

SEQ ID NO: 22365 - DNA, 201 bp, Bos taurus
cctccccctggaaggaagtgtatgtcatccaacctggctctcctgcgctcccacagagccagcgcctgggccaggaagggccaggctggggcagaccctaagtcctgagtgagcagtgctgtgacctggcacttccttctgaactttctctctaggggtccccgacccaggacatctgtgactgagaccttcacaggtggc

SEQ ID NO: 22366 - DNA, 201 bp, Bos taurus
tggcatgtacataggtcacttcggatagtctgaaatttctattgcactattggctcatgatcacacttcttaaaagggcctttagtagttactactgtatactttaatctcacatgtcacccaggaggggccaatacctagatagctgagaccctgaaagcatggtattatacacatgaagggtagatttaaaacagtgag

SEQ ID NO: 22367 - DNA, 201 bp, Bos taurus
aaagctcagattctcctgcctcaaatacaggcctctctcccctaagctaggtccaactggtaggcaagagtttctgagaaaccctaaaagatacaaccatcattcttgaagacatgctccctccactgtttgccactctcgcttcaccaacccaaatcttgaccatcccgtgaagacaactgttaagacctgctttcgtct

SEQ ID NO: 22368 - DNA, 201 bp, Bos taurus
acaccagtgtctttcatggcacacactactctggggacccacagttgcttccctttcgagatgacagtaccactgacctgaaaaggccaggaaaaggagacggcacagacccagggtcagagggacctgtacctgaacgccagccctgggtgagaacgacagattaacctctctgtgagtcagggcctcacctgcaatggg

SEQ ID NO: 22369 - DNA, 201 bp, Bos taurus
gcttcatatatatatgtgtgtatatacatatatatatatctctcatgtatctctattatatataatctgtattatctaacagtaggacttcacagaacaatataattcatcctcatagaggtcctcctgatttaaaaatactggattttcttagtttactctcacaagtttatcagtcatggatatatatatatgtatgta

SEQ ID NO: 22370 - DNA, 201 bp, Bos taurus
acagcagtggttatatggtgcttacacataattatctcatttacatccagcactttccagacacattttgtatggttttttcccaaacatgaatttaagacatgtaagaggaaatgcctctctagaaaacagatgtatacaagttcttaccccaagaagaactgctgcaaaacttgagaaaaagttttcctaaagagtttt

SEQ ID NO: 22371 - DNA, 201 bp, Bos taurus
caggtatagtcagaccgaatgtctgtgttagttcaccctccagtaggaaaaacatctgtgcctgagtgggagactccaggggcgggatggatgcttgggctcctctagcttatcttttctagacaagagccctaagcctagtgaaaggagggagcttctgaagccatgagaatcagacaggaattccaggaatctttctga

SEQ ID NO: 22372 - DNA, 201 bp, Bos taurus
tccctggcaccaaatccagggcactagagtttgactttcagttgtatgaatcccaatcttccacatttgtaacatgagatgcttgttacctaactcactgcctcactcagagagtgagaggtaattgtcacatggtgctggtcagagggtaaactgaatacatttttctcgagagtaatttggctatatgtactcaaaaat

SEQ ID NO: 22373 - DNA, 201 bp, Bos taurus
gattcagacgagcctcccactttttctaccttttgaccctttagctgttctttgcctcaggtagcggggggcatggagggactgtgacatcccagagatacacatggcctctgagtccaggggttgcaattcagtgacttctgggctgcatctgatctatagatagattgtgtggcctgtggtgtgacagcacaaggcaga

SEQ ID NO: 22374 - DNA, 201 bp, Bos taurus
cggggcctcccagggactgccggttgctcagcccgagtctacagattggaagccacttactttggagagcgggggccacggtcttggagaacctgaagttggagttgacccgtgaacacatccctgtggtgtagtaggaactcccacactcgtgcgaccagagggggctgcaggcctgtggagcacagaacggacccccag

SEQ ID NO: 22375 - DNA, 201 bp, Bos taurus
tggtgaccctacggcccctcctgggcttttctttggtccaggtgggaccacacggtgatcggtagcatatggccctgtgcgggacacagacagggccgctaacggataaccctccaactacccacccccagcccaaattccacttcgtggctcagccccccacactctgcttccaccttgtgtctccagcccagcttggcc

SEQ ID NO: 22376 - DNA, 201 bp, Bos taurus
tttggctgactaccagcgggccagaggctagacattaggcggttgctgctaagtaggaggccaggggccaggagaggccagctgaaaggcagcagtactgatggacgtgaggagaaggggcaaagagcattttctggaggggatcataattggaaagaagctcaggttctgcctctaattagactggccttgccttgtcca

SEQ ID NO: 22377 - DNA, 201 bp, Bos taurus
agagaggacaactagaccgctgactgataaggagacagagcttcaactggaaggcatggtccctgtggggattcagcctccaaacgcattggccagagctattctcgagtcttccacggtgccaagtcgctctgcctctagcatgggggtacaactgcctggaaggattctggggatgtccctgcaccactgggcctgggc

SEQ ID NO: 22378 - DNA, 201 bp, Bos taurus
tcaggaggcctcccagcctcccagatgggtttccctctgctcaagtatccattctgggtgggggacagagtgaaggacaggccatgtggtacaaacaggcactgaggctgaaggcattcatagacgggcgtgggaagggaagcagagataggctttgaacacagcacttgttaaaatttgctcaatgtgtggtcctctggg

SEQ ID NO: 22379 - DNA, 201 bp, Bos taurus
cactggacagagttccatgtgctatacaagtctgaccttgttggttatccattacaaaatagcaatgaggaatacttagggagtttcggatggccatgtacacactgagatactgtactttataggacgtttttgaataagcaaaagcttgccagctttgagagaggcctggagagacggaacacttctcaagctaaccag

SEQ ID NO: 22380 - DNA, 201 bp, Bos taurus
ctctcaacacacagaggcatatgcacacacacacacatatgtacacacacacggccagcttctttttccctcttacacatccttgcaggtcctttgacctgtgctgcttctgtatctagaccgtggcccccactgtgcttccagatcctcagagagagctgagactcttgggcgatgactttcagtgctaacagcctccct

SEQ ID NO: 22381 - DNA, 201 bp, Bos taurus
tgcgatctagctccctgaccagggactgaacccgggcccctgcattgggagcacggaatgcactggaccaccggggaagtccctcaagaagtgcttctgatggaggaggtcttctatggcctattgaagccagacccttgcttggcttcatgagaggtaaaggtttctggttgctggggttctctgaccctcctccatgaa

SEQ ID NO: 22382 - DNA, 201 bp, Bos taurus
tgctctaggacttaggcagtaggtcagaactgagggaggttgattttgctgtctctgttttagtgtatgacaatacagtaaatcaatacaataacttatacagattggaaatacgagatccggtactttcagaggactgagtctgacacacgcagtgcagtgtgtgtgtgacctgtatgaaatgcacatcaagagcgaggt

SEQ ID NO: 22383 - DNA, 201 bp, Bos taurus
aaagatgaagtagctctggggagaggtgactgaacaatggtatgaagggtaaattggttcacttttcaaaatgccagggccatcctagaacttggattcatataaaaggtatattcagagcatctgttaggtgctaggcacttgggacatctgtgcatttgatagggaaatgaggttgaggttgtaggactttctggccca

SEQ ID NO: 22384 - DNA, 201 bp, Bos taurus
cgcccaccctgcttccaggccccacccaccctgcatccagtcctctcatgccctcccagggaatgtgtctctgctttggctccagcaagccggacagtgcgaactgtcccctggtacattaacgtccgcccaagcagtcattaacagagtcacaatcaatttctccagaatgattgctactgcacagggaacttaatggaa

SEQ ID NO: 22385 - DNA, 201 bp, Bos taurus
gtgtaatccaggcatgaatgcatgtacagacacacacacacacacacacacacacacacacacacacacactcagatatgccaggtccaagcctccaccccgagatgttacatgctgggcacactcacaaatgtacagacacaccaggcacagacactgcagacaagcaagctggctaggggcacacaggaagacagagat

SEQ ID NO: 22386 - DNA, 201 bp, Bos taurus
gctgggccgctcgctgcccgtcctccgtgtctgcggggtctccctggcacagccgagtcggggtctccccgagcttgacagccccgtcacagtccttgcttagtagatgacctcataaaccgtggccttcttgtcaccagagcctgttacgatatatttgtcatccgccgaaatgtcacagctcaagactgacgaggattc

SEQ ID NO: 22387 - DNA, 201 bp, Bos taurus
acctatgaagtcaggtgcttactggatttggtgcctggagtcgtcctacccctgggatagagcatgcttctcagatggaccgtggggcccaaaacagcctgcatttctcacagcttccccggtggaatctgggctacctgtgctcatatcccattttgagtggggagggtcttggccactggggagggtggggctgcagtt

SEQ ID NO: 22388 - DNA, 201 bp, Bos taurus
ggccggatttccaggccagtgccttctgctgtctgcctctggctgctgcttcgcccgtgaccgttatctgcttctagtcttccttccccagcagccacgagatgaaggaaagctaccagaatggcctgccagccgtggtggactctgagaagccaggaccagatgtgggaatggtcccttgccttctccctcatcccctgt

SEQ ID NO: 22389 - DNA, 201 bp, Bos taurus
tgttaggggactgcagaactataaagaagacaaccatgcagtatgtgccttgatggaaatcagagaaggtgaagaaacaggccatccatataaaaataagatgttaaaattctgcaagagtttttgaggggtttagggggctgtgtgagtgtgtattggccaaatatttttcaaatgttttataatggttgtgagattctt

SEQ ID NO: 22390 - DNA, 201 bp, Bos taurus
agtacgtttggaatgtattacaatcatgcctgaagagaaggccctccaagtgagattgaatggaagttcttcctgtcgtcacagaacacctactgggccccgaagtgctgttctaggaaccaagaatataaaaaataattccttgagaaaagtctttactcttctgtagtgtcctgttatggggaggaaaggaaagcacca

SEQ ID NO: 22391 - DNA, 201 bp, Bos taurus
gagatgagggtgggaaggtatactgcagtgcttctccaactttgagtgcactgcagccaccaggacagcttgcttaacgtgagtgctgggccccacccaagtttctgattcagccagcctgagccaacacatctaccagcttccaggggatgctaatgctgctggcccaaggaccacactctgagaattactgccacaatt

SEQ ID NO: 22392 - DNA, 201 bp, Bos taurus
ctgccgtcacatctccttctctgactctcaccctcctgcctctttcttattaaggacccttctggttacattgagcttggccagataaatctttccacctcaaaacccaggatagcttaattatatctgcaaaatcccttttgccacattaaacaaacacatcccagttccagggattaggacccagacaccttcagaggg

SEQ ID NO: 22393 - DNA, 201 bp, Bos taurus
cttgcttccattaaaattaccttgcaagaaaaagcagaaaaattaaagttccaatgataatagatttgaaaatataataaataagaggatagtaatgaaagtaatattaagggagtaggagagtatggctacaaatttcttctaaaaggaaaagatggatgataatgctttcaatggtggcagcaatagtggaaacattta

SEQ ID NO: 22394 - DNA, 201 bp, Bos taurus
attttatcaatggtttcctttgctatgcaaaagcttttaagtttaattaggtctcatttatctgttttggcttttgtttctttttgccttaggcaacaatccaaaacaatactgctatgattcatgtcaaagagtgttctgcttatgttctaagatttttatgctttccggacttatatttggatctttaaaccattttga

SEQ ID NO: 22395 - DNA, 201 bp, Bos taurus
gcttccacggggcccagccccttggttgttctctctcctgtttcttcattctcttcttttgccaaccaaataccccccaagcaatcggatgttaaaacaagcacacaacaatggccgacagtgacacctctttgactttcctccagttctagccaccatttttttatccctatagactgatgcagtccccttcttagctgc

SEQ ID NO: 22396 - DNA, 201 bp, Bos taurus
ttacaggatcccaggcaatgttgaggccactggtccaggggccacacgtggagcagctaggtcacagcagacagtgcagcagagacgctctctagtgtccggatacctggcggtgtggccttggacaaatccctcaacctctctgagtctgttttcttatgtacaaaatgagacctttaatcccatctcacaggattccaa

SEQ ID NO: 22397 - DNA, 201 bp, Bos taurus
agttggcggtgacagcagcaacactgcaaacacacaggcccagccaggcccaggcgtctgtggagccgccaacaggctgaagctgccacaggaagagcgcaagagggaggtgagcgaggccgatttccaccaactcttctgagcattcctgttcgtccttccaggggcaagtttctgggttgcagtttccttactacgcct

SEQ ID NO: 22398 - DNA, 201 bp, Bos taurus
actgggtcttctgcattgtaggcagattctttaccaactgagccaccagcagttgggataaaattcgaagataaaagcctgggatttgaagtttgctatgtgtgagtttcagagacggcaatggcaccccactccagtactcttgcctggaaaatcccatggatggaggagcctggtaggttgcagtccatggggtcgcta

SEQ ID NO: 22399 - DNA, 201 bp, Bos taurus
aaaactcctagcctcgtctctggcccacagaagtctgcggcaccttagctattaccgtctgtaactgatggagaacgggtcagagaacaggtgcaggggcgggatgtgccaaggcaaaggcctgacccccatcaccctgcaggctggaggtccaagcctgacccagccccgtctcctcccaggctggagttgagtcctgga

SEQ ID NO: 22400 - DNA, 201 bp, Bos taurus
taatcctgggcaccacgctcctgctccacatcacagcagtctactggttcttaactctggctgcaccttagagtcacttaaggaagttttaataatagcagttcccctggccccatccctagaagtctgacgcagctagatgagatcactgctaaatagctgatgtgtgtaccccaggggcttgagcctaccttacaagtt

SEQ ID NO: 22401 - DNA, 201 bp, Bos taurus
ccaaacctcacccgaacccagtaaccccattcctgacaaatcccatcctataggaagtcggctatggcatctcttcctctgtctgggcctctcagagccttgcctgccttccacttcctctgctcatcaccccatgtccagaccctgcctgggggatgggggagctctgaggcttggcccctttcccagctgggtgccatt

SEQ ID NO: 22402 - DNA, 201 bp, Bos taurus
gacagaggagcctggccagccacagtccatgggtcacaaagagtcagacacgactgaaatgacttagcataaagcacggctttgcagagctgtactagacgtgctcaacctttggccaaagaaacatcagaatgttctcatcagacaatgatcatctgtgaccatgatgatgtcaccaactagacttgggttggtgtcccc

SEQ ID NO: 22403 - DNA, 201 bp, Bos taurus
agcaggaaggagagggtaaaagcaccgcccccgcgcccccccacccctaagtctggggacagcctggggctggcaggcagcccagaccctcctgaagcccccagggctggaggggcggggagagcgcccgagttttcgggagttttcagacttgcgctgtttatgaaagcctttctgagcaagtttgagctaagctgagag

SEQ ID NO: 22404 - DNA, 201 bp, Bos taurus
tgtaaattctcatgctgccaggttcgttgcaggtagtggctctagaatggagatgtttcacgggaagggtactcactgtccctgactctactgggtcagtgccggctccacttgccctggggtagcacccagatgccagccttatgcagaaaatcccagaatctcaaagtcattgggatctctctttattgaggtatttaa

SEQ ID NO: 22405 - DNA, 201 bp, Bos taurus
gctggattgaacagtataggcagaatgaaccatatgaagcttgcaggcctgagaaaatatgacattcaagatttcaatttaaatacaggatagggttccagaggggaatgtacctggagaagtaatttagatccaggtctgagaggcctaatatgccaagtttttttttttttttgctctgtcctatgtactcatggttaa

SEQ ID NO: 22406 - DNA, 201 bp, Bos taurus
actagaaatagagctactgtatgagcctgcaatcccactcccaagcgtatatccagagaaaaacataatctgaaaggacacatgcgcccaaatgttcatcgcaatgttcactgcattgtttgtaatagccaagacggggaagcaaccaaaatgtgcattgacaaggaatggatatagaagatgtgtgacatacctacaatg

SEQ ID NO: 22407 - DNA, 201 bp, Bos taurus
ccctgattggcctggggaagcggggccgaagagggccacttgaggcagaagtgggcctaggaagccaagcacgagcctctcctctggcaaggagaagtggtgaagggcactcaggcgctaggaagacagaggatgcctcaatagcaactcatttcagttactgctcctgccccccaatcaagattaaagcctctccaggca

SEQ ID NO: 22408 - DNA, 201 bp, Bos taurus
ggtcacctggaagtctcctgagggccaaggcccatgtctgaggaaggagctcatgaagcagacccagaaccctgaaaaggttcctgactgaggacaaacccctgggcctcagttcccttgtctgaaaagtggttgtgaagaatatctgagctaattctcccaatgaaaacatcttatgctgtggctgacacttgtttagtt

SEQ ID NO: 22409 - DNA, 201 bp, Bos taurus
atctgtagccaatgtacctataatcgtgtacacgcagctctatgagcagcagggaacaaaagggagtaaacaaacaaaaaaatcaagctaaagatggcgtcgggcggccttgaaaaagcctcgcagtcgtgtccctccctaaagaggcccctcccctccctgacttgttgcgtgattgtggattgcggccagtaaagtccc

SEQ ID NO: 22410 - DNA, 201 bp, Bos taurus
tgcacaggattcctgcgccgacacccctgttcctctcgcgttcggcgctccgccctccaggaaagtagatccggccaggcagacaaaagtttgggagagaggttgagtcggtgctgagtgtgagcgaggggggcgggggccggagagagtgggggctgccgcgcgagtctacgcgtgaacagatagacctgcggacgggac

SEQ ID NO: 22411 - DNA, 201 bp, Bos taurus
caagtaccttttttagctccacacgtgactcagattcagaaaggttcctctggcatctttcttcccttgtgttactgccttttaggtcaacacccttgacccataaacagcagattaggaatcctcattatgtcaggctgctgctgaaagggactagagagttagaggccctatggccagtaggccagagaggtggggtgg

SEQ ID NO: 22412 - DNA, 201 bp, Bos taurus
aacatatgcatagtcttgtgaggtacttattattgttactcccatgttacaagtaaggaaactctggcacagacaggtttggtattgcccaagaccatgggtctagtaaatgctgaaacaagggtttgaacctagtgtacattcagaacctctctacaaatggtacaaacagttttctatttgtgacatttgttgttgaca

SEQ ID NO: 22413 - DNA, 201 bp, Bos taurus
aacattgaaaagaaataaggacatttatagagacctctgggacaacaccaagcacactaatatatgccttacaagggccccagaagaagagtgggagaccgtggtttgatccctgagttaggaccatcccccggagaagggaaaggctaaccactccagtattctggcctggagaattccatggactgtatagtccatggg

SEQ ID NO: 22414 - DNA, 201 bp, Bos taurus
gcttcacacacagttatagaaaagttatgttttttttccctattattaacataatggtgaccaataatacttaaaatcagatactacttgacctcaaaaccactagatgtcatgattctgagttgctttaatatatctaattttttcaggctttatggataaagatttttttgcttatttttaaatttctgagctcaaggt

SEQ ID NO: 22415 - DNA, 201 bp, Bos taurus
ggggagctgaatcctactggctttccagctaaatgatagattggtttgttatttgttgttgataatgtgacttgtgataaattctttcttataggccagtttaggaaaatttattttctcaatatttgttaagatcttactatgaaatacagtgggtcacaggtaatagtggaaaatagatggcctcggagaagatggaca

SEQ ID NO: 22416 - DNA, 201 bp, Bos taurus
aagttatccatgtccctagataggggtcccctaatcctgacctcacatcagaattgcctataaaattttttataatgtcaagatcctaggcctactgaatctgaatttgggggactgaggtctttgcatatctatgtttgattaactccacagtgattcttagtagagaaccatttttcttggctgacactgattttcacc

SEQ ID NO: 22417 - DNA, 201 bp, Bos taurus
catggatattaaattattaatttttatactgtgcttttcttgttgtaagtcaataaacatattttcatattaagtatttttgtagcccttaaagaggccacgagttgtagcactaaacctgtagtgatgctaaacaatcctgggagtacaactgtgagtctagaaagacaaaaggatttgggattctgttgcttacatggg

SEQ ID NO: 22418 - DNA, 201 bp, Bos taurus
gaggagtctgtcaggctatagaccatggggtcccaagagatggacacaacttaatggttaaaccaacagcaaaatgttaacaactggggaaaggaagaacctttgtttttgcttttgctaattttacatgttttctctgtctgataagaactagcaattctcagaagtgacagaaggggtagtgtgagttgtcatcaacac

SEQ ID NO: 22419 - DNA, 201 bp, Bos taurus
agcaatggtggaacttgctgtccaacacaaggagctaactaatgaagacccgatggaactggaggcccagagaaaggatgaagagagacaaaaggaagaagtgactgaagaaccgaagagctttacaacacgggaaacggcaaggagattttctctatttgaggaggcactaatagttttgggggcacaggaccagaacac

SEQ ID NO: 22420 - DNA, 201 bp, Bos taurus
ctctgcagtatgaaggtggatgattcttcaaattaaaggtggacactgacttttctcaccagaaatggtttataagaaatcaacttgcaaaaatttagaggcaataaaagaaagagtaaaatattttcttctatcattgtttgattctttgctagattgtaagctccatgaaagcaggataacttgcttatctgcaatgcc

SEQ ID NO: 22421 - DNA, 201 bp, Bos taurus
cattttcgtggtgtatgtgtttgaagaattgaagaacaggaagatagttgagaaaagtttagttactagagcagaccttagagttaagaggaatgaggaagaagtataaacaaaggtaggtttaggggccccggaacaaatattttgctactctttggtttctctttttctgcctaatttctaaatgttaagttcgaggta

SEQ ID NO: 22422 - DNA, 201 bp, Bos taurus
acaaattacttcaggattcacaggcaaacagcttggtgggactgttacctgggcagaggtgagcatgactcctgctggatttcttggaggaatggcactggtggagaccaaggacaaaaatgactgagctgagccgacaggaagatgagactattcccaaatctgcacccaagacctaagtcagtgagtctacatctgtgt

SEQ ID NO: 22423 - DNA, 201 bp, Bos taurus
tgacttaatgtcagcatttatcctattatccacaaaccatcatcctgtttttcctttttaaattcatatttttcttattctttctttcagtgcactttcatacttcagattcttaaagaaaaaaagtgggatatagtataataaaggaacatataaataaacatgtaagtaaataagtagtttcaatataagaagagctta

SEQ ID NO: 22424 - DNA, 201 bp, Bos taurus
aaggaagaaagaagaagggatgctggttatggaatatgtgacccctttccattgttcatgtatttataatttatctgttgtgataacagttaaaaaacaagctactttcaagtttgtgatgctcacagggaaattggtctgaccaaactgtatccattctcatctaaagcagttgttctaagaaaaactttactttgtata

SEQ ID NO: 22425 - DNA, 201 bp, Bos taurus
cccacagtctgtaaggccaatgagacctaactccaggccctcatttcctagcacctttccctctactgaccccactccagacacactgatacttgcccataccaagtgtggccagtatcaaggtctggaatgtcctttattcctctttgcaatattcataggctttaacttgttcctttgttcaggtatctggaaaaatca

SEQ ID NO: 22426 - DNA, 201 bp, Bos taurus
accccagattgtaccaggaactttccagggcctggcagttgagcacacagagggtggtctgctactctccatgctcgtggccatagcatccatcctctcccgctcaacaccaaattccctctcaggcaggcattgccttagacccttgccaactggaaaaggtttctccaaggtgggaaccagattttctggcactcaggc

SEQ ID NO: 22427 - DNA, 201 bp, Bos taurus
catgattgattaactcactgaggacccgtactgcgctattcacgaatgtcagaatatttcccctttgctaaatactgaataattcactgaccttccttggcgtttttgtttttctgcctcttgtgtcaaattccttgcaaacactgttttttgagggaatgtggggagagaggtgttcacttgtaatgaaccatcccttca

SEQ ID NO: 22428 - DNA, 201 bp, Bos taurus
cattttatctacagctgctacacagctaatgattcacctaggtcatttatttatatttaaaactaactcctgtacattttctgtcagagcctgctcgacatttgtgtataccataaagccctgattctgctatagatctggtaggcaaaagtgctcttttcttttttatttttttccctgtgtctttcctacttccacctt

SEQ ID NO: 22429 - DNA, 201 bp, Bos taurus
ctatctgaagtctggccaggtttctgcagtcataagaaatgttcttttcctagaaacaaagtaaatttatagaactgttattaccactgtagcctgtggctagacatttacaaattgaatatctgtgatattaaagcaaatcatttttaccaataaggaggactgattaacttgaattaaagagtaatgatgataaaaaaa

SEQ ID NO: 22430 - DNA, 201 bp, Bos taurus
ttaagatgcaataataaggattggatttacttttccttctaacgtaacttaacataaaatacacaaaacaatagttctcagaaccctggacatcaggcatcgaaggacaacaatggtccctaagagggaaaacattgagtcctacaattgcccagctttttgctgtcagggatttttctgggatgcagagatatacttctg

SEQ ID NO: 22431 - DNA, 201 bp, Bos taurus
ggctcctattccagctgctgctgaaggatttatttctcttctttgagcatctcatgaggtggtttagctattcttcaacagcaggaagaacagatactcagaatttagtttagaggcaagggataaaaattgatgtcaaagaggttcaaattaggatgttgccagtattcttcaagagaatattcacccaggaaaatcaag

SEQ ID NO: 22432 - DNA, 201 bp, Bos taurus
gttaatcaacttccctgttaaattgcatgtttttcttcatgtcattgattatatgtgtcttctccccccagtctctggtcatttttattgcttttaactataagtgatttattactatcaagtcatttccccattcgtgaatcttgctatttccaatgattaacatgaacaggttaccatggatacatttttgtgaacttt

SEQ ID NO: 22433 - DNA, 201 bp, Bos taurus
gtcacctgggccttggatggggggtgggaattagagacatgggggtgggagcagccaaaggtccgtcattcaggactcagcacacaggcacagcctggccattcctcacatctcacagacttccttgttaacagcatacctcgtagtgtgttgcacctgatgtgaaagtggggaggaagtttgagcacttgtggctggacc

SEQ ID NO: 22434 - DNA, 201 bp, Bos taurus
cccgctgttgaaccagagcttctccctctttggtcctctctacagtccagcccacagccagcatggttttcagggactctctggcaggccagcgataaatttccttctcctggaagaacattggagcagaagagctgtgtagggcaggctccagcactccggctggcctgcctcctggaaaagacgttggagcccacagcg

SEQ ID NO: 22435 - DNA, 201 bp, Bos taurus
cacaaacttagaaaataaacttacagttaccaaagaggaaagaggggaagggaaaattaggagattgggattaacatacacccactgctcctgctgctgctgccaagttgcttcagttgtgtccgactctgtgcgaccccatagacggcagcccaccaggctcccctgtccctaggattctccaggcaagaatactggagt

SEQ ID NO: 22436 - DNA, 201 bp, Bos taurus
gagcaatgcaagggtatctattgccatgtactaagttaaaggactcatgattttgaagatggcatagtttaacctagattggaatagtcaggaaggccaatgaggagccgaaacttgagtggagttttaaatcacaaggagagacaaaaaccagagggtcttgcaggtgggaggccagcaaaggcagatgaaggaagagga

SEQ ID NO: 22437 - DNA, 201 bp, Bos taurus
cacacagaggacattcagtttctctgatgactgaccttgaactcactgaagggccagttcaacagatggtcaccctttcacaagacctctccatatgattgctcagaaccattcccttttctttggccccagccttctgctgggatcttcacagcactttaggatccagtcattagaatcatgtgaattccttggcaggaa

SEQ ID NO: 22438 - DNA, 201 bp, Bos taurus
actgtgttgtacacctataacatagaatattgtacgtcaactctagctcaatttttaaaaatgtagtcattttgatgatgcctccattctaggattgttcgatatgatatatacctgaatatgaacacatgttcagtaaataccatttctcattccttttgctctgctcaagtctccttgtaattaggcagcttgagttta

SEQ ID NO: 22439 - DNA, 201 bp, Bos taurus
aaagtatggccaaaccaccttgggaactggcagggaaattctcagtccatgagtcagagaaacttcattccaactggccccttggtacagagttcattgccccctcctcctggatgaggtctcatttgtgttgaagcagaagtcagagttctctcttggccacagctgaacctcaaatatgttgggagtcctggcaccagg

SEQ ID NO: 22440 - DNA, 201 bp, Bos taurus
attttcaagtcttcttttaaaattcatgtgagaaaataaaatatagcatttcttacattctcttgcattaatgacagttaagttcttatttttgaatacctatgtggaatttttgaagatatcgaggcttcatgattttttctattcacttgttatgttttttaaagtaggtctctggatcagatattgtcccccacattt

SEQ ID NO: 22441 - DNA, 201 bp, Bos taurus
gtgatggcttacatactcagtcctcaggctggtccacagggagggagaaaaagaaagctgggcataattgctgtcaccaccatgtcccctcatataccaacaccacctcacgtgggcttagttctatgctttcgagaatgtcttccagagagaactatctggttaaatgccatgtaggaaacatgtaacattgacaccgtc

SEQ ID NO: 22442 - DNA, 201 bp, Bos taurus
aaaatccttgaaactgtgtccatcttgaatgtctaatatatacaatgaaaatgatattaatacatccatggtctggagggagacctaaaagagcccctgatgcaaagtgtctgacatactgaagacttaaagtaagtagtagctatcattatttttaaatccactggtttcaaaacaacccattccaatttgttcagataa

SEQ ID NO: 22443 - DNA, 201 bp, Bos taurus
atggcataaaagactcttcagactttggcctctgcctctttttcaagtttcactgtcccctccctactcataccttaccttcaccttcctaaatgctgtacagttttatctccatatctttgcacatgctgtcacccaagcccaggatttcctttctgggctgtctgatgcattcccagtcatgctttaagaccaaaatct

SEQ ID NO: 22444 - DNA, 201 bp, Bos taurus
atccatatttcatgtggatagagagccactgatgagccacagagaaataagcagtcttatgagactgggtagataaaattggaaacttgagggcttaagatcacagtgagaaggaagagatagaactgggcctgatatacagctcgttttccccccaggatatttgctgagttctgaagctacaaagaacaggagaacatg

SEQ ID NO: 22445 - DNA, 201 bp, Bos taurus
aaaaaaaaaaaaagaaagaaagcaagaaatcaaaatgaatatttaggttgcccagatgcagatccactaagaacaaggaaaagactttagaccaaaatcaagttttcgtgggtagacactgttttcatgggtagacacctccaacattctcctagacatcactctgactgctgaatacgatttggtcatgcctcagtggag

SEQ ID NO: 22446 - DNA, 201 bp, Bos taurus
tgaaatacctctatcaaataatatttgatatttgataggattttttaatgctaatccctggaattcactaggatgtgagcagcagctactctcatattctctttagagtgtaaattgttataaactctatggaggttataatgatcttaaattctaactgcatatctgacaatattatgatactactctcaagttaatcca

SEQ ID NO: 22447 - DNA, 201 bp, Bos taurus
agtcaaaggcaagttcctctggtccctcatccacaatgtttatcccagtgggatatgatacagtctgtgcaattgctatgttccacaataattataaaagtaataacatgtggtacgaacagaacttgtaacaaagaacagcagtagatggtaaaataaaccactggttatgtcaaaactaataacttatttactcatgca

SEQ ID NO: 22448 - DNA, 201 bp, Bos taurus
ctttcaccatgtgtaggacactggaaaaaaaaaaaaaagtagggggtgggggagagtcatccatgaaccaggaggcaggaccttgtctgtgtgtgcgctctgctgtgtccgactcttcgcgaccccaccagggactgtagcccacctggctcctctctccaaagaattttccaggcatgagtaatggagcgggttgccatt

SEQ ID NO: 22449 - DNA, 201 bp, Bos taurus
aataccagagtgggttgccatttccttctccatttgatatctcttacaaagcgcaacaacaatgactcaaaaaaaaatctaaaatgagagttctcaaaggatctctattctactggttcaatgcaaaagttcaaatatgccagtgggcttatttgtggactatgccggatgattacagagcctttgtcgatgagaaatgac

SEQ ID NO: 22450 - DNA, 201 bp, Bos taurus
caataaaagaaaaatactgtgaaattataatagaagactaaactctttgtactctttgctatatcctggtgtcatctgtaagataaattgtccaaactctgtatctcaatttcctctacatatgaaaatatctcaagtatcaaagattgacagtctttttttctagcaagcaaaagccccacaagaagtccagtggatgat

SEQ ID NO: 22451 - DNA, 201 bp, Bos taurus
tcagctaatatccttattaactttatgaggtatatgctataattatcctaattttgtgaatgcagaaattaagacgattaaggccacaaaattaaggtcacaaagctagcaagttgcaaagcagaagttggaatctaggtagtctggctgcagaatctgtgctttaactgtgcattataagccctgtggccaagcacttca

SEQ ID NO: 22452 - DNA, 201 bp, Bos taurus
cagatcatttctctctttagttcacaggtcctcagaatgagagagaggaaatgtacttattcctgttagtgaacagctaagttgctcccaaatttctcacttaaagaagctatcagatagtaaatgttctttgtggtaatttattatgcagccatagctagccaatatctaagcagaaaaggaagatgattagaatgaaag

SEQ ID NO: 22453 - DNA, 201 bp, Bos taurus
ccgtcatcacttctctcgtggactcgtttgtcaaagtgaagtgaaagtggagatggagggatggaggccttgatgggtgccccacctcaagtctctgtgaaccgagctaattggctaagcttggagacaagagcagagtgtttggaaaatggcaccaagaactaccgaaagtctggacctttgtgctcgccacaccaggac

SEQ ID NO: 22454 - DNA, 201 bp, Bos taurus
atatcttttaaaggacattattttaaaaaaaatctacaaccgtgattttctaaaaatcattggataggctaaaaaagaaaaacagaaaaaaaactgtaaagcagacttcatcaatatttttaaactttacttatccaaagccaccactaagaaaatagacaaaccacaggctgagagaaaaatatgacacataaatatgac

SEQ ID NO: 22455 - DNA, 201 bp, Bos taurus
caccagcaatatgtgaaaaggcctattttcccaccaggctgagattttgaaagagaaaagaaggaggcaatgtctaggctctgaagaagcaagggaagaagaaggccaagtccggagcacaagcccagagcactcagcttggcagatgaggtgcacagatagcagaggactgtgtggtccaggccatggtgtttcatttgt

SEQ ID NO: 22456 - DNA, 201 bp, Bos taurus
ctgaagaaaggcccgcgggaggacgaggccctgagccgggaatgcaggatggcggcgatgcagaaggaaaggggtgctccgaggtaggtaccggagaagggcggccgggagctgggcctgcgagctcctagggtgcctggcagtgacagaggctccgctgagagcagtccaggagaagagcaggcccaaccgaatcgtcct

SEQ ID NO: 22457 - DNA, 201 bp, Bos taurus
gtggggggccaggaccccatttcctgcctcccaggtcatattttttccctccacaaatatgtgacacttattcagagaggaggggaggaggagcaggatggtagcttggagagggcctcaaggccccagagaggccccacatggttccagcctccaccttagcctacagctgagggaggggctccagtgtccgagggagct

SEQ ID NO: 22458 - DNA, 201 bp, Bos taurus
tggccatattgggatttggggcatttcccttattcttttctggggccagtgccatcttttccttttattcctgtccttgaggctaggatttggggctggagctgattggtggtcaaaccttccaaacttggacctttttagatagctggggatcctccacttccagggatccccagttacccatcccttgattatatgaaa

SEQ ID NO: 22459 - DNA, 201 bp, Bos taurus
tgcacaccctagagcctgtgctctgcaacaagagaagctactgcaatgaaaagcctgcccaccacaactagagttgcccctgctacggcaactagaaaaaccctgtgtgtagcaatgaagacccagcacagtcaaaaataaaaaactaaaattaaaaataatgatgaaaaattcgtattccctgtaataagttcacacaat

SEQ ID NO: 22460 - DNA, 201 bp, Bos taurus
acagtgcctcctattcaccaaggactgtgacaggtgttcaaaatatttttattttggaatcatcatgacaatccaaaggctaagtttattggccccaaatcgaagttaaaggaagtgaggattaaaatgttaaaaaaaaaaatctgttcaaggtcaaagtacagaaagtggagaattgcaagttcacacaaatgggtctga

SEQ ID NO: 22461 - DNA, 201 bp, Bos taurus
tgaaactgtctaaggcagggcggccacctaaaaacacaggaagatctttaacttctacgaagaacactcttacgggccctggaagtacctttccagatgtgaaacctgatctggaagatgtagatggtgttctctttgtttcctttgaatcaaaggtaagattgtcattttcagctttctttctaaggccaaataatcatc

SEQ ID NO: 22462 - DNA, 201 bp, Bos taurus
cactgctgccacaaacagtctcatatatgattcctggtgtgcctgtgtacaagttactctcaggtatacacttgatcctgaaagtctttactgatggccccgtggcaaagtgctgttctctggtctgattctctttctacctcagagttctgagttcaacactctccactaaggcctctttccctgtgtattagttaggat

SEQ ID NO: 22463 - DNA, 201 bp, Bos taurus
tctagtctagtgaggcctaaaccaatcctcacatgctcctgttatacaaatttctttagaacaaatttatccacagaggccagataccctaggatcggtatgtgaaagacttttaaatgctggacagcatataatgccatctggccctgatatagtcactgtgatgaattgttggtggattcgaggttaaagtttgctctt

SEQ ID NO: 22464 - DNA, 201 bp, Bos taurus
gatattacctgggaacttattgggctctacctcagacctactgaatccaaattctaggggtggcatccattaagctttttaaatagccctccaggtgatacgatacattctaaaatccagaaccaccactttacaaattttctactatatgtagacagtggggaaacatagtcataagtataggttgggggaaggatcagt

SEQ ID NO: 22465 - DNA, 201 bp, Bos taurus
acttgatgtttcctgtggccaccttctctgtccgcaagatttacatgtgatgtgactatggatgtctgttgctgctttcagacctgcctcccatggatccaactgaattctggcctgcctgtgtgtgagctcacatgtgtgtcagttaacttccaagaccagcttcctctgagttttttaagttattgtaggattgagaag

SEQ ID NO: 22466 - DNA, 201 bp, Bos taurus
gccggccagcccccgtccaccttctctggctcacctccttcggccgagtgtctgccagaagcgccacgtttcttggccttagtagcagctgtaggggaaccggcacctgaaagtcatccttccacagggagagcagcatgagcaggagcctccgagcctgccccctctccagctggtgctgtgccggaggccccaggatgg

SEQ ID NO: 22467 - DNA, 201 bp, Bos taurus
cattaaaaagtcacctacatttacaggaagttggtttaaaaaatatgaaaatattattttcctttgctgtgaggattgtcagtgtaggatgagcaataagtatcaggaaatagatatagttaagatatttctgagatttggcctgagctcgtgtgcacagtataaagatattagcaaaattttgttcttcttttgatgctt

SEQ ID NO: 22468 - DNA, 201 bp, Bos taurus
atgtaacaaatagccagccacaggcattagtttctgtgaaaatctcccagtaaataatgtgttaatctgctattatcattattccatcttgtgaaaatgtgtttttcttatagataagagagaagactttgcccaaatccttatgataattaagtagagaagaggggtgcatgcatgaatatgagtgtacagaattattta

SEQ ID NO: 22469 - DNA, 201 bp, Bos taurus
tgcatatttacatttctgaagaatattctatatatatgtgtgtatatataacctccgtggcaatttttcttcttttgttcatcctaataacttgcagtcttatctttttgtgctttatttctctcttgcagttatgtacataaaaacatggtactaaaatgtagtttatgacagtgctgtgaggaaaagacattgaaatag

SEQ ID NO: 22470 - DNA, 201 bp, Bos taurus
gatgaaaaatacaatctcagataaaacctaattatcattactcctttcattctccagctcaaataaaactcttgaatgttctgtaaaatttaaaacctggcaacttgaaatatgattgaagtataaattgcagaatcagaggccaaaattttattatttcagcaagtaacaaaaaatagctgcaatgtagtctatttattt

SEQ ID NO: 22471 - DNA, 201 bp, Bos taurus
gtacagtgtttttggaaattaactatgtgtgtgtgcccacatcagtgtatagctttgtgactctttctagctggctataagggaaacctttacctaggccggattttctcaatagcatcactatttatactttggaccaggtattttttaatatgaaggttgcccagtatatcgagtggtatttaacagcatccctggcct

SEQ ID NO: 22472 - DNA, 201 bp, Bos taurus
agagaagcattcatatccgtcttggtaatacgggcatctgtcatttaggaaacctgagagaaaagagcttcattgtctattatttaacaggccaaaaaaatgtaaaataaagagtctagcatattcagagaatataaattaatgttattggagaaaaggaatgatgatactctttatatatattcttggtttatgtatcac

SEQ ID NO: 22473 - DNA, 201 bp, Bos taurus
acaattttctaatggaaagttctttaaatatcagtctttagcacatgtaaaattaatgcataaatacatataaagaataaaacatttccatagaaaagaacctaatacgttagtgtttacagttaatctaagaactgcacaaattagattaaaattgtttctagttaaggcatttaagttctgggggactactttaacatg

SEQ ID NO: 22474 - DNA, 201 bp, Bos taurus
gggtggaagtgtagtgtatcatttccagacacggcagcaagtcctttgtcctatctggctactctcctgacactgcaaacttggaggccatgttttgagacggcaagaacaaaagatggaggaagcttggattccagagtcaccagattgtggggaatttgccccatttcctcctgccagcccatattaaattgtgtatga

SEQ ID NO: 22475 - DNA, 201 bp, Bos taurus
agtacaaaagagaggccaaggaaaacttgttcttcaaagagtcactgaaaattatctgataaaaaataagatacattcttataaacagacccagcatttaacatccctcataaagaggtaagaagttgagtataaggggagaaagaggacatagtaagagatgaaaaagtggtggatataaagttctagctctatttggtg

SEQ ID NO: 22476 - DNA, 201 bp, Bos taurus
ttttttttttttcccctcctaccctctcttataaatggaaagcattgtcagttgaaattgagagatgaatcaggtccctgtttaaacatcaatagaaatataaggattccagattatatcatttatcttctcatttaataagatgttaatcaaatactatgaacttcagaaaaagatttaattaaaaattcctggtttttt

SEQ ID NO: 22477 - DNA, 201 bp, Bos taurus
tgagcagattactttagccatcttagcttttccaaacttatattctttggctcttatttattgttttactgtgtataagtttgatcattacttgaaagtcttagctccgaactgcctactttttaatgtactcaaacagaaaaataacaatcatgctagagtggcaaaatttctgcaaggatcataaaagagaatatatat

SEQ ID NO: 22478 - DNA, 201 bp, Bos taurus
ggccaaaattgccccttgccttccagctctgactgtcgcatgcctgactctctgcctccagtgggggtggggagaggggccgcggggagggagcctgtacgaagccacctaactctcatttgatattcactcaatcctttgttctgtgagccggccaggctgcacattggagcctttcacaggaaagttctcttttttttc

SEQ ID NO: 22479 - DNA, 201 bp, Bos taurus
caaaagacactgctctcagacctcctacatctatatgagattttaatcactaccaccttccccaagactcaccaaagcagaagggggcaccgggcccttcgcagggacccaaagtgtatctaagctgaagtcacatactccctccaattctcttatcctctctggccaggaaaatggtgcttacctcatcaaacatgcttc

SEQ ID NO: 22480 - DNA, 201 bp, Bos taurus
tgcattggcaggtggattctttaccactgaggcacctgtctgaaatccaaaaagatcctgaatgctggaacacatttggtttaatattttcaaataatggatgatggacttataataaactaatattaaaactatcaaatgttttttaaaagactacagtatttgtgaattcaggaatcctacaaattaactcaagagaac

SEQ ID NO: 22481 - DNA, 201 bp, Bos taurus
ttcttacctgctttcttctcacttgcatctttgcttctttctcctcttctaaagtacctccaagataacacaaatttcctggagggcccgtatttccatttaaaacatgctctgaaatgcaatcagctcttgaaataatttcacagaaatgttaccaaggcaaagcagaaaaaggaatgtaaaatgtaatatggccatggt

SEQ ID NO: 22482 - DNA, 201 bp, Bos taurus
gaacacttctggaatccccatacaagtgctttttgacaaatacaaattttcaggccaaaaaatcatgtctattcttaaagatattttcatcagaatctgatagtactgcaagggccttctgcctatattcattttattaaatgttgacttcacatcaccaaccatttccatcttttagaaaagtttctgctttccttaaaa

SEQ ID NO: 22483 - DNA, 201 bp, Bos taurus
ggtgctcgacttctgccatgtcttctaccttcgtctttatttctttttttgacaaccaccttccctgccccctatttcaactagccaataaaccacaaggcttacaaaaacagtcctcagaaaatactgctggaatggtcatctggaccccaaacaacagacatggaaacaagaacaaacctcagctgcaggttcaattaa

SEQ ID NO: 22484 - DNA, 201 bp, Bos taurus
aagaaggtacagaggcctccatgggcaggccagcccacatcaacatctctcctgccccaaatccctttctagtgaaaaggctcggtcatgtgatatgcagcgtgagtgctgaggaaactttctgggccagtgtggtcacattcacatcagtgcccagcttaaccactgctcaggggtcccacccactcaggtctcagcccc

SEQ ID NO: 22485 - DNA, 201 bp, Bos taurus
aaatgaatatttgctttttgttctggtctattaaagttttaactatttaatgtttaaccccttaatatctgagctgtgatatgatttaaaatatagtttcaaaatggctaacctattttcaaataatattttcaacattttggagtaattttcacttcctcctttgtaattctttattcagcattcattgaagtctgagtt

SEQ ID NO: 22486 - DNA, 201 bp, Bos taurus
tggggcctaattttgaaacttaatagttgagggtactggaattctccagttctcccctgctaaccatcctgtcctctggccttgttcctctcatgggtgattctagagagggatttacacaaagaaaaaaaataatgaacaacaaggtaaaacaacaaggtaatactatctcgttacccgaaccaatgtccccactgtcaa

SEQ ID NO: 22487 - DNA, 201 bp, Bos taurus
catgagttctctggctgccagaggtggaggccaggtcgtgctaaaggcaatggaaagtgaactcaaaggagagttgtaaagatggcagaagagctctcattgcgggatctaggcagtgctatcagtggactcaggtaaaccttagcccctgcttcagctactatacgtccatttttcctctttcatgcccacccacagcca

SEQ ID NO: 22488 - DNA, 201 bp, Bos taurus
atgtaaatgtaagatggagaaagaccatgtgcttaaatccatagggaatgtctactactgtaattgtcaatggggtggattgagaagcatattctcaagattacaagatgcatggctcacaaactgaaccagagaagcccagctggtgctgaaggagaacagaaagcaagtatccctggctcccatcatttgctcccaact

SEQ ID NO: 22489 - DNA, 201 bp, Bos taurus
ttttccactgtctgccaccaaactgcatttgtctttggagagaattagtctcactgtctagtgtattggcttcccctgctgccagactgccagttcttccccatgatgacttatcagtataacaagtgcattgacgctgacatgaagattaggaatttaaatgggcagaagcaccaggaaagcttgtgagaataggtgact

SEQ ID NO: 22490 - DNA, 201 bp, Bos taurus
ctgtctttgcctgaacagtgcctgacacctagtagatcctctgtgaatactgttaaattaacgtgcacttttatgctcatgttctgaccctccttacaccgtacttagaacccaagggcttcaagtgagggtcaacaggtaacaggagaattagggaagcccagccgacccctggattggatccacagcgatggcacgagg

SEQ ID NO: 22491 - DNA, 201 bp, Bos taurus
acactactatacataaaatagataaccaataagaatctattggatagcacagggaactatattaatatcttgtaataatgggaaggaaagaaagaaaggaaagagggagggaggaaagaaaaaaatgaaggaaggaagaagggaaggaaagaagaaagaaaaaagtaaaatagaggattaagttggggaactgttctatca

SEQ ID NO: 22492 - DNA, 201 bp, Bos taurus
ttactcagacaccagtcatcctgtctctctggctcagacgctatgaatggggtgaggagatcaggggccatagctgggctggtggtggtggggtcagctttttgggcacaagtgaatacaggctgaggtggctccagccctgtctctccctgccccagggcatgtccctggattgtgtggagatgtctctgggccgtgtgt

SEQ ID NO: 22493 - DNA, 201 bp, Bos taurus
aatgaggctgtcttgttggaccttctgagcatcttgatagaaacatctcctttcagagggtatgggtggcaggtgcacgctagcgttgggcacatgaagacgttggcctagaagcagggttctgcacgtccccatgcgtaccagggccctcccagcctggacctctttttccatttcaacctgaggatatggatctttcac

SEQ ID NO: 22494 - DNA, 201 bp, Bos taurus
ccttcactctcagttatcactaccaaagcagcttatagacctttaggtcataggtccttctcatatagtcctcttaaaagctcccgttacattctttcccttccaatgctagtgattaaactggctgggcactccctcccttaactgaaaagaagctaagcaatggctcactgctcctaactaatccattataacaacagg

SEQ ID NO: 22495 - DNA, 201 bp, Bos taurus
ttggagaaaatcactactataaagatgggtggaatacagtaaattggcaagagattgatgttttttatcttcaatatactgaagtaataggccctgaagtctgcttggtggcacagagctgtgatctggatatgtttgtaattccaacagactctggctgttcagacacgtggccataggcagacgacatttttaaaatta

SEQ ID NO: 22496 - DNA, 201 bp, Bos taurus
tcctgcctgaagaatcccatggacagaggagcctggtggcctacagtccacagggtcaccaagagtcggacacaaccgaagtgactgagcacatgtgcaacgcttggtatgatgatgaaaatggccctttacttccgcggttatcttctcaaaaacccgtaacctttattttatcgtaagaaaaacttcagacaaattcct

SEQ ID NO: 22497 - DNA, 201 bp, Bos taurus
ataaaagctcaatgctagaaataactcaaatttcttcagttagtgaaaaaacaaattttggtatatccatacaatgaaataatactcaacaataagacaagaagaagaaagaaactgctaatacatgcaacaacaagaacaagtttcaaagatgtcattctgagaggaagaagctgaacacacaagaataaattctatatg

SEQ ID NO: 22498 - DNA, 201 bp, Bos taurus
tcctctcctcttttgtgtctgcttgaggcccagagttaacattcccccaagtgctaagctcctgggggcgggttgcagagaccaagggcagccagagccgtgctcaggccctggggtcccagagagaagattaggcctgtctgtcgtgtgtttgtactgagctgtcagctctgaaggcagggccatatctgctctcctatt

SEQ ID NO: 22499 - DNA, 201 bp, Bos taurus
acagtcctgtgggacctgtgagcatgatccctgctggccaccagagtcaggtgatataaaggtgtcccctgaaagcacctacaaaaacctgagggccagataagggtgtaagcctcttgctggaagatactggtgagctagggcaaggctgaaggtgagcacaaaggttgtatccactggcctccattccctgagagcaac

SEQ ID NO: 22500 - DNA, 201 bp, Bos taurus
tgcctttctccctccctcccgtctcgctattccctgagatacaatgatattcaaattaggatacataacaacccttaatggcctctaagtgtttaactgagagaagagtcacaagtctctcattttaaatcaaaagctaaaaggattaagcttagtgaggaagatatgtcaaaagtcaagagaggccaaaagctaggcctc

SEQ ID NO: 22501 - DNA, 201 bp, Bos taurus
gaaagcgtttctctcactctgccctcaggccacttcccagccttctctggaaactcattgtgtggacacatctagaacataccacgggccatcaagactcatctctggctttcatgctctatatgcacagtctactcttgtttccatccgtttctggttcctctggtcagcagaggccaaagttgtaaggagtttatctta

SEQ ID NO: 22502 - DNA, 201 bp, Bos taurus
aggtggagttgggtttcaagttgcttaccaacaatccagagcctggctagaaggctcctgtgctgctagtggcctgcgaattctcatagggcactgagatgcgaagggaaaatggagctttaagactcaacactgctgagagcaacaaaatccccaaggcaaatccaggaacacacaggattcccgagagcctgggggaat

SEQ ID NO: 22503 - DNA, 201 bp, Bos taurus
gcggggacagagcagagacgggtgggctttctgatgtgtcattttcctggggcctcaggcaatgggcaaggaaaggccccatttggtgatcaggccctcaacttagagaaaggtgccctccaaagtgggcaaatgtacaaccagtggtagagacagattgatctagagaactagggcctggcccatcacccacagccctct

SEQ ID NO: 22504 - DNA, 201 bp, Bos taurus
atgagcttctcctcgctggcgtgtccctgcactgaggcgttggctgcctcgcagagactgctggtcgcggctgccaccatccgggcctggcgacagtcaaaagagaagtgacccccagcccaaacctccctcaggggatctaaaaagccaatggggaagaaggagagagcgactcacggcagaaatcaggccctgcgacca

SEQ ID NO: 22505 - DNA, 201 bp, Bos taurus
agggcagctgcacacctaattcaggcagatctaaatgccaccttcctcaccaggatcctcccttctagcagacaagcaggctcagtgctgtttacttagacgtttgatttagccactctgtgatgggccttataatgtgggagagtaaaggggtgatgctgggtagatatgggagaacttttggtaaggcaagcttagaac

SEQ ID NO: 22506 - DNA, 201 bp, Bos taurus
atagcagaaaagaacgatttatcttcgaaagtagaagttttccagaaacgtgagacaagaaagtaaagcaacatctcaggcccaatttcgtacagacggattacaaaagttatagcactccacagctcagaaacattactttagggacttttagaaacttctaactgcttctgatttttcctcatagtcactctaaactca

SEQ ID NO: 22507 - DNA, 201 bp, Bos taurus
ataaggtacgtttttatcaataaaacaaattgttcagtgtcactggtatgcattagatccaagactacttttaaggaatacatgattaagtggggtatgaggaactaacaacaatagtgtcccaaggctgaggtgtctttttctccagtgcccctagaattacttctgttcttgacatagtgtcgagtggaaagcttgact

SEQ ID NO: 22508 - DNA, 201 bp, Bos taurus
tggtcaggagctggaagctttagcaggtgagtgaatgcagcctgtggtactctgtgatccagcagatgaccagagctggaaaggcaaggaagcttttggtatggcccatgtgctctgattttggggcacagagaggtagagaagggggagcccggggtgcacagaagacacccagagcagcagacattcaaaaagacaagt

SEQ ID NO: 22509 - DNA, 201 bp, Bos taurus
gcggttccccaccttgtctgggcagaagaatgacccaggagcactgagaaacaacagtgcttggtcctcactacagaggctctcatgtagttggaacccaatcatagtttgtttccttttttttttaattgtcaccagctgaatctaatgtgttaccaggcttgagagccactgtcttttccaatgtttatctcaagactc

SEQ ID NO: 22510 - DNA, 201 bp, Bos taurus
atgggtaccagcctctgtggccacaacatgagctccaatatcatctccattttgcacatgtggcaaggtgtgcaaggccaaggtgactgacccgactaatctctgctcagcaccagctcctatgtatggcagtgccttccttgtcaggatggcataggacaggccctctagtctttgctgagtaactgtggttatgagcac

SEQ ID NO: 22511 - DNA, 201 bp, Bos taurus
gatatccagccactcgtaataaagctacttttagaaccctcaggctggtgggtctgagcttatttgaaaaaagcctgtctcccacttttagaatttgttcagaactggccagaagaagaagcaacacatcccatgcatggctaactgggcatggtaattgactgaaactttcttccctcatggctcagctggtaaagaatc

SEQ ID NO: 22512 - DNA, 201 bp, Bos taurus
aaatctccctccctctcttctggctcttgactgggttactgttgtaggaggtgggaattaacttatgggaatagacatagttcccccaaaattgcacatatcataaaaaagagagacctatagattcatcttcctatagcatatacatactcacaacttggctgaacccttctacagggactcctagatatacgaaccaaa

SEQ ID NO: 22513 - DNA, 201 bp, Bos taurus
catcactgaaaatctgttggagaaactcagaaagacaacccctgctcttgaggattcttggttcctgagacccactgggacctgggagggtggggttcacatgggatccaagtagatgctcaggttccagcatctcccctcctttagcttctatcggagcaacccagcttttcctagtattgcagacctggcttctgagtc

SEQ ID NO: 22514 - DNA, 201 bp, Bos taurus
taggctttcaagttcatgatcaatgtgccccacaagactgtgtctctgcttcctccttaccagctcatacctgacccccacacatacaatatgtatacatgcatacgtatatcctccaccttgaagtgatcagggagattttaggaaaacctaccatatctacatacacacgtatacacacgtgggcttccctggtgactc

SEQ ID NO: 22515 - DNA, 201 bp, Bos taurus
tttaatttgaaagttttatcctctgggtctggttaattcaaatacacggcaaggagcattactgtggggcctgaaagaacgtgggcatggtgaattgtgttaacaaagacagccccatccagtgttgctgccgctcggctggtaaaaggtgatccccctcccatgctgcccacactcctttggtaaaaggtagtagggaga

SEQ ID NO: 22516 - DNA, 201 bp, Bos taurus
tacagctgagatcgcagtgggatgtttttccttcctaccttgcttctgcattacttaggagtggtttataggatcagaggctacaactccaacacactgatgcacctttccctgggacatgaaagctgagagagaaagttggcacatgaagcagaatgtggctttaagctttcaggatgctaaaatgtggtacccagcctt

SEQ ID NO: 22517 - DNA, 201 bp, Bos taurus
gtctgagcaaattgtcctttccatctctgtttaacagacacaaaggctagcacatagaaggtcttccatcagtgtctacttgaactacaacaaatcctgagacatcactgccctaatgggagagagagctgaggaatcacatggtgttatagagctgatgggactctaggtacagaggccctctgcctcctagagcctctt

SEQ ID NO: 22518 - DNA, 201 bp, Bos taurus
cctggtgaactctgaggctgggtgactgcagggaaggccagtggggaaagctttggaggcgatccagaaacttcagctggtgatgaattcaacatcaagcacagttcattcaactcaaggagatttgggttcagactcactttgcaatcatcgtcttccatccacagccaacaagaatgttgtccagaaagtcaaagctga

SEQ ID NO: 22519 - DNA, 201 bp, Bos taurus
taaagagtttaacataagcaagtgtaaggaaagtaccacaggaaccacccaggcatggcgttggtgcccttcatgtggggtatttctacacttggtcattggcaaaagacattccacattgcctttgagacctagttttaccttaaccctcatgtgctgtggaatgaaatgaaataatagatacagaggggtgctgaattg

SEQ ID NO: 22520 - DNA, 201 bp, Bos taurus
ccaggagcagagagatagaaggaagttgcagcaaggtggggagttacctagaagtggagcacacaccacctccagtaattggaaagcttggaggcattgcaggcatcttcaatgaagggtaaatcccttgtatagccaaccggccagcttctggaatcttctttggggctggtgggaggagccaatcttggccaaggctgg

SEQ ID NO: 22521 - DNA, 201 bp, Bos taurus
aaacactacatataagccctgcctttggtaagttatcgtaagattaaaagggaaagatcatggggctgttggtggtttttgttttctggtttttgatgttattgttgctttaaggcatttctgtattccagaagttttcatgaaatgcattgtctttttaaatgaagcttgtctttcacagtaagagcatttccatcgaag

SEQ ID NO: 22522 - DNA, 201 bp, Bos taurus
gctaaaggtttccagttgacacagctggcttatcccttgccaatgatcacaccaatcatgtttgtaagtcatcccaccagaccccagaattctcagtaagcgacaagctactgaaaagaaagaagtatctccatttcaaaaaattctcttgtgccaaaattcaggttaagttctattggaataacggagcaatgatagaat

SEQ ID NO: 22523 - DNA, 201 bp, Bos taurus
tctcacgtgcgcctcctggcccatctgcaagtttgtgtttcgtttcctgggtccaaaacaaaagttctcacggggaagagagggttggccgaaggtgaaacggacaaattagggtgtcccaggtcgaggagggcaggactgggagccgggggaggcgagtgagctggcggggaggggaacaagagggggcgccggcctctg

SEQ ID NO: 22524 - DNA, 201 bp, Bos taurus
cctgccaccagtgtccttctcccacagtgagacacagccactctctgcctcctcaggcctactcaaaggtaggcctgggccatgctcctatggagtcactcctttgccctgggtcccagtgcatgtgaaacctcttgggcaccctccagtagtggagtctctgtctcacccagttctgtgaagtgcctgcactcaagccca

SEQ ID NO: 22525 - DNA, 201 bp, Bos taurus
agtaacaatgctataggggtgtacacactcggccaggaagtgctgtggaaatagctttgagaaaaggtgatacaggcttttgatttagagacaaaggatatacaaattgggtttgtttaaaaatactcaaacttactcttcaaaactaattcttttgccttggactcctgtagatttttttaagggagaaaaatttaaatg

SEQ ID NO: 22526 - DNA, 201 bp, Bos taurus
catatttttgtcccttcatagaattatccagctcaacagtcccaggaatgagttttagacctcactaggcagtttccctcctggggcccctattcacacacagggagccgtgggcactggatacaccagtgcttaacttgggtgcagacatcaaagcagtcacccctccttgtcgctcagctctgatccgccagagcttgt

SEQ ID NO: 22527 - DNA, 201 bp, Bos taurus
gcaagcaaaaccatctttccaggctgctttgcaagttacagacttgcaccccagccagctgggagcatctgtcagccaaaatgcaggcaatttaggaacattgtgtcttaaccgaggctgctcccttccagcccgcagctgtgctgttccctatttaagtcttgtcacacctttgccacctttaagcctaaagatcaggca

SEQ ID NO: 22528 - DNA, 201 bp, Bos taurus
tttattagaggcccaggtcactcagtccagtgaggaaccatagcggtcttagtatattttaaaaatttattttattattattatttttagagacagagtagtctttgtggtttcaatggccaccctgttcagaggataatagaaacgtaagaaactctggatattaaaaaggaaggaggaggacggtacagaatgagggaa

SEQ ID NO: 22529 - DNA, 201 bp, Bos taurus
aacttactaatttttgaaaatattaaagaatacagtcaataaactttcatggttaaggcaagctcactcaccacagaactcaagaaaggctctgaaattgaaagtgacagagaattcacaggacatgggataaaacatatggggctgaaaacagaacaaatctgtgcaaagagtagatccctaggatttgttctaaggaat

SEQ ID NO: 22530 - DNA, 201 bp, Bos taurus
ttctagaaatggggattatattgtcagtaattttagagggaaatgtcattgtccattttcatagtttatgtggtgaccagggaaaataggctcttttagacgtttttaaagtatatgggaaacattttatacttgtttcttgttttttctattgagagagtattgtgctgacagattttgaagcatatataatactgtttt

SEQ ID NO: 22531 - DNA, 201 bp, Bos taurus
aaaatgcatatatgtgtataattgagtcattttgctgtatagcagagattagcgcattataaatcaaaatatttcattaaaaaataaatgaagattaaagggcatcacaggtacagcagagatttttaaaagctggaagccaatactatgaaaaatcatttcaaaattactactttcactatattaattttgaaaatatta

SEQ ID NO: 22532 - DNA, 201 bp, Bos taurus
caagaaacataaaacttctaccaaatcaagtttcatctcaaatgccaccaaaagcttttccataactcttctaaacttttagtgctttatttttgccactattatgtcccgtactttatgctaaaactatttatgtattcactctcttcccaaccaaacttagtcgttgaggacaggtactatatcttatcatccgtatca

SEQ ID NO: 22533 - DNA, 201 bp, Bos taurus
tagccgagggtactgggccatgattttttacttaaaaggaaaataagattaatggagaggtttttaaaaattcacttatcagaagcgagggaagttatactagtgattttaagcagaagaatgaacaaggtgcagcagttggtcctttagaatagtgataccacattcataggaatttttaaaagggcactagctaaaata

SEQ ID NO: 22534 - DNA, 201 bp, Bos taurus
tttcagaagctgtgtgtgtgtgtgtgtgtgttaatgctgcagaacagttaaatgacctgacaagtacattccttaaaggcttcaagcaatcactcttaaggctgagtctgaacactgaggggaatatatttaatgctactttaataccttctcaaaccagtttaagtaattttcttttcgtgggccatcactttttccaga

SEQ ID NO: 22535 - DNA, 201 bp, Bos taurus
ccaagattggcatgttaagtaaccctgcctgctttttccagagctgtgtgagcgatgcagtactaacctagctcttctgctttctttggtaaaggtaacatgcattttacagatgactaaagaaagaatggaccagcagcaaactgggacatctgaaacattatggtgaagtttctagtttgggaagtaagatctacaaat

SEQ ID NO: 22536 - DNA, 201 bp, Bos taurus
tcaaattccttacatgcctctggacgctaattattagtatttctaatactacaggcagtactataatagtgcaggtcaattagacttgcacactggcaccgtctctgactctcccttctctccactattctgtccccacacttgatactccccatgtgtctcctgaagcagcccttccattcctaccaccaccgttccatt

SEQ ID NO: 22537 - DNA, 201 bp, Bos taurus
caacaaacaattttttttaggacttttggcttcatgaagtcatatgtactgtacaattacgtcactttctatagcaggtcaaatcactacacatattttagaaaatcaaatattctagtaaaatcaatatgggatcaagagtaccctctacatagtgatctcctgtccacgttctctgttaagtgaaaaggttaagttgca

SEQ ID NO: 22538 - DNA, 201 bp, Bos taurus
tataaaaatgcatgaagcactggtctagggggtcaggaattctcccaactattccttcctgctctcagctctgagccttcttgttcgggtccaaagtatcgcagcatttgtcttgttgctatactgttgaataattttgtattgtctgactggtatcttcagaatgatctgtcagtcagatggactcccattccagttcat

SEQ ID NO: 22539 - DNA, 201 bp, Bos taurus
ctgttatttaggaagaagcagaagagaaattgagaaagcaaaaggagttgaagcaagattttatggaccaaatggccttgaaggaattaatacttcaggctgcaaaagaggaagaggagacatttagaaaagccatgctggcaaaatttgctgaggatgatcgaatagaattaatgaatgcgcagaagcaaagaatgaagc

SEQ ID NO: 22540 - DNA, 201 bp, Bos taurus
ggaagagagaaagaatggagttcctggcaataaaaagaaacaaaattagcaagatgtcagttcctatcgaagaaataaaaagaaaataaagaaggagaaagagaaggaatctgttttacttcccatccatatgtcttttcctggaataattttgtctgtcttcctctctcctatgcctcaccttccattccacctcagtct

SEQ ID NO: 22541 - DNA, 201 bp, Bos taurus
catggctaatttgtatccaaggggatgctcagtgctcttgtcctcagttctaaatgccctgtgctcttctacaaacccttgatcatctcccctttctggctctggaatgacccattcattccaggtggtggttgatgagttgcttctggttcctgtttcctgactctcttctgttcccttggaaattctgtactaaacagt

SEQ ID NO: 22542 - DNA, 201 bp, Bos taurus
cctgtttcttatgtaccacatgccattttaaggaacttaacctgtgaatgatgaggagctgcaggggattggactggccagtttgtgtttcacattgattgcactggagtctgtgagaacagcgtcaggtgaacagggacggaggctgtggcagtaacgcagtgagagctcctaagggcctggactagagcaccagtaaag

SEQ ID NO: 22543 - DNA, 201 bp, Bos taurus
gtctagaaatgtatagatttggccgtcattaacacattaggtgctgaaagttgatggggttgctaaggaaagagtggggtatacaaaaataacagtaagagggctgcagacacagtcagccttaatgtttaaggagtgagtaaaagaagagtcatcaaagtaggttaggaagcaggaaagaaaatagtgatgcgggagtca

SEQ ID NO: 22544 - DNA, 201 bp, Bos taurus
gatgcatgctttattataaagagtaatgtctatgaaagtaaaatacatttttttacattaaacaacttgaaaagtacaaagatatgttttaaaatgtccccagtccatatccagaggtgatcattgttaacattgagtgtatataatttcatgtattttgccatacatgaatatagttagaagggaaactagctagagaga

SEQ ID NO: 22545 - DNA, 201 bp, Bos taurus
aatagcttcctggctgaatttctcttatatctgttttcttaacattagggctagttcctaaggtgagagccccttggtaagaaaatacttaaatgccatggcaggacaagagcagaaagacccctctagaaataggagtgcccaaataggaatcctcggagaaggcaatggcaccccaccccagtactcttgcctggaaaa

SEQ ID NO: 22546 - DNA, 201 bp, Bos taurus
aaggtggatgctctatcaagttacctcatcttttcagttaaagagaattcaaggtgtttgtaaaccaaaggaatgaaatgacttcaagtggaaaaggaaacgaggtgtaactatatactacaagacagcaatgcaatttagagctagaaggatctaatgtactctaaatctatcagaagtttgcactataaacatataggt

SEQ ID NO: 22547 - DNA, 201 bp, Bos taurus
acacagcaacagtgcacaagtttgtggaagacttctgcacaaatgaccaaggcgttactaaaaaaaaaaaaaaaaatagaagaaatttagaaaaggcttccttccaattgaattttccacttaaatctaagctcaaccaattatcgggaatacaacaattgagcttaagaactcgtaaatagtaatgctgggtatacatca

SEQ ID NO: 22548 - DNA, 201 bp, Bos taurus
aaggaggcaatgaaaagacagtctcaataagtggtgctgggaaaattggacagctacatttaaaagaatgaacttagaatattctctaacaccatacacagaaataaactcaaaatgtactgaagacctaaatgcaaaactggatgctataaaactcctagaggaaaccatagactgaacactgtttgacacaaataacag

SEQ ID NO: 22549 - DNA, 201 bp, Bos taurus
cagtagatctcagcgtatctcagatgcttcaacggaggatgccaagggcattaaatgtgataatatatatcccaaaactgttacataaaaaacactaaacaaaggtagctggtttagtaatttgaactgatttacctgacctgtgtttttaaaattctgttctttggttctcttgttccccaagggagagtgaacagtggg

SEQ ID NO: 22550 - DNA, 201 bp, Bos taurus
tcctaattcagtcccaaggccaatgacacatattttaggtttttcattgcagcagactgaatgttcgtgccctctcctccaaattcctacctagaaacctactgcccaaattgatggcctttggaggatggccttattaaggtttaggcccaaactggcacagtgttagttttgccatgctcttttagttaagcagtcaca

SEQ ID NO: 22551 - DNA, 201 bp, Bos taurus
aggcagattagtcttgttggacattagagtcttaaaattatgccatgtttccaattgctgtttttcaacagaagatttcctctcctctaacacatgggtttaatcaaatttcagtttccaatttactaaaatgttaattgtcacaaaaacctaccctgaccttaagaatactagcttttcatgatcctttctggtacgtta

SEQ ID NO: 22552 - DNA, 201 bp, Bos taurus
gtgatgtgttttaagtactattcatttaagttattgaaaatgagaatgaaatgttgagcttctttaagattaacgcactatgcaagcatgtgtactttttgtatctcccaggtttagtttttacaacacctcgtcccgattgctgtctcacacagtagtcctgtaacatgctgtcttggcagtgcaatgcggactaagctg

SEQ ID NO: 22553 - DNA, 201 bp, Bos taurus
cccaccagtaagcactccctccaggttcagaagagaacagaagacaaaaagcataggtcttggagtcaactagcccgggatctgatggctacaatccatgcgcgagtgacagcctctccgagcctctgtctcatcctcggtgaaacaggcagagcagtacttatctcagagggtgggggtgatgtttaatgtggtgacgta

SEQ ID NO: 22554 - DNA, 201 bp, Bos taurus
aataatcgttgggtcaaaataactttaatcacagaattagaagtgttttaaactacactacattttctgaaacagttaaaagactcctgggtcgtttgccatttttacaggctactgtaaatacgcttaatagcatcggcttcttctttatcaaggatgcctttctccacataagcatcagcttgttggttgatgaagtcc

SEQ ID NO: 22555 - DNA, 201 bp, Bos taurus
aaattatccagaaatcccacctttcctgattatcctttcctaaatatttccatgactagtacacttcttttgaaaaaaatcaatgagaaccattttccccgaggccgtaatatatgtcattgacggttgaatttagaaactgaaaacaggaagaaaaaaaaacccacccacacatttcctggaattactgtttctgtttca

SEQ ID NO: 22556 - DNA, 201 bp, Bos taurus
ccttaggccatagtttgttgactcctgatctaaatcctcagcttttacaccatggaagtgacccagttcaaggggtgggaaaggcaggtaacccctgccatgatcaagctaaggccttcaaggagatacagcatccatgcaagcagaagctgtgactacggtaatgtgacttttgtcccctgtaaataagataaggtacag

SEQ ID NO: 22557 - DNA, 201 bp, Bos taurus
gcaggtcctgacactaaactaatgcagaacagtggtaagacaaagtttaagaggacaagcattgatagactgatgaatactctagtactatgggtaagttattataacaaaattaggcaatatcacaatcattatctgaatatgtttcttacattctgatgagatttctttcagaaatcttcattcttcttgtggaatttg

SEQ ID NO: 22558 - DNA, 201 bp, Bos taurus
tttaatctactcttttccacctccatctcttccatcaggccattcttctggattctttgactagtgccctttcttacctttcaagtttttcttctttagttgaagggcaggagctgcctgtggtagtgagggtcatgagaaggacattaagggtcacaccaggctgggtctgaagaggtgacattgagctggtgtcaaaga

SEQ ID NO: 22559 - DNA, 201 bp, Bos taurus
tgtgtctcctgcattgcaggtagattctttaccactaagccactgggaaagcacatgtactccctaggaagtctgaaatcaacaaactattaatggtatgatatgtagattcctgttaggtatacctaccaaaccacaaagtgaagattcttatgagtatagccagtaaacagttccttgccccttggagaattctgctgg

SEQ ID NO: 22560 - DNA, 201 bp, Bos taurus
attgttgtgaaagctgaggatggcgacgtgatacaggattctaagatggcaagatgatcagatcttggccactctggccgaggtgtaaaaggtatatgatatagcgagtaaggagactagaggcagggggacttggaaggctaatataggagtcctggtgagagtgcatgatggtcagagcacagtggccggggagatgtg

SEQ ID NO: 22561 - DNA, 201 bp, Bos taurus
tccacctccatttagtctcacaaaggtctcttcctacatggttagcacccttttgactttcagctcttattctggagaatacattcaagggctccatcccgctcagttgtccttcatctcttttataggctggttttgtgaagtgccagggcagttttgttagtcactaacctttctttagggagaaagtcactttatggg

SEQ ID NO: 22562 - DNA, 201 bp, Bos taurus
tctctctctctccttctccctttgctgccatacgaggacacagcaagaagctagctgtttgcaagccaggaagcaagatcataacaggaaccaaattggctagaaccttggtctgttgtttaaacccccagtttatcatatgttgttatagcaacccaagcaggtaggcacacttcctttccatatatttgtatcttcttt

SEQ ID NO: 22563 - DNA, 201 bp, Bos taurus
tgggcatcttgccaggccactaatttcttctccatcatactctaaggtattcaactacaaaagaaaaataaatagctagtgtcacatctgttcaatgtacatgtttgaaggcaatactgctttatttgtactgaaattctatgggaaaaattctgtctttattctttcatagtgttagagataagacacattactagattt

SEQ ID NO: 22564 - DNA, 201 bp, Bos taurus
cttaaccactgtatagtactaactgttctaagtatactaatattcaaatattctcccaaataatgacatccattttaaagaggatactcttaatggcccagatacattgtattcataaacatcttctttgtttataacacattctgcaagaccatgatggtaaaggccagtgttactcatcttagtatctccctcaaactg

SEQ ID NO: 22565 - DNA, 201 bp, Bos taurus
gtctgactcttagtgatcccatggactgcagcccaccaggctcctccgtccatgggattttccaggcaagagtactggagtggggtgctattgccttctccgaatacagtaattatttgttctcattcatgtacaatattctactgtaaaaaacagaggtaaattctacaagcataatgttaagcaaaagaagccaagcac

SEQ ID NO: 22566 - DNA, 201 bp, Bos taurus
acataaatttcagaggaaataggagtacctgtgaacctcagcatgcatttctgagagcaagaaaggtgatctcgtttgagaggccagtttcaggagtcctcgtaagttagaaaagcatcaatattttgggaagaacttaagcacctattatgtacagacaacatggcatggaattccaagctgtggcaaatatttgtttcc

SEQ ID NO: 22567 - DNA, 201 bp, Bos taurus
aataagctcccacgtgatgccagtgttgctgggctgcggtcgttaaatagcaaggtgctaaaccacgttctggaagtgtgggcctaaggtagatccaaactggaattatcaataacaaaatcatgtggaactttcaaaaccttgcagaatttactttgagataccttctctagacgaggtgctctagctcaccctccctgg

SEQ ID NO: 22568 - DNA, 201 bp, Bos taurus
gtgaatattgtgtaatacttaagtaactgtagctgggaatatggatgattaggatgttttctgaatgtttaaagttttaattcttaaatatttagttctacgatcaatttcaagttactttttgtgtatagtatttgattaagaacctttttgtttttcaagcacaatttaatataaagatcatcctgttttcattgaatt

SEQ ID NO: 22569 - DNA, 201 bp, Bos taurus
gatttcagaggccatagaaaagtaatgttatcaaaatttggtgagacctggagcatgaataaagggcttttttcccactcaagctgttagaaactaagcctggtttatggaacggaagagattacaagaagcaaagccatgttttctttaaaacaagtcttatatagcaaagcatctacctgtctgtgtgatatttgcatg

SEQ ID NO: 22570 - DNA, 201 bp, Bos taurus
ctcagttatgagcttagtcagccttaaggtggaagaagtggagcgaatgtgcagtgctttgcaaagtactctagttggctctctagtggcctgggtccctgaggctgcctgttaatttacatgcaaactgagcacatgtctgcaggacagcagatggaatagtcaacaaccatcatccaccaaattattaaggccatgtct

SEQ ID NO: 22571 - DNA, 201 bp, Bos taurus
tccaccaactgtggttgtgtgatctgggaagttactcagactcagtgtgtctcagctgtcctcaactgcaaaatgtcctcatcgataaaatgcgggtaaggatatggtgctgggtggcaactcctaaggttgctgttacaagctgacgcgtataaagcacctggcatgtgacagatgctcaaccgagctggagctctgaac

SEQ ID NO: 22572 - DNA, 201 bp, Bos taurus
tgtatttcattttcaatacagaaatctttaattacagccaatctctttttgaatagcttttggtgatgaaaaatccattatttcactaaatggcctattgcttttgaggatttataattgttaggaggttcttcactgtgatgaactgaaatctattttttaattaattgaggtatttttgagggggcccctcaccccaca

SEQ ID NO: 22573 - DNA, 201 bp, Bos taurus
accctttatgatgtgatcagcgctgtgactggccacacgggttaccaagtgcaatgttgtgtggtgctctcagagggtcaggagggcttgggctgactgttctgggccactgcaagaacccatctgcgtgggtgggatggacatgggagaagagggacccagcaggactgtgcctgcttcatcagtgactgtccaactgga

SEQ ID NO: 22574 - DNA, 201 bp, Bos taurus
aaggagccagtcagacagcctcaaacaagatgccccagctattcccactggctgggccactttccactgtcactgtctgtgggagcagtccttcctctgcgtcatgctgtggcatcctttccccaagcaggtcatctttagtacagcacatggtcagtcaaccagcagaggcaaaagctttgtgtaagaaatatgcacaaa

SEQ ID NO: 22575 - DNA, 201 bp, Bos taurus
gacataggacacagaagaggttaggaatagcagcaccacctcaggcagcagaagaaaggtagggagagaaataagagcttcctcctcttctgttgctgttccagtgaatttcttcagactcactagaaccatggaatgagtggaaagtcaggagaagaaggcattaaccaagaaaaggatcgaagcccaatggcaggaagt

SEQ ID NO: 22576 - DNA, 201 bp, Bos taurus
cccactgtcttcataggacttcttggtaacctggcctaactgcgtttagaggcattccaatgatactgctcaaaatgatagcttccattttgaaaactatgaatattgtagattaatgttctattccatatgaaacaatggaatacagtaaatttgtaagtaaagtattctttgcctctttccagatcagtcactttacaa

SEQ ID NO: 22577 - DNA, 201 bp, Bos taurus
tttgactaatctttgcctgtggataagggtggtatgaggcctattttggtggtgaggaccactccacttgcatcagatcccatagacattgccccagtctatgtaattctcatcaggccatgacaacagcaccaaaggggctaactagcatttgaattgtgtttggtctaaagtttccaaagactcatcaatgctattagg

SEQ ID NO: 22578 - DNA, 201 bp, Bos taurus
gcaatgcaagttaaagtggtgggtggtccctgcctttgtacataactgtaccactttgttaccataatagcaaataacccataaagactatttctagtcgcaacttcaacagtctttgaaccagatacccatttgatgcagaggtcaatccactgtgatgctagtctgactttctagtgcagaaaacacctcacaattaac

SEQ ID NO: 22579 - DNA, 201 bp, Bos taurus
tggggcctggacatgagaatttttttaagttttcccagatgactctacttgaagccaaggctgacagagaaccattgactggatcaaaatgaaactgcccacttcagttgtggcccagtccagctcatctggttagagttctacatggggttctgaatggcctgtttccctggccttgtcctgcatataatgactagaggg

SEQ ID NO: 22580 - DNA, 201 bp, Bos taurus
ttatgtgcactagggaaaacattatctagcaatagtagataatctgctgttttctggccagcattcctctttcttttgggaaatcaccaaaaccaattccgtgtatttgaattgaccccaagcccatgaccacatgctttcaaattgtagtgctggagaagactcttaagagtcccttggactgcaagatcaaaccagtca

SEQ ID NO: 22581 - DNA, 201 bp, Bos taurus
ctttttcagagatatgctatttcccttttctcaatactaaataacttttgccaaaagtattcattgaactttccagtggcgtatctgtgcttggatctgagctgttcactaatcttgacattatatcctctattgcgaggctagaagctgaaagcagtttgttactgttgacctttatgctcttgtaatttagtttctttt

SEQ ID NO: 22582 - DNA, 201 bp, Bos taurus
aaaattattctttcagctcattatcttaaaggcttttctttttttgaccgggctagtctttttgtaaactataaaagtaatgccagaattcaaacttagtcttttcaataattatgtatcttttgaagtctctggcacttccctttttaaactgagaggtgttttcaaattttggtgattaagcatgttagaggcctccca

SEQ ID NO: 22583 - DNA, 201 bp, Bos taurus
gtcctaacctctggatcactagggaattccccaaattcatttctataccttgagggttatctaaggtggtgcctttaccacatagcacatgcaccagataatatttctaatgtatgtggatgtaaactgaaaagactgctcatggcctttgggctaccccaggccttactgggctgctttcagcaaactactgggaaattg

SEQ ID NO: 22584 - DNA, 201 bp, Bos taurus
ccagctcagggcctacaccctgcttcaagctcagtttaggagaacagatttaatacttgcctccttctagcaaggtgctcctggaaggggttttcatatccggcagggccagagggtgaatatgacaacggagagagagagaggagatctatttatcaccatgttgtcactttaagggaaaacaagctttattcccacttg

SEQ ID NO: 22585 - DNA, 201 bp, Bos taurus
tatcaggcttgaatgatatttttttctggacagtgtgactctgtaatagctctagactgagcccagttcttcctctgtgtgcactttcccttattcggactttaacatttacctacagcataattatcgatatgcgtgactttctttctcccaccacacagtgagttgctaaaggatgggggctgtgtgttaccaatcact

SEQ ID NO: 22586 - DNA, 201 bp, Bos taurus
acttgtgtcttgctgtctctgagactgtcatgccctaagacccagcctccttttttgtccaccctgcttctttgtagcaagtagcccaagccaggctgcacattccccgaagcggaactaccgccttcatctgagactttacttgggctccagtcaaggagaggagtaagagggccaggatcagtctcatgctcaagctgg

SEQ ID NO: 22587 - DNA, 201 bp, Bos taurus
taggagaagttcagtgctcttgctgggaaggtgaacagacagtcctatctaatacaaaccaccagggcatccccattggtagatagaatcctgtccaggtatgttgtctctaacagagagatgcaaagagataaccctctggataatcacgatggtgtgatcactcacatagagcaaaacatcctggaatgtgacatcaag

SEQ ID NO: 22588 - DNA, 201 bp, Bos taurus
gcatttctagcaagggccccagtaatgcgatgttgcaggtctctggaccacactttcagagaatagacttcattttgtgtagcaaagcataatgtgtggtacaaatcctggtaccaacaattgtcaccacaagtactagtgacttaacctaactaagcttccgttttttcttctggaaaatggcactgtttgagtattaac

SEQ ID NO: 22589 - DNA, 201 bp, Bos taurus
agactcagcttccaaaattcccttcaaaagtaccttgccctctatttcttagttaaggaatagtactattacttatgcacgccagaaaccaagagggtagtcttccctcttcattctccacaagcccctccctctgaatcaacactcagctaaaatcttgctgattctacctttaaagtgtccgctggtcccctcctcctt

SEQ ID NO: 22590 - DNA, 201 bp, Bos taurus
cttcagaagtatgtgaaaggagcttcccaagttcacattgcaccagagtcaaaggaacagagcatgggaagttaggaaagcacgtgctgggttcaggactatgaatgaaaccatctctgaaaccttgggcatgtgtattaaaactgtcctcttttgaggaaaaaaaaaaggcattctattttgagtctgattctcattttg

SEQ ID NO: 22591 - DNA, 201 bp, Bos taurus
tttatagttaaaaattttttaaaatttccacttgatatttaaaattttataagtgatgtattatgtcaccatattaagccaattcaattaactacactcaataggaatcacttcagaaatgccttgaaaaagataatgacagacactatatatttaaaaactactagtccttacaaagttcatctctggactagaatataa

SEQ ID NO: 22592 - DNA, 201 bp, Bos taurus
agcagaacagtctgacacagcatgcagaacaaaacaagtattagcactgggatctggatcaaatttaagttgctttttcaaggtttcctccttgttagatggtagccttctgaattctggccagctacttgcaacactgggcactgaggctaacccatgctcaggcttaaaaagttccactcttcttgttcactacctgtg

SEQ ID NO: 22593 - DNA, 201 bp, Bos taurus
tgcatgtacaggtcaaaagtgaaacacaaacgggatgacaatttcctcacatcacagcctcgacacaagtgagtgtgatgagacccagaacttgaagcagactattcccagagttctaagttatccagttctacccaggcttgttttcctcattgagcacaatatcatgcaggcttcatctaagtgaagttattcattaat

SEQ ID NO: 22594 - DNA, 201 bp, Bos taurus
gatagaattacaaacagggcaatgggaattttatagaaaaaaactaagaatcttatctcatgctggacatgttcatgaaagtgtcatttattcatttaatacatattaaaatcagccacatggcagatcctgtgccaaacacagaggacacaatagtgagcaagacagaaatagtctctacctgtaatggtgccttcccat

SEQ ID NO: 22595 - DNA, 201 bp, Bos taurus
cactggtcgaattcacagtctacattaccagatggaaatttgtctcccttccaagtccagtgagcagggctgggcatcccagaaggaaaactggtgtctcctctcctttgctcccttcagcttcaagccaatcagcagcagccagtcagccctccaggtggccaaaggcattccctttccaaaggaaataaactggcctca

SEQ ID NO: 22596 - DNA, 201 bp, Bos taurus
tgaacctgtgtcccctgcattgacaggcgaattcttaaccactggaccaccagggaagcccacttgtactctttcttcatcagactttcactgagcttcttcacatctcaaatgccatcttttctgaggaactttccctggtctcccaaccaaatggaatgtgttaatattttgagcctcagaagacactggactttgttg

SEQ ID NO: 22597 - DNA, 201 bp, Bos taurus
caatgataactatatcaatcaactctttatagcctacttttcctgaacaaagatatatttttcttttctatttttcacaaggtgttaccttagaaataagcatcaagtgaggaagtatttctaccattgggatagtttaatgggatttcttggtaagccttgtaagtatttttatttcccttgattgtatttcttaatact

SEQ ID NO: 22598 - DNA, 201 bp, Bos taurus
catttcttgtttaaggtgaggagaggatgatagtctgctcatggtggcctatttcctattacatgacaaagttatgggtaaactgtgtctgttcagaaaccttcctattcagaaatggattcttcacagaatagcattcataaagatgggataagactaaatttagaaattgcggagtaagatgattgttttcttataatt

SEQ ID NO: 22599 - DNA, 201 bp, Bos taurus
gactgttgtcagcctacagacctcagtttcataacattccttgataaaatcttaatgtggtcctggaaaggccatctcttgccttatacattcatacagttaccatgttttcatttggttctataagcagtgtgattccattttttattgatcaataaggaggaccccagccatttcaccttttaaaagtggaacctcaga

SEQ ID NO: 22600 - DNA, 201 bp, Bos taurus
cacggtgtgtgttgagttgagtgactgacttcaatataccattctctttaatggatcaaatatgcaaaaaaacagagataatgtgactaatgcaactgataaggcaattaccaatacattttctacaaaataaatctttgttgtagggactattgtgtgcatcgtaggatatttagcagtggctctggcctctgccttccc

SEQ ID NO: 22601 - DNA, 201 bp, Bos taurus
gtacctctctgactttatgcttaagttatgaatactctactacatataataatctcacaggcatcctcctttcgaatcaagatcacactattttagatgttgtgtctataaaggaacttttttttttaaacaaacatacccaaacttccaaatgtaggagaacatgtcaatcttcttggagagccttatgctcattccaag

SEQ ID NO: 22602 - DNA, 201 bp, Bos taurus
ggcacattagctgaaaaaataagatgttaataaaaaacattaacggcccaaatgccatctccgcaagctgcttcacaggaagttgtgtgagtacatccagtgggacagtagacaaaccacacttgatagcttacctcctctagaaaaggatagaaatggggaaggctctggggtgggtgaagaaaaaggagtcccagatag

SEQ ID NO: 22603 - DNA, 201 bp, Bos taurus
tgagaagtaatgctaactttgggttttgtttacataatataaaggagccctgttaataaaacagaataataattgtaagttttgtccctttaatgtgcttgataatttcaattggatcttttctaatctgttttggagagcaatttaaaatgtaactcattttgcattttgcttttgttttataatagcatgagtccacag

SEQ ID NO: 22604 - DNA, 201 bp, Bos taurus
attgaggcagagaatagagggcctgtaattcggagtaatgtgtggaaaggctgtaagagagtggacagcgaaggttgtttggcctagataataatcgcagtgggtatagtgtaggccaagtgggttcctgacccacattacaagtttattttaccaatgaacttttacttctcagtgaaacattagaatttcagggagtta

SEQ ID NO: 22605 - DNA, 201 bp, Bos taurus
ggttttatctgcctgtcaattgacgttaccagaagattttgagaaagagaaagagactagtaggaagtaagtgtggcatgttaaaatagagggcagaagaacaagtctggaagctgggagttccacaactccaaccgttgtggaataagccagtcaagacctagtcataaatcatgccagtgacagtgatggaaaagagag

SEQ ID NO: 22606 - DNA, 201 bp, Bos taurus
ttcctgaggccatcactaccacccccctgttggagtctgggactgtgaaggcagaaacatcttgtgcccttttcctggctacaaagtagaatagcagagaaagagagccagataaacctcagggcctaggctcagctcagatgttcctctcctagaggcatttcagtccatgcccctgcatttaggtagaacaggatggcc

SEQ ID NO: 22607 - DNA, 201 bp, Bos taurus
cttttctctgattcagagtcctttcctggcccctccccagctcatcacaggtactggctcccacctctctacagggcagggccactctgcccgcgacgcttattgctcattcgatacctgagaccgtccaatcacagttctcttcccccaggagactgccagctccctgagggtaggtcggcctcctgtgttcaaagccta

SEQ ID NO: 22608 - DNA, 201 bp, Bos taurus
aggaacatttatcaactaaaaacttgagcttttgctttctttcccccactttgtcttcatttaaaaattttttcttggctttttatggttacttcagttgctgttcttaactttgtagtgttaaatgatcgatggtctgaccactgaaaggaattactttaattttattttgacattgactccatgatagttctacaagcc

SEQ ID NO: 22609 - DNA, 201 bp, Bos taurus
actacagttgaaagctttatgtcccaaggcattctcaggccctggagtagttcttaaatattgctactctgcaagtaaggatgaggacatctttttgagatctcagggccattcatcaaccaaattattattcctctattcccagtagtacctaacccaaataaacatctgctgccaattatatctgaagttatttgtttc

SEQ ID NO: 22610 - DNA, 201 bp, Bos taurus
ttgacatcccttcctcactaagcttagtcacttgtagatttgattgaaagtgagagacgtgattcttcctttcacctgaacactttgaagccattgtagaattattaattggcctaatttaagtatcactgtatctcagagaataggaaggactgaggagagagagacaggttggggaactgtcagtgaaaagagtagtca

SEQ ID NO: 22611 - DNA, 201 bp, Bos taurus
aacttccacctgccaattcactttttaaaaatgattttttgagaacaaatcttaagtaaagtgataatcaccataaacttcccagaaataattaaattttgatcacaagcattcaaaacattttcacacattctctcagcaatcagtaataagtcaatagtacatacaaaatttctgcattacacactgcaatacctttaa

SEQ ID NO: 22612 - DNA, 201 bp, Bos taurus
ccgggtctcccgcactgtaggcagatgctgtaccgtctgagccaccagggaactctataaccttccctcatggcagatgagagtgaaaacagagggccgtcctggacagcaatctgacagcagttaatttacaatttatgcatatattctccatatattctgtacagcaatcttatttctgggcatagtgacagacaactt

SEQ ID NO: 22613 - DNA, 201 bp, Bos taurus
ttacctgtaatcctagactctttccctgatctctgtttcgaacacattgctcacactagccattttattggtcccagttttacatgataatctattgaattagttcatttatggctcattcctcagcttttctgcctgcttccaaataataaccaaatcctgttgctgtttccttctccattaactccaaaagacagtttt

SEQ ID NO: 22614 - DNA, 201 bp, Bos taurus
cttattaattacaacatacatgttcatactttaaaatgaaaaaatagagaaataccaaaattaaaaagtaaagatcatcatacataatctgacaccctacgagataattaacaaaaatgtactgtatctcctttcacactttttattgcatagacaaataatctttttctctaaaataacagactcaggttcaaaatattt

SEQ ID NO: 22615 - DNA, 201 bp, Bos taurus
tggacacttccccggcctgtaatagctcagctctagggtaaacatttgccctaccaaattgacagccatcccagggtcactgtgtttacgctggaggcggccaaaggccatggcctgagggctgtccagggcaggaggggaaaaggaactgtgttccacatgtacggcttgccccttcacctctgctgtcttctcggaacc

SEQ ID NO: 22616 - DNA, 201 bp, Bos taurus
cctgggtgtggggcgaagggtagtaggtgaaaggatgacgtcagccgcctccacacctggacccagcctctctgaagcaaaatgttttctggagtatctctgagcgctggcctgcacagctcctcctgcacagactacttactgccttcttggcctgccggcccctgaaggagggctggaagggagtgttagtgagacctg

SEQ ID NO: 22617 - DNA, 201 bp, Bos taurus
taggctctcaggcagaggtaatcccactctgggggccttggagctgagacagggctttgtttcaggatagaccccaagtcactgtcctcaaggatggcaattcaccaaatgccttaggccgctgtgggaggcgggagggaggggtccctgacagtgacagaacgctgggccctccttcttaggactggccctggaagcccg

SEQ ID NO: 22618 - DNA, 201 bp, Bos taurus
cccaggcccaggcgcacactgaccctttgtcctctgcaggtgaccctgccctcagcatgagtcgctggatgtttcaccagcaggccctgcaggagtacattctgatgtgctgccagtgccccaccggggggcttctggacaaacctggcaagtgagtgccttgtctctggggagggcggggcgagggggctgagcacgcag

SEQ ID NO: 22619 - DNA, 201 bp, Bos taurus
attgaatttgtgaatgtggaggaactgcagttaccaagggctgactataaattacacttggattaacccctacacattgttcaagggtcagatgtaactctatatggctttatttttatttttgcctctttccacacatgtttgattgccctgtagtaggacttggtaatatctttatattaatagccactaataacaaaa

SEQ ID NO: 22620 - DNA, 201 bp, Bos taurus
tcccttgggtttggccattctgatattcttgctatgtttggagacttattttgcaacatactttcagattttttgaggtgaattagatatgttcatcttacaatcagcttgcttttggttaagtatgttaaaactcaagttgaataaaatttaagttagtaatataaaaagtaatgagctgttctacagtatgatttggaa

SEQ ID NO: 22621 - DNA, 201 bp, Bos taurus
attataaacagatatatctttgaatacctttgtgtatgtctctttgttcatatgtgttagtttctctagggcagtgcttatcaaacttttccacatcatattgtatgtagaagatatttttcctgcccatattatcacctgggagatgatgacatatggcaaagccacagagttctctgtggcgaagtgttacaaataaaa

SEQ ID NO: 22622 - DNA, 201 bp, Bos taurus
ctgaattaaatataaaaattgctgaaaaatgaagcaaagactggcccggcgctctcctaacatctcatctttttccaagcctagcttgcctgccttgctagattccactttgcaggcaggccatgcgacttaggttctggccaatagaatgtaaaggcccttccaagtgtgagcctaatcctgcccatcctctaggctctc

SEQ ID NO: 22623 - DNA, 201 bp, Bos taurus
cagagaggcagaagggcagggcaagtggtacccagtgacactcaggcaagcgagtgaactaagcaagacgtggggcacggttggactgtttccttcactcgggccaaatcatttaatgatgttcacaggagccagagagggaggggttgttattccagtcttccatttcaaaaacaggggctcagagagatgaatcacttg

SEQ ID NO: 22624 - DNA, 201 bp, Bos taurus
ctaagaatgttgaactctttgtcttgttgttgttggatatgtttcttggttaagtgttcaattatatcttttgttggtttgaaaaaagttcaaatcaactcgatttgggaagttcttctcttagaattgcctggtgattccagaagggttcataaatgtaagtcttcctttattcatacatctggattattggctaaatct

SEQ ID NO: 22625 - DNA, 201 bp, Bos taurus
agagctctattgttctaaattctgggccccagactgactgtgtcaaatctggcaaggctttcaagtttcagctcagacataatgaatcagaatctccagagtaaggcccaggtattttaaaaagttctttgcgttaaaataacacctctggaaaaacagatgtatacgaaaaaagcctatagggagagataatgatgttat

SEQ ID NO: 22626 - DNA, 201 bp, Bos taurus
atcctggtgtattcgcgtgattcaacaacaacctttcaaccacacactgctcacaacgcaccgcccccctccccccaaaaggagaaagttcaggcaaagcaaaaggcctacctcttgaccaaccatgagataaccaccatgaaattaccaccacgagtcaaagtgttagctgttctttgcaaccccatagactgtagccca

SEQ ID NO: 22627 - DNA, 201 bp, Bos taurus
cctgcacttcccagctcccagccaccccgctcaccccttgctgccttctcccctcccttccctctacgaccactcactccccacaggccccaggagagccgtctcttgactcaagacacccattaaacaagactgagacactaacaatcatcgggcactttgtgaggagggccaattagaggccggcctgaccagggcgag

SEQ ID NO: 22628 - DNA, 201 bp, Bos taurus
actgcaattgccatctgtctctgttttgctaactcattagttcggacaccacattgtgttaatccccacttcccctggctatgagcttgatccagatctctaggagatagtggaactgcttagcctgactctcctgtcagctggctactgccttccacagtgggcagcttgccaggcctgcacctttccagaagactcttt

SEQ ID NO: 22629 - DNA, 201 bp, Bos taurus
cacccatgaagtcatctgaaatcctgtcttgtgtttccttcttgtcctttgccctttatttcactggaggaaggctttagggaaatagtaagaatgctgcggtaacagagggaattaatttgaccctgctctgaagaaacagtgtgttgattcccactagcaatagtttctccacccttcagaacagggcaagggatgtgg

SEQ ID NO: 22630 - DNA, 201 bp, Bos taurus
gcgagggctacatgaacctgggctatggccttggtgctcaccactgcctgtctgccttgaagcacatctccaaagctgccttttgcagacttgggccacacgaatggtttggatggtccacgagtgcctttgttccccgtctaccggaaagcctttggttttcccttttcctccctctgaaggcccttgacgccctgcaag

SEQ ID NO: 22631 - DNA, 201 bp, Bos taurus
aatgagaatgtcaaaggattttagaacaaccacagcagcactggaggcccacaccagtgcagaagcacttggagttgggggcccttcgccaagtcagggcatatgttcttgctgctcaggctactcagcggtgataagtaatcaaggagaagcaatattcagtgtctctgacattcctgcagagaggaatataggccaggc

SEQ ID NO: 22632 - DNA, 201 bp, Bos taurus
ttcattcacttaacatgtattccattccttctgctggttttgtctcatatgctccatatatacagtctccttgatttttaaaccacatttctgtaagcgttcataggtggatattctcccattttagagagggaaaactgaggctcagagaccttaactgaggacatccaacttgtaagaggcagaggcaagattcaagtc

SEQ ID NO: 22633 - DNA, 201 bp, Bos taurus
ttccatggagacactgaagtaaagggtcaagtcttggggacaggaagcttccccaggccatagggaacctcccctcacctttacagccagagcctacacttcaggatctctgggaatcaatgcttccatctttggtatcacccagggactgactccggtggaggaaattctgggctggccaatgggtgtgctcagccccca

SEQ ID NO: 22634 - DNA, 201 bp, Bos taurus
gcaaccaccccccaaccgcccccactgggcatagtcattctgaccctttggaggtttcatctgaaacctccatctcccctcctctgcagacgaaattttagggttaggggttctggtcagcacctgtggcagcctccccagagctgacgttttacaagtttaggcctctgaagctggggtggttgagccaaagcctcaagc

SEQ ID NO: 22635 - DNA, 201 bp, Bos taurus
aggtggctgctggtcagcttcacacctggactcaagtgttcaccctagagtctcagcgcacagagtcacagatgcagcactgagcaaagtaacaaaaatccttgccctgtgtgacagacactcggtggatgtaaaaatgagacaactgagtgagtgaaggagcaagtgaggaaccgatacaaagtgcgaggatccaggaag

SEQ ID NO: 22636 - DNA, 201 bp, Bos taurus
cctggccctcctctgctcccatgaaaccagcaggagggaagtaccccctcaagccagaggtgatggaggggttggagggcccctccctgggctctgactctaggatgactccagttatggtttccccaggaggaaacgagcctgggcaccctttttccccttctaggacggcacaagggaatgacttggcccatccctgca

SEQ ID NO: 22637 - DNA, 201 bp, Bos taurus
gactggctcagcctttgatcaatgaggaaggacacacctccaccccaggattctgtttgcctgtgcttatctgggctctagtcttaagcagtttccaagagaagggccacatcaggctttttatgaaagctatccttcttgattatttttctcttctgttctcccactcattcgcaatgaaccaggatccctgaccttttc

SEQ ID NO: 22638 - DNA, 201 bp, Bos taurus
tgaatgcttctggtgaaagtcacaaaatgtgctgattcgttctactaaaaatacgttaacctccccacacctcccatagctgttacattttcctgccatcttcagtgcccttgtatctactcttccctttctccaagatggtaaccaattttacctatttaatggattgagatcatctaacacaaactctctgcatcttct

SEQ ID NO: 22639 - DNA, 201 bp, Bos taurus
ttgaccccctctgcatcctctctgtgagccccaatctcctgtgttaccccagatcccacattagatttgagaccccaggagcactgatctgtctcaggacattgttgtcggccctgtccacaccccactgccctgtctgcagcataggtggtgcttggttgagtcagcctgaaaagctgcctttaattcccagctgctcct

SEQ ID NO: 22640 - DNA, 201 bp, Bos taurus
gaaaatcatcaggcaagctgaagaaagagactgggtatggctggctgtccgtcctgcactgtgaaacccgttctcccaggaggcccccgcttgagtcagtccagttcagtcactcagttgtgtccgactctttgcgaccccatgaactgcagcacaccaggcctccctgtctatcactaactcccggagtttactcaaaag

SEQ ID NO: 22641 - DNA, 201 bp, Bos taurus
tatggcctttttggtcctagaaatattcaaaataacctttattatcaagtagcataattattagttaaaaaagtaacattgcttttgattaaacagacttgctttggtggccatgtgattttatggatttctgatgaactttgtgtttgctggtctggttgctccttcttggtaccctcatctttgtgcatgaatttctgg

SEQ ID NO: 22642 - DNA, 201 bp, Bos taurus
tatcctgcatttattatattagagagtaggattattttctctaaagattcttaaaagccattaaaataatatcttattccaaatcaaatggagctacttattgccagaattttgtacctttttcaatgattaaagaaagcaagcaagatttatagacaatgcaattttcatgacacatcaaaaaatgtgttcttatagctg

SEQ ID NO: 22643 - DNA, 201 bp, Bos taurus
gtatctgaagaaatttacatcatcagtttccctcgccacctccctttctcagtcaaatgctatggctcaaattcaaattccaattaatgtggccaaggttggagaacaaactttatgttcaagctttattatcactggatgagcacccaccaacaccacagtgtttggttctttaaatccagatgacatgtgttcaagcta

SEQ ID NO: 22644 - DNA, 201 bp, Bos taurus
atctgtccagtgagaaggcagagggtgaaggtgaccgacggcagggcgcttggcaggatgagcagcagggagggcaggcctgagtgggggacgggatgcccgtttctgcccaggacagaatctgccttggacctgccaggggagatgtggcatcacacaaggggcaggagagaaacctccgggcgctggccaggctttgga

SEQ ID NO: 22645 - DNA, 201 bp, Bos taurus
tgtctgcactcctggtccccttccccgggcttcctttcagcattcacagtgaggggttataggatatttccccaacctgcacagcgcagagcaggccaactagaggctgctggctctggcttgctttcaagaggcttcgagtggggtgtgttccccggtgagagcgccctctggcctggagctctctgtgaggctcctagc

SEQ ID NO: 22646 - DNA, 201 bp, Bos taurus
agaacccacctaccaactcaggagatgtaagagatgcgggtagaagagactagaaggcattttggaataatgggcatacactgtgaaaatggcctcctcttttgtgaccacacctgaagaagtgacacccagtttgcctcttatctgtgggtctagaggtccaaatggacccttggcaattggaggtcattggaacatctc

SEQ ID NO: 22647 - DNA, 201 bp, Bos taurus
gaaatcatattatgtaaaatatgtaggatcaattccaacctgaaatagcaccaaaaacaagtctccataagtattcattagaaaatactttggctcaaatgtctagcagttctctatattcatacacacatacaagttctaatatttacatattgcaaaaatacataagaagcttcagctatagagaattcatgcacagtg

SEQ ID NO: 22648 - DNA, 201 bp, Bos taurus
gagaaggagatacaggcctcacaaatagccagaggggtcaatgaaagaggaagctcaccacaaaagccatccaaaataaaggcagttcccagcaggctcttcgagctgaaggagtctgaagtcctgtgggtgtttaaaaaacaagaacaagctcaccgtcaatccctcctttcatccccagaacaatcagtcatggccttg

SEQ ID NO: 22649 - DNA, 201 bp, Bos taurus
gatggccatgcacaagctcagagtatctgcagaggctgcttcggtcgtatagtccagggaccagtggattttgtcacacttatgctatgcatattgcactaccatgggccctattcattctgaagacttcccccacagctcagcacttaaaacgcatatttactgagcatggagagtgtaggcttcggccagaaagtgcaa

SEQ ID NO: 22650 - DNA, 201 bp, Bos taurus
atgaagatgaagggcatgctttttaaagaaatgtctgataaaggagtaaaaagatactcaaatctcattaatgagtagggaaattcaaggagaaacgagtattttttttttacttatcagattggaatgatggtgcggatagaaggaaggggcatacctagatactcttggtgggaatattaatttgtacagtaggtttgg

SEQ ID NO: 22651 - DNA, 201 bp, Bos taurus
tcatctttcactgcttattactgatttttgccacctttttttttttggtcatctgttcagacgtttcattctcccaagttcagacgtttctggggaaaatacaaaagcacaactgcaggtagtctggaccttctattatttttctcattcttttactgaacttcactgcttaaccacaaacactgcacttttcattgttct

SEQ ID NO: 22652 - DNA, 201 bp, Bos taurus
cttaacaaccaaacaacaaaaacagcatgaaggagggtctcttgctatccaccggagatcttctgaactatcagttaattttaccatttcataaaaagcatctggccaatgaaaaagtaaaaaaaaaaaaaaaacttatcctcattaggaatgaaggaaatgcaaaataagactacacacgacattaaacattctcaaaat

SEQ ID NO: 22653 - DNA, 201 bp, Bos taurus
agtcacgaaacttatcttggctccagaccacgcctgatctcgtcgtgtctccgggcgcgccccagtcgccctgagacaaaactccagcagccgtccgcgcctcctcatttagagtacggacggaggctgtgcgtctggaatgacagtgaccgtgatgctggagccggccggccgctgccgctgggacgagcgcgtgcatat

SEQ ID NO: 22654 - DNA, 201 bp, Bos taurus
atgatattaatacttcatttcccatccttaccacagtcttccagaagtagaagttgggtaacaaaaggagtgggaagctcttgagtcagtggcaagaaatgattcagtttgtgaaagaggcatattttcataagcaaacattggccaagattttgttcagctttgttttcagcctttctttgtagctgaagaactgaactc

SEQ ID NO: 22655 - DNA, 201 bp, Bos taurus
gaattcagggaaggatgctccctgggcctgccaggaaacataggcagagctgccctctagtggacatcagaggctacagcaaggtcaagcttctctgagcttgaagctgggactggaaagggtgtgctgaaatatgttgtcagaagtgctgagtgcgtgtggagtgcgaggtcgttaaatcacgccagcaactagcgcaga

SEQ ID NO: 22656 - DNA, 201 bp, Bos taurus
gaagaggaaatccaactagttggggtctgatggtgactttattctcccgaaagttctggagatgacatccaggttctatcagtcagcagaacgccccctgcccaggaagtaaggcctgtaggctccgggcagaacaccccacctccccagccctgggtttaatcacctggtttcccctggccatgtgctaacctgtgaaac

SEQ ID NO: 22657 - DNA, 201 bp, Bos taurus
gccagccacagaagaaccttcacagtcctcaggtactattcctgttgttcagtgtactttaaaaaaatagactaatttattttccgctgccctgagtcttcgttgctgaacaaaggccactttctagttgtggtgtgtgggcttctcactgtggtggcttctcttattgcggagcacaggctctagagggtgggctcagta

SEQ ID NO: 22658 - DNA, 201 bp, Bos taurus
tctttcagaacaaaagccaaaatcctaacagtggcctccgaggccgatgtaaatgcttggtacgtcactgacttcacctcctaccactcacagctcttcactccagctcccctggcctccctgctgttcctctcccacctcaggtccttgctggaatgttcttcccctagacacccacaccattcactccctccttccctt

SEQ ID NO: 22659 - DNA, 201 bp, Bos taurus
atatatttgctttaaaataattttcatagagtaaaatgttagtatttaagtaaaaaacttactcagtagccacttaaaactactattctttgatccagtaatcgtccaacaaaatgttttgagcgcatgctcccaaactgtgtatacttatatacctataaattcaacacatatgttgctaaaccaatatgtgatgttctt

SEQ ID NO: 22660 - DNA, 201 bp, Bos taurus
atcatttgacaaaactcaacatcctttcatgataaaaactctcaacaaagtaggtataatgggaacataataaaggccatatatgacagttctgttcagttgctcagtcttgtctgactctttgcgaccccatggactgcagcacgccaggcctccttgtccatcaccaactcctggagtttacccaaacttgtgtccatt

SEQ ID NO: 22661 - DNA, 201 bp, Bos taurus
ataagcagtttcagaatgtatgtttctgggagaatatccagttccctaagctcctaactgcatagaaaggatttcttcactgaaaccctggatagtgtttagggaatctttgatctcaaagaaattgatatgtatgcatttgtatgcatgcctttgtttgtgtgtattcctttagtatgcatttttcttgggagacagtca

SEQ ID NO: 22662 - DNA, 201 bp, Bos taurus
ctgagtagataaccatgttgaaatttgagataataaactcatgtcctttctttctccccccactttttttttgtcttccaatattttgagcagattcatactcaaaggaccggggaccttggatcgtaaaaccagtggcctcttccagggggcggggcgtctacctgatcaacaacgtgagtttgtaatgggggcacactt

SEQ ID NO: 22663 - DNA, 201 bp, Bos taurus
tcagcttttattggtgactttgcaaatagtgaagaacctactagctgtgtgctctgctaactggtaggtaacagcgtgactttatccatgagcagtccacggggtaattacttaaaggcttaagaagctgtagattagttccatgtactgtgtgagaccattttaccaggtggactaataccttcaggatcttcagtacgt

SEQ ID NO: 22664 - DNA, 201 bp, Bos taurus
ttgactgtgagacaccgaggtctgagtagcacccactggaattcaaagcaagcaggttcctcatggcccttaccacatggccttacaccgctgagcactcgtgcacgtacctactgttgcactgcaaaaattccttcctctttgctaaaaacctctacttactaaagaaacttctttttgtgagttggagactgcttttgt

SEQ ID NO: 22665 - DNA, 201 bp, Bos taurus
caccgggctcacaaccacctataccctggaaagaaggaccctgctccattgttgtctgtgcctgatgctttcctggggctccttaggcaccaagttagctgtgtccccaggctcgggaccttagcctctgggcaccaacttctggggtccagatgtgaccatcacctggctgatgaggaggggcacatggtgaaacttggg

SEQ ID NO: 22666 - DNA, 201 bp, Bos taurus
ttcctcgtctgtaaaatgggattcgtgttggtaattgtgaggatgaagtcaacgtaactcttgcctgtaaaggatgggaacagggcctggcacatagcatgcgtgcaaagcctgccctgttaactatcagatctttgctattgaacccttgctctggctgccgtgtgggggccttgcaggatgacttgagaaggatcagag

SEQ ID NO: 22667 - DNA, 201 bp, Bos taurus
taaaatgccgcctcctcagagaagccttttctgactactgtgtccggatactgttctattctgccatctgtgccctggcccttctctttcttcatagttcggttcagttcagttcagtcactcagttgtgtccgactctctgtgaccccatggcctgcagcactccaggcctccctgtccatcatcaactcccggagcttg

SEQ ID NO: 22668 - DNA, 201 bp, Bos taurus
tgtccccaaaggtcagcaaatgcggaggctgagaaaccctaggctagatgtaggagtccaaaaggttctgaccccagctgtgcttctcactagcttccctgtggccttaccaatcgaatccttgatttctctgaattctcttccttatctgtaaaatgggaaccttattaccaactgagagtagtggtgaggaacggaacc

SEQ ID NO: 22669 - DNA, 201 bp, Bos taurus
ttggctagtgcttgggagcagctgccaccatccagccattcccacccagctgaccaactcgataacctgccagtagccaaacacctccaggccacaggacgaggagaacaaagtcaaaggaaacgccaatttcctaacaaaggagggaagcaagtctggataagtatgatttgcttggaaagtgggagaggccaccactcc

SEQ ID NO: 22670 - DNA, 201 bp, Bos taurus
tcctttcaaacaatgtaacttcagatctgaaaattcctgacgagtggaaaacaatactactttaatttccatttcaccaagatatctgaaacacagggagaggttaacttacccacaaccactgagcaaccaggccaagatgacaggcggtgatcctaatccctggctaaattctctttctgctgaatcgtaacccaggtg

SEQ ID NO: 22671 - DNA, 201 bp, Bos taurus
tggaggcctgcaaactggtgggcgtagtgcccgtctcctacttcatccggaacatggaggagtcctacataaacctcaaccaccatgggctgggccccaacggaaccaaggctattgctatagccctggtggtgagcatgccagtgcgggcacatgaagcctggcagagttggggcctgacagggtggtgggcccaagagt

SEQ ID NO: 22672 - DNA, 201 bp, Bos taurus
ccccaccttggagcagaaaggggaggtcttaagggtacccacttaacagccccaaacctcaatactcttgtttttaaagtgaggtgaaaatacaagcttatcattcttttttgtaaagttggtgaagcttgtcaagtgcctagccaggtgcctgggttagaaaccactcagtaaatattagatactatgcattgctggggg

SEQ ID NO: 22673 - DNA, 201 bp, Bos taurus
acggggtctcggggtacaaaccgagagcgctctcccgggctgacttccacccacgccctaagaagaatcacgcctccggccttgtctgctagaagccgacacgccccggcttctccagaccccgcctcagaactgcgccccacgcctgctccacagcagctcccgtagcacaaggtccccgtacaaaatggcggtttggcc

SEQ ID NO: 22674 - DNA, 201 bp, Bos taurus
gtagcggccccgcagggagctcctggagcctcgctccacgtctccagctgggacggggtctgcgtgagcaaagggcagagtgtttggctatgaattcagagaacaaaaaggcctacctgaaggcaagaagatgaaccaggtaacaagctggtggctttccccccacggggcatttggaaatgtctagtggcctccaactag

SEQ ID NO: 22675 - DNA, 201 bp, Bos taurus
accattcttaccagaggtctgggagacttggctaatgctgggtgaatgctgaggatggaagagactcttaaaggtcaagttcaacctacagacaagaaatttgctccagagagttccctggttgcctacgggttaggattctgggccttcacctggccagagaactgaaatcctgcaagtgatgcagcatggccaagaaac

SEQ ID NO: 22676 - DNA, 201 bp, Bos taurus
ctgtgcccctgttcacacaacctctgccatcctgaagttaaacatacagtgggattgcctggggtctctgttctggaaacgttacctttgcagaaccttccgtatcttattttagggaccgactcatcaggcggtctccttagcaaacacacagggaaagaggcgtttgcagctttgattaaatcctagccgaaaacttgg

SEQ ID NO: 22677 - DNA, 201 bp, Bos taurus
taatctctcctttttcttctggcactttccatccttctaaaaataattttcttcagagtactattcttcaccaagaagcttcttggaagacgagtcacccctcaccagctccacatcctcagaactattttttaactcttttagcttagcttctgccactccagctgccccaaaggactgtgtgcaaggctcccagttccc

SEQ ID NO: 22678 - DNA, 201 bp, Bos taurus
ggaacagaggaaaattggatttccaagtaaagtcacaaggagttatgatagtagtacttatagaaagtagttgaatgagtgcccagcaatgactaggcttctcccttacctgtcactggagtttagctatgaaaccgttaggtatcatttcagggggctccaaagaggtccagtcctttatgtctcaaggctgaaagaatt

SEQ ID NO: 22679 - DNA, 201 bp, Bos taurus
tgtgtccactggagtagcactgttaatttccttcaagaagttttcctttgccctcaccatttgcataactatttggtgcaagaggcctagctttcatcctattttggcttttgccatgccttccttgttcaactgaatcatttctaacctttgattttaagtgagagacatgtgacttttcctttcacttgaacacttaga

SEQ ID NO: 22680 - DNA, 201 bp, Bos taurus
ccatgacagtgtctaaacctgttgctgtttggcttaatgaaaggccagacatgaaggaagggtcaacataattttgagaaaggatttgtggaatatttcaacatgtattgtgagcaatgttgttttggttacaaagaggatagcactttcacctctggaagtgaacaggaactttttcaatttgctccctaatggatatat

SEQ ID NO: 22681 - DNA, 201 bp, Bos taurus
attaaattggcttctctttctctctcttctctagatgctttgtttggtgtctctaaagtttgctggcaagtggttgctctggagattaaattgttcttgagaggccagtgtaggaggattatactatcctagtgtatatttctttaggacttttaatataaatctttgtcggagtgggcgatggaggtgagggctgccata

SEQ ID NO: 22682 - DNA, 201 bp, Bos taurus
ttttgtctatatgagggcatggaaatgagatttctctgtatcatcctggcctataaatatgcattgaaaatacatggaaccatggccccacacttatgcacagagtatgtgggttgtttgtcttcctgacctctccacagacttgcctagaacaaaaggactgtctggcccctgcctggctggaatttacctatagaacag

SEQ ID NO: 22683 - DNA, 201 bp, Bos taurus
caatatataataaaccatctatgaaataaatacattgcagggctatttctaaaatctatatcccttactttgtattcccttgtggccccttctgtaatgctgagattttgtttttcatacttttttcatctgttatttaccctccccttctcctcctggagctcttggcctccaggaatttcttacagacgttacgtcccc

SEQ ID NO: 22684 - DNA, 201 bp, Bos taurus
actcacagccttgtccaactctctgcagccccatggactgtagcccgccaagctcccctgtccatgggattatctaggcaagaatactggagtttgattcgtccctctgggagtagacatctgatcacaggccctttctgccctgcgccagaggagatgagacctgtgtgtcgtggatgcttggtcttaggtgccctgtgt

SEQ ID NO: 22685 - DNA, 201 bp, Bos taurus
agtcacactttgctccatgagatgcattaatttttcacatggtacttttacagctttacggtaagtccctgacactgtgttggcctggatggaggggtttgccaaatgtgaatgatggatacgcaatgctgcataaggacacttagggaccaggtgcagaattagaaaatgataattaaagccaaaggtgaaaggttatat

SEQ ID NO: 22686 - DNA, 201 bp, Bos taurus
tcattagactgtggaagtttgagcaacagtggaatggatttcatttaaatcttaaagcttaaaatttctgtggaaagtcatctcaactagaactcttcccgattgagccataatatccagtttctatcacttaacttacttttgattacatgtattatttaagtgactgaatcagctcatatgcacaaagaaaatctttta

SEQ ID NO: 22687 - DNA, 201 bp, Bos taurus
ctctagagcccatattctattattttactctcctgctttaaactgaatctacttggattttaatcctttattaaaatggaggccttgaaaacttttatgcaggccagcgagtggcaatggtgtattaggtggctcactaaggtcttgagaacaccgagtccctggttagcaacccagagcaaaaaaaaaaatgtattttca

SEQ ID NO: 22688 - DNA, 201 bp, Bos taurus
ccctctttttgatgtgcaaaatagttacacagttgaggatgcggtttacattcactcaaagattaaagcccgcattcatttatggtgtctccaagtgtgttttggtaatgaaatttagtacttaaaaattttacactgcagctagtcctaacacaattactatcggactatgtttataaccctgccataccatttatgaat

SEQ ID NO: 22689 - DNA, 201 bp, Bos taurus
aaggtcaaagaccttagttgccatggcccaagagcagtgttggctggccaagaatattaggaatcacctaggcacactttgacctcggtggagtctttgacgttgagttacgattatgccactaaactcaaggcagggaaggcagaaggcacttgtatgggtcattagccatagagggcagggagtgtctggatttctgct

SEQ ID NO: 22690 - DNA, 201 bp, Bos taurus
gatcaaaccctggtctcctgcatcgcagccagattcttgaccatttgagctacagggaaatccttatttttatcaattcttaatttattatgcattcttcgtattcattcactctttaggaatttatcaaagtcctagatgacctctgaagtactttagttacccattctctagtatgtatttagaatatttaagactaaa

SEQ ID NO: 22691 - DNA, 201 bp, Bos taurus
tgcagagcctgcatcggacttaattttgttctctgcaaggttcctgttcctgtgatggcgtatgggtccacaatctctaggaaccattcctcggtaagagtcaagatcaaccttggccaagccctcgccctgcagtgtccccacctcacacagtgcagctgccctgcagggtccttgctgtaaacgcaaaagacttgaatg

SEQ ID NO: 22692 - DNA, 201 bp, Bos taurus
attacacacataagtgatatcatacagtattagtctttttctgacttaatttcactttgcaaaattaccttccaagtccatttgtggttgcaaatggcaacatttccttcatttttatgactgagtagtattccattatacttcacaccttattttcttcacctgtctgttgatggacacttaatttgcctctgtatcttg

SEQ ID NO: 22693 - DNA, 201 bp, Bos taurus
actctcaaaatgggtcatttaatttccatttaagaactgtcaagactaaccagagctgcagacagtgcacctccatggccaacaggtgggtaatggcagcctcaggggcaggtggtgacgtctaagttatacagactgagaaatccagttagtgttattcactcagttctgtccgactctttgtgaccccatggactgtgg

SEQ ID NO: 22694 - DNA, 201 bp, Bos taurus
ttctggcctggagaatccttgcaaagagttggacaagactgaatgactttcactttcaatgaaagagaaaaagatgtagtttgtttaaaagtatgttctactgtcctttaatgttgaggagactaatgctcaagaggaatatgagttatcactgatatttgtagctgggtaaagaatttctaaaataagttaactcatttc

SEQ ID NO: 22695 - DNA, 201 bp, Bos taurus
gagcctgacaagcctggcactcacaggcctgcaatcaaagaaagggatgaatacaaatggcccgaagtcaagtcacaaaacgatgcctcaggcctttgccaaatggaaagagatttctcaccactcgaggagaggagtgaagtcctctgcagagaagctagagacaggccccaacccaagcacactgcagcctcatttcat

SEQ ID NO: 22696 - DNA, 201 bp, Bos taurus
tgggccactagcagcccctgggccacatgccccaagtcccaggcatatgcacagacaggcacagcagcacagcgcatattgggcgtaataaacccacccccactcccggcctcttccccccaacccagtctccccactccagagaaagtaacagaaggagactctctggagtaaattgtcacagtcaagatgcacaaaact

SEQ ID NO: 22697 - DNA, 201 bp, Bos taurus
ttagagcttagacagatacttcaaactcagcaaacggaccccattcttctgatcgccatcctcactgccgtgcctcctggctctctggactgtctcttataaccctggctttcatttactattcctccaggggttcctgttttgtggtgtaagtaaacactaaccagccagctatctgagcatctctcttcatttttcctt

SEQ ID NO: 22698 - DNA, 201 bp, Bos taurus
gtcttgcccaattgtcttatcaaaaagagaagggaatgcattttgtattgagttcatggcagttcctgcgaatcatctcattcttcttctgtttgtacaccagtattctctttagccattaggatgggtatgcaagtgacattcatgaattttgtttctaggtaatttctagaatcttcattctaaattgttcttttcctt

SEQ ID NO: 22699 - DNA, 201 bp, Bos taurus
ttacctccaatcttaaaggacaaggaaagtcagcaagctgagagatttgggagagtctaaggctgacagctgggttatgtatgacactaatgtgcagtgcatagtcttgactctttgctcaagcatacctagaagagaagagcgatgctagcaaataagactctgaaaatagcctccgagagctttattaattacctctct

SEQ ID NO: 22700 - DNA, 201 bp, Bos taurus
attagccagagaaaacagggaagatatttgaggcagaaggaataatatatacagttgtataaaacagtaaaaccacctaggacatttaaatattctgttacgttggaagtaaaggttgcatccattaattttaaaaggcatattgtgtgcttccacacactgggagacaagctaaacaaaatagatatggctgctccacac

SEQ ID NO: 22701 - DNA, 201 bp, Bos taurus
gaaatggagaacagaatgggttcagagttcctggaaatgaactactgcttatagccatatccagactggagcccatgttcttgtgtctcccaggcccttggtctttcttatgtatcatgttgactttcatttttgaccgaagaattttagtagcaaccatggattttattatcgcggctacatagctgctgaactaggccc

SEQ ID NO: 22702 - DNA, 201 bp, Bos taurus
caaatggattgctggcctgtgagtagtcaggaacagtctaaacaggcttttacacagttttctaggctgtatttgcattttcattaagttggcactttgatctataccttactgataatgtaccagcgtcagatactttgttagtccttcacctgagctatgtactaatcataagactaaatggttgagatttagaaattg

SEQ ID NO: 22703 - DNA, 201 bp, Bos taurus
aacaatgttctgacacaatgcaggaaccctgaaagacgcatcactgcatcaacattctgcagcgtgctgtgaatttgaatttttgttattacacatgttttagcattagccttcttaatgaatccaatgaataacaaataaatgctaagaaagaaaagtgcctgccacttaaggaacaatccattatatttattccagttt

SEQ ID NO: 22704 - DNA, 201 bp, Bos taurus
aatgagactcagtctatcatgttcaagagcttgaatcatgtatacagagaaatattaagagtaggatataaatgtctaggatagagtgtatataacgtaagagctatagaaacttaaacacaacaaaggaaatgtcactacaaatcaaaaaattctctgggaaaggtgaagaatattcaattcccttaaattgctatttga

SEQ ID NO: 22705 - DNA, 201 bp, Bos taurus
cagtgaaacttccaagactagaacatgtggattaagactggtacattctatcagcctctttctgctactggaatttgcaatttatggaactcaaaaggtggagaaatccaggcaaaagtccatggctaagaggaagaaaaatcagctgaacttggagggatgacataagtctgagtaaatcaaaagataaattcagcgcaa

SEQ ID NO: 22706 - DNA, 201 bp, Bos taurus
agtggggaaaactgggtagtttttctaacaattagtaattcatgccttttcagggatggagccaaagacaaacattagaacaagagagtctcctagtgctttttttttttttttttttttttaggaaattacaagggttttaggagctctctctgtgcctggaactgagggcagaaaccaattatctcatactgatatata

SEQ ID NO: 22707 - DNA, 201 bp, Bos taurus
tatttatgggcatgctggaatctggccagggcttttccccttggtaaaatgacaacgtcttaattaggaatgtttggtctgtggcaagagttgccagagagccgtccattgttctaatgcacagacatccatcaccagcctgcaaccaaagcccacagcgcagtgggagaagcacaaggctggaagacatcggaattactt

SEQ ID NO: 22708 - DNA, 201 bp, Bos taurus
gtttaatctaggactaattttttcccactacttggcacaatccttataagtaccctacccaaagctgtgtccttcatgaagtttttctgtctgacctgtggggacatgcaccattgccctgcctatgtctaatatgtgctttattgtggtgatttggtacctaatacacaatatttctgagcagtgtgcctatactttatt

SEQ ID NO: 22709 - DNA, 201 bp, Bos taurus
gtgcctctgcatggggaaacaacacttgttcccatatatgtgtacttgtccaaacacaaatgaagagatacatggtttttcccacattcattttgcccacctatcctcagaaaaaagcctgtattttgacaatattaaccactacccattctctccacatggtttaagctctaataaacattcatatagttatcactgaaa

SEQ ID NO: 22710 - DNA, 201 bp, Bos taurus
caaaaaaaacatcaactaaccacactacaggacagaatgaaaaagctactgatagatgtaccttttcatctttaaaatatgctaaggcagtgcagctatgggacctgtgaattctgaagtgaagccaggaatgtaggctgggaaggttctacagaggtatgtgagagaacttacatacatgtacggatagaccctgatgta

SEQ ID NO: 22711 - DNA, 201 bp, Bos taurus
aatcaccaatcttcaattctccagggagcaatgtgaaacttgaagcttctgtagcaagtggtctctctcccttttgaagattgctaaaggaagctgaagaatgggatgatggtcctcggaaaatagtggccctcagtatttgtatgtagaaggaatttggttgaacccaagttcaaagggagacttggagaataaaaattc

SEQ ID NO: 22712 - DNA, 201 bp, Bos taurus
gcagaaagcacagaggattacgtggggaactacagtgaaatgtaaagattatcatgataaaaatgtcactggagcgtgggctgggatgggggttcttaaggcagtgataaggttagcaaagtctcccattgtgagaagacttactcttaaagttaaagaacatgtaggatgaatctaggaaaataaaggagggacatgtgt

SEQ ID NO: 22713 - DNA, 201 bp, Bos taurus
ttttaaagtttgacttcatatccaagatgaaatttcatctaaagtgcatcagaactcaggcagtccggcagcttctatgggaaaggccagctgccatgcagaccctatgtagctcctcttcctgggaagaaagactccactttgacatcgtgagggataatttctgatgtctccctgcctaataaatacagcagaacttag

SEQ ID NO: 22714 - DNA, 201 bp, Bos taurus
aaatatgtattaaaactttcccccttatcgcatatgtgttgcaaattaatagttagcaacttctctcatgcctggaattaaaatatatatcaaagagactcggtattgaaatagcagaacgtctagccaaatgccctgctatcaatatgaaatactgtttctgggagtatgttcaggctgtgaagatatttatgaaggaga

SEQ ID NO: 22715 - DNA, 201 bp, Bos taurus
atcccagttttattatctctattttacagaggaataatctggcctgcctgggttaagctgtttataaactatttagaattttactaatatattttatcattcttatattcttgggagggcctgtggatcgctttgttttaactctctgctggttcttttgatccctcactttttcctgtgtgcgttgtcgctcagtcgtgt

SEQ ID NO: 22716 - DNA, 201 bp, Bos taurus
tctttcttaccatatttgggtgtttgaaaggagtctactccttgttccaaacagaaataattgacatgcacaaaaaaagcagcatcattgaagacctccccaaaagtttggagtttagttctgcgtggtttattttcattcttgttttactcaagctggtttgctattccataagcatatgtaccatatgcgaccgaagac

SEQ ID NO: 22717 - DNA, 201 bp, Bos taurus
taagaaaccccttaaaggaagggtttgatttttaatggcttccctttacaatttcctcaccgtgtttaagagggaaaagctttgactagtacctgatagcgtttgcctttgcagttctgtagtagtaccaacacggctctggctttaaagataagccaaaggactcactggattcttgagcaatgataaggaaagaaaaac

SEQ ID NO: 22718 - DNA, 201 bp, Bos taurus
tcctacatgctgcaatgaaaagatttcacatgccacaatgcagacccggcacagacaaataaataaaataaagattttttttttaaaaaattctctttccgatctgctagggctgagatgtttgtttcatttgcaaatggagctgtcaagtaggttccttgagaggaatcttgagttcaggattgagtataggtggttgca

SEQ ID NO: 22719 - DNA, 201 bp, Bos taurus
atggtgaatactctttggaggatataccgtttaaggccatgtgacacttccacctcctaaatctgatgggacaactggtaatggtagaaacatctagcccgcagtctggctactagaatagataggccgaatacctagttacagaaaaatgaaaaactctcactctttcataaatgcttatgacataaaatgtcaggctat

SEQ ID NO: 22720 - DNA, 201 bp, Bos taurus
cttttgttttctgaaaagtgactgtcccctaatctcagcagtcaggcagggatgatctacttaatgttgatctcctgagccggagtgctccagattcttttgttcctcttttggggccactgcgcctgcagttcactctcaggagagcctgtcaattatgtggtttttctggtaactagcacttggggcctgaaacatttg

SEQ ID NO: 22721 - DNA, 201 bp, Bos taurus
cccctctgagctgaaattgaactcaaatagtgatcattgtcccttcttcaacaaaactccccaaaaaaggaattcagaaaaataaaatctacataattgtgtgttgcaaagattaatgggaaaatacagtaagcatatcatcaaaccaaaagtactgaggtaagggaaaataaagcaattaaaacaaataaataataacat

SEQ ID NO: 22722 - DNA, 201 bp, Bos taurus
cttgggacagatatgacccatggcattatagtgtctaacacttaaaatatatataataactgattatttttcatctcagagaatcccatagcttgctgtagggctgtcatcttattctgatatgcaagaatctctagaagaagtatgaactctagacaagaaaatgaaaggtagtttcaaagcagaggactttttaaaaga

SEQ ID NO: 22723 - DNA, 201 bp, Bos taurus
tttaattttcttgtccatatcgtgtggcgtgtgagatcttagtttcctgactagggactgaacatgcaacccttgcattggaagcacagggccttcaccactgcactgccagggaaatccaccctctccacagttacacatcaaagtcccaacccacagcgtgactcatctggagacagggcccttacatgtgtgttgtga

SEQ ID NO: 22724 - DNA, 201 bp, Bos taurus
cgggggagcctggtgggctgccgtctatggggtcgcacagagtcagacacgactgaagcaacttagcagcagcaggcagcttcaagcctatttttctgaatctaagttttccattctatgagcctaatgtagccactgtaaccagctttctctgaagtttaaataaagtgcccagcacagtgactgaaactaaagaagggc

SEQ ID NO: 22725 - DNA, 201 bp, Bos taurus
ggctgtaaaaaaaggccattagagagagtacacagactcaacttcaccgcatctggtgggcaaactcctgtttgagcaaaaggaaggcagaatacccatccgggcccgttttcaactgagagcaactacgtcagctgtcctgaagctccccacgtgaagattatctgtcctttggatccttttgtattattcggggtagat

SEQ ID NO: 22726 - DNA, 201 bp, Bos taurus
gaatctgggaacatctatcctccggtggatttcctctatttataataactcgggttcggcaagattcaagtgttcttctctgaatggcttttaaaggctcagtctctcttagttcgaaatggagatggggaaggaaggagtcggttggggacgtctgagtgtgcgctctgagtggccctttgggggccgacgctgacagcg

SEQ ID NO: 22727 - DNA, 201 bp, Bos taurus
atgccgatatcctctgtctgtggtgaagcctgggaatgtggatgctcccggtactggagatcactaactgatcatctttagaacttttcctaagccagagtctcagtggttttatagttgtctggctaaagtcacttgtgaatttctgaaagtatttttttctatatattctgccacctaggaaatgtcgctccatttaac

SEQ ID NO: 22728 - DNA, 201 bp, Bos taurus
aggccacatcccaaaagccaggaacagggtgggcatgaaggggctttgtggtaggggcaatgacaaaaggtatcagggctgaggagaggcgcaatgcagatgagggcctccgtggtatcctgaaagggtaagtaacagagctggggaatgtgactggccttttgtcatggccactgacagtcgatgtgaccttgacttctg

SEQ ID NO: 22729 - DNA, 201 bp, Bos taurus
ttacgactaaagtttttatcctgttctcagacttcatagtgccctggaaaggatgaagacaggaagcctgagaaactgagtggccacaaaacagtaaggacccagatctactctgaaaacagccctgtggattgcccagttctaagtttcctactaagacctctgtggccatggatagtaagtcagctcaattgtctctct

SEQ ID NO: 22730 - DNA, 201 bp, Bos taurus
catgcagaacgagcaagaaatcagtgttggttgtggaaagtcactgggtttaaggattctttgttactatggcatagctgtacatcctgcctgaaaaagatggtaaggcatgctctattacctttacagggttgggttgaaaaatcaaatacagacatgtaattggaagcttttagtcaatgtgaaacatctagcttcttc

SEQ ID NO: 22731 - DNA, 201 bp, Bos taurus
cacagcgtaggaagtatctttactcctcagaaaccatttggcctgactctaattaatacttcacctaatcttctagtaatgctactaattgttcacaaactggcaatttaatcaacactctactaacaggcaaagttgtgggttttttatcccctctccactttttttttgtgctctgacacagtgtgaacttaggcatgt

SEQ ID NO: 22732 - DNA, 201 bp, Bos taurus
cctcctataaggtaggcagcaatccggtcatggtttcaggcatcaggttaaaacttgaagagtctatagccacaaatggtatgttttctgcatgatttgttggtcttctttgtcacggagtctgaagaggcagacaaaccacttttttatgaggatatctcttccttattgggggctttaaataataacagattccctaat

SEQ ID NO: 22733 - DNA, 201 bp, Bos taurus
ttgagaatctgaggctaaatactagggcataactaggtctcatgacaaatggagtaagaaaagtttgacatcaaggcccacactagtgtagaatccttgcaggacattctaatctgaagagtctattggagaattcagatatgcctgatctacagattgcaggcccattagaagtgggcaaagggttaatgtgaagcatat

SEQ ID NO: 22734 - DNA, 201 bp, Bos taurus
aaacaaagaatatatttcactgaataaaaatagttggggaagtttttgcattaagtcacttagcaaccaaaattgaaggcctagtgtaactcaaatataatggcaaattttagcgtactaaaacagggtaagatatagcaattgggaagaattttcagttgcttctaattacaaagatcttaccaaccaatagaaactttt

SEQ ID NO: 22735 - DNA, 201 bp, Bos taurus
atagatgtaggaacaacgtcatattttggcattcactacaactggtgacactgatagattgatcctgatcattattccttgggaacattgaccaagaaccggcaatgttacaatttcatagattatttgaatttctattgtgcttgatatttttcagaatattttatttgccctatatgagaccattttcaaaaaaaacac

SEQ ID NO: 22736 - DNA, 201 bp, Bos taurus
ataaaaccttggtatcttccattttccaagacatataaaagaaataacacattcctttaaatgtaataactttacctaatggctaaactcttaaattaacggtaatggtaattaggcactgtgtttaaaggaaagcttcctgaagcacgtgctcacccctggtgaccatcgccttctaagtgtcacatagaatggagcaat

SEQ ID NO: 22737 - DNA, 201 bp, Bos taurus
ctggataggaattgggatggtcaggatctcggagccagcgggggagccccacaaagcccaaaagaggcttctgatgaacagggccagttttgcatccctcatctctgatgggacactctgagtcgctacctgctctgtgtgctgtaacaaatgggaggcggggctgcccctggggttgctgtgtgtgctctgctggaacag

SEQ ID NO: 22738 - DNA, 201 bp, Bos taurus
ccatcaccaactcctgaagtttactcaaactcatgtccattgagttagagatatgcattaaatacttcattacgatctacatattcagtaggtgggtttcccaggtggccaagtggtaaagaatccacttgcaatgcaggagactcaagagacacaggcttgatccctgggtcaggaagattcccctggagaagaaaatgg

SEQ ID NO: 22739 - DNA, 201 bp, Bos taurus
ccaacgtatgccagactctaaacattagaagctcaaagaaaataaagacatgctattcactgttcttattgttaggttataccctgttttgcagtaaattctccccaaatgtttaaagagaaactatttttactatgtcttatgatttaatggataaggaaagtgatcagctgagaaattcatttattgcatgtatcagag

SEQ ID NO: 22740 - DNA, 201 bp, Bos taurus
tgtatagtgagaaggaagaacatctgaaagagaactatagagacccccagagagattatccactctgtaggtgttcagtagtttaacccacaacattattgtttttaaatatttgccatgtcaaatcttgaactgtaccactatatgagattaatagtctcaaggcaaataagcctctggttttcagaaagtttgtaccaa

SEQ ID NO: 22741 - DNA, 201 bp, Bos taurus
cattctgcctttttaggttaaaacatttcaagctaactacctagttatacaaatatggcagtactcgttcttaataatcacatatttttgttctttttccggagttatactttcttttacttttcctatgaaaagcccaagatgactgatatatttgacaagcctagaactggtagaattttcaattatggcctgagtgtg

SEQ ID NO: 22742 - DNA, 201 bp, Bos taurus
accattgtcagcatcagtactgttgtaagtaatctagcaataaataatgaaagactaatgctagctaacagctaccaaaagcttaactctgtgcctggtactgccatgtcaagtttataaggatcatctcagttaagcatcacaggatcccttaaaaggaagaggaactatcgttatcctaactttccaaattcagcattc

SEQ ID NO: 22743 - DNA, 201 bp, Bos taurus
ggcatcggtcagaaccctggagtcatgtttctctcttctttgttgtccgaagtgttaattccaagccataagatgtgccaagatcctgttccctccttggagttcccacgtattagataattgccggtctgtcttccccctcaatgcctttcccttcccaccccacccccagagcctctcttaaataaaccagaccggccc

SEQ ID NO: 22744 - DNA, 201 bp, Bos taurus
ataatgctgtaaaggccatgcttgaatatacagcagtattttatttatctgatagccatgatcctaacaatgggtgttcaacaatggctttgtaccaggagtggtggcacacaccagctggttccaggctgctccctgagaaaggtaacagcagcagagaggggtccttgagagcccctttgaaaaacataattcctcgtg

SEQ ID NO: 22745 - DNA, 201 bp, Bos taurus
ctgggcacggagcgggcagctggagtgtggctttcaaacctcggtccctcctgccaaacactcagagagaacagagcagggaaaacatagagcagaggcccgagcagatgtgagctcagaagccagctgtcgtctttgctgggatggggaagcagcgaggaggaggggaccggcttccggcgtccacggcctcaagcctgg

SEQ ID NO: 22746 - DNA, 201 bp, Bos taurus
ccttctttctgtctcaactatccattgtcttccagccacagtgcagtggagagatgaatgtaatctggggaaaaaatagaatcttgccacatgtcctatgaaaaacagtcttcccatgaaggagaggctcacaaagctcactgtatccctccagccagaaaatccccttttggcataacttcaggtcacatcccaatagtc

SEQ ID NO: 22747 - DNA, 201 bp, Bos taurus
gaattcctgccatgtgccatgcactctgtccccgtgcatgcaagtaaaaccaataaaaataggaaccagacctgtccctggccagcccacgaccagtagtcgcactgggttagcctgggcgcgttcttggcttcagctaagaatggaagtcacttggccttgctcagtcctgcagccagaaactcacccttgacctcacag

SEQ ID NO: 22748 - DNA, 201 bp, Bos taurus
tgaagtctttatggcgctgtccgtggtacccagccctggtctcaccattgaaggaaagtttttacctaatgacatcccagtgattaaaaacatcaccttgtagagaagaaatgactattcttgtagctattataagtgaaataaaaataattatggctgatttgcattgttgtacgacaaaaccaaacacagcattgtaaa

SEQ ID NO: 22749 - DNA, 201 bp, Bos taurus
cagtcatgcagcgttccccacttaaaagggcctcgctcttggtttaatgctctgctgttgtcattttgaggcttttaatcatttttttgtttttttaacaagagactgcattttcacttgacactgggctttgtgccttatgcagctggtcctggtggataaagtggggctctgtggcttactaaccttgagatattggac

SEQ ID NO: 22750 - DNA, 201 bp, Bos taurus
aaccgaatctgtgccaggccacatctgcccctccacccccactcctggtgaaaaggcgaacagacagaaagcagcttgctggaggctctggagagctgggtgctcgccaggaggtgggaatgccagtccttcctgatgcctcctcagttagggtgttgccatcctactgacacttgtcctctgccacctgtagcttaaaag

SEQ ID NO: 22751 - DNA, 201 bp, Bos taurus
cgattagctcatttttaagcttaaaacaggccttttaagtaaaggtttttttttttttttaatatcagagtgttagttcaaaaatactacatatttaaacattggccttctctctgtcatgccagctttattttctgaagaaaattcaatttatttcttttttccagtttggtagccaaagggttaaagatggggaccact

SEQ ID NO: 22752 - DNA, 201 bp, Bos taurus
tgcaacctgtttttgatagtgtttgctataggtcagaattggtagcctttcctgtaaacagtcaaatggtaaatgttttaggctttccaggccacgcagcatctgttgcaactgtggcgccactggaaagtgctgcagacagtatttagatgaatgggcatcgctttgtcccagtcagccattattaacagaaaaaggggg

SEQ ID NO: 22753 - DNA, 201 bp, Bos taurus
gacatttgcacttcagcgacccctgggtaacaggaagttactaaatgctttttttttccgagtagcggggacatgattggacttgcattttaaagattaaccaggcccctgggcttccaaggtgacacagcggtaaagaacccacctgccaatccaggagacgcaggttcgatccctgggttgggatgatcccctggagaa

SEQ ID NO: 22754 - DNA, 201 bp, Bos taurus
gtcttcctcttcacttatccccttctctgtcagcctgaaagtagacataagagaagccgaacacttttctgagtcacaagttggaaggcccactgaaggatggcagagcaccgagagagaaggagcctggatccctgatgaccaaggagccacctcaccagccccaggtcaccttctggccttttaagtgagagaaacaaa

SEQ ID NO: 22755 - DNA, 201 bp, Bos taurus
gagagcagcgccctcagggggcaggggacagggccggctcagtcctactcaatcaacaccccccctcccctgcaccgcctcccctttgtgtctttttacatgacagtcaatagaggccgggcctcgagggtattatcagagccccgatcgcgacctctaacattataatccacgaggctgcggggagcatcagtacatcct

SEQ ID NO: 22756 - DNA, 201 bp, Bos taurus
tcctgtttgattttggttttcaaaagcagaacaatttttacatcattatataaaggccttccactatttaaaatgtcggtgctaaattaattttatacccacaaggcacactgcatctgaccacactggattctatccacttaataacatgagagaagatcttggacaagaatttagtgaaaggaacagtaaaaacaaaaa

SEQ ID NO: 22757 - DNA, 201 bp, Bos taurus
aatcttaacaccaaggatctagaaatccgatttgtacagaaccgtgaggcaaaatgaagtcaggttcctgcagaagacaaagtattttcttagaaacatatcattttggtactggcctttcctaaccttaagtctgaccttggcatacaaaggcaacccacggcaagtttccccaaataatccaggagtcctcaaatatta

SEQ ID NO: 22758 - DNA, 201 bp, Bos taurus
ctgccgagacgcgcattcacctgtggtctctgtccctcaggtgacccgttctctgctgtgctcactgcgaagcttttgggcttactggccttatatctcatactcttctttgggatggctgctcccaaatgacatcttctaactgtgttggagaagactcttgagagtccctaggacagcaaggagatccaaccagtccat

SEQ ID NO: 22759 - DNA, 201 bp, Bos taurus
agcggcctgccgggcggtgggcacaggagaaagaggccgtgttcctgctccgcgcagggcagccccgctcagagacaaacaggcccatcacctgccccggtgaccgcagaagaacctttgacacctcatctgatatttgcatgtcccaccacgcaacactaccccgatgtgaagtaattgactcaacaaggccgaactgca

SEQ ID NO: 22760 - DNA, 201 bp, Bos taurus
ggcgatactcttgtccctgacatccccctggggccctcggggcccttcaccaaaagtaccccgaccagaagccgcgctttcacaggacactcactctaacggcactgctgaaaggcccggccatccgctcttccctagaagcccgcggccttctcactgccttctgaagtcctgctcaggcctcccgccggctctcaggag

SEQ ID NO: 22761 - DNA, 201 bp, Bos taurus
ttcatcagcgctccagtcattaaaccatcaggagcagggagaggacttcacactcgtttaaaaaaaaaaaaagagcatgctagtatgtagtgacctaagcatggaaatcacacatttaaaaatagctctcaaaagcatttatagaatgaagtctctaaaacctgcctaggaagtagaaatgattattattataacctcacc

SEQ ID NO: 22762 - DNA, 201 bp, Bos taurus
ctttcactttcactttcattcctattttgaagaggagaaaattgaggtttccagggatacatgtccaaagtcattcaggtaattacaggcagtcagaatctgaatccaaatctacaggacgccaatgcccatctttccagatatcagattagtatttctcgaagagtctggaaaattcaatcaagagaaactctgttccca

SEQ ID NO: 22763 - DNA, 201 bp, Bos taurus
tttacaaaacctattttgaaacaaatttctaggaatcttcggaaagatggaatgaggtgaaatgcttcccacactcccttgttcctatgtgaactctgagccccatgcaagcaccattttcccactccaggtgtagacttcaattaaactgtaggaaacaaaaagatttgctttactgcgaagcctgtcccctttccattt

SEQ ID NO: 22764 - DNA, 201 bp, Bos taurus
cagggctcgtgtcccctaagaggccagatggcagatgctgagctgctctcaggacgagatgctctcaggacagactgatccagagagactgagcttaaggcaaacatggccacacccccactccctgcatgaaggtacaatcaatgaaaaaactttgcacccaaagaaatcatttcgtcatcaaccagctacaaagtggta

SEQ ID NO: 22765 - DNA, 201 bp, Bos taurus
aaggtcagaggtgtgaggcctcgtatcaaggccacagacacggagccccacgccaaggtcatctccagatcggactgagctccatagcaactgttgccataagcccccttgatccaaactggccagctccctgaccttaaccaatcacctgatgccacccttccagctggaatcttctttgtctcgaggctataaaggttg

SEQ ID NO: 22766 - DNA, 201 bp, Bos taurus
ttttccccatttgaattgtctctacttgcttttaaattaaggaaatatcatcattatgggacattatcttttgaaataacagagtttatctccaagcttttctttgtatagtctattatgtcctttgaagaatacagatgtagaagaaaatgattttttaaaaaatctgactcattcaaaattgcttactttctcctttta

SEQ ID NO: 22767 - DNA, 201 bp, Bos taurus
agaggacgtgtcccttctcgtccctgcgcctggcgcagagaaggtgctagatgccatgagacggtcacctgaggcaggatggtcaccttgctccagaagcacccagaaaggcagcagtcagggagctgggctggagttaacgggatgaagagggggaagggggtccccggcctcaggcagtctcttctccgcactgagcgt

SEQ ID NO: 22768 - DNA, 201 bp, Bos taurus
gaccccgcaaaccactccctcaccccaagccctggttctccagggagaggagcctggtgcctgggaaacaagctgggcaagctggtgctggcctcctgggtagcgcgggctcccctgccttcgtgaatcggctctttcatgtggaaattgcatgagggctaacaggacagaggtcctgcgaacccacacgattcctgcccc

SEQ ID NO: 22769 - DNA, 201 bp, Bos taurus
tgggccccggggtctccagcccacggcccgggggccgggccccaccccgctccggctaacaccgtttcagccccgctgcccttttggtctcacctgtctcggggtcgctgaagtctggcaaagtaattgtattaagctgtcgtctgtcagcaatggttctatctaagaggctgctcccacgtccagaatcactgcaaaaca

SEQ ID NO: 22770 - DNA, 201 bp, Bos taurus
cccagctggctctatgacgaggctgtgctgggcacttgggagttccacacgtctatgtgtgtgatttgtaaagaacaaagttcttgaaatgttttgtgctcgagtctttcctgtttagcatgatacaaagagtcctttaggcttgggttttctctcctataagctgttaaaaatgtcagaactccactatgtattttattg

SEQ ID NO: 22771 - DNA, 201 bp, Bos taurus
cggatggggatggtgtataaaggctgggttttgtttttgggctgcgctgcaccgcagagttgcccaaccaggtatcaaatccatatgtaaaggctctttttaatccagctctttctacctatgtaaatttgcatagtttctcctccaaatagtcagcttgctcttgagcaggagggattattgcataacctaagaacatgt

SEQ ID NO: 22772 - DNA, 201 bp, Bos taurus
atgacttctggcttgattgattaggcagataacttgtgatcaagaatagagtaggggcttccctggtggaccagtggtaaagactgtgtttccaatgcagcgggtgtgggtttgatcccacgtgtcacacagtgcggcagaaaaaaaccaagaatagagtagcaaaaatacaaaaggaatagggctgagataggaaagggg

SEQ ID NO: 22773 - DNA, 201 bp, Bos taurus
taaataaaataatttcagttaccctccatcttaaacacagtgttctgtgtaaatattaaaagatatgatatcctagagaatatttactataaaacaaatacggtttgtagttttgtttttagatttcaacggaataccattgagttggtttgttgtgtccctgctgcgtttcaggttgtcttgtgtgggagtaaaacagtg

SEQ ID NO: 22774 - DNA, 201 bp, Bos taurus
gtgtggggagtgctcgcagtgtctgggccacactgggtttgcccccgctcacggcgcgtgtgcttttctggtctacgctgatcaggctccaggttgtgcaggggaagtctaaagcaggccctgggttgtgtgcactccccaggtctaagctgctcagcttcaggttctcgggtactccacaaaggcacagactctgttggg

SEQ ID NO: 22775 - DNA, 201 bp, Bos taurus
tagggccaaaaaaaccatttccatcattcgtactactcatgagagataacactatcaaaaggccatgtttgtagatttccagaagtttgctctcgtaagagaatataaaaaagaagtaattgaaaaatgcacttttctgtgtcttcactgctttttaaaaaagtgtttttaaaatagattttcttagggaatagatcagat

SEQ ID NO: 22776 - DNA, 201 bp, Bos taurus
ggtttttgatgaatgcatgtccacaaagatagactgtacacttaaaaaaaattacttacttactcacctttggcggtgctgggtcttcttcgcttctagcgggcctcccctagctgcggtgtcgtgcttctccttgtcgtggcttctctggttgcgtagccccggctctaggctcagtagccgcagcactcaggctcagtg

SEQ ID NO: 22777 - DNA, 201 bp, Bos taurus
accagagactggatggggtgggggacctctgagagcaacaggctgcctggccattagcccggctccactcccatctgccatccccaggcgctggccgtgtggggtttctggggagagggaagtgggcaagtgaagtgatgtgggaaagtgggtggcgcagaattgcagcactagctcccaggtcctgagaaaagcagatcc

SEQ ID NO: 22778 - DNA, 201 bp, Bos taurus
catggaatcttaaccactggacagccagggaagtcccagagctcttgaatttttgagtctagtttttctacctcttctggctcttgtttggccactagccatcttaactgcctgcctctggagaccaaatatcctcactggtgtgtgacacggcaggaaaccaggaatcacatgcaggagtcagccaccaggagcaggctc

SEQ ID NO: 22779 - DNA, 201 bp, Bos taurus
ccaggaggagtctgtcctcagtggaggacagaggagcctggtgtgctgcagtccatggggtctcaaagagtcagacatgacttagtgactgaacaacaacaaattccaggaggggctcagggaagaaggtgagttagggcacatgacaacaggtgatgggaggcaaagatgtgagaggtgagtggtgggatgagggaggag

SEQ ID NO: 22780 - DNA, 201 bp, Bos taurus
agcctaaatccaaaggcagggcccctgagaccacagcccgaagcacgtggaatcaggactgtccctgcagcctcagattcggtggtctcagcgcttacaggggcctgggctctctccacccttgactgtctttagttcaacgtgaaattcacacattcttggtgttacagttctatgacttggtggttgttgttgtttctt

SEQ ID NO: 22781 - DNA, 201 bp, Bos taurus
tcgaaactatccccctgcttgtcctgggtcagaaccaccagagagacaccatgacagccaggaagacggatcattcattcactccctcacttatccacacgcttggtcattcacacattgactcactacttgttcatcaaacatgtacactgcaggccataaggatagaaagatgattaagattgctccttccttgaaaag

SEQ ID NO: 22782 - DNA, 201 bp, Bos taurus
cacctgggaagaaaaagggacactatctaagtctatattgggagggtgatgtcataatgggtcccccagaaagaacaagcctactgacaaaggggccacaagggcagagcacctcataagtaaactgagtcacaaagccttagcaccactcctagtgttcaccatgggagtagcctcagaggccagacgtctcagttggta

SEQ ID NO: 22783 - DNA, 201 bp, Bos taurus
tcctctacagaattaccctcttggagagtagcatatcatctctgagaagttctctcaccaacagcagggaacatgtagcctggatctccacaagaaccctgagtcccaccagccccagcacggacctacaaaggcctcaggcatgtgccgagtgctcgctgactctgagtggacagtgtctccaggccctccactctgagt

SEQ ID NO: 22784 - DNA, 201 bp, Bos taurus
tcaaaattagcagggcctgtttctttccaggcaggaagtcaatgcctccttatagagatcacagcctcacggacagacaacagacttatagggagtgaaaaccacccaggacctccgggatcctttgaaaaggggcattgatcaaaccacctaagtccccaaaggctctcttttatgtgattcaaatatcacttatcagtg

SEQ ID NO: 22785 - DNA, 201 bp, Bos taurus
ggccccagttggctccccaagttttagggctctgaaaaacctccatctggactcgagatgagaacggcttctagaaaacgcacccaggacgcacctgttcagcgagggcctccatgggggtgatgtagacacagcggccctccgagttctgcagcagcatccgcaggatggcaaactccgcacagatggtcttcccgctgc

SEQ ID NO: 22786 - DNA, 201 bp, Bos taurus
tatcttttaaagcctgaggccctgagcagcatccaaccactcttcagtaaattcctaaaacatggattcattaggccctgccaggccctttgctacagccctcgtcttccaatttagaaacctaacagggagtatccgtttatgcaagacttacgagcagtaaatgaggccatcatccctattcacccactggtgccaaac

SEQ ID NO: 22787 - DNA, 201 bp, Bos taurus
taaccacaaccttcaaacaggctacagatccagaatttggggacaaggtcataagaatggtgacctctgagactgaagccagtaagtatcatcaaataatgaaatcagctgtgtgcaatagtgacgtacctgaagatgtaagcctgttgctaatgagagaaggacgcctccaaaatctcatcagacactaaaaaacaaata

SEQ ID NO: 22788 - DNA, 201 bp, Bos taurus
ccaagtatcctgctctcccccatgagagcccaccctgggctgtttccccaggcgatgaagacctcctggccataacagctcaagaggtggccaagcagaagctgatgtttcccagcgccacagtgcacaaggctctgtccccaaagcctcagcacttccaggtgaggcccttcactgagtctcaggagagcagaagaagca

SEQ ID NO: 22789 - DNA, 201 bp, Bos taurus
gcccgggagattgtgaagtgcccccaaggctggcacgtgaagcaaacctgggctgtggagctgaaccatgcagtggacaatgagggtcagtcctctggactctggctgagggcggaagggcctggagctgaaaaccgccaagctctcgggtggagtgggcctatgtccctggggtccccagccttcagagagtggggccac

SEQ ID NO: 22790 - DNA, 201 bp, Bos taurus
gagaaggccaggacctgaacatattattgaccagagacgtattcatatgtctgttgatacccgacctttatgagctgcaaaagtttcaatattcacttattagaaactaaggccacaggaactagtttctgcaaaaatcctctagtcagtaatcaaagtgtctgcaaggcccaaagtgcccctactgttccccggagcctg

SEQ ID NO: 22791 - DNA, 201 bp, Bos taurus
atgtcttttgctttttttttttggccgcgccctgccaggcttgcagcatcttagtctccccgccagggctagaacccaggtgcctggcagtggaagggccagggaaattcccctctcagtgttttacacacaggactggggagaacagtttgtttttcctgcgtgatggagggggaaactgaggtgctgaccagttttgag

SEQ ID NO: 22792 - DNA, 201 bp, Bos taurus
tctaggggtggcctggatctggtggaggaaggaggaggagagagtcaggaagaactggggtaccagaagggctgtggggctttcatgggtggtgtcctacaggagaaggaagcagacgtggcctgtgaccatcctgagggaaagaggtctctctccagagcgccagctgagtggccgtggacgtgtgtattcaggggcccc

SEQ ID NO: 22793 - DNA, 201 bp, Bos taurus
aaatatcccgccatgagtggccagctgtctccccccacccacttgtggccatgggtggcaagacgttgccatggagaaccaggcgtccccagtgtatagccgagtgttgccccctgagtggccaagtatccagctgggggtggctgagtgttaggctatgtagggctgaaaatccaccacaggcagtccagtattcccctg

SEQ ID NO: 22794 - DNA, 201 bp, Bos taurus
agtctctaagtcatcacaagagcctatgttccctctgcaaacgccatctccgccatcaacaataagtttgaatgttcaattatgtacctttaaaaataccatgaatcccttccatggttttttccttttttttttcttcaattttagtgtaaagcatattataaacgattagattcagaaacaactttaccaatattattc

SEQ ID NO: 22795 - DNA, 201 bp, Bos taurus
aaagcagtgctgagaaaaaaaaaagaagacaagaaatcaatgaaatctagtaatgtcagcaaaaattactgtagagtaaggatgggaaaaactccatagatcagaaagaaagaaaaatggcaaacttttcaaaataaatgtttttcagaatttcagaaactaaccagacttttagcaatccagaagtagtgtttatttttt

SEQ ID NO: 22796 - DNA, 201 bp, Bos taurus
attttcagcacctaaatgataacggttgtagctttcttgagtatgacagctttttggatggagagagagaagcatagaggagtgggccagatcgcctgaatagggaaattttgggaactcacttatgttcactaagattttagtgatgagagcaaatgttagtaagttcttttggccacaaagagcgttcatttcacttcc

SEQ ID NO: 22797 - DNA, 201 bp, Bos taurus
tacaatcttatgagatagatgctgctattatcttcatttaaggctaaataacttgcccaaggccacgctagaactaacgaagccgagattcaaaaccgagctcctcattaagaatactgatgtcctcctctaggaggagaggaaaacataggcaaaacactctccgacatacatcacagcaggatcctctatgacccacct

SEQ ID NO: 22798 - DNA, 201 bp, Bos taurus
tattacttggcctcctgtgtttctggcacacaaacttgctgcattcagtaatagattcagaaggtctcagcagcttagtgtattgcctatgcgatgtctgtggttccaaggcttggggcgggggccccgggggtggtggggggttccatcaatgggggactctgctggccagagcctgccactccttcctcagctgctctg

SEQ ID NO: 22799 - DNA, 201 bp, Bos taurus
taactcactggaaggttcagagtgggcaggtgaatgcaatggtgcaggatgggagcagagtagtcagggaggcttcctggtggaagaagaccttgaatttccaaggccaagtcctattagcaaagcaaaatgtatgcagaaatgggtcttagatctcctacgggttgggcccaatgagattatgggcacaggggtgtggca

SEQ ID NO: 22800 - DNA, 201 bp, Bos taurus
aagatggcgatgtcttcccacagatacacttctaggataccttcttctcttatgttgtgatgcttagggaatgcatagtaccgtatttactaacaaacttggctcccttttctcttgataatgttcactctacactgaaactgtggtcccattccttgccatactgaaaatgtaattaatctttataagattaaaaagtga

SEQ ID NO: 22801 - DNA, 201 bp, Bos taurus
agaccccatggtggcttccctccttaggaagcagatggcctcgggaggtttgagctctggtgatgacactgaagtcttcaccacacacaggtcttgaacggtggtctgttttctgtcctgctggccagtttaagaagtcatggccaaatacaattagagggaagatcctggccaccgccctcctgcaaagtccagggtgtc

SEQ ID NO: 22802 - DNA, 201 bp, Bos taurus
acttttttttaatgctatgaaaataatcatttcatctgagtttaagtcttttcttttttccttttttactgctatcatttcttgtgcttgtttttttccccagtgagggttgtcgaagagaaaatacaatgaagaatgttggaagtcgcaaatatgcgtttaattccctgcagctgaaggctttccccaagcattacaggc

SEQ ID NO: 22803 - DNA, 201 bp, Bos taurus
tagaaacttatttctaatggtccaatgaataaaacagaatgttagaggcaacctcctatgaaaaataaatgttgcaaatgtcagagaattttaacagataccagctgtaaaacagtcacttggatgaaaagaagaaattttaagcagtagatcaaaaagaacataaaattaaaaagactgaattttaaatcacttgaaggt

SEQ ID NO: 22804 - DNA, 201 bp, Bos taurus
taaaagaagaatgatttgccctaaaatgatcacacttctagactagattccctcatctcagaggaaaaaactctagctggccttataatcagaagatgctcataaaacatgcttaagtttacaacatgtctaccaggaggacaatcaagaatcctagggaaaataccagcatggaaaaaactaacaccatgaacaaagggt

SEQ ID NO: 22805 - DNA, 201 bp, Bos taurus
gcgcagttcctccttcaggatctaatgggcaggtagaggaaggggaactccatttgcagccttcaaagggatgtcgaacccttcagtgacagggccagcataggaccagaacagctcagaacggaatgagtgaactgcatggtcagaggacaaagggtgaatcaggggtcagggcgacctcaacaccgtcagcaaggaggg

SEQ ID NO: 22806 - DNA, 201 bp, Bos taurus
tgcatcattgactttcctgagttcattactcattcatgaatgactctgaagggtaagtctatgagtcaaaacaagttttctgccagaaataatcattttctaggttctcttcaagcaatgacatcttttctgtctttattataggaagctgctgcttgggagcctaatcagtagacttgcaggtttcagtgtacactagat

SEQ ID NO: 22807 - DNA, 201 bp, Bos taurus
ccagcacttgtaggggaacttccttgctgggacacgctacctatgtgagctctccgagcctgggttctgcatctacaaaaagggagattctaatgctgtcgatgttctcgagttgctatgaagattcaaagaactgactcatctacagggtgatcctgtgttcagtttatgccagctgtgcctgcatcactgttatatatt

SEQ ID NO: 22808 - DNA, 201 bp, Bos taurus
gtcccttctctatcctgctgttaccaaggtctcctgaatgaaaagcaaaggaagatccaatgtccccttattaccgtctctcctctgctccccaagcacctgcctgttctatcatgtatcaaaccattttatctcttttaaagaggctgcaaagcaacactgctgaatttgtgtccaaggacagagtcagctcagtgcatt

SEQ ID NO: 22809 - DNA, 201 bp, Bos taurus
catccctcgcgggccttaaaccagctgacggcagatggtggccgggatgagcccaagggccaactgtgcacagcagtgggccccagaccgtgggtgtgggcggacagaccacgcggggtccctggcttgaactctgagtcctagggatgatcggccagggaagacaccgtcctggctgcctgggtcttcacttcctgcgcg

SEQ ID NO: 22810 - DNA, 201 bp, Bos taurus
ttggcttcaggggtgttcaggttcccacatccacgtgaagccccttcctctgactgtatccctggccagtctcatccaaggacagagccacctgaggccaggagtcagccagccgtgctctcctcagcaggttttacatgagacctagcacctcccctttcaggctgccctctgctcccagtcacccccggggcagactgg

SEQ ID NO: 22811 - DNA, 201 bp, Bos taurus
gcaacccgagcttcatcagggaaagtgaacccgggagctttgcctgaatttggctccacaaccaactacattcactgaacatgaacctgaacatgactcaggactgacacgttcttcgggagcatgacagacagcattcagcaccatcaatgccccacagaacccggaatcaaacaaaaggcccaagagttatgccttctg

SEQ ID NO: 22812 - DNA, 201 bp, Bos taurus
ttctgtaagactgtttgggtcactaacataatgcgtctagctctctttcctaggtgtcttttagggtttagaattacagcccttcccacacccccagagccggccttcctgcctgtagacatgttggtgggttgctccataatgatgcccaggtagctggtgccccacgggcttgccttcccttccctccactctcctctt

SEQ ID NO: 22813 - DNA, 201 bp, Bos taurus
taaacacaatgacgggattcttggatttagaagagaaaagggcttctcttttactttgttggccctccttttcactgggttaaagaacctaagccccctttcaacacaacggtttctttctgtttagatcgacactgtaccggcaggagtatttaaatatttgcaacaaattggaatgaattatccagaaacatccaacta

SEQ ID NO: 22814 - DNA, 201 bp, Bos taurus
aggaacgtccatgtggatgatcccaggagtaacactgactgtcaaaacagtccctgtccttggggatcttgcacctcggtacaggctgggaggttagaaatcactagtaaggacacaggcaagtgtgaggaagtcccccgggccctggggactcacgggagtgtggggaggtcatatttcactagagcgctttgtggaggg

SEQ ID NO: 22815 - DNA, 201 bp, Bos taurus
atgtttctccttcttgctggggtgaaaattctgtagtcaattatgcatgatgtagaggaagatgttgagaattatgaattatttgaactctaaggtcctataattcattctgtgcgagtgacactaaagatgattgattctaaatatccatataacacagtgtcagaaaatcaaggggtcctcccatgactgatgcatcac

SEQ ID NO: 22816 - DNA, 201 bp, Bos taurus
ctccacatggactttcctccctttccccttctccttctgaaagtccacttctccaggatgcctttcacaggcgcctctgccctaaaggtctcttcccctacccttggtgttgctcagtcgcttctttgtgtccgactcttttgtgaccccatggattgtagcccccaggctcctctgtccttgggatttcccaggcaagaa

SEQ ID NO: 22817 - DNA, 201 bp, Bos taurus
taggacctcagcaacatcctctgcactcttctgcatggccacattgccctgcctctgtcaggaaaggctgtctctcaacctctgaatctcagctggtttgctaactgctttggccaacaaaatatggcagaaggatgttgtcccagctctggtcttgtgtggcagcttcttcttcctgcctcttagagctcatcacaaagg

SEQ ID NO: 22818 - DNA, 201 bp, Bos taurus
agaagtaggatggagacgtctgggcagacatgaagaggctgagagttttgaactagccaaattccccttaatcttttagtagtggaaacaagacctcacatcctcccaaaaacctttccctgaagcttttcgataactgtggctgagcaactgtatcacaagaccctcggccatcagccctcatcacctctagatgctaaa

SEQ ID NO: 22819 - DNA, 201 bp, Bos taurus
tccttctccccatctttggcttggttgtgtctactggcttaacacccaccaagagacaaacacagttttcagcaaataccaatgaatggagtaaggatgatctacctaacccctctctctcttccctcctgccagcctctcccattggctgaatctcactgggaattaagtggacagggtgccaggtgacaggttctgcac

SEQ ID NO: 22820 - DNA, 201 bp, Bos taurus
gtgagtgtccaggagtctctggcggaagcgtgggtcggtggtggcctgctgcagggctaggggcactgagtgtagcagtgtgcgcatggaacagtttaaggaggtccccatagcttcatggcctccaccaaggtttggctccaggtaaaataatggggagggaatacagccccacccttcaacagaaaattggattgaaga

SEQ ID NO: 22821 - DNA, 201 bp, Bos taurus
gagagtcagtgccaatggagcactggggctggggggccaaggtcaaaaaaggatggggcgtggggatggaaactctccaagagtggatggctgagtgtgaggtgtgaggggacaacgtttcaacaacagaggcagcctgcaccgaggtagaggggcagatgtgccttgcgcagctttggaaacagggtggactgggttcct

SEQ ID NO: 22822 - DNA, 201 bp, Bos taurus
atgtgccattcacagtagggtttgcattcttatgagaccctaatgccactgctgatctgacaggaggcagagctaaggcagtaatgtgatctatggccagtggctgtaaatacagatgaaactttgcttgcttacctgccactcacctcctgctctgcagcctggttcctgacaggccatggatggataccagtccatagc

SEQ ID NO: 22823 - DNA, 201 bp, Bos taurus
gaatcatcaacttttaatgattctgctgaaactggcctccttggaggcggctaacagggaacgtgtgtctactttgagattcccagcccgtccccaaggcagctcaggtttttacctggcccctatatcagatctggccattggacaccttggattgatttcacttggggccctgagcggaggaagcaatcagaacagctt

SEQ ID NO: 22824 - DNA, 201 bp, Bos taurus
gaaaagtttcaatcatgtactatatttcctcttcaataatactagctttgttgttgatatttaataggcagtattttttgtcatttaaacaaataggaaatctcatcctctcccttcattttaaatgaatacaattctacagagttctctgtacgagtggatgattcttttctcaatgtagtctcttggacatgaaattgt

SEQ ID NO: 22825 - DNA, 201 bp, Bos taurus
ccattccttcctccaggggatcttctcgacccaggaatcgaatctctatctcttatgtctcccgtattggcaggtgggttctttaccactagcaccactgtggaagcccttcccaagtgtgaaccaggttctgaaccacaagcaaatcttttacctctttgtctgtgctgcctctggcattccattagatgcgccgtcttc

SEQ ID NO: 22826 - DNA, 201 bp, Bos taurus
cagagccctgcacctcgcagtgggtcagctcggggtcgtgttggcctctctctctcctgcactgtattttctgggaagggcttgtatctcccagtttatccgtggaaagtctattgaggtggggccagcgtggtggacttgctgggcagctctcaagggacttgaaggatgggcatctatcggaaggtggcttgtgaaggt

SEQ ID NO: 22827 - DNA, 201 bp, Bos taurus
gagaggcagacgcaggtttacttctggccgggtggcgtggtcagacccctggggccagccagagtccctggggaagcaggtctgtcccaggtgtttcttgtataggagggctgctgtccaagggatgtgcaggggtcagagaatggggaccctggagcagccagagacccggagcagggaaaggcaagcagagcaggagcg

SEQ ID NO: 22828 - DNA, 201 bp, Bos taurus
gttaatgagttaaatttaaaaatcaaattgcagaaaaattggcatgactcactcctttacctattcaagtctttgttcaaatgtgatcttcccaaaggcccttatagttcagttcagttcagtagctcagtcgtgtccaactctttgcaaccccatgaatcccagcacgccaggcctccctgtccatcaccaactcccaga

SEQ ID NO: 22829 - DNA, 201 bp, Bos taurus
actcagggccagtgggtcccagacccactcagtcactgcttctctggcttacctcccagtgagtctcactttgttcgtctgtctctgttggctgctcatgcctgcatccctgctcaacctggatggcccctccttggctgcctgctctccctgcctcctcactcatttcccatttatattccacgtaggtgccaaaatttc

SEQ ID NO: 22830 - DNA, 201 bp, Bos taurus
ggcttggtgaggtgaaaggagctgtgtcccctgtccttgggggtgggtcccatgtcacctgggcgaacctcaggggacagaagccggcctggaggtcggggtgatgttaacacaaggtcatgtgcccggtgcacagcgaggtcaaacaaactgaaacatcggaggcggggccagaggaaggtttctttcggggccatgcga

SEQ ID NO: 22831 - DNA, 201 bp, Bos taurus
gcaggcattggaagatttctgcttaacttggcagaattcatggctgctcagtatcttggatttagttatttattggaagcccttgcctttcatgtgttgtcttgctaagttattataaactactatacttttacactggatggtatcatagtagttagaggccaaaattgcttagttctgtatagaaaatgggcttaaagg

SEQ ID NO: 22832 - DNA, 201 bp, Bos taurus
tctttgcaactcccacgaaaggcttttacctttaaaaaacccctcaaatgtccacccagagctgcacgcacacacccacggttgatggtgtggccactagcgccagctagtggagcaagcaaaagcgtagacgtgcaaagtgtgagttaattttaaacttgggggccaaaggcagttttgtatgggcttccctggtggctc

SEQ ID NO: 22833 - DNA, 201 bp, Bos taurus
ggaaatcccatggatggaggatcctggtgggttatagtccatggggtcacaagagtcaaacacgacttagcaactaaaccaccacccatcctcagttgaacctcatggccaatttcatagcagaaaaagagaagcagctgctatgtccaggctctgtatgggggtcacttgtgcatttactattcgatccaattcctagat

SEQ ID NO: 22834 - DNA, 201 bp, Bos taurus
accccccacccccacccccggctcctctgtctatgggattctccaggcaagaatactggaatagattgccatttcctcctccagggaatcttcctgactcggggatcaaacctggagtttgaagtcattacagctcccatgggcaggaaggtcccagaatcgtagatctgaccttcatcatcctggttctggggtgacatt

SEQ ID NO: 22835 - DNA, 201 bp, Bos taurus
tgcagttgcaaaagtcagacatgtgtgagcaactgagcctgcacccatggctaaaaagaacagtgaggagaaatagaataaaagtttcccctggcccctcccaacctcatcttcattacagtcttagttgcgtcttaagactgacttttggaattgagctgttgacaggtggcagacagggtggccctagtggtgcatgag

SEQ ID NO: 22836 - DNA, 201 bp, Bos taurus
atatgggaagaagtttaggtttttataagttgccaaaccagaatagtgatgatgaaatctgccattaattttgcattgtcaaaatacttgatgatgtatatgaacgtctcaacattctgggatgaccactgctctgatttttgtgcacaaatacaagacaactgaaggtatgcacaacaaccagttttcctcgtctctcag

SEQ ID NO: 22837 - DNA, 201 bp, Bos taurus
gagcaattttcactttcatgaaacaaacaaacaaacaaaatttagctaaagccatctttacttgagctctgtgctaaaagatgattcagcattttggccacgattgataacttgttctcaaggaggcttcctccctttgcaagatgctcttctagcaccgggagcatgagagacggcccactgtccctcatcccatccctt

SEQ ID NO: 22838 - DNA, 201 bp, Bos taurus
cgtacagggacagcccagagatccagcagaactaatgtcatcactgagaaaggcacttaacccagactgtgcggcttttatgatgtggaatcaggaaagtgccaccactttcatcatacaaccagggaccaggatccaaaggtaataggacatgacagaaccttggcacctgccttccactgccagctccgtggctggagt

SEQ ID NO: 22839 - DNA, 201 bp, Bos taurus
ttacacttgcagctgctcaggtggatctaggaggtgggaagaggcacttctctgtggagtggacacgtgatagaaggattagcagaaagaccccctctcacgtgccctgctggggccatcagtgccacggctgcagcgcagaataaagccaggatcaacgccacctgtgccaacctgccgctcttcaccaggtgtggtcgg

SEQ ID NO: 22840 - DNA, 201 bp, Bos taurus
tcctcgctcgtggccgtttaagagaatgttcttcaggagccttgagtaaaagagaaatccccaaacttaatgaatgaaggtaccaaaatttacatcaatcagtgttatatgatgtgtgttggacagtaatatatatgtttcaaagtaataattttgtatatattttaaataaagtattattgttctttccgtgtagaagcc

SEQ ID NO: 22841 - DNA, 201 bp, Bos taurus
tgagggttgagcacagcaagagaagtctgttaagagccaaggccaagagacaatctgtgaacatgtgaaacccctgggttcacccactttaagcacccctgtttacacagaaagataccaaggccttctctcctgtaaccactgtctactagggagtatgggcttgcagtttcaggtgctaatacaggtgaacagcagaac

SEQ ID NO: 22842 - DNA, 201 bp, Bos taurus
gtatgattccacttatctaaaatacttagaatagacaaattcaaagagacagaaaatctagctcagacaaacccctttcacatagaaactgcaaatgctcaatccaatatccaaatttaaatgaatgtaggtcaaatgattgaaatttaatcattagaaaagatgaaaataaacatttcttccatcttgacatcttggaga

SEQ ID NO: 22843 - DNA, 201 bp, Bos taurus
acctctacccacactaatataaaactgcaaggcaaaaaccaccctccatacagacacatacacaagttccaaagagccttctcatccccgcactcgacaacagaagaaaaattacaaggcgtttgaagaatgcctgtctagtaaaaggaaagtaaaaagaagaacttggggaaagaacatgtaaggaaacaacaaaacaaa

SEQ ID NO: 22844 - DNA, 201 bp, Bos taurus
gcagcagggtgagaactctattgagtactttagcaatcattccttgtcagtttgagccaaacagtaacaaaggagggaactggaggccaaagcaaggtgtttttcctgtaagaagctaatgggctgctgtggaatctgggacaagctaaatggtgcaggcagcatagatgttgccagaacctgatgttaaagcctaaatct

SEQ ID NO: 22845 - DNA, 201 bp, Bos taurus
agacatgtacaaattttacattattaaatttgaaaatcttaataaaaggcaattctttggaaaaaaattatcaaaagtgactaaaaaccctgaataataattgaggaagaaagagttgtccaatattcccctcaaacaacatcaagtccatgtaattttgaaactaatttctatcataccttcaaggaatagacaatttct

SEQ ID NO: 22846 - DNA, 201 bp, Bos taurus
agaacaagcctgcgtggatgcaacctggaagtgttcaaaagtgacttttgcttcatgctaaggtctctgtccaaagggggcatttgtactctgctaggcacaaagttccaaagaatagcaaggagagataagaaagccttcctcatgatcagtgcaaagaaataggggaaaacaatagagtgggaaagactagagatctct

SEQ ID NO: 22847 - DNA, 201 bp, Bos taurus
gtacaacaaggttaatgtatttaacatgatcaaactatacactttaaaatggttaagatggttaagatattctctgtattttatcacaattaaaattctttttaaaaattttcaatccccagataaacctaaacggaaaatttatttcttttacaagaaatactaagggaaacgcttcaggatgatactagagagtaactg

SEQ ID NO: 22848 - DNA, 201 bp, Bos taurus
atattagtatatattcgcgttgcttgagcacatccaatctctttcttctacatgctacatagtcttccctggggtatgtccagtacattttacttatccagctccccagaaatcaaccttagactgcccccagatccctgcaaagaggagtgaaatttccagatatgcccccttcttatcagtccttgtgagatttttttg

SEQ ID NO: 22849 - DNA, 201 bp, Bos taurus
ttcctggcaaaccaagacttgtaactcattctcctcactattgctttgtttatttataaaatgtgcttttaattaataatgactattctttattaaaaaagcagtacatatacaagggaaagaattccaaaactgcatgcataataaaaaatatcttcctgctacttcatgccccttcctcccaatatctgtcctggttgt

SEQ ID NO: 22850 - DNA, 201 bp, Bos taurus
tggattggagtatttttatgaaagttgaagaacctgaataagccactttattccttcaaaagaaatgcagtgagagagagtacttaaggatagagccaaaggtctttgaaagttatttgggttgtgttctagaatgacataaatgctgttaaagccataataattttattcctaatagtcttaaatttggtgttaaaaaag

SEQ ID NO: 22851 - DNA, 201 bp, Bos taurus
actgaattttaggggactgaaaagcctcaagtggacagaactgtttgaaatatgtgaaaataaagatacggcgcttctgccaggagttgtacgtgctgttcgtcctcactcttcttcctcatcccagcttcccatccatcctctccgtgtgctgttcttgatgcctgtgtttgaaaacctctctctcttcctcgggtgctt

SEQ ID NO: 22852 - DNA, 201 bp, Bos taurus
tttaggtgaaacagttacctgttgtgatcttgaaggggtgttctatgtggcaacaacccgatgtgtgccctgtgcctttggtgtgagagctgcatttgacaggaaacaagtcacagtgatagctttcctcaggttgtgctgatagcatcagcttggtagagagtggggctccagagggaggagccagggtctgttccgggt

SEQ ID NO: 22853 - DNA, 201 bp, Bos taurus
cagatactgtactagttttgattttttgaaataaattttgccttgctcatcgtcctttgaaaattattcttgttttatggacaatttgcaaagattcagaggaatttcttttatattctgtttcccacaagttgcttttgataagttctcaaatgtcctgtctgattacagattacagactaaggcagcctttttttggtg

SEQ ID NO: 22854 - DNA, 201 bp, Bos taurus
gggttggtcctgaaaggccacccccccaccaactccccgtgtgaaggcacacagagatctgtggctgtgtcctgggagcagcaggtcccccagggagtggagggtgtacttggatggtcgttggccccagaagcctgatgtgggatggaatgactgggagctgagtcctggctgcgtggctgggccaggtgtcttggcaac

SEQ ID NO: 22855 - DNA, 201 bp, Bos taurus
attagtgaccagcaggctcaatcagatctctcttgggaattttgatcatataagtcaggcagtgaaaaggagaaacaaaggcaaaggaagtacaagagaactgcttacttccgaggtggggaagataccttctgcagccatgttgagccttcctgggtaccagatagcagtctgttcctccacctgggagccagacatgac

SEQ ID NO: 22856 - DNA, 201 bp, Bos taurus
gctcctgtgcaaagcgaggtttgtctggatgagatctgtttattctccacaagcccagcccaggcgggctccgtgtggggcccaggcccgctgaagctgcgtggagcagcccctttccctgtatcccatgaggatgagcaaggtgtgggcaaggttcgggcaggagtgtggaggcaatgtggggagatgggcccagaggga

SEQ ID NO: 22857 - DNA, 201 bp, Bos taurus
agtgtggagttgcctgtgggcagtgtggttcaggtctagaatcttggccctgacttccagcatctccaaggtgggctgtgctggccaacatcgtttctacgtgtctcagtcactagccctggggaggagctcatcttctcttaagaagaggggtctctaggccaggctcctggaggggagggcagaaggctgagttacaga

SEQ ID NO: 22858 - DNA, 201 bp, Bos taurus
gaccatgaaatcaatgtgagggggtggggggggggggtgttcagagcaaggagaggcttctacactgagcctgaaccatagtgggtagactgtactaatatatctagggaaagactatgtcaggggaaaaacaacctgatcagtcctggaaatagaaaagaagagtaagagttgactgttcctatctgtttacaccagcat

SEQ ID NO: 22859 - DNA, 201 bp, Bos taurus
aatgagataccgtgtctcatctatcagagtcataaaagtctctaaagcctgtcagccctgtcttggcaaggcgatgggaaactgctcgctcagattttgtgggggagagaacaactcaacctctccaaagggcaattggccactacctttcaaaaattacaaatgcagatgccctttgacctaccagttctgcctctagac

SEQ ID NO: 22860 - DNA, 201 bp, Bos taurus
tgggagggactgggccacctgagctctgccgggccctgcacagcacttggggctgccccaatccctcccaccggggtgcctgagcctgcatcatcagccagctcttcagccttaacctcctcagggaccttgccctccacctccccatcacacacggctttccccagggactccacctccccagccctcccctggagaccc

SEQ ID NO: 22861 - DNA, 201 bp, Bos taurus
ttttgcagcctgagacccttgtgggccttccccagatcagaatcttccctcctcccttctcccctcccccaccccagggaaagacagccgggccccagacaccggctcacccagttcccaaacaaaagccccactgtcagcaggtcacagaacagccaagcccatgcctgattcttgggtctggacctcggccaatggcac

SEQ ID NO: 22862 - DNA, 201 bp, Bos taurus
agaaatgttccaaggactccgacctgcacacatggtcacccacatagataaactacatttcccagaattccctcacagctggatgtggccagcattccaaatgataacctatacaatcagttcagttcagtcactcagttgtgtccaactctttgcgaccccatgaatcgcagcacaccaggcctccctgtccatcaccaa

SEQ ID NO: 22863 - DNA, 201 bp, Bos taurus
aagggaaaagcaaataacaaacaagggaacacccataagattatcagctgatttctcagcataagctctgcaggccacaagggaatggcacaattatatttagagtgatgaaagggaggcacctacaactaagaatactctacccagcaaagctctccttcagattcgatggagaaatcagaagctttatagacaagcaaa

SEQ ID NO: 22864 - DNA, 201 bp, Bos taurus
gagaaaccgaccagcgaaacttggttccggaagggggcgctctcgcgtgtgttactccaggcgtccctggcaaaactcctgcaccggtatcagtgcctctgcgattccgtgcctgtccaatactatcctgtccaaatcatgagcatatgtaagacctgcattgtcccacctcctccattaagtcttccctgatcatttttg

SEQ ID NO: 22865 - DNA, 201 bp, Bos taurus
tacctggcatgtcagcgttcgctcagcctttataaagttggctagcctcaccgtgagccatctgtattgaccggtgagcagtcaacagtgggccccaggcatcgccgctctgtggctgtcaccagcacttcactctggtttgaggtctgacagactttctgctgattggctggcctcatttctgatctgattactgatttc

SEQ ID NO: 22866 - DNA, 201 bp, Bos taurus
ccggatacccccagagcaacaggtattggtttttactttccagggaatttgcatatgtttcccaaattttaggttgtgtagaatgatctacacatgaaacgtgttccagaatctcctttgttctgactatgatttctttcaaatcactcagcaccaccacacatgtgacaacacgcttagtgctgatttctgtgggtggaa

SEQ ID NO: 22867 - DNA, 201 bp, Bos taurus
ttgccttctcctatctcctatgaaataaacttaaacatcaactctgagaatctgagccttgggccaagggaacagcaagtgattttgccctcttcccctttaaggagagtgggtctaccctgaggaggtagggtagagggattggatatgcagataacaccacccttatggcagaaagcgaagaagaactaaagagcctct

SEQ ID NO: 22868 - DNA, 201 bp, Bos taurus
tgcccttgtttcccaggccctccttcccataagggcgctgtggaatagatcaggatgttcgtggtttcaccatctaggtctacagaaggcatttctgctgcgttgccagaggcaaacatagaccttccccattcacaaaaagtgtcttgcaagtggctgcatgcaggacacctgcactccatcgggtagtagaaagcaatg

SEQ ID NO: 22869 - DNA, 201 bp, Bos taurus
catgaagagagagtccacctccaacctctctctccctcttctgcccccatcagtttggaaaaaattgctagcttgggaaagattaacaaccttctgtgactgcactgaattccccttctccctttgagctccttagactgagttctcctaaaggattagggttttctggaaaactgcttgcctaaatgtaaacaagagaaa

SEQ ID NO: 22870 - DNA, 201 bp, Bos taurus
tgtctaaggtatggtgatgtaatgacacaagtaagcatgcagaccttatttttaaatgttgaaggcaacctttctatttcttcaggattcaatgactcacagtggttcaaggtcagaagaagaagaagctgcttgtgcctgccatgctcttggacctgagatgtctagacttcttgtgaggttcactgacattcttatatc

SEQ ID NO: 22871 - DNA, 201 bp, Bos taurus
cataagcgttgattaatgttagtcactaggaggcttccctcatatcttttaaaatcataaactctaccagttggacatgactttaagtctaaatgtaaatctatgacgtaaaaatttccttcaggcgtagcaataggccatatgtgtatctggtgaattgctgtttataaaactcaaaggaaatttttccctgtattatgt

SEQ ID NO: 22872 - DNA, 201 bp, Bos taurus
gggtcatgaatgaaatctcttaggactgtgtggagtaaaggagattatgtaatgtccttagcttctaggttggaacatgtaagtgctcagacagtgcttgctatgaactattacagtacatgttcctcactttccagacttgaaattctttaagagtaggaactatgtaatatatgtattttataaattatggcctaaatg

SEQ ID NO: 22873 - DNA, 201 bp, Bos taurus
tgagagggccttactctgggggagtaaactttgtggtttataccacacagttccattctttcagagaagactcatctttttccctgatgggagtagaagcacgactttggccgtttctttgcttgaactagggagagcggctgctttcatatgtagcctttttagtgaagacatgagtgttcagccctacttctccttgtc

SEQ ID NO: 22874 - DNA, 201 bp, Bos taurus
gggccttccgatgtgaatactgcgatagcgggtaccacatgaccccaggaggccagtgcgagggtgagtctgctgagaggaaggggagaccacagcccttcgcagtgtggagcacacatgtccatgacatgcagggctagttccagaacttgaggcttgtaggcatctggcctggtacgggttttcctccactgccaatcc

SEQ ID NO: 22875 - DNA, 201 bp, Bos taurus
tgccagcgattatgacttgggacaagccagtgtgtaggcttgggtttacagtgcagaaaggtcaaacttcggttaacaggccacatcattagcacacagagagcactatatgtaaggtttaaaagtagctacattaacacttttgtgagcttcgtgtaaactggatggtgttcatccaggccaaaaagtttgctttatata

SEQ ID NO: 22876 - DNA, 201 bp, Bos taurus
tatgtgcttacaggttacacagtacagccgccacttgacactcattgaaatataaatgacatcagattgctgaagcggtagagtgcagtttaaagaaatacagatttcacaaaacctacaatttgtaatccacaacttgtaggatgtattgaaggaggacatggggagaagcgtcccacgccaggcagccatacccacctg

SEQ ID NO: 22877 - DNA, 201 bp, Bos taurus
gaaaatggaacagaaaaccattaggaaagttaataaatgcgtgacaactgacttagtagtctaggtactctctgggaggatcatcactgttgaatatggagaattcctatatacagaaggtttgaagtttcagaatttagagaatttaggctctgtaaggtgcggggtggggatgtgggagaaagctgaagacagtcagca

SEQ ID NO: 22878 - DNA, 201 bp, Bos taurus
ttctgtgagtaagtgtgtccaaaggatggggcaactcaaccctacctcatcatcatctcctgactctcagctcccttttcctctctattccccctgggctcgaggggacgagaagcatggcatgggtaccctattccttattcactcgtattcatttctgtatattaaactttcaaaataatattattaaaacagggactc

SEQ ID NO: 22879 - DNA, 201 bp, Bos taurus
tttctagctgtctgtgtgtgatgtgtgtgtgtaaggtggagatttgattataatttttaattagtccaacttcaggtttacatatctcgaaggacaactatcagttcttggcaattaatgtttgtatatcacctcgagaaccttgaggaagagagatggtatataaatggataatatggtaatgaaaatattacagtcact

SEQ ID NO: 22880 - DNA, 201 bp, Bos taurus
aatatgttgttgactaatcaaaatgcatattattttagaaagccagctctgcatttgtgcaagatgagaacccatgtatctaggatgatcctggaaccaagcatcttcagtctatggaactcaaggaattagaaatgttgccaccagagccttttacaaaatgagaagtccttcaataaggaaaatctggcttcttgaggc

SEQ ID NO: 22881 - DNA, 201 bp, Bos taurus
ttttagacctgtacaactgtcataaattatcaacacacaaattttgtataagaataaaaacatatagttttcttggaaataaatgatacaaagcatatctcaaatgccacctcttccttaagccactctctgactacaaaatttgtacatgtgctatctcagcttacaaacttcaggaccattacgacactggtaacacac

SEQ ID NO: 22882 - DNA, 201 bp, Bos taurus
aagtttgagtggtgttctctggtgcagaaatagaaacatgttcagtacatgatatggaatagaaagaggggatttgatgagtcagactaattgatgttttggcaaaatgagatgtctgaaaaaagttacatgttcatatgcatacccagataacaagaatctaaaccataaggaatgttgcaaatatttttttctttaaaa

SEQ ID NO: 22883 - DNA, 201 bp, Bos taurus
ataataattttaatgacatttaatgatggttttgcactattttacacctactcttagcaaccaaggagttaaaacatttattcttatctatacaagattcctttagtaaagcttgtgaaatgctcattataagtctcacacgtttagaaacaacaatacattaatagaaatgcaattaagtacttattgctgttgtcattt

SEQ ID NO: 22884 - DNA, 201 bp, Bos taurus
ggaaaattccatggacagaggaggctggcaagctacagttcatggggccacagagagtcagacacaactgagcaatcaagcacacacacatacacacagtgatatggggaaaactgttggccaaaacgtggtaaaaatggtaccaaatatatcgatagccaaaataagtatagagtacataaacttaactgttgaagagaa

SEQ ID NO: 22885 - DNA, 201 bp, Bos taurus
ggaatgttagtaaagttccataaaggcctgcacatgtaagaagaaaaaaataggaaagatagaaaaagtgattcagatggagagcgattgccctttcaaattggccctctgcaggggtctattcagacaccagttccaggacttcaaaaaacgggccagtgaaggagggggcactctgtcctctgtccattgcccaccagg

SEQ ID NO: 22886 - DNA, 201 bp, Bos taurus
atgaatgaaactggctggtatgtgacattagggagtggtggaacctggagaagtacagagtgccttccctccccaatatcttaggaggagagtgtggggacgatgtgctagagtaaaggaacagaaatattaggctttagaatatatggagaggaagctgtcatttccttcttggagctgagagaagaatacaacagcagt

SEQ ID NO: 22887 - DNA, 201 bp, Bos taurus
ctctaaatcatctgatccgaaagctctaaagcaaaagattaagaatttggagaaactttgcagtgattactgaggtcaaagaggagaacaataactaagacaaaggcaaactgggtataatttagggggatctgactgttctgctaagaggctgagaaaatgtataaaattccacacaaactaaaaaggatttgagggcta

SEQ ID NO: 22888 - DNA, 201 bp, Bos taurus
cttctactctactgacttggagaaatgagtaaagagagcccctctactactcttcccttcataaaagtggaaacccttgctgtctatgggagatgagaaatgaaggaatgaatgtttctcaaggaagaaccttcagattagttttatgcattccacacactgcatatccaaatgtcaatgggacagcatcagctgattatc

SEQ ID NO: 22889 - DNA, 201 bp, Bos taurus
gggctgagagagaggccagagcctcaggtgctgttgatacaagtctttcctaagcatatccacgaagctactaccgtatcattcttgatctagtgccacacataaacagcaacccctgggccctgggctatgttctctgaacagcaccaggattgttctgcacaatgctctgattgtctgtggggcagggcagctggagag

SEQ ID NO: 22890 - DNA, 201 bp, Bos taurus
agttatttgtgtttaagtaaaacagattgctctagtatggctagtttggctgcaaaaagaagaaataaaattgcaagtaaagtgaaatgtactttaaaaatacagtatcttgaatctcaggactgatggtgtattttcaagaggtttccagatactcaaagcagagaagacctataatctctcccttagggcatctcattt

SEQ ID NO: 22891 - DNA, 201 bp, Bos taurus
ctgagctggggtcaactgaagtctgtcagattcagccacatttgtgtctattttccttgctcccagaggtcatctcagtctcctcatacccctacttctggttcctttatatctgtctccatctctggctttgggccctgtgttggagacctggaagtcagttgacggggaggaagtcatttgcagtttgacagctactcc

SEQ ID NO: 22892 - DNA, 201 bp, Bos taurus
gtctgtttaaaagcacccacatgaatacacacacacagaaaagcctgaaaacgttacccttttgctttcctctatattttctgtagtactgtttttgtgcgttttttatactcttctaccagcaatatctattatttcggtaataaggaaaaaacggtctatgttatattttaaaaacacaaggcttaaaggaaacagcgt

SEQ ID NO: 22893 - DNA, 201 bp, Bos taurus
tttttgagaaacccaagttaattaccttatcagtgatttcattcaggatttggctaatcattttaatttaatttcatgattaatttccagttaaacactgcgggcaataaaactaaacagctgacagtctataattcttacatcacatcaggaggggtgcagtgttaactgcttccacttttggtgatgctgaacctttaa

SEQ ID NO: 22894 - DNA, 201 bp, Bos taurus
actaacacttgaaacttaaggaaggtcaaaacactttattccacaaacaactgagttatgagaaaaacagaagggacaaaaagaaaagtaaaaccgatattgtcctagaaataacataagtaccactcggttgtacaaaagatatataatactgccctaatgtaaataagagtattcttctttgtattaaaagtttaaatc

SEQ ID NO: 22895 - DNA, 201 bp, Bos taurus
gtttttcacctttttaatcctataagatgcaaaaaaaaaaaaagtggaattctttgaataaaaagtgaaaatatatacatggtatgtatatatattctttccataacatcagttgattgaaccttcaacattgcagtcaattttgatattgtatatatcagagctgtccattctgtaagcagtaaagacatgaagtttctt

SEQ ID NO: 22896 - DNA, 201 bp, Bos taurus
tagttcagtactctcaaacagatattatgacttaattattttcaaaacaggaagttcccctttacctacagggaacccttttgttttggtgccctctgttgtgttttcccctgacctttctttctgcctaccaccctgagtctttcagtttatcttcccaaggtttagtagagtgggcaggtacagtgtaggtggttagaa

SEQ ID NO: 22897 - DNA, 201 bp, Bos taurus
tcagagcaataatccaagagagagaaacggggaactttcataacatagcctcagaagtcaagcaccatcatatccagtacccaagtagttatgcaggtcatcccaattcagtgtgggaggggattatttataagtgtgactatcagaagcaagaatctttgggtaacgtcttgatatttagaatattaaaagtattccagt

SEQ ID NO: 22898 - DNA, 201 bp, Bos taurus
ccctctgcttcatcattacctgtgtgagagtcacattctgttgccagtatcaaatatgacataataataataaaaggaaaaaccaggtggccaggcttttttgagcatatggaaacaagattcttccatgattttgccagtgcccacaggctcgccagcacctaacattagaggtggatggaacagcgcagtcatcgaggc

SEQ ID NO: 22899 - DNA, 201 bp, Bos taurus
ctggccacagcgtgacgtcactagtgggcggcgcctcgcgtccctgggagatcagagtggtggttcccaggaacaccaggcgacggtcgcagagtgcatgcctttgcccagggctcgaggccctggcggttcatcacctgcagctcttcactaataggaggacctggggcaacttcgtggtgctggacacctcacatggta

SEQ ID NO: 22900 - DNA, 201 bp, Bos taurus
ttgaaaaccaggctcaactaaagagaagggaagctgtatagagtacaaatgaagcttccacaatgagagaaatgagaagggtccactacatttctcgacacagtgaaactaaactcataaaggcaatgtacaatgtcttcaggctttttttgcttttcccaacatttccatgcataacacatgtgcaacaccaaacaacat

SEQ ID NO: 22901 - DNA, 201 bp, Bos taurus
tgccttgtgagccaaacctgaggatatgtgatttggccctgccacggaaacctctctgcttagggagttgggccagccagttcctcagttcaaattccccctgagggtttaacctgcctgtttttcatccctctcctggttccagattcccaaggggagatcctccccaaagccagctccagggcagtctttgaacacaac

SEQ ID NO: 22902 - DNA, 201 bp, Bos taurus
tggtgggggaaacaggaacagtagcagaaaacacacttaatgtaactggaaggtaaatgaaaatgacatcaagtggcatgtagaatttaactgtaaaaacgtaaaataacaactagaaagttaaagtgttagtcactcagtcgtgtccaactctttttgaccccgtggactgtagcccaccaggcccctctgtccatagaa

SEQ ID NO: 22903 - DNA, 201 bp, Bos taurus
atgtaatgaacctggaactagccagcagaacttcagttttctagattacttacccgtttgggtttctttccagctcatttaaaagtgtgtgatcacagtattcaaagactaaatgcattttcctctttctcctgaacacctcaatgaggttcacaagatttggatgttttaattgctgcaaaggaattgaaatacaaaagt

SEQ ID NO: 22904 - DNA, 201 bp, Bos taurus
gtcagtagtgcctggcaccatagtaatcccacaaagtattatttactgttgttttgagtacatttttataatgttttaaaggggaacagtcatgaggatccggtcccatcacttcatggcaaatagatggggaaataatggaaacagtgagactttattttggggggctccaaaatcactggagatgatgactgcagccat

SEQ ID NO: 22905 - DNA, 201 bp, Bos taurus
ttcccttcagtcctcattttcttcactcgtctgcagcatccagccacgttgattgctctccttttgcacctctctgcctttggccaatactgtgctccaccgacttggttcactacctcttctgattcttccctttttaaacctactttcacttcctcctcttatgtgttagctgtagagggccccaaggtctttcccctc

SEQ ID NO: 22906 - DNA, 201 bp, Bos taurus
atctctttctccttccatggctcatgcttcttatgcactccatattgtgctcctcttgccccttcccactcagatatttttttatctaggctgttgccttcgttagcatttttctggaccagtctttctccctgttttcaatttctgcatcaaaatgttcccttcccgtgtacctttcccacagtgccttgacagacggtt

SEQ ID NO: 22907 - DNA, 201 bp, Bos taurus
ttacttactttctcaatgctgccaaccccttctctactctgaggacaccaatcatttaggattattttaattgtatataaattccaaagatgcaaaatttgggttacaggatatatttgggcttgagcgctttagcaggggggcaaaggagtgggggaagaaaccatgtttaaaacattttttaaaaagtctctactctgt

SEQ ID NO: 22908 - DNA, 201 bp, Bos taurus
gaattcctttaaaatctctttggcaaagtcacccatgccacatttgagagtcccagctattagtagttcatggtcacacaatgcacattttaacagctacggctgtcagcttgggctggtaggcccgtgcatttatccaggtctattccttaaaccatatgggataagtccaaccctgttcctcatgacattcgtcaggca

SEQ ID NO: 22909 - DNA, 201 bp, Bos taurus
atctatgatgagggaatcacccaggtgttccctagggtgccagttcacctggccattcgtacgcatccttttagcacatgacgaagaggaaacacaattacagctgccaggtgaaagaatccggtctcctcctctctactttcaagaggcaacagaaaatgcccccggggcaaagatatgatagatgggatattcttatct

SEQ ID NO: 22910 - DNA, 201 bp, Bos taurus
caggagccaaccctcgacagcttacaaagagatgaagcaaaggaaacagtgcctttcctggagcccttccttgtggccctattcttctcctggtcactcatccatgaacaattcacattatccgtgaattctcccctattcttcatagcctgtctaaggcctgtgggtttttcagtaaggaaaactgccattattaaacaa

SEQ ID NO: 22911 - DNA, 201 bp, Bos taurus
caaatgctgaagagattctatttccctttgttagtaatgccagcatttgaccttgagtgtgtgtagatgggcaaatggctgtaattctgagtctaaaataaattttctttgattcatattttaattggtaatggaatagttatctttatttctaatctgctttcttttttttctcttccttttgctttaagaagagaaact

SEQ ID NO: 22912 - DNA, 201 bp, Bos taurus
gttctatttgccaatctggtcagtgattttgaacattacaactgtcaacatccctgtttccatggccacactttatatactttgtcatacatgtttccaagaaagtttaattggggatatggatgcccagtaataatgtcttgtatttaatatttgcttttttttttaagtaaaagctcttagcacaatttcttgctatta

SEQ ID NO: 22913 - DNA, 201 bp, Bos taurus
gacacttttgtcagcccattggtgagcagggctgaatctggaaggccagagacctaaggtgtcagagctggtaccagactgctagtgggtggactcggtcctgccacagctgtctgctggcctgcagttgtcctgaggctaatgtctgcctgctggtgggtaaggctagtcctgaagggtgaacaggcttagtagtagaca

SEQ ID NO: 22914 - DNA, 201 bp, Bos taurus
tttcaatgggaggaaacaatacctgttaacctgccactcctgaaaattctgcctcaatggcagcaatactgagaatagacagtgaggggtgggtggggggttgtcccttcatgcaaatagcatttaccaacaaaccaaaagaccaaagaggggaaatggttgacagaagacatcccctgaacctgcctcatcctttttagg

SEQ ID NO: 22915 - DNA, 201 bp, Bos taurus
ccctaacctaagacaccgccaggcctgggcacagaacaaaggactgaacagagatagccggctgcagacggtacccctctggtgacaggcagccagagccagaatgggaaaatcacagccccagagagacattatctataaaactgtaagcaggcttttttgctaactaaaacttcttgggggtctggacgatcaacatcc

SEQ ID NO: 22916 - DNA, 201 bp, Bos taurus
ggacatacttctcctccagcaacaaaatacaaagaaactgtttgggactaaaaataactgtgtgcatgaacagttggaacaaattctggacacaaaagatccgaaagtgacccaaaaaatccagcttctacttttgaagagcctggagtaaaaacaggttttggcagctaaagaagtacatatcctcctccactcaacacc

SEQ ID NO: 22917 - DNA, 201 bp, Bos taurus
caatgcatgttgtaagtaaactcatattagttaaggcaaagttagtaagaataattatcaggatttctataacctacaaacctggccattttgaataatcatgttttccaatccagttggtttattaaaaatttatttttcccgtggtcaggtctttcatattttggcaagtgtcagtttttccctttcattatgtaggtt

SEQ ID NO: 22918 - DNA, 201 bp, Bos taurus
aagtcttaccaataaaccaagttattttaacttcctctaaaaggactcatcttacatatcgttttattgcttttctttgtctttcttgtagtggaatgctggttgagctggaaacaacccttaaattatatagttcagtggttttcaatatgaactctgcaaagtctccatgattttcacagacatcttctctgcctccca

SEQ ID NO: 22919 - DNA, 201 bp, Bos taurus
agaactgaagagaccttctgtgcaaatgtacacgagtacatttggataaaattctgactagatgctccttgccaaactcaaccatgaaacctacaagccattggattaggaaatgttgtgattctctcgtccccagtgttctcaactagtcagagaaacccatccaaaagtaagggccatcctacatagattttggttagg

SEQ ID NO: 22920 - DNA, 201 bp, Bos taurus
actttatctcaaacctctttaaatatcttgcctcctaccaggtgccctacacaaaatagactaccaacaaatttgcacatgacggatatgacccctggccgctttactactcagtgtcttttccccaaatgtctctaagaacaatggaaaaagtagggggaaatctatactaaccaagcagcatcacttcctccaaagtgt

SEQ ID NO: 22921 - DNA, 201 bp, Bos taurus
tggcatcacgttttttcccactgagaatatgaacagtttgattatcccttcagtttctgagaggtttgatttcattcccatcctcaggtatagcctcagtgcagtcttagagagagagcattagttttaattcagacttcaggatgttctgatccatctcccaatctgtctgagaatcctcagatacctacggagaactca

SEQ ID NO: 22922 - DNA, 201 bp, Bos taurus
cgggggcagggtacatgtgtatacctgtggccaattcatgttgatgtatgacagaagccatcacaatattgtaaagtaattatcctctaattaaattttttaaaagagtggcctttttatattagaaaaaagaatggtgatcattttaagatgtatagaaatatcaaaacactatattgtgcaccaagaactaatatagtg

SEQ ID NO: 22923 - DNA, 201 bp, Bos taurus
taggatggctcaacttgtaaagcaagctgtgagttcccaaacctgcagcagtgggtaacaggctgtgaaaaacccaaaaggttatatcctccaatgcccttttcagatttggccccggaggagccttgtagacaaagaaagatggcccagagggtggagccaagagtctgaggtttttagaacactctcctctctgaggta

SEQ ID NO: 22924 - DNA, 201 bp, Bos taurus
gggcaatgcaaagaacttaagcacctagggtcaatgaacctcctccctagagcgcttgcattaaagcagccccattccaatggcttcctccagatccagaatcttcagagaaagaatctgatcagcccaatttagttcagttactccctccatacccaccaactatgatgggggagtcacctggtacagaacctatactgt

SEQ ID NO: 22925 - DNA, 201 bp, Bos taurus
gacccccatgctcttggtgatctcagggtctagggagagagaggttgaaggcccctctgcgtttggggtcagggctgagtctgtggctgggagagcagaacagggtacactattctgtgtacaccaccactttgggtatactggcagaatagggtccactctgtgtaccctcagccgctcaacacagagtggacagagcag

SEQ ID NO: 22926 - DNA, 201 bp, Bos taurus
aactggggcttacctctgttgtctcacctgtaatgaaagaccaggaccacgagtcagttccctgccagcactacaggctaccattctgggagaaacagaccctaagactgaagaggttcctggcaccaatgggttacatcagctcctctgggaatgctgctgcaaggtacagttgacagctggcaaatccaacagtctggt

SEQ ID NO: 22927 - DNA, 201 bp, Bos taurus
aacatataaatgttttattttgttagagtattagcaaattctgagatttattttccttttttgttttaaataaattgtacctggtgaaaataataaagcaatggattcataaaggcaaaaataaatagattatagaacatactgtttagacaaaaacctataaagcaaattttaatcttcccttataatccttatccttcc

SEQ ID NO: 22928 - DNA, 201 bp, Bos taurus
ctgtctttgaatacttgggttgcgccttcctctggactgttgtgagttacgcttcgatgaacactgaagggtgtgcaaatatctttttgagattcagctttcagatctttcggattatatatacagaagtgggattgctggatcctttagtagttccatgtttaattttctgagatccaccatattgttccccaaagcttt

SEQ ID NO: 22929 - DNA, 201 bp, Bos taurus
ctagtgtgttgtgtgccctcagaagaggccccagcggccccacggacggaaatgttaaacacagagtctctgtgtttatctcaccccgtcgtcatgcagcatgactaaggcctgcctgcaattctaccctgggtgtgctcagggaatcacagcctctccatgacaatatttactccactgttgcctgggggagctctaaat

SEQ ID NO: 22930 - DNA, 201 bp, Bos taurus
aggagaatcagagcctctggtgagggtgtcctgagtggaggaggggcctgtggggggcgtgagggcaggagacttctgtgtgagtgacttcagtgtgcagtgaggcagggcatgaaatgcatgaagacaggagaaggaggattcctgcttaggaggatttacagccatgacaaaggcctagagatagtgatgagaattgga

SEQ ID NO: 22931 - DNA, 201 bp, Bos taurus
gaaggagagagcttcctctgaaggggctcgtccagcctgtcggcttcttgctgaaaactgacatggtctgcatggggatcctactccttaccagacaatgtgcggcctcatcaggattaaggcaggtggaaacagttcagcagataccccgccagggagtctcgcccttgtcaccaccaccccactccctggctcgtgggt

SEQ ID NO: 22932 - DNA, 201 bp, Bos taurus
tggtgaaaggaagaaggaatatttcatccaacattgtgttggaaagaaagctttccaagatgctccatgtgtattttttaactctctttactttttggccaccgtggatcttagttgcggcgtgtaagatctttcattgcaggcacgtggactctctagttgcagcatgtgggctcagtagttgtggtgcgtgggtttagt

SEQ ID NO: 22933 - DNA, 201 bp, Bos taurus
tccagcctcatttcaaaacgtgaaagaggagtgggtgccagaacttaaagaatacgcaccaaatgtaccctttttattaataggaactcaggtatgtatgttttgattttacccattcaagaataacctttctggcctgcctcgtgatgttgctcttagatgatggccccaaggtttagcaaatgagatacgtgtttaatc

SEQ ID NO: 22934 - DNA, 201 bp, Bos taurus
tcagtgtctgatttcatttggggctggtttcctctcttgcaggccctggacgcatgaaatctgtattaatttatacatgtggcaggatagtacagcctatccctttccctgtgtttaactgccttctttcttcccctcactcaggcaactagcctagtttgtgcttcttacccagaggagagatgtgatagctagaagtag

SEQ ID NO: 22935 - DNA, 201 bp, Bos taurus
aggggaaggtcaccttacgagggctggtgccgacgccggggcagaagggccagtggggcaggccagcgtgctgcttggtgagggccaccctgcagccagattgccttctttgtcctccagcctctactgcccgaaggataacattgaggaagccctgctgctgctcctcatcagcgagtccatggtgagtgccaaggctct

SEQ ID NO: 22936 - DNA, 201 bp, Bos taurus
tgagctgttggtgccaaaaggtctgctgagggacttgagtgaggtcaggcaatcacccacccagctggttgcctgtcagaaaaaagtgaaggttcccatctcccaggcccctcagagtctctgctctcacacgggcccctcaggctggtgctctgtgtgaagcagggcctctcggtggcctttctctggtgagtgtggaca

SEQ ID NO: 22937 - DNA, 201 bp, Bos taurus
ctcggccgtacacagcactcccagggctctaaccttccatttttggtgcttaattttggtgtctggcagcctgtcgtcttgccttcctgccctcctccctatgggccctgttccatcatgcacagctcggggtccagatcccaaggccatgcagtcagagcagcttggcccagagccctgctggacatgctgagcactgct

SEQ ID NO: 22938 - DNA, 201 bp, Bos taurus
aaagtttagatacaaattttaagtcgtatttttcttagtcaaatattagatatcaaactgactactgtgaaaattaaaaagcaacacctgtaaaacttaaaaacaatttaaagagtatacttgtgtatgaaactataaagaaacgttcttaaatactgaacctacaaaagattcacaaagtataaaatgagagcaattttg

SEQ ID NO: 22939 - DNA, 201 bp, Bos taurus
taaatgattgctaacaaaagcgttaacaaaccttaatgaagcctactgtaaaacaactatactccaataaaaattaattaaaacaaaaatagtagcctacataaatctccattggatttgtacccaatatcagcatcaagtgacttgaagcttttaagtttgggactcttttttttccctcctttgaggtgcccttcaggg

SEQ ID NO: 22940 - DNA, 201 bp, Bos taurus
tggaaagtggacatgcctccaacaggagaggacatgaggaatggtgaggacatgtcaggctggagtaatggtctgaccaaaaatctgaaaggaaagctcagggacatcggtgacaggctggagggtgttggacagactcagagagccttgaatgtctgtccagggagttaggctcttctgtgtgcaggagaggaagtgagg

SEQ ID NO: 22941 - DNA, 201 bp, Bos taurus
aaaggtgctaatagcatttaagttgagctaacagctatcaaactgaggctgtgtttagaccaagataacagggaatgtttactggtggaatcacattaccgtaaaacaaggctcccatcccactatgcaggtaggctaatactgatgcatctccattttaatggcaagtttcagagtgaacttctactatattcattttct

SEQ ID NO: 22942 - DNA, 201 bp, Bos taurus
gcttttttgataatccaacggatgttggcaatttgatctctggttcctctgccttttctaaatccagcttgaatatctggaagttcatcgttcacggactattgcctgacttggagaattttaaacacgtccttctactccgccatttttcaagttgggcagcagccaccgtctctccagggatcaggaccatctgtgcag

SEQ ID NO: 22943 - DNA, 201 bp, Bos taurus
ttatactgagtcctgagactgtgtgtgtgtaaccctttggtgtcagctacgctgcgctggtgtatttgtacgcacgtgctctgtgttgtgcttgttgatagttgcagaaggggattgctgcagaagatttatctttcaaatccctgctggtgatggtgatacagatgtaaccatgaataaaaattcatcaagctgtataat

SEQ ID NO: 22944 - DNA, 201 bp, Bos taurus
agggaaagtgctttatggcaactttagcccaaggccagtgacaatgaatgctctccagagagagccagctggcctggctgctgctgctccgggtgtttctgtgcccttgagaatgtgtagatttagcaaatgacaacactgagcgggcctgtccccagtggagcccctggcccttcctctctttgtgttggctcttttcca

SEQ ID NO: 22945 - DNA, 201 bp, Bos taurus
tcaaccacagtgggtaaactcaccagtccctgcccaactttgtgctctctgtatccttacctttgtcttggtttatgcctacattgtgaactttctttaatcaattccttcatcacctcatcacattaatctgcttatttaaattttactcatccttccagattcatcacaaatgccaaccctgccttagtgcttctcttt

SEQ ID NO: 22946 - DNA, 201 bp, Bos taurus
aaagaaatacaaggtcacttacactaatatgccttttaaaggatttaaacaggggagaaatatattgctagataaagataaatgtgtttcatttttcttcaaaattctaccttgcaaggataaacaaaatgaggaaaaaggcagcagaatggacattagcctgtattttcttctcagatagtagagaatacaaatttcaga

SEQ ID NO: 22947 - DNA, 201 bp, Bos taurus
taaaataagcatgttgggtaagagacataagggaagaaaaatattctttgagcaaagaccctacagaaagtgtacagcagtatggagggtgggggtagtgtagggtgagaatcaatgatataatcttgatttaaataagacagagcaagtaaaatgaacagaagccactgcacctaaatgcagaacttcatttacatagaa

SEQ ID NO: 22948 - DNA, 201 bp, Bos taurus
tcaatgtatcatttatgtgaaggaaatggattaggccatgtccaaccattaatgatttggtttagagccttgctccccagggaatgtcagctacctgtctttacctgaacttaatgacttatatttatttgtttcttaagtttttattttatatcagaatattgctgattaacaatgttgtgatagtttcagatgcacagc

SEQ ID NO: 22949 - DNA, 201 bp, Bos taurus
agcctcctgactatgagaaataaattcttgttatttaagccgttcattctatgttatttttaaaatcatagtctgaactaagatgggcagtaaattgtaatgttcttgtctttgtcagttcaggttgttctaacaaagtaccatggactgggtgacttgtatacaacagaaatttacttctcacagttgtgaagggttgaa

SEQ ID NO: 22950 - DNA, 201 bp, Bos taurus
agtcatcaaggaggacaaattgaatgatggggtgtgacaccaggtgtggctgacgaccaaaagcattattcaaaatctaaatttgtgactgcttagaaaataacaaaagtaggcctagctccttcagtaccccaaattcaattagattctttcatatttgtgccttagtcttgttattctcacacctgtagttcccaatct

SEQ ID NO: 22951 - DNA, 201 bp, Bos taurus
actatttataacatcctagggctgtagtctatctatttacataaactttgaaatcctgatcatttcactgacaatgctttgattgtctcagtgcactgtcaccccaaatattctactgaacaaaatattctttataaataagtgaatgcaattctagtttgaattcactggaaattcttaatggcaaaataaatcttaaca

SEQ ID NO: 22952 - DNA, 201 bp, Bos taurus
tccgtgtctatgtggaaattcatttctacgaagccaaagggccagggtcgtgtcattggtcactgatcctcatggtttagtggccaggatttagcactctcggcatcacagcctgacttcagtctctggccaggaactgaaactccgcttcaagcttctggaggcccaggccacccaagatcagggtcttcatgatgggat

SEQ ID NO: 22953 - DNA, 201 bp, Bos taurus
gttaccaaagcagcagttattattcagaacatctgtaagatgcactgataaccacaaacaaacaaattcactatagattatcccttagtatggatcatgctaaaatatttgcttcatgagaggtctcaagattcaaatttaacatggcctcacacgttttgaaaacgtggtttgcatgttacactggattattcctttctt

SEQ ID NO: 22954 - DNA, 201 bp, Bos taurus
ttgagtattaaagatgtaagcaatggaaaaatagtcatgagtttgagtccagagaccagagttttagattgactgtggccattaactccaacataacatttattattggagaaagaaatcacaacccactctggtgttcataactggaaaatcccacggacagaggagcctggtaggctacaggccatgtggtcgccaaag

SEQ ID NO: 22955 - DNA, 201 bp, Bos taurus
caaaatgcctggtttccgccccaattgcttatttccctgtccccaaggctacaaggcacagaagcaaatttactctcgacaatctatgaagccaatactttatagaaatctagaaagtacttccaaatgtattttttgtgcatccctgttcaaatggttggctacagagttcagaaattaatgacaagcattattgcctta

SEQ ID NO: 22956 - DNA, 201 bp, Bos taurus
gtccatgggggtcacaaagagtcggatatgattgagcaactaagtgcagagatctttgacaagacctgacataggattctcccttacagaccaaaaggtgatttaacaagaagcttcaaaaaaacaaaacaaaacaaacaaacaaaaaacagaatataagtatgcataataagactgacaaggttaaaaagcaaagacaga

SEQ ID NO: 22957 - DNA, 201 bp, Bos taurus
tctcaaattaagatctgtcataactaagataggaagaaccttggaaggaggacattctggggatttttagttttaatgaacttggcatattgagctagtcagaaagatgttcattgggaatactggatgatcccatattgatccagcaaagccacactttcggtatcaaattattcaggtacattcagtactcataaactt

SEQ ID NO: 22958 - DNA, 201 bp, Bos taurus
tctacctaccagcactcaacccctggccacattttgagcccactggtgcacactctgttggctatttctacccattcattagcatggatccagatcaaaggcaaacacaaatcctggaatgattctggggctgtttgggcaggcagttttgtaggttaaggtccccagtgcatgatttggaagatgaggagtaggtccccc

SEQ ID NO: 22959 - DNA, 201 bp, Bos taurus
attaatttggacttttcctgaaaatcctttctaggcccaggttgttctggaaacctctgaaactcatccatttctccccaaattcttccagactggtgaaatattaaggccatttggatcttttgaaactctgtggattaaatttaggcatgcttatactgttgaaacagagaaggcaatggcaaactactccagtactct

SEQ ID NO: 22960 - DNA, 201 bp, Bos taurus
tgtaacaaatggttaaatggggtaaatggttcagctggtgatttctcactaccagttcaccagcaccattcctccagataggggatctctaacctgacagcgctggaggacaagggcactctaagctcagctccctccagtgctggttgccatgacaacaacctcagagaacccttcatttcactactaggcagagtctgc

SEQ ID NO: 22961 - DNA, 201 bp, Bos taurus
acatggacccctgcatagactacccgagtttcctcacagcctgagtgattctggagggagcaagttagaacaatctgacagaatccacagaggcttttcattacctagtctctgatgtcacaaactgccacttcctccttattttacctattagaagacaggaaataagacagcactcgggggaagtaaatataggctcta

SEQ ID NO: 22962 - DNA, 201 bp, Bos taurus
tttgacccagaactgggcaggggttacacaaggtaaaatgagtatcaaagactcattgtgggggtaattcatgagaggcacagtccttgctcttgttcagatgactgaatatcaaactgacatataccatctcacatacattatttactatgtcctcaatggaagcaattttaaaagaaagtataatgatatacaattgta

SEQ ID NO: 22963 - DNA, 201 bp, Bos taurus
catctgggaactccctccacggagtataggagagtgacagagtgacagttccagtgtctggaacacagaggaaaggaccaaatgaacatcactcatctgttactgtacaaggccttacactgctagttatccagtcatgtgcttacatcttgctctctaattagtctgtaagttccctgagggcaagagtacttcattaac

SEQ ID NO: 22964 - DNA, 201 bp, Bos taurus
tatttaatcacaattgtgtagaatcatatagaattggaattttaaaaatgagtttttctcatgttagccccattcttatctaataggggagtttttctcacgaagcacttaagaattaataaattatattaccatgaattcattctgatgatataataagtatcagatttaacaatcatgaaaacaaaaacaaatttggca

SEQ ID NO: 22965 - DNA, 201 bp, Bos taurus
cataacttcacagaaggaaagtaacccaactctaaagaaaaaagtgtttcttgaaacctgaacatttgagtcacaacaagtatctgacccagttctgcaggcatgaattcttgctgccagcaaaaacagtagactgaaagcagtcatttggactgctgtagaaaaaaaaatcattactcaacaacacaatcacattcccga

SEQ ID NO: 22966 - DNA, 201 bp, Bos taurus
tcgcccctagaacttttgggccccacacgttagtagacagccacctcaggataacccctgcaatttggggaccccacttgttagtggatggtcagacaggcatcacacccacaacttgtggggcccccatgctaatggacaagcaccacaactttccctttcctgtcctgtgtttcctgacatctccatactcacaggagt

SEQ ID NO: 22967 - DNA, 201 bp, Bos taurus
tcaatcctacttttaacatttcagatcaactgttgcttgtctctgtcctcctgctcctgtctggatgggttgccacctggactgtcatcccagaactttagtacctctagtagttttaggtatgacattgcttgtttcccagctttcatgttttcttcttttttgttaggtccatcattttactgggacccattcttcatt

SEQ ID NO: 22968 - DNA, 201 bp, Bos taurus
cgcccctgcccctctcaaagctgaagccaaagcaaaggccaggaaagcagtgttgaaaggcgtccacagccacaaacaaaagaagatctggaggtcaccctgcttccaacggcccaaaacactgcggctcaggaggcagcccaaatatccttggaagagcgcccccaggagaaacaacgctgaccactcaccacccagtca

SEQ ID NO: 22969 - DNA, 201 bp, Bos taurus
gtcacacctgctgtcacagttgtccgcgtctcgcctctagtaaatatcagacatgccggcggtgggtgagggcctaggcagccatgatggcctctcccagaaggacaacatcaatgccagaaacacagtggctttgccaggaagcgaatcccacagtgtgggtgggcgcaggagtgggcctgaggcttctgcctggggagc

SEQ ID NO: 22970 - DNA, 201 bp, Bos taurus
cagctacttaaagagtagccttgataaactaataaatatatgaaaagatcttcaactttgacagtgatcagggaatgccaacaataatcacaaatgagatcgataccatttcacacttagcaaaattactaaaatccaaatgtttggtaataccaaaagttggcagggatgctgaggaacgagaactctgctctattactt

SEQ ID NO: 22971 - DNA, 201 bp, Bos taurus
attctcatgggtgaacatccactgaggttgggccacttactctgcagctcagaaagcagtagcctccccctctgccctcagacagttcagcctaatcactcagatgcacttctaccatcaacactggaaaattctctcagggttattttcagggaaaggagagagaaggctttcatgttttcctgagactactgtggggga

SEQ ID NO: 22972 - DNA, 201 bp, Bos taurus
cttgtgtattttctttgtcaggcctctctatccggagtgtgtgctggaaagcagaccgcctcctagcagggacccaggacagcgagatatttgaagtaatcgtgcgagaacgggacaaaccgatgctgatcctgcagggtcactgtgagggggagctctgggctctggccctgcaccccaagaagccactggccgtgacgg

SEQ ID NO: 22973 - DNA, 201 bp, Bos taurus
ctgatgccttcagttccttccctagaccgcactctatggtgctttatttcagcaattcttttgtgggttacatttatcaatatttaccataccagaaaataaaacagaaaatttcacatttgtttacttattgactcattaaaaaacaaaataaacccattacatgcttataaacaccaaaccaaaaaaaattttattgag

SEQ ID NO: 22974 - DNA, 201 bp, Bos taurus
atctatttgtaggacttaaaatgtaataacttttgtctattaaatagaagattttttgctttatcatttgccttttaatgtttgtggtacttttgatatacagtttaaattgttagcttttaaaaattaaatatatcattcatacaaatgaacatgtaaataccctacatatactgtttgaagaataataaaaataaaaca

SEQ ID NO: 22975 - DNA, 201 bp, Bos taurus
tagcagcacccacggcccctccccaatagatcctagttgcatttccaaactgcgataatcaaaaacgtgtcagatattgccaaactgcctttgactgagagcaactggcctagaccaaagctgttatcttagtcttctcaggcttccataaaaagtaccacagtgtgggtggcttagacaacagaaatgtacattctcata

SEQ ID NO: 22976 - DNA, 201 bp, Bos taurus
cataggtagtaggctcgtaattgttggaggagtcagagaagaggggaattaggcacaaagagtgaaagtacaaagcaaaacttaaacctatattcattttttggaggcctacgtcttaattgacataattgaaaaaaaaatctgagattgtgcaaataacaataggccagtttctctagaaaataaaatgtaaggcaataa

SEQ ID NO: 22977 - DNA, 201 bp, Bos taurus
ctcatttcctaaatcccagcagcctttgtgacttgctttggctattagtaagtggcagaagttatgttgtgcaagttctgtgtcttggcctcattaggactctcatgtttctgtttttctattgtattgttctctgtcattgccacaagtaggacaaggccaggctagtccatcagtcccagcagaggatgaatatcaggt

SEQ ID NO: 22978 - DNA, 201 bp, Bos taurus
gaactatctcttggaaagcagctgaaatcctaacataattaagagatcgttttactagatcctatgaagcaagcatgtggttctagagaaagcagtggattgaatttcagcaagaagaatttagagtaaatataatattttataatggataatatttcaaaatttatagaaattataaagtgtccttcagtggaaatgtta

SEQ ID NO: 22979 - DNA, 201 bp, Bos taurus
gttattagtgagcagcagtgaggggaggctgacttctcctggagtaaagccagttttcccacagctcctaggggaacatggctgtgatccagaggagaacgttccagcacaggtcagtgtttgattttgctcccagcaccattgactgatggcaaaagaggagacattgctgtgatgaggtaatgtgagtggggaaaccac

SEQ ID NO: 22980 - DNA, 201 bp, Bos taurus
agtttccagtctgattagggagaaggcttggagcacaggcagaggacgatcctgctatagatcatacatacaaacagaattggtgggggaatgttctggtatagtcaaagggatattctggaagagagagcatgtgaaccaggtcttggagaaaggaaaaaggaaacacggtaggcagggtggagcagagcagactagagc

SEQ ID NO: 22981 - DNA, 201 bp, Bos taurus
gtgtggaagggtaagattgtaacttggtatggtggatatttaataagtggtaaaccgcaacattctccatttgaaagttaattaaggccactagatgaccaggcttgtgcagaaaacctgttcatggtttagccatggaaacagtcacaacaacactgggctaaaaatagtgaccttaagagacatttttactgatcattc

SEQ ID NO: 22982 - DNA, 201 bp, Bos taurus
gtctgacccaggtaaagtatactttaataaaagacttttgcagagagtgtctgaaactaaagggatgacttaatgatgaaatttcaggtgtgaggaaatattttgtttagatggggagaaacaaattagccaggaaagcagaggatgaatgaaatttagggaacacttctttttataattaaaattttaactataaattac

SEQ ID NO: 22983 - DNA, 201 bp, Bos taurus
aaactccaagacttctaaaataagaagaaccagatgggattaaaaaaaaaaaaagtagcaagaaaattgaactagttgggcttgctaatgtcttaaatctcattgtcttgtgacccctattttattttctttactactcatccctctccaagcttacaacccaaactcaattgggtatgtcaatttcatcctagaaaagtc

SEQ ID NO: 22984 - DNA, 201 bp, Bos taurus
tctatgatgagaagaagccaattttcattttctctgttcttgtttgaagaaccaaaactgttaaagggataaagctctcagaagtgcctgttccaggttacttgtctcaaattgctcatttaaaacaccattatagtacagcaaagccagttaatctactctgaagcttcctttttttatgaccgtagctacatttggtga

SEQ ID NO: 22985 - DNA, 201 bp, Bos taurus
cacacatggtgtaagaatatgggccaccaattctagttttagacatctgagttattttcaattaaaatattgttcaaggcctcaagttggatggaaaagtttatctggttgggcaactgaggacctagaagtacagcaaattgtaattaaagggtcaaggacatgccttgtagatcacattcaatttctctacatggccct

SEQ ID NO: 22986 - DNA, 201 bp, Bos taurus
ctcctccaggaagccttccccaaatatttaagtcctagacatttctcctttctgaaggaaaggagagtttggatagcttagggaccaatgcctgacgtgaacagcattttttcagactgctaacatacccgtgtaaataatttaacatttcccaattccagcatagatgaactggatgtgaataaggagtaaaaagaatgg

SEQ ID NO: 22987 - DNA, 201 bp, Bos taurus
actcctggccatctccccacaagggcttctattccaggaccccactggaaggcaggtgcccctcccccctcatgcaggatgagtggggagctgaatgggcatgcaagatggactgcctgcattattgatttaaaacggccagctgacagtacactgtgcctcctcctatttatttccacaaggtacatctttctctaaact

SEQ ID NO: 22988 - DNA, 201 bp, Bos taurus
gtagcaggcaggacacaaactcgggctgactgaagaacgtggagactttgtggtgattgatccttctgtatttttaccaatttacacaaagcaaagccagcagttctgaagtttcagagtaccaaagaatcaagtgggaagtgtagatgagaagggcatggtcttggctaaattatagattttcatgcaccactctagaaa

SEQ ID NO: 22989 - DNA, 201 bp, Bos taurus
tttttggggggctagcggggaaatatacgggagttgaggcctcggtgcagaagagaagtgttttcatttggctgcagcatttgatctttgaggcccaagaactggagaggggatcttggggcagaaagcaggcttttccctgctcaggagaaggacagggtcttctggccttgccattgtacttgagcctcagagtcccag

SEQ ID NO: 22990 - DNA, 201 bp, Bos taurus
catcccactggtgtcacactggccctatgcccactgcccttctaggggtaatgaccaggcagggagctgaggactctgtgcacaccccactctgggtgatctggtggccagcacagcacctgttctcactggctgcaaactgcagacaccacgggctgggtatgtggggtcagtgaagtctccgcgatggacctgccaagc

SEQ ID NO: 22991 - DNA, 201 bp, Bos taurus
gactcttttgcaaccccctggactgtagcctgccaggctcctctgtccgcgagatttcccaggcaagaatactggagtgggttgccatttccttctccagggagtcttcctgactgagggaataaacctgctctcgtgcactggcaggtggattctttaccactgagccaccagggaagcccaaaataaaataaataaata

SEQ ID NO: 22992 - DNA, 201 bp, Bos taurus
cccagaggagcaccctccagaggcagaaaaacggttcggcctcatcctgttcaccgagtctctgttctgtgacaatggcagaggggtctggcctgaaggttatgtggtgggggcgggggcgggggtgcggtgaggaaggggtgagggtgacagatccctcagacctatgggcctgtgggctgcagagagaagcctggattt

SEQ ID NO: 22993 - DNA, 201 bp, Bos taurus
acagggacccccctgcctttggcacggggagccctgagctcaactgcggccagactccggttcaggggagttactgctatcctcctcaacttctccccacctcccagctcatctctgcctctggcctcaccctcctctctgtcctccacatttgcaggaggtcttcccaaacataaactcaaaggtagtggaaaaccctgc

SEQ ID NO: 22994 - DNA, 201 bp, Bos taurus
acagtgagagtcaggggatgttacaggaggggctggtggaggagaaccaactcggagctgtagagactttacaaataggataatatttgaattggcccatagaaccaataggatgcatgtgtgtgtatatatatatagacagattcattttaatgaattgactcatgtgatcattgggctagcaagcccacgatctgcagg

SEQ ID NO: 22995 - DNA, 201 bp, Bos taurus
agacggccctgaggtccatctcattggcagctctcccaccccagcccctcccaccccagagacaccactagaatctctccttcctccatctacacactaaaaatgtacctttccacggcctatttgtctccagtaattgtaaagtatttgaatgaagactcccagaaacaaattttccatgaaattgaaaaccttttatca

SEQ ID NO: 22996 - DNA, 201 bp, Bos taurus
aaaaggcctctcctggaacctctaattttcttagttccttcttatggatccagcattccagaatttgtctagaattgttaaagcagatgaatctgtgagcgcattgcacctcatagacaggccagcagatgtgaatggagaggtggggctgttctgtgttcctctgtgcccctcgctcgccccgagtgttcacccaaaacc

SEQ ID NO: 22997 - DNA, 201 bp, Bos taurus
acctgaaagttttctcttggccccattcattctttcatcctccatgcctgtgttcatactggtccatctatctaggctactctctccttttctttgtgtgaggaactcttgctcatccttttaggcctgactcaaacatcatacaacttgaccctcagtctccagagcaaatcttgtcacccctcttagctgctcctttca

SEQ ID NO: 22998 - DNA, 201 bp, Bos taurus
gatctctaagcactaatgcagggaaggcagtcgggcatggatcagacaacagtgaagttcaggctgcagctacattcttcccttcccttctgccagtcctcggggttattcagcccacgtggactccctgggtatggctttctttagggagagagggtttccattctgaagtcagttatatcctggccacctcgaaaatgt

SEQ ID NO: 22999 - DNA, 201 bp, Bos taurus
ccagttggactatttccctggccaccagagctaggcagtcaagggacatctctatgtgggctgagtgtaatttctagcattagtagggccacagccgtggcatggtgggatcaggtgtgcctactggcttaacagggaaagagggagtgccaaaatagtgcccaccagtgctgatactagcaaggccaaaagagaactcaa

SEQ ID NO: 23000 - DNA, 201 bp, Bos taurus
gagtcagacaacgcctgaagcaactgaacaacaacaagtctctctgtgtcttcttgctggaggtcctctttttattcctgaagggaaggatggaatgtagaacaacctatgaggcctaggagagcactgactcatggaaagtcgactcgtcagcagtgtgtgggggttggggtctcagagcctgtgaggccagggaaggac

SEQ ID NO: 23001 - DNA, 201 bp, Bos taurus
gggtggaggggggccatgaagtgggcattcccaccatgacggggacacggcagggagatgactgattcaggagactggaaacaggatttgggatgagaaattggagaggagatgggatgctggccttccaggggcctttcctgcaagctctccaaactggctggtctgtggtccctcccaactccacctgcaatcctcacc

SEQ ID NO: 23002 - DNA, 201 bp, Bos taurus
ggccaattcttaaccactgaactaccagggaagtccttctatttatacttataaaaggaagttagctctacaggcttaataaattcatgtgcaatttccgtggccaaagtactttattatagctgcagcatgcctcatgtcacatcacaacaaagctctcagagtctgttgttcctatttcatgatgctaagatcaatcat

SEQ ID NO: 23003 - DNA, 201 bp, Bos taurus
tctgcaaaccagtcaatcttaagggaaatcaaacctgagtattcattgcaaggattggtgctgaagtttaagctctagcaccttggccacttgatgcaaagggccagatcattgggaaagaacttgacgctgggaaagattgagggcaggaggacacggagttgacagatggttggatggcatcattgacccaatagacat

SEQ ID NO: 23004 - DNA, 201 bp, Bos taurus
caatggattttcaacattctaacaatcagcttcacatttaacataaggctatgagaattccaggagaagagccgacctgtgggattgaaaatgtttctaattgaccaggatgtgtgtttgtagtgggagcattttattttctttttcattcatgtacttatttttcatatctgaccattattctcggattgatcaggtcac

SEQ ID NO: 23005 - DNA, 201 bp, Bos taurus
taacagaagagaaaggggtgtccacaggcactgatgacattaaccttgccttgtggacgtgcaaactgttactaaggaggttatgtaatgtgcttaagatcacagagttcatatgaggtagaactatgtcttaaaccgtaagcccaaaacagcagtttttctcatagttttgcacatggcaggttctgtgtaagttttcaa

SEQ ID NO: 23006 - DNA, 201 bp, Bos taurus
cttactgagcgcctactaggtgtccagtgttgcacggatgctgaagagacagcaattaacaaaaagggctgtacttgaactggtggcagctcagacccacggtgctttaggataaaggacagatgaccctgtcttcatgctactcaagaagggccaacctgcaggggttagaagtgcaaatagatgaacatgagagccaaa

SEQ ID NO: 23007 - DNA, 201 bp, Bos taurus
tcatctattttctcatttcaaaataatttctttttggggtactttctaatctctactttcaacatggaaggcacaacagtctctgttttctccagatactctgggttcttgcttccttaatcactcccttctatctacagcaactacaatctcttccatttatccattttgctctgtcctcagattttcatttattcaaca

SEQ ID NO: 23008 - DNA, 201 bp, Bos taurus
ctaatctcataggcaatatgtccttcttactataccccgtagagactatagaaaacatagtttctgaatcttatgtcctaagtgccaccaggtaatcagctcttttaaaaatatcatctactctgaccgctttgtatcctcttaaaaaatatgccctgtttttgattcttaacaactcagggcattcccacagtgaatttc

SEQ ID NO: 23009 - DNA, 201 bp, Bos taurus
actggacccttaataactgtgtcaatagagcagttccctgactcttttctgtttttctctaatatatctatttaaaaaaatactggatgcatttacataggtgccattgataatagcatgtgataatatgtttttcaaaaatgatgaaccttattgaaggatgacaggtaactttacctaattgtacacatatgacatcta

SEQ ID NO: 23010 - DNA, 201 bp, Bos taurus
cagagtacgcttgctatccaacatgcaaatatttttcctcattttctaaaatcattactacatttttcttatacataatgtaatttcccttaacaagagtagctctgcttttattcatctggttgctgtgatgatggaagtatttttcccttgggaggtcatttatatttaagtaggattaataggcttaacagaatctat

SEQ ID NO: 23011 - DNA, 201 bp, Bos taurus
aaccagggtgtgtctgggccaggaagtcttcgagtcaggacgaaggcaaggatctacacaaagaccccaaagcccctctgaactgtctgtctctggagggatcccactggggctttcttagaagggcctggggagtctgtgtattctcggccctactatgtgcacatgagctcatgactgggatcctagagaggatcacag

SEQ ID NO: 23012 - DNA, 201 bp, Bos taurus
gacctggttctcccgggcggcaccaagcgccgccgacccgaggggggcaaccaccccagctagaagaggcggcgcgggccgtaccaagagcaccgtcgagagggggtcagccaggcgcgcgcgggcggaggaacacagccgctcgcgccgccgctctaaagatatgggccgtaccacgcgggaagcgtgcgagggagcggg

SEQ ID NO: 23013 - DNA, 201 bp, Bos taurus
gttattgaagggatgtttcggtatactgatttaagggggaaagtcactttaataaatggatattgttgttgtttagttgccacattatgtctaactctgcgaacccatggactgtatgtagtcctccaggctcttttgtctgtgggatttcccaggcaagaatacgggttgttgttgttcagacaacagaatactgttgct

SEQ ID NO: 23014 - DNA, 201 bp, Bos taurus
agtgggacggagaaggacacctctgaatctcgcgtccccttgtctgagtcctttggcggggggtttgaaggagagagatagacaggtatctatctccgggaaatttccaagtgacagacggccaccctgacggtggcgatgacacctcctcggccttgcaggagagcgcagagtcatccggggtgaggcctgcgtgaagtc

SEQ ID NO: 23015 - DNA, 201 bp, Bos taurus
gtctcatttatctgcactaaaaattcttttaagtaaacatccctcaggtaacaggaacacaagtctgtatcaaatgtggagaacttttctagggtagttagtctaagccatggagcactagaattttagattcttcctaataatttaagcctctactgaaggcaattttttatgatatcaacacattctaggaattaagat

SEQ ID NO: 23016 - DNA, 201 bp, Bos taurus
actgatatatcagctgtggagtgtgagtaaaagaaacacatcaaggaagaatctttaccaaaaaaaaaaaaattatttgactgcactggttcttagttgcggcatgtaagatcttgttccactagcagggatcgaacccaggccccctatattggaagaacagagtcttagccactggaccaccaggaaagtctcaaggaa

SEQ ID NO: 23017 - DNA, 201 bp, Bos taurus
agtgaagtaagttgttcgacatgatagcaaagaacttttcagtgggagtgaatttactttgtcacaggaaagcaaaagtcaccacgttaaaaatcccatgataattgccaatgctggctttccagtccccaaattctgaaaacaaaattattgcaattcccactgggactgtctgcatgctcatttatagcactagatagc

SEQ ID NO: 23018 - DNA, 201 bp, Bos taurus
gttccacttgcctagtccagccctgtatccccctgggggtggccaggcttgaggactaagtggactggcatctagataggccaggcagacaccccaaccccccacccccagaatgtgacccaggggttctggaaagaccctcttagcactctgagcctgctggcagagggggagacacggtcatgggagggcttccaacag

SEQ ID NO: 23019 - DNA, 201 bp, Bos taurus
ggaatgaagaagcaaaaacgagaagcctccactctccatcatgaaaataacagatgccagggcagtggcattcaaagactggtggggtctcaggggctggcttggggtcatggcagaggccagcagagagaaggtggctgagaatgctggtagcacgatgcatctcttgaatcagagtcacaagaatacccatagtttcct

SEQ ID NO: 23020 - DNA, 201 bp, Bos taurus
aatattagtttcaggtatataacagtgattcaatatttttatggattatactctatataaaggtattatgaaaattggcttactctgtgctgtacagtatatccttgcagcttattattttatacagagtagtttgtatctcttaatcacctgcccctatcttgcccctccctccttccctctccccattgatacccacta

SEQ ID NO: 23021 - DNA, 201 bp, Bos taurus
cttgatgcccaggccagatgccatgctaattaaactctctaagagtaagagacccaagcattagggttttatccaacgacctcttccccttgtgattccagtgtccaaccaagtccaaaggcctcagccacaagtccttgctgttcaaggtgtgctccatgagccagcagcattggcaccgccccgtccccgcaccccagg

SEQ ID NO: 23022 - DNA, 201 bp, Bos taurus
taacaagagcactggcctgtggtactttacaaaactccatcattgacttttagataagtcagttaatgtgcttgggattaggtttcctgttttgaagaatgaagactttgaaatcaggaaatttctgaagggtctcttaaagccccaatttttatgcttgtaacagaacttgagtagttgagtcagcattttttggtcctc

SEQ ID NO: 23023 - DNA, 201 bp, Bos taurus
ggttattaaagataggatgtgactagcttgtggacatgcttctgattggttggtggtgaaggaaccctggagtcaacttcatcaagctgctggttccagtcgttctgggatctacatgcttgagggcagcatacagttaacttctacctggtggggatttcagtatctgcaaaatagctcaaaggatatggctcagaatat

SEQ ID NO: 23024 - DNA, 201 bp, Bos taurus
agaagatatatgtgcttccatatccttatgttcatgtgtttttatttctcctcagggtgaatctctgatgatgaataagaaatttattctgggaggatttcctggtgtattacagaataatttctatttctctgggcttccaactgctataacctgggccatcttatttagttagaatgcataagtggttttttagagtcc

SEQ ID NO: 23025 - DNA, 201 bp, Bos taurus
tccactctaaaccactttgtctttcaagattcttagggccatagagtttgcttcttagcaagctaagattgagaaactgtaatgtggagtttctgctcagcgagagcaatatgatgtttttaaaaaatgtcttaatagagctatgaaaatgtcagcacagtcacaaatgcttcctctcattcactcacatgggagatacag

SEQ ID NO: 23026 - DNA, 201 bp, Bos taurus
agcatcttgaaactcttccgccaattggctggccaccatccaaaagaatctctccctagtcatgtcttacctgagccccaccctgctgctgaattggtgagttgggttttcttctcaaagaaagcttctccaccttgttcattactgaactcagagcccccacccctgcctatctggttgttcataagaaagctcaaatcc

SEQ ID NO: 23027 - DNA, 201 bp, Bos taurus
atcttattatcaagtgacatataacattcatataagatcactaaacttgcttgtggtagaatctggatgttctcaacatcttggaaaatattcactaagtgcatttttatttttctccactgtcactcctaccagcatatccagaataaatggaataataaaatttagtgtagtttatgtatcaaatgctgctgctgctgc

SEQ ID NO: 23028 - DNA, 201 bp, Bos taurus
caagataaaattttcaagaagacaacatgtatatacaacccgttccttggcacatttccttaataacagaagccaggaaagagttgaaaacatttctaaatcaggagtgaagagacactggcttaagttctggcatcacactgtccttgctgggtgacaaaaatgagtataactaaagtttataaaaattatgtaaaatta

SEQ ID NO: 23029 - DNA, 201 bp, Bos taurus
ccagtgcttccctgctggctcagctggtaaagaatctgcctgcaatgtgggagacctgggttcgatccctgggttgggaggatcccctggagaagggaacggctatgcactcaagtatcctggcctggagaattatatagactatgttgtccatggggtcacaaagtgtcggcgactgagcgactttcaccttcacacttt

SEQ ID NO: 23030 - DNA, 201 bp, Bos taurus
cacaaaagtacaaaagctgaaacgtgattcttttagaagttgatattagaaattgtagagtcacttctagcacagtatcttgcttatggccaactatggggcaatcctacattcagttcagttcagttcagttgctcagtcctgtccaactctttgtgaccccatgaattgcagcacaccaggcctccctctccatcacca

SEQ ID NO: 23031 - DNA, 201 bp, Bos taurus
ctggaaatttctcaggctgtgtttttgtaccttgctttggtctgtgtgtttgccttaccattctccttaatttcagttccttggataagtattgtggctgttccctctaatttggccagttcagagagctgccagctgggagctggcctggcctcagagtttgactgtggtcctcattactcaacagagcaacccacagaa

SEQ ID NO: 23032 - DNA, 201 bp, Bos taurus
ctagctgctggcaagcaggaaagcagaaatatcagttctataaccagcaggtactgacttctgccaacaacttcatgggcttagaagaggaccctgagctccagaaaggagctcagcctggccaacaccttgacttaagcctcggaatgccctgagaagagatgctcaacaactgacctacagaaacattgatgttgataa

SEQ ID NO: 23033 - DNA, 201 bp, Bos taurus
atagtctatcttttccttacttaactacccggtaaggcaagcagctgactgtatcacaattcacagaaggtaaatcatggttcagcactagaggtaggtaccagggctgcagtaatccaaggaaaaaaacagctagtaaacttcagaacactaaagctttattccactctaaaacatctcccactctgttgggaaatagcc

SEQ ID NO: 23034 - DNA, 201 bp, Bos taurus
agcctaaactctttctgctcctaggattatatatgttcgctatagaaactctcagcttttataagctcaaactaacagtagaacaccaggcacttgccatctagtaagttatttccacctcctctgaagctaattcttgctcatgtcagataaatggtctcatttgtcaataaaaccacaatttgccatggtatataatct

SEQ ID NO: 23035 - DNA, 201 bp, Bos taurus
acaataaagaggacaatgacaaatagaagtcaagattatggggtgattattacaggaaatatagaggatcctatgaaaaactttaagaacattcacacaatctgcctccagcttcacagtacctgagctcttactggttgcatgtgagtatgactctgagagacagcatgggtgtgtgtgtgtacagatgcatgtgtgtgc

SEQ ID NO: 23036 - DNA, 201 bp, Bos taurus
aaaatccaaggtgttttctcattaactatcctccatgattgcagaagaatttgacctgattgcaacagcattcccagtttggattgatcactgtctttttcgcagaatattctattctcctggattcaagattctgtactctgtttgctctctggtcacatttcaaggcatgcctttcctctctgattcatttctatccca

SEQ ID NO: 23037 - DNA, 201 bp, Bos taurus
atatactgaaagagtatgtaatcaatgtggaattttcttcagccagaattctctatttgtacttgttaatggctttaacattataaggtaccaaaaatcatattagagaaaacacttactaatataataaatatgaaaaattagtcaccaacaattttattttgtatcaaagaaattattttggagagaagctctgtaagt

SEQ ID NO: 23038 - DNA, 201 bp, Bos taurus
ggaatcatcattgttggaagctgctgttcctgagtttactataatgaattttcaattagagtttaattgccctacctcactcttgtcagagctgccagatcttaccaaagctgtgttgctgctgatttttcaacccagaggctgtactttgctagtttccaggccaaatataactttgcagtatttcagcagtctctgcct

SEQ ID NO: 23039 - DNA, 201 bp, Bos taurus
tttttggaatatgtactcatgtatgttatggtaatttcaataatgcttaatgaaaatctccatctataacccataaatgatgaaatgcctggcacattataaaccttatctacttcatgcatagagactcattgtgttttttatgttataattggcatcttggaatagattggcaaacacaggtgaaatatcttcacctgt

SEQ ID NO: 23040 - DNA, 201 bp, Bos taurus
tatctttaagcttatcaatagtaaatgaaacatatttgatcaatgtagaaaattccaaaagttatagaaacaaagaaatataataatcatgccctctccagccacaggtaagagttaattattatggaaatgtattgttatagaatcaagaatatgtttgagcatatttgtttgtataatattttcattctatactatttt

SEQ ID NO: 23041 - DNA, 201 bp, Bos taurus
ccaaaatagaaacatataacattacgaattgatgccatttttgaggtcacttttacagttagagcaaaaccatatagaccttaatcttggcacaccaaacgattccagacaaagagggaaaattcctgaaattgttttattttggaaaatcaatggtacttaattaatttattgttgttcagtggcccaggtgtgtccaac

SEQ ID NO: 23042 - DNA, 201 bp, Bos taurus
gttttctgaaagtgtctggaaaccttaataatgagctatatggtctcaaccacatcttttatgcattaagtctcattttcctcatttctaatttagggcctgtaaacacaacatctccaataaacaaagtttacctaattattcatttaaaaatacttattaaacacctgctacatggccatgctgcccttatggaattca

SEQ ID NO: 23043 - DNA, 201 bp, Bos taurus
taaatagaagagacagtttgacctatttagatgtattaaaagtttggtaagatgtaatgagactgattattttacttacagagagcagtccagttattctatggtcaccacatttcactgtatacctgatgaatttaatgccttctgtctagcagttctatctatacagtgagaaatagcgaaaagagaaaaccacaaaca

SEQ ID NO: 23044 - DNA, 201 bp, Bos taurus
tacatgctcccaggacaatggggcactttcaggaatctacagatatatttcttagtagggagagttatcctaccttcctgagacatgagggcaggtactggcagctgctggtggatttcccactaatgacagctatttttcaccctcccaggataatggggacaggttctaggaaatctgatggatttcctagggacagaa

SEQ ID NO: 23045 - DNA, 201 bp, Bos taurus
aatcagagccacttttactaaaagcataaaacaattccaaaacttgcatatatttcaatataagcacctagcatagcaatattttaaacaacacccataatattatgcttttaataaagtaaacaaaaaaactctttggtgtcttatagtaaatccatagtccctttttcttgattatctcaatgtttttttttccctaac

SEQ ID NO: 23046 - DNA, 201 bp, Bos taurus
gtgctggaattgagcttcctcatttgtttgggagcaatttctgggcaatttctgaagggcacagcctgacaaatcctaggtggtatttctacaagttgatgaattagtcaatacaccaggcatgcagcatctaacaatggcccaagctgaatttgaggggaaaacttgcattctgggtcctatacagaaaagtaaacaaga

SEQ ID NO: 23047 - DNA, 201 bp, Bos taurus
gaagtcagaggagtgagcagtagaagtttgggttatataccattttaaattggtctggtcacattcaaatcttggctgtctataataaaatatagtttcattccaacctcataaaccttctttcttccttttgttcttcaaatgtataaacactttatagacagagatatacttgctttcattgcgattattttgatttac

SEQ ID NO: 23048 - DNA, 201 bp, Bos taurus
gatgatttatctctttcgtttatttgtacaaagagaatattttatcacagctctcattaccaccttcaccatgcccattactactacttgtctctaatgacaggctggtaatcaattatcataccctagctgctctcttgtgtgtgctgaatactccagctgccctagaacttcccacatgtctcctgattccctagcccc

SEQ ID NO: 23049 - DNA, 201 bp, Bos taurus
ggataagtaaactatcatttcttatcccttttccagagtgtttcaaagtcagatcctataatgcatatagaattgttttggaatctgcatggaaatgatggagttgaggggcattttgtcctttatctcatgtattgtcatgggttgcagttcatatttgtcatgtataagttttaggtacatattgcatgcctgtgcctc

SEQ ID NO: 23050 - DNA, 201 bp, Bos taurus
tgggaaaaaagccaagagagtagtgcagtgcggcagcagataaagcaacagacaagcgacaggcagtggcagaacacagaaaccaaagaaagcaaccaccgaaataaaggagaatgaaaacagcagcagcaagtggcagagttggcggggggaggccagatatctgttccaatttactgaatcaaccactcagctcagaag

SEQ ID NO: 23051 - DNA, 201 bp, Bos taurus
tcttagtctccctctttcttttattttaaccttttcctgtcattttcaattcttgccatgttaacccacgtccatttcccaagcactagcctctctgtcatttctaggccttcacatgtgcatactcacacacactgcagactctctgaccaactggctgacctgtactcactctttagacctcagattcctttcacaaga

SEQ ID NO: 23052 - DNA, 201 bp, Bos taurus
ggccgaactgcttcctacatctttccacttcctagtttcacagatatctcaaatttacctgttcaaaactgaaaccttgattcccacccggcctctgaatttactcctcttcaagttactcccaatccagtaaatggcattatcttccatgcagctggtcaaaccagaaatctgggcatgagcactcttgacttcttcctt

SEQ ID NO: 23053 - DNA, 201 bp, Bos taurus
ggccgcgaccgcaggtcctggaggctgccccgcgacgccaggcggacccttccggagcctgtataatcgagtcaccttaatttccaggccacggtattttacactcagggctggggagccccagaacccactgtctccccatcaagtgaggaggagcggccgagatactcagcacgagtgtcacggcatgaaagcagatct

SEQ ID NO: 23054 - DNA, 201 bp, Bos taurus
aaagagggagaaaagcacctatgggaaaatatatgacttttagaaaagatatacggccctcaggagaacagatgggagaggtgatatagttttgtgacaatgtctaagagatttcttatccccttgcaacttctgtctgagtgaaagaagtcaatccttcctggtgcaaaagtcttagggagaagattgacagttgagtcc

SEQ ID NO: 23055 - DNA, 201 bp, Bos taurus
attttatatagtgctttatcattctctcttgctctctatgtcatttattctccttaacattaaccttgatagccctttacttataagtgctgaagtgtgtgtttcttaaaaacaagaatgttttcttgcctagccaaggttcagtttaccaaatcaggaaattaaacattgataaaatactattacttaatttatggacct

SEQ ID NO: 23056 - DNA, 201 bp, Bos taurus
ttttgtaggaacattatccataaatctcaaaggttgcttgtcagctactaatgttcaggaagaactctgtgttaattacttacctgatatttctcatccttgtctccagaagttcataggtccaaattaagtggcaaaaatcttccagaagttgttcttacttcaataataagcttatgacttttcatcaagatgcctgta

SEQ ID NO: 23057 - DNA, 201 bp, Bos taurus
ctgccagagtccagagttcaggtgcgcgcgcggggggtttccagggtccggggaggggtgctggggctggctagagagggcctggttgggaagtggtctggtgtgggggcgggcttacaggctgggcagcccctctcagactccccctagcgctgggcccgggcctggcagagagaccaaaattaaaggaactagcttaga

SEQ ID NO: 23058 - DNA, 201 bp, Bos taurus
tgatgtagagccctcttgagtggaattcatgtcctcataacagaggcctagagagagctttcacctcttcaaacctgtgaggacacagaggtgggtgctggctgtgaaccaggatgaggggcctcaccagaacatggccatgctagtgcctcgacctgagacctccagatgatagaaaataaactcctgttgtttatgagc

SEQ ID NO: 23059 - DNA, 201 bp, Bos taurus
aaaactgcctaaaaagtgtcatatattttaggacatacctggtaatgcaaacctatagaaggcaaataaaattctgctttaaagcttcctggttgaaatagtatacattaatacataattttcctaatattgaaataattttttgaatatttttatctagaagaaaaacataaagttacacaaatatctttagcaaattct

SEQ ID NO: 23060 - DNA, 201 bp, Bos taurus
gggacacatatatacctatggccgattctactgatgtatgacaaaaaccatcacgatattgtaaagtaattatcctccaattaaaataaataaataaatttaaaaaaataggccctaacgatgtggagactaacctggacttgtgggcagagtaaaggtcaagttatcttgttgaaatatatcacaccaaagatgtgctga

SEQ ID NO: 23061 - DNA, 201 bp, Bos taurus
gaattctgctagcaatcacactgggccccagacagagcagagaatccttccctattgtaagactgtggggtgtgacctgaactaggcccttaaagggtttggtaaaaggatttgtcaggtgtcctgtatctcctccaaaaatgcactaggtcattaatttggccatatcacatatctcaggcttctatgtattaataacat

SEQ ID NO: 23062 - DNA, 201 bp, Bos taurus
tggaatattctgattttgcaggagtctcagaggcaacacactgtagccgtggttgagtgggcctgttcaacccttgtctggcagggaggggcatctacacttcctgcctgaagataaaccatgatctctcagcaagcgtgtatttccttggggcagagaatggggcttgatggcgattaagtacagtgtgaggaacaaata

SEQ ID NO: 23063 - DNA, 201 bp, Bos taurus
cttttcttttgaaaaatcctctaaaaacacaaacacagtctcttgtgtcttatgactttcagactttcttctccttctcctttgtaagtcatcctagcaagactagttaacaaaatacctgaattttaaaaggcattttaactacatatttgtaaaaattgtttccatagagaatgaggcaagagtttattttctacaatc

SEQ ID NO: 23064 - DNA, 201 bp, Bos taurus
aatcaacagattatccttttcattttcaaatttaaatttgtacttagccttttgaggttagctgttttttgttctttcttattcttttggtggagattaacttgcatttaaaggaagtagagaactatattggtgagtaaatgtagagaagcagttggaattcaagtagaccgaatggtattcagatgacatgatactggt

SEQ ID NO: 23065 - DNA, 201 bp, Bos taurus
taagatataaatttctctaatccttgctagcatcccctctttaaaactagcaagataaaacaactgtcatcaatcatatagtaagtttgaatcctgtcttcgaatcctgttttccattccttttctaagaatagagcagaatgagaaggaaacaaaatgtaaaagtaacaaagctgattttgcaacttaccaaaaaaaaaa

SEQ ID NO: 23066 - DNA, 201 bp, Bos taurus
tcattattgagatcactgtaagcaataatatacatgatatataatattttataacttagctactttaaaaattataattaaactagactctgtcagatgacaaatcttacacagtggagaagtatattattttcattttagctgaaggaaagaagcttaactataccattaaccagaaattagctcttaaaattccaaaag

SEQ ID NO: 23067 - DNA, 201 bp, Bos taurus
actttcgaaaattcctttgcttgagtttcccagatttttgctcagaaattgctactatttattacaaatgtttaaaaaaattcttcatcttaatgcaaacgaccagagcagaaaaactgtgacgtggacaacaggttggaaagcccagatcacttagcttataaatgtttaatgtagtcctggaggacaactgtctgttag

SEQ ID NO: 23068 - DNA, 201 bp, Bos taurus
actgatgctgaagctgaagctccagtgctttggccacctgttgtgaagagctgacacactggaaaatactctgatgctgggaaagactgagggcagaagacgggcctgacaggggagaaaatggttgatggcatcactaactcaatggacataagagtttgagcaaactctgggagatagtcaaggacagggaagcctgga

SEQ ID NO: 23069 - DNA, 201 bp, Bos taurus
cttaaaattcatgcgacctattttctcagctgaaagtgggagggatctgacagcaagttggtttgtgggtaaaagcatgacaccattggtccgggtctgttggcctgactaaccatagctgttacatgttcatattaattcatgtgacctattttctcagctgaaagtgggagggattctgacagcaagttggtttgtggg

SEQ ID NO: 23070 - DNA, 201 bp, Bos taurus
gccagaagtcagtcggggtcatttttggcacagtctttatgggagagaatattttatcctatagagtggtatttcccaaacttgttcaaaccagacccacaattatcaagacagtgatatctgtggagcaaactgacatgaatggatgcccttattggttgctggatgagttcactgggatctggggcttgccaggaccac

SEQ ID NO: 23071 - DNA, 201 bp, Bos taurus
cttcagaaataatcagccatcattaaatattcttttaaaattgtttttaaaaatttaatgttggagatcttcaaccccaacaagccaattaagtctaaaatgtctttattaaagcaacataaggttgtctaccacttgatctattaataaatgctcaataagtgtttcttgaatgaaaaatgacgcaaatggatcaccata

SEQ ID NO: 23072 - DNA, 201 bp, Bos taurus
cattgggttagtaataagattggtgatgagaattatactatcattctaagccagaattctgtttgagggtgactgccaaaggattgtccaagagttttcctttgactgtaaacacaaagatcagaggatttgtagtttttatgtgaaaagtctgatttgtttatgatgtatatcgtgtgtgttttgtttttcctgtcaggt

SEQ ID NO: 23073 - DNA, 201 bp, Bos taurus
aaattgatagcattctaggaaagtgcgtgcaaccccaggtttcttggagaaaagctttctgagggagtgtgtgcatactcttatggtaaaggattggatagtctgtcaattttaataaatcgattttgaatcggtctatggtaacattttctctattaaaaataatcaagctccattttgaggaatgagaacagttgaagg

SEQ ID NO: 23074 - DNA, 201 bp, Bos taurus
ccagggaagaaaggggtaacctctcttgggtggtcagagggagtgagtcaagaatgcgaaatcaccacggcagtgggacaattctggagaatgggaagagaaagcaggcctggaaaaataatgtgcatttgaggatctgtgagtggtttggataggccaggttgtgggtgcaccttgatgaggtgtggagtgtagagagtg

SEQ ID NO: 23075 - DNA, 201 bp, Bos taurus
aaacagtttcaaacacagagggagttgcaacaatagtgtggtgagcccacatacccgtcacctaaattcaccagatgttaactgacatttgccacattctctcttgcacacaaatgttcacagtatttgtaatagcacaaacctgtaaacaactcgatgtttatcaacaagtgagtggataaaaaattttggtatatgtac

SEQ ID NO: 23076 - DNA, 201 bp, Bos taurus
gctatcagctagaactttaaaacatcaaaacacagattatataaaattccaaggaaatgataggattgcaaaaacaggcttcgtctagagtatgaacttatgatttggagactgtgggttactaaggggtccagagacaagcctagaggcgtggggccctctgaaattgtgcacagttctcaaagaggtgatgacttctaa

SEQ ID NO: 23077 - DNA, 201 bp, Bos taurus
tgactttctttggaagtaggattgttgcagatgtaattaatgaagataaggtcatgttggggttgagtgggctcttaattcaatatgcccagtggccttacaggaaaatgatgtgaagacacagaggggaaattactatgtgattacagaaagagagagattagttacattgttacaaactaaagaagaccaaggatcagt

SEQ ID NO: 23078 - DNA, 201 bp, Bos taurus
gggattttggagtgaggagacactgggccatggaatgagcattactgacagcaattttgtgactgtaacagtccagggtattgctggaaatcatcaagacggcaaatgaaaggccccagagaataccatggcagcaatgagcccacccacttcccaattctatcaagaactaccagagaaaagtgttctgcatccagcatc

SEQ ID NO: 23079 - DNA, 201 bp, Bos taurus
cgaagagagccaaatactttaagcaagttatgggatataacataggaacaataatatgtgtctggaaaaaggtctaaaattcatgagttacgcttaaaataacaaacccactgcaaacattatcctcaatggtgaaaaattgaaagcatttcctctaaagtcaggaacaagacaagggtgcccactttcaccattactatt

SEQ ID NO: 23080 - DNA, 201 bp, Bos taurus
gtacagtgattcaccactctgctccattaaaaacaaaaaaaagcaatgatacataaacaaagagacaaacttgggctcaaaaaccaaataaaaatctctctgaatcagaaaagaatggagatgctaagcagttaatagggctgaagctacagattcactgggattgtgtcaaaagtatgttgctgctgctgctgctgctaa

SEQ ID NO: 23081 - DNA, 201 bp, Bos taurus
tcagccttcaaagaactgaagagagttagggcctttgctctggattagaacattcacaccttggctactatttgatgcaagatgcctaacttttggcccacctaggctttcaacatgccttcctcactaaatgtaaacattcttggtttttttatttaaagtgagagacttgtgactcttccttagaggccactgtagggc

SEQ ID NO: 23082 - DNA, 201 bp, Bos taurus
ctctgcttgggtgagggggctggacagctgcctgattcaaatgtcccctcctccaccccccaccccagctccagagggtggaggacttagatcacgggccagctgatgggataatgagtttatacaaagacagctctgaaaggacttaacgtttagcttgcaaatggatgtggccgtcacatcacactgtgccttcagtgc

SEQ ID NO: 23083 - DNA, 201 bp, Bos taurus
aaagcttaagatattctcaaagtgagagggtttatttgaattcttaaattaagctactgatccagtttccatttttacagtctgtgattgtggctaattggggatagccaaaattgcatctcattgtttttagatgaaatttctttgattactggtgagagtaagcactttaaaatacatttttattgttattggcatttt

SEQ ID NO: 23084 - DNA, 201 bp, Bos taurus
tgtaagataatctccctcttgagcgagctccagactgctcggacacatagatacctaggcatagttaaaccctacaaatggccaatatgcatattaaaaaataacttcagtttcactactaataagaagttgtttgtttaattggcaatgattcaaaagaaaacatgccaactgttagcaaggccatgatgaaactggagc

SEQ ID NO: 23085 - DNA, 201 bp, Bos taurus
atgatctccaattcctactagactataagcaccttgaaggaagggctttgtctatttccctcacttttagggcattgctgccaagaacagagcctggaatataaacaggtgatcttggagatttttgtggtatatctggggactctcctgtggcctgctaacttttctccaccccagtgaaattcgtgagtaaaaataaga

SEQ ID NO: 23086 - DNA, 201 bp, Bos taurus
agagaagtaaccattaaattgggaatgtggtgatcattgagggccttgaaataggcagtttcagtggaattgttgagtcaaaagtcactgcaaaatgagctaaaaggtgaggggtttcaattttaaattgagagggaaagacattttagccccttttcttgcaaaaagcacccacaatcaggagaaggtgagacaaaacca

SEQ ID NO: 23087 - DNA, 201 bp, Bos taurus
ccaatatagactctttttaaaatttcctaattaaatagttttgcagattagcctgtgtgtaattaggagaataggcccaatgttggattggccctgcctacgttagtgtagctcctctttaggaaatgcatcctttgcctaagcacagttttcttctgctaccacaatgacggcctcagatgtatatagctcagttcagtc

SEQ ID NO: 23088 - DNA, 201 bp, Bos taurus
gaagaaaaccaaaaggtatattctggacaccttaacacagaggtactagggaaatagtcatgtatagacccaggaaacttacctggaacctgctggccaatctcatcagctgatctcatagtaactaagcagtgagggcttccagagaaatcttgcaacaactccaggccaagggatgggtggatagatatgggtcatgtc

SEQ ID NO: 23089 - DNA, 201 bp, Bos taurus
tgcagcaacaacccacagcaggtagagaaagccacagagcagtgtcagcgcaatcacgctggagaacaaggcttctctaagcagactgtttctgggtgccagctgttggcaggctggagggaccaggcgaaggctgtctgatggactgctgggcgcagagctgtggcctgctcacgctgcagagcctttttgatacccagc

SEQ ID NO: 23090 - DNA, 201 bp, Bos taurus
ttcttagcctagaatcctcagagtcagccagtaccgcctctcagtcaccattcagctgtgggaaagctacctggcctctgtctcctctctcataacatgacagataggaccaacccaacacacattaatgagaattaaatgagatagtgtagcgagagcactggccaacccagagctagggcatatttaccgtgaggatta

SEQ ID NO: 23091 - DNA, 201 bp, Bos taurus
ataatatcttcttattttccttctattgattctgtattacacagtgaaagtgaaagaagatctttaatgtaatcatcccaggacttcacccaaccaaatgcccttgggggaaagttcctgcctcctcagaacaaggtgacaaaagtaggatttattctttgtgtatctgatgaggtggatcttacctgctcagaaggctgg

SEQ ID NO: 23092 - DNA, 201 bp, Bos taurus
tctaaggtcgcgtgatccccccaacacctcgatgtgctgaacctggacagatgtccctgtaggacagacgtacctcctgtcttcccacagtgcaggaggccgccacatccctcttcagtggcggtggtcctcagtccagtagccttccggcatcttgtgttgctctgtgccttgttggactctagagagacgatccacgac

SEQ ID NO: 23093 - DNA, 201 bp, Bos taurus
ggggaaacaggtctgtgagaaggaggacttatccaggatcacacagctaagtagaggcgggcaggggccaagatccccagactcctgctattaggtcctcagtctcaagtatcccacaggctggggtcatggaaacagctttggactggatgctaggggaatctggcgctagacttgagtcactacttgatgatgtgacct

SEQ ID NO: 23094 - DNA, 201 bp, Bos taurus
cgccctgtcagacctgcagcgacagtggatccctcccgctttctcttcggcctcaccctttacaggttcaggggctcaggagaagagaagtggcctcatccgagaagagcatccaggtctgatgaaaagtcatctttccccccaggtggggctgcttgctaagccccaggcccaggtgcggttccttaagaccacccattt

SEQ ID NO: 23095 - DNA, 201 bp, Bos taurus
tttttcaagaacctacgacacatggaggagggaagcagagtgatgagtggtaggcatgtcttttgaaaatctttccacgagattctgatatcctctcccacccccaacatgagactctttagtttaggtctgaacacaagagaattgggttggaatggaggagtatatggtgttccgggagaaggcagaagttctagataa

SEQ ID NO: 23096 - DNA, 201 bp, Bos taurus
ttaacatcctcatttagttactctgtgagggtgccagcatccataataatgaaattactttgattatcttccatagagtgtccgtgggcagttagcagctccgtaaggagcacagtacagattttctgccagtttatacttagggttggagaaggcaatggcaccccactccagtactcttgcctggaaaatcccacggac

SEQ ID NO: 23097 - DNA, 201 bp, Bos taurus
tcctcttggctcctctcctccagtgaggcccagcccatccacaggccgctgaggacctgtgttaggtccatggaaagagtccagaggccaaggcagcttaacacaaggaagagatgatcagaaaagaaatgcaaagcattcaggagcacaagagaacaggcccaacaagcagtgagcatcaacgctacctccagaagcgtg

SEQ ID NO: 23098 - DNA, 201 bp, Bos taurus
cattccccacattggaactactctcccaggtgggtggggctgaggcccattccagtaatggagcacatcttcctagaatcagggtgaaggcctcagcaagtgggggcaggacactctgagagccagatccacgctcactgcccacgcccgggggatcatggctccggatcacaggagctggagcagcaggtggctaatcag

SEQ ID NO: 23099 - DNA, 201 bp, Bos taurus
catgtgactgaggccattgtggactgtccagtgggtccagagccctggtcagcaccatgtgaagcagaagaaatgcctgggcaatgcacagaaccacgagtgagagtacatgttgttactgtaagtctctagggcttaggagatttgttacccagcaatagaaaacccaagcatggtcccctgaaatgccagggaaaattc

SEQ ID NO: 23100 - DNA, 201 bp, Bos taurus
ctatcagcagcaaaaacatagctttatgttcaattttctcatctttatggtcttttctcagtgctttcactagcatttgcttaataataaaaagcacagatctgacattaactaaaatgtgggtttaaatgctttagcatatcagatactgttgagttttggaaacatagtactacatttaaataacttctatttttttat

SEQ ID NO: 23101 - DNA, 201 bp, Bos taurus
tggaaatccttttgagaaagaaactgggtagataacaaccaaccagtcccctaacagagttttcacactaatagcctactattggagttggccccaaatcactcttgttcccaaatttatgctattcctttcttttgtatttttagttttttatttatatgatcagttcagttcagtggctcagttgtatccgactctttg

SEQ ID NO: 23102 - DNA, 201 bp, Bos taurus
aataaaaaaagtcacatagaaaggtcagagtgcaatgacacttaatgtacagaatattccaacagttggtctgccttttcttcctggcctcctcgaacacactgttgggtaggaagggtcatcaaaatgcaatcctgggggaggttcaccaattaagataaatgtagtgttatggctcctgctggccactgttcatccccc

SEQ ID NO: 23103 - DNA, 201 bp, Bos taurus
tgaccacccattgatgaaaatcatctactgttaatgtactgctatttctcacttaggtctcttaatatttttttatacatttaggtgttcctatgttggatccataaatatttacatatgttatatcctgttgttggactgaccccttcatcattatataatgaccctgtcttttatcaaagactgtcttaaagcctattt

SEQ ID NO: 23104 - DNA, 201 bp, Bos taurus
atttggacagtgaaggcaaaatctgagctcagatctcaacctccagaaggaatggggtaggcggcagctcccctccccacatccaacacttggggtattcaggtttcaatgatggcaagaggaaccttaagaccttctgtaagaaggcaagcagaccccacactcttcccacttctggggccccaagtctaaagccaaatt

SEQ ID NO: 23105 - DNA, 201 bp, Bos taurus
acatgcagaaactactcgtgtggaggcttgatggaggggtccaagtgggaaggaagcccccactgcagtggtattgcttctgtcccgctgagtaggggcccagcctggctattcttcttggggatcttgaagccatgcaggctgacccacatcccagcgagccatgagcagtcagacgctccccaggccgtccttgattgc

SEQ ID NO: 23106 - DNA, 201 bp, Bos taurus
atcttttctctttaaaaacaggtaagaaagaaaacccagaaagacgttagggtctaggttaaggccatggtcaacagaaggccttggccacccagatccagatccactccagccccctggtgactcagccctgggcagacagtgaggagggaggaacgggcctgggaagcaagaaccgtgtaggctggggaagggctcagg

SEQ ID NO: 23107 - DNA, 201 bp, Bos taurus
ttaatctctcaggggacaataaccctgatgggccttgacacacatcttggtgagttttgagtggtcaggggaacacagcttccaacggccttgcgagtctcacccatttggtacctggaggtaggaaggaaggggccttctgcaggagggcacagcaagcctcagggtgaaggaatttccactctgttttgagaatgcagt

SEQ ID NO: 23108 - DNA, 201 bp, Bos taurus
ctccagtattcttgcctggagaatcccatggacagaggaatctggcaggctactgtccatggggtcgcaagggtaagacatgacttagcgactaaactaccaccattaatccaggttggggactgacgattttaactgagagtcttcagtctagaggaccccagagaatcccctgagttcagtctagtctcctgatcccag

SEQ ID NO: 23109 - DNA, 201 bp, Bos taurus
gtcttgtggctatgaatgcgagggccgtagtgatgagtgtgccaggaatttcacccatgttctccacctagatgtttttctatagcgcttttatgatgccagtattgtcaccttgaaatcctgaagaaatcaaatattccagggagtgaaattcctacacttctgtcgtcattgtacgtaggatgatttaccttggtcatg

SEQ ID NO: 23110 - DNA, 201 bp, Bos taurus
cccagtgaggccctggtgatgggctcatatccgggcagctctctggagctccttgacgcacactgggatctccccagggcaagtgagagcagcatccatgagtaagcgcctgtgtttgcccacaccaaatttatgctcctatctcccagggacccctgtgtcgttcctaacagatgtatttgctcatggcagaaatagaaa

SEQ ID NO: 23111 - DNA, 201 bp, Bos taurus
tcctctgaatctttcctgtgcttcctgatctcaaggcaatggaagtagtcagaacccataaggaaaagctgaaggggaaataagagtaggggccagtggaagttcatgggtgtggttcacagtaaattctttttcctgctacaggatttgttttcagtctcatctgctttctttctaggtcctagcctcatggcctgcaca

SEQ ID NO: 23112 - DNA, 201 bp, Bos taurus
gccttttcgtcttcttcccgtatttaattcagctgagaccataggacttagctgtctccaccaccatctgtgtgagcctggccccgtgccacatgttagaagtgatacaaaaacaaacatgagcgagacttactcttcctctctttgagttcactggccagagaaacagttctgtaggcagttcaacccattgcacaaaga

SEQ ID NO: 23113 - DNA, 201 bp, Bos taurus
tgatcccatttaattaagattttcagactctcattaaatagagtttgttttggtaatttcctgaaagagagcatttgatagctccacctttgccatggatgcacttacctactaccacctggtggtagcaaaaatattacaaaataaaggaaaagaggaaaaactgagactttcttatttcactgctcccaaggactggtc

SEQ ID NO: 23114 - DNA, 201 bp, Bos taurus
aaaaaagaaaaaagaaagaaaaaaaatattcagatcgtggatgggctggctttttagtcattgtgggctgctataacaacatcttgagactgggaggctttaaaaataaacatttatttctctcagtctggaggctgagaagccaagatcaaggtactggcagatccagctctgagtgagagctctctttccgacctgcag

SEQ ID NO: 23115 - DNA, 201 bp, Bos taurus
ctctggatacctctgagtatgtagctcagcctaggactccttggtccttctgcagagtattcattttcatctttcaccctgagtggagaaaggaagcctgtgatgccctgctgcgccatgccctctgggcctgtaggctccttctgtggccctctgtttccgtttttctctccaactgtctctttcccctctttggccccc

SEQ ID NO: 23116 - DNA, 201 bp, Bos taurus
acaattctgtctctgtctcataaaatgacagatcagtaaacgagcagaaaatccaatgaaataatgtttaatacctagtaaggtgactgggacagagaacactttgaggaagtgtctcccatctcctgaatcatctaccgttatccccgttttacagattgggaaacagcttccaacaggttaagtgagctgcccagggtc

SEQ ID NO: 23117 - DNA, 201 bp, Bos taurus
tccatctttcaagacacacacacacacaaacacacacacacatgtacttgtctgcctggtgaatccctacccatcttttgtctgcttattgaatccctacccaactttcaggacacacacacacacacatacacacatacacacatacacatgtacttgtctgcctggtgaattcctacccatctttcaagacacaggttg

SEQ ID NO: 23118 - DNA, 201 bp, Bos taurus
agattccattgctgggaaacgacgtggggtattatcagttagatagtttccaaggaggtcatggattttccgagctttaatgacaagtctgccttcactcatgcgccccccacctccccacactgtcctccctgggggaggcttctggggggaaccaagagggttgcagaggaaagcactttggaatcgggccaaacagct

SEQ ID NO: 23119 - DNA, 201 bp, Bos taurus
ctgagctacttctgtgtgccctgggaggcccctggcctcatggagcttagattctaggcagctagagagggaaacatgaattcattttacaaatgcatgtgagataagaatatggaaacgtgtggccaggggatctttcctgggctcatttcaagactctatgattagcaggatcctgggaaaagcctgggtgactgcaat

SEQ ID NO: 23120 - DNA, 201 bp, Bos taurus
tgtttaaaaaaatgtagcctaagaaagtgaggcaaaaacggtatgaacaaggtgaacatgtttaccacagtacagagttcataaataccatcataaatcattgaacaaatgcttgggagcaagtcccagactaagtgaaattcgctggttccaacttttgaggaagaaactggagaaacaagtgaactacacaaaaccata

SEQ ID NO: 23121 - DNA, 201 bp, Bos taurus
cctgtcctcacctctcctcccctcaccaccaaacatacaggagaacacgctctctttgttgtgaagggaaggagaatatggagctgaaggtgagcatgaagaggaaggagcagagaaaggcagctcccatttgattaaatttacttgtttttcaacagtactgcatgtttaaagaagagggcccctgggtttaaaccctga

SEQ ID NO: 23122 - DNA, 201 bp, Bos taurus
aagctccctacagagaactccaccgccataaacagataaattgggcattccaaatctaaccatccttgagatgaggagtggcccatagaatgagtaggaagtattttcagactttcagttcaatattgtctttctcagaaggcatttgggtgtggctaaggcaggcctctcccaaaagcttccatccagagcccatctgaa

SEQ ID NO: 23123 - DNA, 201 bp, Bos taurus
ccttccttgatcccacccacctaaacaaatccgggctcctggagccttttgttcatcattctccattccacaaacattcatccattcagccagcagacacattttgagcccttaatataggcagtgctctaagttctagaataatagctatgtctgtgttgtacttaagcagcactctgtcatttacaaagtaatttctct

SEQ ID NO: 23124 - DNA, 201 bp, Bos taurus
cagcctctgggctatgaatagatgaggctggggccccggaggagtctaatgactcaacagctagagaggttaagctttcccagaaaagtgtttccgtttgcgtttgatgaacttagggcccaacaaaggaagggtttcctgtctggaagactagggatgaaggagctggaggaacccttgcagttcctggaggctgtgact

SEQ ID NO: 23125 - DNA, 201 bp, Bos taurus
ccttgattatcccagtgggagcagacgggagggctcactctgcctgagtgcctcaggacccctgcagtcctccagagagaggtgggtgggcccagcaggggactgacattgctttttgttggtgctgacacctggggtgagcatcccacaggtccctcagaccccaagctgtgtgaccctcaggcactgtccagctgaggc

SEQ ID NO: 23126 - DNA, 201 bp, Bos taurus
gctgtatgccacaatctgagatgaaagcacaatttttaaaaatttgggtaaaattcacaaaacaaaaagtgaacccttttaaagtgcaaaattcagtagcgctcaatacattcacaatgttttgcaactaaagcagaaccccaaaggaaacccacatcctggtcatcaatcagtcactttctattcctgtccccccaccca

SEQ ID NO: 23127 - DNA, 201 bp, Bos taurus
agaagagtgtccctccagcagggcctgcccacattgcaagaagcaaaaagcagacagtgtgaaaaagcagctgagcaggctgggtcctgaaagcagaaactcagctggccagggacagcttcttaaaaagttctaaatgaggggtggcgattacattctctaaatcagaccctcagcctctggaggggtggctctgttact

SEQ ID NO: 23128 - DNA, 201 bp, Bos taurus
attgaagctgaaccctgctacttaatggctatgcaatttggcctctgtttcctgaatctgaaaaattcctaatgggaattaaacaatcagtttaaatttacggaccaatttaaacaataccccacaaaagcactatcaccacacaatttagtgtgcaatttaatgcaatcattataatgttttttttttctctcattttat

SEQ ID NO: 23129 - DNA, 201 bp, Bos taurus
catgagtatgtctgtaaccctcctctcttctcacctttgctagccctgaatactgctagccctagggtctggtttttttttttttttttaaagtaagtctataaggagaaacaaaataaaaatttgcattttctcgattgattagtaatgttaacatctattagccagttttatttcctctttggaaattgtctatttaaa

SEQ ID NO: 23130 - DNA, 201 bp, Bos taurus
tcagatacgactcagcaactaaacaacagcaatgcctgtattatacttgaatcaaagcaagggtgcacttaaaagttattttgtaatcatatttttctgttacatttttatgaatctgtaccaaccttatataataatgtagaaactatataacaggaaagcaaaaatgaaaaaataaaaacatcacccacataccaccat

SEQ ID NO: 23131 - DNA, 201 bp, Bos taurus
gcttctctggggaccacctgaggaccccagtcagaccagtagctcagccagggccagcagctctgggctgagggggcgatagagcccaggcctctgcacataccccaagaccccctgccctggatgatgccagaacaacgtgtcagtaacaccccaagaagggccactcatgactcccaaacacacctccaagggatgttc

SEQ ID NO: 23132 - DNA, 201 bp, Bos taurus
ccaattataatgttttcccagtggaaaaaggtgatttcttttctgattgctttttcaaatggttcccaggatagctttgtaaagagtgtgggtattggtgtgcaagtctgatcctagtgtcccaggaaggagtgaaaagagcctctgcaagcttgaggtctcctgaaaggatctgagtttccctgtgctctttgctgtatt

SEQ ID NO: 23133 - DNA, 201 bp, Bos taurus
tagctgctgaggcctccggactcaccttggctgggagagccctaaggtgggacctagactttggtgatggggaggctagatggaaaactggagactgaaaatgaaaagtggcccacatttaatgcagcacaggggatagacttctgccactctcttccagcccactgcctgttccttgactcccagggctcttaagtgaac

SEQ ID NO: 23134 - DNA, 201 bp, Bos taurus
taggattgtctgtggcctgaatgaggggtctgtccatggctaggcttggaaggatggctatctgtggctgaaataggggcctcagtcaatgaccaggactggggggatgttcaattcacagctgagtttcaatactcattctggggtgggaattagagtgtaggatgttgtgaagtcctattagggagatgcaagaaggaa

SEQ ID NO: 23135 - DNA, 201 bp, Bos taurus
cccacctgcttcacataaaaggcagtacattgtacacgttaaaaggataaactctggtggtgtgctgcccaagcacatgttggggctctgccactccctcgctgagggcctttggataggttacttaacctctctgaacttcagtttcctgaccagaatgtgaagaacaatagagtgtatccactattgttccttatttta

SEQ ID NO: 23136 - DNA, 201 bp, Bos taurus
gttatgttacagaggagttagaagtttgtacacgaaatggtaaaagcacaaaggactctgatctattctgaaaatggagtcatgaaaatttcaagtcttgtgttatccttgaggatccaggtctcagaggaggaatgggaagtgtgagtggctgatcacagctaaaagctgccttggatgccctttttaatatttttaagc

SEQ ID NO: 23137 - DNA, 201 bp, Bos taurus
ctccagagactttgcattcacactttcacttaaagatatcaaaagatagaattgtagaacatgcaacataaatgtggcttttgtggaaaaagaaaaaaaggaactgtgtggaatgcttatcagagggaaaagaccttggccctacatcataagcatagctaaaaaatgcacatttatatatcttaggttaaaataatatgt

SEQ ID NO: 23138 - DNA, 201 bp, Bos taurus
attttgagactatggcaaagcttcacatgtgaaccctcattgaattgttaacaataagtcctatggaacaataatataattatccatttattaatagaaagcaacagaaaggatgttaagtaacttggaaagtgtcacacaattaggaaatgacacaatcatgattagaacaattgagtttttgtctgcagtgtcttaatt

SEQ ID NO: 23139 - DNA, 201 bp, Bos taurus
ttcagaggaaagaattagctgaagaaaggtttcattagaattctaaatatgaggactttccattataaagacagcgcttctgaatctcatcttcctaagatctgtgaggagagaaatttgagacggactctgggcactctctgtggaatcttatgcagggagctcatttccacatgcacggataggaggcgtgtgcgaccc

SEQ ID NO: 23140 - DNA, 201 bp, Bos taurus
gatcatgtaggctttgttcatgatacttcctcagcacctagaaagaaactgcacaagagttcctcaataagatattaaaaataataattaatggaaggatcgatgggtgaataggtgagtgcacagatgaatagataaaggcatccctgaccagtcttcatatgtgaatacactgctttccatcactgcctttcttttttc

SEQ ID NO: 23141 - DNA, 201 bp, Bos taurus
tttgtgggaggtggtcaaagagaagcagaaataacatttcctgaatggttgctcttagtattgtcacagaaatgacatttcatataagggtagcacatttgaagaataaattataaataagattaaatgaaatagcagtgaggaaactcaggaggattagaacaccatagaaagaaaaatgctgggagagaaaatgaaaaa

SEQ ID NO: 23142 - DNA, 201 bp, Bos taurus
atcttcttgcatcaaacctgtgtctcctgcattggcaggcagattctttacctctgaaccaccagggaatccctagaacttttctgatttctattctttcgtccttatggatatccgcaccattacaattgcaaatgcaatgattactttttatttaccaattctcactgggctgtagttaagaaatagtttccagggaaa

SEQ ID NO: 23143 - DNA, 201 bp, Bos taurus
gattggcaggcatgtacaagctgagaagtagcatttcctctttcccagacttgttctgccctttatttgaaggcggcagcagttcaaactaaaattcttgcaagtaatagatcttaatgtggattcaattccatatcggtggcagatccgtacattatagataacaggtaagttataaaggacttcttggctgtctacagt

SEQ ID NO: 23144 - DNA, 201 bp, Bos taurus
tggtgggctgtaaacacagtctctactttccaggctgtgtgcttgacactgaggattagaggtaaatatgagagagccattactttaaggaaaatactttcgcagagggatgacagaagcaaggaagtataatacaatctgataaggactatgacagaggaggtaccagcaccatgaaagtacgaaagacgatggctacct

SEQ ID NO: 23145 - DNA, 201 bp, Bos taurus
gcttcaggcaaccagaagcttctctggccctcacagcaaagtggtgcagtttgtaagaggcatgctactatttccacgtgatagatgagattacagagatgtgaaaaggatatgcccattcactgagcacaacttctgggaacaaactatgtaacaggcattactctaagttcttcagatacagtcatggccaaaacagtg

SEQ ID NO: 23146 - DNA, 201 bp, Bos taurus
ctcaggcatcccattcaaccttctcaactagatgcttcatgaagtgttgctgagaccaattgcatcagatcgctgctaaaatacagatgtctgggccctgccacagacctactaaaccagaatcttcaaaggcagtgctcaaggactctgcatttgttttaaaactccctaggtaatccttagaaacaatgaggttggcaa

SEQ ID NO: 23147 - DNA, 201 bp, Bos taurus
tttttgaaaaccagaatccactgcatgcctgccacagatcctgatgttgacccaggtattgaatatggatttattattggggcatttttattatgctttaactgtatacattttttaaagacaagctttctttttaattcaataaatgtaatgcttaaaaatgaaagacctttcataaaatgaactcaggttaaaccaggt

SEQ ID NO: 23148 - DNA, 201 bp, Bos taurus
aaatgagttccctggcctcagacacctccccttctcagccttccccaccacccaccactgctgccagccagacataactccccccacccaacccctgtatcgcccagatttgcgatggccatttggatggctgacgtgaagcctccgctctcacacgttctctgtcctttctccagaaaggtcagttagcactgcatcctc

SEQ ID NO: 23149 - DNA, 201 bp, Bos taurus
tacagagtcaagttccagatccttggacccttactttccaactattttatgtctatgatacccatagctcacatctcaaagagagtatctattaggcccagtgtcttctctaactggatactcacccattatcccgaattcctatgatgcttgtacatgatcttacttctttgatcaaaagaacaatccgtctaagttggg

SEQ ID NO: 23150 - DNA, 201 bp, Bos taurus
gtgcggcggggtgggggagggtcctgggagcagtgcctgcatcatctggtggctggttagacatgcagactctcaggccttgctggatcagcatctgtgtgttgacaagatcaccgggggaactgggaaggcacatcacagttccggaagtttggtctggggtataggtgggcagactacacccatgggccaaagcctacc

SEQ ID NO: 23151 - DNA, 201 bp, Bos taurus
cctatgcaagggggccgtggggtcctcaaatctcaggctacactgtgggctaaactttagagcagccaagaaggcctcttggaggaggcctcttgagtctctttcctgaagctgcaaacttgggacaccatcccactggtgtggaagagccactggagggaggcccaactcacccctccctctctccaccacctccccccg

SEQ ID NO: 23152 - DNA, 201 bp, Bos taurus
ctcgttcaaatgaccaaatctgcttccctcacattggattacctccactacaatgcctagtgttttttgtttgtttgtttttcagatctaagaaacttaactgtcaataagtaaacaatttttccacagtggaatctcacaagagaaagtaaggttttattttttttttcttttggatcatttgtttagggctccattctt

SEQ ID NO: 23153 - DNA, 201 bp, Bos taurus
ctggggatctcctggagtgaccagactcagggggcaggttaggggggcccatccctccagaccatccaagaccctgtagcttaggacgtggggttgcaacatggagagctgtagcaggtgcctggccaaccaaatcttttgactttctattgctccctctgaagatagaaagagtgaccaggaagggaagactgaggagag

SEQ ID NO: 23154 - DNA, 201 bp, Bos taurus
tccctcaattgtttatctacctttccttcttaccgatatcaaataagtcttcatgtgtcttaaaaattattgtagtttatcaaaaatttaccaagaacttatattatttcactgtttatgccctaaataatgtactttaagtaaaataggatcaggaaactaactcttaaaatataggcagatgtgcttcgtgagaaacct

SEQ ID NO: 23155 - DNA, 201 bp, Bos taurus
cctgactcttcttagctgggtttccgcacttggaaccaggttgggaatgtcctctctctatcaaaattgctggaacttgtgaatattactttacctggccaaaaaaaaaaaaaaatggagatacgtcttctgcagatttggagatgcgattcagttaagctttttgagatggggagcttatcctggatcatccacgtaggc

SEQ ID NO: 23156 - DNA, 201 bp, Bos taurus
gacagaagcacgatctcagggtgagagcagcagaagcaccctcttccccgcctgtctgttccgggggcccctcctgttttgggccgtacccatcacccctcggcaggtcccagcttgacttggttcctggtgagttgataaatcgtggtgcctgtcaggctggaaatgctgatgctgtcccgaggcaccgacggggcccct

SEQ ID NO: 23157 - DNA, 201 bp, Bos taurus
tccttattacttgagggtgagaagttaatttcaagaccctgcagagattaacagactcctagtgaagagagggaccaaggccaaggtcaggacaggacactggctcctggactctgggactgaccgccccatctcctttagatcaggctcacccccagtctgtacaatgtatctggtgaattggacagtgctccctgtttg

SEQ ID NO: 23158 - DNA, 201 bp, Bos taurus
tctgctctggggttccccagggccaggaacacttctcaggtgagcactatctctgcttccttcttgcctctctcacggggcctacctgaggctgcacacagagaggggcaaagaaagaaggagctggaagagcccagagcggcttctgccctggaatagagatggctgggcctggggaggaggatggctctggccctggct

SEQ ID NO: 23159 - DNA, 201 bp, Bos taurus
ccatcagtgtcaggtagattgatggcacatgtccatctcaagcctgtgtcccccttctatgctttgggttcctatgacatcagagcttcctgccccaatggcagtctacagggcctctctgggcctctttggggaggggggcagacctggttgctgagatgcatacccctagacttcagggagggccaaggggcagctgct

SEQ ID NO: 23160 - DNA, 201 bp, Bos taurus
tcacacaagtgtgcttatgcaaacacacacacacacacacacacacacacaaacacacacactcttgtcaatggagcaaaagcccagagtagaaagaagacaagaagggggcttgttcccctgatgacaacatgcaagtgcgtatccccaggatgtcagcttcccggtgagaagagacataacctgcttggccctactttt

SEQ ID NO: 23161 - DNA, 201 bp, Bos taurus
tcaaggtcatgtctattttacagagttgacatctttgggcagtgagatgattcagcccaacaaattcagtgctagaatcccaggattctggagacagtgtcatactgatgtgacaggtacttggttagaagttctgatagccaaacttgtaaaacccaacatgcatatttccctagcatcattttatattataacatagat

SEQ ID NO: 23162 - DNA, 201 bp, Bos taurus
atgaacttattctagaagattaacagtggtcttaatataagaataatactgttgtgcagaccccaggaacaaaccacttaaagaaacaaagatctcaagagatttccaagttaatattccaagagtctctaaacccaagtggtaacaaaattaagtggtccttgaataaaggcaggactggcaattgcattgtttcctact

SEQ ID NO: 23163 - DNA, 201 bp, Bos taurus
agatacaatcactcgtttactcatcttgctacctaattcatttggcaaatagtttttgaacacctgtattgttctaggcctgtgctaagcaacagattacaagagatgaataaacatcagtatatgacatcaggaatgtcaccaggacatagatgagaggcccagcgactggtcatattatataggatggcgtcatgatat

SEQ ID NO: 23164 - DNA, 201 bp, Bos taurus
cccctaagaaagcgcacccctgcctggccactgtgcaaaaacacatgatgtcaacaaatcagcatttgatgctgaagctccactgactgagtatgtggaacgggaagggtggaaaggtaggaggaaccattctaaaagcctgtgctctaaaaactattttttgtggtgttaatagctgtttcacaaggaaaaggaaatcta

SEQ ID NO: 23165 - DNA, 201 bp, Bos taurus
cctttaactgtaatcccagttaaggaaaggactgaaatacctttccttaactattacccaattatacatcccacatgaacttgttttctttcagtttaaataatttctagaaatccataaaaatgaaaatcgatgcataacttgattatgttaaccacatgctgataaagggaagtgaaaaaactcaaatggtcatttcac

SEQ ID NO: 23166 - DNA, 201 bp, Bos taurus
agactcacgtccatcgagtcagtgatgccatccagccatctcatcctctgtcgtccccctctcctcctgcccccaaacacacacatacagacatatacatatacacaatatcctctcaaggtgtcatattttgaattttctaccatgttcaagaatattttatggcttttcaagtagcctaaaaccaaagcaaatcctgag

SEQ ID NO: 23167 - DNA, 201 bp, Bos taurus
gagggacaaggattcaaggcctggctagccacagccaatgtctgatcttggaagaagagcatccctgagaatgggggtaacagaggtcagaccatgcaccactgaggactagggctttagtcaagtccaccgctggagttttcattacattagtcatagattctcatttgcttaagcgagtttgaattagattttctgtca

SEQ ID NO: 23168 - DNA, 201 bp, Bos taurus
gccttgagaaccccatgaacagtacaagtcatacacagtctctaagcttatatctcctcactggaaaattaataataaatgctcttcttatagagctgtggtgaggatcaatgaaagacatacatgaaaatgcttaactagatctagcacaggctaaaagcatctttggttaatataataatacatttttacttgtctagg

SEQ ID NO: 23169 - DNA, 201 bp, Bos taurus
ggtcagccatgcttgtgaattgctttggccaatgggctatgagcaaacatgactcatgcagaagtccaataggtgcttgtgacctggggcttgtcatcttggaggtggccatgctgtaagatcacctgaggtggccatgctgtaaggaagctgctctagaaagtcaatgtggaggaggactgacatgcctgacagccagca

SEQ ID NO: 23170 - DNA, 201 bp, Bos taurus
taatgaggtattattcttttctcttccaaattcttagtggattatttatgttttcttttgaaaattctcactcttaattggttcccaagatacttccagaagttcattttgtctcattaagcctcctgtcctggatgaggaacttggaaatagtttgtttcaaagtgaagtatgtttgctatttaagtttacatggggagc

SEQ ID NO: 23171 - DNA, 201 bp, Bos taurus
aaatcgatccctggtgctaaaaaggttgggcaccattctactccattgacagaccctaggacagaccttgtctcctggccattgcacatgctgacccctcacagtgtttacctgggtgatgatcaacgagccttctcttagctcagacatctcggcctccctgtgtgccccccaggactcactctggcttataggcttggc

SEQ ID NO: 23172 - DNA, 201 bp, Bos taurus
taaagtcaggtcttgtacaactagggacagcccctctgccccagtacctgctgaaattattcacgctggtcgattctaagtctgctcaccctgccttatcatggctttcctttagaaaccaagataagggctgtgggtcatgttctccccctagctccttcctcatcctgactggtcctggtgctcctcttggttgccttg

SEQ ID NO: 23173 - DNA, 201 bp, Bos taurus
cagagggacctggaaggccttgtctctggagacctttcaggaaagaaaagagcattctccctggtagggagtttcccttgcagagctccacgctggtctctgaggggcctgggctgcttctgaggcagagaaagaacacctaggaaatcagctaaaacaggggtgagaagagggctgagcagaagccttgggtctcccatg

SEQ ID NO: 23174 - DNA, 201 bp, Bos taurus
acttatctcttgcaaaccacctccccaaagcctgctgaaattcttggggttgctgaaaggcagaagaaaattgatttcgccttgcatctcacagcaccccggctgtgtttaacacaggggtatggctgtgtgtgttctcccgatatgcattgtaccatgggtttgtctgcttcagccataaaaaggctctgttacttctcc

SEQ ID NO: 23175 - DNA, 201 bp, Bos taurus
ggagcacagagaaatcaaggctctttgccatcagatgcacacctggatcaagtccggtctgcggcctctctgagtctgggcttcttgattatgtggactggtatattcctttttagacgtaagccagtttgagtcgcatttgttaccacttgcaacctgatgcatatgtaagttactcactttctcttcatggtggagcag

SEQ ID NO: 23176 - DNA, 201 bp, Bos taurus
cagaaaaaacagtgtttagataaacttttactttagagtgacaataatgaatccagcatatgaatacagacacggggcatgaggctgactaggcctggaatccaacacgagttcaaaacctgactctgcagcaactagcgatgtgactttgggcgggttagtcctgagctccagcccctcactgccacggaaatcacacca

SEQ ID NO: 23177 - DNA, 201 bp, Bos taurus
cacaacggttgtaccaatttatattttgtatggggccgatattaatcattgatcactttggagagagaatttcatgattaataaccagactgaaaggtctaagtggccttgaccttttgtcctgttgtcttataaaaatctttctaatctctgtttttcatttgagaattaattagaaagatagacttaaggaactcctct

SEQ ID NO: 23178 - DNA, 201 bp, Bos taurus
tgtgggggaaaagtagggccagagagccccaggcattttcagtcgaagcggagcagcctgtcatggaatggatttttccagagcagggctaagtaaatgaggaaggccgggccggagcctcgaaatgtctgggaaaagacgagagtccagcaaatagtggataaatctccaagggtgagaagaagttggagtctaattacg

SEQ ID NO: 23179 - DNA, 201 bp, Bos taurus
tttatcctgaactgattcacatttcagttggaactcagaaggggagagaagtgtgattgatttaccccttcaagtctaaacagcctttcctctgctgggtcttcctggatctgtctcccatgctgatggagtaatggttgaaaggccccctttcctcttttaaaagaagtgttgtccagacatgtttattctcccttttca

SEQ ID NO: 23180 - DNA, 201 bp, Bos taurus
agaacatgatgaaaatttagaatagattaggaggttgattaaataaaatatatcagctttttatgtcaaccctgtctctggaaaaaaaaaaaagacaaaacttgggctcatgcaattgtttgatagcacactgtctatctgcctgaaggagcaagcttccagagtacctgtctacagtggggagactactgagttccatta

SEQ ID NO: 23181 - DNA, 201 bp, Bos taurus
cccattgcttttctcagtgattatttattgctataaaatactgctttgggatgggaagatcctcataaaggtagagaaaaagtaattcccttgtacttttctatattatccactgcatccctaaaatattacagagaacttctgaataagcaaaaatctgtctatattctaaaggcattgtggccttggaaattcagttgt

SEQ ID NO: 23182 - DNA, 201 bp, Bos taurus
atttttgtggaaggaaaattcagactcactccagacccatactgtcctctcagctgcaggtgtgcgtagcaagactctgacaccgttaacttgagtatattcattaggacattaatacaattcggggagccacttcattcaggtcagagctgtgagtggcaccctcttctgtagaatcactccattgggtatgtatcaaca

SEQ ID NO: 23183 - DNA, 201 bp, Bos taurus
tatgctgaacacccctaaagagttgtgcccccaggacaccctctgtctgccctctcccccaacctcattctcctaatcccttcaggagatctacttgctgtctggcctggcaactcacttttcctgaatctcagtctcttcatttctgaatgggattaggccagattagaatcacctagaaaatgcttttaaaatgtagat

SEQ ID NO: 23184 - DNA, 201 bp, Bos taurus
cccctggccctgcctttttcgcagagaccccaataaaggctgtgtcctcggctctcccctcactcttctgcctcctgaccaccgtgggggttttcccatgtggcctcccactctgagaagctggaagtgtaataagcttggttctcctgagctctcctggggctgcacctgactgacgtcccatacgagagcacagaacac

SEQ ID NO: 23185 - DNA, 201 bp, Bos taurus
ttcttcttttggctcagtgaccccaggctgcccactccagctcaggccatcagagaagggacatggatccacagcgacattctcctgagtcaccctgctgggaacgttgcagggactccaggcctggtcactggtggcctcttacaggtgaggtcctaggggctgagtgatccagcagggccatgggccagctccggacag

SEQ ID NO: 23186 - DNA, 201 bp, Bos taurus
aaggatgaaggctgagaagtgcacctacctcctacatggccacgatggcttttgaaggggtttctgtgactgttttcagaccacaggtgctgtgtaccctgttctatcccagcagacgtgagaaggccaatggagccagatctgggtgagggcagactcagagccaagaagctggacagggcatcctctgatctggaaccc

SEQ ID NO: 23187 - DNA, 201 bp, Bos taurus
tgacggaagtcgatgctaacgagaggacctgatgcttcagcgtagttgcaggctgaggctctaggtggcgtaagcggcctgaggatgccagcagtcagccacctggactctaggttctggtccaaggtcatggagacaacaactgttgaaatcaggactatggcctgcttctgactcgtcatctaggacccttcccacctc

SEQ ID NO: 23188 - DNA, 201 bp, Bos taurus
tgccacgctgacctccaccctcacactcctaggcctcagcttgctgatcctgggttgttgtctgcctgccccaggacactatgaacccattcaaagcagtaacccaggcttggccagctctgtgtctccagggtttgactccagggcttctgttaatgtttgtggaacaaggcagctcccgggatctagacaactatgaat

SEQ ID NO: 23189 - DNA, 201 bp, Bos taurus
tcccctgcagcttgtccctggggtccacttctccactggtttcagcatccagcgaccagaagagtgcagagctcatggaaccacgctgtcacccccaaatgccgggtggacggtcctgcagggcacagagccaccctgcccccgctgctatgaaagaaagtgaagtcgctcagtcgtgtgcgactctttgcgaccccatgg

SEQ ID NO: 23190 - DNA, 201 bp, Bos taurus
gccctggtcttgtccagagcgcggccaccacccgacgtacggcagggcagtgagtcccggatcggcgggcttcctgtctccccaccagcacacgctctgcgcagggcccagtgtccccggtgcctggaccagcacgggtacccagcagggctgggattaatggcctcccggccccagcctcacccctcctccagacggctg

SEQ ID NO: 23191 - DNA, 201 bp, Bos taurus
ctcttccgtgagccaggctccgcagctctgggccccagtgtcacatggaagcctctgcacggggcacctgtcctcatgaaggaagtaacgttaagagcaccgattccaggaggccaaggacagagtttggaacggagcagtggctggcagaaaaattcaaatgtgttcggcaggaagctgatcactgccaaaaataactgg

SEQ ID NO: 23192 - DNA, 201 bp, Bos taurus
gatgaaggagtatccagcaggcagccgattatgtgaatatatgggtctggccctcactagacaagtctgggctggaaatccagatctgggagtcgtcatcgtacagatggtaattagagccttggggaagggtgagatcaccaatgagggcggacagaacaagatgaggttttaacgtaacagtaaaattcactgaatcat

SEQ ID NO: 23193 - DNA, 201 bp, Bos taurus
aacacattgttggattagacctgggtttcttatcacagcttttctgtgcctcctctgtaaaaattagctactacccatgagtcccttgcaagggatcctcacatggtaaatacttattaaatttagtttcattgttttcctttcattgaacacattcatttcattaaacaggtgctgttttaagtcttgggattcagtagt

SEQ ID NO: 23194 - DNA, 201 bp, Bos taurus
acatggtccctcatggaggaggttccatgccagtgaacagaggggcagtgggcagtgactcccagcagtaaacgtgcccacccagggccagtgagggaccgagtctgatctaaggtggagtcaggaaaaggagggcaagatgcctgaaccttgtccagggtcacctggccactagttaacagctgcaggccaccctctgcc

SEQ ID NO: 23195 - DNA, 201 bp, Bos taurus
gttggtaatggccccgggactgtttattgaaatgacttttattttccttctgctccatagtttcacctctaacataaatcaagcatccatgtatgtacaggttatttctgggtgtgcttttcaagtcccttgtgcccatcccaccctggtttaattactgtaaatgtataaaacattgtgacaataaagtaagcccacttc

SEQ ID NO: 23196 - DNA, 201 bp, Bos taurus
gatttagttggtgctgtatcgtgttctagtcatttctcgaagtgtgagtgcttcagaatatctatgctatttcaggtccgcttctttgacacgatcttctctttacaaactgagcttatcactatcgtggacgaagaaaagtttcctctccccttcagttggtctaatactcaaatcgacatgaaagagatcgacagaaga

SEQ ID NO: 23197 - DNA, 201 bp, Bos taurus
ccaccgctccaggtcatcacagagcaccagcctgggctccctgtgctacagtgcaacttctcaccagctatccatcttacacttgacactgtatgtacaccgacgctactttctcccttagtctcactctctccctatttgcagggaaggaatggagaccagatgcagagaatgaacaaatatttctcatgtacctatctg

SEQ ID NO: 23198 - DNA, 201 bp, Bos taurus
catcagataaattataaatatattttaaatcaaagactggtcccacaagggcagcactctctgtgttactcattgctgtacctgggatacgcactataactactctcacactgaatatatatttgttgaatcaatatatgaagtctttcactagtactaatagcttgtagattctaattttttctgtgtagaacatacttt

SEQ ID NO: 23199 - DNA, 201 bp, Bos taurus
tgctaggaagcctacagggccaatggcatgtgatagaaacaaaggcttcattatttggttctaatagatctgcagtttgaaaggtacctcttctccaggtgataggttaggtaacggtgtggccacttctctccctgtgttcttaattctggaatcatcattagagtcaggtaaagtagaattaacctctaagatgaagtg

SEQ ID NO: 23200 - DNA, 201 bp, Bos taurus
tgtgtccaaggagatttatggtttcctccaaagggccaacatgcttacacctttccaaaataagattctttcaaagcagccaatagttttagtgatggacatgcaggacaaggggcccctgaatgctcaagcccttcggccagcaaggaccgtctgccctgtggtttgctggggtctcactgctcctggggaatctagtga

SEQ ID NO: 23201 - DNA, 201 bp, Bos taurus
ggctggagcccactgaggttcttccctaccccaggagctggcctgcactgacgcctgcctgccggtcccctcaggggcttccctccacgcccacagcacatctgaacatcataccatggcctgcaatgcccatggggtccaccctgatcatctctgaccactgctacctcctcctgctctgtccgcatggacctccatgcc

SEQ ID NO: 23202 - DNA, 201 bp, Bos taurus
gccagaccgagcacctgcccagccccataccgcagctcaagtgcaagcgcacagtagcaggaaactggacttagctaaagctgggttttaccaggtgactatgaaagtgggagaaagggccacgttttagaaagaagaggactgacaacacaagggtggcagggaacactggaaaggaagtggggctgagggtcccgggag

SEQ ID NO: 23203 - DNA, 201 bp, Bos taurus
atgtggacaaccaaaaagatactcattttctcaagcaacttgatatcttataaatttattgaaggaaataggcaagaaaacagagatgtgtgcatagaaatgtttgagatactgaaaactggaaacgagcaacttattcaaagataaagatcaactcaactatagaaacatagcttctgtaccccagatggtggtatgaac

SEQ ID NO: 23204 - DNA, 201 bp, Bos taurus
cccatgggggtaattgaagggtgcttgttgggtgcttcctcagggttgtagggcggggactggacatcagtgtggggccttgacacactctggctccctctgtgtcctcacagtggagccctggcgtcaggaagcttgttcttaacaagcagatcgggtgaacctgatgaagttggggccacatcaccgtttctgaaatac

SEQ ID NO: 23205 - DNA, 201 bp, Bos taurus
ctgggtctcagaagctggtctgtggccccacagcctcagaatcacctggatacaatggttaaatgtacagtttccaggtctcacttcaaagacaccgaatcagtattatgggaagtgggcccagaagtccgtaattttgactgtgtgattttgtcatttatttcttacgtttgaaaaccagattcatgttttgtgaaatgt

SEQ ID NO: 23206 - DNA, 201 bp, Bos taurus
gtctatggggtcgcatagagtcagacacgactgaagcaacttagcagcagcagcatgattgagagagacagaaatctatttttataggcccctctgtcaaacggttatcatttggaattgttttacaaggatataatatctagacagacaatacttggcttaattctacatgctggtttgaaaaaaaaaaaaaggcatcta

SEQ ID NO: 23207 - DNA, 201 bp, Bos taurus
tcctcctgtgactagtgcacggtcagatccagagtccagctgataagctgagtcctgacagatgaaagatggagcatgcaccatctggtggtgtgagtacaagctcagcctcttcattcttactctgtgtgaagataagcgtgccctggatgcagagaaggagggcacacccctgtgtcccagctttcaggctgcagtgcc

SEQ ID NO: 23208 - DNA, 201 bp, Bos taurus
ttaggatcctttggaacacctccatgttatggagatgaagttacaaagttaggacttcatttatgacagaagttacaaaggaaatggacaccactgctttcttgagccactggacacagtgtctaggtctcattagcagatgtttgtcctgttgaggaacatggccaggctgtacctttccaactttctgtgtttattatt

SEQ ID NO: 23209 - DNA, 201 bp, Bos taurus
aaagagaacagaagatttctgcaatccaatctagttcagatgctgggggtcctcaaggaacaggtggcctggcccaggcttttgagggagcctcccaggccgttggttagtgaatgcctcaatactgtgttcatccttaacgtctgaatgcctctagtttgtgtacatatatcattgctcttaatcggtcttagtctaaaa

SEQ ID NO: 23210 - DNA, 201 bp, Bos taurus
gctgctgctgggtctttgcagaggggattacagactccacccatgtaggccgctggaccagagtgcactgaaatcaatagacgtgctgcctgttctgtaaatcttcacacacccacaagggaaaaagtcctggcacatcggacctttttcttgtgtaatcagacccgtggtccctggagagtgcatctgtgacaccattgt

SEQ ID NO: 23211 - DNA, 201 bp, Bos taurus
cctggtgagtgttcattatctgtttgtattcatctcttgctgacatttgtctgcattcatttcagcatttgtcatcacaaggaccattcagaatcaatacgttcatagacttccacttgcaaatatggcgatctttgtgtttaaactaagaaatatcttcctaattcagttggcctggaatacaatgttgggatgaaaggc

SEQ ID NO: 23212 - DNA, 201 bp, Bos taurus
atgctactggagatcaggggagaaataactccagaaagaatgaagagacagagccaaagcaaaaacaactcccagttgtggatgtgatggaggtaaagtccgatgctgtaaacaacaatatttcttcagtcagttcagccgctcagtcatgtccaactctttgctactccatgaactgcagcacaccaggcttccctgttc

SEQ ID NO: 23213 - DNA, 201 bp, Bos taurus
ggtctggttgaagagccccagccagggccctttgtcctgctcagattccacttccaaaagaagtcagctgagttcttctgctaaacagcagggcgtctactgtggggttccaggcaggccgggggctgaccctgaagatataaagggagtccaactgtgactgtgctgcccgtggcagggggacaccagtggctccctgga

SEQ ID NO: 23214 - DNA, 201 bp, Bos taurus
ttcttaaccactgggccaccagggaagtcccccttcactccttaaagacacacgaacagatgttgtcccctctcctgtctcgagatgctgctgtctgggggtatgatacctgagacagctgcggccatcctgagattaggaggggaacaaacctggggacaaagccaccaagctggggagggaagaacaaaaggacggaaa

SEQ ID NO: 23215 - DNA, 201 bp, Bos taurus
aacgccagagccgggcagctgtgcttggccatgtgcacagagaagcaaaggcagccagtctactaagagaggagaaagaagcaggtgcaaagagaaaagcagagacgaggccatgtggccctggcgacacagaccgagtgacctcagttcccagggcttctagaccctgggcccagcccttctgagccccactgtcccttc

SEQ ID NO: 23216 - DNA, 201 bp, Bos taurus
ctcttcctggagagagcgtggtggtgtggaaggcagagccctctctctagattggggttcagggaagcgcctagcactcagattctctggccctctgtttcctgaaacccaagatcaagggtctgatgggaaatgggctggagcactcaccccaaagagaggccaagatttctgaacaggatgcagggagggaggaagtgg

SEQ ID NO: 23217 - DNA, 201 bp, Bos taurus
ggtcttcatcatggacaggaaagaacctcgaaatggacagagccacagccacagtgctagagtggccccaggcttaggcccctgcccgtcacggccctcaacttcccagattggggttagagagatacaggaatctgaatggaagcagaggaccccatatggctcccaagcgactgctgggaccactgcggtccagagagg

SEQ ID NO: 23218 - DNA, 201 bp, Bos taurus
cccattctacagaagggaactctgaggcccagaggggtgaaccatttgagtctctgctgacattggtctgagaccccagtagcagaggcagggctgaccacgccatcccagtggcccgttgtgttagcccctagaccagcccagcagttcctctgaggccccattcagccccatccgggcccccggggccccgaggctcac

SEQ ID NO: 23219 - DNA, 201 bp, Bos taurus
tgtccatccatcagtttccatcacttaaaagctcagaaacctttctgccttttatttccagatctgaaatgccagtcccctctgtttgagctcttgactgtggccatgttggccatctcctctgcagagtcctagttgttgtatctaatacctccagaaccttccttaacaggatgttggaggtcctcacctaaattcaaa

SEQ ID NO: 23220 - DNA, 201 bp, Bos taurus
ggtttgtttcttggccagaagataaacatgcattaagacaagttctaccagagaattgacctcagtgatatctgaactcagttcaccttattgtgtgagcgctcagatagatgcaaattttaggccagtttcctggacctttgtgctgaccatctcataatactgttttattaaatccttgaatttaatattgagtttttt

SEQ ID NO: 23221 - DNA, 201 bp, Bos taurus
gcagtcctgagagatgggtggtcttggtccctcatttaccacatagtgaaatgccatctacccactagaaaacccactttgcaacatttgagcagccatcattgtccctactggtacaagattttcttctgtgaaataaatgattatgtcttttcctgcttttctgttgagttatttctcttttttaattgcagtacagat

SEQ ID NO: 23222 - DNA, 201 bp, Bos taurus
gatgataggggaacctggaggagatccagactggccaggaagttcccctttgccagcacagtgtggttgacattgattagcccccaaacacaatcagcaatgaaagcacacttagtgctggcctcctttgtatgtatactgaaatgcactagattatcccagtgcataatctctgaaaacatcattgacttttgttaatat

SEQ ID NO: 23223 - DNA, 201 bp, Bos taurus
ctgcccatggaccccctctccccccagggtgccaggagatgtgggaggtggtgctcagaaacctcccccacaccaggtttccgcaggaagggtggggtgggcactggccggtactcctctagtttgagagctcctctgacttggggagctctgctccgttcccctcccctaggtggggctgcagcgctggcctggattggt

SEQ ID NO: 23224 - DNA, 201 bp, Bos taurus
ccaggcaaggggccaggtacatacctgtccaaagtggactgtgattggccgccggtcctctcggaacttggggtccttggcctctaccagtggggacggcgcagtctttggcagctgctcttctgtggtgggggcacagccattctcagtgatgtcctgcaaggagaagtcccatggcggggttggtgtctgggttatggc

SEQ ID NO: 23225 - DNA, 201 bp, Bos taurus
cagcactgcattaaaatttcagaacaagaaggccagggggatggttatccccactatacagatgagaaaagtgaaccttagctccaagtcacacagacaatagagccaggggcagaggccaaagtcaagtacaaatgtgtcttactccaaagtctgtgctattccattaattctcactgctgccaggattttttagacaag

SEQ ID NO: 23226 - DNA, 201 bp, Bos taurus
aaaaagtcacttctccaaggagacccaccgtccccaccctgtcaggatgaatcccatgtccatggctctccattccctggactggctttatttcaaggccactacccgccccgggcaccgtgtttgttacctgcctcccagaatggaccgtgactccgtgtggatacgacttggtctgtgggccgcagctgcacctcagta

SEQ ID NO: 23227 - DNA, 201 bp, Bos taurus
tcttccatggcccagaaatgatggctgagaaaccccactggacgtggcagaaggctctgtactcagagtgaggctcagacatgctgatggcccccagccctccgactgtggggaccccccaggggactgcggtcctgtccatctgcccgcaggagcggtaagcagcaccagtggccagccggcccctgcatttctgctgtc

SEQ ID NO: 23228 - DNA, 201 bp, Bos taurus
gggcctttgtggggcccgtgctcttcgtgctgaccgtgagcggagaggcccaggggtcctgccggggtgggacaggtcgtgggagggggagccccttttgtgctctgacaccagatctccaggccaacacctgcatcctggtccgggtggtgattgtcaccgtgtccagtgcccgctgccgcgcccgcatgctgagcccac

SEQ ID NO: 23229 - DNA, 201 bp, Bos taurus
caaaacataaagagacaattgccgatgggagggacaggtgggtggctgggtagctctgtgtggaccagggacaaaggagtgtggtcctgcccagaggcccggtgaggagacaaaaatcaagtgtctccagtgtgaaatggatggtggttgaaatcccagccccactgcttagaattggtggcccgcgccctatcctctcct

SEQ ID NO: 23230 - DNA, 201 bp, Bos taurus
agagctgacaggattgagagtatttcttccacgtacccaggcctgcacacagagcacatggcactaggctacccctgagtatgttgactagggatacagatgggccacaaccagtactatgttaagaagcctaaacttaaagtatgattatatccagaattacagctcatctctggcacagaagtggtcaaacccattcca

SEQ ID NO: 23231 - DNA, 201 bp, Bos taurus
ggacccccagttttgacttcctgagcagggcagggtcatgtccccccaaaacctcaggaggtgggaattcgtccactagatgccaatcttggtcaactgccttcacagatgcctcaggacctgagcaagccccaccctttcctccaacccttctccctcagagccaggaaggacacagagagaccagagctgggcgtccat

SEQ ID NO: 23232 - DNA, 201 bp, Bos taurus
atattaataatgcttcctcataaagctgttggacaataaaatgaactaatggatataagattgccctgtgaattataatgtactgtaaaattgttacaaaggcactcaaaacagagtataaattgaaaaataccaagtacaaataaatgttgaatgtgtttatgtgggggcaatgatgatggttttgaaatattcaatgaa

SEQ ID NO: 23233 - DNA, 201 bp, Bos taurus
gatggtttaaattccagtctgggagccagcgggctcgagatccaagaagagcaaggttccagctcgcatccaaaggcaggaaaagattgagggcccaacttaagcagtcagacaggagttccttcttactcagccttttggtttcaggtcttcagtcgactggataaggccccacccatactgaggagggcagtctgtacc

SEQ ID NO: 23234 - DNA, 201 bp, Bos taurus
ctcagtacaagttttacgtatgtcagtaaacgacgcacacagtggcctcacagagcccagccctgccacgggagaagctcctccacagtccctcacagatctgttttgctgcctggtttgtaggaagcctggtttctcttttactgccccaaacagtcactgaggcaagattcttaatcttatcccaaatttagggcaaac

SEQ ID NO: 23235 - DNA, 201 bp, Bos taurus
aattttattcgtatttcttcctttccctagtccctgtactatgctttatacataacagctactcaaaattttctaaatctatgattaaaaagaaaaaaattaaacaagtagctagtagcttttcttaatccagaaacaggtcctcaataccttagtgtaagatgtcagtatgaggaccatgaaggctttgcaggttgctca

SEQ ID NO: 23236 - DNA, 201 bp, Bos taurus
atccgacatactgtgtctgttaactctttctcccccacaagctccatcggaggagagattttgcctcctgtttactgctgtacctttcaggcctataacactgcataactgttcagttgctcagtcatgtccaactctttgcgatcccatggactgcagcacgccaggcctccctgtccatcaccaactcccagagtctat

SEQ ID NO: 23237 - DNA, 201 bp, Bos taurus
cagggccgtgagtgactggggtgtcagggctggctctcttgagagttgtttttggaactgcgaagatttcaggggagagcattcctggaggagggaacagttagtgcaaaggccctgaggtggaaatgaacttggctgagaccaaagactgaaaggccgatgtctggatggtgagggccccattagtgggaagacagtggg

SEQ ID NO: 23238 - DNA, 201 bp, Bos taurus
ttacattaaagagatgggcagaaatggagactgagaaccatcagccaggggcagacaggggaaggagttacttgtggtaacctggaggccagctgtggagggagcttcaagatggaccagggggtggcactgccagatgctggggagaaatccaagggtgaagggatgaagccctcttcaacaggcatacccagcaggcca

SEQ ID NO: 23239 - DNA, 201 bp, Bos taurus
cagggctgtgtcctggcctggccgtctgggggcggcagaggcagaaacagggctcctattttccaggggtgtctctagggccctttgcttttttctacccgcccaacctcaggaaccagccctctctgtgcctgcagtaaccatggcagctggtcagaggtggaacaaagagagggccgttccgtgcagctctgatgtgct

SEQ ID NO: 23240 - DNA, 201 bp, Bos taurus
cttgcccagagccccacgcagacgacgctggttgacacacaggttcccgccaggcccccagccccgcagcacaggaggggcctggagaagcagagctcgtcaatactcacacagagatctaagtcccaccgtggaatgcacgttcccccgtttcctttaaaatgcctggccttctccatctgtatttcgttttcctacttt

SEQ ID NO: 23241 - DNA, 201 bp, Bos taurus
acaatttcgatctctttattgacattgttctcctgattttcttgaactctttgtccatagttttctttaacagtttgagcaggtccacagcagttgactttaacagatctaactagctcttaacaatatctggtattcctcaaggatagtttctaattttttttcccctgtgaatgtacctttttttcctttttgtgtgtg

SEQ ID NO: 23242 - DNA, 201 bp, Bos taurus
aaacttggggagctgtagtttccatgaatcaggcgttttgtgtgagcctgtagtgatcacagagaagcgcactcatggccctttcacctcatttgctcacgctcagtggacggagcaggctgcggggaagagcagagtggtgatgaacgggtgtctgtccacccttcccagggtcagctgtgtctattagattatggtcgg

SEQ ID NO: 23243 - DNA, 201 bp, Bos taurus
tgattgccagcagaaccaacggatagaggattggaacttttagccccacccatcatgacttctggggaggaaagaatgactggaggctgaactagtcacccatggccaatgatttaatccacggtgctgatgtaatgaagcctccatgaaaccccaaaagggtggggttcagagaactcacaaattagggcactagaaaac

SEQ ID NO: 23244 - DNA, 201 bp, Bos taurus
ggcagccgggtcagagtaggtggggtcactgtgagaggtctttcacccctccccgacccccggccgtggtttcccatgcttgaacgttagtcctgtccgcgagagggcacaaacccgagtcactaggagccaagtaaactggatgcatcctaactgatctgaggaaacttcagatatttttcaggacctagccactgagct

SEQ ID NO: 23245 - DNA, 201 bp, Bos taurus
ggctaccgtgaggttgacccatgggtgagggattgaaaggcagggcccctcgtctcccggtcagctggtcttgggaaggcctaggggagtgtctgagcatcggcaaggctgtgaaattgccagaagcctccatccatctgattcaatgaaacagctgcctctgagctgagagtgggccagctggtcccctcctctcctggt

SEQ ID NO: 23246 - DNA, 201 bp, Bos taurus
ggtagatgaactgaggagctgtctaagccccagagcacagggcctggctcaggatcaccccacaaacactagtgtccccaccccaccttggcaagcttcatacattcatgcgttgtcctttggggccgggacgaggacgggtgactgtcagagccagactccaaagtgaggcctggggtgcatccttggctctgccacgca

SEQ ID NO: 23247 - DNA, 201 bp, Bos taurus
tctgtggctacactcgctccccctctcagcttgccggccctgcctgggagacacaggctctgtgttggacgcagcccttctgtgaggtctctggggcctcggttggtatcaaggtggtcccccgagctgcagctgcaccctgcgtccctccgatgcccccacacccacttctccactccccgggaagcggccgtgccagca

SEQ ID NO: 23248 - DNA, 201 bp, Bos taurus
tgttctactctgtcctcagtgcctttcccaacccctctgcttcagtacagcactgcagcctccaggccccctgatggaccctctgacgaaagggccctgcaggaatcagatggcacagaccctcatgtggaaagccaagtcctctctgtcctttggcatccagcccctgcagacgtggccggctaaagaccctgaagtaga

SEQ ID NO: 23249 - DNA, 201 bp, Bos taurus
tggggcagtgaaggcgcctctcccgacccccatcatcggtcgttccacatgcaccacagggagagccctgagcacatggccgacaggtagtaagtgcttaataagtattattttaaaaaacattaagcaagtgagctgaaaagttgttgtctaagaaggaaaaggcgtaggttagggtgtctttgaggcaggttgtatttg

SEQ ID NO: 23250 - DNA, 201 bp, Bos taurus
gttaggacttggtgctttcactgccaggccccaggttcaatccctggttggggaactaagatcctgcaaaccgggcagcatggccaaaaaaagagagagagggagactgtaagaagagtgggatccaggagctaaagagacagagggtgtttctgagacacaggatcgatcacttagacaagtgctgctgataggcccagg

SEQ ID NO: 23251 - DNA, 201 bp, Bos taurus
aggaccaggtcgaccagtcctcctccagtgaggcccaggcgccccctggtggccagaggctggaggacacagtggagctgggccctgtgccaagtccagcacccacaatatcacccacaacagccccagaaaggatggggtctttcattgaccacattttctagacatgattgtcacggcctgaagtgacatcacaaagct

SEQ ID NO: 23252 - DNA, 201 bp, Bos taurus
ggctgggcactgcccaactccatggatgtcattcacatagacaactctgatgacctctggacagtgcagtatggtggcctcagccctgttccaacaacagagctcttgtgcgttcactaatgtcccgtagcatatgctgcctgtaacccgcacccctgcagtgccctgtgtgaatacccagatcacgtctgaggcctattt

SEQ ID NO: 23253 - DNA, 201 bp, Bos taurus
catcctttcatttcaaatattagtcatttcagtgagacctcaggttagacagatctgtgagctgggatccagaatctacaagtgccccatcccaccctactctaactagtctgtattctcaactgcactgtaccaatcattcttttttcttttttaatctttatttacttggctgtacaggtcttagttgtggcacatggg

SEQ ID NO: 23254 - DNA, 201 bp, Bos taurus
gctggatcctgcgcagtcggcctcccgggagaacctcctggaagagcagggcagcatcgcgctgcggcaggaacagatcgacaaccagtaagagccttgcaggcggtggcggagggccggtggaagtctgcgcctgcgccgtgcgtttgtgaggggctgtggtggaggccgccctgagctgaggctccagggcgagcactc

SEQ ID NO: 23255 - DNA, 201 bp, Bos taurus
tgcgtgaccgctgtagccctcagggactcccacctgctcgcctgcccccaaggcgcactggctcgggggtcccatggcccagcgctgccttgtggacctaagtacaggctggcagcctcacccctcgtaccttcttcagcttggtgttcctggggagctgctgcacggccagggcgaagcccgcgctcagctgcagccggc

SEQ ID NO: 23256 - DNA, 201 bp, Bos taurus
ttcaaccatcctttggtaagtgcctggcctgggccaggaatggtaccaggagaacacggtccctggctaatagtctgggaagagaggcagacaggacaacgttgacacagaggccagcataatgctagaaatgtctcagaggcagcccagaggaaagaggcattagctgtggctgagtgtgcagggggtggtctgtgtgtg

SEQ ID NO: 23257 - DNA, 201 bp, Bos taurus
aaaggactgtatgagagaaagtgtgatttctgccatgtattttcttttcagacccaagttttgggagaatctaacgagtccgctatttggtacgctttcttctccctcggaaacatctgaggtgagtgctgaagggagggacagtggtggagaggccctgggagtgaaggctgggctgagactgggctgtggaaaatgtct

SEQ ID NO: 23258 - DNA, 201 bp, Bos taurus
tcattttagagatgaggagactcaaggccagagagggacagtgactcctgaagctcacacagcaggtcatttcactagactcagccttcacagcccgagacgcccgcttgacagaggccctgggtggacctgccctcttccccctggtatcatgtcctcggaggctgctgagcaggggctagggtctccccagcaactact

SEQ ID NO: 23259 - DNA, 201 bp, Bos taurus
ctctcctgccatgaatttgcccagaccctcagcgctcagcccagctcttccgctagctgtatgtcccttgcttgtgaaatctcccttaaccagcctgggcgagccctccaggagccccgtttggtgtggagccaccctcagggagctgccggtcatttagaggagccgtcaagagtccagaacaccagtctgctgagcacc

SEQ ID NO: 23260 - DNA, 201 bp, Bos taurus
agaatccaattctgagtcagggccagggctttctctttcctgtgaatgtgaagacaggaaggaaattttctgtagccacaaaatcagtttttaaaaaagtattttgtaggcacagaagaggccaagcagttggctttggtttaaggcacaaataacaaatggaaatggtcagtcgtggggaaggagggtctgggagtattc

SEQ ID NO: 23261 - DNA, 201 bp, Bos taurus
tcctcagcctgacaggcactcccccacatgtccccacacaagtgcactgggacttcagctgcctgctcccatgcctccaacgcgtcatttcccctgctccctgcaaacctgctcctcctggaggccacccccttaacgaacggggcagggaggggggccctgccaagtgctcagatcagatcctcctttctcattcccaca

SEQ ID NO: 23262 - DNA, 201 bp, Bos taurus
ggttttaggatcctgcgtggacgtgggcctggggggactggagacacatctgcctggggttctgtcccagaaccgctgcagcctggacagcgactggagttgctagccccttctgggccttggtttccctttctgtacggtgttcaggttgccggatggtgggacttgctttggggaagtgcctcccatccccatcctgga

SEQ ID NO: 23263 - DNA, 201 bp, Bos taurus
gctgactgaagtctttgtccggcttctgcagggatgaaccgaggctcatatgtgtatactgtccagccacaaattcaggcctcaaaagcaggacacaccctagagggtcataaacttcagctgcaaatgggtgatgtcaaccaaggacctcaccatggggtggggtcgagcccttctccccacttgcagtcacccgggggc

SEQ ID NO: 23264 - DNA, 201 bp, Bos taurus
tggatctgtgccatcttggcagcgggggcccctgtcttcttgccccatatgtcccggatgttatccctgatggagaaacagcctttgcagaaatgagcccattgcggccccccaggcagaaaccaaggtcagagaaagaaaccaaggccagagacaaagaaaggcaaggccaccctccccttctgtcccctctgggtgcct

SEQ ID NO: 23265 - DNA, 201 bp, Bos taurus
caaacccaggctgtcttgaccactcttttctgtgctgtctatattagggtgaccatataatctgttgtccaagctgagattttacgtgtgatgaaaggccccattatacattttgccaggacagcaggcataagcccagtataacaggaagaaggggcgtgggtcctcttcccatcaagtcttcgctgcctgccaggcaca

SEQ ID NO: 23266 - DNA, 201 bp, Bos taurus
gctaccccaagtaagttcagaaactttcctggtctctgggtcccctgatgtcattgtcattctcctggcagtatcagagcttcagtaacaagggtagcaaaggaggaaaggtctggaaggcccacttaaaatctctcccccagagcagtgcggtctgttttgattttgttttttatttggggtttttaatgagatgtccta

SEQ ID NO: 23267 - DNA, 201 bp, Bos taurus
caacccctgctgtctgtgaccagctctggcagggggcctgctgcggtctgcaggcagcctccccttgtcatcctcaggaaaccctggtgccactctgtggacacagaaggccagcacagacggcaccgcgggaagcagcgccctcagagtggtggggccgccagtgtgctccaaggctgaagcagagaaccatggacccca

SEQ ID NO: 23268 - DNA, 201 bp, Bos taurus
ctgagtgcagcggggcccacaggaggggaagaagagatcaagggctggagaaccccacccctcctccctgcacagagctcctctctgtctctgggacgcgacatcccggtagggaggcctggtgttctttcttgggccaggagtgaagctggccacgaggcagacataccgtgaggacacagccttgttactactgataac

SEQ ID NO: 23269 - DNA, 201 bp, Bos taurus
ctctgggacaggcgggagccactgcagggcttgaggcagaggcacgacgtgtctggactttcccactaaagcacgccctgagcgctggttgagactaagcaagagaagcagggagggccaccaagcccagggcaggtccagaatgagaacgtggaggtcagtcggctttaacaagggcttccgatccagtggtgacattct

SEQ ID NO: 23270 - DNA, 201 bp, Bos taurus
tccctagttccttacagttgaaaattaaattcaccatttcagaattttggagacagttattagcacctggtttgtaacttttggccacgcgtggaccattttttatctgagcctgtccacacagcctcatcgacacctataattacagcttcatctcggccttcaacggttttgacattttgacttgtcagttgcagtatt

SEQ ID NO: 23271 - DNA, 201 bp, Bos taurus
aatacgttttgttttccaacaacaaactcctataaggaaaaaagcagtcgtatctggacaagcctgttagtcagtcatcagaggtctgcagcaatggtcgtggctgacagcctctgctgttcggccgtactataaaacccgtctcttctttgagcagctgtcctcctccaggaccctctcatcccagtctgagttcctctt

SEQ ID NO: 23272 - DNA, 201 bp, Bos taurus
atgtgaacctctggcagacaacattattggcctcttcatggatcacagccttgttgtggtaaaggagcttatgtaactaaatgaagccattagacatgctgtgcagggccacccaagatagacaggtctgagtcaagagttctgacaaaccatggtccactggagaaggaaatggcaacacactccagtattcttgccttg

SEQ ID NO: 23273 - DNA, 201 bp, Bos taurus
aggagccaaccgagccctaggacggtctccccctgaagatgagggaggcgagggtatagctgagatcagagcatcccctggcagagccctctgcccactgcgatgctgggcagcctcttcccgcatgggccctccagtggctcagaaccccagtaactgacaggaggccgcatctcatcaaaggaaaaaaaaggattaaaa

SEQ ID NO: 23274 - DNA, 201 bp, Bos taurus
gccctgccgcctggagaggagccgtgctggaaaggggacagaaacaatgccgagatggccggggtctgagagcgacaccctgagtgagaaccccagaagtgcgtggagcttcagggttacctaagtgccagaaaccttccacgggccccaacaagatgtaagccgaggactctgatggtccagcgtgccctcccctgacgg

SEQ ID NO: 23275 - DNA, 201 bp, Bos taurus
gtctgtcttagaagatgccaaaaaaacctttgaatgaaattcaacatcaacttcagacattttaaactctaaacactatactttaaaaaatttatttattctgcatttattcttgctgtaccgtgtgaggcatgtgggatcttatgcctcacataagttccccaaccagggatcaaactcatacccactgcaatggaagtg

SEQ ID NO: 23276 - DNA, 201 bp, Bos taurus
tggacacactctggcagagaaccatgcggaccagtgtgatgtccacgttcacgctgttatcactcagcgtgggtggggaccctagagtttgcatggcccctgtgatgatgagtccacagacacgatcaggctgtacaacaaagggacgcacaaggtgcctttctgccacgagcaaccgctgtgtctctagacccctggggc

SEQ ID NO: 23277 - DNA, 201 bp, Bos taurus
ccagcagaggtggacatgagccatctgcggaggcctctgccttttcagggtgatgaaacacccactgtctgatgagcctttacaatcggtcacacccgtttcctccccacagctggggaggcggctgaccctacatgcaaagatttcttctttccctcctggaccagatacgtccagacagtcacattccgactcggtctg

SEQ ID NO: 23278 - DNA, 201 bp, Bos taurus
ccccgaccccaccactgctgctctgggcctcagtcccctcgtctgacagaggggagaacttcaactctgacattaagtgaatgatgccactgtgtcactctagtgacagtcaggaccccggccaggcggcccccacaccgccgccccgcccccgccctgagcctgcacgggcctggccacggcaggaaggcgggctcagag

SEQ ID NO: 23279 - DNA, 201 bp, Bos taurus
tcggggatctagtgcctcagtgacaggctgccagcactctctcgggcagtggaagcaggaggtgtgggcacaggcaaggaggcccggattaggagacagacacttgcatgtgaaggcaagctggaaccataagccctcagacactgatggtcatggaaaggcctcagggataacccagcccagaccccaacttccttcccc

SEQ ID NO: 23280 - DNA, 201 bp, Bos taurus
gggcctcttctgtctccgaggctcagcagaactgtgctccttgacacgatcccatttcaaaggtgagaatgccgaggctccgaggcaaagcctcctgtcacagggggcccagcccagccgaggcagcccgaggctcgagcccgcatgcgccagggctcctcccttgcactacactgcccccccccctccccgcaggggcgc

SEQ ID NO: 23281 - DNA, 201 bp, Bos taurus
aggcctccaggggagacaaggtggcaggcctgcactccgcagccccttgccaaagcctctgttgaaacctggggaaaagcagtcagacagcagccttgcaggctgggccctgagcgggcagagtcagctgcaggctgcccagcttgccagccctcctctgcttgggtccctgggctgcagcagtcagcttcctggtggggc

SEQ ID NO: 23282 - DNA, 201 bp, Bos taurus
cggcaagcctggatggacaagggcccctcacaagtgtgacatccgaagtgggctggggaggaggggtggcgtgagtcactgcttctccaggctggactgcatggcctctgccctttggctgtgaccgcgtttccaaggagatgggggcacccctcccccccgccccatcccccaagaggatagagtggccgctgacaaaga

SEQ ID NO: 23283 - DNA, 201 bp, Bos taurus
cttcctgcacctctgaccccctctccagcctccatctgcgaaactcagggcagccagacccccaggagctaaggcagctgccccgtcagcccaacaggagcccagcagacctaaaaccacggccctaaagcttgcacttggccttgattaagcccttgcccaggtcctcagcggctccctgctgcagtcttcccaccacat

SEQ ID NO: 23284 - DNA, 201 bp, Bos taurus
ggaaacacaaggaagaaggggtcagcgcgtatgtgtggcttacacagcaggaactcacacaacatggcaaagcagctgtgctccaagttagaatatatacgggaagtacactgtgcatagagagagagagagaaagccaggccccaggaccgcagggtcagcgcccctgggaaatggcgtcaggggtgagctctgggccga

SEQ ID NO: 23285 - DNA, 201 bp, Bos taurus
tccatatcaataaatggaccaaacccaacttgtgggccacccgggatcccgaccacaccaggacccagtaccatgtctgacgtgtccctgccaagacgcagccccaaacccggccccgaggagacaggaacagactgagcacttttgacaagagcaccaacccatcctcttcacggtcaagtccaggaaaacaggccgatg

SEQ ID NO: 23286 - DNA, 201 bp, Bos taurus
caaaaagtcactgctgcaagaaactcaccacatcgtctctgcccacccttggttcagagtaactcgtcaaatatggcacctgtttcacgcaaagatggcccagggtttcctcagacggatctgacacacggcggtgatggcaaaaccacggctctgcatctggctgactctcagccacggctgctgctcctcctccaattc

SEQ ID NO: 23287 - DNA, 201 bp, Bos taurus
gatgcacagagcatgcagagtaggccaccttttcagacaggcttctctgacttagcggtttgcgtccaagtttcttccatgtctttttttgtgcttaataatattccactgtctggaggggccagaggttatttgtccattcatcaactggagaacatcttgcttccttctaactttaggcaattacgaataaagctgcgc

SEQ ID NO: 23288 - DNA, 201 bp, Bos taurus
gccatgcccgagcttgcacacagctgcacggggagctcaccacctcaagaagcagcctgtgcttgtaccatgggaacagtctctgactttgctgagtgtgaccttgcacccctgccccggggccctgtgggcactgctgtgctctgggcgctgagccttctgggcatttcgtctctgccccgtggcatctgtttctggccc

SEQ ID NO: 23289 - DNA, 201 bp, Bos taurus
ccttgcccacgaagctcagcctgtacctcctggaagggtgggcacaggagacagacccccacgaacctctgcaaccagcccattctggtttcctgtcataaaaattcaaacataaccactgtggggaccccttctggtctaggaagtgtagtcagccccaggggcctggagaaccagacggtcgcctcgccagtgagggac

SEQ ID NO: 23290 - DNA, 201 bp, Bos taurus
tccatccatcagaggggccttgcagggtctcaacactcccctccttgagctgcttgcaagttcaagtttcttgggggagattctccctcaaccaagcacgtgggggccttcctcctgccccgctcacttcccccaggagccagagtgttggccccagactggatcaaacacacgatgcgggaataaagtgcaaacaagggt

SEQ ID NO: 23291 - DNA, 201 bp, Bos taurus
tgcactgaatttaggcatgttcttctctttgatctgtggttgtcatatctctttcaggggcaggctgctccccagttttgggggtagaaacctcaagacccaattctaagctgtggtgtgaagtaagtgagactggattgtttcctctgggaaaggagcagttgcatattcctcccaaggagctgttcacagggacatggc

SEQ ID NO: 23292 - DNA, 201 bp, Bos taurus
attgtacaatcaagtctcataagatggctactctcttgctctctgtacatcccttgcaagaactggccctgcctcactcttaccttattcacatgattttcttcctctcctaagctgaaagtttaatcagtaactacatgtatgatcagtccaactcccaccaacaattattctagccctggaactagaccagaatggctc

SEQ ID NO: 23293 - DNA, 201 bp, Bos taurus
tccctggctcactagttacagaggtctatgcagttgacaaagacacaggcatgaatgctgtcatagcctatagcatcatagggagaagagggcctaggcccgaatcctttagaattgaccctaaaactggcaacattactttggaagaggcattgctgcagacagattatgggctccatcgtttattggtgaaagtgagtg

SEQ ID NO: 23294 - DNA, 201 bp, Bos taurus
gtgtgttagtaagcaagaaaacctttatgcccctggccttgaggcccttccttaaatggttgctgcaggttttctggtaggcagggaaatcctctagtgctaataggctagagagaggatttaaaaatggtgtttggcagttgatggtattagtacagtataataaggtccccaaaatgactgtgaccagtctctctgtcc

SEQ ID NO: 23295 - DNA, 201 bp, Bos taurus
ctatgtaccaaaaatactatgtgctcagagtgaagaaatgtgcaacataggtttatctctatgaactcataatctataaggaaagatgtaaaagaatcaagggttataatgtggtttgttactgctcacatcgtgtatgcccagatgctatgaaagcaaagaagagaattctcagttaatccataagatattgggactttt

SEQ ID NO: 23296 - DNA, 201 bp, Bos taurus
atgtatacaacataattgaatcactgctactcccatccctgggcgtccaaaatatacttagaaatttaaaattataaagacaggccaacaatggccaaagacagatctaaagatgaaaagagaaaatcagcaaatgaagctcactgaaaaatctgctaatactgttgttgaatcctaatcatttattcatttatccattca

SEQ ID NO: 23297 - DNA, 201 bp, Bos taurus
aatgaacatgcatctcattccatgaatttaaatttatttgatcattctttatgagaaagggttttctaaaatttttatcattaatatgtctctatatgatgaatcctccagaggacctggtttaagatatattcattcatctactctttttccattttctgattcattcacttcagctcaaattttgtcatttaattcttc

SEQ ID NO: 23298 - DNA, 201 bp, Bos taurus
tacagtatttcactgactttactcaaattatgcagaaatttaagtatggtaaattatacccattaatttatttaagaatttattagcagaaatgaaaaaccttctggactatgatgaaatatgtgcatgtactttttactggatactaactggcagaatctcactgttacataattctaatttctctttgaagttaatggt

SEQ ID NO: 23299 - DNA, 201 bp, Bos taurus
gccacgcccacacaggtctcggattcagggaggagacaggccacagtcactgctctgctaggatcctctgcccactcacccagcagctggtcatgggaggcaggtcttcatggccccttcagcattttctatgacattttatgcagcacaccgtctctgagagcaagtagtggaaggccagcaaatacatgggctctccgg

SEQ ID NO: 23300 - DNA, 201 bp, Bos taurus
catggaagacagtttttccacggatggagggaaggcagtggtttggggatgattcatgattcacatgattacatgtgttgtgcagtttatttctattattattatattgtggtatgtagtgagaagattaaacagctcactgtaatacagagtcagtgggagccctgagctcaggtggtaactcgagccctggggagtggc

SEQ ID NO: 23301 - DNA, 201 bp, Bos taurus
ttctaattaatataatgtgatttaattgttatagtagtggatcattttgtttctagtttatgtatatggagtttatatatagtttatgtatatacattaaatatattatcatttgcatttattgctaccactcatgctgatacaaataaaaaattactaaaaaactttactggtacttggaattagtgttttaatgtctga

SEQ ID NO: 23302 - DNA, 201 bp, Bos taurus
gcatgatcttgtgggtgttgcttgaatcacttaacctttcagagcctcagattccttatttacaaaataggatgaaaatatttacctggtatgtttgttagggagattaatttgagcagtgtttacaaaatgccttgcgtatagtagatgctaaaagtgtagttctctcagcctccccactgtgtaaattaattcatgttg

SEQ ID NO: 23303 - DNA, 201 bp, Bos taurus
cttgccttctgcagaagctgctggctgattgtaaccagggctgaataacaagcctggtggctgcaggaccccacgaggataatgttggcccactagtgggttgagttatcttctggagttgggtgttgtggggctgggtatccctaatctaatactggctttctggtggatggaaccagttgctgacaaggcctgcttgaa

SEQ ID NO: 23304 - DNA, 201 bp, Bos taurus
aaccccttccatcagatgaagagctgccctttttacttgacaaacatttgttctaatttggccttgcttgatttttcagtgcttttaagtccctctccccctctctatacccatcagcatctgttagtcagaagatcactctggctgacatttaccctgaatgtgcttgcttattaaaatatttcaatgttagacaagctt

SEQ ID NO: 23305 - DNA, 201 bp, Bos taurus
ctctaataaaaattaattttaaaaaatgcaatttaaaaatggacagagaaactgaatacacatgtttttttttagaagaaggaatccaaatggccaacaattacctaaaaaatgctcattagttatttgttgttgtttagttactcaagcatgtctgattcttttgtggccccatgaactgtagcctgtcaggttcctctg

SEQ ID NO: 23306 - DNA, 201 bp, Bos taurus
ataatccttactatcactaaataaatcttaaagttgtaaatattatgcataaatgatatggagaaaacattatagagtatttgtgacgtctgtatgtacagttatcagagtctgagttggtatcctggttgtagttatttcactttaatcagttttatcagtctccttcatcatattttttttcataaagaaaactggcat

SEQ ID NO: 23307 - DNA, 201 bp, Bos taurus
gccgcctgagagacaacttgccaaccaacagaaaaggccatcttaaacatttaaccactagaccattatcagctaaccaaaaatacatgaaagtagccaatgctattcaatctggcccagatgtgaaaacatccctatccttgcaactctcacacagaaaatgagtaaagccattacgttttgtaatgttttgctacgtaa

SEQ ID NO: 23308 - DNA, 201 bp, Bos taurus
agtcttttaaatttctttaagaataaataagaagagttaaaagatttgaagcagaaaagtgacagttaaatctgatatttttgagtgaaaattctagtagcaatatgattagtggattgaaaagaagcatcaataaaatcagagagggcctaaaaacatcatgttgagattcttgagaaataggagtttgttaaagagacc

SEQ ID NO: 23309 - DNA, 201 bp, Bos taurus
aaaggatccctggatttctttttccaccacagaacagcaggtttccctcctcccaagccatcgtacccaacaatacttcagagatagctcagttctttagcttttagtgtctgttaaaatgtagaattaaaagcacactacagagctttgattcttcattttttccctcctcatagaaacaaaaacctaaaagaagttcag

SEQ ID NO: 23310 - DNA, 201 bp, Bos taurus
gaagtaacaatgaagtttgtttttgacgacaaagtcatccaagaggagcaaaattttgaactgtgttttttaaaaattgcataagaaatactaagaaaacggatgttcccagggaaatagataattatgtgctctttggagaaactgtaaaaagaaataatgggtttttaccataggtttgtgtgtggcagaaaagagaaa

SEQ ID NO: 23311 - DNA, 201 bp, Bos taurus
acacatctcataaatggtatttgaatatgtgagcattagacatacattacatacaaatgataaccaatctagctattgtacaatgctaatttctggtgatctttcacaaggcattcttttttgctaccagattagctccttaaagaggtaaacccacaatgccacttgtaaagacactattgactgtcaggtatcacaagt

SEQ ID NO: 23312 - DNA, 201 bp, Bos taurus
atgaaaaggcttggcaaatcttaagaatttgaatttagtttcatgctaattgaggggcccataaagaattttaagaaggaaaacaatgtgtatttctttctattttgaaaataaaagttagcttcaggagaatggaatgggggagcagtgtgggttgaaaatgaagagacaatcagcaggcatcactgtcaagaattaatt

SEQ ID NO: 23313 - DNA, 201 bp, Bos taurus
atatttgttagtttattttcattgctttatctcctagttggtaccttgttttagctttgttttccagtttggattttggttagctttcttttggtagatacgatttttggtttcctttgtttgccaggtcaatctgttgtactttatttttgttggactgttttgattttgcttatgggtatatatgcatatgtgtgtatt

SEQ ID NO: 23314 - DNA, 201 bp, Bos taurus
ggttgaacttcaaaactgtttttaattaatcctgtgagttgcttttaaggcttgctcaaatatcactttcttaacctgatccaccagcaccttccactgatgacattccttattctcctttatccactgcatttatttcttagggctaccatcatgaattaccacagccagtcttaaaatcaatggggtttgcactctcat

SEQ ID NO: 23315 - DNA, 201 bp, Bos taurus
caataagaggtgtttactgttcagcagacagaaaactatgaaaagggaaagaaatgaataaatacttgagtaaagtgaaagacagtgttagtgatgaagcaactgctgctcaaggatctaatatcttaggcaagtattatacaaaaatgaagcaaaataggacaaagacaatggcaccccactacggtactctagcctgga

SEQ ID NO: 23316 - DNA, 201 bp, Bos taurus
aaatatttctggagggaaaacagcactgcatattttacttattcccctagattttgttcttcctctaggttccatctcaattttctttgttattttgatgaatctctaatgttttcactcaatatgtttaattttcattatttttcaatattgatttcagattttataataatggtgatcaagaggagatcagtttataca

SEQ ID NO: 23317 - DNA, 201 bp, Bos taurus
ctatttatataatatttaagaggtcaaattttctgtattcatattttaaaattgcagtttttctatgacattttaaaaattatgccccataattatccactgtaagaatagtgctgtgtcttgcttggtttcaagtactgtgttctacaacagcaggaactagtttaacaattttcctaagacttcagctggtttcaaagt

SEQ ID NO: 23318 - DNA, 201 bp, Bos taurus
aaagaaatagcagaaaaaacatacatctatgcagtacaacacagtaaggtgagacacgattcataattcaattatctattactaaaattgcatgtgtttagtatggggatgatttgtttttctatagctattccttcaaggttctatgacttttgtctcgcttttattttctttatatatggcactattctcttaggcaga

SEQ ID NO: 23319 - DNA, 201 bp, Bos taurus
tctgtaacaaaagaaaatattagagaatatataaaattggcttccaagtaatataaagaaattccaagagtataaggtaagtacactttaagaggaaccatagatcaaactgccaatatcacctggatcatcaaaaaagcgagagagctccggaaaagcatctatttctgctttattgactatgccaaagcctttgactgt

SEQ ID NO: 23320 - DNA, 201 bp, Bos taurus
gggattctggaaaaagctcctgcaaagcttgacatcacagctaccacttcccacttagcctctgtcaccaaagggcttagaataaccttaactagcaccagtgcatagaatcagctttgaatctgtgaacacatgggctgtcaggaatatactgcgacatcagacaagtctgcggccaataaacgttccacttcccttctg

SEQ ID NO: 23321 - DNA, 201 bp, Bos taurus
tcacttgaaaatgagaaatagattcagaagttatttgatataacagctttaagtatgtcctacttatcagttcccagatgtaaacctgtttatagatctagaatttcttgagtaaaaagaaggccaactcctctctagaacaaatccagcctcattaccaattcatcctgttcatttttccccagccttcttaaaaggggc

SEQ ID NO: 23322 - DNA, 201 bp, Bos taurus
aggtcagtcactacttaggctaccatcaagatttttccaacacaggagtgtcacatgtaaagaaaagtcttaactctcagtcttgggttgtctaatcaaaacgacactgagccaccagtgttgccagttggttctgtgatgaagctctgttggccctgttcaagatgaggaacagagtcacagcacaccagcacgtcattt

SEQ ID NO: 23323 - DNA, 201 bp, Bos taurus
ctcttgtgatatgtatgattctgaaaattgacgaaattgactgaatcgcatgattaaaaatggacaaatcgaatggtatgtgcataaatattaccttgatactaaaaaagggaacaagctagtaagtgcaacaacttcgataaacttcaaaccgttatgttgagtgaatgaagccaaagataaactcatgtatactctatg

SEQ ID NO: 23324 - DNA, 201 bp, Bos taurus
ctgcgatggcctcttggaggcctcctggaaagcaagggttcaaaggagaagagagtaggcagactctaaacacaggttcaggagcaatgaacaggcaggcggtgcggcctgtgggttaaccaaaggacagatgtaattctaactcccttgtgtcatgcatgttgttactacactgtacttcgggtctaccttggtggtaca

SEQ ID NO: 23325 - DNA, 201 bp, Bos taurus
atgaggtggccaaagtactgatgcagacaaatgctgcttgattccatttatatgagttacctagaacagtcaaaatcacagagtcacaaagtacctgccaggggccgaggtgtgagggtgtggggagggggtaggagttaatgttcagtggggacagagtttcagtttaggaaagtgaaaaatttgggagatggatgatgg

SEQ ID NO: 23326 - DNA, 201 bp, Bos taurus
actttggtccattttcccccaaacacacccttgcagtatttttattttgttgtttgtcttaacttttcatcaaccttcaagtctcaactcaaattctatcctcattaagaaaactcccctgacaaccccaggcaaactacggttctccggcagccatggtgtctctgtagtttagacactcaattagggcagttgtcttgg

SEQ ID NO: 23327 - DNA, 201 bp, Bos taurus
tttttgtgttttatggctgattgatgggggtcagagcgagggctttgagacatgccgagggggaggaactgggccgctttttgatggcctcatttgtggcgtgtcttcttctgggagagagggaggtcaaggtgaatccctctttcagactcagatgactcaggcgacgtcacccctgggcagaagaggcaatggtggggg

SEQ ID NO: 23328 - DNA, 201 bp, Bos taurus
gaacctgatggtatgtaaatttgaaaagaaaagaaaaacataattaaaagagtttgaaaaaaatctggacaagatttactgctaccaaaagaaaccttccgaatgcactctcacaatctcttgattgatattcttgagataaaacattacccccagagagggatgtcagtctcttccccacttaccagagaggcactcgac

SEQ ID NO: 23329 - DNA, 201 bp, Bos taurus
accttgcatcatgggatagccacaagcagctgtggacacaggctgagattcctcaagtccaaggctcgtacacccacttccaagtccaagaaaaataaaggaagggctcctggcttcagagcaggtcggagttcccaggtggaaacacctggggccgtttccagggcaggtgagccctgcagccaggctccttcccggggt

SEQ ID NO: 23330 - DNA, 201 bp, Bos taurus
acaggttgaggaagtttccagctatttgtaatttgctgtaacattttatcatgaatgaacattgcattttaccaaattttttttgtttgttggctttttttcaggggggcaggggcaatgactgaaatgattatatggcttttcctttatgctgtaaatagagtggtttacattatttgatttcaaatgttaaaccaacct

SEQ ID NO: 23331 - DNA, 201 bp, Bos taurus
gcttggaccttcagggtatctttaagtatttcattcgtttctgtccatatctactggacttcgagcttcttgaaccaacaagtggattttattcaactccgtcttcctggtgcctagcacagtctagaagccattaggcttgttgagggaaggaagagaaggaaagagggagatagaaacggaggggaaaggaaagaatta

SEQ ID NO: 23332 - DNA, 201 bp, Bos taurus
ttaggatctgccaccttccacgtgtctgaagccacaaaagcagttgataggattacttacgcagaaaagctgtcacctctggtgggtcaggcttgccgatactgtgaccgtaaagagctccatgactgcactggaaattcgtctcctcgctttcccagaccggattcgcttgctggtagtaagccagtttctcattcacag

SEQ ID NO: 23333 - DNA, 201 bp, Bos taurus
atggatgcatgggtggatgagtagaaggatgaatgagtagagggagggatgggtggatggatggatagatctgcctctccccagtaggccatggggaaaaacagtgtcctgggggtttggagtctaaggtttttggctccagttgagccactactggactttgagcaagtaactaaatctcccagtgtggcctgtttccta

SEQ ID NO: 23334 - DNA, 201 bp, Bos taurus
gtaagaggccgtgctatctgctgaaccccagcctcagcccccgtgtgcccggccagcctcggagggaagaccgcagtgctggggcgccggccctttcagctgccgccttctttcctaaggtccttaacgagcatgctaattagtggcaatttccctggtggtttgtgtgatgtggagactcctccactaagaaatggccca

SEQ ID NO: 23335 - DNA, 201 bp, Bos taurus
ggctccaatcacatttcaccagtatttccacacgcgtaccttctctgttccatagtccatgccaagacatcacactgcattgagtcaccgtgtctctttcgtctcttttcatgtgtgacagtttttcggttttttttccttgttaactcatgaccttgacagtctggagaaataggagccaggtatttttgttctcactct

SEQ ID NO: 23336 - DNA, 201 bp, Bos taurus
tgcctgctgatgggtgagagctgcgaggaaagcctgccaaagtgaggggtttcccgcgaccagccaggcccgtctcaggaggccctgacaccatgctctcacagccatccacacctgcctctgacgagcggaaaaacacatcagctcctctctggacagaggtaagtgacacaggagacttcaggagtcggccttcaggct

SEQ ID NO: 23337 - DNA, 201 bp, Bos taurus
tcttcttaacttcctgaagggttgggtggatcgactgtttggcagacaaccaagggattccactgttttgcccagaatgcatcttcaggtccacatagtttcagggaaaacaaccaaaataaagaaacaagcccacagccttaccaatcgatggatcagaaatataactgtctggggatggggtgagcggagagagtctgg

SEQ ID NO: 23338 - DNA, 201 bp, Bos taurus
ataaatattttgattgtcctaaaattttctatccagaccgtctgcacatatactataattatagtgctaccataacaactatttctcaattacagttgatgaattttcattataggcctgcattttcaggttgttatgtcttttctaaacactctagaagcttcctcctggcagctttcctctaatttgctactaatttta

SEQ ID NO: 23339 - DNA, 201 bp, Bos taurus
aggtagtacagtgactacctggactaaggatggagaaaagcaacagatgtgagggaaacagtgaagtgtgacagaggcactgaaatggccctgagtggctcggtttggatgactctagttagttctatagatggaaagggaacacagaagggatcctcagaaaaagaaaggaggaaagagaggaaagtgcagaactgtccc

SEQ ID NO: 23340 - DNA, 201 bp, Bos taurus
ctgtgtgtgagagagcagtgccaaggccagcaggctaggaaggacagaggtgagaaggcaccgtggagcaatttccacagcatctcactactctgttctgctgattgcttatcaatcagcagaactccctatagagacttcaagaaactcaagagacgggctgggaattgcaggccttagtgtggcagatgctatgcattc

SEQ ID NO: 23341 - DNA, 201 bp, Bos taurus
aatctgtcatcagacaccctctggggataccataatgaacatccatggtctgtgtgttgaaggagctcacagtctactgaaagcaatttctgtacaataaggattgtgcataaatataagtcctttatctccaaattgttagagctctgtactagatataaacatgtcttgtgacagtgaagcttaacaaacaaaataata

SEQ ID NO: 23342 - DNA, 201 bp, Bos taurus
ttcaccaccttccccgcctcccaactctaggcagcccctaaggaactctgcgaaaactgaggggtctgtgtttgaaaaccgctcattcaaggagagtgacgtggcgagcgtgacaccgcaggaactttcattcattcctaacatttgcttagtgacttgatccaacaaaaacatatccacttattaactggaaatgctgta

SEQ ID NO: 23343 - DNA, 201 bp, Bos taurus
agcaattgtcagccacttcaaaaataggcacccctacctcacctgtgctgctaaagtctccttccctgcgcacacccacccctgggggcagggcctttcatgtttccattaatgactggtttagttcacgttctgaatgggaaggaaagcccgtgcaacactagataccagtgtgcatgggcatgggtacaagccctgacc

SEQ ID NO: 23344 - DNA, 201 bp, Bos taurus
tcatctacttaatgacaaattaataaaataattcatatgttcactatttcttactctttaaactttagatgactagtgttctctgtatctctggatacttacgttattctagtgttttcctatattttcactgaattttgaccacttttttttttttttaaacaaacactgtttataaatactatgaccagaagttgagta

SEQ ID NO: 23345 - DNA, 201 bp, Bos taurus
ggcccacatggaaactaaagacaccagctgactaccagcatccacaaccagacatgtgggtacagaaacttccaaatgactcccacctccagcattctagcactttactgaggttacagacataaaggaagaggtaagtcatgcttactgtatcctttctgatttcctgacagaatacatgaacaaaacaaatggttgttt

SEQ ID NO: 23346 - DNA, 201 bp, Bos taurus
attttcctcgcttgtgaggccaaggggatctgccagcaagtgatgctgcctttagagtctctgtaccaacagctgggttagtgagatcaaaaggaaggggaactggagagcccttggagacaaatacagagaagcccaggtggcagagtggtaaagaatcagcctgccgatgttgaagacccgagacatgggtttgatctc

SEQ ID NO: 23347 - DNA, 201 bp, Bos taurus
cagcaccaataattatattattctaacacgactgtttccataataaccatgtcactgggagggagaggcaattccattacgtgagagtgggggaagggtacggagcaaagaaaacagcagatgtctggtagcccatgcacatcaaggactggaaaacaatctcttgctaggtttagcaaaaccttgtttatgcagtcatcc

SEQ ID NO: 23348 - DNA, 201 bp, Bos taurus
aacaaattatagggagtggatatgtgcttagctgtgaaacagatatatcatttatttaaaagttctgttcattcatagttgaatcaaggactatgactaaagggaaagatggccttgtactgctgaaagtgtgtgccacataactctccacttgtttttctattttagatgaaaatgaacattttgtcacattccctcatc

SEQ ID NO: 23349 - DNA, 201 bp, Bos taurus
ctacccttccccgcctctcactcaggcttgggttcccagatgggccctctgggagtcatctcccactcctggagtttgccttccacgtggcagggttttaagaagcgggaacctctcccggatgtctgggaaatgacaagcgaatttaatcagatcatcctggtgtgacattttgagtcgtcaagcgggggctggccttgc

SEQ ID NO: 23350 - DNA, 201 bp, Bos taurus
ccgagctgagctccctgtgctgtacagcagcttcccactcgctatttccacagggtagtgtatatatgttaacacttctttcccagtttatctcaccccctcttccccacgtgtgtctctgttcctgccctgcaaatagattcatctttaccattttcctagattccacacgtatgcattaatatatgatacttgtttttc

SEQ ID NO: 23351 - DNA, 201 bp, Bos taurus
actcatctacaacttgcttccactaatgagagaaaatgtctgctgatcacttggactttggtcctgaatgttttccaggaatggaggccacatcactcattccccaatacaatctgccttttgctagttgatcagcctggatataaatagaaagagcctgggccaggccccatgctgaatttctccattgcctttgagata

SEQ ID NO: 23352 - DNA, 201 bp, Bos taurus
gagagagagaactagccatttgatctggatcaattcaatggttaatttattatttatttaacaaacatttcttaacaccgatacagggccaagcactgggtgtacaatggaaaacaaaatgcaatgtctctctacaagggattatggtgtaatggaacataggaagcagacataactttttcagtgtggttttccaggccc

SEQ ID NO: 23353 - DNA, 201 bp, Bos taurus
tatagtgcatttttgcctctccatcttggtgattggcttttaaaaggcttcaggatattgtaagtgggctccattcttagcagcaatgctctgtttggcaagaaaatccccaaagtcatccacattagaactgaaccactgtgaggtccttgcggctccctcgtgtcataggggcttttgcaggcctaatggaactcttct

SEQ ID NO: 23354 - DNA, 201 bp, Bos taurus
acagaggcttgaaagcccatggctaaaggacctcaggagatttggagccatgtaagcagaagagaaacacttggcttgatttcaccattcttccacttacgttaaaacggcaactgcaaaattcttattgaacagattgagtagctgtctggtttgattgtagcttcagcaaatctgtgcctttgacctccatcgaattgc

SEQ ID NO: 23355 - DNA, 201 bp, Bos taurus
tgacaaattggactataagactagatcggattatagcctaggttaaaaatagtaaatcaatgctgaatccttaggacttgataactatataatgataactctaaaaaatatccttgtctcaggagagaggacaaaaatttggaaaatgttaaaaattagcaaattctgacagggaaacataggagtttatattaatctttc

SEQ ID NO: 23356 - DNA, 201 bp, Bos taurus
ggaaatagaagaacattaaataaaccataatagcaagtattatgaacttataaatatatacacagtaacttctagaaaataacttctatgatttaaatttgattatataagtgactatttcaaaattgctgggctaaaactaaattagctcttcaatatggttaaatggttgttctcggtttgtgcttacaaacctaacaa

SEQ ID NO: 23357 - DNA, 201 bp, Bos taurus
caactaacacatttctgtgatgacccagatttcaacaatcaccagcatgtaggcctgtatagcccacaaagcctctctccccaaacaccagcctgcagtgggtaatgcaaaacatctactctggccactttaaatgcctaatatgcctcctctaatcctttggaatagatgctattgatccattttacagatagggaaact

SEQ ID NO: 23358 - DNA, 201 bp, Bos taurus
accccaaattctctctcttaggagatctgaaactgcaagccgctcttcattaagaacttgtttttcactggaaagcccattccaaacgttggccacagtttactccatctgatccacgctttttatctcttctcaaccagacaaatgcataataaagcttcatttgctgcatgatcaggcaatccattttcaagactggat

SEQ ID NO: 23359 - DNA, 201 bp, Bos taurus
agagggccccagaagttagagctggtacctcaggaaacaggtcaggatggagatgcaagtggtgaattatgaggaaagactgcatttcccagcctttcttacagttaagtttggccatatgactaatttctggacaatgggatataagtagaagttttctgaagaaactggaaaagttccttcaagaaaatggactcagct

SEQ ID NO: 23360 - DNA, 201 bp, Bos taurus
gggccatttaaatgctatatgttaactataagaagaccgggtataaaggctaggttacaaagtggagaagagaaaactgtgattaggaggaaaaagtgatgaaatggccatagtaggcagtgttacttactgtgtttgacaggataaaccacaaaagaattgaaggatatgcactttattgttaaggattctacaatctaa

SEQ ID NO: 23361 - DNA, 201 bp, Bos taurus
caagcctgttaataattcctgggaaaccaaaatagaaaataaaatccaaccttttttcttcttctgtgcttggtctagtttcacgtgctcatagagggccatgtgcagagggcttgaacttggcacttcacaccagagttcctggttcaaaatggctccctccacacctcagctgggagggccatctgcagatctcgcgca

SEQ ID NO: 23362 - DNA, 201 bp, Bos taurus
atatttatgttcttttttgtagattgattttccaggctgacctgaatgctctctttcttggccgtggctatatacccatagcacttggcccatagtggacatttataatttagtcttgaaaatattgcttgttgactcgttagaaatgatagagcaaaaggcctggaaacttgtcatcagattaacagttgggactgcgta

SEQ ID NO: 23363 - DNA, 201 bp, Bos taurus
cttagagaccccatggtctgtagcctgtcagctcctctgtccatggaattctccaagccagaatactggagtactgggcaaatgaattaactcttttgagcctgttttccctatctaaagtgtaatacgactacaactcattttaaagggctgtttctgaggattcggtaagataatgaggtaaaatggccagaacaatcc

SEQ ID NO: 23364 - DNA, 201 bp, Bos taurus
agttaatttcatattcttttattatcctggtttattgccctgtttaagtgatattctttatacttttacaaaattgactgtcaaaaaaattggtagcagacgtcatgaaaaaaatgagataaaagaaatttaagaactagtgattttaggatagtgtaatgttgacctctggaaaatgttgctatttaagaaatattgttg

SEQ ID NO: 23365 - DNA, 201 bp, Bos taurus
aacacacacgcacacacaaaggctgtaatagaacatagtcaagatgctgtgaagaacaagggaaggagaggtcaacagtatgtttggagagggaacaggagagggtaatattgcatctagacaagaaagaactgtgcagtccagggaatggctaggaaagggaggaggagaagatgagcatgaactagcagatttctgggt

SEQ ID NO: 23366 - DNA, 201 bp, Bos taurus
tttgactcacagtaccaagtctgtctcctccctcttgttccaacacaccttcttgtccctgagtgggcttctagccccaacctttcctggcttggcccaccctaccccactgtccccacaacaggataccttatatttacacaagtattaataaccttgcctggttgaccaggccaaccccttagtagtgactacttaaaa

SEQ ID NO: 23367 - DNA, 201 bp, Bos taurus
gtggtctttgacaaagcaacaaagtatgttgtatcaagtgtgaaagtctatgtatttttttttggagtccacagatctcctgaaatcacatgagcttctgcggacccaacatgaagaaccactatccaggagattaactagttgagttggcctcaaatagggcagtactgcccttatgatgtatgtgagaaatgtgaggag

SEQ ID NO: 23368 - DNA, 201 bp, Bos taurus
atgtggcggagatgggtgagggagcctttcagcagacgtgggcagaccacgaggctaaggagcagaaaggacccaaggaaagagacttgtgggggctgcagcctgtgacagccgacagctggtacctaccagctggtacctacatgttcctgggagcatcacaggagtcgaagaaaaagaccacaggttcatgagccacag

SEQ ID NO: 23369 - DNA, 201 bp, Bos taurus
ttaaaagtaggcttagtcttgtgtagtacacaataggccagagagttaacagggaagcagtgctcctcctgaggctgctggagagcagcggccctcattagccagaggtcccctttgggtaagatgactgccagggagagttgggactttgaagtctaagcctcttttgaagaattccccaccgttactaactgggaggtt

SEQ ID NO: 23370 - DNA, 201 bp, Bos taurus
agaacaccctgtgccgacgagagcagagactagagagaggcagctaccagctgaggaccaccgaaagcaggaagagatgaagatccttccctcgagacagcaagccccagccaccaccctgacttctggcctcaagcctgtgcaacaagaagtttctattgtttctgtcactgtctacagcagctttggaaatcagtgtag

SEQ ID NO: 23371 - DNA, 201 bp, Bos taurus
aagcatgtatggtgtgtaacttttcagcaaggttatgaacatttgtattaggaaacatccagttaatctttttgggaaagtgtttttgtccggtgtttaaaacagcacagtatattgttctgcctgcctgcatacagtctaggttccacagtggaaccactgttcctctggtggtggtggttacaacaacattgagatatc

SEQ ID NO: 23372 - DNA, 201 bp, Bos taurus
gcctctcagttccatgatgaaggggtggctgtgctggggtctccgctcagccgtctccagcgaaatacattcagaaggcgccgttggaaactgacccgcacggaatagcctgagtcctcaggccagagacatgctttcagacttgcttagttacttcaacttggttcccggggcaggcctttggttgtcattcccaggcat

SEQ ID NO: 23373 - DNA, 201 bp, Bos taurus
tgtccccaacccctgccacccacctgcagcaggaccctagctggagaccctcacagactcacttcagttttccagatgagatctgtgggccatgagcaggaggaactggagtgggggaggtgaaggacaatgttcttttcttaaaaaagcatctaccagcatcacactactgggcctgatgtcccctttaaccatcacttg

SEQ ID NO: 23374 - DNA, 201 bp, Bos taurus
ttctggaggccaggtcagaagttgcttgtctgatccctgccagcagctgggatggcttgcgggcagggacctggggagagtggtgtgattgtgctttgcaagttgtgtggccattgtgagatgcagtggtgtttgctgctatgactggagcaccaactggcagatctgggtgttaccacgtaaccatccttgggtggtgtg

SEQ ID NO: 23375 - DNA, 201 bp, Bos taurus
cagcccctagagaactgggatccgggacccctgatggctgcgcaaccgcccaagcatccttccagggccagtgtgcaatctgttacctggccttgaggtgtggggctgtgtgagcactgagggcagagcttggaggcaagggctgggctgtcagctctctgtgatgttgagcagaaccaggccaggaaagggcagtaggtt

SEQ ID NO: 23376 - DNA, 201 bp, Bos taurus
cctggctaatagtgccacccagagactggtacagggaatttatctccccacctgctccttcccactcactaaggggtgcacacccacctcaactccatcctgtttccctgcactcaagcacacattttgtgtcttccagtcttcagctgataacaataaaggcattctctttcttatgtagcaactttccttccacattat

SEQ ID NO: 23377 - DNA, 201 bp, Bos taurus
tcagcatcagggtcttttcaaatgagtcagctcttcacatcaggtggccaaagtaatagaggggaagaaataaagattagagaaaaaccacacacacacacaaaaaatcaatgaaaacaaaagtggcccttttgaaaagaccagcaaaattttgcaaatctttagctagactgaccaagaaaaagaaaactaaattactgt

SEQ ID NO: 23378 - DNA, 201 bp, Bos taurus
taccttgatcataataaacatggaacaaaatccgccccgttttcagccaggcccgggacacctgcttcgccatttctggcagccttcggtggagctgagcgttaaactggcatagtctgtctgggccaaggaggcaaagcgagctgccagctgggagccagggccgcaggctccagcttttctccttccaaaaacaaaaca

SEQ ID NO: 23379 - DNA, 201 bp, Bos taurus
atactgttaattaagtcaatcacaggaccagctcagcaggtagtatgagaaccagtaagcatggctcactggggccaccagtgggacaggctgccatggtctgctggggagctgtggtgaccatccttgtagaaggatgaggctctcatcggagggcagccagtgaaagggttctctataagagcaacccccgaatcattt

SEQ ID NO: 23380 - DNA, 201 bp, Bos taurus
cacacaaagacattggactgatcagaaatgctggatgctaccagttgaagagtgagcaggctggctagtctctcactctgagaaatgtaaggccatgggaaatcccagcgctctatatcttggatcacttttcctgtgcccttccattggattcccaggtctgtgttttccagattactccagtcattgagggccatctgc

SEQ ID NO: 23381 - DNA, 201 bp, Bos taurus
agcactgcaggactgcctttgctgcttggaacggcttcccagactggccaaatgctggaatctaaatcctagtatcaggattagaaatctgtggtttcttgaaatcatggatataggccagggacttttaggctttattgttgttgtttagttgctaaaggtatttaactggtcatggaccaccctcatgttcatcaatta

SEQ ID NO: 23382 - DNA, 201 bp, Bos taurus
tgcatcacacttgacataatctccagcaggatgagctggggaaattctgtagtccagcaaattgaagttgaccccagagtcctgtaatttccatgtgactatgaagacaggagaggccaatgtgggcagagtgacgagggcttggggatggcgcttaaggaatctcattgagatgggtgttgacaggaacctcatgaagat

SEQ ID NO: 23383 - DNA, 201 bp, Bos taurus
ctgccattggcacctgccatctgcctctacagggatgagatcacgtgctgctgactttcagcaccccgagaggaggccagggtggagagcagaaatgaggcaaaactatacttgaggaagtactggcaagacaagtcttcagatagttaaatatcaggggccgatcctaattcttgtgtctcctcatatcttcatggtgat

SEQ ID NO: 23384 - DNA, 201 bp, Bos taurus
ccaagtgcccggccacactctagtcaccagacaccttccagatatgttctgtgcctccgaccaagccctcttcccctgcgatggctgctggcttcctcgctgactcacatcccatggcctagacacccctctggcctttcagcttccctcccggcctcatggaacgtgttcagatttgactcccttgaaccaccaagctca

SEQ ID NO: 23385 - DNA, 201 bp, Bos taurus
cgcctcacttgtccctccctgacaggaccgcgggtctgtgtctccatgggttggctcttgttctagctctcgtttcgggggagaaggcccattgacctcttccgggctcctgctttttttcttcctcacccttgctcctctgcatcatcatctttctctcactcttgaagggctggtccagtgcacacaccaggccaccta

SEQ ID NO: 23386 - DNA, 201 bp, Bos taurus
agtgctcctacatcaatagcgcttttgatttttgagcagcactgcagaggcagagaatggtagagagagaactcagagatggccggtgcttttcaaggtcacacggtcaaggcagagaatgaaatccaaattcaggcttcttctcaagaaactggagctgaagtttcttggcctcgttggtcagtttcatttttcaacatt

SEQ ID NO: 23387 - DNA, 201 bp, Bos taurus
cactcagttttacatctgaacaatgaacagcaatgccgggaccaggtggacagtgaggacgagggaaaggatgacagagaaagagatgtttcaaggcctaacccctgagacttcctcccgtatccccttcctggtgttccggtgcattctgctgatgaatttagatggtgatgtctacttttaattttatctgcagaaaga

SEQ ID NO: 23388 - DNA, 201 bp, Bos taurus
atggaaagcaccactgtccttggtagcttgagccctccgtacactgataccaggatccctcctgctctccaagttctgggagctatgctaaagaccacctatcctaggatgtaatttcatactccgaagtcaaaacgctcccttgggtatattcaagcttctcccaactgatgcacagattccagagatgcaagaagcaac

SEQ ID NO: 23389 - DNA, 201 bp, Bos taurus
tctattgctgatttatcgcttttgtgtgcttcaggctttctgggggaagaaaaaaaatcctcgacccctgatgggaaagtcggcaaagccggaagtgggcgcaggagttgtgtggagcctcacttcacttcttgaaggcagccagcagaatcacccctggcttggactgcttcgggactggggctcatgggcagggacagg

SEQ ID NO: 23390 - DNA, 201 bp, Bos taurus
ttaaaaaggagcagaagaatgcttatgaggtgccagtcatattttattttttaatctgagtaaagattgttgttttgtcactaagtcaaggccaactcttgtgcaatcccatggagtataacctatgccagggatactccaaggatatctgtccatgggataccccaggcaagcatactgcaatgggttgccatttcctac

SEQ ID NO: 23391 - DNA, 201 bp, Bos taurus
tgttcttcaaactagaaactggaccaagtaagatttgttcaaccaccaatatacatagagcacctactatgcactagacgaaacagataaaacctctgtcattgtgtgcttatgcaagaacaatttgaactttatttcttcatctgaatatatcacttgttatagatctcagaaatattgcctatcgttcaataagaggta

SEQ ID NO: 23392 - DNA, 201 bp, Bos taurus
gtgaacttccttgttttaaaaagatgtgggggcttctctttcccttagaacaaaatctgaattgctaccctgggtttgtaaggctctgtaccatctggcccccgtctagctctctggcatccactgcctagtgctactctctcatttgttaactcagctccaggtgtgttgatgctcttctggtcccttgaacacacaaag

SEQ ID NO: 23393 - DNA, 201 bp, Bos taurus
gagagttgcaaagagaaagtctaagattaacagagggtctttcactcagtgtttatttgcatatgaggaaattcctttaagctagggatacaggcagaggggattgaaactgaaaagcagtaagcctaacaaccaccagtgcacaaagaagtggaaacaatttgtgtttctacttaccaagtgaaaagaccttaatacata

SEQ ID NO: 23394 - DNA, 201 bp, Bos taurus
gtcacagccatctggtttccttctacctcctgctctttcactaaagctacaggaacaaacggagctgcctggagcaaatcaatttcccattatccttaatatgtgaagacgagacttctgacagcgatcgcagtctttgtctactgatatggttgaaaagtcatgtttacgtaacagaaaatgttttcacgtagaagggat

SEQ ID NO: 23395 - DNA, 201 bp, Bos taurus
cacccttttctctttttctttccattccacacctccccttcctctatcacacataatagtggaaatatcatgagcaatgaaggcagaaggaccttgttttaaattctgattctgtcatgtttgataagtgaccttgaagatattacttaatttccatgaaattgaattttataatcatttataaaatgggcatttaattca

SEQ ID NO: 23396 - DNA, 201 bp, Bos taurus
gtcaccatcatcagtgaagtcaaggccgtcacaggggattcactagaatgaccctgcccttgcccatgatgctcttggagtatgtttctaggatatgtttatgggaaagaacacatggcccaggggagctaaaaaaatcaaggctgtgaggttaagaagtccatgcaaaatagtgaagatgaatagtaaggattttatcaa

SEQ ID NO: 23397 - DNA, 201 bp, Bos taurus
ccagagtccagaggcttaggaaaataagcaagtcaaacattagtaatcaacattattctaaattcatttaatgcaaacgatttgtcaaataaagtgaaaacagtctagctgtgcatagcttacaatctcttgaggaaaccagagaaagaaagccaggaagactttcccagaaataaatcaaagctttagcaatgatattca

SEQ ID NO: 23398 - DNA, 201 bp, Bos taurus
gctttagttgttatcattctgtagcagatgctatctatgtatgatttggaggtgatcttagctatggtgcacataaggttaatcgtatttactgtgttgtatactggaagtatccataagttactacccaggaatctctgctgaatcctgaacatcagtttccattcttcaggtccatgcagggcagcagacagaaccaaa

SEQ ID NO: 23399 - DNA, 201 bp, Bos taurus
atgtatgtatgtatcaatcccaatcttcccattaatccctcccctctctgcccccaataaccataagtttttttccataggtttattttttacatatgtgcctctatttctgttctatagatgagttcctttggagcctttttttagatgccacatataagcaatatcatatgatatttgtctttctctgacttgcttcac

SEQ ID NO: 23400 - DNA, 201 bp, Bos taurus
ccagggagaatatgtggagtgagatgaaaagaaagcttaggatgtagtcctaacttgtgtaacatgggtgaaaaaaaataagtacaaaccccagatttcacaaaagtttggcctcaatgcagtgagatgatgagaccacaatggaaggaagcagattaactccaaacaaaatactttccccatttctgtaagtgctttttc

SEQ ID NO: 23401 - DNA, 201 bp, Bos taurus
agcaagctctgaataaacagtcgttgcctgttccgatttggttggcccttgtttattccacactggccccctccatatcttcccctctccagcacagagacgatctagcatacagattgggttgtaggaagagactgaagcccagaaatctgcatggggatgatgggacttgagctgtgctttgaggagaagcatgattca

SEQ ID NO: 23402 - DNA, 201 bp, Bos taurus
ctgtctccccacagcctgctagcagagtggatggttgctctttctgtattttggcagtgcaatggtgagagaaatatactggaatatattaatttgcattcctctttttgtgagtaaaattgagcagatgtataagggtaactcgaattttgttttctgtgtggtgtctagtcatatcctttctctgtgatgtctagtcat

SEQ ID NO: 23403 - DNA, 201 bp, Bos taurus
tgctggcttttggattccagagaaatttgtgtgttcattatctatatctatgtctgtatctgtttatgtctgtgtatcccttttctttatgttcaaggccatcgctaagccgaaaacaatgcttggtttcctctgtgaggcttcttacggggtgagaaggtgaagctggtccctggccaagacccatctgaaagctgtggg

SEQ ID NO: 23404 - DNA, 201 bp, Bos taurus
acatacacaagcattctctctatgggttctcatactaaaaccaacatttatctgctatagcataagagagtttccatgtgagcaaatcctctgtgagaaactgacccttatccattcttatgatgataaatgtgaaccataagaaatatataataatgtttacttctccagcattatcagagtttgaacagattcacataa

SEQ ID NO: 23405 - DNA, 201 bp, Bos taurus
aagagctacaaaagcctaggagaagctaaatcagattgaagtggaaaggtaaagaaggtttcctggaagtgacatgagaagagatttttaaagtatgtgttagctagatggataatgagagaaaggcattagagatgaaggaagcaacaaggtaaaaaaaaaagctcagaagaaagaaaccacaggctgttttcagaaatg

SEQ ID NO: 23406 - DNA, 201 bp, Bos taurus
atttttttcccctgaagtcctgtctgttgcatcataatccctttaactcaacattttattttatataaagcactttgactagaaacaaaaatagagtttacataataatcaaatttggtggcacacaagtgaaggactggctctttagaatgttatctcaaagaaaatattttctatggtaaagtctcacttctaggtatg

SEQ ID NO: 23407 - DNA, 201 bp, Bos taurus
aacttgatcaaaaccaaaataaaatctggaagcaaatgtctcttgccgtaccgtcacagccgtttatacatattataggacactttgcacttcccagaggggaaggaattactcttcttcaaaatgatgctaacagttggctacattggaaccaaatggtgaatgtcttggaaatatgggaactcctatgtataagtaagt

SEQ ID NO: 23408 - DNA, 201 bp, Bos taurus
accaaagtaaagagcaattttaattaagcaaaaataatgagtttattcaaaataactgcaattcgggacaaatgattctattctggtgaactgtagacaagtcctggagaaggcaatggcaccccactccagtattcttgcctggaaaatcccatggacggaggagcctggtaggctgcagaccatggggttgcgaagagt

SEQ ID NO: 23409 - DNA, 201 bp, Bos taurus
ttgtgccagatacattcaatcctcattttatgtatccctcataataactattgttatcacttttcagatgaggaaactgaagcagtttgcttaagatcacgcagcttgtaagaggcagaaccaacattcacattgtgggtatcagcgccagagtctgggtcttgaccccttatccttagcatctcacttgggaaggacatg

SEQ ID NO: 23410 - DNA, 201 bp, Bos taurus
atagtatacaacagtcttttgtgctggatttgatgttaagctttggggcctcagtcttgctattactgatatcagcagatttttcttttaactgctatccgtgtggcattacattgtggatattccacaacttttatattcatttaccagtgggttccagtttggagctttatgaataaatctgatattaatgtttacata

SEQ ID NO: 23411 - DNA, 201 bp, Bos taurus
accaactgagctatcacatattcttgattcctccttttgtgcctgtgcgaagcatttataggcattcaattatttatcacaggcctactatgtatcaaatcccataaaggatataaaaaatacataatatacagtctatagcaagctatgaatgaatgaggccaagacagataaatattcaacatcactaaagagcatcca

SEQ ID NO: 23412 - DNA, 201 bp, Bos taurus
taaacactggcttatgatgtaaagtcagagatttgtttatatggcaaaattctcctatcatatataattaaacatttggggagaaaaaaagcaaacacataagtttactggctgtgagtggagaagagaggtatattagcactccaacagtattttcctatccatcagagtaccctctgcttttgtcatcaccaccaaatc

SEQ ID NO: 23413 - DNA, 201 bp, Bos taurus
ggaagtcctgtaacaaagtcgtgcataggaagtgtcctgcctctgactagaaagggctgtgttagtacccccaccagcttcactcactgggtgggagcagactgcaggaagcatggcctcaacaccaagaaggtggtggatctagaggagatattgcttcctgagcagaagatccaaccagcacatttccagccaccgcaa

SEQ ID NO: 23414 - DNA, 201 bp, Bos taurus
tttctgaaaggtacaattgagttatataataacatacaggatgaatttagatttttacatgtaaaatacatccacatccttactccttatggccttttttaaaaaaaaataagcaattctgtgttccctatcacccataggatgaaatccagaaaacttgtctggccatcagagttccttaacagtctgactgcaacctac

SEQ ID NO: 23415 - DNA, 201 bp, Bos taurus
tggaatccattgctcatgaatcagaggaagagaagaggtgattattccgagccaagaggtcattaagaatccttgcttcggtcagaaggccagtctcctcgttagctctttctccagcttcctggctgtggtctttcttctgggcatgctccttggagctaccaccttgtagggccagggatgtaggaagtggtctgagcc

SEQ ID NO: 23416 - DNA, 201 bp, Bos taurus
cttcccacagtcagcatcctctcattaaagtcttgataacaccaaattgctttttaaatgcctcgtactctataaagctgatgagcagtgaaataaatctgttcagtcaacggagattgggtttattctcaggggtggcaggaggtgggtacgtcaaggagaagggactgaactgaatccttttcacaagaaattatttca

SEQ ID NO: 23417 - DNA, 201 bp, Bos taurus
aggccacagcagagaacactggctcttgctctgggtgggaagggaaacaggagggtttgagcagagacgtgacatgaacccgtgttgcttctaaaggatctggccttgcctgctctttcgagaaaagatgggagaggtaagggggctgggaacaggatggctggtagccgtggaagtaaggagtcagatttctggatctat

SEQ ID NO: 23418 - DNA, 201 bp, Bos taurus
gggacagagcacagacatctggacctaagggtcaaacagccctgtctgggaatctctgtaatctggcatggagccagccagcaagtaagaggccaggccacgcaaggtgctcagagaagccacggtgccaagtacaggcagcagctgaacgaggagatcacagggctcagtcactccatcatgtccgactctttgtgaccc

SEQ ID NO: 23419 - DNA, 201 bp, Bos taurus
agaagccctcacaatgcaactagagtgtagctcccatcaccgcaactagaaaaagcccacgtgtggcaacaaagacccagtgctgccaaataaataactaattaactttaaaaacattattcaaggagaaataagcccaacacaaaagaccatactatgtgattccattttatgtaatctcaaaaaggcaagagctataat

SEQ ID NO: 23420 - DNA, 201 bp, Bos taurus
ttggaggctcagattcacagcattcaccctgttggttccaaactcgggtgaacagatttctgagctcctggcaacctgttccagtgtggctacagagggtaatctggagtcacaccgatgggcctccaatcaagggctcccttgattaggacagttgtggtctgcccatatctcagctctgcttgtgcttctgccctgaca

SEQ ID NO: 23421 - DNA, 201 bp, Bos taurus
gctggggaggagggtctctccctgatctcctgcagtgacagccttggctggccacgcacagccattcctgtgcagacccaggcctctggggctcccatcaccacacagcgctgctcacaaacaccggaagtatctttccaacaaactgtaattacacacgtgcttccctgaagttccacactctccgctgggcaggccgtt

SEQ ID NO: 23422 - DNA, 201 bp, Bos taurus
gtgcatggcatgggtaggggctgcggctgtttggtctctgtgatcgtcagaagccagccggtgtagggagaaattgggtcatctgtagtgtgagaaagacgaatgtgcttcatttacagggagagaagctgcttgttttcccaacttgcctttttagaaagcaacttacaaatttgtgcttgtaaaaataacttcctaacc

SEQ ID NO: 23423 - DNA, 201 bp, Bos taurus
taacatcaagaaataaaccaatggaaaatcagacagtttagattatcatctgatatgacttttatggaaattaaaatctgtgtataataaaaattttactgctaagattatggaagatgaatgctttagacatgaaacgttatctaccatcttcataaaagaaaaatactaaagagaaacttgtctccttaaatagcatgt

SEQ ID NO: 23424 - DNA, 201 bp, Bos taurus
gccacctgttcaggaacagctgcttctggctgacgcagagcagacaggtcaccagtgggtacaaggcctgaggagagagaagaggaggccacaggatgatgtaattgcaatcactcaggtaacacaggctctctggaaccaccgtccatccatccagctcccctgtgtgccgtacaggccaggctctgtaacacacccacg

SEQ ID NO: 23425 - DNA, 201 bp, Bos taurus
gctcctgccacggagctgagagagccgggaactcttctcgattctccatcttgcccatcaaattaagtgacaatgaacggggctatcattcccatgcactgaattctctccagaatctttttttatttatgtcctatctttcccattaattaaattttaatagcagttttttcctccagagtttccaccatatggatgaac

SEQ ID NO: 23426 - DNA, 201 bp, Bos taurus
actcacctctcctcctctgggtgcacatctcaacgcccggccaagtgaacactttcactctaccccctgctgctaagtctgggctttgtgcttccagccgcttcacttccacgtaccaggccagccatttaaatgtccgtatgttcccagcatggctctgtgggggcacttgtgactctgaatgtaaaacaggagactcca

SEQ ID NO: 23427 - DNA, 201 bp, Bos taurus
aataacattgacacctaagaatagagctcgggtgagtaaggaagtaggtgggtagagaggtctaagaaccggaaaggcccagcaagggcactgtgagtcatgccaacttcagagagagtttgcagaactgccaagggcgattgtttcggccagggcttaatcctgttaaggtctttcgtgaaatttcagttttgagacatt

SEQ ID NO: 23428 - DNA, 201 bp, Bos taurus
tttttaaaatgtatctgttgcactttatatattatataacaggtaatacagttaaagcaatgaaatgaattagaaaaaagacgataagtccattggatttggaactcagttgtttgtaggaaatctttacatagcaaaactaagcatctatgctcacaggagagcctctcaaatccaaatttttttttttcatttaaaatt

SEQ ID NO: 23429 - DNA, 201 bp, Bos taurus
ccaccaccaccaccccgaggccagtggcagcggtctgcagtcaacagctggtctcctggggatcttctcctcccttccacatctctgctgttaggagactcgggccaggaatcatcgccactccccaccctgtaaacccaacccaaatggcatctagatgcccactgtggtgaggatgaagcaggtctttactgaatctgc

SEQ ID NO: 23430 - DNA, 201 bp, Bos taurus
accgccagccccggccctcggcgcatagttgagggatggagtcacacaggaaactcaaggagacgtttgcctgtgagtctgcctgtgaggtttgggggagaaacaagcaggcactcggccaagcgcagcgctgcccctcctcgcccaccgcgaacccacattcccaggagggaagcggcccgggcacccgcgcgcccgcag

SEQ ID NO: 23431 - DNA, 201 bp, Bos taurus
ctcctgtcgagaaaggctttggggaggcccatagctctcagccctggttacgttaggaatgtaagtgtgggaatggctacccacttatgtatgcttatatataaatgaaatgaatgactgcagagatagaaggggtgggagggaggaatcaggattattttactgttataaattacactactagtgaagtaatcagtataa

SEQ ID NO: 23432 - DNA, 201 bp, Bos taurus
ttgtctgctttgctaaccatgactctttactggttaattatccacaaagacgtttgctccacagtaattttccagttctaaattccttccaaacacaatgtgtgcgtaatcactagaaacttgcacacaaacgtggtcatcctacttacataatttaatgttatgcaaagactaagtcctagagaaggaaatggcaacccc

SEQ ID NO: 23433 - DNA, 201 bp, Bos taurus
ctccactgcaggagttatggccctatcagagtctttttttagcctctggtagctggtgatcagacggcctctttggccagtctttcactgaagctctgcccattcaggcatttggagttctcttatcttgggtccttctctgtggtttggcatatcaggcatatagaagggccccctggctggggtcctagtgtgtattgg

SEQ ID NO: 23434 - DNA, 201 bp, Bos taurus
ccttaatgttgatggctgttgcctctcaggatggttgtcactgaatgttgggttgactttggtaatgtcttaaaataagacagcaatgaactttgatgaacagatttacttttccttttagacaatttttctgtagcatataatgttgtttgatagcactgtattatcagtaagatttattttttcaaaattgaaataaat

SEQ ID NO: 23435 - DNA, 201 bp, Bos taurus
attttatcttgtcatgcataggagtcattaagttgttttaggccatgagattgcatggaagtttttgcatttcaaaatataactttaaccttaggatacatgagaggattgagggccagggagaatactaaagaagccattgcaatgagactagtgagagaattgttggccaaatctaacacatagaggtgagagacaaaa

SEQ ID NO: 23436 - DNA, 201 bp, Bos taurus
ggtgaaaacagactactgctgggagacccatgagcaagcaacaggccctgctcccactgattcaggaaagcatagatagcaccagcccctaggacatccatgatcatgcagtgggccttaccttcagtgctccatgaaagtgcagagagtaccagttcctaggaagtctgcaagctgggcccaggacctactcttgctgtc

SEQ ID NO: 23437 - DNA, 201 bp, Bos taurus
ggggtcacaaagagttggacatgactgagcaactgaactgaactgaagtgaggtgttcaggggtttggggatacaagccatcaatccccttgcatggcccggcaataaacatttctctgcttcatacttttatgttttggtttgtttggcttcactgtacatcaggtaccagaacattcattccataacatgaggccctag

SEQ ID NO: 23438 - DNA, 201 bp, Bos taurus
ctttagctctaacccttgtgctctgttgcctgtgcttagtcatgctggctctgtacctttgtgatagaatgttgcctagagcctgaaatatagatgataatccactctcaagactctgacctttaaatatataacacttttccattcacacagagataaaaagttgcagaatataaaataacaattgtcttgttggagatt

SEQ ID NO: 23439 - DNA, 201 bp, Bos taurus
ctgctcttccccagtagcatattggatactttctgatctggggagctcatcttctggtgtcatatctttttgtctttccatattgtccgtggggttctctgggcatcagtagtgaagttggttgccatttcctcctccagtggtccatgttttgtcagaattcttcactatgacccatctgtcttgggtggacctgcacag

SEQ ID NO: 23440 - DNA, 201 bp, Bos taurus
aatgaagaggtgacaggatggttatctagagcagtggtttcaaactattttgctcatatatctcacagtttaaaaaataacagtcaatgcaatatctgattttaaatatattttacctattcattttttgatcaccagttaatttagaaaatataatgtatttgatgtaaagcttattctaggaatagacatgtcatttcc

SEQ ID NO: 23441 - DNA, 201 bp, Bos taurus
aacctgtgtgactgaaaaaaaaaaaaaaaaaaacctaacaaagtatctatgtatttctaacaagatattttaacatgacactttttactattaaattaataaagtcttattttactaaccacttaaaagatattgagtagctgaattaatcatttagccctcattttactcttccatactttttttttttccccaattagc

SEQ ID NO: 23442 - DNA, 201 bp, Bos taurus
tttctcagttttttaataatgaatcctagtcttacatataagtctcaggtttttttcctgatgctcaaccttcccatcaatgtccattgcagcttctttatggtaggcttgtgtgtgcctgagtaaaaaggtattgttttagtttctagaaatttatttataggaaatcttaatctctgagtcaaatgctattgcaacatt

SEQ ID NO: 23443 - DNA, 201 bp, Bos taurus
ttgacatgtttattataacacccatttatttaagttttcaattatcaaagagtatgctcttatccctggaagtgtctacatagatgttattagtgtgtatattgcatatttttatccatgaacacgatccccttctacttctggaaattactaaagatatcttacataaatacttccaacaagaatgaaataaattatgtt

SEQ ID NO: 23444 - DNA, 201 bp, Bos taurus
aggaatcatgaatcaaagaacgtctgttacctcttaaagcttgtaagggccagaagctggattctcctccagtgcctccagagaaactctgccctgatgatacttgattttaacccagtgaggcccatggtgaacttctgacctactagattgcaagattatacatttgtattgttttaagccattagtgaacctgttagt

SEQ ID NO: 23445 - DNA, 201 bp, Bos taurus
tggttgggtgtgtgttttgtgcccttctcaggtctgagcagctcaggtaaccaagtgctttgtgagtgcactgtcctatggagactgcgtgtcttaatcacctccctggtcctagccgctctgcttcctaagtgtgccatgacagcactatcgcaggtgtgccatgtgtctcctctggggagctgatctcaggctgtgacc

SEQ ID NO: 23446 - DNA, 201 bp, Bos taurus
ggagagagtggtctccccgtcctatacctctgccatcttaggaccgaccctaaccattctatcctatattccctatgctatattccaagtgttccctgttcgtacaatgtttttccatgtaatgcccagatacattattttcatttcctggaataataatcagagatcttcacctgttaatttttcttttcagaatcaagt

SEQ ID NO: 23447 - DNA, 201 bp, Bos taurus
attttactaaggatataaaggaaagtttctagaatgaagccaaactaagtaacaaaacaggttccttatccttaaatgcaattctaatattaagtagttaggaaattaggatttgtaacaagctaaaatctagactgatggtttccaacctggctccacattaaaatcattgatcagttagttctggtcagtcgctcagtt

SEQ ID NO: 23448 - DNA, 201 bp, Bos taurus
ttgatcctaattcaggacctttgatatctagtttacattgttttcagttttccagtggaaattcatcctggtcttaaagaattatttgggactcttgtaaaaaatatagatcttgaaattcccttgaattattgattcagtattctaaaagaatacattctggtgtttcactcaccatattataaaattatactaaaatat

SEQ ID NO: 23449 - DNA, 201 bp, Bos taurus
aacacaaatcaggtactgtgtttcagtttaatattgctttaattgcaacaaaacagcttttgtggttgtcaaataaaaactgtaaatagggagtgtagttcaagccatcctgcctgagcagttcctaactgcagggtctaaaataaattaagggacagagagtgttctgggaggtaatgattgactatgacagagacgtgg

SEQ ID NO: 23450 - DNA, 201 bp, Bos taurus
ctcttttcagtgatttgcagtgccacctctgtatagatctgtttctagcatcttcatattctgcagtgttgctctatcttctgactcctcttctgtacatgtacactacatcttttcttcagaattttttttggcattctttgttgtttgtcagacatctggattttagatttattttgttaatttactaatccacacata

SEQ ID NO: 23451 - DNA, 201 bp, Bos taurus
gatcactgcatgaacaccttaagataaagacaaatgcactttgagacttatgtagcatttccaaaagtatgtgtgtgtactcaatctctttaatcatgtccaaatctttgtgacctcatgggctgtacccctccatcctgcactatccatgggattcttcaggcaagaatactggagtgggttgctatgcccttcttcaga

SEQ ID NO: 23452 - DNA, 201 bp, Bos taurus
aagcctaaggagaaaggactatcaaagaaattgaaggaaaatattcaagaaagatagcaaataaatgatgttgaatattccattaaacctgtgagaaaaatgatatatggagaacaagtaaaagtgataacccccatcatatattccctgggaggaaaaagttaagaaaaatggttaatgtgtgtcttagttcagattgct

SEQ ID NO: 23453 - DNA, 201 bp, Bos taurus
caaatttagcaaaacatttaggtaactaccttttcaacaagaggagcaataagaattaattattgtttactttcacacttgttttgtaatctctgtcacagcaaaggcagagcaagcaaatttaaataagagagaccagtaccatgggtactttttactgctctagtgcctaaatgaaaaacaagtaacacatttttagga

SEQ ID NO: 23454 - DNA, 201 bp, Bos taurus
tagctcttggttggcaaaactgccccactggacattagttgttggttggcaaaacctcttccagaaaccaaaactcagaaagaatatatttcaactaaatttgaactgtatttttatcttctccccttgcctggaacaatggtatatttaatctaacatgggtttgttatttatttattagcttattaagagatatcaccc

SEQ ID NO: 23455 - DNA, 201 bp, Bos taurus
tccaaattctggtccttctttagtccttgggcatgtaaacctttactcaccactgggtgtcagtcagtgtgccacgtcggggctggccaaaggacctgttagattttctgggaagggggtacagggaagactggagctgaggttggaggatgatcatgaactgaggactccttggcctcactgttgctgctggctgtcctg

SEQ ID NO: 23456 - DNA, 201 bp, Bos taurus
aggccagaagcatactcaagtcattgcatctcctctgcatgtcatatttgacccacatcattaatgcatggaagatggtttcttcatcaggaacattgacatcatcactggccaggagtttatggagctcctcagctggaagcagtagaaactcttgatttcttataacttccattatgttttcctagagggagagaaata

SEQ ID NO: 23457 - DNA, 201 bp, Bos taurus
atcacgttttaaaactcaatgagtttccagttttattagcctcacttctttcttaggtcatgtgaatctattgaactctagactgttgttgaatatatatacagtgctgcaatttttagtttataagacatttgggattgttatatatcctgcattattttatgaggaaaataagtttcagttgacagattatatggaaga

SEQ ID NO: 23458 - DNA, 201 bp, Bos taurus
tttgcagatgtatttagagaaataaataagactgatgggacaagtcaccattatcaacatggtgtggcggaaacagcattatctttatagttagaagaacatagctgtttcaacggagaaggcaatggcaccccactccggcattcttgcctggaaaatcccatggacggaggagcctggtgggccgcagtccatggggtc

SEQ ID NO: 23459 - DNA, 201 bp, Bos taurus
ttcacttacttgaaagtgaaataaaattatatcttatgtaagactcttgttactttggatttcagtcactaatagttaaaaatattcaaacaaaacaacttagtgagaaattgtgccattttaatggcatccaaggtcatccagagaaccaggtggccaattaaagtgctatttcctattgcataactctaaggcacttgt

SEQ ID NO: 23460 - DNA, 201 bp, Bos taurus
ttttgtgaatttgctccttttctggttgtggaattacttttttggtactgtgtttcatttttagtgtcaagaatttctgtatttcaatagcaatgtggcacatgagaaaaacattaaagtacatccctttttcatgtgtttattctttaagagcgttcaaagcttgcttgctctcaatttaacaaaccacaagtttgttaa

SEQ ID NO: 23461 - DNA, 201 bp, Bos taurus
aaatattttttaattttcatacattagagatgtaacaattcaagcatgcaagtttcaaactgagtttcaatttttctacctgaacttgaaaattttatcagtgctatattcacatgaatttgtcaacatttaaactgctatgtattttttcatttattttagctatcattttattcaaattgctatgtgcatattcattat

SEQ ID NO: 23462 - DNA, 201 bp, Bos taurus
tatgagtcataaaataaaaaatgatacataaatacctacgtctgacattcatgtggtcttatgtcacaataattaacacagctttcttgtttactaaatactttagaccacatttaacatgcttgtcttattttaaatgcattaaaagtgaattacatgattctatttttaaaggcttaatggcaaacaagagaaaaatac

SEQ ID NO: 23463 - DNA, 201 bp, Bos taurus
aacaatttaaaaagagttgtaattaatctgctttcacaaatgaaatactgaatattgaagattctatataattttatgctattcaactaaaacggggcaccacccatgctttgaaccacttgcagtgtgtgcgtacaaaagccatagatgtcttctagcttgttgtctggcccagggttgctgctcaacaaagggttttga

SEQ ID NO: 23464 - DNA, 201 bp, Bos taurus
acttgtttttattatttttacaacccaggaagatgctttggtgtccataggccaaacttcaacttgccataacccctatcccacaggcctctgtgcttgaatttgtcctgatcctagaagttactgaaaacactttaataaaatcataatgaaaaaggccttaaaacacaagtggtacagtgaaaatgcttcctttccttg

SEQ ID NO: 23465 - DNA, 201 bp, Bos taurus
ctggcccttcccagtttccagtgttcagtttcctgtttggaagcttgggtcctgctcagaatatatcatcaatgtgtagacattcttcaggctggcagggaggattggtggcacactgaggcctccatctctacagggtctgattgatgacagtaatctgaattttcctcatctgtaaagtgggacacttaatctgtattg

SEQ ID NO: 23466 - DNA, 201 bp, Bos taurus
gcctcccaatccacaatgaattgtggtgaaagtaaaaaaaaaaaaaaaaaaaaacacttttaatgctatcaatcaactaaaagtgcagtcatttgttaaagcaactaacctacattatcttgactaacaaatggtacacaaaggttttgattaattgtattattttcttttttgatatttaaataaaattggttattctct

SEQ ID NO: 23467 - DNA, 201 bp, Bos taurus
ctatgtttcagggaagaaaggaggaaaaaagaaaatgagcttaacagatgtcagctctttgtcagatctcaatcatatggcctcccctagttttaaccaacaattttaagattcagacaatggggaagaagagggactgaaaatgaaagttgaggcccccaaccaaaaatgtctgccttcccacctcctataaactgaatt

SEQ ID NO: 23468 - DNA, 201 bp, Bos taurus
tgaccccatgcgcagaattattttttcttttttttaatggggggagggacgggcagttcaccattcttatctggggagcagaggtaaataaatacaagaacctgcagacctaagggctgacactataataataggaaggtgaagattccatcactcagaactccttgacaagtgacatttgaatactgtgtctaaacttga

SEQ ID NO: 23469 - DNA, 201 bp, Bos taurus
cttacttgtttttataaaaacctaagcaagcatggtgtaggcaaggcgaggtggggcagtggggaagtggctataagctttggaccagctgactacattccgctgaaggtaaatgatcagctttcaaatatcctatgccatgtaggaatgcacatgcccagattaaagtatagtgcagacctggggaagagttcagagatg

SEQ ID NO: 23470 - DNA, 201 bp, Bos taurus
ctgactctaattccagagggccaaagcagtggtgccatcctttccttcactgagaaatggttgtgctctggctgtggacacactgttcaggagtcctctccggggattcttaatcacttagtggcccacacattcaggcagggcacaaggtagattcaaccagcagatttgctattttagggaaagccatctgtttagatt

SEQ ID NO: 23471 - DNA, 201 bp, Bos taurus
tttccaggattctatcttctgttcttcacttggaaaataaagtttgtaaagactaaaatcctaaatatgactcaattcccaatagccaacagtttttgatatttgctccataaaatttctccataaaatttgatattttctccataactatttgacattttctccatttacttcataaatgtatatggcatttatttcttg

SEQ ID NO: 23472 - DNA, 201 bp, Bos taurus
ccctctgtctccctgcccctactctggattcaactcataagcgttcattgtccagaagatggtcattctgcagatgttcattctataactctccccacccctcccgatctccaagatggatatcaaacaagacactcgcaaagatgtttcataattaaaggattgatttttcaatccagttctggaatcattccacaatat

SEQ ID NO: 23473 - DNA, 201 bp, Bos taurus
ccctaagattggtgtttttgagctgatccagcgcctttcattgtaataatcggttttatgcttttcttccccaagactgagttcttttctggtcacaattcatctcttccttctcaggacctgacatagttttcttcttgtgcctttgatcaacatgaaccattgtttcaagttggagtagagaaagctggattttttcaa

SEQ ID NO: 23474 - DNA, 201 bp, Bos taurus
ctaaatatcttgacaatcgaggaataattaagaatggaaaattatggggccgataaaaataacacttaaaaaggaggtttaatagcataggaggatttttacattctattgaggcgggtataggatagaaaattctatatgaaggtgtgatttacatatagaatgtacataacaagcatgtttatatatgataagatcaaa

SEQ ID NO: 23475 - DNA, 201 bp, Bos taurus
ttttttccttcataatttgaatatactgctttattactttctccaatgtttttgctggaaagtcgagtgtcattctcatctttgatccttgatatgaaacgtgttttgtcctctctggaaaattgtaggataatctttttttatggcccccgttttctataatttcaccatgaggtatgtgattgtacatctgtttttgcc

SEQ ID NO: 23476 - DNA, 201 bp, Bos taurus
gactagattccagtcttgagccacctgtgcctggcaaaggctgaaaagcaaaacgcagctgactattcaaaaagcagccatgaagtttcaggacactgtcgatagcaagatttgtttgttatggctttctatggctacaaaatgcatgaagcagatacaccaaactgtggtcagagcttgggggccaccaccgtgatcaat

SEQ ID NO: 23477 - DNA, 201 bp, Bos taurus
ataggatgtcatgcaaaacagacactgcagggagcaagcttgatgaaccctttgcacttatgaagctgacattctggtggggaggatacagactataaactggcaaatatgaatatatgagattattacagacattatctaaaaaaattaacaaattgatattgtagaatatcctgatgcagcagtacttttgaaagtcag

SEQ ID NO: 23478 - DNA, 201 bp, Bos taurus
gttcggttttttgttttgtttctgtgtagaagcttttcagttcgatatgatcccacttgtctctttttgtttttgttgttgatgcttttggtatcacctccaagaaatcattgttaagttcaatatctagaagcttttaatgttgctttagttttaaaacatcccaatgtgctccttactgattttagtgcatttagattg

SEQ ID NO: 23479 - DNA, 201 bp, Bos taurus
ttcaatcacgaccaatttacagataatgttgtgctagtttctcgtgtgtgttgtcagtttcatcacctgtgccagattgtcaagtgaatgccctagataacgtggataccttagtcaacaagtttcatcatgcttctaagtggaaatgttctggaaattttcctctcagctcttttcacttgcttgtacctttctggatga

SEQ ID NO: 23480 - DNA, 201 bp, Bos taurus
cctccctaactgcctacaagaatttagatggagggcctattccctgagtagagctctcagcagagatatctgtaaggaatatagggtaggtatggtgagcgtgggcctatagatcacagcccattctgcatcccactgtccctgcatggcccattaaatatttgtttatcaaacctttctatcttcccaggtggctcagtg

SEQ ID NO: 23481 - DNA, 201 bp, Bos taurus
agatctcctggattcaactaataggaatttttagggatagcaaacataggaagccacttttgtagtagttactacagtcttttacacaatacattctcaaccagtcttcactgaatctgaagaaggaggaggggaggggaagagggagggggagaaaaggaagacactttcatctttgatgaagaaacttcagttgcgagg

SEQ ID NO: 23482 - DNA, 201 bp, Bos taurus
tctgtttcattatgtgtaaacaagtgggcctcttctttcttttccatacaattctataatgaatttctttgataagtataatctttgctacagtagatagcattttctacatatcccacttggtcctaagagctgtatggatctgaattcatttaatgttgactcttaacttcctcatgaagttgctataagcaacccact

SEQ ID NO: 23483 - DNA, 201 bp, Bos taurus
cacacgctgtccgagtaacaagaagccgtcccagaaacagtcacagaaggtactagatcataggtaagtgttgctgggtaaacccgcttaagcctcatcacgaagacaatttagaactagccatgtcatgcatcctttagtttgattaaatgagttcatttcttgatttatcctttcaaagagattagtcaagactctctt

SEQ ID NO: 23484 - DNA, 201 bp, Bos taurus
ttcttcagtattaagtacagtgaaaaaaaacaaaaacttgggaaatagcagaaacaatatactcagaagcaccagggaattacagatggcccactgacacaaaagagcagctctgggaaagacactcattcattctgaaaacatttattgtttcctgtgtgccagacactggatcaggcggaaggccatgacatagatatc

SEQ ID NO: 23485 - DNA, 201 bp, Bos taurus
aagcaattctattctatctgtgcatttttaaaaaaattaatagcagatgttcctaagcaatgaaaagactgacaaacatgtttggacatgaacataatgcgcaacatgtaaattaatagtattttgtactaccacataatcagtgaacactcaaccacatttgctggatgagaatatttatgctcaaaatattaaaccact

SEQ ID NO: 23486 - DNA, 201 bp, Bos taurus
ttcctcagtgatgacactgacataatttgtaaagcaataataaaaaaaaaaaaggcaattgctgacatccctatgttgttacttatttatgaaattctgcattctcaaaataccaggactaagagacagagttttcaagaaggtgaatctaatacgtgctgtcagctctgctcaatatcttgatttctgaaattgatacac

SEQ ID NO: 23487 - DNA, 201 bp, Bos taurus
tctcccttaggaagttcccctaccagagatttgactattaactcccaaatgaacttctctaagcctaaacttttgctaaaatcttgctctaccttttttttcccacacagatattacagaatgatgtccagtgtatatatacacgagtcattccaaagttagctatcacccataaagtgaaagccactcagttgtgtccaa

SEQ ID NO: 23488 - DNA, 201 bp, Bos taurus
ttttggaatgtacagatggagacatttggtagaataataaatatcagatttggaaatcaggagataagttgctcatttacatctatctctctaatcaatcgttcatttacctatgtacctaatcaattactcatctatctatctatccacctacctacctgtgtgctcagtcgcttccgtcgtgtctgactctgcgacccc

SEQ ID NO: 23489 - DNA, 201 bp, Bos taurus
aaagacaaagatatatatattttagaatgtatcctttagaatatatcctttcagaaaggatatctattttttaagcattgactctttttgtccttctactcctcctttctggacctttatcactttcattatttctatgtttaaatattgagaaagatcaacttcattttagtaaatgaagcttatatataaaaaaacacc

SEQ ID NO: 23490 - DNA, 201 bp, Bos taurus
gaattggacaggactgagtgactttcactttttgtccttccaaaagaaaagtataaatactcattataaatagttgattcctgttaacatttgaatcaagaatgtcttgataacaattttttgacaaaacttttgatttcaaaccaaatgcaagggaaacctttattaggggtttgtctaactgattactatatgttaaaa

SEQ ID NO: 23491 - DNA, 201 bp, Bos taurus
gtggctgccacctaccatacacacacatcatgaaggtttgtttttatggatattttctcatcctttttctctttccccacctactttattccaaggcaagtactatgggctgaatgtttgtgtctccccccaaactcatatgttgaaaccctaatccacagtgttatcatctttggaagtgaggccattgggaaatgatta

SEQ ID NO: 23492 - DNA, 201 bp, Bos taurus
agattctatcaccctagcttttcagtgaacactggcagaaattaaattactttgtcttgacctaaagcagaggctgatgctcagcactttccttttagagacagagttcacatttagagatgttctaatttcctttttagagacgctgcttcttgtcggcaattccggttcctgacgaaagagctttgctgtgttgccggc

SEQ ID NO: 23493 - DNA, 201 bp, Bos taurus
agtgttcaatatgcattcaatatctacttatgtcgtaaagcatgtatatcaaagtaaatactgaaagtcatcagtgcacggaactgcagagagatacataaggaagtgctttcctgaatattttccatgctggggttcttcctttttcccttgatatgctttcattgtgcctcactgaaggataaaggagtagaacacaca

SEQ ID NO: 23494 - DNA, 201 bp, Bos taurus
aaatacctcatgtgagagctgagctggatcatgttgagagaaattctcccaagaaactgttggaagaacaacacagaggggccagtctcaggaaccagggtacctggggaaatagagggtaacagtgatgatcagatgtggccaccagagcaggcaagcttgaagacaagcaaaatgcaacttggcaaccagccatgggga

SEQ ID NO: 23495 - DNA, 201 bp, Bos taurus
atttcagcaaccaactatatcaaagagggagagaagtctaggctgactttctttcccaaagtcactgccacagaccaggcttttactcttttttggcctagattttgaatgcattcacttaactgcagtttcccagtccccagcttctgtccaaacatactaggtggattggagcaaatcaaagcatgtcacttgccaggt

SEQ ID NO: 23496 - DNA, 201 bp, Bos taurus
ccaggtagcaaaaacctcctattatctcttatgtggaggtgggagaattcatggctattgagagggtcgttttatagaaaaagtgttgggcttatgccggggcaggccaataaatgtggtggctgagagagggcagatgatgaatatgaatgccatattttgaactttacttgaggaaataaaccataagaaaaaagaatt

SEQ ID NO: 23497 - DNA, 201 bp, Bos taurus
tatatttgaagtgattgattttggagtcaaagtgatgaaactgttgcagataaatgatttgctcacaaaagcatattgaagaaattgaagaaatctgaaattcagaattgaaaatacttttttttgttgttgggaaatagtgttttactattaagaaagtctgcttcatttgtaaagaaaagcaattttttgttgaaaatt

SEQ ID NO: 23498 - DNA, 201 bp, Bos taurus
actgtacacactttagtgcagacaaagtcttcccctgtgttactcacacatctctgctgttccagcctctggtttccttggtccactccttacaggatgttatctgaattaggatctcatcagccctctaggcagccctctggaatcattctcactcagccttcaaaataactagacagctatagcttctcactgttaagt

SEQ ID NO: 23499 - DNA, 201 bp, Bos taurus
cctgaggtctatgggttctaaggaagctcaagaccactgcatagccagccctcaactgttccagccaatctcagctcaggcaccagacttgggagtgacaccaccattgtggtgcttcccagcccagcgaaaccttcagagatttgcagccccagccactctgactgaactgcatgagcaatcttaagcaaatccagataa

SEQ ID NO: 23500 - DNA, 201 bp, Bos taurus
aacccactgaatctgagttctgcccagccaactcctaaattgtgctttcatgatggagcctgctccttccttgagcctcctgtttttctaactggaaaagtaaccatgctcctggccctgagtccctggaagatacacagttttactgacttctgtgaaagtgaaggaaaacattagtcactcagtcatgtccaactcttt

SEQ ID NO: 23501 - DNA, 201 bp, Bos taurus
ttcttggccttcacaaatgcacatctgacttttatttccccaaaccatctccttcctgtacacccagatcttcttctcgattcatctctgcctctcagacccacccaggcagtctttccggcctctttgagggcttaatggcttcccaggtggggctagtggtaaagaacccacctgtcaatgcaggagacatgagagaca

SEQ ID NO: 23502 - DNA, 201 bp, Bos taurus
caatccatggggtcactaaaagtcgaacacactgagtgactaacatttcacttcattctgtttacagaatagaaagtttactttgactctcaaaatgggtgaagatttaactgaaagaaaattgagaatcagggattaagagatttgatcaggtagagaaaattagtaaattaaagtggtgttctggtctcaagttctcta

SEQ ID NO: 23503 - DNA, 201 bp, Bos taurus
tagaaagcaattaagtaattttctcatgtaataatctcaacaaagtcctgttgtccccatcatggtttattatgtataaggaagattttttgtagaatttatgcattgaatatcatctgtttcagcattccaaattgtattttgtagatatacaattatgtgtgtctaaataacagctttttagaagtcaaggagaaaata

SEQ ID NO: 23504 - DNA, 201 bp, Bos taurus
aatttagggaaaataagttagtgacaggtagaggaccatgaaagactgaattaagagagcctttttcttagagtgaaaaaagaacaccatctacttcagacaaagttccatattgctacatatttatactcattctcttttctcatttctttctggatgggaggtggaggaagaaagcaaattatgagaactatccagggt

SEQ ID NO: 23505 - DNA, 201 bp, Bos taurus
ttctaatgtctcctgtaccaatgaagaatatgatttattggggtctagcaccattttacaaagatggcagtgatgtgtcatttgccgtgtttctataaaatacctttgccatgctagtgtgaattattgctcagttaccattgtttaccacctaattattgcgaagcacttccatccatcactgacaactcagtaaatgac

SEQ ID NO: 23506 - DNA, 201 bp, Bos taurus
cacctacactgggggaaaggacacaaatgttctctctttcatggctaccggtaaacttaaaaccaaggtggtttgagggtcagtttgaaattgagcggttgcagtacactgaggagaagccctcttctactgactgtataggtattgaaaaccaggtgaggtcattatactttgtggtttagatattctgtagttacataa

SEQ ID NO: 23507 - DNA, 201 bp, Bos taurus
gagttagcccctgtgccttcatgtgggttaaaaaggagccagacttgggatcttttattacagtttctttttgcctataaaaaatactaaagaagaagttcttttcagatctatgtagtaagacatattagtgattatttgtgatagtgcgttgcctcagttaaagcaaaagaaacagacttcagctgtgaaaggagaata

SEQ ID NO: 23508 - DNA, 201 bp, Bos taurus
acaagaagatggggacattagaagacagccacagaaggtggaaagcaagtttccttgaattttcaaaacctccagctatggtagcagatgtagaaaacagatatataacaagctctcaatttcttgcagccgtaaacttattgtgaaatcaccgatttagaaagagggaggttttcactcttcaagactcactaaattact

SEQ ID NO: 23509 - DNA, 201 bp, Bos taurus
aatatggtgctctcagtgctaacatagactcactcacagggtcctctgggaccatataggaggggccccaggggagacggtgttcgcttagattaaacagcgaagaagtcaaggaggggaacactgaccaataaagctgaagaagtgggcactgatcacatcataaccaaagactataaccgttttccacttgagcatcgg

SEQ ID NO: 23510 - DNA, 201 bp, Bos taurus
ctctgatgcaaggccaggcctttcacgtcctgccaaaaccagagccgttctcaagctgggtaacttgtgattattttctcctgttgccttctctttgaaaactaattgtagatgtgaaatggccatgtttaaataattcataaaaaataataaatccagaggaaagtggcaaagggtacagagaaacctgctgaagtacaa

SEQ ID NO: 23511 - DNA, 201 bp, Bos taurus
gagaacaagcatttgacaaaattcaatacacattcatgataaaaagtctcatcaaagtgggtatagaaggaatatatctcaacataataaaggccatttacgacaaaccataactaacatcaagtcaattcaattcagttcagtcactcagtcgtgtcagactgtttgcgaccccatgaagcgcagcacgccaggcctccc

SEQ ID NO: 23512 - DNA, 201 bp, Bos taurus
ttttggacaccagagatgttcatctcaataatcacactgatattcacacccgtgtggcccctcattcattcttggctggccctgtgactagatttttaccagtgatctatggtggaagtcaagctgcaggactttggaagctaaatcacaagaaagcttaggccaccatcctaaagaaatctgctttctttcctaggacaa

SEQ ID NO: 23513 - DNA, 201 bp, Bos taurus
tggggtcacaaaagagtctgatatgactgagtgactaacactttcactttttagttttcacttgaccaggcaccagggccctagattagagcatgaagtatgcaccctgggaggaaaatcgcctcaccagaaataatttcactctgcccaggttgagagggtgggagccaccaggcccaggcaggatggaacgtgcctgga

SEQ ID NO: 23514 - DNA, 201 bp, Bos taurus
ctggagctttctggttgttttttccttattaagaggagagaagtatacttttaccttattactaaggtaactcacccttttcttcatcatattcattatttgaatgaattgattttccttcttggatttcactgatttgcggttggggttaaagcaacagtagacagcttttcctatctcacgtgtcagaatgagagggac

SEQ ID NO: 23515 - DNA, 201 bp, Bos taurus
ataacaaacagcaaaatgtcctggtgggttccagaagaatggcagaagtatgtccttggataccttcagtgagttgcctttttagtttccattacagggagttgaggtgctgaaaatgtggggataaagggtctagtaggacctaaccctggaagaaatgtgcactgtgcagaaattgtttttaaggcatccctattcttt

SEQ ID NO: 23516 - DNA, 201 bp, Bos taurus
tcttctctgaaaatgtattgggggtggcgtgtggcagtgggggcatcgttgcatctacaatgagcactaactacatcctggatcaaatgtgtggttttttgaaaagaattttttttgtagtcaatggctcatagaggcatgcatttgggctatatttactaaacatgaaataaatgtctaggaactttaggcagactatct

SEQ ID NO: 23517 - DNA, 201 bp, Bos taurus
tggtacaaccactttgcaaactgatttggcattatccatggggtcacaaaagagttagtcacaacttagcaactaaacaacaacagcaactattttgtgcaggcttgtcgtttcacttttatgtttgtttttgtgtcttttttcttcttttaaaatatagttgacttacaatattatattagtttcaggtgtacagcaaag

SEQ ID NO: 23518 - DNA, 201 bp, Bos taurus
actggaggaaaaagtcctccaaaaaaacaacaggatgctagagttactgacggagagcaattgaatccctggaccccaagcacaggaagaaaggactgcattgggatccaatatagtctgtaaagatgaatggcagaaagatctctgtagggtttcaacattctgacgagggtaacatttgctattcattcataaacagca

SEQ ID NO: 23519 - DNA, 201 bp, Bos taurus
taaaaaatagaaagaatggctaataaaatattttagctaggaaagagaaaaagttcacagtaatatttcactgagcacaccaactaggtgaaacatttgaacaacaaaatcaaaattatttgaagaataaaatcagatcttttgtatataagggcttccctggttgttcagacagtaaagaatcctcttccaatgcaggag

SEQ ID NO: 23520 - DNA, 201 bp, Bos taurus
tgggttgccatttccttctccaggggatcttcttgacacaggaatcaaacctgtctcctgcatctcctgcattgcaggtggattctttacccctgagccacctggaaagtcctttattaactctaagtaccttcagtttgtttttttcaaatgaggcagtgtataaacaggtgtgaattttgcctcccccagtcttccata

SEQ ID NO: 23521 - DNA, 201 bp, Bos taurus
cccagtcagggaattagatcccacatgctgccactaaagatcctaagtgctgcaactaagacctggtgcagccaaataaataaattaattaattaaaaaagatcccatctcctataagccagagtactgatataatgtagttctaggcaagtaggtggggaaggaagttatgagggagaccttccctcctcttcttgccaa

SEQ ID NO: 23522 - DNA, 201 bp, Bos taurus
cttctcttgttgcagagcatggtctctagggtgcatgcacttaagtagctcccgggctctagagcgttggcttaattgttgtgtctcacgggtttagttgctctggagcatgtggagtcttcccggattagggatggaacctctctgggtctcctgctttggcaggtggacttttcactactgagccaccaaggaagccct

SEQ ID NO: 23523 - DNA, 201 bp, Bos taurus
aaaatggcacaggtgaaccaatttgcagggcagaaacagagacgcagatgtagagaatggatgagtggacatggcggagaggatgaactgaaagagtggagttgacatgcacactaccaggtgttaaatagccggtgggaacctgcacagggagctcagctcagtgctctgtggtgacctagaggggagggacggggaggg

SEQ ID NO: 23524 - DNA, 201 bp, Bos taurus
attctgagcatgtttgaagtctataagttaagaggcaaaataaggagtgaaaacttatacagaaagaggatacagttgtgggaccaagttcctatcaggggtaaaattagctttgaggagaaaactaggacaacatcctatattaaagacaggtgatatggtcaatgcagactctctttttaaaaatctaagcctctttaa

SEQ ID NO: 23525 - DNA, 201 bp, Bos taurus
tagtcaagtatcacacaaaagcagaaatgagtgtgctccatgtcttcaccctcagccctagagctggatagggacttgactttgtatcagcaaggcctgcttggtagggagcaatgactacagtctgaggctaaatttattagattaaacagaacacattttcatacatagaaaataattgaatcgaggctacttaactct

SEQ ID NO: 23526 - DNA, 201 bp, Bos taurus
tgtgtcaaacttctaatgtacaggagctaatactttgcattgttttaagccagtgaatttgtggaatttgtttagaaaaataaaacagatattttattacattcaagtaggatacctgccagggatgtttatagacaaaaggtaacaacaacagcaataaaaacataatcatctctacagatacaaaagaagtgtttgatg

SEQ ID NO: 23527 - DNA, 201 bp, Bos taurus
gaagacaaaacatttctttacatttacttatgggttcatatgtgtagtctacacttgattgctcccaaattatttgaaaagtctcaaaacaacattgaacgtgtttaaaaacacatgttgctgttaacgtcttttgggaaaacaactgtactaagtcaccttgtggtcatcaagaaccaagtcagcttaagtagtaataac

SEQ ID NO: 23528 - DNA, 201 bp, Bos taurus
tgggcaaattactaaacaaaggaaaaactagcaaaaacagcaaccttcacaggggaaagaaatcaacattaaaaatttgcatttcagacaataccatgaagagttattacctttagtttctctaggtagagcaggtagttgctccctataaggatcacaggaatatatggcgttcctttatactaccatttcttctatatg

SEQ ID NO: 23529 - DNA, 201 bp, Bos taurus
attagtttaagatatttatatgagtgtaagtaaattaagattggcttcaaaaggaaatagaaggttcagttcagttcagttcagtcactcagtcgtgtccggttagtctaagatagtaacactttctggtatgtaaagtgggattatagagtaagagatcaacacttagaagtaggtatttagcagagaggtaattttttc

SEQ ID NO: 23530 - DNA, 201 bp, Bos taurus
ggaaaaagtaccaaaaactatcatcagagaagcaaaagctgaaagaggaaaagttgtatgaaaggaatagggaaagttctataagtaccagttccagttactttcacacatgaactcttaaaacttgtaagtaacaccaaatcagaattgtatttggtctgatttaaaaaaaagaaaaatgggaagagagagagagaggat

SEQ ID NO: 23531 - DNA, 201 bp, Bos taurus
taactgcaagcagaaaaagaagcagcagcagcacgtgttaatgcatagtcccatgtatcttctaaatgtgattcacctgtgtagattacgcatatacaacagcaactgaaaaggaatcaaaggaaggagtatgtgcatgagaatctatatacaaatatctttttcctttttacttttcagtttcaacaatagaataaagca

SEQ ID NO: 23532 - DNA, 201 bp, Bos taurus
ataaacctatgactattgagaattgtggctccagtcctataaaactcatcttttggctcttgaatgttaaaccttgcttatacttttgatctctttttatccctctcgcttcttttaaaatccacttaaccatgttcaaatggttgtctccctcacaccccattattaaatgcacacctaagtttgtagtttttgctgttg

SEQ ID NO: 23533 - DNA, 201 bp, Bos taurus
aattcagctgttttttacttctacattattaaatgcattccacctaaacaaagcattttactgcctaagttacctttcttataagtttaaataatctcttgtcacttacctttaacaaaatggcaaaagtttgagctgccagtgttgcaatgaatattaacatttcagtaaacacaagataagtgttttcagatttaataa

SEQ ID NO: 23534 - DNA, 201 bp, Bos taurus
ctcaaactaactgggccctaacaccccactgcaaaactgcccatataaattcaccaattcagcaataaccccaggccagtgtgtgccctgtactgtttcacttctctcccggctcacacttcataccacagtccctgccactcaccccttctaggacatccaaccaattccactagactccaacacccattctgcttaaat

SEQ ID NO: 23535 - DNA, 201 bp, Bos taurus
accatacaacatgcagcataattttatacttaaactctagatttaaaagttatagctccagtgaatttaaacactctaaattcagtcattcttttccttatggattcttgaaaatctaaagatatactgtgtattcctagatttttatatctttcctgaacaacttcaacagtttgtgagggtacagatggtagcttatct

SEQ ID NO: 23536 - DNA, 201 bp, Bos taurus
agtagatcaatttcactgatagtgctgttgggggcaactataactttattgtttttctccctccttgatttgtcaactactgaaaacagaatttttttttatttttccaggtctattagtcttttattcaaaggttttcatagtctcttggtggtggtggtggtggtggtggtttagttgctaagtcaagtctgactcttg

SEQ ID NO: 23537 - DNA, 201 bp, Bos taurus
tccttatccttcaaggcctgctttcacacagattcaagtttagccaaaggtgaaagtttagagatactaggtctgtcttgagtatgagtacaatcctgtgcagacacctggcctttaaaatttagaaattgatttatttaaatcttactatgtctgtgggtcccttgaaaagtcttcctatatacccccatgaatgactac

SEQ ID NO: 23538 - DNA, 201 bp, Bos taurus
tggtagaaaacactggtgcctaatagccatcagttcagaccacaaggctcctcactgtccatgtcttatctattgatgaatctcaaaatgagatatcaggcagcaacagaagtaaaatctgagattatgctattaatcaaaaactctccaacatatactttcaagttgaaagacaacagatattttccaacattgaactaa

SEQ ID NO: 23539 - DNA, 201 bp, Bos taurus
gatcacactgggtgagcagacaagctgaaagcaaactcagggagagaagaaggggatgtattgtgataacccttgtgagaaatcatgacttggaattaagcgttggggaacaaaaccgaaatggagagaagtgaatgtatttcagatagaagaggagggatagactggacctgggatacatagaatctagagaataaatga

SEQ ID NO: 23540 - DNA, 201 bp, Bos taurus
tatattaattttatagacctgcacagacggttaacagggaattgaggactaaacatatatttatgtaagtgttggtggaatttgacatgaacattcaattgtatcttaccgacacttattaaaagcattttagctaaggggtgccttttacttttccttcttctcttgttttggtccgtttacatttcttttcttgctttg

SEQ ID NO: 23541 - DNA, 201 bp, Bos taurus
actcaggatagacatcggttgaaaggctgtaacctctcaggcctccatttcacacatacatggcagaagagatcttctcaagtctttcttctggactaatcgtttctcaatctacacaaaaaagcccacaaagaaggattcttccatttttactgagttacaatatcttctgaattttatgtaacaagaattcagaatctt

SEQ ID NO: 23542 - DNA, 201 bp, Bos taurus
atgagtactctgagttcatctttaatctttgtcataatctccctttatctcatttgagtcactgagtatgtttgtgaggagttcagttccttggcaccagaaagtctttcctacagcaggaaggaaaatggcaacaaaagtccaaaagagaaaatccatcctattaagagaaaatggctttaccagagcagtattaggtta

SEQ ID NO: 23543 - DNA, 201 bp, Bos taurus
tggccttttctccgtgcatatgaaatattctccaagtgtttctacctcttacaatgctatcttacaatgatatcagtcctgtggtattaggattagggattggccctgaaggacttccctggtggctcagacggtaaagcgtctgcctacaattcgggagacctgggttcaatccctgggtcaggaagatctcctggagaa

SEQ ID NO: 23544 - DNA, 201 bp, Bos taurus
cattttaatttgttcttccaaacaagtgtgaatgagagagtcatggccaagtaaatatgcccaatcatatattccctgtgttgggtgcagaaagtgaagtacagaagcacattagatccgattttggtgtataactctattatctcacatttgaccttttgaaatggcttagcatggagtgaaatatgagcacacattagg

SEQ ID NO: 23545 - DNA, 201 bp, Bos taurus
atcctgaagtaccttagtttggttggcaaattatattgccatcttagatctaggccactttctgctacagagtcccctcattacaactttgtgactactatagaacaattgttcctctcctcagagcacttttcctcctcttcagtgtcactggaacattcagttattcagctcagccatagtgatactgactgaattctt

SEQ ID NO: 23546 - DNA, 201 bp, Bos taurus
agtcttatttacccctgtagccactttagagaaagacagaggaaactagtaacattaggatttcttgaaaagtcaggatgtttaattagctgatttaatttttttgtaggataactttgaatccatgttaacttatctgaatacatagaaattatggtagtaaaaggattcagcttcactccaaatagaagtcttatatta

SEQ ID NO: 23547 - DNA, 201 bp, Bos taurus
gccctgcatggcatggcttataacttcattggattatgcagccccttcatgatgacaaggctgtgctctatgaaggggatattgtgaaatggacagtactataatgactgttgcttcactttttctgtagctattactttgtccttaatttttgcttcatctgtactgtgatggcagtagttttataggtagagatagata

SEQ ID NO: 23548 - DNA, 201 bp, Bos taurus
tttgtctaaaaaggatttcttagtgggaccagaaagtttagtagtgaaatagaacttttgaagcagttgcagtcaagttgagaagtagttttccagatgagacaagaagaacaaaacatgatagataagaggatgaagacctctagcaaaataaatcagtttcttctactgtagagggaatttgttcagtgaagtttaatt

SEQ ID NO: 23549 - DNA, 201 bp, Bos taurus
ttaattgactcaagagaaaatttatgacctcttaatttaacacaatgactttccagagtttgctaataaaaaatgatataacctttcaattaattgaacatgttttcaggaatgtaaataaaatcctttactgaactttagcaatcttgatttttttttttaataccacagtgattttaaagagattggaaatgactgttt

SEQ ID NO: 23550 - DNA, 201 bp, Bos taurus
gaaggcagggtgctacaagatgagggaaacatcaatgtcaaagcatgggggtgagatggatggggtatttgggaattgcaattaaagtctgacttgagcattgagtttaagaataagaaatgatactgataaggcagaacttgttggcaggatccaagccattataaaatttcctgagtaaagacattaaaggaaatggtt

SEQ ID NO: 23551 - DNA, 201 bp, Bos taurus
taaatgtgtacatttcataataaataaaggtatataaataaatcaaagagcatctgaaaggaggtaatgatcaaatttgtcagatggctaacaactccaacgaatatataaaattctccatatgtacattttgcttacaaagaggtaatggatgagtgtaatgggagattcatttgagtcctgaaaattaaagcattgttg

SEQ ID NO: 23552 - DNA, 201 bp, Bos taurus
caaagaaaaaccagaaatcatcaagttgaggaaaggtattataagagtgtgaatctaaagctgcagataccaggaactgagaaatgaatccaagatacaacaatggcttcccaattgtgatttgaagactgaacatacatttcctaagatgctatggcataggggtgggggtgatggcttcagtcgtgagaaagagtgata

SEQ ID NO: 23553 - DNA, 201 bp, Bos taurus
atgcatccactttaagtagcaatcaacccatattcttctaaagttttattaagatacagggtacactgctgacaaaatgcaaggggctttggttcagttcagttcagtcactaagttgtgtccggctctttgtgacccatggactgcagcacaccaggcttccctgttcatcaccaactcctggaccttactcaaactcat

SEQ ID NO: 23554 - DNA, 201 bp, Bos taurus
caatgattgaacaaggagatacccaagggcctagctctctgtgtccactgaagcaccccttttatgggcagcctttgctctgaagcacccagcagcactaacagggccttttgggttgctttcatagtctgccaccttcatctggccttccctgttctttctgttttatttaaaattgttgcttcctttaaagcttttgca

SEQ ID NO: 23555 - DNA, 201 bp, Bos taurus
acacaaaggtttaaatttgtttcctaactcttgttacctctgcataaatacttactgtgcagagataagaatgtgattgttttttctacacaataaatggagttcattgaatttaaatgacatgtttagattagtattttaaagtcctaattcataattttctaatgtggaagctaatgaggagacaaattcatgggtagt

SEQ ID NO: 23556 - DNA, 201 bp, Bos taurus
agagaaataagccaatcaattgtgcaatttcaggccatgaccctttagtgaagctctggaataaacattatatgtcagtgtttgcccatgtttaaggcaagctaactggccttcatactcccctaacagtaaatcttggccaacttttcccaataagacccagatggtggtatgggcatagattcctaatcactgctgccc

SEQ ID NO: 23557 - DNA, 201 bp, Bos taurus
cacctggggatccagttaatttgcggcatagatggagcactaactttgcagtgttgagaagctagtgttgggcagctgcagccctgacaactctgcaggagctggggcccctctgaacctctcggttcttcccaggaccccatgacctggtgcggaggcctgcgggtaggtgcccccagcgcatgggagacttggtgggga

SEQ ID NO: 23558 - DNA, 201 bp, Bos taurus
ttgttatgacatataagtggccacacggaagagcagtgggtaaattttgaactatgagataagagttccggaaattgtctggtgtcagtttggtgctaccgttccaggttaaggctgtggaatatcatttttaatataattcccaggcggattatagcttgggttagaaaggaaatgtgtgcaatgttgaaatcagaggtg

SEQ ID NO: 23559 - DNA, 201 bp, Bos taurus
agaatgtttttaagatacattttaacctggagttaaaaaatgcttgaaatgtaattctgtttttataataccaaaataaaaattttatttgttatattaacatcacatattttagttaattacactaaaagtatagctgaagagaattttttttttcttttttggacaggggtggtagtggtgcttaaaactatgattatc

SEQ ID NO: 23560 - DNA, 201 bp, Bos taurus
agaggtgatttagtatttttagttgaagttttatgaattgaaatgaagacgatgaggttttagttttctgagttgtttatagttttaacactggagaaaatattttccaaaagtgattataagctcactggatgtctactatatttagcaaggcactatataatgtttttcatttgaacataaaaaatctggagacagaaa

SEQ ID NO: 23561 - DNA, 201 bp, Bos taurus
tatgagggctcctgtgtcatgtaagtcttatataaatgtgtatgcttttgtcctgttaatctgttttatgacagtttaattctcaaaccaggccaagaaagtctaagaggatttttccttacaatagaatatgcttaagactgatttaatgatcataaatatattgggcctttgtgatttaattcctattagcatctgctt

SEQ ID NO: 23562 - DNA, 201 bp, Bos taurus
atttgaaaaatatagtatttttatgagtatgatctataagtgaaatattattcattgtcaggaattgctgatgagtttgttaagagatcttcctaacatagtgcagctgaattcaaattatgtgatgaaattaagcaggctgaatgagtaatttccatgcatggacaatgggaatttgttgttcagctactccagattatt

SEQ ID NO: 23563 - DNA, 201 bp, Bos taurus
tgttcttgtgttttcattgaaggattaatcttatggataacagttactgattatgatttctttatattgaaactttctgaatattttataaaacaataatcaccaaacaacagtgagaactaataaaaaactcagtttgaatgtttatattgtgttttagaaaattttccaagtaactttaataataattatcttgatttg

SEQ ID NO: 23564 - DNA, 201 bp, Bos taurus
attggccataatcttttaaatatctaaagtgaaatgagggacagtaaatttcttctttcactgaataacatatttgacttattgccttcctgttcctatatggccagaacctctgaccatataggagagactctgaattcttcacccacaaaccctgaaagaaaggtaagagaagataaggacctataagaaccaaccaac

SEQ ID NO: 23565 - DNA, 201 bp, Bos taurus
tcatgggatcatatagctacacttgatatcaatatcagtttacaaaccatatcaaagtacaatagtttctcaagcatattattgctttcctcattggaattggaactagatgttcatataatacatcgtcattgcattttctaatccatgtaaggctagcttgcttacttctgaatcatggagtttagaaatccaagagtt

SEQ ID NO: 23566 - DNA, 201 bp, Bos taurus
agagtaatttattcatcttttattttagaccatctgaccagattgtatattcattgccctttgctttggattaatcagctgtaaccaaggtgatataggacaatgtatggcaaaaaacaaaaacaaaacgtggccaccaaaagaattgtgcataagatactttagcattattttgaaggtaggcatctgaataaacttacc

SEQ ID NO: 23567 - DNA, 201 bp, Bos taurus
tgaaaagatttttttgccccaaatagcattttatatttatttgttagtgacttccttgccccaccctcctttgtataaaaacctttcactttatataaccattgagggctcaccagttgttagatggaatgctgcctgattcatatagtatataatacaattaattagatcttcaaattcactcagttgaattttgttttt

SEQ ID NO: 23568 - DNA, 201 bp, Bos taurus
attctgcactgatggccagaccagttcatatgaaatgaggaacgaaaagcagtaacaggtggagcctgcgagacacttgagaaactgaaccattcccagcatctcagctcttcaggaaagtccttaaactcctgaaaagacttgctgtggagtgatccttggtaggaattgatgagtagcaggactgtttgctttagaagg

SEQ ID NO: 23569 - DNA, 201 bp, Bos taurus
agaaaattgctagtaacaattctgattagtctagagtagcctatgcactgtttgtcttcccctaaccaataaactagcagacaaaggtgcaaaagagtgcatgtgttaaagtgcagagtaaaccaggagcagcagcatttctaatgtgcgtggtgctaatactaagtttatcagaactatgttacagtacagatgagagtt

SEQ ID NO: 23570 - DNA, 201 bp, Bos taurus
agtaaccacaagtataggaatcttagcgtcctaggcatgtataattctatggaactgggtccagctgttttctgcatagcacaactgggcttgccaagaaggagctggagaagcaattttctcatatatgcaagtggacacaaattagagtccatcacacaagttgattgttttctcaggactatttgacaccaggaattt

SEQ ID NO: 23571 - DNA, 201 bp, Bos taurus
aattattatgtcatccaaggacacaataaccttattataaaacttattttcaatgtctattttacagatattctcacgattagaaaatttttcatgtttccgtgctaattcattatagcatcatcttttaacccaatcttaaaaatacctctttttctgatattttaaaatatattgtatctcaatatgtagcttcatttc

SEQ ID NO: 23572 - DNA, 201 bp, Bos taurus
atcagtcatataaatccacctaatactttgtcagcaaacccacactgtctcatctctcataaagcaagtagtccaaggcattgccttgttcaagttctaatgtagagggctgtgcctgtaggacttcaccggacttcacggagattactgcatcagcatgacagggcacgtactatactagagctcaccagttacattttt

SEQ ID NO: 23573 - DNA, 201 bp, Bos taurus
tttctacttagttttgatgctttaacaatgctattaatacttggatacccattctgtaggaactctctcccaaagaacttcatatgtgttaggcagtgatgagcttggattaaaattagtgttctgttttcttattttaatatacatcagtaatattttcattttagacattacaatttattttgcactgttaaatataca

SEQ ID NO: 23574 - DNA, 201 bp, Bos taurus
aagtccaacaaagaatattcttctagcattagatacaatagactgttttctaacatttctaaaaaggacattaaggctccgtgtgaatcagggtcacataataaacagccagtactaaaatctaaggcttctgaaatgcattctttatatcatctttaaaagaatgaactgtagtagcatggaggtggtgacaatgcagct

SEQ ID NO: 23575 - DNA, 201 bp, Bos taurus
ttctgtcaaaaaagcacaaggaaacaaaacaccttgagggacagcaatatcagtgcttcaaaagtcgagaggtgttgggattgtcagacatagaataccacgtaattgtgctttataaaattgaaagaactaatatcaagtttaaggcaaaaatataataaaatgacaaaaaagaacaaaaagcaaaaattactaaatata

SEQ ID NO: 23576 - DNA, 201 bp, Bos taurus
gagatgatcatgattactcaggtgggcccaatgtaatcacaaagttcctttataaacagaaggcaggaggcagaggaggaggtgcaaagagagctagcaaagcaaaaagaattggcctgaagaggttttggaggtgaaagaaaaaggttctgaggcaagaaatctaggttgcctctagaagctttaaagggcaaggaatgc

SEQ ID NO: 23577 - DNA, 201 bp, Bos taurus
cagggaggcctggcacactgcggttcatgaggtcgcaaagagtcggacacgactgagccactgagctgaactgaacagtggataagaactggcttgccaacgcagggttcctggcccggggaagactccatataccacggaacaactaaagccgtgcactgcagctactgagcccttttgttgcaactgctgaagcccaca

SEQ ID NO: 23578 - DNA, 201 bp, Bos taurus
tggaatagacacttgaagtccattctcttgttttcataagatttcatttgaacttatttgtgctacttgatctaaatccacaaagaaaggaaaaaaaaaaacttaaaaattcattcagcttcacattcatgaattggtgcaactgagcaaaggaatagtaacttgtgtaactgccttttccctccttattcatggctttta

SEQ ID NO: 23579 - DNA, 201 bp, Bos taurus
tcctgtatggccagttatatctaaccatatagttttgaatatattggagaatatatttctaagcaggacagaaacttggaaaactaaaaatatctgaggatcccatgtttgtaaaagaaaaaaaaaagaaacgtccttgaatattgagtaataaacttcttattgcttaatattggaaggatgactcagaaacactgaact

SEQ ID NO: 23580 - DNA, 201 bp, Bos taurus
gactacaacctggtgagtgtaatacacagaggagtgagaaaggaaaggtccccttggaagattgctgagttgatcagactggctgtgtagcagaaggtgcgtctcttgggatagcatgctcattaattttccactgtccatctttccccaactcaattttggtacccctctcaggggggtactgccttttgatcatttctc

SEQ ID NO: 23581 - DNA, 201 bp, Bos taurus
aagaggcaaatagctctttcagaccctaattcagaattcctttaatgcaatttgttcaaccatagacacccagctcattccaagaggaatgtatctgaactaggtattgcatatgaaagtaaggagcgagcctgggtgtccagtctgtctgagtggtaccttgttccacaggttcagacacacacatcacttcacagcctt

SEQ ID NO: 23582 - DNA, 201 bp, Bos taurus
tttgcacaatgagactaaattggaagtatagccaacaggtgatccattaaggacttgagtgcagctaagccttcctttgggatgtatacttttacagccagtaaacctggccttactagctcctagtcgctttgcttgccaataacacagccttataatgtaacagagtccagtagagccactcctcttaggtttccaacc

SEQ ID NO: 23583 - DNA, 201 bp, Bos taurus
tttcaggttcaaactgctatcagaaatgaaataaaacatactctattcacatgccagtgtttctgaggttttcctggttgaatgcatattacattgtatacactcttgattttcttcacataaggccaatagtttggttgctgtagtctgatatgggcctgaaagttgccactgactgtattcctataagttatggtattt

SEQ ID NO: 23584 - DNA, 201 bp, Bos taurus
aggtaagatgagtcatggttttaggaatctggagaacgaccctctggagccaagaaggggctggaccacagcccagatagactttgaaggatggagagagcagggtaggaagagtcatgggaggagactgtacgtgcagagaatgggagaagcaaaggcagagggtgcgttctcacagtggtgggcagatgagagcagcgg

SEQ ID NO: 23585 - DNA, 201 bp, Bos taurus
tacatttccaccaacagtacttgctaacatgaagcttagcacacaacaaaaactcagatctagagctacagaaaagttacattattattcaaaaagaaaagtgttgaaagtgttagtcgctcagtcatgtgtgacactttgctacccgggagctgaagtctgccaggttcctctgtccattgagttctccaggcaagaata

SEQ ID NO: 23586 - DNA, 201 bp, Bos taurus
ggcacagactttttgcttcattttcagttactagtggacacctgcatgaactcatccccctcaagggtctgaaatgaaaacaatcatcaacaatacaatcgctttgctttagccacaggcttgacacgaatcaaatgtttctgccctgtgctcataccctccccaaagaagagttcttttaatgaaccgctgaacaattcg

SEQ ID NO: 23587 - DNA, 201 bp, Bos taurus
atgatgaacagtgactattgccttagtgttctagttagttgcaggtaggaagttattccaaataacttggcaatttcttgcaaatcaaaagctccagatgggggtttaatataaattttttcacactatttctgataacaatatacacattcactccagaaaatttgacaaacacagaaaagtacagagaagaaaatttaa

SEQ ID NO: 23588 - DNA, 201 bp, Bos taurus
ctatttgacaaaacactacgtaggaatatcatgcctcaaggtagaatagaataaaatcgcctcttaaaaaattagaatccttgttaattacttgtagttggtagagaccaaaagaagtgcacagagtcctgagagttaaatcatcattgtctaaagtagacttgatttttcttggaataatattataggctcttccacatc

SEQ ID NO: 23589 - DNA, 201 bp, Bos taurus
attttctcgataaccttagccatactcccttccatagacatttcttcctaagtaacattagatggaaaatgaatgcaagtttggcctttattagtctctataacattcccagtcgcatccaggaagtaaatcttacttcatttgcactgaaaactctctcaatgtgaaaatgaaaaattacagggccccggtgaccacggg

SEQ ID NO: 23590 - DNA, 201 bp, Bos taurus
aggcagcccaatctctgtgaacggagtcttgagactactgtaagaggagaaccaaaacccagaggcagaagactgaactcccaaactttagaacatcagagaactcctgactccaaggaacattaatagacaagagcccacccaaaagtctccatacctacactgaaaccaagcttcactcaagaactaacaagttccagt

SEQ ID NO: 23591 - DNA, 201 bp, Bos taurus
tggccagggtcgactttagaaaccaggtgtcatctcagccttgaacaccagggaaccaaacatcccaccacctacctcacctcatgcccaagagtttcagtgggccagagggaacgcacacctgtgaaaagccatcctgtttctttcaaaccccacttagggctgagcaggatgccaggatgagtgaactggagggtctgc

SEQ ID NO: 23592 - DNA, 201 bp, Bos taurus
attgtttgaataacttgctagcagcttgaaggagaataggattacaattaaactttctcaaagtagcagacttctgtgtctgttctacgagttcaaaccagtttctgacaccgacaatgaattacattcatgtgtttcaagtctcctaataaaacatctttaagaactatagactatgccttgttccatgtgttagttgct

SEQ ID NO: 23593 - DNA, 201 bp, Bos taurus
atagtgctgagcctgatacagatgttcccacattgcccagtcctttgattaaccttttatgaagtatctgcctaccggaatctcgattaggatgttcccatgtgtcttattaaaaggctgccaggctttattgaactttgtgtttatactttgtgttctgtggacagttttggtgccgagtaagtggaaaatagaaagcat

SEQ ID NO: 23594 - DNA, 201 bp, Bos taurus
tagagggccctgtgctatacattagaaccttattgtttatctagtcactgttttacttttaaactagagactattgtgcattctgtgtccctattgttttgccaagtcaaggccaagttcctgatttcataattcgaagatctctatcggttgtttactccttccctattcacagatcttagccgcagttccatcactttg

SEQ ID NO: 23595 - DNA, 201 bp, Bos taurus
cttgacttcaattgttttgcctttacatgtatgtttctagtttcttctttcttcctcccatttgcaagttaagtggaagacatgcttattgaactgagagagaaatcgttttttttttggttttttgctttttctccctcaacgtgacatcatgaactgcttttcattttggatgggtgggcattaagtagtctgtctaag

SEQ ID NO: 23596 - DNA, 201 bp, Bos taurus
accccatgccctggggctgctcacacgttctgagatggtcgagatctgtctatagaatgtgtatctgtcccaataacctgctttccctttactttggctgggtcttgaattcttccctgggcaaagtcaagaactttcacttgctgtccatcctaaggactcctgacttttcactgtccagtaacatcaacatgtgaaagt

SEQ ID NO: 23597 - DNA, 201 bp, Bos taurus
atctgttccagaatgatgaattagctgggtgtgcaattctggattattgcttctgtgttaatccactgtcttatgatccgtttgttgttgctgttatgtccgctgtcaggctaattgttatttgtaaatagtctcgtcttttctctctggccgcttttaagaccctttggagttctgcagtttcacaaagcctaggtgtaa

SEQ ID NO: 23598 - DNA, 201 bp, Bos taurus
gcattggcaggtggattctttaccactgagccacgaaaaaaaacccaggcccagttctttaaactgtgctatttactgtaattcacccaccatacaattcgctcatgatttatgcagcaatcagtttctgaatattttcatcatctccaaaagaagtctcaaacgtgtttgcagcctctccccatccctccatccccagcc

SEQ ID NO: 23599 - DNA, 201 bp, Bos taurus
cttggcctcccgcctccatctggctattggtgtggacgtgggaagtatgggctttgtaaatacagtccatttccctccttggtgatgaggtaaatgcttttcaagtctggccgccgcaccccagacttttagctcagacctgtatcagctttgctcgagtcctctgttgagccagccccttcccacgctgggatgctggcc

SEQ ID NO: 23600 - DNA, 201 bp, Bos taurus
aaaaaagaaagctctctgtgtaatacatatatttatgcaaaaacaaagcgagtcataaagtgtatccagctgttttgtcactttccatttaaatacaattgttgggactgtgttaaattttttttcttgaaatttcctttcaaactctattttgaccaattgcttttatgttttataacattatgtgattttttaaaaacg

SEQ ID NO: 23601 - DNA, 201 bp, Bos taurus
tttccaggtaagagtactggagtggggtgccattgccttctccgagtcagaaaactgggcgttgttattccctgctctctcatctatttccagcgtgcaacagtcaagtaaattctagctccagagaaaatccctctggtctgacctgttccctccatgacctccttcagagaaaatttgtctggatgctcagagctttca

SEQ ID NO: 23602 - DNA, 201 bp, Bos taurus
gaaggtgcctggggctgtcctcagggcatgcatgccagggctgggagaggggctccacacggtactaagagtaaggtcagggagggctgggtcatctgccgcctcagctattcagccacagacgccttggcacacaggtgtcgcgcgttgagtcccctcgcccccaaagcacaccaccttgagctgctgctcccactggca

SEQ ID NO: 23603 - DNA, 201 bp, Bos taurus
tgagtaaaaatttacaattcagctcttcttgccaaagcttgtcctctgacctgcgtttcagagctcaccctgagtgttctttattcagattcaggcctgagttgttgctgggtgcctaccttaagtccgatctggaagacccctcccagccatcctggaagccaggtatggccagcacctgcctactctgccctcgaggtg

SEQ ID NO: 23604 - DNA, 201 bp, Bos taurus
tcatcacaactagagaaaagcccacgcagcagtgaagacccagcacaggcgaatataggtaaataaaattatttttaagagagagagagagacatgtaacaactgggccttttcaacctctggaatcctaaaactcttctaaattggagaaaactaatgacaaaaccttcagaagaagccttggttttgaacgctggaaat

SEQ ID NO: 23605 - DNA, 201 bp, Bos taurus
ttggattggaggtcctgggccgaggcccttgggcgctttatttgtgatccgcgaaggggcgggaggggggaggaggaagccaggaatgaagccggtttgcaccaggcctttgtctttctttgcagaagctactccctttgtaagagaactccccgccagactgcctactcgagtcttggagggctggggtgtagatggtcc

SEQ ID NO: 23606 - DNA, 201 bp, Bos taurus
aaaatgatttgaatatattttaaatgtatttgtacaatatgacatatttaagtttgtataaatgaggagtctctaaactatggtccataggccaaatgcatctgcggtctgtttttgtattataaattaagttttattgtcacacagccttgcagtgtctgtggctgcttctgctttagaatagcagggttgcagagctgt

SEQ ID NO: 23607 - DNA, 201 bp, Bos taurus
acggccagcgatggaggaagcagctggtgccgtgggcctcccatcaggaccagagaggggtgtgagcagcatctgccagctgcagctcttcacagggcccgaggatggttcagcatcccacggcctttcagaggagacagtaagagaagccaactcagagaagggcatccaagaaggtcctgagagcaagagggtctggga

SEQ ID NO: 23608 - DNA, 201 bp, Bos taurus
cttgcaagtcctagccagttttgccaccattccacatggcttgtcttcaatggttctagggctcttagtatcctcactatctactccgccaaaatgtcacgtcttctaggaactccaggagggtccaatcagcctgtttgtgttttgatttttttcccacatctgatttttctttcattctatctggctttagcaatagct

SEQ ID NO: 23609 - DNA, 201 bp, Bos taurus
tgctacagatttcaaagaacttgtactcaaattcccatcttctgttttcatttgcttttctttctgcactatcgttttgcatcctaaaaataaataaaaggctccaattataaatgtggggcttcattaataaaacttcccactacaaaagaaaacaataacataccagaatcagtgatttagtatgaccaaaattccaga

SEQ ID NO: 23610 - DNA, 201 bp, Bos taurus
taaagtcagagctgatcagagacccaggctctgcccgacatgcccgcgtggcatgcctttgagccatccactcggaccgaccatctggacctcatcgtgtggattttggcctccacctcgaatgactgttggccccagatcaatgattccgcttcattgtggcctatgagaaattcatagtgcctgaaataggcactaaga

SEQ ID NO: 23611 - DNA, 201 bp, Bos taurus
agcttcccagagcagagcatcactgttgacagtccctcttccactgagatttctctagatgagagcccttggaaacctgctttgttacaaaaaggatttgttccaccctagtgaatgaaggaagcatagtcattaagaggggtcatttgctcaaatgccagtcttggttagacagtcgtcgtaatatcataattggcaaga

SEQ ID NO: 23612 - DNA, 201 bp, Bos taurus
ggagggtctctcatttctattgtcacaattaaagttagtgcatcccatggaataaaaaagaatacagctttacacaaaactggttaatgataacttgcatgtgagctcagtcacttcagtcgtgtccgattctgcgcaaccccatggactgtagcctgccaggctcctctgtccatgggattctccagtcaagaatactgg

SEQ ID NO: 23613 - DNA, 201 bp, Bos taurus
gatgagtactcatattttatgtaagagacagtttaggaacaactttcataatgaaacagaggtgggtacagaaatttagcaaactggcctgtatgctgactgctttgagatctgggttccatgactgtcagcaaattggcatggaatgtgagtggtagaatatttaaagctcaagtcagaactgataaaaatgtattgaag

SEQ ID NO: 23614 - DNA, 201 bp, Bos taurus
gggtcttctgaactttaggtcacattttcttctgccctgtgtttgaccagctaagattcacggctttgttgggatggcagttcaggccttatgaatatacggtgtatatgtttacactgcaagtcaggtattcagcatctctgtgtgccagacactggttagagggtatgacatcaagatgaataggcagggcctactttc

SEQ ID NO: 23615 - DNA, 201 bp, Bos taurus
cttggatggccaaagatgaagagccctggtggagcctgtgggggacggatggagagccaaactcgtcagaggcagctacgaaagccaggaggactggagatcgtgaccaggcccagctcaacccaactgccactgcaagagcaagtcaacattgtaggaaaacaaaaaatgtttaaaaattagcacttaaaatggcttagg

SEQ ID NO: 23616 - DNA, 201 bp, Bos taurus
ctctgtctgacagccctgtattccagaacatggaattctgtattccagaaatggaaaccttaaaaaaaaaaatgtgcacctggacagatggccttgtataagttgtctcctgggggagactcttactcactgggtcagcagcctgagtcagccctgaggaaaacatggcccgagggagtgaacaacagattgagaataatt

SEQ ID NO: 23617 - DNA, 201 bp, Bos taurus
tttttgtaatgagcaaatttggaatatattaagatatgaagaaacttcttttcactgggcataataaatcaaattaccatgagaaaagagaatataaatttttttaatccacttagcttattttaccaaacatggtttcaagatggtcactagttttcccccctttacttgactgtgacatttgtctaattttaggggcaa

SEQ ID NO: 23618 - DNA, 201 bp, Bos taurus
aaatctgagtgtgttttagaaaacatttcatctcatacatgaatttttagcatgcacaaataaagccagattcaggacaagatgcctgtatgcatgatccgtcactcagttgtgtccgactctttgcaacgctatggactgtagggtcttctgtccatggacttctccaggcaaatctactggagtggtttgccatttttc

SEQ ID NO: 23619 - DNA, 201 bp, Bos taurus
ttcaatgaccaccatgatacacttctcttacaattcttcttggagtaaaatgagacaatgcatgtgaaaccactggggccagcatccggctcgtgacctgcattccgtccatgtcatctggggacactagaataaacgaccaactaacccacgcagcttcaggttcagatgtgtgtggcagaggcctccgccacattgtta

SEQ ID NO: 23620 - DNA, 201 bp, Bos taurus
tctcagtggagctatttaatttttaagtttgtcaacaatctggtcatcccgttaacctactatttctttcctttatcccaatcccttttcctaatgaggcaagtcctgtctgcccacctcctccatatatacctctctttcttattcatactttacacccacacagggaatgctttgggtgttctggttgcagttggagca

SEQ ID NO: 23621 - DNA, 201 bp, Bos taurus
gcattcaattagtaactcacaatgatgtgtaaaattgcacagagtgttaaaagaatttgttctggtgtgcagctataactggagatgtaatttacaagtggatgagcataagtatgatcattagcatcactgctgaaagtgagccctctccctccccagtgttagaagtcactgaccaacgacctactggggatataccca

SEQ ID NO: 23622 - DNA, 201 bp, Bos taurus
tgttaaatagccatagcttattttgaaatacaaattaattatctattacaagcatgctattgcttatctccttcaaagtctcattagtatgcaaattactgtaattaggtcactgtcagacattattagtgtagagtcactttccgtggtttagaatgaaaggttttggttcctaaatagttttaaaactatttgtgaaat

SEQ ID NO: 23623 - DNA, 201 bp, Bos taurus
ttggtaagaaaaacaagttcaatctataaattcaattaagtaattgataagaagttaattacgcagttcctatggtcaaaggctgtctcaaatcagaacttttggtgacataaattagcagaaatttccaacttaatattccagaacctccaattgtcagttgcattcaaaacatgtcccatttttgggagcaaatcagat

SEQ ID NO: 23624 - DNA, 201 bp, Bos taurus
catcgtcctctgaagctgtcacattgtgtgaggtgctaaatggagatgaaggtgggtgaacatattttcacagcaggttaagtacatagagttctgggaatagggagcatgcttaaaagaagccttggcaatctatcgatctgtctatccaggcatctattgttcccggattaccgtgtgtacccagaacacctgaaagga

SEQ ID NO: 23625 - DNA, 201 bp, Bos taurus
aatacttcattgaattgagctgaagagttaatgggctttatgtaagttatacgattttaacccgctacttgtaaatagcacttgggtgggccttctaccttgcagaaggaaatggcaacctgctctagcatcgttcctggaaaatcccatgaacagattctccaggccagctacagggatgagcctggcaggctacagtcc

SEQ ID NO: 23626 - DNA, 201 bp, Bos taurus
aatcttatgatcacccaactcaaataatagtgttgagtttattttgcactgtctttatgcctcttatcatttactttaggtaattctacaatttttatctgaactttttgtgttagcatcgtacagtgaactatacttctctagtatacatttgtgtatttgtacaagtaattagttcatccagcacttactaagtgtgaa

SEQ ID NO: 23627 - DNA, 201 bp, Bos taurus
tatgtacatgtgaaagttgttattcaaaatgagaatggatgaccttaatttttagacatcaagtacatctgaaaatacgtcatgcattctcaacttcagttagcagttcagttgttctataactgtaattcttctctggttgttttgaagactaaagcctacagacgcagtcctgtaaaaatcattggggaaaatgtgttt

SEQ ID NO: 23628 - DNA, 201 bp, Bos taurus
gggattgaagttggataaaatcattgttgtgtgggccccgagctgccttaggatagtgtggatatgatgggacagaacacggtggctgaattagggggcatcagagtggccagtggcccagaagcatgactatgagctcaggacgcgaagccaaagggcacacgcttgcccccagagtttattgaaatgtcaggttgacag

SEQ ID NO: 23629 - DNA, 201 bp, Bos taurus
gcatgatcaccatactgcctttagtcttaagcagagtgaatctgtgtggtcttagagcagcattatccatgctaaaaggggggcttcattagcttgaggcaaagatgatgctcaggctttcccaggtggcgctggtagtaaagaacctgcctgcccatgcaggagactttagagatgcaggttcaatccctgggtcaggag

SEQ ID NO: 23630 - DNA, 201 bp, Bos taurus
tgttgaatttcagatgatgctgccagctgcagacttttctgcgttactaattttcagacatcacttactttataacacttcacacagctgtctacccccaacttaaatgactttctgatttctgaacaagaagtagctatacaaataatggcttcagaccaaggtccttggcagaatgatttcatccaccaggcctggcac

SEQ ID NO: 23631 - DNA, 201 bp, Bos taurus
tctttccatatatttccatttcattgatcagttttccattttttccctttcaatggcttaagctttaaataacctttctttttatcttagggtccttgagcggaagcacaactacagtatttttgctaacataagcagaaaaggaagttaggataacaattcccaaataggaaaatcctctaaaaaaagaaaaaaaaaagt

SEQ ID NO: 23632 - DNA, 201 bp, Bos taurus
cctgaggaatctttcagtccagcctagttcccctgaaagacctcactaactgttagcggctgtggcgggcttgctgtatgctatatattatgagttaagagacgctgtgcttaatagattggatatgctcctttgcatcatgcttagaaggttggattgtcctgtgcaaagatttatacaaatgtaaaccaggtgtctcac

SEQ ID NO: 23633 - DNA, 201 bp, Bos taurus
gatgccaaaatgctggaagaggcttcctccagttgcactcagcaagttaagttcccgacataaatcccttcttacataatacaatttggaactgcctcatataatgcttttgagacagactgagatggagactctgtggtcagtgttatttaatttaattagcttaattgatatgcagaataactctggacagtcttatta

SEQ ID NO: 23634 - DNA, 201 bp, Bos taurus
agaactgcacgtctgggagacaacattaatttgtatggcatgactcacgctgaaaaataacaagtttgtagtcaagaaccatgcattcccacttaattaacctcccttgtaactgctggggtggattatcggtgagtcacacacgttttttgtccacaggatgaaggcaggtgtgccactttggttcgctgtatgattttt

SEQ ID NO: 23635 - DNA, 201 bp, Bos taurus
gttttgtttttgttgtgctgagaagtttcgaagaaatgaaaaactctggaatatcagattttaaggtataaagtctggcacgcgagacgccaaatgctttggtttttggtgccacactgtgctttgggaatctgtaatgacgttctcagagactagaagaaaagagtaaaccagaagaagccttttaaaatttccgttcag

SEQ ID NO: 23636 - DNA, 201 bp, Bos taurus
cagcttcaattacactgttttgcatccataaataagcaatatggtcatgttattgtaccacgggatattttgatcatcacattacaaaaatgaaaactcccccaggtcagaattgcctcatttcacagactccagagcactctgccttctagagaggtttgacaagtgattggaatttgttaattgatcgatcgttctgcc

SEQ ID NO: 23637 - DNA, 201 bp, Bos taurus
aaagctaagatttaactaacaactgggtgggtaatggttatcagattaatcatgacagggttgccctcgaaggagcaaggtttgagtgtggactgggagggcagtaaggatgaatcttttgttgctcttcatcaaagtgatggtcaattttatacgtcaacttgcctgagctaagggacaccaagaaggctggtaagacat

SEQ ID NO: 23638 - DNA, 201 bp, Bos taurus
atgatggacttttgtaactgtctagcttccattgggtaaaaccttgttatcaaagatttaaaggatccatttagaatcacatgtccatcacaggaaagaccataaatcaagatggacaggcgaggagtgataccccaaacctcctttcaacccaccttgtgggtactgctttgagcacacgtaggcttcactgggttatgt

SEQ ID NO: 23639 - DNA, 201 bp, Bos taurus
aatagcatcctgttgccaagagactctttcacctccgacacgtgctgccttaagatagcccatcctaatcaagtgtcagtctgggtacaagaaacttgcccggttttcttctgaaaatgttccagactctccccttggctctgtgaacacgtgggcattggggtcatctttaagtcatcaccttggttccaggaagtcccc

SEQ ID NO: 23640 - DNA, 201 bp, Bos taurus
cgaaattccagggccttaagtaagagacctttatttttcacaagctggaagctggaagtctgagggtgccgagtaaggtcagcttcctccaggctggtacatggccagcctctcaccttggctcgcatggtggggagagagtgctggtctctcgtcctctttttataagggcacggcttccttcatgggaccccaactctc

SEQ ID NO: 23641 - DNA, 201 bp, Bos taurus
tctgttcttccttttagaaggggactttcttttgtagtgacaagctctgtggggacccgcagaccaggtgagactatcagagagaggccagcacctggtcccagacacggggacaggagccttgagggaagatgctgacaaaaaagaagacattgacagaggaagttctctgagcactcaggagccggacaaggagcacag

SEQ ID NO: 23642 - DNA, 201 bp, Bos taurus
cgcaggtaggcatttgactagtgctttgccaagttaacataaatcgtaaaaccttttcatagtcccttagcatgatagaagaaaaatgagttacaaatatctatggagagtctagtgtcccaggcagattgattataaaatgtggaaacctacataataaacagaaaaatattgggaatgttttgaacaggaaggctggct

SEQ ID NO: 23643 - DNA, 201 bp, Bos taurus
ttggaggcgggtggtggagaccagggggtaggctggggtgcaggtggtggctttccctgcatccgtccacaccgtgttccctccacgtgtgctgcgggtccgaagggccccgttggacaaggacactgctgtgagatgagttgaggtgttagagccctaaatttcagctcctccgaatgtgaccatatttagagaggccct

SEQ ID NO: 23644 - DNA, 201 bp, Bos taurus
acacggaggtcctgggtgaggctgatggcaatgagaagcgggagggcaccttttaaatggagtagaaggaccaaacgaaaggacacgggacggaaagacccagccaggagagcctagactcttgttctgtcactagagtggccaggaaggttcctgggacagcctgctgccctggagacactttctctgcaggccccttga

SEQ ID NO: 23645 - DNA, 201 bp, Bos taurus
gacacgtctctgccgtttacacacgtaggccttgctggcttcaggtttcggttgcgatacgggatcgtctgagtaggctctccaaagccacacatgggacctggacatcccctggagtagcagtagccatgttatattgcaattatccatttgtgtgtctaagtcttatttgtctttgtcacccagtacctaagagagtat

SEQ ID NO: 23646 - DNA, 201 bp, Bos taurus
aggactgggccagcaaccacaacctggtgaggaatgataaaggattagcgatgtgggaggcttcggaggaggagagatgaactccaatctgattttcagatggcccaggatagaaggaatcggggtattcagtggcattaggaagtattcttcaagaagaccgccaatgtttaaggactctggcactcaaaggaccccagg

SEQ ID NO: 23647 - DNA, 201 bp, Bos taurus
tatttcctaatgtacaaaggcaatttcaattattttttcaaaactgaggaaaactggtaatttttttaaaagcacatttactatgaaaataagaactaaacaagaactaaacaagaactaaagagcctcttgatgaaagtgaaagaggagagtgaaaaagttggcttaaagctcaacattcggaaaatgaagatcatgaca

SEQ ID NO: 23648 - DNA, 201 bp, Bos taurus
gcatttccttctccattcctctgggaggggacctttcttgtgttgctgtcactgtttggacttcaggccattaacatttggttctagaaactaggcttctataactctctaaggatccaggttttatggaatttccctcttccgacaatttctgaatgcgtagttgttctctaactctcgtgagctcatttctgtcttacg

SEQ ID NO: 23649 - DNA, 201 bp, Bos taurus
ccaacaatagccacttgctggaagtcactatctagttaattgaattttcatggcggttcctttgaacctcaagttgcaagtgtatgtacttgaaggtgatcattagaaagacaggtgtccatttcctgggtggtctgagggattctgagatgattgttgatcccagttcttccaaacattcttctctatcatcatctgagg

SEQ ID NO: 23650 - DNA, 201 bp, Bos taurus
tttgtatataaacagactgtatatacatttctgttgtaggggaaaggattcttcataaaaattctgcatttggagaactgttgtgattcccttgggcctcagagctgttttaagaagataacgttccatattttcaaaagcaagataacttcccaaggagaagagaagagacatggctagaaatccacatggccgtgatct

SEQ ID NO: 23651 - DNA, 201 bp, Bos taurus
ctaaaagctatcaatcagacatgcaaggtgaaacaatgttactgtgaagatagggggtctcaaccccctatcaaaggagaccctcaacccacctgcaaccctcaaagtgacccgaaacccacctcccaggttcagagcacgatgctctgaaaagctaacacttgccttgactgatctgagctttattcagcaggagagttc

SEQ ID NO: 23652 - DNA, 201 bp, Bos taurus
cgataaagatcacctgcagacaaacccaagttcaagtgctgcctgaaccagagcggactccccacggctcccttggctcattgtctaaaacgctactgtgctaatcccctcggtttccagtggcctctcaagcccagacccttacaggcactgaaaatatttgttttcatgctcttgtgtgatgggcatgtttatttcaat

SEQ ID NO: 23653 - DNA, 201 bp, Bos taurus
cacaggcccccacatatcctgaaatgtggtttctacctgcttctcctttgatgccaggaatgccatccagtcccgggaggcctttgtcacctttctctccgggcaacccagggcttcctaagaaagagcggaacacccagttcccgtgaccgagaccttctctttccacccccggaccccgaactcgggaggaggctggcc

SEQ ID NO: 23654 - DNA, 201 bp, Bos taurus
gggttgcacacttttctcctggttggtacgagaggcagcccagatgtgaagagcgtgatggtttagactctgtcctcaccaagccccctccagggactggattcatggtgctgtctcgggaactaagtcagaaatcagccttctcatttaactgacattcccagaagaacgtgggccacgctcccatgggagttccacctc

SEQ ID NO: 23655 - DNA, 201 bp, Bos taurus
cggccggttctgcctgtcagctcgtcccctgcagtcacagccaggagctccccccgcatgtccgtccccacgtgcacacagcccggctgtgcaggacgcgcgggactgacggccgagtctgtgtgtccgtctgtctctctgtacctgccgtgacagcccccttttggcgtctgagtcgcggaattcgtcagaggccgagtt

SEQ ID NO: 23656 - DNA, 201 bp, Bos taurus
aaccgagggctgaaaacaagcagtcctctctgtcctgtgcggctgggtctggctggagctgatgtgtcccggagtgaggtggttctggaataaaccagcatgcctggccgtgtttcgtcagacgggcaccgctgtgtccatgtctgatggcaggataccagcttatagactaggacgagggccccgggcatcagggagcag

SEQ ID NO: 23657 - DNA, 201 bp, Bos taurus
aagtgggcgctgacgtctccactccacagacgaggggccagggctggagaagcccaaaacctgctcggagccacacagctcggagctgcaggggagcctcgctccgaactgatggccccgtcccaatcgctccatcatggacacacatctgcgcacccgctgtgcccagcccctccctggtgtgagcgcatctcccgactc

SEQ ID NO: 23658 - DNA, 201 bp, Bos taurus
gactcagccccttgggaggccccatgcggtgctcagcacagggtctctccagaatcgttgtcgcgatgacagtggggaaggcttggctgggagattcttcatgggaagaatggccagagaccctggaggaggtgacgtttaatgttcagcaagctgtgcccagtctactctcaagggagaccttagacacagattcagagc

SEQ ID NO: 23659 - DNA, 201 bp, Bos taurus
tgccagctgggggcaggtcaccgacggcctttgtccaggctggttttgcacatttgcccttaaagaatggttctggaacgtgtgtgcaaatctgggtggagcatcaagcaggcgacgcgtcaggcccagtccacaccgcctttccaggggcacgggagctgcccggcctggtgcccagcgcccagcacacccaccctcgtc

SEQ ID NO: 23660 - DNA, 201 bp, Bos taurus
gttgggaaaaacagtcaccctcgagtggctcctgagtgtgaactggcggctccttcaggtaaaccgtagtccatgccactcccccggccagttcacacttaagacagcccagcctgactccagttacacacgggggtctccagttcacacttgagacagcccggcctgactccccgttacagacgggggtctccgggggag

SEQ ID NO: 23661 - DNA, 201 bp, Bos taurus
gacaaaaccctcccaggtggaagagcccccaggcccctgttctccacgatagccatgcccggtgcctgcctccgcccccgtgcagcctgctgggttttgccgggaatgcagacagatgggcagctttggaatctgtgtggctccatgaacacgcaggccccctcacccatcagatgccccatgtcagcagagtgcccggct

SEQ ID NO: 23662 - DNA, 201 bp, Bos taurus
tcctcgcctacctgatcggccggaagaggagccacgccggctaccagaccatctagccgcgggcgcagccccggccgcttccctgggcttagatcactgttgggggcacttccttgcaaactggttttcaaatctgctttatccaacgtgaagttcatctggcaacacttactatgcacaagagagtaactatggaaatga

SEQ ID NO: 23663 - DNA, 201 bp, Bos taurus
gtccctgtagacacagccttgcttactttggcctcttgtcacatgaacttaagaacaccgtattctgtgtgtctgcacgtttgtgtataagcgggtcgtctgcagttcagtcccgggtggtctggatgatgtatgtgtttctgttaacacagggctgcacttgtgaccctgcccattttcaaagtgttgaataccttagga

SEQ ID NO: 23664 - DNA, 201 bp, Bos taurus
agcttttaccaattacaggaacaccacaaggcagacagaggaattcaaagaagttatgtccagacaataggctatgagtaataatagaggggagggaggcgaggagacaatgataagagaaactatagggggatccctggtgctaacaatgtttccttttttttttttttcctaacaatgtttcaaaggtctttattctgt

SEQ ID NO: 23665 - DNA, 201 bp, Bos taurus
atgccaagtacttgccttaaaagacacttctatcatctacccaaatcacacatacacaaatcttatagaaataccacagctatcaacaaggatttgggccataagagtcaaaatttggctttctccaccatcagagtcagcctgaccaaagcttgcttgctttttatcacagtagtaattttggatttcttcttgtaatca

SEQ ID NO: 23666 - DNA, 201 bp, Bos taurus
taaattaaaatgagaatccttgtacttacattttcatggaataattcttatctgtttctgtctagtgaataaaagaaattatgctgactcagtcttcccataccagaaaactgggtcaaactgaagagagcagttaccttatacaggcaatgtcctttttccatttttgtaaaccaatattgtgaaaacccagatttactc

SEQ ID NO: 23667 - DNA, 201 bp, Bos taurus
caccaagcaattactagtattttctagtcatgaaacatatattccccctatgtgtgagtactacagttctttgtctaacttttgtctgtagctttaatctcacactcttgggaacccaaacctgccaagcaactttatagctaaggctagtccacaagaagcagtgaccaaccttcttttgccatttctctggaataaaaa

SEQ ID NO: 23668 - DNA, 201 bp, Bos taurus
cttcttctccacaagaataatattgctgcttcataagaatctggtgaggattaaatgagatcacacacctgaaatgtttggtatagcacacagagtaaacgctcagtgcttcagttcagttcagttcagttgtgtccaactctttgcgaccccatggactgcagcacaccaggcttctctgttcatcaccagctcctggag

SEQ ID NO: 23669 - DNA, 201 bp, Bos taurus
cggataataaacttcagctaaaacaagctctttaccaacctctttcttctgtctcatcttactcatcttgtttagaggtttcttttgagagctctctctcgaaaatcttgtgcacaagaatccctgtctcaggctctacatctagagcacctaacctacaatcgggatctctgaagaatccacaaaagcaggaaagagaaa

SEQ ID NO: 23670 - DNA, 201 bp, Bos taurus
ctagcagatttctcctaggtccttttacccgttaaacttcagagttataaagaccagtcttgaggttaggaggaaaggtgacttgaggaaacaagggagaagatggagggaagacatgaatagtcattttctcctgaattacgtctccttgttttgtgttccttcctctaggtattttgttaagtcagccaaggtgtgtcc

SEQ ID NO: 23671 - DNA, 201 bp, Bos taurus
acaaataaacaaagctctaatatgcctagtggggttttgcttgacttccagatgatattaaaatcttacatagctgaaattaggagttggccctgagaaccaattcttagggttttatctgaaaagaatgtttttgacatagagacttgcttttgttatgttatggttgctatcatattctcaaggccagatttacacctt

SEQ ID NO: 23672 - DNA, 201 bp, Bos taurus
ttttatttcaacagaattaaaagtcaatgtaggataaaatgtaaattgcttgtcaagattttacatggaggcataaggctacatcgatgtcgtcgttgtcattcagtcgctaagtcatggctctttgcgacgccctcaactgcagcacaccatatagagacactccatcactatttccataagtttgctgaaactcacgtc

SEQ ID NO: 23673 - DNA, 201 bp, Bos taurus
gtgagagttgtctttactcaaagtatacttttgaatccatgctgctcttccaggatactcaattcattacattctgaataattttgtatactgatgtcttaggggcaataatgccattttaatgaaaaatggccccaattagcagtaatatgataagttgtcttatcattcacccactgtttcagttttctagtaaagctt

SEQ ID NO: 23674 - DNA, 201 bp, Bos taurus
cttatggagaagcagcagggtcagtcagaaggagaaagaagaaaagggaagatgtagacaagagccattactgtggcttctcctagaaggaatgggcgatttggggtcagcaggccaaggattggctggtttgaataatttcagtgggagctggggtgtaagtgttagccctgggtgatcagggcagggagtagaagggcc

SEQ ID NO: 23675 - DNA, 201 bp, Bos taurus
ttccaaaagtcaaaaattaaattcatgacttttatggaaaaccatcctcagcataagtttatatctttctttcacaacagagttaaataaagcataaacacactaacgtcattttagtttaataattaatctatctctttcatttctgattgctgtactgagttttaatagacttttacatacctggcttttatgtaaatg

SEQ ID NO: 23676 - DNA, 201 bp, Bos taurus
gtacattatatctcggtggagtactgacttggagctccaatagaaccccatgcagagggaaggaaggagggatggaggaaggaaagatggacataaaagcaccaccagttgtttgacctgagctgtcagagttgagtcaaactcttcgcacaatttttcttttttaaaaaaaatgatttattttaaacaaaagaaagatga

SEQ ID NO: 23677 - DNA, 201 bp, Bos taurus
cacatgtaaaataaaggagaattcatttttaaatggcttaacaataggcaatgctctgtccccaggatatacatattttgaaatcacttttgcactaaaattggataatggtttctagccttggaatgtaagtaccttgggaagcaaacacaatctattcaccacctcacaattaaattaaaaggcagaactcggttagta

SEQ ID NO: 23678 - DNA, 201 bp, Bos taurus
cattgcactggtgaatccctcatctgtaccaacatttaattttacttaactcacttctgtttctatttattttttaatattaacccaaagcctgaatcaaactagttctaatgctcataatcagatgggtctggtgcactgaaaaagtgtggctgtgctctcacagaatgacactaaagtaagaaaaagagaagtaagccc

SEQ ID NO: 23679 - DNA, 201 bp, Bos taurus
gatggagaagcctggtttgcctggtagagtcttgggagattttatggacatgaacccaagggcgtgagtagaaaatcatttcccccataatcttcttctaggtttcctccctagataacagcccacatctcgtgataggtggtaggagtctgtgtatgttaaagttatcattttatcatctgtgatagacatttgtcacaa

SEQ ID NO: 23680 - DNA, 201 bp, Bos taurus
actcacttatccattggccgtgcgttgggggataaggtggcccagtttttatgcttctgattgaatagctaagcagctcatcctagcacagagagctccacggtgggtattgtgaggcttcaggcctggggttgcttctaactaatagtgggaccttaaaaggcattttccttctctacgtcatgtttctttatctatgag

SEQ ID NO: 23681 - DNA, 201 bp, Bos taurus
tccctggagcaagcggtgagctgactgcaataggtttactgggttgcaggctttaaacttggttggaaggaccaagggcactcttcttttggttttgatccgtagactttggggataaaagggaagcaaaaaatacaatttttgtgtgttttgaggatttgcaggagaggaagaacagaggaggcagatctgtctgaacct

SEQ ID NO: 23682 - DNA, 201 bp, Bos taurus
gcagcggcccagtgaacagtcatgtagttgcatcggggattattacaagtgtgctagactccagacacttctcgtgtttatggtcatgcccttggaaccatgatgagaaccttgttggctattcaaagcagagccaccatgcaggcttttgggtgaaaactgcttgttaaaatttcaagggaggcagaggttggagagatt

SEQ ID NO: 23683 - DNA, 201 bp, Bos taurus
agcattctttggcattgcctttctttgggattggaatgtatgctgatgggtatttaaaattagcatagagtttagggtttgtgttattttccctgtttactatgtatttcttggctgtaatttctatagtcaggaaatacatagtattaataagtagggtgaaaaatccaaactctatgctattttcaaatacccatcaac

SEQ ID NO: 23684 - DNA, 201 bp, Bos taurus
caccatcatcatcaataacctgcctctgattccacagctccctcccaaccttaaggcgcccactcccagtagagactgtccagagcatctcactgaatgattgtcattcacctaaggccctcaaacccccagaagacctgaggatgatgcttggcagcagggggataaatgtatccagtgaactaaaggctttcaggaaca

SEQ ID NO: 23685 - DNA, 201 bp, Bos taurus
cattattcttaaaataaatgcccttatcatccttagaaacttctctagtggcccttcttataaaaataaaagtttgaccctgtcatgatgatagtagatttcctactatattctggctagcttaggtggtcacacagtgctgactttgatcctggcaatagctttgctttaactcaaaataccagatactgaaaagaaact

SEQ ID NO: 23686 - DNA, 201 bp, Bos taurus
tatccccatttcacagatgaagagaccaaggcacaaactaggtcggtgacttgtcaaggtttattcaactcctttgtgtagataatgttgcagaggaggaggaaacacaaggtgggggcgggggagcaacagatctggtttcccatcatacacccttttcactgtacctctcctctttgtaaccaatcactcttgcctcat

SEQ ID NO: 23687 - DNA, 201 bp, Bos taurus
aaacaatattaacccctgacgtgccggttactccgattccaacgggagtggctggccccctacccgagggcgttgtaggacttgtgctggggcgtggctcgctttccctttaagggatttcggtggtgcctggtgtagtagattctgattatactggggaaattaaagttttgatctcgccgcctactaaaactatgcaaa

SEQ ID NO: 23688 - DNA, 201 bp, Bos taurus
caccctattcctttatcaaagagcactggaggtggatgtctcttttcctaatttaatgtttctggggttcaggaagtaccatgtatagcactagagagccgtggggcctggacctaactcctccattctctggttgagtgaccataggattaacccaaggaggcttaaagtctacatttataaaacaggagtaataacagt

SEQ ID NO: 23689 - DNA, 201 bp, Bos taurus
ttcacctggctagttctctttaattctctctttgaaatcatggaagtttgaagcctaaaaactgcattttgcagtctgcatggcctgcagagttccagctcctgtgtcacccatgagaaggttctgggagatgtctgacaggtggaagaaagggtccagaagcagaggcaggatgcaggccgaaggcagcagctggtgggc

SEQ ID NO: 23690 - DNA, 201 bp, Bos taurus
agcccagcccgattccacaccccgtcaacccactggcccctgtgccctgtcagaagtcctggctcaccgaggctccttcagtggccaaccatggacttcactgaataaggcctgaattctcaggggagcagctcttagtgatgcatggtgggaagttggcatggggggtgtgaagactggagataaaaagtattcctacct

SEQ ID NO: 23691 - DNA, 201 bp, Bos taurus
tcacatggcctgaagatgaggacacagacatctttggcaggggcattgttctgtctaccctggaaccatcaagctagatcacccagaagaggagacctgcatcttcctggaaggcccccctcaatgcccttgttgctctcccttactgacggggggcagtccccgcaagggctcatggagcactcaggcagagatccacga

SEQ ID NO: 23692 - DNA, 201 bp, Bos taurus
aataaaaccagtgcatgaatgaggcatattttgaggtatgcaaagaaagaaatagaaatatctggtcctacaaaataatttagtgttaaagttatatgcactttgggactatttattgcattcccttgtagttcagtcggtaaagagacccaggtttgattcctgggtcagaaggatcccctggagaaggaaatggcaacc

SEQ ID NO: 23693 - DNA, 201 bp, Bos taurus
atgttcactctggctgctgagggtccactggagtgaccatccaggtttaggaaccagcaacttcagctgtgaaagggaagaagagtccccgagcctggtgatagacccatccttatgtgtttgaagcccccttttctgtttggggcagaaggcagggcttttggtgatgcgtcaccaccgctggtatcacaaggcggtttc

SEQ ID NO: 23694 - DNA, 201 bp, Bos taurus
tgggtcttccggaacatcgctagacggagtgtggtctgtggaccagagcatccgcatcattgccgtcactttgatgggaaaggggagtcttggccctactctttgaaacagaatcttctttaaaccaatccaggtgattggtttgcacactgaagcctcagaagcactgctctaggcccaggcaaatgccctgctttgtaa

SEQ ID NO: 23695 - DNA, 201 bp, Bos taurus
gcttgaggtacaggccagtggggagtcagtgagagaaacagagtgtgtgtgacagaggaaggagagacagtggggcaggaccagcattctggttgttcccacagggacttggtgttggggccatcaacgtaacttgggcagttctgaattctcctcttacagcatgtagaacagaaatagctaatagcaatgatgactgac

SEQ ID NO: 23696 - DNA, 201 bp, Bos taurus
atcctgcatgggaaatacctcctccatttagaaagttaatatccataattatgaacacttatgaatttagaggcagttgttaacattaaagaaatcagtagtgtgaacatatagtcacttaaaatgtcctctcctgtgtatgtgactgtagtattattttgcccctgttaatagcacacacttgattatttctaaaattgt

SEQ ID NO: 23697 - DNA, 201 bp, Bos taurus
tttctagcttctccagccccctcaacactgccagtcaagaacttcacaaatgctccctgacatgttctttccactgatgttttggcctccctacctccccttctccactctcgatgatattcatgacacaggttaccctggtctaagttggtattccattttctttccaggcccactggttgaccaggcaccagttgccct

SEQ ID NO: 23698 - DNA, 201 bp, Bos taurus
aggaagcacactgatgcctgggagtggacagttgcttgctttaggggcatcagagaattcccagactagaaagactcatggggcataatttatgaaacacggtaagtatgaagtaattccaaatctgtaagcacctgcttgtagcagacacctgggatcagaagtgaggctgaaagaatgtgaactgggccaccagaggca

SEQ ID NO: 23699 - DNA, 201 bp, Bos taurus
gagggacaagcagaatcaccattttactcttcacatactccaaggaggacaccaatttgcatgacctgcccacgtccttaatgtgcgtcacccatctgccatagccagacctctttgtgtttttactcagagacttgtggccagggcattatttgcctggggggaatggctactgcccttcagtcagtaagtcctgattga

SEQ ID NO: 23700 - DNA, 201 bp, Bos taurus
gtgttgaaggagaccaatttatttagcctggctctactaggaggcagaaactatatgccctttgtcattatctttgaattagcccctttggtggttgaattggggtcaggggaagatagataaaacaaagatttagaaacagagagagctttgattgctgccttcataatttacttattataaattattggccaattattt

SEQ ID NO: 23701 - DNA, 201 bp, Bos taurus
aactgagctggggttattggttggattgccagggcaagattgcaactcatccctctgattacattcaaaaatcccccctcggaaaacgacgagactgcatacccccatgacttgacttcattgcattctacattctgttccctagagtcgcttcttctctaaggttttttggtaagaaaatctatacttctttagagaggt

SEQ ID NO: 23702 - DNA, 201 bp, Bos taurus
catcctgttgccttcctgaacatctatggcttaatcagagcttgcagtggccaaaaaaagtcatcagtcatggacaaaagcttctgtaaacactagtccaaacaggacagattaggaaatcttgaaactggataatcaatcaagagaacaaatactccttagcaaacgctgtaatattcacattgggcttccagttaatca

SEQ ID NO: 23703 - DNA, 201 bp, Bos taurus
gtgctaagtgggccatcttctcccctacctaactcggtatcatatactttgggtaagcatcagcccaagcagcaagacttactcctatttgggtaaaagtgtctctcacatatatatcaattaagagatggaagacatacatgaaagagcattaagaggaaaatatacaaccagactaaataaatgaaaagacacattaaa

SEQ ID NO: 23704 - DNA, 201 bp, Bos taurus
gctccttgcctcttaatatcagacattactgacaaaatgaactgagagttagaagatgaggtgaattgggagctggggagggttcctgggcccttcacctactgggaacaccactagcttcccacccatcatccagacactgccatcctgtctggaaatttgctgaactataatttgcctctatccagatgtccctcattc

SEQ ID NO: 23705 - DNA, 201 bp, Bos taurus
cttgaactcttcaaaagatgtcaaagtcaaaaaatataaagaaagttgagaaactgttcccatttaaaggcgacgaatgcatcccagggaatttcctggtggcccaggggttaagattctgtgctttcactgctaagggcccgggttcaatcctggtcagggaacaaagatcccacgagctgcgcagcatgtccaaaagta

SEQ ID NO: 23706 - DNA, 201 bp, Bos taurus
agttttcccttcctccgccctcatcctttttgtttcctgagctagatggcctcacgtaccacgtggtggaggggacgctgagcttctgtctggcctccagctaggatgccatcttccatttaccaagaaggcgaggtgggtctctgcctaccccaacctcctattttattgtcagtgacactgttctttaccaggacccta

SEQ ID NO: 23707 - DNA, 201 bp, Bos taurus
ttatgtgaaattaacattctaatttcattcctgtcatgtaccatctatttgtagcaatataaggagaaaaggggttacttttctatttttaaaaaaatcagctagtttccacaatggaatatcaaccatttctgcaaaatagttctttgccattgttactaagaagttatattaaacattttctgttctattttagtgata

SEQ ID NO: 23708 - DNA, 201 bp, Bos taurus
tggacaagaattttagtaaactctgggagatagtgaaggacagggtagcctggcatgcttcattcatggggtcacaaagagtcggagacaacttagtgagggagcaacaaacctttgagtaggaaatacgaaatcctttctactgaagttgacttaaattctgcccctaacccatgaggatgagagaaaactattttacaa

SEQ ID NO: 23709 - DNA, 201 bp, Bos taurus
gactggcccaatagaaaaatggaaacaagacaatgaacaggagaaaaagaaacaaatttaattcatatgcacagaggtctcataggaacaggacttaagaagtggccaaaacaggcagcttttattccttttagagtaaggaacaataaatttgtgaagaaaggatggaacaaagaaatatgggctttttgagtgggttaa

SEQ ID NO: 23710 - DNA, 201 bp, Bos taurus
caggcatcttctgaaatgaagcaggtgagcactgcagagtggaggaggccagggtcctccagctgtatccagggctgccacgggcctgcctgagggtatgccagagtgctccaaaaacagaaaagagaatcattctgtcactttccaagatgtcaaagccagcctcctcaggtttccctaaactttcacagagagctttgg

SEQ ID NO: 23711 - DNA, 201 bp, Bos taurus
tgctcgtgagcaataagcgttgtagcccccagagcaggccaggctgcctatatggtacaaggaagctttcataagatgatgcagaccccactctcagaccaagtagctcagtggctatcccaggccttcagaagctcccccttcaactctgtgcaatggtcacctgctgctccctcctcacgtgaaggccatccacctcag

SEQ ID NO: 23712 - DNA, 201 bp, Bos taurus
cagccttttagtgatcctgggtttagtttccttgttggtggctttatcgagaaaaaattaaagataaagcagtgaagggctatttgacagagaccagcaaatgattccctagatctgtgttctctttccttcagtagcatgttcctaaatcgtagcagcatacagaccactcagaatgaaggctcctgttgtaaacctgtg

SEQ ID NO: 23713 - DNA, 201 bp, Bos taurus
gtaaattcctttggctggtgctcacagcagtctgctgagctggctgtactgtggttcccatctcgaagactggtacttcattgcctcagtgacaacgttgcttctttacattagaaagaaaatgagggtttttcagtgttggtgactgaaaaccaaaaccaaaacaaaaaaaacccatgaagctgtgactaacatcatctg

SEQ ID NO: 23714 - DNA, 201 bp, Bos taurus
gaagacagcaagggtggaccgtgactgccaggcctgctcggtgttgaaaattcaagtttatgctcattgagataacgagctgttacgtactacgttggtacaatggccatctactataacaaatgcagctaggtgacagatttctttaaaaattcatggtactgaactgccatatgacccagcagtcccactgccggggat

SEQ ID NO: 23715 - DNA, 201 bp, Bos taurus
catgttctgcaaggaggcagttgggactttgcctgcccagcacctgtgcccggccccgcacaggctgctcaccccagtcccaaggcccccgtgtgcgtccaggcaccatgtagggcttcatcttgtttcctgtggttgagtgtatgcatttcctggcccaaacctacatgtgagcccactcagctggcgtcgccaccatgc

SEQ ID NO: 23716 - DNA, 201 bp, Bos taurus
tgcttccctgtacaccctacccctctagcatttattcacaggaatcccaggaatgggccaaaatcctattatctggcagggtgcactttggacagctgagaccccaaggagcatttacttgtttcctcttttgcagcctcacaacggccatcacagactgaccggaacagcccattgtatgtaaatccatccccacaacag

SEQ ID NO: 23717 - DNA, 201 bp, Bos taurus
ttttccagagagcaatgtaatgagaaattacctaggggcctagatgatctggttatgaaagcaggagcatgcaaaccagtgaaactaaacaaacagtaaatagatgggcagtgggaaacaaaatggtaattataaagcaaatgaatgttagctctctcttgaaacaagttttcacatgtgtcctacagaacatggagatgg

SEQ ID NO: 23718 - DNA, 201 bp, Bos taurus
ttcacaaagctgctcagatgggcctctttaggcctcagttttgccatctacacaacagggatgatgtctgcaccaaataagagttgtaaaggcgatgcacaccaggcccgccctcagactccactgtgagcgggggctcgaaacccaaaacttaacagctccacacctcccgccgtctgtacccacatctcctgcatggtg

SEQ ID NO: 23719 - DNA, 201 bp, Bos taurus
aaaaattcataaagcttaatgaaaggaaagtctgataaatatttgaagagaaaaattgttctttaatgacagtgttattagaggaatactgtttagcctggattattatgattaactgtcttggcattttactaatctgtttgtaaaatgatattgtctagtgtgtatttaaataataagaaaatgagtgaaaaattctca

SEQ ID NO: 23720 - DNA, 201 bp, Bos taurus
aaatgggcatgtggctagagaaagtcagttgaaagagtgtttttaagataaaagatattatggagtacatgctgatggaataatcctctagagcagatggattttactttcattgttgctactaaggccaaaagctatgataatgtataaatagcagttcagatacattagtctcaggaaccaaaggaacagaatactttg

SEQ ID NO: 23721 - DNA, 201 bp, Bos taurus
gcacagcttggtggagtcatcatagcttgactggaagtcatcatagctatgcccctgtctgagctgccactcaccagcagggtgagcttgggaaagccacgtttccttctgggcctcactgtctcagctctaaaatgtgggcgttggagctggatgggttggtggagatgacgtcggagagcaggtctcaaccagggtggt

SEQ ID NO: 23722 - DNA, 201 bp, Bos taurus
cttgtcatcagtattgtaatggtgaggtgtgattagaccatctcgcaccagaagttgagaatggtaattcccagagacgccatgagccacctactccagatagggatgctggtgtctgactgactgcctctcctcacaaacaatttctgctgccgttaaaggttccctcagggactctgccagctttactgctgcatgacc

SEQ ID NO: 23723 - DNA, 201 bp, Bos taurus
tagtctgctttgcggaaattaaaaaaaaaaaaattctcttaagaggacctcctattgggagttgatgctgtgattaaacagctatttcttgagccaggtatagtactaggtcgcagggagaccaagacatggatataaaaatccctgccttcagaatccttatttcaaagggacaagggcacctcttgtgagtaggccgat

SEQ ID NO: 23724 - DNA, 201 bp, Bos taurus
cctcacagaacatcctcttggcttgaactctggtttcttcttagccatagtgggacaaatttcaattaccaagtagataactatcacatttttcttggctctatgatttctctcttctgtatctgcaaggcatcaatccatattaccaccgatgagtttgtctcagaacatatcatgtaactgcagcaaagacaactctcc

SEQ ID NO: 23725 - DNA, 201 bp, Bos taurus
acatacagatttttatttctactagaaacacctgaagagtggactaagtgatttttccaccgtcagttcttgagtaagaaaaaataaccgatggccatgggggctcagtgaatagtttgagttcagtctagatattcttctgtgtgtcctgtgatattgtcctcgttcacttttggcccacagcagttttcttcttgcttc

SEQ ID NO: 23726 - DNA, 201 bp, Bos taurus
ctacaggagaaatagacattaactattttctaaaatcttcatatgaataccttttctccagaaaaatctctcactctctgaactttcattgctcagtctcgaaattgatttgaataaaatagtatccctcacgatggtctttctgatgaaaaacagtgatcaatgattaattggtaagaaaaaaaccaacagctaggattt

SEQ ID NO: 23727 - DNA, 201 bp, Bos taurus
acattgacacattaagatgctctgagtgatactcacctcacattaatttatttttgttatgtctgtcagaatataagttttcattttgttagggtaaattttaagaagtagcatcactgggtcatatagcaaatgtatgtttggctttatgagaaactgtcaagccattttctaaagctgctgtaccattctgcatttcca

SEQ ID NO: 23728 - DNA, 201 bp, Bos taurus
tccaggagagagcgaaggacaggggagcctggctgcagtccatgggggtcacaaaaagtcagacatgattcagtaatcgaacaacaacagcaaaacttagatatatgtctcagatccttatttgagggaaatagcttcctgagcatggtaaccctcttctgaaggtctactagcagttaaccacttttgtgagaaacacat

SEQ ID NO: 23729 - DNA, 201 bp, Bos taurus
ccgcatgacacagttgtgagaaatcatgaaggaaatttctaatacagctctgtgggagtaaaagctttccgcctatggagcaactgatacaatattatcccgccaaatgtatgattttggtaaatgactgtgaccttcagctatagtatagccttcatgacacacatttacttgtaataacttcctttctggaaaaatgta

SEQ ID NO: 23730 - DNA, 201 bp, Bos taurus
ttatacagggagagcttagattggtgggaatgggttataaagcagcaaatagcagcctattatatcacctttcacactatgcatgtgtttgaagtatattctacctatctggccagcaggtagctggacggatgctatgattcatacagcatataaaagatgtcatttgtgatatgactcccaaattctagacacccatgt

SEQ ID NO: 23731 - DNA, 201 bp, Bos taurus
ggacaggaccttccccctaccccaccccttctgggccaaactgtgtgttgaaggctcaagcagtcgagaccccggagtaaagccaaggaggccgtctggagtcctacttcgggattcctcggaacctctgtgcatccacggtctcatttaagagccatctcggggcaccgagggaggcggttttggggtgcaggcggccgg

SEQ ID NO: 23732 - DNA, 201 bp, Bos taurus
tacacacacttttctgggctgcttacatctgtaggatggagcatgacccccaaaagtccagataagttctccagttcaatgaccacagactttttttccagtttcagtcaagtatcattcagattcttaaagctggtatgaagaagtactgggagattatttatcatctttggggtaatgtgtcttccacatgggaatgaa

SEQ ID NO: 23733 - DNA, 201 bp, Bos taurus
ctttggagaaggatgtgtccctagggtgcatgctttgtgacactaaacacagactctgtgtttgcagcgattcctccttttctcaaggcctcaccctgactctccacccttaacagtaacatatgacaattacctttttatgcttaatcatcagacatttgtaatgttatagattgttttttgctcgggactaaaaacagt

SEQ ID NO: 23734 - DNA, 201 bp, Bos taurus
cagctgctgggaaatgataagagctcaacatatgttagaagcaacaatcacacgcaaggggtataacttgtctttttactatgtgtgaactggaagtttaaaaggatgagtattagtttaatgtagaataacaaatattttttatcagaggataattgctttccaatggtgtgttagtttctgctgtacaacaatgtgaat

SEQ ID NO: 23735 - DNA, 201 bp, Bos taurus
tatgcttggtaacctggcgttctcagctagctgatgacaggagggtaacgaggtggatatgaaccagacaacaagtaaaaaaatgagtttctcaaactgaggtctgtaggcctttggaagtccaaggttattttattcaatcaattgaattaatactgtaactgagcagaaccccatggaggcgacaggcctctccccaca

SEQ ID NO: 23736 - DNA, 201 bp, Bos taurus
ctgggttggaaagaacctaccatccaattagagtttccagaatcgtttctttctcctctttagagcaggaggcagtagaaggaagaaataattagcaagagcagcagggccagcatatttttttacaccagatgatgacgctgagttccactgcgtgaaaggaaaaagggaatttgatgggaattctgactgctaatgttt

SEQ ID NO: 23737 - DNA, 201 bp, Bos taurus
ggtaaaagtggaggaaagaaagtaacatgccttgtaaatgtcttttcatgaaaatccataagaagtctcgtcttttggaaagggcatggccacagggtctcttgaaacacgttgcctctgtgcgctggtttgagatgaggggcttgggggagggcggctctgggcctgtatgtctcgggcgggggtgggaggaattgggcc

SEQ ID NO: 23738 - DNA, 201 bp, Bos taurus
tgtcttttctttaaccatatacaaaaatagcaataacgaattgccccacatttgctgtagatgataattagctggctcattgccaagaagataatcaatccgttgattttaccaaaggcaatgagactgacttccccatcattttataaaacataattctaaagctgtgggcgctctcgtgctcctgaccccagagttact

SEQ ID NO: 23739 - DNA, 201 bp, Bos taurus
tacagttcctacttttcaagtagcttagtaatcctcatctattttcatgcccaaaccactcagaataaaagcaccttatagtggttacagtgacttccttgggtatggatgttgtttggacactcctctgtcctgtgtgaacctctgggtcctttaagcattgctgtgctacaggctgtgagaaaaagctaaatggactat

SEQ ID NO: 23740 - DNA, 201 bp, Bos taurus
ctgccccacatctgcaatcagtcacttcctgaagcagccttgtccttttaatagggaaaggtattcagagactgctgtgtgggtacattggttttatttcgctaagcctaaaagtgagttaaaattaagagcatcctggtctaatttcagttttcaaagtggtgcctcaaagtctgatgatttgattatttgagagtgagt

SEQ ID NO: 23741 - DNA, 201 bp, Bos taurus
aggtgatattaacacagcagatattttggattcagagggccactctaagtgtttttctctctctccctcacctccttgcatctgttccctttctccctcgcagtttgctcctgatgcaaaatgcgattgttacttgcaattttagtttgagatatgaacatttggagttatgtgtttttgaaagaaaatgaaatgtagatg

SEQ ID NO: 23742 - DNA, 201 bp, Bos taurus
acatgaacagcagacactatgtcattaaggaattgcattcagacgcttccagaattctttgcctttcatttagccttctttattccacctaaatggtccccgataaaacatgactaaaggaattaattttcctttatcctgtttccaattgtcttgatgatattggtttaaaagtctccaaggaaccagaaaacactcctc

SEQ ID NO: 23743 - DNA, 201 bp, Bos taurus
caggacagacggaggcagggagcgtggccaagcaggctggcttctgacactctgtccaagagtgcttgaccacattcattgccgaagcgcctctcaggacaacacttaacttctgaggggcaacaagggagggagggagaacagattgaagtatttggtggcagcacaaatgacacgtgtcgttctcgggatagttgccat

SEQ ID NO: 23744 - DNA, 201 bp, Bos taurus
caattctgacttattctgcctaccaggccaaaaagaggaaacaatcatgtcaaagaaaagaggaaatgtccttttaagtcaagaaaactttatatgtgagggtgcaaaggcagagaaggcatatcttttggaagaataaatacttgatgtggctgaaagatacattgaagggaggtggatgtagcaggtgagactgaaaag

SEQ ID NO: 23745 - DNA, 201 bp, Bos taurus
agccaagatgcaggcctggctcagggaccagctcagctaagcatcttcaacctcattcttctctacacgatgggggcaaggcggcagaggcaaggtgagggaaggtcttaccggcctgtctgggtgggctgagagaggtggcaccatcacacagacaggtgaccatcattaggtaaatcagtgggagaaaacagaccccag

SEQ ID NO: 23746 - DNA, 201 bp, Bos taurus
tcagttcagttcagttcagttcagttactcagtcgtgtctgacactttgtgaccccatggactgtagcacgtcaggcctccctgtccatcaccaactcccagagtttactgagggtctgagggtctggcccacagcaaatgcttatcaagcacagctgatacaatgagtatgacaatattgacatctatgggttttttcct

SEQ ID NO: 23747 - DNA, 201 bp, Bos taurus
atcaataagaagagaaaaatgattactcaataaatgttagaagttcattgaatagatttcaatttctttattgtcttaacttaatatagaatatatttctgtgtcaatccaacagctaataccctgatttatgttgaagcaccaaaagatatccccattttttaacaatccccatttataaacaaaatcagaatgtgaatc

SEQ ID NO: 23748 - DNA, 201 bp, Bos taurus
gcttctgttcacagcaaaacttgttaaaaagttgtaattcttgcactcccatcttcaacttgtgttcactcctcaaccaactcatattcagccttccaaactccactgaatcttctcttggaaagtttaccagtttcatctcaccaatgccacttaacacctttctgggcccaagttgcttggcagctcagcagtatttgg

SEQ ID NO: 23749 - DNA, 201 bp, Bos taurus
attattatgcactcatagaatggaatgccgtgtagcctttaaacagaatgaacagctccataaaaatcaaggcgcagaacaatgtcacacccatatatgtatgcatgtatatgattgcagacagggatatttaaacatgcataaactatctctgaaacagtttgaaagagatatgattttaagttcacaaagaaattgctg

SEQ ID NO: 23750 - DNA, 201 bp, Bos taurus
gccttttccttctccaggggatcttcccaacccagggattgaacctaggtattccacattgcagacggattcttaaccagctgagccacaatggaagcccgagaaggccatacaaagccataaaaagttggtctgatttaatagtaaggcttaatttaatccaaggttttaagattgaaggagaggatcaggaacctatga

SEQ ID NO: 23751 - DNA, 201 bp, Bos taurus
taaacttttaaatctatttttgtacctaaacatgccaaaatttcttctttgttgtaatattcctgattttttttctttgtgtcacagcccacacttctttctatccacctaatgatacctccctggggggcatctgaaatattataataggtagaaaggccactcccttcatctgatatttgctgaaagctgagtcaagtt

SEQ ID NO: 23752 - DNA, 201 bp, Bos taurus
ttctgaattcagggaggcctgggttcaaatcccagccctgctgtcacaaaccatgggttcttgcatgtcctctgacttctcaagactcagtttcccacacttacaaaccagagcaataaatcaggcctaccccaccgaatcacataacacatttagcacagggtccacagccgggggacctcatgattattaactaccctt

SEQ ID NO: 23753 - DNA, 201 bp, Bos taurus
atgagcagaggctgaagaattctgaaagccaaaaggccctctcttttgtgaggctggccccaactgaaggcagacaaaaaaggcaaagatgaaataaaacagactttgtcttactaacctggcacacatgcctgctgatcggtggcttagctggcaaattgcaaggacctcgatgggaggttgaaaactcaacaagtcact

SEQ ID NO: 23754 - DNA, 201 bp, Bos taurus
gtcacttcagtcatgtccgattctttgggacctatggactgtagcccgccaggcttctctgcccatgggattctccaggcaagaatgctagagtgggttcgcattgggatgttctacccagacccttttcggtaaactccatcttggctaagagatgcatgcgcacacatggaggatcctgagatctaccaaatgtggact

SEQ ID NO: 23755 - DNA, 201 bp, Bos taurus
tttatgacagtgagaccttatcattttagtttctttaccctctctttcactatcacttatctttgaccatctacatctaaacatgctctagtctttcctcgtgaaaaaacacccagactctcttttaatccctttcctgtttgtgtgcctaagcttcagaccgttttccatgcacacccctgtttaagatcttctgtgctg

SEQ ID NO: 23756 - DNA, 201 bp, Bos taurus
gaactgcatggagtgtgttgaggagaggttgtggaaatgctgtgattataaccactgccttcaaagtattttgctttgaaggggagcagagaaacaggagaggaattgaaaagtattctggggtcatttgaggtgttttgattttatttttcataggacagatcacagcatgtttggatgctggcaggaaaagtctagaag

SEQ ID NO: 23757 - DNA, 201 bp, Bos taurus
tctttgttaaataggaatctaatggagttatgggcatttactctttttatcatataggtgagggaaggaaaaaaatgctagtaaccttctactggtttgagaggacaatcttataagtattcatactgtatagaaatatggaaatgtccaacatgaaatctagagagcatcagattattaagtaagacaatttatcgaatt

SEQ ID NO: 23758 - DNA, 201 bp, Bos taurus
aggagaatactgagaattgctgtggctgacgtcttcaccgcacctggacagtgaacgcggcagctgattcactagtataatggccttcagtgctttccagttgagtaaggccaggcatagtaaagacaattgtggaagcttcagacaaagtattccggtgtgagacctctccttttcatctgacttcacgtacaggaaaac

SEQ ID NO: 23759 - DNA, 201 bp, Bos taurus
attttctctcactgaatgaaaccttgagtcccaggaggcctgcagaggagctggtaccgaggacccaggtctcaggaatgaggcaggagtggctggagcttagtgggagctgcagaggccgcaggccaggggctgctccaccccgacgggtgagccagcaggtcatgggcaggcgttgcagcacccctgctgtcctgtcct

SEQ ID NO: 23760 - DNA, 201 bp, Bos taurus
gcccgccaggtggggttcatctgtctgggttttacttaaagagccttgtccctggtgagagatgacagaggctgctctccttgcagtgtgaagctcaccttggccatgtgttccccgacggacctgggcctgctgggcagaggttctgcatcaacagtgtggcgctccggttcaagccaagaaaacactgaccacctccga

SEQ ID NO: 23761 - DNA, 201 bp, Bos taurus
ctgaggcctctacattggaaggcagattctaaaccactggacctccagggaagtccctcaacacacatcttaaaagggaaatgctattaacccagctaccgatgatgaagttgaagctcaggcaggaggtgacaatggaaattggccttcaggggtgggtagggttttcgttcctggtgagttgggcatcccaggtgagag

SEQ ID NO: 23762 - DNA, 201 bp, Bos taurus
tagagaattctttagctagtgtttctggcttaagttggtccatgtcaactcttccctcaagtagggcaaggcctgggagatgaccttcttttctctctttactcaagaatctcagtgctggaggttctgtgagctctaccagctgagaaccatttatgccataaaatttaggaaccttctgtaacatgcttggacagacct

SEQ ID NO: 23763 - DNA, 201 bp, Bos taurus
gggcatctggagcccggccttggcctcttttctctggttccgggagtattaacccagcttctgtggaaaactcccccagggtcgcgcgaggcggggaatggtgtgtggaaggccctgcccctttgatctcttttcatcaacttctcagtgcgcagcggcggcgggctggaggtgagctcggagcaggccagagccgccctt

SEQ ID NO: 23764 - DNA, 201 bp, Bos taurus
ccttgctgtccaggagaccctccaaagtcttctccaacagcaaatgtgttcacacaaatctctcagccagggtggattccaacaacgaggcctatgggtaaccttagcatcagtcttcttttgacctgcaaggaatttactagtcaagaaaggctccttgactttgagaatgacaaatacatagtctcttatctgggcacg

SEQ ID NO: 23765 - DNA, 201 bp, Bos taurus
ctttaccactgagccaccaggatgccccttttctttgtgcattcttaaacctttcccttttctacttcttttcattaaagcctttaaaagtcatttttttaaatctcattccaataaatatcaatgtaactccctcattattattaatatcctttaagaatgaggtggtctttttgtttctatttaatcacaagaatctat

SEQ ID NO: 23766 - DNA, 201 bp, Bos taurus
gcagataaaagagtcactagtagtttcataaaccacgttaataattctgcgttaacaataaataactgcatgtttagtgttgttacctaagctctcatagccaagaccctcactgggcctggtcgttaaaagcaacggagctcttttaagcagaatctgaattaaacctgctttacctaaaatttcgtccaaagacacttc

SEQ ID NO: 23767 - DNA, 201 bp, Bos taurus
gaaacgattataagagatctctgccagacacagccaaaaagaggagggggcaatgttaagaccgggtaatttttaaaaggcagaactgggatttctctggtggcccagtggtgaacaattctcctcgcaatgcgcaggacatgggttcaatccctggttgggaaattaagttcccacatcttgagaagcaactaagcttac

SEQ ID NO: 23768 - DNA, 201 bp, Bos taurus
ctaatacaacattgcaaagcaactatactccagtaaaaattaattaaaaaagaaaaaaacgcctggcaatatgaatatgtttgccaggcccccacacacactcatcagcagagagtggaagcctcactatctcaaggtgtttgagaacaatctctaatcaatattaggccgaagactaggctattcagacacaggtgtgaa

SEQ ID NO: 23769 - DNA, 201 bp, Bos taurus
gatggggtcttaaataacataaatgtatttcttcgtggtttggaaagggaggctggatgtctaaaatcaagatgttttctgaggccaccctccttggctcaagggtgacccccttctccctgtgttcacacctgctgttctcctgagtgatatctgtgtcctgaccacctcctgttacaaggacacagccttatcaggttg

SEQ ID NO: 23770 - DNA, 201 bp, Bos taurus
ccatgataacggagtggcagtcttcctacaaactgcctgttcttccgctctgaagaacagtaaatagataatttctgaatgtctagattcatgaggtttatttaccagctaatggcttctgacctccgaatctttaaacgaataggaaaagaatgtccttgtttcatagaagcctatgggctgggaacaagcagtctgggg

SEQ ID NO: 23771 - DNA, 201 bp, Bos taurus
atgagaactgctctagcccactgagggagtatgaaattgtgtagccaaggagatggattccatctttcaatcagttagctcttggtgtgtaacagaccactgcaaaacttagtactgtagaaataacacacgtgctccacatgagctcctgttctccaggaggctaaccaggcttttcctgacagtgatgtcagccttcca

SEQ ID NO: 23772 - DNA, 201 bp, Bos taurus
tttccttaagagtgtatctgggtactgaaagttatcttgattagtgcccaaggttttcaaatatggtgcaaagttgtagagaatattgattgagtcattcgattaccaaatatctcctgagtacttattttttagttttctcttgattgtgatttctggtatgccaagcaaatttttaattaaatgatggtattgtatggg

SEQ ID NO: 23773 - DNA, 201 bp, Bos taurus
atatcctattggaatttcaatataaggtactgtaatcattatactacaagataaataatacaagccttctgagtacatttgctgaattattattatattaatatattatcatagaggcagtaaagtaaaaacacaagacttttgaaatacatgatcttgatttctatccattaatatatttaaagaaatacaaaatcttta

SEQ ID NO: 23774 - DNA, 201 bp, Bos taurus
gtccagtggcttttcattagagaagagaaaagaagcagaagcattattgacactgtttagatcaatgtccacagtggaaggctagactctcttgataaaattgtcatgaaaaagctcaaaagcaatccaaccgtctcactagactctaatccctgatatcatctccatccccccaacacacattccccctctacactttga

SEQ ID NO: 23775 - DNA, 201 bp, Bos taurus
agggaggcctggcgtgctgcgattcatggggtcgcaaagagtcggacatgactgagcgactgaactgaactgaaaagctaagatcttggaagagagtctgtcctgaaaaggcctaaatgacataagttagggtttaaaatttctcatcgtacattaatgaccaatatcagcatttcccctaaaacccctggcagagactaa

SEQ ID NO: 23776 - DNA, 201 bp, Bos taurus
atccactcactgatccccatcccactcatggcccccatatctaagccataaagtcttgcctataattccttcttcacccagctgtcctttatcatcttcactggcccttagaattcagctgcaacagtgaaaatcagtcgctcccaagcttgatgatacattagactcacctggggcagtaactgcttcagaggagccgtg

SEQ ID NO: 23777 - DNA, 201 bp, Bos taurus
atccaggagaagtctgggtgatttgcctgctagaaataacaggtgaaggtgagaatccatcatcctgcaggtctcagctgaagtgtgaccttctcaggaacggcctccctgagttggttaaccagtggtttttatatcataccatctagtgatcgtctggactatcaactcaacaagcgcagagatcacagctgtcttgtt

SEQ ID NO: 23778 - DNA, 201 bp, Bos taurus
tttgaaagcacaactttcttttgacagcacagctgtggctctttttttcctcaaaaaggagacctgtttgttgttccacatggagggaaattggagcatcctgctttcatcatcagctgagaaaaggtttgccatcctgggtgtgtgtagagagagagcggctggacatctgtagctttgtctggcttcccaggcacagtg

SEQ ID NO: 23779 - DNA, 201 bp, Bos taurus
ggcacctagtatagggcttgaactcgaccactggggcaagagagaaaaagatgtaaacatcataggaagaatttcctctaagggcagtttttataatcagccaaaagcacttgtatgcttacttttgtgtataaagattcagccttgctaatctgatcagttcccactttattcctgtttattcagatcattgccccaaga

SEQ ID NO: 23780 - DNA, 201 bp, Bos taurus
tcctccccctacttaaaggcccacacttgctctttacttaactcatttatacattatgttcttacatttattaggattttccatgaagttcagttttacctttccagctgtagaagcaaaaggccctacagaagtcatccaggcttgaatacgttgactcagttggcactggtgtgcaatgaatttgaaacactctggttt

SEQ ID NO: 23781 - DNA, 201 bp, Bos taurus
acagtcttcaaaacaggttgagaagaggaagttgaagaaacatgctgagaagcattccagatctttaagaaccaatgatagactgtggccttttaaaaccacagttccttctcccactgtggttgttggcacatcaggaaaaagatcaatcaaactgtgtccttctacaccttgcaactaacggtggcctacagtaaatcc

SEQ ID NO: 23782 - DNA, 201 bp, Bos taurus
tcaagagggaagaaaccaacagctgctgtggcctcagaccattactctggtatttgcttagaagacctttgggaacacagataaggagaaaactaaaacaaggtatctgggcccaagacactgaggaagctgctggcactttccttcctttgaaccctgaggaagaaggagaggcagctgaatgttcttttaaccctctcc

SEQ ID NO: 23783 - DNA, 201 bp, Bos taurus
ggatttaggaatggttctgagtgataagatctggctatggaattctaggaagtccagatattttagatctgcatattaacatcccaaatcagtgccctccggataggttgggactgtggcttcacatgtgtttgctactggttgccagagcaaccaaggagaatgagaaaaccattcatcataaatcccacctggtgctgc

SEQ ID NO: 23784 - DNA, 201 bp, Bos taurus
tggccgcgcgcggcgcagccagtgggcagcgcatccctccaagcagggtctctccattttcagggccggggaagcaacaataagctgagccgagcggccgaccaggctcgccgcactggcggcgccccccgtatctcctgcacccccgggtaccggggactccccgcacgcggcccctgccacgcaccgaccccgcacgcc

SEQ ID NO: 23785 - DNA, 201 bp, Bos taurus
atcctactgcagagagcatcatctggttctaaaaagtgacactatattcagagggttttctcttctcagtgagggagagagcggattagcaggaagggaagtgacacatgtacagcttacatgttctgaaaggctgttgtaatgtaggcgagaagtgattgtgtttgaactaaagtagtaacaatcaagatgaaaagaagt

SEQ ID NO: 23786 - DNA, 201 bp, Bos taurus
attcatagaattgcaaataatgggaattcactcttcttccaggagaagttaaaaggccgcttattattctgaacagtctgacctgactaccagcctttagcttgtcataaagccaggcagggagttgagactagagatctgcactccccacataagaccacagagtcttaatcagtggttcttacctggaaagctttttaa

SEQ ID NO: 23787 - DNA, 201 bp, Bos taurus
ttttttttcagctgacaatataaataacttgcattatacacatactatgttctatgctattcttagaaaagaaaatacaggccctgattagccactttcacctgagccactactatttatgtaatcctggttaaggtaacgtctccgaaactcagttttatcatcttaaaatggagataacaataaagcccacacaaggcc

SEQ ID NO: 23788 - DNA, 201 bp, Bos taurus
atggagtagacatcacaccatccagaagcaacatatctaatcagagcagaaatgcactggcctgagcaagaaggtataatgtgaattcacagaggaagggaaaaaaaaaggtccaaactgaatcaagccaaacaatcaagtaagcaaaccaatatggcaaatgagaaagactaaagtggagaagctaagaagaggttgctg

SEQ ID NO: 23789 - DNA, 201 bp, Bos taurus
ttcacgttgactttgctcagctgtatcagatctactgatgagcttgtcaaaggaatgtcctattgctgctgctgcttatttctaggatttctcttggactctttcttgcagtcttcacctctctaatgaacttccctatttgttcacatatgtccatctttcctatgaaaccctttggcatctccatcatagcgactgtca

SEQ ID NO: 23790 - DNA, 201 bp, Bos taurus
gtcaacaatgactggaggagggaatagcaaaccacgtcagtattcgtgccttgagaaccctatgaacagtatgaaaaggcaacaatgataagacaaccgccttcctgactttccaaacgaaactgagtgctaagtcgtttccattggaaacatgtgcttactttgaaccatgtgtgcatgtgtgcctgtatgtgcacacgc

SEQ ID NO: 23791 - DNA, 201 bp, Bos taurus
ctcagaggcgatcacgttcctcccagggctggaaagcagattggcaaaggccaaagatgagacaaaaggcatgagccctggaaatgatttaaaataacaataacaacaacaaaattgattagggcctcccagttccaattctgtctccccttccggggatgattcctgggctatccagcaaatcccttaaggcctgggata

SEQ ID NO: 23792 - DNA, 201 bp, Bos taurus
ctccataaaaaacctgttagtgatgacttaccatccttttcacagactgaaaaatgaatgcatagagaggtgaagtggtgaaggaggcccaaggcgtctcttggagcccgagctcctgtagctgcttccgcttctgggagtctgtcccttccacttccgggagcgggcgcgctcggccggcatcttgttgagttgagctca

SEQ ID NO: 23793 - DNA, 201 bp, Bos taurus
ttgggtttgtcagtgcaagcaaacttggaactcagaacttccaaatctgcagggtatgacaagacccctcatggtggctcaccagcagcagcgataatggattctctgctctcctgttggttttactggctttgtgcatgcgtgctaagttgcttcggtcgtttctgactctttgcaaccccatggactgtagcctgccag

SEQ ID NO: 23794 - DNA, 201 bp, Bos taurus
gcccaggggctggggactcctgctgtatggcattttggagtgagtctaaaacatgaagatcatataggattcagagagttaagaccatgagaggccacaaaagtcagtccaggagatgttaagacttgagatagacatcgaaacagtggagaagtaacattttcctgcaggggtaattgttctgcggggagatgcatggca

SEQ ID NO: 23795 - DNA, 201 bp, Bos taurus
ctataaccagaaggaattcaatatggtccagaatggcacaaggtctacaaccaggcagattctagctaaagatagcatttaaagaaattagacaatactggggagccctgtccctgtgtctttggataagctctaacttctctgatcctcagttttattcatccattaaatgatggtagtatacagtcactcctccatatc

SEQ ID NO: 23796 - DNA, 201 bp, Bos taurus
aaatcccatagtgaagatggaaaaatccacccagacttgggtttttcctcctgtcaggtaaatgtgggctccctgacttcccttatggtacacacatctgcggttttaatcttccaccaagttttaatctgccagactaattaatgtgattttcaattcggtcatcatcagcttgtatagctaggtaaagcctgcagtatg

SEQ ID NO: 23797 - DNA, 201 bp, Bos taurus
gtctgttaagagtctggaaatgagataattcatcttccctggactgtcgctgctcgagactctcggaaggcctcttaggatgtgctgggaacaggaaggttaccttgaacctcaaccagggacacgaagggaaatgagatgagctggtgagttcttaatgctctcatttaggtaatgggtcgattggttagaaaggggagg

SEQ ID NO: 23798 - DNA, 201 bp, Bos taurus
gaaggctgtctgttcaatgtcaaaccgcatgaggaaaagccacacaataaatggtgcaattagaacagcgagttagcgctaatggaattttagcactaacagcattaacgtcacaggaacaaacgggacaagggccagtgagctctgcccggcgacctggagcgctggtccagcctcaacaatccatctcactaagggaac

SEQ ID NO: 23799 - DNA, 201 bp, Bos taurus
aggtgctgggcagacccggcctcactggtctagctggcccaggttaaccggagcgctgatggtcgggctgcatactctgcgtgaaattttatgaagacacgatgtgatgaggccacaaagggagctatatcagtgtcctaaaattgaaaaagaaaagaagtaacaaattatataaaatttgaacattttcccagaaatgtc

SEQ ID NO: 23800 - DNA, 201 bp, Bos taurus
gcctaggaataaatgtaacaaaatatctataagactttcatagaaaaaatataaacttttagtgaaggatctaaaaggagactgaataaatggagagatattccaaatttaatatgaaaagtctctatataaagattcttccaaaatcaatctataaatttagcacaatttcagcaaaatcagtaagcattactgcactta

SEQ ID NO: 23801 - DNA, 201 bp, Bos taurus
tttcacctgaacaaaagcatattttatcacttcattaaaaggcatcaggatgacaaagcaattttggaaaaactgtgctgacaacaaaaatgctaagaaactagccaaatgtttctagtctctgccaaaactccaaatccaatatgataagaatgcaagttactggacatcgcccgatgtcttctttctttctgccatctc

SEQ ID NO: 23802 - DNA, 201 bp, Bos taurus
ctgctgtcattcgaggcctacataatccaagccagagaatgcatcagtaattattacatgcagttttttaagtctagagaacaaagtttctcactcaatagctatggactgcatacacttttgctttgtggtcatctcagctgaattctccctgctcacttgtcatttctttctttgcaaatttcctggatatgcctccta

SEQ ID NO: 23803 - DNA, 201 bp, Bos taurus
tcagggtctggtaagagaaagagaacataaagaattcagcgggcaatactttattttttttaacctgactttattttattatctttttggccacagggcatgcggaatcttagttccagaccagggatggaacctatgccccctgtgtggaagcaaatccagcatgcattactttataatagcaacaaaaatttaaggccc

SEQ ID NO: 23804 - DNA, 201 bp, Bos taurus
catgaggccgtccccactcctgtctctcctctttcttcttccggtagccgtgcagctcctgggtaagtaggctaatgaggtctgagcttcctgacttgggacctggggtctatgataccccctcctttgggggagagtattaagggattccttccacacctgcgtggaggaggaagccgggctacagcaccaccagctctg

SEQ ID NO: 23805 - DNA, 201 bp, Bos taurus
tatcactgattaggtgtccctggtgtttgacctgggacttttgatccagttcaggatggaatttctctccagccagttgacaaggaggctcagagttagagttagcataagaatataaaaagccatatttctcatgcacgtgggtgctactctgactttcaacagttttgtgaatcagtatcaacccatctatttaaacca

SEQ ID NO: 23806 - DNA, 201 bp, Bos taurus
ctcatcaaataacagatttttcacatgttgtactgaggctagatgcgtatttactctgaccgtggtgaatgacggagggtgagacaagttatgtaacagtatttcaaacctcctttctgcttcttgtttacctaaagcggacagaatctgaaaagaagaaaagaacaagttactgtttcaatttcataatacacattaaaa

SEQ ID NO: 23807 - DNA, 201 bp, Bos taurus
tgtggagccaagcatttcaacagggaacatagttctggtctgcggtaagaataacacacactgcctgtttgcttcagcagcctggcctcgcatctcccgggctgggcgtgtcagcccccgtggtgacccctcgccctccccacagctcctcctgcaagtgcctgtgctggtcaggaaccccacgggtcccagactcagggt

SEQ ID NO: 23808 - DNA, 201 bp, Bos taurus
ggcagttaatgacacttaaaaatgttgacatatatgaaacatctgaagcctgctactagagaaactgaagacactaggatattctttacctttgcataatataatttttaagtcattttaggagtgggtcaagtccttctaaaaacacggccaggcaatctgtagagatcgaaggaaatgtattactgaaaaaattaacct

SEQ ID NO: 23809 - DNA, 201 bp, Bos taurus
gttcagttcagttgctcagttgtgtcggactctgcaaccccatggactgcagtacgcctctacagatataggtatatagatataaaagggtttaataaccctgtaaaatcagactgcattttagaagatttgaaacagataaaagtgcacacttccaaatataggaacctgcctgctgatgcattaggtatgtggcactgt

SEQ ID NO: 23810 - DNA, 201 bp, Bos taurus
tgcttccttgatcacatgcaggaattcagtgctttttacctgcagcccaaaccctctaaggcaggggttcccaacccctagggccacaaactgatttatgtcctgttagatactggtttgtgtcctgttaggaaccataggaggtgagttagcaaagctttatctgtatttacagccgctccccatcgatcacattaccac

SEQ ID NO: 23811 - DNA, 201 bp, Bos taurus
aagagcttctcaggtaaggcggccagcactctgggctggagagctgggtgggttggtggggaggcattccagatagagaagaggatgcaaaaggcagaatggggaggccgttggtgcctggaacagaggctgccactgtggctggagcacggggtgcagagggaagggtttatcaggcgtccaaaggccatcacaccagct

SEQ ID NO: 23812 - DNA, 201 bp, Bos taurus
agattactagtgaactctggacagctaacacagtgcatctgctgtggctgggtttgtgctgcccgcatgaggggaggactcactctccagctgggccagggagaaactcaggcaccccggagtgggggaggatcggggaggagtgggagtccaggtccccactccagcccactcctcccaggcagggccttggggagctag

SEQ ID NO: 23813 - DNA, 201 bp, Bos taurus
gagtcgtcttcgcacgctgcacaaagaggtcttttttaattgagatattcagaatattgtatcttcttaactcttgatcaaagtttgaggttggagctgggacctgggtcatacttgacatcttccatgtcctgggacagtagagtgtatcacaaacctcgctcatgatgggttcttcaataaacactttttaaaaagaag

SEQ ID NO: 23814 - DNA, 201 bp, Bos taurus
aaaagggcaaaggagctctctggggcctctctcagtgttaatcccatgcgtgaggacttcactcatatgacctgctcacctccaagtcctaccttacaataccattccagagggaatgaggacttcaaaatgaattctcattcagaccacaaaaggtggtgtccattcacagcccacgacctgaaactaaacttatcatct

SEQ ID NO: 23815 - DNA, 201 bp, Bos taurus
agcaggagctgtctagatctcagcactaggaattaggaacacaaaaggctctttcactagagccctcactcgagtaaaaagagagacatgaaagaaagctgtccctccaacactcctgaaatggtgggcgcttgcgctgcagtctgatcctgcccagtgggttctttttctgaagttgggagaagagaagaggtctggaca

SEQ ID NO: 23816 - DNA, 201 bp, Bos taurus
gcatcccttagcccagtcagactgacataaaattcacaccaaccccaagtgagtagtaatcataatgtatgtttcccatagtagtagatgagagggaaaatcatctctagtataagaggacaacatgacaaaagggcaaatgtcttttggcctcgtgacatttggttattcaccttgaactatctttataagctgatgtca

SEQ ID NO: 23817 - DNA, 201 bp, Bos taurus
tccatcagacagacaaaaatttgagtttgatactatcaaatgtgatgagatccacaaagaaaatacagagcgtgtgacctacagggagagtggtggagagcgtcagtggacatttattaccaaagtctgattttctccgcagtgtcgtctccttctccatgcttactgctgggctgcacttgccccctaaggtttccagtt

SEQ ID NO: 23818 - DNA, 201 bp, Bos taurus
tggggagaaagatttgaagcttagggagggcagtggggatgaagtgtgggaagcaggcacagactcccgtgcagagagaaggtgccaagaatgaggccattgtggaggaaatgatgcacaggtgactggggaagaaaagggaacaggaaaggtgagaggaagaagtgtggtctggcctctgctgcttgcattacggttcca

SEQ ID NO: 23819 - DNA, 201 bp, Bos taurus
ccatggacagaggagcctggcaggctatagtccatggggtcgcaaggagtcggacacgattgagtgactgagcataccatagcacaggagggccttacattagggtggttcaccccacttcctacagagcactgctttccttgtttctaggctctccttagccactgcaagtggaactcacccctgccttctctggcccag

SEQ ID NO: 23820 - DNA, 201 bp, Bos taurus
attgctttgggtggtgtagtcatttccacaacactgattcttccagtccacgaacatggtatgtctctgcacttgggtcacctttgttttctttcatccaatatattttgctgcgttcaggtctttctgaagtgattcatgccatcggcacttcattctgattttatttttttaacttgttgcttagactaaccatacatc

SEQ ID NO: 23821 - DNA, 201 bp, Bos taurus
ttccaggactatatagttcatggggtcccaaagagtcagacatgactgagtgactttcacttgttaccttttgaagatcagtatgtcttgcccccaaaatgaaaacatatggccagaagaatttaggaaacatgatatacagagatgttcaatacacataagtagattcaccagattgattttggtaactctgaaccattc

SEQ ID NO: 23822 - DNA, 201 bp, Bos taurus
aggaggagtgctcgtggtagaatcctgtagctctgactataactgggccaagtggagtccttcctgggaagtttacaaaatctcaccccaatgcctgctcgttgcattctcttgctcacaggccactgtattgtgtccagctgggaccctgcacacccccaaaccccccactcccgcttctgccttcacagactacccctc

SEQ ID NO: 23823 - DNA, 201 bp, Bos taurus
tcctttccccccaagctgcttctccctcacacacacctggaccacctgcaggtactctgcagttccagacactcatgcttctatttcccaaatggtcccccgtctgtctgctagtcactgcttcctgtgtcgcaggcctcctgcatctctgaatctccccaaagcacatccttgaccacctggttcatcaagaatctcctc

SEQ ID NO: 23824 - DNA, 201 bp, Bos taurus
gtaccccctgcagtcagtttatgtgggaaattttatgtataaaggaagaacttggtctaaccgtgttgggaaattggtctaactttgttgaccctggcccagagaacacgtggtgtcggaaggtttaaagctgctcccaagcttgaggggcagacacctcactgcttctcagcagagctggcctaggacggcacccagatg

SEQ ID NO: 23825 - DNA, 201 bp, Bos taurus
ttaaaaccatggcagtcctttaattttgcagccatgtacacagccatgtgtctaacaaagctggaaactatcagaaattacaaagtggctttatctcaacctacacactctacgctcaacagcagaagaccaagtctgcaagtttggtgctctatcctcagagctgcccatgcgggcctggcaggagtatgagcccgggcc

SEQ ID NO: 23826 - DNA, 201 bp, Bos taurus
gtggctccacttagctggagcttggtccgccagagcctgtttacatgtggccaccagcccttcagtgtcccacctgggtaccacagcagctggactcgaggaggaagccaccagctcccttatggcctgtgctcagaggtcccagagtgttattgcttctgccatgttcggaacggtcaggcctatgtcaggcctgccagg

SEQ ID NO: 23827 - DNA, 201 bp, Bos taurus
atacaatgaaaactttccctccaagctccctgccctcatcagctgcccaaaggcaaccaataatatcaactgtccttccaatatatgtatgtagtttacacccatacaagcatatacgtacatatttttaagtctccccctctttgtacatacaaacggcatatcatgccctgtttcacaccctttttctcttcatttaac

SEQ ID NO: 23828 - DNA, 201 bp, Bos taurus
ggccattttaagagctccagacatattctgaatctcacggaaatcaccgagtgaatgaagcagcacagaactgggtttcctggaagctgtgagcaccaggcggcccgggagctgctgatgcgttgacagaagaagaatggccgcaaggaagacctggagtgtcaatcagggtagttctttgttaactgtctggagtgtggg

SEQ ID NO: 23829 - DNA, 201 bp, Bos taurus
ctgtgtaagaggcctctgagcttctcttgacccactacttagatgctcaagagctagtgtgtctcttcctcttcctaatcccatgatatggccccattcacacaacctcatctaaaccaataacctcccaaagacctcacctccaaataccatcacagcctcatctctgtcttaggccctggaggcatttgataagccatg

SEQ ID NO: 23830 - DNA, 201 bp, Bos taurus
ctggcttcccacagagcaggtgattcaagagagggcacaaaggacccagcaacaccttctatgatccagcctcacaagtcacacactgtcccttctgccatgttctattcgttagaaaagagtcagtctggtcttcactccttgcctttccgagagaggagagtcaattacctgtggacatgttttagaccaccagatcat

SEQ ID NO: 23831 - DNA, 201 bp, Bos taurus
aaaaggcactcttccagttggcatatcagatggagacaggggtgcaggtggacagggagctcaactggcttgggtgcattgctggtgaggaggctgaaactcagtcaccaggagctgggagagggtgcgactgcaggcttaggagggagtcagtgtggtccagccacacacaaggcgctcccagggctttcatccttagaa

SEQ ID NO: 23832 - DNA, 201 bp, Bos taurus
ccccgtatacttcccttatgcagtccaggtggtgaaacattgatctatatgatggaagaagacacatcggaagaaggccaggatgggggctttccctggtagtccagtggttaaggcttcaccttccagtacaggagatgcagattcaatccctagttggggacttaagatcccatatgtcttgtggccaaaaaaccaaaa

SEQ ID NO: 23833 - DNA, 201 bp, Bos taurus
catttgaaccaaaataatgaacaaatcaagagtccacataaaaaaagacccaagtatctggcatttcttgagagatggtatctggccaaccagaaccccacgactaccctggcaatgactggatggagctgagtcaaggttgaacactgtggctggggtccgggccatccagctcatcacagcatcttggacaatgaggac

SEQ ID NO: 23834 - DNA, 201 bp, Bos taurus
tccctcgtgccacaacgaagacttggtgcggccaaacagacaaacgccattgagaaggaaattaggctcgcctgagtgggacaccctttctgccttgtcaactgctattggccagatcagaaccagtcctgaggatgagacggggtggggctgagcctggctctctcattcacctcatggggatgtctcgagggccacctg

SEQ ID NO: 23835 - DNA, 201 bp, Bos taurus
accctcctgcacctcctgcattggcaggagcacatttcccctgcttcttggctcagatccttaaaagaagcatttttattggcccagcttgtctttttaattcaagccacaaaatgtttctaagcagttttctgattggttgcctaggaccaggtggccactctaacccaatcaattatactttagagtagaagatggaca

SEQ ID NO: 23836 - DNA, 201 bp, Bos taurus
tcctgtaagtggtatacaggatgtgtttttcttcatctccttttttggcttaagatatttgtgaccatccagctggatgttacttttgtaacatttgtacctattgttacttttgtacgtttggaatgtacttttgtcagacattgcagtatatggttgtactacggtttcatcaatcctttctgtgggccctgttttttt

SEQ ID NO: 23837 - DNA, 201 bp, Bos taurus
gaatgcagtgattcagagtgtgtagtattcgtggagttgctgatgtgaagtggttattaaattgcttaccttgtgttacctcagccttttgcagtgcttcgagtattaattttctaactcacgttcttgccatgtgtccctttcttctgacaactgagaagaatctcttgccagctaagaaaaatcttttcttcacacttt

SEQ ID NO: 23838 - DNA, 201 bp, Bos taurus
acaaagcctcggtgaactgtcccttctcctccctcccccaaggacattatctggaagtattcttgtctggatatcttctcagtgcctaaggactgggtttctctttgcttcctctgaggtgatgtcaccccaaataaggttgagggcaggggggcacctgcggccactggtgttttctgtggttagaaaaccattcctacc

SEQ ID NO: 23839 - DNA, 201 bp, Bos taurus
atcccgtagtcacaaaccaacaaaggtaagggccgccaccctgatcctcaaaaccgtagaagtgatcagccctcctttccatggtgcccctcgcatgtcgtggcccgtccggaggcccctcctgtctttggcccgcttccctctgagccatcaggaggacagtggggcatcgagcgcctcgccccagctgggctcgcagct

SEQ ID NO: 23840 - DNA, 201 bp, Bos taurus
aatgagattctaaagctctcactggccctgaaatacctggaggggccaggtcagcctggcatgacctcagtggttcccttggtcatggggatggtcttcagcaatggcgatggggcccctcaagcagcacccagttcccatctctgcatttgtccagcttgcagacacataaattctaagggtcaccaaacttcaccctgg

SEQ ID NO: 23841 - DNA, 201 bp, Bos taurus
gcatcactccatgcaacattaggcaagtttggggtgagataaactgaaggatgccctccgctcagcctttgggaattggagactttgtagagacagtggtctgaactcaggccctgagggacaggcaggagtcagcaagggactaaggaccgggcaaggacggagtgggacagagctcaccaggggaggggtccatgtgtg

SEQ ID NO: 23842 - DNA, 201 bp, Bos taurus
tttgttcatcatctcagagaggcagtgcaattcacacccccaaagggacgcacggggtgccctcgcggggagggtctgtctgttggggtcttttccccaacagatcagatggatacaggggcgcacagagatgccacttgattcgcaaaggacacggacgaggggcgattaagcgcgcgtgcggggtggggagcgctggga

SEQ ID NO: 23843 - DNA, 201 bp, Bos taurus
cggatgttttccagaccagaacaaggctgcaggtgtttgtgagacatggacacggtttaggttcgcaacaaaggggacactgttagaagtttaaacagcaggatctgaaataaaggagctgaagcgggacgtgtgtggaagaggattccaggggaacacgtgtgggcttgtgcacatctgaccaaggcctctggggggaca

SEQ ID NO: 23844 - DNA, 201 bp, Bos taurus
aggctctcaaggtcaagctcaaccctggcaatggcatctgttgaatggacgaagaaggctctgcttgaggccacgtggctggatggaggccccactgggatagaactcaagtctcctggagcgaatgatggagtgatggaggggaggaccagggtgggggaaggccttgtgacttcaacctcccagcaccctagggagaat

SEQ ID NO: 23845 - DNA, 201 bp, Bos taurus
agtcaaagtccaggtgataggggcttccaaagggatgtacccctgatggacagaagctacagtggggtaagtgttgactcagaaaaccaaacacccagccgatcttccctgggtgtgtcctgctaaggacacagaagtcattcactggagggtcagttaatgacctacttgtaatacagttttgtgaaattataaggatga

SEQ ID NO: 23846 - DNA, 201 bp, Bos taurus
tacaagttcttgtctctgtctccacccttagtcccttgtccttggcatctgtgcctatatagcccctgcagctgtaactgccattcctatttcccttgaagtaatacacaccccagtcttcaggcagcctggaaatagcctggaacattgcatatttttttgtgatcagtctggtttaagggaggtaactgagagctgaac

SEQ ID NO: 23847 - DNA, 201 bp, Bos taurus
taaagaaggctgaaggcaggtgtgtatactggtccttcagtatacattccacctacattccatcatgcctgggcaagcagtattatcccaaaggaggcaagtccttgacttccccatcagctcgtctaaaccattgtcttggagaaacggattcaggactattttactattctgcatcaagactgaaaacaatatgaaaat

SEQ ID NO: 23848 - DNA, 201 bp, Bos taurus
catgtacctacagggacgactctagtccctgaatgctgatccacgtctgtttcatggaaagtatgacctcattcgtctgtgggtcacagctatgtctcgacgtggtggccctgagggatggtgtgaggcactgggaccctgatctaggacagcatagtgctggccaccatggctgcgactcaagtcactctcctcctccca

SEQ ID NO: 23849 - DNA, 201 bp, Bos taurus
gggagctgactactcctaccctctcccactttcttatcctgggtgagaggggaatgggacctcacatgtgtgggcacaggcccagagccttgctgcttgccgcgtgccctgtgtgggaacccgtgtttatggctgacaagatgaagacccacgatggccaggagcctgggtgaccctctgcctgcccagggataagacatt

SEQ ID NO: 23850 - DNA, 201 bp, Bos taurus
tctaggggatcttcccgacccagggatcaaacctgggtctcccaccttgcaggcagattctattccatctgagccaccaaagaaggccagctgtacattactatcattgacaaataaaatgcagtacacatggggtgattcatcaactgcatgctctaggtacaaatttcagtttaccttaatgtggccctgcagttgaat

SEQ ID NO: 23851 - DNA, 201 bp, Bos taurus
atcagtatgtttttaagaagaccttggccctttcttgagccttttttcttggctaagcatggatttctttttaatcacatctgaaacagggtgattacctaggacacaggccccaagttgggctagagttctcacacacctcacagaaatcactctcggcaggatgcgctattttagagcaacctcaggtttacttagatg

SEQ ID NO: 23852 - DNA, 201 bp, Bos taurus
gataactctccctctctctcaaatgaaattgctcttctagtttacaaaaataattttgctttcctctgaatttttaccatccttgtatagtcttacactatggtattacctggttagatggcacctttttttctttgcttcatgtgcccacatctttgatacatgcagttgtccattcattcttagggctaagtttgtcaa

SEQ ID NO: 23853 - DNA, 201 bp, Bos taurus
gcagtagatgaaatgcatttcaatgtaactgagaaacatagtaagggtaattaaaggtgcatagacctcacacaaatccactcagtctcattttacccaacgagtaatagggtggtattatccataggggagtatttgtgatattattccacccctacatttctcacttagctttccttaggggattatccataaaaggca

SEQ ID NO: 23854 - DNA, 201 bp, Bos taurus
ttctgggaaatagacaatgaaagttgactaggagcagactaattcgactttattttaacttggggaatataaacagtgatttggaaaaaataaacctgcgatgaatgacttcctgtttcgtgcacacaagggcctgcagaaatatgccacagagcaatttctgggtcagaataaattagagtttgtaatgcatttgcctat

SEQ ID NO: 23855 - DNA, 201 bp, Bos taurus
tctaattcatcacatttacctgcttgaaatatgacactgatctcaggtttttaatcagggtcatggaatggcataagtagggatgggtttttacaaagatatttgttttctaggccctaacacaagatgtagaatgcaaatttaaaatcttgataataaaacaaaatactaacttgatctagatttgctgaaaatttgatg

SEQ ID NO: 23856 - DNA, 201 bp, Bos taurus
aagtgaaggaaggcccagtccatcgtttcagagaccttggaaccagctcccacttcccagttccatccttgataagagctttgagcatctgtatttgttttatttcaaacccaaaggccaaaagtgggatttgctgttgacaaggactcggtcgtgaacagtactcatttgtgacccctacattccccacccaaagccact

SEQ ID NO: 23857 - DNA, 201 bp, Bos taurus
tacatatataaaaattaaatgactaaaatgcaaacttctgtaggtcgagcatttttatcccctctgcaatgtcaaaacatattagctgctcagttaaaatccactgagaacgttgatttcatttttgaaataaagttgcttaaagcaataatcagaatatagtaagagggaagcttttctaaggagactgggtgcagatgg

SEQ ID NO: 23858 - DNA, 201 bp, Bos taurus
gagtatgagatgaaacttggcagcttggcttattacaactggagtgattataacctgcacactggagaggagagaagggccttcctgggttggggatcatcagagggagagcctatagcttgggagtaggacttgtacagtgttgatccaggtggtcactggtgagcccatctctaagcataaagggtcagtgttgagaac

SEQ ID NO: 23859 - DNA, 201 bp, Bos taurus
gcacccttggctgaaccaccagtcatcagcattgagggctttataataaaatgcccaagtgagaaagacactggaggggtagcaaggcgccagggcccccgagggctcgaggagagctggacccacctgtgtcctgctgcctgacctgtcgatgcgtgctgtcacctgcgctgggccacagatgcccagacaggtaaagca

SEQ ID NO: 23860 - DNA, 201 bp, Bos taurus
ctgctcctgtctgaagtgtttgcctgctgatggacacaggtcactctcccaagccccttccttccccacaggccatcaaaatcatttttccacctgcactcggatgaactccaagttcctgtcttcatgtgtctcttgctactaatgattttccctttgtgccagtgagtcatcatccctcaaagttcaagtctcttacag

SEQ ID NO: 23861 - DNA, 201 bp, Bos taurus
tattgccagttctcatcataggagctgtggctggggggagccacccaaaatgggaaattcacacaatgaaaaaattccaaatcattctagacaatacttcggatggccagttgggcctgattcaattgggcagttgggcctgattcagaaaagttacatataacttttggttacatataaaactcacaaaacaggtcttta

SEQ ID NO: 23862 - DNA, 201 bp, Bos taurus
atttctgtctgtccaagactgacctgtgaaatgtggacaaaaacaccaccgtcggcccctgcacaccatggcagctgtggaattacaggccttcgggacagaggctccatcaaccaagccggacattgcagcagccgggcagccatgataatagcgggaatgtagctcccccgcagagaccctggggccccctgcttcctt

SEQ ID NO: 23863 - DNA, 201 bp, Bos taurus
ttctgacagtctggtgaggcgcacgtcgcactgggcgtcagtgtgctgtggaaccacagcctcaggcgcatcctaggttatgggtgctgagagtcgaaccggctagcgggaagagtgtgaatgagaggtgcagtcaagagctcttcagggtgaaggagcatgccctttatgtgtgaatcagcatgccctgtccgaggagtt

SEQ ID NO: 23864 - DNA, 201 bp, Bos taurus
gcacccacacctgtggtcctgcctggccaggctgaggccatctgcttcgtgctgagttggttaagatttcaaagaccatccgtaagttcagacttgggtcaggggaggcggtaaggccaccatcatccaactagattagcctccatgtagaccaggctcatcctgtgtgaggaggacaagtggaaagctggacgtgtggct

SEQ ID NO: 23865 - DNA, 201 bp, Bos taurus
ttctctggggactcatcgtggaggtgagacctgaggcggcttgacttctgttctgtggaaggaacctcgctttcagttgtttggccctttgtctttgtgatgacagtgacgaacgccggtcccttgcccgtcctgacgtccttcgctctcatccccccagccgccacttccttgttactcccatttccaggtgtgggtggc

SEQ ID NO: 23866 - DNA, 201 bp, Bos taurus
tcttctacaactataatttagaagttttctgttcgtagagaaatgcgttcttgctcattagggaaacatgcagccatagctggttacacattttcttctcctcatgctataatgcactcctaagtaacattttaatcatgactaataagcatgactgggcccttgagagtgagtttgcccttactttgaaaaggggagact

SEQ ID NO: 23867 - DNA, 201 bp, Bos taurus
ttaagaaggccaagaaaccttttttcttacctcttgggaaacctatattcccttagaaagagaggagaataagaacaaatgcttccagggagttccctagtggcctcatggttaggattccaggctttcactgccatggcccgggttccatccctggctggggaacagatcttgcaagccacagacagacaaacccagtgc

SEQ ID NO: 23868 - DNA, 201 bp, Bos taurus
gacctggtcattggctgttaggccctacatgacctggtcactttctatgtggcttcctgtattccctttgttgtctaatgtcagaaactataactatctaattcacactaggttctctataaattatttgctgaacaaaatatttcttcttttgaaaataagagaaacatagagtttacttcgttagcttctccacatttg

SEQ ID NO: 23869 - DNA, 201 bp, Bos taurus
tgaccaagtcattggtttgaagatgccagaatgtgtagccagtatggagtcactgatgtgaaaaggaccacttgggcctttggtcggccatgcaaccagatgcctacaagactttccttgtagagaagaggcactcccctgctcaggagagagggatgttctgcagcctccccaccttttagggccctggggcatccaggt

SEQ ID NO: 23870 - DNA, 201 bp, Bos taurus
actttttttttttaattacaaataaatttgacgtactcttcacctccaagggggaaaaagaaaactaaagtattttttattttggataaagaaatgccacaaatggagattccagcccagacttgccatgaatgagctctgtcatcttgggaggcaatttaatccacccttctccaagtgttgtgccacttctaaaatcct

SEQ ID NO: 23871 - DNA, 201 bp, Bos taurus
taaaatactgcaggccaaaaggaagtagaaatgggacattctatagtctcaccttgccctttctgtgtcctagtggtaactggtagtgttgtgtatattcagtttttggtagtgtacccataaacgtgtcccagtgtgggtaaatctatgcgtgtgaatgtatgtattttagtgcagttgtttatgtacagtttttaccca

SEQ ID NO: 23872 - DNA, 201 bp, Bos taurus
ctaaatcatcagaagtcatatagaacatagagaagaatttagtggttttgatggtgtgagaaaaagcatcctcaacatatgggtacatataagcctgtgtgcatgtgacctggtatgtctctggagttggtgggcaaattgaatccagaagctattgcttgtttccttaacctaaagcttcattatttaagttctacatgg

SEQ ID NO: 23873 - DNA, 201 bp, Bos taurus
acttttaaaccgttccctcaagagaagttacgggtaggtcattcggtcgggacgaatatcagcggtaccagcctgatcctctttgcgtctcggtggtgaagttagaatcctctcctccccctctatcctcacctgtagctggacgcgcctctggatgttgcattggtaaaaatagccttcacttatctttttaaaagcccg

SEQ ID NO: 23874 - DNA, 201 bp, Bos taurus
ccacccaacagctctatagtgggactaatggcagtctcctccaagaggacttatgccatccaccacacctactaggactgttgctatcagtgcccctgtctctttggcaggtggctgatgacccacgcttctgcagaagaccctgaaacactcacaggaaggtctggctcagtctcttgaaataaggtgaataaaataggt

SEQ ID NO: 23875 - DNA, 201 bp, Bos taurus
aactcaaggaccttgataagttgagggtaaaataaagactttaaaggacgcttactcatttccctgatgactggtggcagttttgccattgtctctaggggaagttatgcaaagttctagtgtacatctcttcatgctaattgagtgggttcatattattatattaaatatatattttatttggggaggatgagaggcttg

SEQ ID NO: 23876 - DNA, 201 bp, Bos taurus
ttttaagaaagaatgtcttatctctttaactttctcaggttatctgcccttgttccttcctgcccaggagcgtcaatgatgtgagtatcctccagctatactttgtctttctctgtgacttgactgctgactgattcaaatgtctgtcacttccctctcataaaaaattctggaaggataaagaggagggtgacaggagag

SEQ ID NO: 23877 - DNA, 201 bp, Bos taurus
acattacccttctaaactaaagaaataaatgaaattgtctttgttctagagcagccttaactttaaaatcatcacgacttttgtcagcataaaatatttagattccttaaaatcatttaaattttttttttaaaaaaaggagaactaagttgtagggaaaaaatctacttccctacctctgtgtctaaacatttttgggct

SEQ ID NO: 23878 - DNA, 201 bp, Bos taurus
tccatcttttggctttgccttcagtcctgcaaatccatgtaataaatttcatttctacttgagttagcagaaatgaattctgttgtttgcaaccaaagaaacttagcacagaattatacatccatcttttaatctccaatagtcaaaacccaatgtctagcacttaaagtcttcagtaaatttttctgatatagaaaaatt

SEQ ID NO: 23879 - DNA, 201 bp, Bos taurus
tgttctctatgtctctgtctctacttctgctttgcaaataatgttaacttatttttaaactctgctggaacaggccatggttctcaatagcactgtattaatatggactgcagtcaaactcctgatctgggactcttaatgataagtatttctccatacaagaaagctctgtgatttatagaaatgcagaaatcatacagt

SEQ ID NO: 23880 - DNA, 201 bp, Bos taurus
tttagaccaagcatcagcacatgtggcttaccaacccagaaatcacttctgtggctatacagtcaggggctccctgctccagagacacatacctaccagcgtcaagggccttggctatacttcgatgaagcccctcgcagttccctgagctagtacaagcctggaaaatctgcatctcaggccaggtgcacaccatccctc

SEQ ID NO: 23881 - DNA, 201 bp, Bos taurus
tgaacatatatgcagaaatcctcaacaaaatactagccatctgtatcctataatacattaaaaagatcatacaccatgatcaagtgggattcatcccacaaatgcaaggatgtttcagcatcaaaaaatcagtgtgatatgccatatcaacaaattgaagaataaaagccatatgatcatctcaatagatgcaggaaaagg

SEQ ID NO: 23882 - DNA, 201 bp, Bos taurus
tatatttcattggtttatataatatttaattaggttacaataaatgtaactggcaggtttagaacacactgatccctgaaagtataaattcaactactgattgcagaaggcaaggtatactagagagtagtctatcagccatgagtgtttggattattttaagaaccactcagtatattctaaagaatgaaaagtgtaact

SEQ ID NO: 23883 - DNA, 201 bp, Bos taurus
aggatacaggtacttccttaactatggatctcattaactctgttatttcacaatgtccagtttgtcaacatatcaagcatagacacttgacacagtttgtcgaaggacaattggcacttgacaagaagcctgggcaaatatggaaaattgattatattggcccattaattcgagataaaggatgccaatatgcgtgtactg

SEQ ID NO: 23884 - DNA, 201 bp, Bos taurus
agctaaactagcaaatataactgaacacaaggagggggtctttggaaactttgatctatagctggttggtcagaagcacctgggcttgtgattggcatctgaagtgggttgtagtcttgaggaaatgagtctgtggggtctgatgctatctttgggtaggtagtgtcacagttgacttatattgtgggacacccagcaatg

SEQ ID NO: 23885 - DNA, 201 bp, Bos taurus
taagagacccctcaaaggaccatggaggcctgagccatggtccccacagccagctgactaaggttttgcaatcttgaaatccctgtttggcctttctccacgaagggcgctgtcagggtgttgccctaccacctgacaggtaatcgctacctgtgcatttttctttgcagcttccaaagtagaatttccatccacactctc

SEQ ID NO: 23886 - DNA, 201 bp, Bos taurus
ctggcccttaagtgttggcatctctgagctctgtagaacagaggtggggacatcatgctgcctgggctaaatctactctggggattgaaaggagaccctcggtctgagttcttgtgggatcttctatcctttggactccttgcagggcctccctgtgacaacccaactgcctggagtggtgtcaacctaggcttttgggag

SEQ ID NO: 23887 - DNA, 201 bp, Bos taurus
gccatctggccaaacatatgcattgggccttgggtaagggaatccagaagcaacagctagaaagaggaaaaggccctctttagctcccatggcgattcttccctcttaatgcctcaaaataaaactagaaagaggaatgaaatgattaagtgcttgaggccaaatgagttgattcaaataacacagaagcagaggaagcaa

SEQ ID NO: 23888 - DNA, 201 bp, Bos taurus
tccccccaccccacaggcagagaccacagcccccctacagattttttccaagttagtcctatggaccctgctcgggccctaggttggccgaggctctctgccttccacaaggaaggtttcctttttccattcgggttcaagtaggtaattatgaaaccaaagctgagaccaactcagcacagactttattcaggggccaaa

SEQ ID NO: 23889 - DNA, 201 bp, Bos taurus
agaggcggaaccccgcagcaggtctgatccaggtgcgtccagatagcccccgtgtgggccccacacggacccatgggacccctggcctgggcccgcggtgctggagcgaagccccactgggtatttgtctcctgttggggaattcaagtctgtgctgagaaccgcttagatgtttgcagaggcccagctcctatggcacat

SEQ ID NO: 23890 - DNA, 201 bp, Bos taurus
ctggctcccttggtcagaaccggggatgctcagttgcaccagggggagtggtccctctgagatgccccatttagacaggctagtacagcgctacccttggctctttaggttgtaatttaaaaagacttgaccctttcacaaggtgttccagtagtaaggtgctctcctcagcacatctcccgcccaggcagcagtggcagc

SEQ ID NO: 23891 - DNA, 201 bp, Bos taurus
tctgcatagatgtcactgtttaaaacagtggacattggcccggatttgccaaatggcccagaagcccatgtggggaacataaaatcccctgggaacctctcctgggacagtggatggcgcagagggacaaggggggagggggcaaggccagggctgagcttccccatgaggaatgttccttccggcacatggagcagcaca

SEQ ID NO: 23892 - DNA, 201 bp, Bos taurus
tgagagttaccacagtgccaggagggccctgatcccgcatatctcccagccactctgtgtaccagcagcaccacctccccctgccgactggggccaattagccctaacagaaccaaaagtcctcctcctgaccgttgctccctgggtccaaggggctcaaaatgccagggaggcagcagtggcccccccccagcccactgt

SEQ ID NO: 23893 - DNA, 201 bp, Bos taurus
ggaaatcatgtgggaattcacgtcttatcaaagaagtttttgcctgacccagggcacaaggattctctcccatgtattcttataggatttttatgtttttagcttttactcaatccaattcaagttactttgggatattggtaagacagggggttgagattaattttctccccatagaatattcagtggtacctatttgat

SEQ ID NO: 23894 - DNA, 201 bp, Bos taurus
caggacatgtggccccactgcccgggggaggagggccagggtggtgacatgggcaccacaactctcccgggaggaggtgtcaggctgggaccgtggtttcaagtcagaaggccatcttgggttatggggcatatgccctttctgcccgcatccttctctagccctcgacctccgccttgcaccctagggcgcgcactctgt

SEQ ID NO: 23895 - DNA, 201 bp, Bos taurus
cgtgttgaattcctgtacttaagagtctgcggcagttaaaaaccaaaaggttccctaggttgcgtcccgccttcatcagaaggatctgtgctaggtgtgtgcatcccgaggccttgatttctcaggaagcctgacatcctcccagccttgtgaccaaccctgagtctctcatgatgatggtggggttgtctctaggctcct

SEQ ID NO: 23896 - DNA, 201 bp, Bos taurus
tgctgactaggaagaaagaggaaggcccctgctattacttcttttgttttcactgatatcatctctctcccttaacacacgttgatattcagggtggaccagggggcccccatgggggcttttgaactttatctcctgtaatcctcacgaatggaggaggtggtctttcccacctgtcacagatggggcaagcctgtccag

SEQ ID NO: 23897 - DNA, 201 bp, Bos taurus
aagtagaatgattcaccagtgtcgggaagccttgaggacaaagagactgagccgaagggcagcagctgacctcagagcctgggcccttaaggaaagaagtggtactcacaggacagaccagccagagagaaagctgacctgcattgctcagcagataaagcactggggcagacctccgatgcctctgtttgggcagccaac

SEQ ID NO: 23898 - DNA, 201 bp, Bos taurus
tttttttaattcagtgactctcatttctggatctgctgtgcatttgtttctatattctgtgtctcctgccttttgtacatgctgccttgccatctcaagacgcctggtaattttatactgtgtgccagacactgtacatttacaattgtttgtaaatgacttaggtcctgtttgattcattttatgtttgggatcacctca

SEQ ID NO: 23899 - DNA, 201 bp, Bos taurus
aaaccactttcctaggggacctgatccagtttattgccaaatcatctatatgctaatgaccctgatcttagagttctggccagtccctctccctgatgattcagactcccatccagcatgtgcaatgagatgcaactcacacttaaaatgttccaactggacttttggcccatcactctaaattcagccagtcatctccat

SEQ ID NO: 23900 - DNA, 201 bp, Bos taurus
ggaagatgctggtctcacagggtggatttactgaatgactagactgatttatccttggcatatttggatgtatgcaaatatgcatacatgcttggggccacccaaactgggttgaattcctcactggaccattctcacaatgtgtagcctcagacatagcaaaccaatgcaagttcttgtacagtttgcccattgttttgt

SEQ ID NO: 23901 - DNA, 201 bp, Bos taurus
ctggggttgggtggagtccctcaaagatccatgttctcacagaatcacaggatgtgaccttatttggatacaggctggggtaaggtggcccttagtgcaacgcgactggagtatgagacaagaagaggaaagcagaggtgcgcaggagaactaacaccacgtgagacagagtcaggggtgagagtgatgcggagtgagccg

SEQ ID NO: 23902 - DNA, 201 bp, Bos taurus
gcaagctcccttgcttgttaaccccaccacttacttatccggagcagtggcctccattttccctcgatcagggtcctcctgagtggagccagcctccaacttcccgtgagagtacctgggaacaccagccaacaagatctgcccactcctgagatggaccaaacattctacaagatggtggagcagaaggacgtgtgctca

SEQ ID NO: 23903 - DNA, 201 bp, Bos taurus
cttccttcatggccacgttcccaccagcaaggaggggagagggctggagagacactccctgctctcctccatctcagcatcgactgagatgtgctgctgcagtgtgaggtccattggccagaacatggtcacctggtcacatcaagttcaaggagggctgggaaatgtcattgtcacttagggaagccattgcccttgctc

SEQ ID NO: 23904 - DNA, 201 bp, Bos taurus
ctatgctgtcttttacttgaaacgtctggctcacttggtctaaaccgtggcctccgatgccagaaggctgggctgtgtcatgtgctgggtggggtgctggatgagtagatgcaccagtgagttggccctatgaagaaggcccaggcaggtggttttggaaaggcctgcacccttcactgggaaagcctgtggcttttgcat

SEQ ID NO: 23905 - DNA, 201 bp, Bos taurus
gccctgcttttataaccagtccttctccacaaggaagactggccccgggtgggagggactcagcagtatctagggacatgtcagttgtcacaggggatgtcgtgtgtccaagccagggaggccgccaagcatcggatgctccaatggcccccacagcaagagacttcagtcccaaacattgatggtggtgggtgcaacaca

SEQ ID NO: 23906 - DNA, 201 bp, Bos taurus
caggagccttgaggcatcgcagctaaactgatggccctcaccatctgaatcactggggggactcttggggtcggtggttgtctccaggccccgggttatcaaagtgagtttccaggtgtggaagggagggtgtttcatgctcaggtgtggtcagtcaggagagatggttaccagctgggtctcgcaccaggctggccctgc

SEQ ID NO: 23907 - DNA, 201 bp, Bos taurus
attctaagcaaaacgttaagactggaacaagcaaagcagaacaaacacttcccttcccaattaacagctctcagggaaacagctcaattatcttttcaggcccaagtgtgatgtccattaatgctaatgggatccaggcaggaggctgaggccctctggcttctgggagccggaaatgcctggtttctggtttgtgggggg

SEQ ID NO: 23908 - DNA, 201 bp, Bos taurus
ttcgctgaatcaagcctggaaaaactcttatcatggtcatatgtgagggtgagttaattccatgtctgaatttaaaactcctaattggggggtaaaaagtgacataagtttaatttttctcttcagtatgtagatgtgaaacaaatcctctttcatatagaaagaacagttttactttgaagacacgatggatttcatcaa

SEQ ID NO: 23909 - DNA, 201 bp, Bos taurus
gaggaagcaaaatccagtcttctcagcctcagctgtccagatgtccttgaaagggactctgcagccgggggcccccgagtcccagcagtgggaccatttgttcactgcagttctcggcgccctggtggccccatctcttaacaatcagttctctcaggatggacaacgttttcaaggtatcctagcagagtggtccggatt

SEQ ID NO: 23910 - DNA, 201 bp, Bos taurus
atgggactccctagtggtctggcagttaagactcagtgctccactgcagagggcccgggtttgacccgggtcaggggactaggtcccgcgtgctgcaactgagacccggctcaaacaaataaatgaacaaaacaaaactacagcgaggtatccctgcacactggtcagagtgcccattattaaaaagtacaaataaaaaat

SEQ ID NO: 23911 - DNA, 201 bp, Bos taurus
tcgaaaggaagacagagccagtgatggagagaaatcaagtcctggtgacaggatttgatctcctggagccagaaccagaccatttcagttacataaaaatcgtttttcgtaagtctattctgtcagagttggtgtcactcatgacagagccctgcgcagttttctgtctctttcttttgtgaaggatacagtcacatagga

SEQ ID NO: 23912 - DNA, 201 bp, Bos taurus
ggtggtcaacccgcggcacaacctgggcctgcagttgtcggtggagactctggacggtaagtccccagccagcaccccagctcatgctgatgcagcccgccactgtagactctggggggagctcaactcatgtctattaggaccaggtttcctctgctcccttccccatcagcacttcctatcgagcattctaatccaaat

SEQ ID NO: 23913 - DNA, 201 bp, Bos taurus
aggctgaggacagtgggaagcctggggcctcggggagcttccttccagcccaatggacctgtgaaaggatctgcttttgttttagttttcagggctgcataatgaagggccacagatggcagcttgaaacagcaccacctatttgctctcatttctgtaggactggagttcacagtataaccagggccccttctcaaggtc

SEQ ID NO: 23914 - DNA, 201 bp, Bos taurus
ttgtcttacccagctccgttctccctaatttattctctggtcttgggtgaagctcttgctgagatttaataaaactcatattgctctgaacccttgtgtcagctgcgctggtccctctaagccaggagggggcagcgttttcctgtggagcaaagggctccgaaagcaggggattggggtgggggcagggggcagactatc

SEQ ID NO: 23915 - DNA, 201 bp, Bos taurus
gcttcacctgggagtgtccacaggccatacagccagtttcattcggttctctcccaaagacccccaccccctggagaccacaagctcagtcaccaccagtggggcagcacgatttcttcacctctgaatagtgatccttccacactgagttctgatgcggtactgagcactctgtagtcacttcaaagacatgaccttctc

SEQ ID NO: 23916 - DNA, 201 bp, Bos taurus
aaatgattatgaaaaatgattataacgattgcttcttatttctttctggcttttccaatcaatccagctaaaagtcggttgcaaggtgacatgtgcatgtggggtgtttgacgtgataaatacacaggtgtagagccaagcttgagagcttcggctgttcaaacaccactgttctttcaagaaatactctcttgggtcagg

SEQ ID NO: 23917 - DNA, 201 bp, Bos taurus
ggtctcctgcctggagcggtggcacaggctcagagttctcgggcaggcagagggccctgtggaggcacactggcatttccacgggagagccattttaatacggaattgaaccgctgagtcgaaagttatagagactgcttgctttcttattggtatcattctgttttcttgacttgaaatcagagaacattcaaccaaaaa

SEQ ID NO: 23918 - DNA, 201 bp, Bos taurus
ttccacgtgagcacgtgatgcctgggagcaaatgtgaagggtgagtgctttgctgtctgaacttgagatgttgtcacaggcgagcatctgcagaacgttagctctcaacctggtgcttccatgcgcatccactttcattagctttcttcctcttcgtgttcagtggtgtgttttactggggaacacgtcacaagtggacgt

SEQ ID NO: 23919 - DNA, 201 bp, Bos taurus
aaagtagcctgccttaaatatgactttctgtatgttttcttctaaagtaaagttttgttcaaagcgctccttttgcagtagtatagatgcttctagtgacaggccactgaagggcttaggtggtgacatgtctatagtgttggctgcccagagttggattagtggggccaggacagaaggattgagagcctggcgattctg

SEQ ID NO: 23920 - DNA, 201 bp, Bos taurus
tagggtgaccaagtgccctggtttgcccaggaaatgatattttagaactaaaactgagaaagtcctgggcaaaccagaacaaataagtcaccccacacccaggcactttcacctggtctgaagtcatgggtagattagaccttgtttcaaaactggatggagagtcattcagataaggtgctgggaagggagtgtcaattt

SEQ ID NO: 23921 - DNA, 201 bp, Bos taurus
cctcattcatgtgtctttctgtggttgttttctgccttacttttgccttactggaattcaagtttctacaagagcaggcaccatgaattgataatttctccctcgacactttctgggaagtgatggatccgacaccagagggtgagtgtaaagtgttcatggagacagccaaggttgcttagcagagagccagcacacagc

SEQ ID NO: 23922 - DNA, 201 bp, Bos taurus
atgaactattataaagctacatcatgaatgaaccttgaaaacatgctaaatggaagaagccagacacttagagttaagtattgtgtgattctgcttttatgaaatgtccagaataggcaaatctataaagacagaaagcggatgaatagttgttaagacgtggagggggggagtggagagttattaggagtgactactgtg

SEQ ID NO: 23923 - DNA, 201 bp, Bos taurus
acaactgactgactaacactttcacgttcgagtaaccacagctttctgagcctcagaacctgtcctctctctacagaatgggcccaataatagtaactacctcatagactgtgtgaatattagagaggatgcagactgcacgatcaatatagtaccttgtgcacagttaatgcctacgattatgctttctcagggcctccc

SEQ ID NO: 23924 - DNA, 201 bp, Bos taurus
actttctcctaggctggagagctttatcttgaagtgctagcagatttaacacaatagatttttcctccccagtgttaacaaaaacctttataccctttccgataacttccttgggcaacctcacctgtctaatgtctaacatcttaaaggaaacttccttcttttctcagtcatgtcatatctacgtcagcatttaaatat

SEQ ID NO: 23925 - DNA, 201 bp, Bos taurus
tcagccttctagggtgagatttttgttatctattcctttgtaaccaactgctccaaagtttagtagcttgaaacaacaatgtatcatttcccatgattctatggggttgactggggttggttgggtgatttctctgctcagcgtggtgaaacccagccccctcttgaggatgcattctgctgagagcttccctggggctag

SEQ ID NO: 23926 - DNA, 201 bp, Bos taurus
atgctgagcgatccagtctatttccctcattttgaaggtgagaaaacgaaggcccaatgaggtttagtaaactgcctaaaactctacggtgactccgggtagagtcaaggctcctgtctcctggcccaggacctttcctggagcctcccactgacactcagactgccactaggaaagtctacatggatacccccaactgat

SEQ ID NO: 23927 - DNA, 201 bp, Bos taurus
atcctgcaagaaacagaaaacccacctgaaccttacagttctcttgggtggttctagaattcatgtctgttacctgctgagtacttccccaccatgtgacctcccttggccttcaatcctgggaaagtgggggagactgatgaaagccagtcccagagcttcacagctgtgtcccgtgggtagcctttaggaagagatgcc

SEQ ID NO: 23928 - DNA, 201 bp, Bos taurus
ggggccctttcagtttcttctagaagtggagaaagcgtagagaggagcagcagtccatcctaagcaaaaagacaagaagccagggcaagtgcagtgtggtgaggaaaggccctccgttggcgaggtttcccagtgcactggtcatctggggccagctccccacgtggatgggaggaccttttacagaaccattggcctctg

SEQ ID NO: 23929 - DNA, 201 bp, Bos taurus
actgtggcccatgtcccagctccttccagaagcctctgctacctccagccctgggtgccctctgctgagccagcgtcttgggagtttaattaattctcttgcactgtcccctgtaggtggaggccggccagaccatttccctgattccaccccagcttctgattagctggaaggcccatttggatagtgtggcagacatcc

SEQ ID NO: 23930 - DNA, 201 bp, Bos taurus
gctccgcaccatgtgactatgcacactggccattaatgtcctatttggagagggactctgggctggcagccacatttgggacccccagagggtctgaggagtctgaggcccagggaggggctgggacccgccaagctctccccgtgagtcaggtggctgctcctgttttggcatctaaggctgacggccactccacctccc

SEQ ID NO: 23931 - DNA, 201 bp, Bos taurus
tggcccctctcacaccctcacagatgtctggaagccccagcccagaagccttacccagtggcattcttggtctcagccctgtccaaagtaaactctgagcaacctgggcccctcatctgcggctcagcctaagggagcaggggttgatcattcacttcctatatgtggggtccaaagagcacgctgaaggcctgtgggtgg

SEQ ID NO: 23932 - DNA, 201 bp, Bos taurus
aaataaagcctaatgactgtatgtccgttgaaacttagactctggccatgtacggtctgctcagagcaactgctccccaagccccatcccaaagctccttttctgccagacagtgaggaaaacggccaatctcttcatgttgaaaacaatcagacagcattctacagagaggtttccctgccacaggacagctttatacat

SEQ ID NO: 23933 - DNA, 201 bp, Bos taurus
ctacagacatcacttcctcctccttgaaatcagtccttcccttggccacgctcccttgcctgttctcccaccctgctaagcattctacctctgcccctttacaggcataatgttttcatattggccaatcagcgtatttcttcacccccgccactgtgattggctcagagctcggcatgtgactccagctggaccaatggg

SEQ ID NO: 23934 - DNA, 201 bp, Bos taurus
gcctgcaccagcagctacttcacccaagggctttctacttgatgaaggctgcctcacaaggtcaactcacgtcagggaacccttgagcccctggggttatatccggggccttcaaccagctctcctcagctctgccgagcggaccttaggtcaggctgtgctggggctaaagacaaggcatagggtgaagggttggccaaa

SEQ ID NO: 23935 - DNA, 201 bp, Bos taurus
taccagctggcctcaaggtgatctgagtgaaatgtccttccctggggacccaaatgctgggccctttccttgtgagatcttggccagtcacctcccttccataaacctctttcctcagcagaaaatggggctttctgaacctcctcacagagttgtcctgagcaccagttgggaaagttgacctgcagtgccaagcccagg

SEQ ID NO: 23936 - DNA, 201 bp, Bos taurus
tctcccccacttaggagggagccagtgttgcaggaagagcaagaccacacctctggttccagaagagggagcaaagccattccctttggctcttatccaaggctgcaggccaagtcagcacttgtccccgtggtcctgcaaacactatccatccatctgagcctctgcagacgtggccaccgatgggagcagctgggctga

SEQ ID NO: 23937 - DNA, 201 bp, Bos taurus
ccagactcttcctccccctccccacaggccatcttcaccaggtcccatcagtgacctcctggcaaccctcacctgctccctctctttccatcctcacacctactggccgggctcatagtccactttctgaacctcctccggctttccctgactcagacctcactgccttcactccattctccccctgcagcagggagattt

SEQ ID NO: 23938 - DNA, 201 bp, Bos taurus
ataactctatgtattcattgtctctccagatttcgatatggcagtttgtcctatgacctccgcctgccaatacaggagacatgggtttgatccctggtccgggaagagtctacatgccacagaacacctagtcccatgcaccacgactattgggcctgtgctctagagcccaagagcccaagtaccgagcctgtgcaccac

SEQ ID NO: 23939 - DNA, 201 bp, Bos taurus
tgattccctggaccagacatcagtcatctctggctggcagtgaaaattctggtttctggtttaggaggtaatcgcgtgaattatggaggcccagggacaaccccctcaaaaccaaggggtcctctggcttccaactagcgatgccaccacaaaatgactcattgcaaaaggccttccctccactgagctgagcttccccct

SEQ ID NO: 23940 - DNA, 201 bp, Bos taurus
gtatataatttaagaagtccaaaataggtcagtcccaaacagccactactcccttttctcttgggagatggtcttccccggaggcaaccataaggttcatgtacgagctgcctaacacagacatgcatgcatggtaagtcacttcagtcatgtctgactctgcgaccctatggactgccaaagtcctctgtccatgggatc

SEQ ID NO: 23941 - DNA, 201 bp, Bos taurus
ccaaagtctaaactgtttgctgctgcatcacattgcctccctacctgccctccccataccatcttgtaataaaacctctctgcacagccctcacggtccattgatggcctcactatcaatcctacaccttcctccaccttggtggacttcaaatctttccataagggggtagattcagagggcaatacagtaacacacctc

SEQ ID NO: 23942 - DNA, 201 bp, Bos taurus
gtcacacgagtgtcagagtacaactcaggtcacagaaattcctctctcctcaccacgaagccttttcatactgttcacagggttctcaaagggagaatacgagagcaggttggccttctcttctccagtggaccatgttttgtcacagtgttattgagttacgcaagtccctttgccacggcaaggctgtgatccatgtga

SEQ ID NO: 23943 - DNA, 201 bp, Bos taurus
ataggccacggcagagagggtggattttatcctccggcagaagggagtctttgagggatttgccctgctttcccagccagagcatgtcctggaatttcttctcccaggccctgcgagagactgacctgtgcttcttccccagcaggcccatggatgtagacctcctaggatctgggctgtctggccctgggtctagggctg

SEQ ID NO: 23944 - DNA, 201 bp, Bos taurus
agatagggcagacacaaggaaagaaggcatttattctttaactacaaactccctaactatgtagaactgtcatcctaaatgcagaggggccgattaaatggttatgttttatcacttgtacgtctagccaatttaaaatccactagaaaattttttttctttttttttttagtcagaggcttttactgcctgcttgcatgg

SEQ ID NO: 23945 - DNA, 201 bp, Bos taurus
catctctcagcagtgagggggttgcacaggggatgagtaatgctggccactggggagggaatgggtgtttatcaggggccagtacagttgtagggagctcaggatttgacattcacatctcttctgagagggaaggagctggctgacacctccctggcctacaggggaggcctccttaacttcgccttttggtttttctac

SEQ ID NO: 23946 - DNA, 201 bp, Bos taurus
ctcttatcatcaacctttatttagcactgttttaacagatttttgtagtaatatacaaaggggagatgggggaagaggtaacttggcaataggccagggcgaacagagtcaggcacccagtaagatgtgcccagatcagatcagatcagatcagtcgctcagtcgtgtccgactctttgcaaccccataaattgcagcacg

SEQ ID NO: 23947 - DNA, 201 bp, Bos taurus
atgaatataagtaatggttaggttgtccttcactgctgatatgtttctgtctctaagggttattgcaatcagggatgaacattgctcctcaagccacttatgtccccactgtggtggagtagagtgggattcctggcccatcgcagccctcttttagttgggtgagttgtgtttcctctctgagcctcagattcttcatct

SEQ ID NO: 23948 - DNA, 201 bp, Bos taurus
tatgctttgcaacacataaacacacaattgagttacaaaggtgcacatatttcttctcttctgtccatatccatacttaccttcccttataccttgaggttatcttacttcctcctcctgccatgtacccacacacttgtcctcccatacccttgtcccactgttttctgcctagatacccagaattgagtgtgctgtgca

SEQ ID NO: 23949 - DNA, 201 bp, Bos taurus
ctccaaggccctgctggccaatcactccaatgtttacagaaattaatcaaaaacttaagggagttttccagcggtagttcaatacctatggctcgtactttaaagtcaaatgtcattttaggccgtttggatttaaataaactgcgataaacctgaccaaaaagggacttgaggaaatttgctgaggtacaagtaagacag

SEQ ID NO: 23950 - DNA, 201 bp, Bos taurus
ggaagaggctgtaaaagtacatagtaagcaacataaaatgccccagaagaatttaaacttcatttttcaggcgttagggaatcattgaaaagtattgacacggtcacatctgttcacaattctagtagctatgaggaattgggctggagaagtgagagtaaaaatagacagttgttagaggcctttaggtgtagcccaggt

SEQ ID NO: 23951 - DNA, 201 bp, Bos taurus
ctctgcactctctgagggaagcccccagacgtcacaggctggctgagaaagcctcgtttgacctcaaggctttccatgtgggctgaggagaagggatttctctgaggccctgggattcagctgacatcgtacctgcagacccagcgcccctttgccccatctgagcagggcaagtcgggagaggagcctggccaagtcggc

SEQ ID NO: 23952 - DNA, 201 bp, Bos taurus
ctatctctgccttggttttgggcagcctggctaagggtactggaaaaatgtgtaatgatttgttggttacagttagagaaaagattggccccattgccacaccggattacatccagaatgcacctggattgcctaaaactcgctcaggtatgttcagaggcctctagggattgggattggatgggccaaggcccactaggg

SEQ ID NO: 23953 - DNA, 201 bp, Bos taurus
tggaacccatgtcttcttgcgtctcctgctttagcaggtggattctttaccatggcaccacctgggaagccctcctgtggagcaggtactgttattactcatgttttatagatgaggaacagaggaccagagggacaggataactgaggatttgcactcacgcagtctgactccagaactcctcaacattgtgctgtattg

SEQ ID NO: 23954 - DNA, 201 bp, Bos taurus
taacaaagcccctttccttagtatgtgtaaggcctttcttttgctactgaacatttctatttaatttctcaaaggcacttccaactccatgatgcccagacgctcatcactttactcaagcctggccctagttcagctctcccaccaggaggcccgtgtgaccttccgccttcacagccaggcctctcatcacccacatca

SEQ ID NO: 23955 - DNA, 201 bp, Bos taurus
tcaagatctttgtggatgccgatttttatcttaggatatcaatcctgaactaataaacacattattcctaaaggtaaaataaaaagaacctgagtgttttgtgttatatttctattgcagagcactgttataatagatgtttaactgtgttaagcactgaaacatatttccctatttgtgttggttggtaagatgcttaaa

SEQ ID NO: 23956 - DNA, 201 bp, Bos taurus
ggactcttcgcctgcaaaagaaaacagccacagtgtggacagtgactgcccggggagagtgggacttggggtgaaaagtgggggcactgctgttattttttgcaaggttcatgatacccagagattctccaaatcataatcgaaatagtcagcttcacacggaatttcttttactactaccagtttgtcttacaaggcact

SEQ ID NO: 23957 - DNA, 201 bp, Bos taurus
ctgctggcatcttgttttaaaaactagggctgctgctcagtgtcctacaatgtacaggacagaccccaacaacagaattatctggccccaaatatcaatacttctggagtggagaaaatcttctatagcaaattctgaccagcgatcgttcatcctcaccctgagtgcttcaagttgttttcatcaaatacataggtgtct

SEQ ID NO: 23958 - DNA, 201 bp, Bos taurus
ttgtcaggaagggctctccaaggagacgtctctggtaagaaagccaggggctaacaggggagctgctatttggtggctctcctgtgtcactgatgctttatacacgtggccttactctttgggggagcctcagagacaggtgacatcaggaaccttagccaatgaaagtcccagccagggtgaggagccggccaatgggag

SEQ ID NO: 23959 - DNA, 201 bp, Bos taurus
cacactggagtctgggaactcaacctctcatgaccctctgaactccagcagccacagacctcaggaagggccctggaggggaggccctggaggggctgctcacctgtttcctcacatactctaccaacaattcaagttgtcgagggtcttcgcatttctggttgaagaaggttctccagagggcggccgccagcccacggt

SEQ ID NO: 23960 - DNA, 201 bp, Bos taurus
caagtcattaaaatatgccaagtactgtgctaagtctttaccagatcatactgtttaaatcacacactgtgtggtgaacagagaaagaaatgcaaggtaaggagactttctcagggtctcaaggccacactacggttgagcaggaattagcacccaggtctgtctggctccaaagcccatgtgatgggaggtaactgcttg

SEQ ID NO: 23961 - DNA, 201 bp, Bos taurus
gagattgaggccagcggtagagacttgggagatatcaacagttagaaaaagtgggctcctctaggcaggatgttgaacggcagaggaagtgaccttagagcatgacctttatcctcaggtcagggccatgtcttagtcatgtttgcactgagcacaaggtctgcacacagtgggtcatcaggagagctgggtttactgctg

SEQ ID NO: 23962 - DNA, 201 bp, Bos taurus
tgctgggaggaggctgggaatacagtgaagtcactccctgtagactcgggaaggcttggtctgatctttctgccactcataacctccttggtggttttgctgaggccaagcattgactgggcagtctggtgggcaggggctgtagccagagtggagagccctggctgctggcattgggtgtcccacatgactgactcacag

SEQ ID NO: 23963 - DNA, 201 bp, Bos taurus
gttacatttcaccttgctcagcactatccagcttgctgttggctgttgaaatcagctggtttccagggatcgtgtttgttttgtttccacagggtctgtaccacctctccatggacatcatcatgatgaaccgagtgtgtaaaatgttccgtcaaggcctcaggggatttcgggaatatcagatcattgagactgctcaca

SEQ ID NO: 23964 - DNA, 201 bp, Bos taurus
gaggccactgctctatccacacaggttgatcagttttccaattaagaggtataggtgtgggtggaggaagattaatacgagcagtggcccctagtgaaaacggggggatttgaaatcttgagcagtcaaaggataaattcttccttgttgatttttgcccaggcccaatcttcgtatataaccttgattgaacataatttg

SEQ ID NO: 23965 - DNA, 201 bp, Bos taurus
taaaaaagaaatgagaattaaattctaaatggactccatacaaacaaacttgtgaccttgagtaagtcagcatattttttgaagggtatactcctctgtacttctatacaagagggatgctaagctttgcctagaggaatgctgtcagaacccgtagaccatgtagcagatgtacagcagacattcagtcaacctcctctt

SEQ ID NO: 23966 - DNA, 201 bp, Bos taurus
agatcagagccctgaaggaaacatagttgctgagaaagaggatgggggaggcacctcagggaaagtggggtggaggatgggaaggaggcaggccagggcatattgggaactgcaaggggcaagatcctgaggtgtaaggcgtttggtgtatggagggaactgggacaggttccggtctgaaagggtctgcaaggtcagggc

SEQ ID NO: 23967 - DNA, 201 bp, Bos taurus
gttaaaaggctgaggagggaggagccttgagattctggcatcagcttgtcctggaacttttggttttaaaaatgtaaatctcttattgcctttgcggaggagaactttggccggggagggtgcggatgagcaactgagttgggagtgtctagggaaacaccttccttccattgacagatgactaggaagcgcaggcccaga

SEQ ID NO: 23968 - DNA, 201 bp, Bos taurus
ctccagacttcgaactagaggttgtaggccaagtcatcacgctgagaggaggttaagtgatttcttagggctaagaggggaaggaacagaggatactgctgggcccctggatgtgcctctgtaccccagccctcccttccccttcgtgccgccttgcgtttggggtgcttgcttaggccgagctgagatggggctctaggt

SEQ ID NO: 23969 - DNA, 201 bp, Bos taurus
tcttggcctgagagagtcttcagggagctttggggagctcggcatctgcccgtggtagtggtctgtaccccagggatgggacaggacccccgtgctcctcagagacctctgactaggtggccctgtcaagtacagccaggcggggaagcaggacccacatctctgagctctgctgcagggttcttagggctcccggctcac

SEQ ID NO: 23970 - DNA, 201 bp, Bos taurus
atggctctgtggacaagttagggcccttaccctctgggcaagtttcttcacagctggccagctgtgctttctgtggaaaccattcctcccatgaacaggcgtctcttaggtgtgctggtgggggctcaactaagtcctcagtttcttcagtgtccacattcccttggactaagagtcgttcagtagctaagtcgtatccaa

SEQ ID NO: 23971 - DNA, 201 bp, Bos taurus
acgctttgcctgcaagggagattttatgactattacctcctttttatagaggtgctgagagggtaaggaacttgcccaaagtcacacagcaaatccttattggagactaactgagctgcgtgctggtttttaaagccgtgttgagagtggggaggggtaccatagagttgcagatttcattctttttctttttttagccaa

SEQ ID NO: 23972 - DNA, 201 bp, Bos taurus
gaaataggaaatcaaacacagtgtaactggctagggccgccagctgccagtggcaaggagctctgtggcccagtgtcagctattccaggagtctcacagcatgctaagctgagtaacacctccagcttgtacacaccatgtctgtgtaaacaaacacacaaaagagaacagaagacatgcttcagtgggctttggaaaaca

SEQ ID NO: 23973 - DNA, 201 bp, Bos taurus
agcctcactggtgggagcgtgcgcctccgcagcccccacttctgtgttgttggggcaagccagccatgaggcagagctgtgtgcattgggaatcgcacaatcatcttccctcaagctgtgcctcaggccaggatgagagactagagcttggggaagacagtgaccttgttgtctgtgtccttcttagctacccattccctt

SEQ ID NO: 23974 - DNA, 201 bp, Bos taurus
ggcttttcagtctcaggaagggtgaggccctcccctagctgggtggctctcttgcagccatcgtgcccatctcacacctgacccacctgcacagagagggcggccttcccgaccaccttgcctaggtgcttgctccgacttttccttctcaggacactctttccagcatttgtcaatggcctattgactgaccatctccct

SEQ ID NO: 23975 - DNA, 201 bp, Bos taurus
ccaaatagtcggaattctcattgatcaggtgctgcagggagtcgtagccacaagcctggcagatgtctgtcatggtgccgatggccgcctgactgatgagtagggtttggtccccagccttctccagtactggatatagggctgacatcaagagcaaacggaagtccttccctagtgcgtgtgcgaagtggcctatccctt

SEQ ID NO: 23976 - DNA, 201 bp, Bos taurus
catttctaaccgtcttatcccccagctcatctgcagcatgtcagctctggcttacccctctaaccaaaaaaggcaaagaatgtgtcagccttgcttccctcggccagttgtctccatgtgctgtgctgggctgtgttcccacagtgtcagctggatccataggaagcagggggatgttggacatattttctacttctggtt

SEQ ID NO: 23977 - DNA, 201 bp, Bos taurus
ggagatgagctggttcaatcactccctgtgactaaagaggaaactgaggcccagaggaggggaaggcagtagctggccagacctgggccttgaacctaggactctaagcccttcccgtctcctcgtcctaattggatcctttttgatcaggttccaaatggcctctcggacgcagccaggtcagggctggagtggtggatg

SEQ ID NO: 23978 - DNA, 201 bp, Bos taurus
gggcctgtgagcctcccccaacccttcttcctgaatggaacttcctgaaagttccatatctattgatggattggggcttacaaaattggccccagtttccattcctgtgtgacacagtgcagggaataaacctgtgttgtttcagtagatgtttgtccctgagtcaaatggaccctgcctgggatcttagtgaacaaaaca

SEQ ID NO: 23979 - DNA, 201 bp, Bos taurus
tgaaggagcagtgagcaggccataccctggatttaagggctgcacacggcaggtgctcagtcagtgatgggagagaaggaaaggaaggcagccagttaccatagtccaggcccttctgggtgatcctggccacaatgccagggttggtagtcgtcacagccgtgcccagggcggccagcaccaccagggttgcccacctcc

SEQ ID NO: 23980 - DNA, 201 bp, Bos taurus
gatgggagagaaggaaaggaaggcagccagttaccgtagtccaggcccttctgggtgatcctggccacaatgccagggttggtagtcgtcacagccgtgctcagggcggccagcaccaccagggttgcccacctccgcgcggtgtcagggcctctggccatgtcttcgtcctgcagagctgccaaaacctcgaggtcttgg

SEQ ID NO: 23981 - DNA, 201 bp, Bos taurus
ccccactgccaatcagtgggcaagagtttcaggggtgtgtaggtggagggaccgggctgcatgcagaagcggcacagtcagctccgccagtcatcctggagttggccattcagtggtctgatcagcatcatcttgactctttttaagtaaaattagtctatagttacagagttggtttgttcccatttcttggaggctgat

SEQ ID NO: 23982 - DNA, 201 bp, Bos taurus
ctctgaagggggcccctgaagtccagattcagaaatttgggggacaaatctgggttctctttaacccttttctttctgaacctatgagaaattctccctgtgagacatctgggccagaagttggggctggtgggggccccttgtgccacagtgctagtaagggggtccgctgtttgtcccagtcctccactgtggccccca

SEQ ID NO: 23983 - DNA, 201 bp, Bos taurus
ctggggacgttcacataagagaggagagggactttcttctctcaaaccacagcccttctttgtgggactttgaaatcctactggccgtaaagcaactgcaatgactgtgcttggcacagggcagggcatggaagtgcccagcggtggcagaaacaatgtcccacagaagcaatggtaccttcaggaagtggtgttggtggc

SEQ ID NO: 23984 - DNA, 201 bp, Bos taurus
gccctgtggtctacgaggatgcaagtggatcccatctccatctcagggtcaacccatgctaattaggtgggctgaggggctggatattccggaggcccctactaacccttgggtcctgagcaacctggggcagagagcaggaagcccacagtggaggcacagtggggccaggcagtcctctgtccccaagtcacatgccct

SEQ ID NO: 23985 - DNA, 201 bp, Bos taurus
agtggctgaaggcttcatggctgcaatagcatttgtttactggtatggcaggtgacattctctgtccacgttattatctcatttaattttcaccactaccttgtgaagcttccctggtggctcagatggtaaagaatctgcctgcaatgcagatttggaagactgagcaactaacactttctcactttctttcactttact

SEQ ID NO: 23986 - DNA, 201 bp, Bos taurus
ggatttcccaggcaagaatactggagtgagttgccatttccttctgagtggagctcaaggaattgctaaacatcttccaatgagtaggacaggccctgtgcgtaagagcattactcagcccccaatgcatggaagttgagaaactttactacagaggaaaggcttggctatctaagcgatcacctacctggtcctgtccca

SEQ ID NO: 23987 - DNA, 201 bp, Bos taurus
aaagggggcaggatgggaaaatgaggtctatggactggttggggttcttctacctatcacaagctatggactgcacctggtacactgctttatcaatgacatgtgctaatttcaaggcccatgatgatacaaatatggatagttcagagcaaagccagctctgttacataaagaaagggatatcattttgtacattttctg

SEQ ID NO: 23988 - DNA, 201 bp, Bos taurus
ggaaaggggaattcagggaagaggcagatggtaccaagttctaaattgggaactgagcttagcagtttcaaggcagaggaagatcaagaggccagtgtaacttgcagacatttaacaagaaggaaggtggcatgaagtgagaagcagagaccaggtcagggagcaccttgtaagccatacgggagatcaggagattggatg

SEQ ID NO: 23989 - DNA, 201 bp, Bos taurus
gtgggatgcattgatggccagaaaggatctggctgcaacccaaacccactcctctgactttgagaacagagactacacactagccttccaatggcccatctgacaatgatgagaccatggctgacgggaattgtctcaactgtgtcaggaatgagcacacacttgctaatggcctatttccttccccactgacatccctac

SEQ ID NO: 23990 - DNA, 201 bp, Bos taurus
ggtcctagggggccactaagaccacgaggttgacacttatgcagttctccaggtggcttgggtaaaccatagcccactggacttgacaagtcattgctgcgcatctgtggcctccctttaagtcaagcagtgtctttttccatattgaggccaggacacattgacaaaggggcagctctaccactgaccacaggctctgtg

SEQ ID NO: 23991 - DNA, 201 bp, Bos taurus
gaataatcagtgctcttaggataaaaaccaaaagccttgacatgggccaataggcctcatgtgatgcagttcctgatatttctccagcctcagctcacaaactctcatcagtaactctgctctggccgccctggattactttccaggctttcctaccacagttcctttgcatatgctcttccctatacctagaatcaacta

SEQ ID NO: 23992 - DNA, 201 bp, Bos taurus
cctggttgccaaagcattccaacgatgcggtccaaaaattagtcaagcccccaaggtgctcggagccagacttcaccgtggcctcctgcggcttgcattcaagaagatgtagcttcagctgctgctctgctggttcctttggaggacttggcactcccccattcacggatgcatcacccccattggcctggttgtcctcct

SEQ ID NO: 23993 - DNA, 201 bp, Bos taurus
agtatatgacaaatacacaaagaaacagctttcagtgtcaatgagagtcaggaagaactgtagaaattatgtcaaagccagggctttaagaacacaggccaaaatggggagagagggcatacattcctgatggatggagcacagtgtgctaaggtataggtattgggggctttgctggaagcacaggaggccccacagtaa

SEQ ID NO: 23994 - DNA, 201 bp, Bos taurus
gactctcgtcatgggtaagggaaaggacatcttgagttttagagatgaagctttcacaggtcatgtcagataagctgcccctgggcggaccaaggtgatcgtctccagcttcgattttcatgaggttctcgggttcgttttcaagggactcggaagtccggctcatgtgcgtataggccagagactcatacagtttggagt

SEQ ID NO: 23995 - DNA, 201 bp, Bos taurus
agagcagactgattctgtgtgacgtggtgggcagggaagaagccagatacccatcaccttagctccctttccctgcatcccttccctggcagtaccctctagggcacctcttcagtttggtgaaacagcagccttcaagcttctcctatcagtcactcttatcagtatcaggaaacaggctctgaggtcccgctgttctcc

SEQ ID NO: 23996 - DNA, 201 bp, Bos taurus
tttttcaagagaccttgttgggagcctggaaaagatatctgctgaggattaaaaatataagacaaaaaatatttcttccatgtatctcaaggtcagctggagggtggggaggggagggaggcaaaagagtataaatgaagtctctgtttcagcttccaccaagaagggcactaaattaccccttttgaaaatggccttaaa

SEQ ID NO: 23997 - DNA, 201 bp, Bos taurus
tctctctctttttgatgtggactgtttttaaagtcttctattgaatttgtcacgatattgttcctgctttatgttttggcttccttggccacaagtcacacgggatcttagttccgtgacgagagatccgtcttgcaccctctgtaccataagctgaggtcttagccactgggccgctggggaagtcccctaccttcttct

SEQ ID NO: 23998 - DNA, 201 bp, Bos taurus
cttttcttggccattaggatctctgagatgatatggtcactttccctcaaggcttctgtcactaacactttgcctgccggttcttcttttctggtcataattagggccagaaatgcaggtcccactgggagttgaggtcgtaagggagagaagccagaactttttgattctctgtccttagtcaaatgagacttggagcag

SEQ ID NO: 23999 - DNA, 201 bp, Bos taurus
ctaaggagtggtgggcaactgaggccctctgtacagcaacccacgaggaagtgaaacctgtcaacaccaaccacaggggtgagcttggaagtggatctgtcggccctagttgagccttgagatgacagcagaccaggctgacacctccactctaacttcaagaatgaccttgagccagaagcacccagctaagctgctccc

SEQ ID NO: 24000 - DNA, 201 bp, Bos taurus
ggcccggagatcatctccaggatgctgcgaggggcactgatcctatctcagctccatcaccaagaccagtggacaggcttgggcacatagtctgatcctgacttgtcactcactctggccagagtatcaaaagtgagcacagcccggattcttccccaggacctacagacagcagagggtgtcagctgattcattccagtg

SEQ ID NO: 24001 - DNA, 201 bp, Bos taurus
tttgtcctctgtcctctgtccctcccccagcttgacatggggaggaccgagggagctaactcaggacggctgatcagggaacttcagaaagaacagagatggtggtttccctggcctggctgtagtggcgggtttaagaaaataaacaaccaaccaaccagtgacacaataacctgcggtctatttctacttcaagggtgc

SEQ ID NO: 24002 - DNA, 201 bp, Bos taurus
aggagaaaccaagctcagaatccagctggtccagggtcattagtattcaccatccagcaaccaaaacagcaaggttggccaggaggtgataataacaaggatcaacatgcacggagtgctcactgtgtgtgtcccactctatttcctaaatcaccacctggcccgtcagctcccagacttcaggaagagtgtgttaataca

SEQ ID NO: 24003 - DNA, 201 bp, Bos taurus
ccccaaccaaggccaaggtaggttggagggggaagttcagagagactgtagtggctctcagatctggctacacaacggactcttatgggctccaattatatgtgtggcctggctctgtgcctgaattttctgattcagtagctttaagcaggaccttgacctccccgtctctgcaaaactccagggtttgaaaactcagcc

SEQ ID NO: 24004 - DNA, 201 bp, Bos taurus
agcggggcaggcagcaggtgtcagagtgatggccttcagccagctaagagacggtgtgtgagaatggcttcaaggtctctgttgtggcattaactcctgcatgccaggtgccagggcctctatccacccctactaccttctcttctccaggtgagaaacatcccctctcccacaaccattccaggccaggtactgccactc

SEQ ID NO: 24005 - DNA, 201 bp, Bos taurus
agggatccatgcagtggactgaactcataactttggcctccttagtaccactgagttgtccaaaaggagatacataagaatcactcttcccacttaacaatatccggcaactgacaagacaatcagagcacacggaccacaggatcagccctctagaatcaggagtctaacttcctgactcccaggtattcccgttgggcc

SEQ ID NO: 24006 - DNA, 201 bp, Bos taurus
ccggagaggaaactgtgaacaccctgtaagtttgcagggaggaaaggatgaggaagggaatacagaattctcaactggaaagaccagaagggaatttctaaataattctaatccaactagtggcccatacttagattctgttggatccacagtatagaatatcttttatttaaaaagtggccaatattgaaaatcaggaga

SEQ ID NO: 24007 - DNA, 201 bp, Bos taurus
tattttgagaagtatcagtggacctcccacccacagataaaatctgtgttcttgatggtaacaaaattctgcacactcaggccagcctttgaatgctccatagatcaaatttaggtgggcaacagagcctttggggtgagagcgcaattgtttctgggctctcacaaggcagccaggcctgggtttctgctgcagtggttc

SEQ ID NO: 24008 - DNA, 201 bp, Bos taurus
ccagccatcgtgtgcctccaactctgaaagtctggggtccaggtcacagctttcctacccactggctgtaagcctgtggcttcacctcaagggcctgcgggggggatagaagcagacctagctcagaggttaacgccagttaccagccctatgagctcaggctgaccacctgacctctccccgatatcacccacatcttgg

SEQ ID NO: 24009 - DNA, 201 bp, Bos taurus
ctcttcagcctctttccctgggcgcccttgggtggtttatgtgccctctctgagccctgctttttgcatccgtgaatgggggctgattgggtgtctcaggattatgtctttagatgggttggcctcttccaccctctgcctgaaccccagaagggacagtggtcttttcaactgaccagagactggcctcccccagctggc

SEQ ID NO: 24010 - DNA, 201 bp, Bos taurus
tgcaagccccctgttgagtcatcaaccagtgcgcatgcccagaccttctaacaaagtgtccaagagcagatgcccatggtatgcgggcagcaaggcccagccctttaagaatagtctaccttttgaggatagactatgctggtgacactagaaaaggttctgcagcctcaaaagggggtgagtggagatgggagagaagct

SEQ ID NO: 24011 - DNA, 201 bp, Bos taurus
cggaaggctggcgggggcggggcaatcagattgtaaacaatggagacctggcctcttacgttcctcagcaaacgcagaagaagaacggccgcatccgatcaccgcgcatcgcggatttcaccctggacctcccggggtttatataccctctgcaacccagggtcggcccctcaacccccgggcctccggggcccagacccg

SEQ ID NO: 24012 - DNA, 201 bp, Bos taurus
cttcagtcctcttctggagaatgggaatgtaggtctgaccccctgctgctgttcactgcaccacaataccacctccttgacctggtcctctgacctgcccatgaggccaacagacaagatgtatatcagcctccctaaagcttaaagaggacaagggacatgcccaaggccactcggggtcagtggccaggccgggaccag

SEQ ID NO: 24013 - DNA, 201 bp, Bos taurus
acctcccttcccttgtttattcccttccagagactagtaagtgtgtgaattccactggctacggagacggagcagatggatgtcaggctgagcttgtcaccaaatctcaggccctggtcacagggactagttaagggaatggcctgtgtttataggctagattatattaagaaaagatgagccagggattttagtggaaga

SEQ ID NO: 24014 - DNA, 201 bp, Bos taurus
tggctgtggtggctggtcacagaggttgaaggtggcctctgggaccccttccctggccctaagggatcctgagcaaaaggtcatctcagccaagcacccccgcctagatttcacatcatctggctcctgtgtttggtggaagagggataagtggagctcagagtcctaaggggccccaagcggaaatgtactgaacctgag

SEQ ID NO: 24015 - DNA, 201 bp, Bos taurus
ggcttttaagtagctgatttgccaaaccaatcaaaaaggatttttcctaaacttgacttgcatctcagagaagacaggcctggcagaactggaggagagcagtaaagatgcacagaggaaaagcataatgtcttggcattgccttccctatacaaccttgaatagacaagggccatgaccgtggcctgagaagggtttggt

SEQ ID NO: 24016 - DNA, 201 bp, Bos taurus
tctgtgtggctgtgctcccacccaccaccaccccacccctcgactcaaacaggcagggccccaatgcaggcctgctgtcgccttggccgaaacccaccacgcggataaacttgtgacttggtaccgccccttcccgcctgctctcaggaaaggtctccagggggcgccctcttgagtctagctgtgttggctaggtggccg

SEQ ID NO: 24017 - DNA, 201 bp, Bos taurus
agaataaaccaggatttaaaatcaaacttaaaaaaaattcacaaaatccctaaagctgctttcccagaaatcagtggcagtggtttgtgcagcagatgagctttggccaagccctgctggacagtgggtggggctgcaaggcaggaggtgggccaggagatgcccaggacctaggctgtccccaccttggttgtcgatgtt

SEQ ID NO: 24018 - DNA, 201 bp, Bos taurus
gtctgggagttgaggctgatgcttgtggccagttgattttgactctgggtcaaaggatcacaattttggttggaaaatgagacaaagttgagggtggcatcaggggcccaatttgaggatgttcattaggtcttagaagcatctctgacaggatactatcagtataagacagagactcacattttataacaaagttctaac

SEQ ID NO: 24019 - DNA, 201 bp, Bos taurus
gggcaccaagagagtcaaagtggggtggcgtttctgttttgggaaggggggtctgggaaatatcccactgctagatgagatatatgaagaaagacaagacacaaaggaggtggctcttgagggaaacagccttctgggcaagcgcaaaagccaggagcagaggctggctgggtgtgtttgaggaagagccaggaggcacgt

SEQ ID NO: 24020 - DNA, 201 bp, Bos taurus
ttttactccggcacacagcacgtccgagccacctcgacctctgggccccctgttcagtgaactcagaccagccacctggccacagggagagtcagtctgcttgtctgctgaatggaatcttcctttggttccctcaagggcaggtttgggtaaaggctagcatcacatgaacccaaggccctgttcctttgaattttaacc

SEQ ID NO: 24021 - DNA, 201 bp, Bos taurus
accctaagggaaatagtggtagtggtgataccaggagggagggatgtgctaggttgggcttggagatttaatcttctttcttccacgcagaccttgcccgtgtgtcccacctggtcagcctccctcggccatggcagcctacagccagacacagtacagtgcagggatccagcaagctaccccctacacggcttacccgcc

SEQ ID NO: 24022 - DNA, 201 bp, Bos taurus
ttttttaattcgttatctttttgtcttcaaggtcagaattctgaaagcaaaggtgtcagcagggctgcattccttctggaggctccaggggagaatccattctgtcggcctttctagcctctagaggctgcccgcattcatttcttgcagccccttcctccaccttcacattgcatcattccaacattggtttccattgtt

SEQ ID NO: 24023 - DNA, 201 bp, Bos taurus
aaacacttgtcacaggtaagccatttttgtctacagtaattgcttttcctgttttgtgtgctggcctgagagttgacatttttctgaataaatcctttcagtggatgaatctaggtggctgctgcttcttgcttcccacttagcacatggagggctgggcataggtggttaggcgtacagcctcactaggaaagaatgtgt

SEQ ID NO: 24024 - DNA, 201 bp, Bos taurus
gtccttgtggagtgggggccctgcaaaatgccacatggaggcattctctgagaaaggaccccaggttgtcctttgggggctttatggaggcttcatcccatagtcacgattaactaagtcattggccaatggagattggttcaacctcaggtccctcctgttgttgtaaactaaagtccctcagtcgtgtctgattctttg

SEQ ID NO: 24025 - DNA, 201 bp, Bos taurus
agttccctgaccagggagcgaacccgggcgtgaaagtctaatcactggaatgccaggcaactccccacatatcctcatgttagttgagaggaaattattacgcccagctgagaatatgtaggtctcccctcggagtcatcaactatcctaattttcccaggattgaggtagtttctggcatgtaagtgctaaaaccaggga

SEQ ID NO: 24026 - DNA, 201 bp, Bos taurus
gttggaggatcaagccccctgggccccagcacacccagaaggttccttctgagggacaactctctctcagatggggtcagctggccctcagctggaccctggaggcgactgtggacttaattctctacctgtcacttctgatttatccaagcatccaatctctggacaacttactgcattaccacatctctgcccacccta

SEQ ID NO: 24027 - DNA, 201 bp, Bos taurus
ggagtaccctgggcagtgcagatggtcatgcatagacgaacagtgcgcggccgactgcagtgcagccgcagtccccgcgcaggggcctctccatccttcacgccaattttaatccccttgtctcaccccagtgttgttctggaagcttgttccatgctgatggccttaagtcaatgaagtagtcctcagcggcttaaatga

SEQ ID NO: 24028 - DNA, 201 bp, Bos taurus
ccaaacgtgtacaggcccttcaattgtctgcaaaaataaatgggggaaaaagtcactgatgcaagtagattcttccaaatatctaaatatttggtattttagaggcctgtcttgcctggaaatccttccctttctccccatggccgatgtttcaactgagagaccctaacccaaggaatgttctggcatttcattggttta

SEQ ID NO: 24029 - DNA, 201 bp, Bos taurus
gtactgttggctttcacatccatcctcctcataaatatttgtgttgtctctcccagcctcaccatgtcttctggggtcataggagagtctcacgaaacgtatcagaaaaaaaaaaagaactttatagtgaaatggtagcttccttcacagaggctccacgtaggctgggaacaactgctccatggccgggttaatgagtaa

SEQ ID NO: 24030 - DNA, 201 bp, Bos taurus
gcccttttttccttgtgtctttaggcagcagaaggggtaagggagctctctggagtctcttttttaaggacagtaaccccattcatgagggctccaccctcgtgtcttaaccacccaaaggtctcaactcctaattaccagcacattagggggaattagtttcaacatatgcattttgagggacttttgtattttcagccc

SEQ ID NO: 24031 - DNA, 201 bp, Bos taurus
tgatatcaagtggctgatggggctgctccaaacagtgctttgggaccttgccccgggcatagaggactcccttttccggatcgggcaagcctcctgacttggctccttatgaaatacaaggaaggacctacgtatggaattccatgtatagcacatggaattctactcaatgttatttgccagtctggatgagaacagggt

SEQ ID NO: 24032 - DNA, 201 bp, Bos taurus
ggatggggcccagagctggagctcctgagctagaatggaggaaaccaaggtctcctcttgtttggctccaccagccccaggagtcctggctgcttgctttcacaggggccactcagtctgggctgtgtcctgctaattccctgcctgagtcccagcgctgggaaaacccatcccacgtgtgctgagaagcctgctcctcag

SEQ ID NO: 24033 - DNA, 201 bp, Bos taurus
cttccagcctccagaattttgaatttccattgttttagcaacccagtctatggcactctgttctggcagccctcgcaaactaatatagacgctaagtgacgtcttaagaaatttggaaaggagaccagatggtgacagtgattatctctcggtgcaagaattatgggtgactccaaccccctttctatattctatgattta

SEQ ID NO: 24034 - DNA, 201 bp, Bos taurus
cttttcgaattaggttttcgtcttttacggattcatgtccaggagcgggactgctggatcatgtggtagctctacgaagttgaccatcttatgatcccatagttctgataatgtgtcatgtcaatgtaagatgctaggattagaggaggctgtacaaagactttatgggaatgctgtactgactttacaactcttctagaa

SEQ ID NO: 24035 - DNA, 201 bp, Bos taurus
agctaactgcagaataggctgggaaatataatctctctcagccacatgtgccctgggagcacctccaggttcttgcgttttgaggagaaagatgagggaggttggtaggccctggcagtccctgccaccctcaccctcagcgctgagcacggtcttatctggctcctcatccaccagcccagccagactgtgagctctctg

SEQ ID NO: 24036 - DNA, 201 bp, Bos taurus
gtcacgagatggttgccacagctcactcatcacctcttcacacaattacagccaaatcaggaaaggaagaaaagaggccaacagatctctcctcatatgcctctttcttatcagagaggaaatcccttcccagaagcccccagcagagcttccctttggccagaactggggcaaatgactacctctagaccaatcacaggt

SEQ ID NO: 24037 - DNA, 201 bp, Bos taurus
agagaaaaccaggccggccaggaccgtgccaccctggggaaccagaggtgggtcctggagtgggtggtgggtggctggctgagcctggtcaccttcaccttgggccacatcgagcccttgatggccggtgaacagcagggtctaagtaaagggagccacagaactgacgcccactgttcgcattttgggcttcctaagaag

SEQ ID NO: 24038 - DNA, 201 bp, Bos taurus
ggtcccccaaaagttcaggccccttgaacttgctgttgaattactgccagtgcttatttatttgttcatgcttgctgtgccgggtctttgttgctgcgcttgggccttttttagctgcagtgagagagggggctaccctctcgttgtggtctgtggcttcttatcgacaggctttgcttgttgccaagcaggggctcgagg

SEQ ID NO: 24039 - DNA, 201 bp, Bos taurus
cccacagggccctgcacccagaggaccacaaggtctaacaccctgccaccaccatcttaaaattcttagcaatatttgaaccaggggctgagaattttcttttatgctaggccctgcggactacaaagccagccctaacgggctgttctcagcccaaaccccaccatcccgacgaccccatcgtaagaaaagcttaactag

SEQ ID NO: 24040 - DNA, 201 bp, Bos taurus
tcaatcattttcagagcagagaagccaaacatacctccttgtttctctagcattttccttatctttctcatgctttcctgagagctgaatgatgcttgagaaaaagaagagaacaagacagaaaataatgcttggttaggtaaatataatcagctaaggaaagcctcctagaagagcataattcactgagtcccagtttat

SEQ ID NO: 24041 - DNA, 201 bp, Bos taurus
cacgaggagtgcacatcgtggatttctaaaaagtgccaagaaggcacccccatcccttgaaatgagaagaatgaagatgtctgtgaacacatgtcttggtgcagcttcggaaggtgatgggcgttaggtgttagcaacagcaacagatccgtcccggtgagagacacagcttggaggatctttctgcataagacattttcc

SEQ ID NO: 24042 - DNA, 201 bp, Bos taurus
atcgcccacatccacaccctcaggagtggtggagacagaccctgaccctggaggtcttagtgtctgtcttcttacgcacggcttcagatgatgctctaacatctcacagacaaggagggtggcaagtagcgggagtgccaggggagatctacagaattaccgcccagcagctttccagaaccaagaggacagagacttgag

SEQ ID NO: 24043 - DNA, 201 bp, Bos taurus
ggacaggcccattctatctgagggggaagaaaggaaggagatgtaaaatttctgtctgggatccctttaatgtcttaactaagcctgttacaacgacatcgtgtattgagttggccctgtcttaagaaaggaacaccttctctgttgaaagctcttgctgccaggggactcagtgttaccagagcagtcaactttgatttg

SEQ ID NO: 24044 - DNA, 201 bp, Bos taurus
gggaggaaatgaggttggaaagctgggcggagactctcactggctgctggaaggaaggcttggggagtcactggggcagtgtgagcccaggcatggtggcgtctggtccaccctttgaaagaacccagggaaacgccgctgagccgggagaacaatgctagcggaactagcatctaagcccctcttttccaaagcagatac

SEQ ID NO: 24045 - DNA, 201 bp, Bos taurus
gcaatactgggaatggcgttcaagtctttgatgtcacacacgtcttgatctgtattcgaggctgttgagttcgatcctgtgtatgagggcaggcacctgactgctttaccatgtatgctatcatgccaagcccaagtatctaagtgttgacatccatattttactataaacaatgtcctcttatttgtcctttgaagaatc

SEQ ID NO: 24046 - DNA, 201 bp, Bos taurus
ctccagattaagtctctaaaagggatttttttttctacttcttttttttaagttaccgtgatcacaattttcagattttcagctatgtataaaacttttttctccctccttctctcacagagaaggtcaatcactttttagatataagagaatttgagaagagattaatgacaaagacaaatgatgatttttattttagcg

SEQ ID NO: 24047 - DNA, 201 bp, Bos taurus
gggagagttttgacacatgtgacggccacacgggaagcggtagcgctgcgccagtgctgggaccagcgaaagcggagcttgaaatctgctgctgtcagagatccactgtgtgtcccaggccagccacttcccttttctgagactccttttttaaaactgggtgctggaacatttactggaagttgtggaagggattagagc

SEQ ID NO: 24048 - DNA, 201 bp, Bos taurus
tccgggagttggtgatggacagggaggcctggcgtgctgcagctcttggggtcgcaaagagtcggacacaactgagcgagtgaactgaactgaaaagccaactaaggccaaagaaatatttctctagtgtaagaaaaacagttcaagcaatgctggcctagatgttggggagacagatcggagcaggggagactgtggtga

SEQ ID NO: 24049 - DNA, 201 bp, Bos taurus
ataaccttcaagagggggaaagttgaaatatccggttagaaggaccccaaatcgggtaatgagacacgagggtcttgttgccctttagggtttgacacacgtacggcaacctgctcagaatccaagtcctgagcgtcttggacagtggggtcaggttcaaattcactgctgcagctgtgcagcctcgggcaagtcaaccgc

SEQ ID NO: 24050 - DNA, 201 bp, Bos taurus
gaatccgtcttgcaatgcaggggatgtgggtcgatccctgattggggaacttgagatcccaaacactgtggagcaactaaactccttgagcggaaaccagcgaggccgagccccgtgatgcagaccctgcgtgctgcagccaagcggatggcgggtgaagggcaccatagaagcatacatgccttcaccagcgactccgct

SEQ ID NO: 24051 - DNA, 201 bp, Bos taurus
gctggcccgtgaggtttaagcggacgcctgcttggggcatgggcttccggcgaggaccctcctttcgttcccaataaagggagaaaaaacagcggcgcacggtggcctttcctgctcttgggtccatcgcccgaggacgggacgcgtgggtagggccagcttggagccgcggtgcgtatttacaacacgcacctggtatct

SEQ ID NO: 24052 - DNA, 201 bp, Bos taurus
gagggttcagtccgtgggtcgtgaagatcccttggaggaggaaatggcaacccactccagtatccttgcctggaaaatcccatgaaggggctacagtccatgggctcatgaagagtgggacgtgactgagcaagtcaacaacaaccaaagggtaagaaggaagataaagcctgccgaagggataaagcctgatggagatcg

SEQ ID NO: 24053 - DNA, 201 bp, Bos taurus
ccctcaagtgcagcagtgaccaccaaaatccctggtggcagagggagcgcatgcccctcaggtgatggccactggtccgtgtaaacctccagtctctctgcgttggcctctctctcactcccgtagactcctcaggctgcacaaaatagttttcctccccactctctctgtctccatcctgtcttgtctctgcatgccctt

SEQ ID NO: 24054 - DNA, 201 bp, Bos taurus
tctgagttatctagggggaagtagggaccagatttaagttttcataattacttttctcaatgctgtaccaagttttttgcatgtagtagggaatcaataaatatctgttacattactaaaaggaagaatgcaggtagtcagtgagtatttgatgaattgcttagctgaaccacttacaagctgatttccagtcatctgcgc

SEQ ID NO: 24055 - DNA, 201 bp, Bos taurus
tgcaaggaatggagctgagattcgaagacgggctcctcggattcctgagcctctgttctttgtccctgtgctccactgcctaaatcttcaattacagatgattttttagagtaaattatagtatatccacacaaaggaacattgtacagttataaaaagtaatattatagaagtatgattatttagatgaaaagagggaca

SEQ ID NO: 24056 - DNA, 201 bp, Bos taurus
cctccagctatgacttatgcctatatttggaaaacttaacaaaacaataaagctctttagaaatgactgccaacttgcctggaaataggaacccctggatgaaacacactgggtacagagccctaaactgtgggcaggacagcctccaagacagtgaaaagcttgagaatcacaaaggtctgaatcgttgactgcttcacc

SEQ ID NO: 24057 - DNA, 201 bp, Bos taurus
accccgcctcccaaaagcacgaggctgcatggaggcagtggccccagactctcgctgcagtgcctccggggtctgcctgcctggtggaggccatgcccttccccggagctgggcacagtggggtgggtgtgcagacgcctactcagtgctggacactctgttagtaacattagctcctccctggggtaaactgagctctgc

SEQ ID NO: 24058 - DNA, 201 bp, Bos taurus
acccgggtgccccggcctcaagaacccctggccacctgctgaaatcgccttgcatcctgtgccccctggtggaaccaaaaccttctgcactgatcacacgcggccgccccctggcgggcatcagttgacactattttcactgtgaaaccccaactgagtgtctccttaggagtttgagtgagtggataacagcaggcaaat

SEQ ID NO: 24059 - DNA, 201 bp, Bos taurus
tctgagactgaagttccaaagctgaacgcagtgagattcagaaatccctagaacacagataccaacgtggagcccacaggtaccagggcctcttgctgggcgcctgccagcccaggaaccttctgggagagcagaatccaggcaggtgaggaatgaagccagggcaggtccgcggagagcccacaaggaaggaaagatagg

SEQ ID NO: 24060 - DNA, 201 bp, Bos taurus
accccggtgggtgtaggtggtgtgcacacccacaattcacacatgccctgctccttcctaggccctcccgagctctgaccccttctcggggccaacacatggggtatttgtccttcagggagcagttcaaatgagaagggctgggtggacgcaccccttgggaggacccctggcacggccgccttgcataggcagggtgtg

SEQ ID NO: 24061 - DNA, 201 bp, Bos taurus
ggccgctgggcagcaggtttcttctgccacggtggcacaggcacctggggttgtggttggctccaggcgggcgggggctgcgtgcccctgcgcaggcacacaggccgtgggtggggagtctcagagcttggcgtgaggtcccacagggctgggcctgcaggatggaggccactgtcctgagctgcaggtgctggcaggagc

SEQ ID NO: 24062 - DNA, 201 bp, Bos taurus
tgcgggctgtgctgaagtcgtagtccggccggaaggactcattgagcgtggcaatcaggtagaagagggtcttgcggctgcacttgtcgctgagggggccctcatcctcgccaccttggctcttactcagtctgcacagagacaagtgtcagccccgtgctggcccattcgccagtcccctataggcaggccctgccccta

SEQ ID NO: 24063 - DNA, 201 bp, Bos taurus
gtgtggccccagcggcccccatgtgcgtgcctctatcccttcatctgtcgtggtgggcgatgtgctacctcctccccccgctgtgtgaggcctgaatgaggtgacgtgtgtaacacagcaagggctgtgtctggcgcaggggaagagctaaatgcattttctcatcaacccagagatcttgacagcctgccaggtgccagg

SEQ ID NO: 24064 - DNA, 201 bp, Bos taurus
cctgaggccctgagaccacaccggggcctgaggaccctcctgctctctctccttccgcttccctctgccaccctttggactctgggtccatggctgctcccgctggcccgccctcccgctagtcttagaaccttgaaggaagtgtttagaaactgatgtaattactgacgtggagccgctggccggctcttcgggaggggg

SEQ ID NO: 24065 - DNA, 201 bp, Bos taurus
tgcacctgagacctcgctcaggacggccaagtcgccctttgagctattccacttcacacccgggagagaaaagagattgccttttgccccttggccttccccctcttcctccttggcgtgtagatgtgacagctgcagcccctgcagccttttctctgtctgtgaggatggaagctaaggctaagaatggcagatcagaaa

SEQ ID NO: 24066 - DNA, 201 bp, Bos taurus
cgcttccaagagcttgctgactggtgctcagcatgtttggggcaaggtccagaatgttctttctcctcccctctgtttctggggtcccatcaccgtcttgatctgatttctgccgtctcttcctccccatcacactcaccaaagttttgtatattttagcagccttctcagaaaaaccaccttttggattttgatccagac

SEQ ID NO: 24067 - DNA, 201 bp, Bos taurus
tcaaggctgatctaggccggctaccgacctgccgagtaactgttttgacatcaactcatgcactcaagctgacaatttggacagattgtcagaaatgtggatggtgagaggaggacagatcctctctggggcaggggggcttcttggaacagaccagagtgtgaatacgctggaagggtacccactgcagggagccgaggc

SEQ ID NO: 24068 - DNA, 201 bp, Bos taurus
tttcactttctgattcttctagaatctaacctaatctactttctttaaagtgcttagcatccccatcacaagtccaagggcagctacaaggtcaaatgtgctaagttttcccaagatgtttcatctttgggtagatccagaaagtcttgcatatgatcttttaattgttccagagaatgtctttgtgatcacaattgaggt

SEQ ID NO: 24069 - DNA, 201 bp, Bos taurus
atgaattcctgtctcaaggactcattctcaggtcctcaaccttgggacacctgtcacttgccacagctcagcctaaaaagtgcagctgctatgtccatccaggtggggatatcctctccagcctaccacagaatccggctggccctgagctgcccctgccagtgagggccaccgaggtgggggcccgagtcacctgtgagc

SEQ ID NO: 24070 - DNA, 201 bp, Bos taurus
aagactctggtggagggggtgggaggcggaggcgaattctgggttgttggggtggcccaggggaggaatggcgcatgctggcttggtctgaggtgagaacattactgtccgctgctgaggcatgtccacgatccctgcgaccagttgaaggaacccagcacttaggaaaaaactgcaggggcgaggagacggcctctagcg

SEQ ID NO: 24071 - DNA, 201 bp, Bos taurus
tcgcctgtcacctccctgcggctaatgtctaactaccccacagtcccatctgcacgtgtcacactctcagagaggtcttgcgccaccaatacctccttctttctccatccctcgtgttagccccctgccctccggagccggcctccgggaccgctgggagcctgccttttcctgccagtgctgcactgtgggagggggctg

SEQ ID NO: 24072 - DNA, 201 bp, Bos taurus
ccctgtcctcccctgacctgtctcccctcctgtggacccaagggttcctcctacagggaccacagctcttagcaggctccggggaggagggccggtccagctgaggacaagtggaccatggaggaacccgagtcacagatctgagaccccactggagaaagagtgaggccaccttcccagggttactcaggcgccagccag

SEQ ID NO: 24073 - DNA, 201 bp, Bos taurus
ggcctacctcctattgatggtcctagaaacacacaccataggagcctaatctggaaaaactagacgccacatctgttgtcatggtgatctacaaaggacacctctgtatgtaacttgcccaaccttcatgcatggggggtagtgctctgacctgggaagcacacggctggtttctactggtgtgtctcattccgtgtagaa

SEQ ID NO: 24074 - DNA, 201 bp, Bos taurus
cctgctggcctgacccctcagggtccatggccctgtgctatgccaccagtgattagcagagcagttaggtttttgcagggctgagccatgaagaagctgccgtgtcgtgttcctggcttttccttgcccccatcccagctctgccctctcctcaccacttatcaagaggtgtcctccatcccatgcaggcctgggccagca

SEQ ID NO: 24075 - DNA, 201 bp, Bos taurus
tgccatggcccttctacatcagctccttgtgtggtaagcactttcctgagggatctaggtgcatccacgttttgggcctgctttgttggaaaaccttgccagaggaccacgctcctgtgggaaacaaggaattgcctaagctgcactggggaatctacctcattgaccagggatggccaaggagtggaggccttgagtagc

SEQ ID NO: 24076 - DNA, 201 bp, Bos taurus
tgtcagaagagggctgtaatcaggagggggtcctactaccccacactgagcagtatttctttcactccagagacaccttatgcccaaatcattctgtctcccccactgaccctgggcccccccaaaggtcagaagtgtctgaggtctactcttcatgggtgggcctcaggccctgccctccatcaataccaaggcccccca

SEQ ID NO: 24077 - DNA, 201 bp, Bos taurus
acagggatgggcccccagtcctgtctgcggccgtgagagagggcgcagggctccaggaagaggaacccgggggtagcagggcctgtcctgggccgccaccatctccaggacctgtccatgtctggatcaggtccttctggtccccagagaagcaaactcagggccatagaagtcccctaactgccacggacagcggttgga

SEQ ID NO: 24078 - DNA, 201 bp, Bos taurus
cctaaggcgggggtgcgctgctcaatcacggaaggggctggattctgtgcaggctgaggactcctgagccctatgcaatcagtgagaccacaatcgagggcgaccacctgactagtcgcgtctttggcacagacaggaccatgtgggcccggcagatcccgggagcagggctggagggaggcagatgctgcccctctccca

SEQ ID NO: 24079 - DNA, 201 bp, Bos taurus
ctctggttccagggggtcaagggccctgattccgagcccctcctgagcctgggcttgatgccctgtgctcccgccagggcctctctgtccccattgtccatgtgagaagtctgagcctgccctagtgacagaatgcttgggctcccctagtcaggaggggctgagtaggtcattggacctgggctcccacccttcaaggcc

SEQ ID NO: 24080 - DNA, 201 bp, Bos taurus
aagtcctgaaacagagttgcactggccccactggggcttcagcagccatggggaccgtgacagaagggggtgaaggtttcttgcagcccagacatcccagaattctacacttctgagccaaaggccactgttcctgaaatttgctcccagtttacctccagcattctccaccaaagcttgtacaatcccgatggctcacac

SEQ ID NO: 24081 - DNA, 201 bp, Bos taurus
gtcctgtgtctgacatgctgtaaagccaggccccagatgaggtcggtcctgagccaggaaaagcctgggtaacacctgtgcacagcctctgcaggccggtagctcctattccaccgccctctgcagacagagccatggttccttagcatcacccatgccccattcactcacttggccaactgatcagtcatttatttacca

SEQ ID NO: 24082 - DNA, 201 bp, Bos taurus
gtgtgcctgggcacccatggggttgttctggcggctcttgccctgggcaacatgcccatcacccacttctttcagggccctgcgatcaccccactttccccgcctttgcctttgctcaccgttgcttctctgggatgtgcttcctgactactttccagatgttcctgcaaggctccttcctccaggaagcccacctggcct

SEQ ID NO: 24083 - DNA, 201 bp, Bos taurus
caggccctgcccaacgggcccgacgcgtagtcagcaggacactgcaagggggccaaaggtctggactgagctgggcaggccaggtcggggacagcacagatacctgctctactagagtggcagattgggttcatcttgatcgattgatgatggctgcccagtgctctgactggacacagggtcaaaggccactgtgctgtg

SEQ ID NO: 24084 - DNA, 201 bp, Bos taurus
ggctccgaccttggggctggcccaggtgccttcagcctcaccatcgcccctccctacccgtctaagaggccgcatctcttacaccctagatccccacgccgttagtctaacatctcagcttctggaggggacctttaaagatacgtatgttcttaggctttaggctcaaagtgaaatcactcagttgtgtctgactctttg

SEQ ID NO: 24085 - DNA, 201 bp, Bos taurus
gtcatctaaacacagctgtcaggctaaatgatctaacactcagctgttagggatgctccagcagggagaagcccttgaatacttcatcaatccaagccacgagcagcttctcacgctggccggtggcgctgctgccacgggggagtcctgtgcactgcaaaagcttcagcagcactccgggcctcacctggtcagtgccag

SEQ ID NO: 24086 - DNA, 201 bp, Bos taurus
caggtgtcccttttccttctgcaggtggaagggtttaaggaggggagcttaagaaagtcccgccgggctgtggacggggctatgcaattcccccttttctagggccttcctttcctcatcattagcattggagaagggaccaggtgaccttgaaaggactcctagcacctcactcttgctttctgatgagcccctgttgct

SEQ ID NO: 24087 - DNA, 201 bp, Bos taurus
gactgtgtgtggcagggtgggcaggtggggcagggaccctcctggctcagtcccaccttctgtctgccagttctttccacacacacacactgacccgctctcacctcaaaaaacagactccagcccacgttctgggtcccctgatcatcaccccaagggccctccccaggaccctagcttcccactggcctggggctccca

SEQ ID NO: 24088 - DNA, 201 bp, Bos taurus
ggagatgggggagcggggttggcctgtggctttgacccgtgtgcaggtcggcagcagacatagggcagtgggcagggagaggtcatggcccaggtatagttttaaggcaaggataatgggttttgctgatggattgctttgatcctcagagacagagagaggagtcggggtgactaaggcttggggcctgagcaaatagta

SEQ ID NO: 24089 - DNA, 201 bp, Bos taurus
gaagcagggaacccgaaaccgcatcacaatctagagaccttgcccaaccccacaagcaagacccaacccacgtacactcctctgtgttctaagcataggtatcttctcttaggttcacgctgcctctgggccttcaggcgtgtttctgctgaagtggaatcccagggctgcctgttaacagctgtgggaccttgactatta

SEQ ID NO: 24090 - DNA, 201 bp, Bos taurus
tcacaaagcctcgtgattagcgactttcactttagggtcacaaagatttactcctgagccttcttttttgaagagttttatcgttttagctcttaggtttggagatatgatccattagaatgaatttctgtgtatgttgtgtagacaggatccagcttcattttcacatgtggtatcctgatgtccagcattatttgttga

SEQ ID NO: 24091 - DNA, 201 bp, Bos taurus
ggcccgcagggactggagacagtaaattcagcaaatggataatccacgtgcgctgtgtccacacggtggggtgttatcagccatagaaagagaagaagcacgacatgggcagacccagaacacatcaggttgggaaagaagccagacaggaggccacagagattccatgtgactgtgtgattcgtaaggaagagcaatttg

SEQ ID NO: 24092 - DNA, 201 bp, Bos taurus
aacacgcggcccccagacacagggaggggccgtgctcagggacatcacacctctgctgcgctcgccacagagccctaagtgtttgggggctttacgctcacggtggccagcacatgttttccacaattctagttttcactttgaagtttgaattttattattgtagcaaatactggcaactgttttcctggagggacaggt

SEQ ID NO: 24093 - DNA, 201 bp, Bos taurus
tatacttcagttaaaaataatttttttaattaaaaaaaactgaaagcgattggtaagctgggactcccttccctgagggttgtgctctggttcctgaagtgccccggggccagatttctgtggctctgtggctgggccttgcctgggacacaaaggtttaaccttgactccacactcaccaggttcctctccccggataga

SEQ ID NO: 24094 - DNA, 201 bp, Bos taurus
cactttaaattaagccttaatcagatattaaatttgtaagtttcagagtatgcaaaaatactaggcagaatgagtttaaactgttcagatcaagatgctacatcttaattcagcaagtcttttctccggagttacaaagggaaactttcactgatacagcgctcgctcgctctctggtctggctgctgccattgcttgatg

SEQ ID NO: 24095 - DNA, 201 bp, Bos taurus
agtgactgaagccttgcctcgattcctgcactctcacctgctcactggtggatgtgtccactaacccttcaaagttcagaccgtgggagaaccatgagtcctttttcctgggcctcctataagagactcaagtgccttcctacgtggctggtgccaggggacacgtccctcttcagggagcaccctttggaggactgtgac

SEQ ID NO: 24096 - DNA, 201 bp, Bos taurus
atgcacgtgagctcacgtcgtgccagcctgctggtcgttgctggcatcgccgtcacactggtacctgcctgatccaggcccttgttgtttttgtggttttacctttctctctctgctgcttcgccaggctctgctttattccctctcttcctgcttctctttgtctgtcgagtttccaccttgggcctcctgtacgctctt

SEQ ID NO: 24097 - DNA, 201 bp, Bos taurus
ggaggaggcctggctgacttggtctgtctgggcactgaactgctgccttcagggagggtgagctgggtagagttagtgcgtccaatctcagtgtgtactgcggcttctctgctgggtccctgggcctccacagaggccctctcctgtgtgcgtgatggtctaaattagtgttctttggggagaagacagcagaaaactctt

SEQ ID NO: 24098 - DNA, 201 bp, Bos taurus
ctccagtgaacctggctcgtcagttttgcaagggctgaggccatgttccacatgaacacatgaaggcttcagtcttctggaccctctttcccgggcttggcgacatctctggcctgcttggcctgcgttgcctgggtctgggtttgcaatcacagcccatcaagggagctgtgtgaaagcctggggtgggaaacaagcaca

SEQ ID NO: 24099 - DNA, 201 bp, Bos taurus
gttgactattatcagcagtaccgagtaattttaagtattttaaacttgatataaatgtatactgtaattacctcctgccatgagctgttcgctcagccttattaacgtgagacctagcctgcagtgaggtatggagttcttaattcatcctcacttacatatgtatatgcttccagtgtgtggctgttacagatttactta

SEQ ID NO: 24100 - DNA, 201 bp, Bos taurus
tgagcgggagggtaatggacacggtgtgtccccggcctctgtctagccggggtgtgtggtgcacgttaccttctcagcagtaggagctgatcagactcacggatcggctgagcttggccattgtgtcgagggctgctggatcctctgtgttcccctttgcagacagctgaccgcttcctgcaggtgtttcttccctgtcca

SEQ ID NO: 24101 - DNA, 201 bp, Bos taurus
cccttctctgttagactcctctctggtccgggtacaggacgctccatgtgcgcgaggccccctgcctcagagggcctgcctgcaagaggttggtgcccacctgtctgcgtcctcctgtttcaccctgatggggaaaacagaccactgtctctctggcttgcttctccctgatggctggcaagcttggggatctcctctgtt

SEQ ID NO: 24102 - DNA, 201 bp, Bos taurus
ccctcttgagcctctgcttttacatctgtactttggggtaaggaaacctataccttgttgggtttttgtgatcactgattgtgatcactggtttttaacttatcactgaataacatatgcaaagtccttagcataggaactggctggtaaattacagtcaggataaaagcacaggatttgagcttatcctccaaaccttcc

SEQ ID NO: 24103 - DNA, 201 bp, Bos taurus
tggcaggagcagcagcggagcgaaggaaacaaagaaaacaggcaactttgagtgtttgaggttgaagtaggttgacatccaaaatcctctgtgtcccaaaatccggatcagggcaagactcttccctggccagtgggaagtcttggcaagtcatatgatcaagagcaggatgcatcactgtctggggtcgggggtgaaatt

SEQ ID NO: 24104 - DNA, 201 bp, Bos taurus
tcccacagcagaggcactttgactcccaaagaactgcttctcactcacctcttcctctggctgtgattgaagcaaggagggtgtgagcagccgagactgacggtgcaattaccacgtgccaggcttgcagctccaccccattcagccccgtggtgaagagatcgggacccatgcttctcagatgaactcattaaggttctg

SEQ ID NO: 24105 - DNA, 201 bp, Bos taurus
ccacgttatccccaggaggctttgctggcccctctgcacctgctgtgagctcctgacaccctgaaacagctactttttccagaacaaacctgactcactcgggcccttaggcctttgcccagcctttatagctacatggcatttccctctacctgatcaactttgacctatccttccaaattcaaagcaggggttcactcc

SEQ ID NO: 24106 - DNA, 201 bp, Bos taurus
ggccccctgctgccctagaaggctcaaagggacggggtcctctctccacttcattttctataaagcaacctaaagcgtcacccccgcctgctggcctgaggacaggcacttttcaaggtcgttttgctgaagaataaagggttggggaggaaggggggcttcagaagaaaagaggcttatccctgtgaggaggccggctca

SEQ ID NO: 24107 - DNA, 201 bp, Bos taurus
gccgcccctcaaatgtgcaagctcgttttcagcatggggcttggcactagctgttctaggagctctctctctgatcttggatggtttcccagctcacctctctaccatggcccatgggctctagaaagccccctactggccaaacccctgccccacaagcgctccagacactcctgatcatctggctccagtccacactct

SEQ ID NO: 24108 - DNA, 201 bp, Bos taurus
aataagtgtcagcagggcagcagcagagggttcggtggctctgtggggtccaccgccatccgtctgcactctgttggccatgctgtggaatctgaacgtatataggaatagagttcagcacctcttgttttaaaacccagtgcgtttctgactagcaccaccacctcctgtttgtctggatgaaatgtctcctgggatgcc

SEQ ID NO: 24109 - DNA, 201 bp, Bos taurus
aaatactgctttggtgaacattttcacaccaatgcctttatttatttatttttcccaacttaggatggttttctccggccgctcccttagaagggagattgtggtcaaaggagacgaatgtgttgtgtgactcaggaagcgtgtgggtccccaaaaggctcttcggaaggagtggggcgagagccagggtgacgcccctca

SEQ ID NO: 24110 - DNA, 201 bp, Bos taurus
acagagggagacagatatacaagaagcagagccttacaatttaatctgatccgtgctgtgcaagagaaatctgcaaagattatggaaggctccacgataaataaaaccagtatcatctgagaatgatggcacccactgtatgcccacagccttgctccctttttctgacagccatcgtgggggcaggtgtcccgagcctgg

SEQ ID NO: 24111 - DNA, 201 bp, Bos taurus
gaggaagcctcctttattacatgttttacagctgaaggaatggagcacagatgagaagtaaccacctcaggttatctgggattccaaccaaggtgaattccggtgaattccaggtgaattccagacccagctccctggaccaatcacaatattaagatgacacagagacttcacattattaacctctccagttccctttgc

SEQ ID NO: 24112 - DNA, 201 bp, Bos taurus
tttgaaattccaaaatgtttgctgtcaaattttggtctttctcattacattcaaaagtctattttgaaacttaaaatcaggggcccaattttctctttctgtgtcttcaatttaaatgcactgtctctcttctgggactggggaaggctggatgcccagtggccccagatgaaagacagtgctgggacagtcgtctgcatg

SEQ ID NO: 24113 - DNA, 201 bp, Bos taurus
acatgtgtgctaaaccacctgtgcacaggtcctcatctctgcatctgctcttcatcatctgtcccctgaaaccactagaagtggtacagctgctccttatcacatgggaggcagggtgtggagtcagccaaacctgcgttcccctgcgttccgggtgaccctgtgccagcagcctctatagaaatgaccctgaaggaccat

SEQ ID NO: 24114 - DNA, 201 bp, Bos taurus
aacagtgggtggccaagtccctctctggaggctgctctgtctgagagagctgctgaccaaggtcacacctccttcctgggtgaccagtaacagtcaatgcatgagtacaaaggcctggccagagtctgcaggtccagagcttcccctgggattgactgaggtctctgtgcagcggactcctccctctgccccacccccttc

SEQ ID NO: 24115 - DNA, 201 bp, Bos taurus
gcattgaccttgacctttattgaaaaggaacattgtttgttctcagagcagaacagagggacttatttttcagtacagtgatgctcttctccagaaagaatggggtcttctaaatccttggttcacccactcacaaggctggctgcttactcgcctgtcagtcattactgcacatgcccaggagggcagagatctctttgg

SEQ ID NO: 24116 - DNA, 201 bp, Bos taurus
gagcaagcgtcttttcatttcatggctgcagtcaccatacaaacacataatgtgcacaagacattgatttagttaattattgtcactattattattgtttgatcagaaacatttcctgcttggacaaaaacatacagaaacagtgcaaaacggaaaggatcctcttaaaagtggacctcaggcatcttctgggcaaggagc

SEQ ID NO: 24117 - DNA, 201 bp, Bos taurus
ctctcctctgccctgaggtgcttttaatagaaacgcatcactcttaaatggcaatgatacttggagggaaggaggtcagatttctttgtcatcagtcagaatgtatcctcagagagtgtctgagtgcaacagggtagaggattgagctggcagacttgggaaccaggcagtacagagtttcacatagtaaacacttactgt

SEQ ID NO: 24118 - DNA, 201 bp, Bos taurus
ttattgtaacaccgatccaagaatttcttaattcctgctagtcccaagggtttggaacatctgtctcttgccttctcctgacttttaatttcttttcttcgattaattactatgagtagactgattttctgggaaaggtaagtgcatgtatatatatatatatatatacacaaacacacatatgtgtaccattgagtaaaa

SEQ ID NO: 24119 - DNA, 201 bp, Bos taurus
tgcaaccccagccacagccctcagcaatgccttgcacagagcagatgcaggatagttcttgtgtcgttcctgccgcaccgaaatgaactgcagtgacctcgtggtaaaataagtacgttcacagatgtcaacaccgtaattaaaattccagtcttctggctttaaattctccaccgtgaagaaatgtcaagtgtcctactt

SEQ ID NO: 24120 - DNA, 201 bp, Bos taurus
atgagttttcatctttttcccacacagtttttgacctttggttttttaattcacagtgacctacttttaggtttgttttctcttgtaacaaattctatttgcgtcacccgctacattgcagtgaaagaattgtgagcttctgggcatggtattcacagtgcatgaaatatgaaaccacggcgagaagcagtgttgtggagc

SEQ ID NO: 24121 - DNA, 201 bp, Bos taurus
aaggaatttctgtgctcctttgctctaccttctccttgactttcctcctggaggaagatgacgccgactgagggaaatgaagtgaactctcagtgctgacttgtggccagacctaggtgtctctaagctgttggtcatctgtgctttttctctcccaagggcaccctgtgtgtgtgtcccctccccgtgcctctctccgtc

SEQ ID NO: 24122 - DNA, 201 bp, Bos taurus
aaagaacatacaattattccaggaaagctaaatatgtttttgggccaaagaacgaatagattattcagaaacagaggtcatgagagagacaagcagatgatggggtaaaggaacaggtcaaaaaggcagactgaggaaagattactccatgttctgtcctgagctggggtcccgtaggccaaccactaccctaatgtatca

SEQ ID NO: 24123 - DNA, 201 bp, Bos taurus
ctatgattcaaaatacacagttaatgcaaagaaagagagaaagaaggctactaagggaagagaggagactggagtggagaggtgagaaaggaaagtcatagggaagacaaatgtcagcatggctaagtacccaatacatgccaggaactaaggtgttgtcatatataactcattttaacatacattgattgtgtaacttaa

SEQ ID NO: 24124 - DNA, 201 bp, Bos taurus
ttataatccatgtataataaaactgtggtaaaggggaagataatagattatttacattacattttaaagagatccaagctaagtagatttcttaaataaacgaagcgtgccttttcagttgcatttcaggaattttgaaggaaatactttcaaactgatagtggctatgacccctccccaacacaaaccaaaatatactgc

SEQ ID NO: 24125 - DNA, 201 bp, Bos taurus
ccggggtggggggggcggtgggaatcacatcaaaggaagtgctttcctgtctctgattggattactggcaagaaggtacagaggggcatccaaaagttttctcaggagggccaactttgcaacgtcctgtctagagaagttgttgacacgttcgtcccttccgctataacacaagcattcagaaaatctccactgtgtata

SEQ ID NO: 24126 - DNA, 201 bp, Bos taurus
tcataactctgtttctcagaatccaacccaaagaattcagtaaaagcatttttaaaacaaagattgatgtataagtaccttgattgcagcctaatgcatagtagataggattgaaaaacaacaatcaaatattatgctgaatacagtcaaatattatacaaattttaaaaatgctgaccttaccagcactagaatcctgct

SEQ ID NO: 24127 - DNA, 201 bp, Bos taurus
acacaaatgcagatttacagaatcggataactgaatcagattctcctagggttttatttatattttttaagtgtataaggaaaaatttgacatgcagacatgaggaacacaaactgtgtataaaagtgtaatgggaagacagttagcagccagtcccagataagaggatctcatgagcaagggggaagagaaaggaggaga

SEQ ID NO: 24128 - DNA, 201 bp, Bos taurus
agagctaatggtgggaaggatagtcacaagctaggttcactgataaaaatgaagatgatggtgccatgtagcaacagaggtcaggtgggaagtagcaaactagaagtccaggggaggccagagtgacagtccagagggctgggtctgcagagaactgtggagatgattaataatatatggcatccttaggatcaaaacaga

SEQ ID NO: 24129 - DNA, 201 bp, Bos taurus
caatcaccagctgtgcagtgtgagactattcactttacactatagtcctcattttccccatctgtaaaatggattcgtgtgattcccaacaagcccattcgtgtttgtcagtctttaagtctaagtttccatgattttacagaagggtaagctcttggtaattcctggtaaggggaaaaggcatcgtcactgctctcatgg

SEQ ID NO: 24130 - DNA, 201 bp, Bos taurus
atgtaaactcatgaagtccagcacatgcatattatacagataaagccaatataagaaaaactttcaaagtttttaagttataatggtgcatttcccttctgtggagaggctagaagtcccaaatgagactgaatattggcctatggatttcttattcccaccaaatgtgaccatcctaacattaatttgctggcaccaaag

SEQ ID NO: 24131 - DNA, 201 bp, Bos taurus
ccgcatttacctcttggccagttctaattatcagcatcgatgctttctatcggcaattatccaggctcagggagctgcctcagtaaataattggagtgcaaggggccccggaaggttattcacacaggcacactggctttgctccccagctctgacttgcagtcagcatggcctgagtgggagcaatatgggcctctgcaa

SEQ ID NO: 24132 - DNA, 201 bp, Bos taurus
tatgccaggcgtgcaggtgaggaaaactacttgggcaaattccccaggtagagagagatggagattatatctgggtctgtttagcatctaaacctaaaactttgattctcaatacacagcccagaaggtcacttccattggctttctacaatgtagcacttaatctcaaccaggtaacctgcctctgtttcacatatattg

SEQ ID NO: 24133 - DNA, 201 bp, Bos taurus
gttatggaaatggctcctactgggatgcatatttctgagtattaataaaaacatgaaggcccatagtgacttggatcttccctttatagcatctatttgcagatgggcttaaggagagggtctcaatgccagcatgtctcatccatagaaaccaatgaatattttattttgtccctcacgcaaactttatctggtgagcat

SEQ ID NO: 24134 - DNA, 201 bp, Bos taurus
agcccatgtctatatcactttatccaatataaccgagcagcagttaagagcagttaacggactcagagagaaatccaagacaggaagttgagcccgccaaaacgtccctttgagccttagtttctttgtacatagtacaggatggagaagacctacctcccatgggtgtcaggagggatcagtgcagtgaggctcatcacg

SEQ ID NO: 24135 - DNA, 201 bp, Bos taurus
cttcaccctgttaccagcctctttgcatcactcattatccttcagaccaaccctttcaacatccttttaggcagtccttgatggcttcagctactgatctcccacaaattcaatttgctttcccaagtaattatccagttttccataataatatgagtccatttcatatttttcataatttaattcaataatatttaccta

SEQ ID NO: 24136 - DNA, 201 bp, Bos taurus
gagaagtgcttctcagatttaagattcttcaaggaattttttcaaatgcagattctgcttcagtaggtctgggaccaagtctgagagtctacttttaacatggcctttcaatgatgaaagtgatgtgaaagtgaagtgctagatgctcagtcatgtccaactccttgccaccccatggactgtagcccaccaggctcccct

SEQ ID NO: 24137 - DNA, 201 bp, Bos taurus
tggaatcattagtgatgtggctggtgtttgggtgggatctgggaagagctggtaggttatcaaagtcagcggctgtggagtgtctaaatcatgtgtgtctccagtctacagggcagctgccattctcctggccattccaggcaaaggacagacagagctgactggtgacatcctggtgccttagacagagagcaggaccat

SEQ ID NO: 24138 - DNA, 201 bp, Bos taurus
tcacctggtctctgtcacaactatttaactctgccattgtagcataaaaatggccatagacaatgcataaatgaatggatttggctgtattccagcaaaacgaaatttacaaaaataagcagcgggggacttctgtggtcttccagaggctaagattccacattcccaatgcaggggacctggatttgattcgtggttggg

SEQ ID NO: 24139 - DNA, 201 bp, Bos taurus
caaaaaggaaaaaaactttcaagattgtggaggaagaaacaaaactttgtttgcaggtgacatcatttctctgtaaaagtttccaaagaaccaaccagattaagataaaaaaaaagcaaccatacaagcaaacagtaaaccagaactaagaagcacatgaaacacggtcttgggatacaaaggtcgtaagtcaactgctct

SEQ ID NO: 24140 - DNA, 201 bp, Bos taurus
accagcacagagtatatctgagttttaccacacaacctataagatccaataattatgttcttcctcagtaaagatcaaggaaggactagctttaattgattcaaactatatttgtgacatgacactgtttcatggggaacaattaatagtgaagctgtcatttcataaacaactaagactcaagaacatgtcactgtctcc

SEQ ID NO: 24141 - DNA, 201 bp, Bos taurus
acagagtggtgagtgaaggacagtgaggtggcaggaggacacaggctgggggcagtcccagcctgaccactagtgggcctctggcaagtcactagcttcgttgagccctcctctcttcatctgtaaaaacagcagagcccacgtttgtgtgacccagccccaactctgggggccagaagtcactaatctaacggtatcagc

SEQ ID NO: 24142 - DNA, 201 bp, Bos taurus
cacaactctgcatggggaagatgtttcccagaggcaaagccagcatctgcagcctgggtgggaaccctccaggtctctttgctttctcctgctctgaagagtattccacttcctcctcttctcagctgggaacttgccttgcctgacacctccagtctctttatgtttggggtgactgttttggaaatcaaaagttccata

SEQ ID NO: 24143 - DNA, 201 bp, Bos taurus
ctcaccttgaagccatgattagtgaaatcatttgccttttttagctaaaagcatcctaactagtatgattatttaataggttacctgttgctttggtcacacacgagactgtttaagtagaactcctacagagcctttgttaatgttgagaattgctggtaagtctgcactgttacctctgggaaaccccatgagaaaaac

SEQ ID NO: 24144 - DNA, 201 bp, Bos taurus
tggaggatggctttaggtataaatgttctcttcttgttaaaaaaaaaataataatacagttcagagcctggtgttgaaaatatctttgcccaaatatatttatgaattgtaagtcccctgaggcctgctgcagtgattaaatgagtccaggctccaaatggtccatgaggaagtctaccctgaggggccaggtacccagag

SEQ ID NO: 24145 - DNA, 201 bp, Bos taurus
atcatgattaaaagtgaccctcagtggtttcctaagcaatcgggattcagcagcctaaagacccggatcatggccccttgctcttcagtggcctccccatttgggcactcagaccctctctctctaaactctggacctgcgtgaccctgcacagttcccaggtagtaccaccccctctccagacagccttagggtggcccc

SEQ ID NO: 24146 - DNA, 201 bp, Bos taurus
gggggagcctggtgggctgccgtctatggggtcgcacagagtcggacacgactgaagcaacttagcagcagcagcagcagcagaatgcacatggatatatgcatgtcagtgttggaaggtacacgtgttctgacttttacaccttccctcctcaccagtgtttgtgagaggtgtccctatgggccgtcctgaatgcctccc

SEQ ID NO: 24147 - DNA, 201 bp, Bos taurus
gattatgcgacatgaagtggtttcaccgtcctttagacaagtgttattcggggaaatgaaaaccccaggagagaggttcctgtgttagccatcttgagaggaagtttctataatgatttcttaaaaaaggatggtagtgtttgagatttctgtaagtggagggtgaaaaatataatgaatttgctttactattcatgtgca

SEQ ID NO: 24148 - DNA, 201 bp, Bos taurus
gcagtcctgggaaggaaccacttcctgcctgcgtgcccttgagcaggtgcctcgtcatccctgtttgtaacttggtgtcgatgatgattcctacgagtgcaggtgcgttcatttcccgtggctgccgtaacagaccgccacacatgtagtggcttcaaacaacaggtttactatgtgacagctttggaggtcagaagtctt

SEQ ID NO: 24149 - DNA, 201 bp, Bos taurus
attcatatacgaagagtctgctttatttgtgagtgtccattccttctttattcatgatccagactttcctgtttagacgtaatcatctgacaggagattcggaagcgaatttatagatcgcagaacccaacaaacgcctctgttgcccagccactgctcctggcagacactgctaatccaattcatgtctcttaccagttg

SEQ ID NO: 24150 - DNA, 201 bp, Bos taurus
tgataggagccaggcagtccctgggtagttatgaccccttctgcctggagctgtcacttcttgttattctcataggaaattggtcactggaatctttctatgatggttcccttttctcatgaatgattgtccgctgccctcactatgggtggaaaggctttggagtagcaaaggaggacagtttgaatactgaggagttga

SEQ ID NO: 24151 - DNA, 201 bp, Bos taurus
ggatcacagggaaatatcagggaaaactaagacttttttatgtgagggggacctaatagcatgtgcactccatacactccataaaccatcttgaaaaagagcatgtctgctcagagacacacgctgggtccctgagagacacagttatctgggggagagatagtacaaagggcggtttgcttccctttctcccattcacat

SEQ ID NO: 24152 - DNA, 201 bp, Bos taurus
tgtaaatttccttgagattggaattaggatgtgtccaattccagagagttggctttagattaaacacccattagctttcatgcattgcaacacagggctatcggtaacttttgtaattacctccagcagtgcctgaccttctcagagagttgttttctttccctgtatcatgcccattattaaggtatgaagtttagtgac

SEQ ID NO: 24153 - DNA, 201 bp, Bos taurus
aaggccaataagaagcaaactcttccttagtttgggtaacacaagggcaaaagatgtcccaagatccagcaaaacacccttctaacattgcctttaatgagtgtttatagggcttccctggcggccctagatggtaaaggatctgcctgcaatgtaggggacccatgtttgatccctgggtggggaagatcctctgcagaa

SEQ ID NO: 24154 - DNA, 201 bp, Bos taurus
gtcttccgtcctgagcaaccgtgaacaagtctgctatcttctctgagcgtcaatgtactcatatgaagaaatcaccagcttactgtgaaaaccatatgccgtagaggacatgatcacctcctagtaggagctctcagccattcaataataagtgtccaagtactgatgggagcggcctcagatacattttgtatttctctc

SEQ ID NO: 24155 - DNA, 201 bp, Bos taurus
ggccattagcgggctgtgatcttgaacagaccctgtcccctcggggctccgtttatttcctgtgcatccttattggtactgatgcttgtctagctccttctggagcagctcacagcccgggtgggccagaagggacatgctttgggagtgagggatgccagcttctaatcttcctgctgctaccacatttaccaccttgga

SEQ ID NO: 24156 - DNA, 201 bp, Bos taurus
ttggtggatcacaccgccctctccatgggcatcactcttggccccacttcccagatgaggaaagtgaggctccaagaagtggtttggcattcacggattacaccagcaggaggcagaactggggcctggggcgcactgctggactttgaagttctgctcttcagtccttggagaagaggttgtacctccgcggaggtggac

SEQ ID NO: 24157 - DNA, 201 bp, Bos taurus
tcctagtccccactggatgctctgtatttggccttacagccagggacagggagagcagcgaggaccatgcaggaggtttgtacaactgagtgatgtaaccgagggcctcactcccatacacgtgccaccggcggcaaggacagtcacccgaccatggctcactgcaaggaaggcgggaggtgtggtccagctcggtgccca

SEQ ID NO: 24158 - DNA, 201 bp, Bos taurus
aatcccccctaatcctgggattcactgggatcttcccctatgtcctcattctgatactgacggcgccattcacccaattccccatgccttgcagggctgttaattccacttattataattcagcagccttaggattcggctttcagaaatttcaactttctttctacagaagacaaggatttctttgaagaccacagtaga

SEQ ID NO: 24159 - DNA, 201 bp, Bos taurus
aagtggtgcacacccccgtcagtctctgaaaggccttgctctgggagcattgatctgcccagtatctgaacctgaaatgcacagaggaaggatgcaagggttggattggccgactctggggccccttcaaactcctaacgccttgatcttaaactggagacgaagaatggagtagaatgcaagtttccaggtgggctggac

SEQ ID NO: 24160 - DNA, 201 bp, Bos taurus
tgcttggtccagcatttcagcttcccttctaccagtgctctccaccctcttcccttccattggattaatcccatgggcctgcttcctctgcaccttgtcttgacctgagcacagctacagaaatacccacagacagactggcgcctttacaggtgttgagtcttcagcctccactgcactctccatgcggcctcatgctgc

SEQ ID NO: 24161 - DNA, 201 bp, Bos taurus
gctttgaccaatttatgcccaagtgtgtgtctcataggatcaggcagaaaacagtcaatcagcattgcattaacgagttcctttactagaatagaactctcgagaccaagggccaagtgtgctttacaaacatatggtacacattgcagatgatctcattcggggagatcacatgacttcagagccctttacgacttctca

SEQ ID NO: 24162 - DNA, 201 bp, Bos taurus
cgtttcattctctcagcatacaaaaagtgatctagacagaaggaaatcttagttatttctgtatcccctgaaactttggaccgtgtacaagtttttccccaaaaatttcaagtgtcccattgttgtgttttttaatttttaaaactctgccgtgaacaagctagctgagaatcctgatcacctgtacacctactttatact

SEQ ID NO: 24163 - DNA, 201 bp, Bos taurus
gctccgcctcttaggccaaggcagggggtggtcttccacttccactcttccactcagacatgcaaaatgaaatccaccatgagaagtcttcccccaaaccttcatttggactccttgcgatgatcatactctttctggtaacataactctggcctcatttcttgtaaacagccctggtcttcttttgtttaaagattgttg

SEQ ID NO: 24164 - DNA, 201 bp, Bos taurus
atttctctgtgtgtgtgtcccattgtggtggttgagagaaccaaagccgtctaaatgaattcagggattgtctgagaatcagagaacaagggaagcaggcggtgaggtgaatacggccgaggatggaaaacacagcttcatcaagctggcaggagttgtggcccccttcaatcacaggaacgtgaccacgcgtgcaaatgt

SEQ ID NO: 24165 - DNA, 201 bp, Bos taurus
cccagggaaggggtggccagggcctcaaggggaggagggggtagcagagggagaagacagtatccatggcaaacctgaggctcctacaagacagctgtaccggcccagatcttagcggagtgagatggtggtgccaggggccaagttttaactgggcaagatggtggtgccaaggccaggtttttgcaggacaaggtggca

SEQ ID NO: 24166 - DNA, 201 bp, Bos taurus
ttaatcctgtttatatttgtgtgtctgaattttaattataggccatctccatgactttctggaagggtacaagtgtaaattttgagtctataagttaaatcttttagaaaatgaaatattattctggagctcagaattgttattagattttaataatttattttgtatgtgcgtttaccaaacatgtattcaaggcttgct

SEQ ID NO: 24167 - DNA, 201 bp, Bos taurus
ctcgggttgggcccccggggaggggcccggaggacagaggaccagtgtgagcaaaggctcagagagatacgatggacccaggaggcccgctgattggccatggacggtcggatagatgaactctgtccatgtgaacggcttcattctccgtgatgacttagcaggaacgtcaggcctcatctccagactgtgtttgcccat

SEQ ID NO: 24168 - DNA, 201 bp, Bos taurus
ccaggagatgagagaaaacttcccggtccactggagcaactgcaaaagtagacacatgttcgagacatcttcccgtctcgaatatgactgaggatcccataccttgaaagatgacatcattccttcttccaaaaccctgctgtcgtcaaaggcatagaaataccactgctgctgtgagcagttgagaaaaggaaagaagag

SEQ ID NO: 24169 - DNA, 201 bp, Bos taurus
ccgtccgagccaccaggaagtccaaaataaagatctccccaatttacttatacttcactgacaggctggtcttggaggtgaacctggatataatctctaccttttcagccttgtttcccaaataaaaactgtgactattcacagttcttaaaatcaatccccaaacttcttcatttccacgcatttgctcataccattcta

SEQ ID NO: 24170 - DNA, 201 bp, Bos taurus
ttacataactaagaatatgctgaaatgctcagaattcttctagtcagtgatagacaggcattaaaaaagaaaatacatccttttcaggggtgggaagaaacgggaaatacaaaccatttgttaaaataaaaaaaatgtaccgtaattttcattcagaattgttcggagttaaaggaacagggtagaaggaagtaacaaagg

SEQ ID NO: 24171 - DNA, 201 bp, Bos taurus
catgcagaagacgttaagagcctgagagcagaagttgcctttgggtgcattttctacctttggcaggagcatcttgaatcctttcctgggaaactgaatggaagagaaagggcatgtgactaaaaggaatgcagtggatactatcgcgaggactggtttaatactttgcacttgtcctgccctgtgcccagcacatcttgc

SEQ ID NO: 24172 - DNA, 201 bp, Bos taurus
ctcttacctttgcccccaaagagacctaactaatatattatgcatcctcttaaagggagaactcttgagtatttggttaaggagcttgagctttgagaaaatagtattcagcgattccttgttatacctcaagtgctcaagtgccaagttcattgcctgccactttgtaggccctaattaggtatttggtatttaaaagcc

SEQ ID NO: 24173 - DNA, 201 bp, Bos taurus
gggtataaggcagacctaggctgtagacactggctagagagtcatcagcatatttaagattttccagctaataagtgagagttgggattcacaccaaggcagtgtgactccaagccctgaacacaactcacatataatattgctgacttcttagataactccaaggtcagttccaaagttgaggttctgaagagagcattg

SEQ ID NO: 24174 - DNA, 201 bp, Bos taurus
gagttgagaagataatgatgtgccagcctctatttccgatggattttctgaggtttaacaagccctgcttttgtctttctgtgtctaacaaagtcatagcctactaaatgaggggctcttgtgttcaaattatgttgattttatagataaaatcatattgctctggtaccataacatgttatctagaattcctctccttat

SEQ ID NO: 24175 - DNA, 201 bp, Bos taurus
taattagtgcccagagacctacttaagcatgtagcaatctctccttctacattcaatgatttcagaataccactcttcttgtttaaagtagtactgtgcacttcttttattgcggggaatttccgcatttcctgattctagtgtccttctctggggcgacttgttcacttatttcatcgtctttaatctatcgtgacctat

SEQ ID NO: 24176 - DNA, 201 bp, Bos taurus
ctccttgtttttaaaagatattataatttgcagcatttttatgttcatagcaccattgagggaaaggaatggaaatttcccatataccctctgctcccacacccacatatacatagctttcctcattatcaacattcctcaccacagtggtgcatgttttaccactgataaacctacacggacacatcgcaattaacccaa

SEQ ID NO: 24177 - DNA, 201 bp, Bos taurus
ccatttttaaataaatgtaaaattttccaatagaggaaaaaagaacttgccctttcctttctgtatccgagcgtataatcaagtttcagcatatgtcctcgggcccacacaaaatttacaaggctttttgaaagtaagaaaatgtggttaaccaacggatccttttcatgattttaacaagaaacactttatgtgtttcag

SEQ ID NO: 24178 - DNA, 201 bp, Bos taurus
gtaatagacatttctgctccctctcctcaaatttctcatagaagagaggaagctgatgaaggtgaccatttcttttgtttgtggatccctaacctgagaagtttctggcatataattgaaaacaatataatgataggtttcatagattgtatttcaaatgagagaatagcaaaccattagcaaaattaaatattcaaaaga

SEQ ID NO: 24179 - DNA, 201 bp, Bos taurus
atatgcatacgtgtgaagttctcctgagtgttcaaggtgttttttcccacttgttctgcagtgggttttatgcttgttttccactttattcactttcaaacgtgatgaggtttatctgtaatgtgttcttgtgcagtgtgtctgtacactaagtgtttgccagcccgagtttgcaggcactgttcgctggggtgatgttta

SEQ ID NO: 24180 - DNA, 201 bp, Bos taurus
tgacaatgaggggctggtgctctgatggtgagatggcatccggaccccagcagcttcagtcgtgtccatgtttgggtgagatttataactcctgcacaaatggcaaaccaacactcaacatggccctgagcctttattcactgatcactccaaatatgttatagggattctccttccatcacacactagtgggaacagaga

SEQ ID NO: 24181 - DNA, 201 bp, Bos taurus
atggcccaggtgagtatggaaactgtgaaccctgtagggggtcaaggacagaaccgtaacaacaatcaccaacattgaagatagtagataagctccccccaaaaaaaaaatccttgaaggggccagacacaaggaaaatagatgtgatataactagcacagagaagtcgagagacctatgaacttgggtgtgatcatcaca

SEQ ID NO: 24182 - DNA, 201 bp, Bos taurus
gtgagcaaacaatcttctttttttgccagattaatataataggtgtatagggtctctcataggagttttagtttacatttttttccgcaatgagagtaagtccctttcttgtgattaaaggccaccgttacccatttctccgtgaacttagcacttcctgcacatgcttttcctttcggattgttagtcctttcctttttc

SEQ ID NO: 24183 - DNA, 201 bp, Bos taurus
ccattcggggcttggggtttgttcccgggaagccaggaaagtggcttgtgtttttctccttgtacgatttggagacctgctgcattttctgagagcgacgttaagtttcaaacaaacaaacaaaaaaactctctggcgtctggtattctgcggtttcatacatcccgagtgttcttcccgggcattcctaaagcggtttcc

SEQ ID NO: 24184 - DNA, 201 bp, Bos taurus
cgtaccctaaatataaggatgaactagcttcctagcttcttcccttcattcttacatctcctagtttaatcttgtgccaagagctgggtttgctcctcctcataccctgaggttacccctggccgccaccccctggtctcacatggcaaaaagaggagatgtaggaccagctcagctcagacctttgaccagttgatcaca

SEQ ID NO: 24185 - DNA, 201 bp, Bos taurus
atctgtccccctggaactctgcacttggcctgtgggaggggcttcagcgacagccacgcggagcctcagtttcctatcagtttcttcattctgtctctgctgcagtcaacttgatttaaacctagtcagctggaatgttgaagagaagtgtgtcttaactaaaataactcttggcggaactgtttgtcagaaaaaatttaa

SEQ ID NO: 24186 - DNA, 201 bp, Bos taurus
gggaaatcccatggacagaggagcctggtgggctacagtcatggggccgcaaagccagacatgactcaacaactaaaccatcaccacctttgccaggcacagccctaactgctttacttgcgataacatcattttgacagtggatagatacccttactttcctagtttttacagatgagagaatggagggaggaattcaga

SEQ ID NO: 24187 - DNA, 201 bp, Bos taurus
ggggcaagctgggcacaggtggggtgttgaggcctccctgagatctggcctggaagcccgctacgaaaggcacctgagtgctcaggcccatgaggaaacaacctccctctccctcttcctgccccttactcagcagctgcccctcctccaccagttcctccggcctccacatgccccagcgatcctcctccatcatcagct

SEQ ID NO: 24188 - DNA, 201 bp, Bos taurus
tgcctggactacctccccctgcaatgtctgtacggtccacttcccatcttataaccctttaagtctttgttcaaaagtcccttctcagtgaggccttccccgtcaaattgccaagaccaccgtcacccctcccgctgctcatggatgtctaccgttcctagccctctatctggccctgcagtggatgataattctgagcct

SEQ ID NO: 24189 - DNA, 201 bp, Bos taurus
tgtaatactttacgtgcctcagatccccaaagcctatgaggtgggtggtattattattattacaattattattgttattttagtcctgtgtgcacagtacaggcactagagccagagtacctgattgaaatgcctactctgctgtagtctaattccctggaggctcagatggtaaagagcctgtcttcaatgcaggagacc

SEQ ID NO: 24190 - DNA, 201 bp, Bos taurus
aaaagtgttactacacctttaaagatcagagccttaagaatgggttctcctgtatatttcaggctgcaggcaacattctataacaaaagatgcagagccagaatgactaagcacagacaacagacacagggtaagagctaaggaatagattcaatatggagtcaggcttgctcttctctgttacatacttggtcttttctt

SEQ ID NO: 24191 - DNA, 201 bp, Bos taurus
gattatgtttctgagtttgggaggaattctggattcccagtggactctgggaaggcttcatggtagaggtgatatatttgagttgggccttaaagactacgtagtctaagggcagtcagtgcttacttgaaggatacgaagagaagtaatggcatgtaaaagccaagaaagtttaaaaacctacatgtacagatggggagc

SEQ ID NO: 24192 - DNA, 201 bp, Bos taurus
acacttttacaactattggggtgagtcaaatgaaggaggctgcttgatgtagtagaagaagcaccagccaatgagcctagagccatcagactgaatttcaatcctaaaacttgtgtgatcatgagcaagtcactgctcatctctggtctttctccattacataaagggattgtgttatctagctcaccctctgctcctgtc

SEQ ID NO: 24193 - DNA, 201 bp, Bos taurus
gttcagatattcatggagttgtgcaactggcaacacaatcagcttcagaacatttttgtcctcaccgagaattccctatgctcattagcagtggctccccatcttatgcaacatttctgtaacaaacctctcttatccttctctaaaggggtccaggaatgtacacccttgtaagtcatctaatagttattgaaactgctg

SEQ ID NO: 24194 - DNA, 201 bp, Bos taurus
accttttgatttcagagggcctcaggtcaagctaagctccttggtttattaaaggctctccccatacctttgactgccttgctgcatttttccttatcccataaatgccacaagcaccttgccttctgggaagtggatctggagtccttctgtctccttgattggctgcctttgtcataaaccctcccttaactgcaagcc

SEQ ID NO: 24195 - DNA, 201 bp, Bos taurus
gagtgtcaggatcccactgggccaacaaagaggctgcgtctctggctggttcagacaccgaggttaatgaggtgctgtgttggctttgtagctgaagcagccccagacctctggccttctgctgtgctacgctgccttttttcactgcatttaccgtgtgggttttcagaagcccaggcaaagccaagaatttcctgaaaa

SEQ ID NO: 24196 - DNA, 201 bp, Bos taurus
acactactgtcctaagtatattgcaaacattttctcattttctatgctgttaatatttcctctacatacatttttaaagaagcactgaaattttaagaatataatgtcacacagctaataaaccgcagaacaatgtttgaaacaggcggtctaactgcagaattagattgatactttacatacaggacattcatgagattc

SEQ ID NO: 24197 - DNA, 201 bp, Bos taurus
gagaggagctgtgggagttgggaagacatgtaatatgtaagctttcatcttctccaggagtgaagattatgcaggcccacaattcataatgtaaaacacaactgcattcatactggaaaacaaatgttggttgatatagcaccgttttgtaattttacagacatgggtcaattgtcctaggccgttttcatcaataatatc

SEQ ID NO: 24198 - DNA, 201 bp, Bos taurus
atatagggcagagagttaaaagcttaggccagtgatgtcagcagagctatttcatggaagatttaaataataggttttggatctcaggctggaccttgagagcagtgtgtggccgtaggagagttttatgggtaggaggacaatggacaagttacttttccaaagggaccactctgattgcaataataagattgcattaga

SEQ ID NO: 24199 - DNA, 201 bp, Bos taurus
ctgaaaacaacttgcaagtgtatccataggaaaatgaattcctctggccctttatccttcaacctttgcataggacttaataggtcatggagcactttaatgtttataggctcatttttcattctcgtaataatcatgttaacagggcaaagagaattatccttcccgttttacaaacaagaacattcctcagcaagcatc

SEQ ID NO: 24200 - DNA, 201 bp, Bos taurus
gatccatgttgtggaactagcacagcactctcccctgtggtgggaggagagtggaaacatttcattggtagatgaaggacagagaaggacttgcccattgattactgcattgacaatccatagatcaagtctgcaggatataaaagtgccctggagtgagtgcatgggaagcctctgcctggctctaaagaagctggctgg

SEQ ID NO: 24201 - DNA, 201 bp, Bos taurus
taatgtgtgatgcaaataaagcaatgaatagtgagaaatttatagatttaaatgctactgttataaatgtaaatagtctaaacaatgaactaagattccaccctaagaagttaggggggaaaatgaacatagtaaattcaatggaagtaaaaggaaataaataatatagataggcgcataaatcattgaaatggaaaacaa

SEQ ID NO: 24202 - DNA, 201 bp, Bos taurus
gatgtagctcactctcagcaatacatgaatctgaaaacatccaccttataaattctgatcccacgtagacctctcgaagtcctcgcttgccattatgctaattctctttctgcacttgctcaccaaaacgtagtactttaaaaaattttgacaactcataattttgtagaaggaaggagggacatctttgctccatggctg

SEQ ID NO: 24203 - DNA, 201 bp, Bos taurus
tatgtactagttgtatcagagacaatggctgttaaaggaagctgggtatgcctattaatgttactaaggaaactactggaaacatcttttagttcatatcgaatacagaacaacttagtttaaaaactgtaattaaaatttaacatattgtctgggaaactaatcattgttcttaatcgttctctgaaaaaataaccagtg

SEQ ID NO: 24204 - DNA, 201 bp, Bos taurus
ttggaagctctgtactctcacacactgacagaaattcaggaagcactccattctttccagctcctgggaaaccctccatcccgcctcagactggaagccttctgatgcaaagaaacttggctgtccctgtctgtccattctcccagccctccttccccacgacccaggctcttgttatcacgttgtgttagttcatctatt

SEQ ID NO: 24205 - DNA, 201 bp, Bos taurus
gtgtggcatttgtctccatcacctgcaagttggccttgagagcaggcttgtgactggctgactcattctgcctggccccaaaacagctaggtgaagatggcttagagagcgagggaggggttcatataaatgcaaaaacatcttccaagcacctccaatggaagctctagggcccagtgggaatggcacaggccaggaacc

SEQ ID NO: 24206 - DNA, 201 bp, Bos taurus
tggcttgttgtctggggatgtgcaggtgagttatcagcaaacccctttgccccctccattactgggccctgatgcatctttcctctttgattttctctgcacctccttgcacttgctaagctgggtctctttgttctctctgaaagcccaactctcttccgcccccttgcctttgctcagaatgaactctgacaccaacac

SEQ ID NO: 24207 - DNA, 201 bp, Bos taurus
ggagagccatagtgaaatctgaaactgaagatcacactgaaaatcaagatcaagtactccttaagcaggggggcaatgaagttgaggattgaaggatcagaaggaagccttgtgagaccaccttgagtgtgcagtgaagtttgtttaagtcacagcatgtgcaaaggacctgaggcagcagaaacaacggtatgtttgaga

SEQ ID NO: 24208 - DNA, 201 bp, Bos taurus
atttcattggttggagatgtgtgctgcagaaaccacgggctggagggaggaagagcatggcgcaatccactgggagggagggcctctgagaaaggggcacatgggctgagccaggtgactggtgctgtgccaagtgccgagagaagaaggtcctgctgtggacggctcaggacacggtggtctcacacatggtggccgaag

SEQ ID NO: 24209 - DNA, 201 bp, Bos taurus
accattagggcattatcttgaggaccatactgggaggctgcccggggagccgaaggatattaactaaaatagaggagggtgcaagctggggtgtgcatctctgaaaggcctcctaaggcagctggcgtggattattctgaatcatgttgtaaaagaagaattaggtggcaaccaggtaagaggtgggggtggtggtgccag

SEQ ID NO: 24210 - DNA, 201 bp, Bos taurus
gaaatgaaatcacttgtgcacagcaaaaagcatccagcacagagctagacagacgctgggaacaaagcagactatggccttcacacctcatcacaacaacttgcatgcacagatctgcccacaaataccaatttgctgattctcaaccatctgaagagatttttttacaaaccctgaggcccagattcctccataggccaa
